United States Patent 7,745,391 (HUMAN THROMBOSPONDIN POLYPEPTIDE) - sequence listing, part 283

SEQ ID NO: 879024 - protein, 236 aa, Homo sapiens
LSLPSSWDYRYYAIYDSGDRQGLLDAYHDGACCSLSIPFIPQNPARSSLAEYFKDSRNVKKLKDPTLRFRLLKHTRLNVVAFLNELPKTQHDVNSFVVDISAQTSTLLCFSVNGVFKEVDGKSRDSLRAFTRTFIAVPASNSGLCIVNDELFVRNASSEEIQRAFAMPAPTPSSSPVPTLSPEQQEMLQAFSTQSGMNLEWSQKCLQDNNWDYTRSAQAFTHLKAKGEIPEVAFMK

SEQ ID NO: 879025 - protein, 893 aa, Homo sapiens
RRGPAGGGGGGAGAGWQVSLTGRWSPGREAGAGEVRQDPGSTAASPSSCDADLSARMARGERRRRAVPAEGVRTAERAARGGPGRRDGRGGGPRSTAGGVALAVVVLSLALGMSGRWVLAWYRARRAVTLHSAPPVLPADSSSPAVAPDLFWGTYRPHVYFGMKTRSPKPLLTGLMWAQQGTTPGTPKLRHTCEQGDGVGPYGWEFHDGLSFGRQHIQDGALRLTTEFVKRPGGQHGGDWSWRVTVEPQDSGTSALPLVSLFFYVVTDGKEVLLPEVGAKGQLKFISGHTSELGDFRFTLLPPTSPGDTAPKYGSYNVFWTSNPGLPLLTEMVKSRLNSWFQHRPPGAPPERYLGLPGSLKWEDRGPSGQGQGQFLIQQVTLKIPISIEFVFESGSAQAGGNQALPRLAGSLLTQALESHAEGFRERFEKTFQLKEKGLSSGEQVLGQAALSGLLGGIGYFYGQGLVLPDIGVEGSEQKVDPALFPPVPLFTAVPSRSFFPRGFLWDEGFHQLVVQRWDPSLTREALGHWLGLLNADGWIGREQILGDEARARVPPEFLVQRAVHANPPTLLLPVAHMLEVGDPDDLAFLRKALPRLHAWFSWLHQSQAGPLPLSYRWRGRDPALPTLLNPKTLPSGLDDYPRASHPSVTERHLDLRCWVALGARVLTRLAEHLGEAEVAAELGPLAASLEAAESLDELHWAPELGVFADFGNHTKAVQLKPRPPQGLVRVVGRPQPQLQYVDALGYVSLFPLLLRLLDPTSSRLGPLLDILADSRHLWSPFGLRSLAASSSFYGQRNSEHDPPYWRGAVWLNVNYLALGALHHYGHLEGPHQARAAKLHGELRANVVGNVWRQYQATGFLWEQYSDRDGRGMGCRPFHGWTSLVLLAMAEDY

SEQ ID NO: 879026 - protein, 71 aa, Homo sapiens
LLNPKTLPSGLESDCRADSGTSALPLVSLFFYVVTDGKEVLLPEVGAKGQLKFISGHTSELGDFRFTPLWL

SEQ ID NO: 879027 - protein, 731 aa, Homo sapiens
MKTRSPKPLLTGLMWAQQGTTPGTPKLRHTCEQGDGVGPYGWEFHDGLSFGRQHIQDGALRLTTEFVKRPGGQHGGDWSWRVTVEPQDSGTSALPLVSLFFYVVTDGKEVLLPEVGAKGQLKFISGHTSELGDFRFTLLPPTSPGDTAPKYGSYNVFWTSNPGLPLLTEMVKSRLNSWFQHRPPGAPPERYLGLPGSLKWEDRGPSGQGQGQFLIQQVTLKIPISIEFVFESGSAQAGGNQALPRLAGSLLTQALESHAEGFRERFEKTFQLKEKGLSSGEQVLGQAALSGLLGGIGYFYGQGLVLPDIGVEGSEQKVDPALFPPVPLFTAVPSRSFFPRGFLWDEGFHQLVVQRWDPSLTREALGHWLGLLNADGWIGREQILGDEARARVPPEFLVQRAVHANPPTLLLPVAHMLEVGDPDDLAFLRKALPRLHAWFSWLHQSQAGPLPLSYRWRGRDPALPTLLNPKTLPSGLDDYPRASHPSVTERHLDLRCWVALGARVLTRLAEHLGEAEVAAELGPLAASLEAAESLDELHWAPELGVFADFGNHTKAVQLKPRPPQGLVRVVGRPQPQLQYVDALGYVSLFPLLLRLLDPTSSRLGPLLDILADSRHLWSPFGLRSLAASSSFYGQRNSEHDPPYWRGAVWLNVNYLALGALHHYGHLEGPHQARAAKLHGELRANVVGNVWRQYQATGFLWEQYSDRDGRGMGCRPFHGWTSLVLLAMAEDY

SEQ ID NO: 879028 - protein, 562 aa, Homo sapiens
MVKSRLNSWFQHRPPGAPPERYLGLPGSLKWEDRGPSGQGQGQFLIQQVTLKIPISIEFVFESGSAQAGGNQALPRLAGSLLTQALESHAEGFRERFEKTFQLKEKGLSSGEQVLGQAALSGLLGGIGYFYGQGLVLPDIGVEGSEQKVDPALFPPVPLFTAVPSRSFFPRGFLWDEGFHQLVVQRWDPSLTREALGHWLGLLNADGWIGREQILGDEARARVPPEFLVQRAVHANPPTLLLPVAHMLEVGDPDDLAFLRKALPRLHAWFSWLHQSQAGPLPLSYRWRGRDPALPTLLNPKTLPSGLDDYPRASHPSVTERHLDLRCWVALGARVLTRLAEHLGEAEVAAELGPLAASLEAAESLDELHWAPELGVFADFGNHTKAVQLKPRPPQGLVRVVGRPQPQLQYVDALGYVSLFPLLLRLLDPTSSRLGPLLDILADSRHLWSPFGLRSLAASSSFYGQRNSEHDPPYWRGAVWLNVNYLALGALHHYGHLEGPHQARAAKLHGELRANVVGNVWRQYQATGFLWEQYSDRDGRGMGCRPFHGWTSLVLLAMAEDY

SEQ ID NO: 879029 - protein, 562 aa, Homo sapiens; identical to SEQ ID NO: 879028

SEQ ID NO: 879030 - protein, 678 aa, Homo sapiens
RRGPAGGGGGGAGAGWQVSLTGRWSPGREAGAGEDSGTSALPLVSLFFYVVTDGKEVLLPEVGAKGQLKFISGHTSELGDFRFTLLPPTSPGDTAPKYGSYNVFWTSNPGLPLLTEMVKSRLNSWFQHRPPGAPPERYLGLPGSLKWEDRGPSGQGQGQFLIQQVTLKIPISIEFVFESGSAQAGGNQALPRLAGSLLTQALESHAEGFRERFEKTFQLKEKGLSSGEQVLGQAALSGLLGGIGYFYGQGLVLPDIGVEGSEQKVDPALFPPVPLFTAVPSRSFFPRGFLWDEGFHQLVVQRWDPSLTREALGHWLGLLNADGWIGREQILGDEARARVPPEFLVQRAVHANPPTLLLPVAHMLEVGDPDDLAFLRKALPRLHAWFSWLHQSQAGPLPLSYRWRGRDPALPTLLNPKTLPSGLDDYPRASHPSVTERHLDLRCWVALGARVLTRLAEHLGEAEVAAELGPLAASLEAAESLDELHWAPELGVFADFGNHTKAVQLKPRPPQGLVRVVGRPQPQLQYVDALGYVSLFPLLLRLLDPTSSRLGPLLDILADSRHLWSPFGLRSLAASSSFYGQRNSEHDPPYWRGAVWLNVNYLALGALHHYGHLEGPHQARAAKLHGELRANVVGNVWRQYQATGFLWEQYSDRDGRGMGCRPFHGWTSLVLLAMAEDY

SEQ ID NO: 879031 - protein, 893 aa, Homo sapiens; identical to SEQ ID NO: 879025

SEQ ID NO: 879032 - protein, 480 aa, Homo sapiens
VLKQIGLQAKVRVGGLAWTARCTRNFWRHPGSGLIPQYLLRANVVGNVWRQYQATGFLWEQYSDRVGEALAAALSTAGPALPSRSFFPRGFLWDEGFHQLVVQRWDPSLTREALGHWLGLLNADGWIGREQILGDEARARVPPEFLVQRAVHANPPTLLLPVAHMLEVGDPDDLAFLRKALPRLHAWFSWLHQSQAGPLPLSYRWRGRDPALPTLLNPKTLPSGLDDYPRASHPSVTERHLDLRCWVALGARVLTRLAEHLGEAEVAAELGPLAASLEAAESLDELHWAPELGVFADFGNHTKAVQLKPRPPQGLVRVVGRPQPQLQYVDALGYVSLFPLLLRLLDPTSSRLGPLLDILADSRHLWSPFGLRSLAASSSFYGQRNSEHDPPYWRGAVWLNVNYLALGALHHYGHLEGPHQARAAKLHGELRANVVGNVWRQYQATGFLWEQYSDRDGRGMGCRPFHGWTSLVLLAMAEDY

SEQ ID NO: 879033 - protein, 588 aa, Homo sapiens
RRGPAGGGGGGAGAGWQVSLTGRWSPGREAGAGEVRQDPGSTAASPSSCDADLSARMARGERRRRAVPAEGVRTAERAARGGPGRRDGRGGGPRSTAGGVALAVVVLSLALGMSGRWVLAWYRARRAVTLHSAPPVLPADSSSPAVAPDLFWGTYRPHVYFGMKTRSPKPLLTGLMWAQQGTTPGTPKLRHTCEQGDGVGPYGWEFHDGLSFGRQHIQDGALRLTTEFVKRPGGQHGGDWSWRVTVEPQDSGTSALPLVSLFFYVVTDGKEVLLPEVGAKGQLKFISGHTSELGDFRFTLLPPTSPGDTAPKYGSYNVFWTSNPGLPLLTEMVKSRLNSWFQHRPPGAPPERYLGLPGSLKWEDRGPSGQGQGQFLIQQVTLKIPISIEFVFESGSAQAGGNQALPRLAGSLLTQALESHAEGFRERFEKTFQLKEKGLSSGEQVLGQAALSGLLGGIGYFYGQGLVLPDIGVEGSEQKVDPALFPPVPLFTAVPSRSFFPRGFLWDEGFHQLVVQRWDPSLTREALGHWLGLLNADGWIGREQILGDEARARVPPEFLVQRAVHANPPTLLLPVAHMLEVGDLGAVQ

SEQ ID NO: 879034 - protein, 625 aa, Homo sapiens
RRGPAGGGGGGAGAGWQVSLTGRWSPGREAGAGEVRQDPGSTAASPSSCDADLSARMARGERRRRAVPAEGVRTAERAARGGPGRRDGRGGGPRSTAGGVALAVVVLSLALGMSGRWVLAWYRARRAVTLHSAPPVLPADSSSPAVAPDLFWGTYRPHVYFGMKTRSPKPLLTGLMWAQQGTTPGTPKLRHTCEQGDGVGPYGWEFHDGLSFGRQHIQDGALRLTTEFVKRPGGQHGGDWSWRVTVEPQDSGTSALPLVSLFFYVVTDGKEVLLPEVGAKGQLKFISGHTSELGDFRFTLLPPTSPGDTAPKYGSYNVFWTSNPGLPLLTEMVKSRLNSWFQHRPPGAPPERYLGLPGSLKWEDRGPSGQGQGQFLIQQVTLKIPISIEFVFESGSAQAGGNQALPRLAGSLLTQALESHAEGFRERFEKTFQLKEKGLSSGEQVLGQAALSGLLGGIGYFYGQGLVLPDIGVEGSEQKVDPALFPPVPLFTAVPSRSFFPRGFLWDEGFHQLVVQRWDPSLTREALGHWLGLLNADGWIGREQILGDEARARVPPEFLVQRAVHANPPTLLLPVAHMLEVGDPTLALKGQRLLAFAPSPLDTSNSNLPHFISGVSLLSSHIALG

SEQ ID NO: 879035 - protein, 625 aa, Homo sapiens; identical to SEQ ID NO: 879034

SEQ ID NO: 879036 - protein, 329 aa, Homo sapiens
RRGPAGGGGGGAGAGWQVSLTGRWSPGREAGAGEVRQDPGSTAASPSSCDADLSARMARGERRRRAVPAEGVRTAERAARGGPGRRDGRGGGPRSTAGGVALAVVVLSLALGMSGRWVLAWYRARRAVTLHSAPPVLPADSSSPAVAPDLFWGTYRPHVYFGMKTRSPKPLLTGLMWAQQGTTPGTPKLRHTCEQGDGVGPYGWEFHDGLSFGRQHIQDGALRLTTEFVKRPGGQHGGDWSWRVTVEPQDSGTSALPLVSLFFYVVTDGKEVLLPEVGAKGQLKFISGHTSELGDFRFTLLPPTSPGDTAPKYGRPFPRLDQPCLTGHG

SEQ ID NO: 879037 - protein, 562 aa, Homo sapiens; identical to SEQ ID NO: 879028

SEQ ID NO: 879038 - protein, 723 aa, Homo sapiens
RRGPAGGGGGGAGAGWQVSLTGRWSPGREAGAGEVRQDPGSTAASPSSCDADLSARMARGERRRRAVPAEGVRTAERAARGGPGRRDGRGGGPRSTAGGVALAVVVLSLALGMSGRWVLAWYRARRAVTLHSAPPVLPADSSSPAVAPDLFWGTYRPHVYFGMKTRSPKPLLTGLMWAQQGTTPGTPKLRHTCEQGDGVGPYGWEFHDGLSFGRQHIQDGALRLTTEFVKRPGGQHGGDWSWRVTVEPQDSGTSALPLVSLFFYVVTDGKEVLLPEVGAKGQLKFISGHTSELGDFRFTLLPPTSPGDTAPKYGSYNVFWTSNPGLPLLTEMVKSRLNSWFQHRPPGAPPERYLGLPGSLKWEDRGPSGQGQGQFLIQQVTLKIPISIEFVFESGSAQAGGNQALPRLAGSLLTQALESHAEGFRERFEKTFQLKEKGLSSGEQVLGQAALSGLLGGIGYFYGQGLVLPDIGVEGSEQKVDPALFPPVPLFTAVPSRSFFPRGFLWDEGFHQLVVQRWDPSLTREALGHWLGLLNADGWIGREQILGDEARARVPPEFLVQRAVHANPPTLLLPVAHMLEVGDPDDLAFLRKALPRLHAWFSWLHQSQAGPLPLSYRWRGRDPALPTLLNPKTLPSGLDDYPRASHPSVTERHLDLRCWVALGARVLTRLAEHLGEAEVAAELGPLAASLEAAESLDELHWAPELGVFADFGNHVGPNLNCSM

SEQ ID NO: 879039 - protein, 893 aa, Homo sapiens; identical to SEQ ID NO: 879025

SEQ ID NO: 879040 - protein, 562 aa, Homo sapiens; identical to SEQ ID NO: 879028

SEQ ID NO: 879041 - protein, 562 aa, Homo sapiens; identical to SEQ ID NO: 879028

SEQ ID NO: 879042 - protein, 844 aa, Homo sapiens
RRGPAGGGGGGAGAGWQVSLTGRWSPGREAGAGEVRQDPGSTAASPSSCDADLSARMARGERRRRAVPAEGVRTAERAARGGPGRRDGRGGGPRSTAGGVALAVVVLSLALGMSGRWVLAWYRARRAVTLHSAPPVLPADSSSPAVAPDLFWGTYRPHVYFGMKTRSPKPLLTGLMWAQQGTTPGTPKLRHTCEQGDGVGPYGWEFHDGLSFGRQHIQDGALRLTTEFVKRPGGQHGGDWSWRVTVEPQDSGTSALPLVSLFFYVVTDGKEVLLPEVGAKGQLKFISGHTSELGDFRFTLLPPTSPGDTAPKYGSYNVFWTSNPGLPLLTEMVKSRLNSWFQHRPPGAPPERYLGLPGSLKWEDRGPSGQGQGQFLIQQVTLKIPISIEFVFESGSAQAGGNQALPRLAGSLLTQALESHAEGFRERFEKTFQLKEKGLSSGEQVLGQAALSGLLGGIGYFYGQGLVLPDIGVEGSEQKVDPALFPPVPLFTAVPSRSFFPRGFLWDEGFHQLVVQRWDPSLTREALGHWLGLLNADGWIGREQILGDEARARVPPEFLVQRAVHANPPTLLLPVAHMLEVGDPDDLAFLRKALPRLHAWFSWLHQSQAGPLPLSYRWRGRDPALPTLLNPKTLPSGLDDYPRASHPSVTERHLDLRCWVALGARVLTRLAEHLGEAEVAAELGPLAASLEAAESLDELHWAPELGVFADFGNHTKAVQLKPRPPQGLVRVVGRPQPQLQYVDALGYVSLFPLLLRLLDPTSSRLGPLLDILADSRHLWSPFGLRSLAASSSFYGQRNSEHDPPYWRGAVWLNVNYLALGALHPRLFIWRETSTGFLLEKSPKG

SEQ ID NO: 879043 - protein, 570 aa, Homo sapiens
RRGPAGGGGGGAGAGWQVSLTGRWSPGREAGAGEVRQDPGSTAASPSSCDADLSARMARGERRRRAVPAEGVRTAERAARGGPGRRDGRGGGPRSTAGGVALAVVVLSLALGMSGRWVLAWYRARRAVTLHSAPPVLPADSSSPAVAPDLFWGTYRPHVYFGMKTRSPKPLLTGLMWAQQGTTPGTPKLRHTCEQGDGVGPYGWEFHDGLSFGRQHIQDGALRLTTEFVKRPGGQHGGDWSWRVTVEPQDSGTSALPLVSLFFYVVTDGKEVLLPEVGAKGQLKFISGHTSELGDFRFTLLPPTSPGDTAPKYGSYNVFWTSNPGLPLLTEMVKSRLNSWFQHRPPGAPPERYLGLPGSLKWEDRGPSGQGQGQFLIQQVTLKIPISIEFVFESGSAQAGGNQALPRLAGSLLTQALESHAEGFRERFEKTFQLKEKGLSSGEQVLGQAALSGLLGGIGYFYGQGLVLPDIGVEGSEQKVDPALFPPVPLFTAVPSRSFFPRGFLWDEGFHQLVVQRWDPSLTREALGHWLGLLNADGWIGREQILGDEARARVPPEFLVQRAVHVGAVQ

SEQ ID NO: 879044 - protein, 437 aa, Homo sapiens
RRGPAGGGGGGAGAGWQVSLTGRWSPGREAGAGEVRQDPGSTAASPSSCDADLSARMARGERRRRAVPAEGVRTAERAARGGPGRRDGRGGGPRSTAGGVALAVVVLSLALGMSGRWVLAWYRARRAVTLHSAPPVLPADSSSPAVAPDLFWGTYRPHVYFGMKTRSPKPLLTGLMWAQQGTTPGTPKLRHTCEQGDGVGPYGWEFHDGLSFGRQHIQDGALRLTTEFVKRPGGQHGGDWSWRVTVEPQDSGTSALPLVSLFFYVVTDGKEVLLPEVGAKGQLKFISGHTSELGDFRFTLLPPTSPGDTAPKYGSYNVFWTSNPGLPLLTEMVKSRLNSWFQHRPPGAPPERYLGLPGSLKWEDRGPSGQGQGQFLIQQVTLKIPISIEFVFESGSAQAGGNQALPRLAGSLLTQAWEHVEFKRVEKLHEESWIGEL

SEQ ID NO: 879045 - protein, 347 aa, Homo sapiens
RRGPAGGGGGGAGAGWQVSLTGRWSPGREAGAGEVRQDPGSTAASPSSCDADLSARMARGERRRRAVPAEGVRTAERAARGGPGRRDGRGGGPRSTAGGVALAVVVLSLALGMSGRWVLAWYRARRAVTLHSAPPVLPADSSSPAVAPDLFWGTYRPHVYFGMKTRSPKPLLTGLMWAQQGTTPGTPKLRHTCEQGDGVGPYGWEFHDGLSFGRQHIQDGALRLTTEFVKRPGGQHGGDWSWRVTVEPQDSGTSALPLVSLFFYVVTDGKEVLLPEVGAKGQLKFISGHTSELGDFRFTLLPPTSPGDTAPKYGRGNWGKRMLGDGSHSGSEGTKASGFCPQPLGYQ

SEQ ID NO: 879046 - protein, 264 aa, Homo sapiens
MKFFLLLFTIGFCWAQYSPNTQQGRTSIVHLFEWRWVDIALECERYLAPKGFGGVQVSPPNENVAIYNPFRPWWERYQPVSYKLCTRSGNEDEFRNMVTRCNNVGVRIYVDAVINHMCGNAVSAGTSSTCGSYFNPGSRDFPAVPYSGWDFNDGKCKTGSGDIENYNDATQVRDCRLTGLLDLALEKDYVRSKIAEYMNHLIDIGVAGFRLDASKHMWPGDIKAILDKLHNLNSNWFPAGSKPFIYQEVIDLVGEPNLKASDYF

SEQ ID NO: 879047 - protein, 88 aa, Homo sapiens
MTQNLLGPQQPMLERPMQNNTGPQPPKPGPVLQSGQGLPGVGIMPTVGQLRAQLQGVLAKNPQLRHLSPQQQQQLQALLMQRQLQQSQ

SEQ ID NO: 879048 - protein, 137 aa, Homo sapiens
ALSVGQGAGVGPEVEALPQLLEGACLRSREAPKLRLAQPSVSLGDQPGSMTQNLLGPQQPMLERPMQNNTGPQPPKPGPVLQSGQGLPGVGIMPTVGQLRAQLQGVLAKNPQLRHLSPQQQQQLQALLMQRQLQQSQ

SEQ ID NO: 879049 - protein, 235 aa, Homo sapiens
MPAKPLQHFSSPGALGPTLLLTGKEQNTVDPAVSSEATEGPSTHQGGPLAIGTTPESMATEPGEVKPSLSGDSQLLLVQPQPQPQPSSLQLQPPLRLPGQQQQQVSLLHTAGGGSHGQLGSGSSSEASSVPHLLAQPSVSLGDQPGSMTQNLLGPQQPMLERPMQNNTGPQPPKPGPVLQSGQGLPGVGIMPTVGQLRAQLQGVLAKNPQLRHLSPQQQQQLQALLMQRQLQQSQ

SEQ ID NO: 879050 - protein, 136 aa, Homo sapiens
MPAKPLQHFSSPGALGPTLLLTGKEQNTVDPAVSSEATEGPSTHQGGPLAIGTTPESMATEPGEVKPSLSGDSQLLLVQPQPQPQPSSLQLQPPLRLPGQQQQRSIFPEAKRESGGPASSGESLFPDFKRSARGTL

SEQ ID NO: 879051 - protein, 546 aa, Homo sapiens
GSLAGPSGGFFPGNLALRSLGPDSRLLQERQLQLQQQRMQLAQKLQQQQQQQQQQQHLLGQVAIQQQQQQGPGVQTNQALGPKPQGLMPPSSHQGLLVQQLSPQPPQGPQGMLGPAQVAVLQQQHPGALGPQGPHRQVLMTQSRVLSSPQLAQQGQGLMGHRLVTAQQQQQQQQHQQQGSMAGLSHLQQSLMSHSGQPKLSAQPMGSLQQLQQQQQLQQQQQLQQQQQQQLQQQQQLQQQQLQQQQQQQQLQQQQQQQLQQQQQQLQQQQQQQQQQFQQQQQQQQMGLLNQSRTLLSPQQQQQQQVALGPGMPAKPLQHFSSPGALGPTLLLTGKEQNTVDPAVSSEATEGPSTHQGGPLAIGTTPESMATEPGEVKPSLSGDSQLLLVQPQPQPQPSSLQLQPPLRLPGQQQQQVSLLHTAGGGSHGQLGSGSSSEASSVPHLLAQPSVSLGDQPGSMTQNLLGPQQPMLERPMQNNTGPQPPKPGPVLQSGQGLPGVGIMPTVGQLRAQLQGVLAKNPQLRHLSPQQQQQLQALLMQRQLQQSQ

SEQ ID NO: 879052 - protein, 351 aa, Homo sapiens
MNAILQSLSNIEQFCCYFKELPAVELRNGKTAGRRTYHTRSQGDNNVSLVEEFRKTLCALWQGSQTAFSPESLFYVVWKIMPNFRGYQQQDAHEFMRYLLDHLHLELQGGFNGVSRSAILQENSTLSASNKCCINGASTVVTAIFGGILQNEVNCLICGTESRKFDPFLDLSLDIPSQFRSKRSKNQENGPVCSLRDCLRSFTDLEELDETELYMCHKCKKKQKSTKKFWIQKLPKVLCLHLKRFHWTAYLRNKVDTYVEFPLRGLDMKWYLLEPENSGPESCLYDLAAVVVHHGSGVGSGHYTAYATHEGRWFHFNDSTVTLTDEETVVKAKAYILFYVEHQAKAGSDKL

SEQ ID NO: 879053 - protein, 244 aa, Homo sapiens
AGRRRARKPGVRKPVLSLTQGLETQPPSAERPARSDTRRSLRSSSAPTSPGPGAAVLPAALLVAMECPHLSSSVCIAPDSAKFPNGSPSSWCCSVCRSNKSPWVCLTCSSVHCGRYVNGHAKKHYEDAQVPLTNHKKSEKQDKVQHTVCMDCSSYSTYCYRCDDFVVNDTKLGLVQKVREHLQNLENSAFTADRHKKRKLLENSTLNSKLLKVNGSTTAICATGLRNLGNTCFMNAILQSLSNH

SEQ ID NO: 879054 - protein, 498 aa, Homo sapiens
MQSPPHLAVCRSNKSPWVCLTCSSVHCGRYVNGHAKKHYEDAQVPLTNHKKSEKQDKVQHTVCMDCSSYSTYCYRCDDFVVNDTKLGLVQKVREHLQNLENSAFTADRHKKRKLLENSTLNSKLLKVNGSTTAICATGLRNLGNTCFMNAILQSLSNIEQFCCYFKELPAVELRNGKTAGRRTYHTRSQGDNNVSLVEEFRKTLCALWQGSQTAFSPESLFYVVWKIMPNFRGYQQQDAHEFMRYLLDHLHLELQGGFNGVSRSAILQENSTLSASNKCCINGASTVVTAIFGGILQNEVNCLICGTESRKFDPFLDLSLDIPSQFRSKRSKNQENGPVCSLRDCLRSFTDLEELDETELYMCHKCKKKQKSTKKFWIQKLPKVLCLHLKRFHWTAYLRNKVDTYVEFPLRGLDMKCYLLEPENSGPESCLYDLAAVVVHHGSGVGSGHYTAYATHEGRWFHFNDSTVTLTDEETVVKAKAYILFYVEHQAKAGSDKL

SEQ ID NO: 879055 - protein, 500 aa, Homo sapiens
MLFGRLCQTLVCRSNKSPWVCLTCSSVHCGRYVNGHAKKHYEDAQVPLTNHKKSEKQDKVQHTVCMDCSSYSTYCYRCDDFVVNDTKLGLVQKVREHLQNLENSAFTADRHKKRKLLENSTLNSKLLKVNGSTTAICATGLRNLGNTCFMNAILQSLSNIEQFCCYFKELPAVELRNGKTAGRRTYHTRSQGDNNVSLVEEFRKTLCALWQGSQTAFSPESLFYVVWKIMPNFRGYQQQDAHEFMRYLLDHLHLELQGGFNGVSRSAILQENSTLSASNKCCINGASTVVTAIFGGILQNEVNCLICGTESRKFDPFLDLSLDIPSQFRSKRSKNQENGPVCSLRDCLRSFTDLEELDETELYMCHKCKKKQKSTKKFWIQKLPKVLCLHLKRFHWTAYLRNKVDTYVEFPLRGLDMKWYLLEPENSGPESCLYDLAAVVVHHGSGVGSGHYTAYATHEGRWFHFNDSTVTLTDEETVVKAKAYILFYVEHQAKAGSDKL

SEQ ID NO: 879056 - protein, 405 aa, Homo sapiens
TICLCFNSSAFTADRHKKRKLLENSTLNSKLLKVNGSTTAICATGLRNLGNTCFMNAILQSLSNIEQFCCYFKELPAVELRNGKTAGRRTYHTRSQGDNNVSLVEEFRKTLCALWQGSQTAFSPESLFYVVWKIMPNFRGYQQQDAHEFMRYLLDHLHLELQGGFNGVSRSAILQENSTLSASNKCCINGASTVVTAIFGGILQNEVNCLICGTESRKFDPFLDLSLDIPSQFRSKRSKNQENGPVCSLRDCLRSFTDLEELDETELYMCHKCKKKQKSTKKFWIQKLPKVLCLHLKRFHWTAYLRNKVDTYVEFPLRGLDMKWYLLEPENSGPESCLYDLAAVVVHHGSGVGSGHYTAYATHEGRWFHFNDSTVTLTDEETVVKAKAYILFYVEHQAKAGSDKL

SEQ ID NO: 879057 - protein, 217 aa, Homo sapiens
AGRRRARKPGVRKPVLSLTQGLETQPPSAERPARSDTRRSLRSSSAPTSPGPGAAVLPAALLVAMECPHLSSSVCIAPDSAKFPNGSPSSWCCSVCRSNKSPWVCLTCSSVHCGRYVNGHAKKHYEDAQVPLTNHKKSEKQDKVQHTVCMDCSSYSTYCYRCDDFVVNDTKLGLVQKVREHLQNLENSAFTADRHKKRKLLENSTLNSKLLKVNVSN

SEQ ID NO: 879058 - protein, 584 aa, Homo sapiens
AGRRRARKPGVRKPVLSLTQGLETQPPSAERPARSDTRRSLRSSSAPTSPGPGAAVLPAALLVAMECPHLSSSVCIAPDSAKFPNGSPSSWCCSVCRSNKSPWVCLTCSSVHCGRYVNGHAKKHYEDAQVPLTNHKKSEKQDKVQHTVCMDCSSYSTYCYRCDDFVVNDTKLGLVQKVREHLQNLENSAFTADRHKKRKLLENSTLNSKLLKVNGSTTAICATGLRNLGNTCFMNAILQSLSNIEQFCCYFKELPAVELRNGKTAGRRTYHTRSQGDNNVSLVEEFRKTLCALWQGSQTAFSPESLFYVVWKIMPNFRGYQQQDAHEFMRYLLDHLHLELQGGFNGVSRSAILQENSTLSASNKCCINGASTVVTAIFGGILQNEVNCLICGTESRKFDPFLDLSLDIPSQFRSKRSKNQENGPVCSLRDCLRSFTDLEELDETELYMCHKCKKKQKSTKKFWIQKLPKVLCLHLKRFHWTAYLRNKVDTYVEFPLRGLDMKWYLLEPENSGPESCLYDLAAVVVHHGSGVGSGHYTAYATHEGRWFHFNDSTVTLTDEETVVKAKAYILFYVEHQAKAGSDKL

SEQ ID NO: 879059 - protein, 242 aa, Homo sapiens
AGRRRARKPGVRKPVLSLTQGLETQPPSAERPARSDTRRSLRSSSAPTSPGPGAAVLPAALLVAMECPHLSSSVCIAPDSAKFPNGSPSSWCCSVCRSNKSPWVCLTCSSVHCGSYRCDDFVVNDTKLGLVQKVREHLQNLENSAFTADRHKKRKLLENSTLNSKLLKVNGSTTAICATGLRNLGNTCFMNAILQSLSNIEQFCCYFKELPAVELRNGKTAGRRTYHTRSQGDNNVSVEEFT

SEQ ID NO: 879060 - protein, 435 aa, Homo sapiens
MDCSSYSTYCYRCDDFVVNDTKLGLVQKVREHLQNLENSAFTADRHKKRKLLENSTLNSKLLKVNGSTTAICATGLRNLGNTCFMNAILQSLSNIEQFCCYFKELPAVELRNGKTAGRRTYHTRSQGDNNVSLVEEFRKTLCALWQGSQTAFSPESLFYVVWKIMPNFRGYQQQDAHEFMRYLLDHLHLELQGGFNGVSRSAILQENSTLSASNKCCINGASTVVTAIFGGILQNEVNCLICGTESRKFDPFLDLSLDIPSQFRSKRSKNQENGPVCSLRDCLRSFTDLEELDETELYMCHKCKKKQKSTKKFWIQKLPKVLCLHLKRFHWTAYLRNKVDTYVEFPLRGLDMKCYLLEPENSGPESCLYDLAAVVVHHGSGVGSGHYTAYATHEGRWFHFNDSTVTLTDEETVVKAKAYILFYVEHQAKAGSDKL

SEQ ID NO: 879061 - protein, 351 aa, Homo sapiens; identical to SEQ ID NO: 879052

SEQ ID NO: 879062 - protein, 271 aa, Homo sapiens
MPNFRGYQQQDAHEFMRYLLDHLHLELQGGFNGVSRSAILQENSTLSASNKCCINGASTVVTAIFGGILQNEVNCLICGTESRKFDPFLDLSLDIPSQFRSKRSKNQENGPVCSLRDCLRSFTDLEELDETELYMCHKCKKKQKSTKKFWIQKLPKVLCLHLKRFHWTAYLRNKVDTYVEFPLRGLDMKCYLLEPENSGPESCLYDLAAVVVHHGSGVGSGHYTAYATHEGRWFHFNDSTVTLTDEETVVKAKAYILFYVEHQAKAGSDKL

SEQ ID NO: 879063 - protein, 293 aa, Homo sapiens
FQGDLPCECLQVEAKLVLRATGALMKLGKAPWQGRSPSSVMGRLSSPAAGIQEGKLFPRRLQNQHKCPVICSVAVIPIQPLIQQPASSGECGSCSCMGWRLLVSLTDIQQPVTQVTKRVGWGGMPGQSLVFALCAMHSQNIVLVLEILNNSSQKTLHSVTILFLVLSLITSLLSSGFTFYNSISNPYQTFLGPTGVYTWNGLGASFVFVTMILFVANTQSNQLSEELFQMLYPATTSKGTTHSYGYSFWLILLVILLNIVTVTIIIFYQKARYQRKQEQRKPMEYAPRDGILF

SEQ ID NO: 879064 - protein, 226 aa, Homo sapiens
MPTTKKTLMFLSSFFTSLGSFIVICSILGTQAWITSTIAVRDSASNGSIFITYGLFRGESSEELSHGLAEPKKKFAVLEILNNSSQKTLHSVTILFLVLSLITSLLSSGFTFYNSISNPYQTFLGPTGVYTWNGLGASFVFVTMILFVANTQSNQLSEELFQMLYPATTSKGTTHSYGYSFWLILLVILLNIVTVTIIIFYQKARYQRKQEQRKPMEYAPRDGILF

SEQ ID NO: 879065 - protein, 439 aa, Homo sapiens
MRRAALRLCALGKGQLTPGRGLTQGPQNPKKQGIFHIHEVRDKLREIVGASTNWRDHVKAMEERKLLHSFLAKSQDGLPPRRMKDSYIEVLLPLGSEPELREKYLTVQNTVRFGRILEDLDSLGVLICYMHNKIHSAKMSPLSIVTALVDKIDMCKKSLSPEQDIKFSGHVSWVGKTSMEVKMQMFQLHGDEFCPVLDATFVMVARDSENKGPAFVNPLIPESPEEEELFRQGELNKGRRIAFSSTSLLKMAPSAEERTTIHEMFLSTLDPKTISFRSRVLPSNAVWMENSKLKSLEICHPQERNIFNRIFGGFLMRKAYELAWATACSFGGSRPFVVAVDDIMFQKPVEVGSLLFLSSQVCFTQNNYIQVRVHSEVASLQEKQHTTTNVFHFTFMSEKEVPLVFPKTYGESMLYLDGQRHFNSMSGPATLRKDYLVEP

SEQ ID NO: 879066 - protein, 379 aa, Homo sapiens
MEERKLLHSFLAKSQDGLPPRRMKDSYIEVLLPLGSEPELREKYLTVQNTVRFGRILEDLDSLGVLICYMHNKIHSAKMSPLSIVTALVDKIDMCKKSLSPEQDIKFSGHVSWVGKTSMEVKMQMFQLHGDEFCPVLDATFVMVARDSENKGPAFVNPLIPESPEEEELFRQGELNKGRRIAFSSTSLLKMAPSAEERTTIHEMFLSTLDPKTISFRSRVLPSNAVWMENSKLKSLEICHPQERNIFNRIFGGFLMRKAYELAWATACSFGGSRPFVVAVDDIMFQKPVEVGSLLFLSSQVCFTQNNYIQVRVHSEVASLQEKQHTTTNVFHFTFMSEKEVPLVFPKTYGESMLYLDGQRHFNSMSGPATLRKDYLVEP

SEQ ID NO: 879067 - protein, 448 aa, Homo sapiens
MRRAALRLCALGKGQLTPGRGLTQGPQNPKKQGIFHIHEACSSIHVNHVRDKLREIVGASTNWRDHVKAMEERKLLHSFLAKSQDGLPPRRMKDSYIEVLLPLGSEPELREKYLTVQNTVRFGRILEDLDSLGVLICYMHNKIHSAKMSPLSIVTALVDKIDMCKKSLSPEQDIKFSGHVSWVGKTSMEVKMQMFQLHGDEFCPVLDATFVMVARDSENKGPAFVNPLIPESPEEEELFRQGELNKGRRIAFSSTSLLKMAPSAEERTTIHEMFLSTLDPKTISFRSRVLPSNAVWMENSKLKSLEICHPQERNIFNRIFGGFLMRKAYELAWATACSFGGSRPFVVAVDDIMFQKPVEVGSLLFLSSQVCFTQNNYIQVRVHSEVASLQEKQHTTTNVFHFTFMSEKEVPLVFPKTYGESMLYLDGQRHFNSMSGPATLRKDYLVEP

SEQ ID NO: 879068 - protein, 448 aa, Homo sapiens; identical to SEQ ID NO: 879067

SEQ ID NO: 879069 - protein, 448 aa, Homo sapiens; identical to SEQ ID NO: 879067

SEQ ID NO: 879070 - protein, 249 aa, Homo sapiens [sequence omitted]

SEQ ID NO: 879071 - protein, 205 aa, Homo sapiens
MRRAALRLCALGKGQLTPGRGLTQGPQNPKKQGIFHIHEACSSIHVNHVRDKLREIVGASTNWRDHVKAMEERKLLHSFLAKSQDGLPPRRMKDSYIEVLLPLGSEPELREKYLTVQNTVRFGRILEDLDSLGVLICYMHNKIHSAKMSPLSIVTALVDKIDMCKKSLSPEQDIKFSGHVSWVGKTSMEVKMQMFQAGICKSTHP

SEQ ID NO: 879072 - protein, 504 aa, Homo sapiens
MKSTRNGKCVVLLYLHVSVISRTRQQKWSTPVADSKDPVAPASAHLSGFEFHAYYHPVITYCFHGMTGLRDGLCALGKGQLTPGRGLTQGPQNPKKQGIFHIHEVRDKLREIVGASTNWRDHVKAMEERKLLHSFLAKSQDGLPPRRMKDSYIEVLLPLGSEPELREKYLTVQNTVRFGRILEDLDSLGVLICYMHNKIHSAKMSPLSIVTALVDKIDMCKKSLSPEQDIKFSGHVSWVGKTSMEVKMQMFQLHGDEFCPVLDATFVMVARDSENKGPAFVNPLIPESPEEEELFRQGELNKGRRIAFSSTSLLKMAPSAEERTTIHEMFLSTLDPKTISFRSRVLPSNAVWMENSKLKSLEICHPQERNIFNRIFGGFLMRKAYELAWATACSFGGSRPFVVAVDDIMFQKPVEVGSLLFLSSQVCFTQNNYIQVRVHSEVASLQEKQHTTTNVFHFTFMSEKEVPLVFPKTYGESMLYLDGQRHFNSMSGPATLRKDYLVEP

SEQ ID NO: 879073 - protein, 448 aa, Homo sapiens; identical to SEQ ID NO: 879067

SEQ ID NO: 879074 - protein, 448 aa, Homo sapiens; identical to SEQ ID NO: 879067

SEQ ID NO: 879075 - protein, 186 aa, Homo sapiens
TNKELQALALSFQGTLDPKTISFRSRVLPSNAVWMENSKLKSLEICHPQERNIFNRIFGGFLMRKAYELAWATACSFGGSRPFVVAVDDIMFQKPVEVGSLLFLSSQVCFTQNNYIQVRVHSEVASLQEKQHTTTNVFHFTFMSEKEVPLVFPKTYGESMLYLDGQRHFNSMSGPATLRKDYLVEP

SEQ ID NO: 879076 - protein, 171 aa, Homo sapiens
MAPSAEERTTIHEMFLSTLDPKTISFRSRVLPSNAVWMENSIFGGFLMRKAYELAWATACSFGGSRPFVVAVDDIMFQKPVEVGSLLFLSSQVCFTQNNYIQVRVHSEVASLQEKQHTTTNVFHFTFMSEKEVPLVFPKTYGESMLYLDGQRHFNSMSGPATLRKDYLVEP

SEQ ID NO: 879077 - protein, 127 aa, Homo sapiens
MRRAALRLCALGKGQLTPGRGLTQGPQNPKKQGIFHIHEDMCKKSLSPEQDIKFSGHVSWVGKTSMEVKMQMFQLHGDEFCPVLDATFVMVARDSENKGPAFVNPLIPESPEEEELFRQGECTLICL

SEQ ID NO: 879078 - protein, 115 aa, Homo sapiens
MCDAHLRGPSGIITSPNFPIQYDNNAHCVWIITALNPSKVGGDPGNIQCNKEGLSVETQSLRLRNRSCLLGNSKDNGCCVPNPVHGTGLQVRYRCIQGLPIHSPSDISFSKKHSL

SEQ ID NO: 879079 - protein, 190 aa, Homo sapiens
LVVTQVGVSQGHNMCPDPGIPERGKRLGSDFRLGSSVQFTCNEGYDLQGSKRITCMKVSDMFAAWSDHRPVCRARMCDAHLRGPSGIITSPNFPIQYDNNAHCVWIITALNPSKVGGDPGNIQCNKEGLSVETQSLRLRNRSCLLGNSKDNGCCVPNPVHGTGLQVRYRCIQGLPIHSPSDISFSKKHSL

SEQ ID NO: 879080 - protein, 79 aa, Homo sapiens
LVVTQVGVSQGHNMCPDPGIPERGKRLGSDFRLGSSVQFTCNEGYDLQGSKRITCMKVSDMFAAWSDHRPVCRDLNNCF

SEQ ID NO: 879081 - protein, 115 aa, Homo sapiens
GVTARIWDACSVSLFVCLFLRQSLTLLPRLECSGAISAYCSLRFRGSSDSPASACQVAGTTGAHHHAWLIFEFLVESGFHYVGQAGLERLTSSDPSASAFQSSGITGVSHRARPE

SEQ ID NO: 879082 - protein, 142 aa, Homo sapiens
YSASFGKGGKASLAEAPIPFPACSVAGDWKTLCDSVQSLGGKASFQDSSSPGATSSPKGIMAALRSLVKPKIVKKRTKKFIRHQSDRYVKIKMRRIMSGVKVKHPAQDSAARKWPSALYTTGAGIHTEKWRPRRENSSMTAL

SEQ ID NO: 879083 - protein, 136 aa, Homo sapiens [sequence omitted]

SEQ ID NO: 879084 - protein, 136 aa, Homo sapiens [sequence omitted]

SEQ ID NO: 879085 - protein, 136 aa, Homo sapiens [sequence omitted]

SEQ ID NO: 879086 - protein, 115 aa, Homo sapiens; identical to SEQ ID NO: 879081

SEQ ID NO: 879087 - protein, 136 aa, Homo sapiens [sequence omitted]

SEQ ID NO: 879088 - protein, 136 aa, Homo sapiens [sequence omitted]

SEQ ID NO: 879089 - protein, 136 aa, Homo sapiens [sequence omitted]

SEQ ID NO: 879090 - protein, 86 aa, Homo sapiens
LPFPCQDPEVTSHQPRRSLIPSLFLGASFCIMAALRSLVKPKIVKKRTKKFIRHQSDRYVKIKRNWWKPRGIDNRVHRRFKGQVLI

SEQ ID NO: 879091 - protein, 103 aa, Homo sapiens
GSLFYRQENSEVLRAVSAPVLAISISTQSPRIPLVSPFLGSENGGGACLPSGKSHELLVFPTKKACKEIVKSYYQRQLLCGILPFHLVLFSLPYGTVGSLHRC

SEQ ID NO: 879092 - protein, 344 aa, Homo sapiens
MVSVNSSHCFYNDSFKYTLYGCMFSMVFVLGLISNCVAIYIFICVLKVRNETTTYMINLAMSDLLFVFTLPFRIFYFTTRNWPFGDLLCKISVMLFYTNMYGSILFLTCISVDRFLAIVYPFKSKTLRTKRNAKIVCTGVWLTVIGGSAPAVFVQSTHSQGNNASEACFENFPEATWKTYLSRIVIFIEIVGFFIPLILNVTCSSMVLKTLTKPVTLSRSKINKTKVLKMIFVHLIIFCFCFVPYNINLILYSLVRTQTFVNCSVVAAVRTMYPITLCIAVSNCCFDPIVYYFTSDTIQNSIKMKNWSVRRSDFRFSEVHGAENFIQHNLQTLKSKIFDNESAA

SEQ ID NO: 879093 - protein, 344 aa, Homo sapiens; identical to SEQ ID NO: 879092

SEQ ID NO: 879094 - protein, 344 aa, Homo sapiens; identical to SEQ ID NO: 879092

SEQ ID NO: 879095 - protein, 344 aa, Homo sapiens; identical to SEQ ID NO: 879092

SEQ ID NO: 879096 - protein, 344 aa, Homo sapiens; identical to SEQ ID NO: 879092

SEQ ID NO: 879097 - protein, 383 aa, Homo sapiens
MEGEGVRNFKELRAKFQNLDAPPLPGPIKFPAGVSPKGDIGGTQSTQILANGKPLSSNHKQRTPYCSSSESQPLQPQKIKLAQKSEIPKCSNSPGPLGKSTVCSATSSQKASLLLEVTQSNVEIITKEKVMVANSFRNKLWNWEKVSSQKSEMSSALLLANYGSKAIHLEGQKGMGLTPEEPRKKLETKGAQTLPSQKHVVAPKILHNVSEDPSFVISQHIRKSWENPPPERSPASSPCQPIYECELASQAPEKQPDVRHHHLPKTKPLPSIDSLGPPPPKPSRPPIVNLQAFQRQPAAVPKTQGEVTVEEGSLSPERLFNAEFEEPHNYEATISYLRHSGNSINLCTAKEIADPTYEVGIEELQKPGKNFPYPEPSAKHEDK

SEQ ID NO: 879098 - protein, 365 aa, Homo sapiens
MEGEGVRNFKELRAKFQNLDAPPLPGPIKFPAGVSPKGDIGGTQSTQILANGKPLSSNHKQRTPYCSSSESQPLQPQKIKLAQKSEIPSSQKASLLLEVTQSNVEIITKEKVMVANSFRNKLWNWEKVSSQKSEMSSALLLANYGSKAIHLEGQKGMGLTPEEPRKKLETKGAQTLPSQKHVVAPKILHNVSEDPSFVISQHIRKSWENPPPERSPASSPCQPIYECELASQAPEKQPDVRHHHLPKTKPLPSIDSLGPPPPKPSRPPIVNLQAFQRQPAAVPKTQGEVTVEEGSLSPERLFNAEFEEPHNYEATISYLRHSGNSINLCTAKEIADPTYEVGIEELQKPGKNFPYPEPSAKHEDK

SEQ ID NO: 879099 - protein, 169 aa, Homo sapiens
LLLVFLANTVSGRHKEESNRTSKTGGGITFLLVSFRTTAPLFLVSPFFFEITSSVFTTSSSSWQPSAPLPCIPLPAREDQQPVPGLSVCLHTIIIPCIFSPSTDTTPVFTSFIQSLAWHYSHSLMNTLNCSLLHSSISLKLRGTLPPPSLCLRMSTLPWLVNVPYQGHS

SEQ ID NO: 879100 - protein, 149 aa, Homo sapiens
MHSLDRRKINDPEFCGVGYQAPKGCFVVIIHNIRSVQKSCVHVCMRVGNGAASNSNSWKKFCFSPAPWPRAEGHQVQKSAERQRLRPRNSSLCVLERGKVSTGTPSVAELKPEHEHPASQFWLECGTSFPITASLRGLLLLIWGQPEKK

SEQ ID NO: 879101 - protein, 79 aa, Homo sapiens
DRKLLGSSNSPTLASQSIRIIGVSHHTQLTLGIYGTKPPSGTTLQKSQFPALNSSWTYPCVVLAPCPGLEAVLGLGPLE

SEQ ID NO: 879102 - protein, 137 aa, Homo sapiens
MSKGSHSPHTGSSQWWGEAITPQTQLQGAQDRRQWGNEDFLWGPSSLGDMEKGRGPKTHQGKRSHQAQGRGQRQQHSRTSHGTHRPGWGPRKASGLREEGEGCHTRKVLYVGKENRVVLGYFKGQNQELWHCVDGSL

SEQ ID NO: 879103 - protein, 747 aa, Homo sapiens
MSQVKSSYSYDAPSDFINFSSLDDEGDTQNIDSWFEEKANLENKLLGKNGTGGLFQGKTPLRKANLQQAIVTPLKPVDNTYYKEAEKENLVEQSIPSNACSSLEVEAAISRKTPAQPQRRSLRLSAQKDLEQKEKHHVKMKAKRCATPVIIDEILPSKKMKVSNNKKKPEEEGSAHQDTAEKNASSPEKAKGRHTVPCMPPAKQKFLKSTEEQELEKSMKMQQEVVEMRKKNEEFKKLALAGIGQPVKKSVSQVTKSVDFHFRTDERIKQHPKNQEEYKEVNFTSELRKHPSSPARVTKGCTIVKPFNLSQGKKRTFDETVSTYVPLAQQVEDFHKRTPNRYHLRSKKDDINLLPSKSSVTKICRDPQTPVLQTKHRARAVTCKSTAELEAEELEKLQQYKFKARELDPRILEGGPILPKKPPVKPPTEPIGFDLEIEKRIQERESKKKTEDEHFEFHSRPCPTKILEDVVGVPEKKVLPITVPKSPAFALKNRIRMPTKEDEEEDEPVVIKAQPVPHYGVPFKPQIPEARTVEICPFSFDSRDKERQLQKEKKIKELQKGEVPKFKALPLPHFDTINLPEKKVKNVTQIEPFCLETDRRGALKAQTWKHQLEEELRQQKEAACFKARPNTVISQEPFVPKKEKKSVAEGLSGSLVQEPFQLATEKRAKERQELEKRMAEVEAQKAQQLEEARLQEEEQKKEELARLRRELVHKANPIRKYQGLEIKSSDQPLTVPVSPKFSTRFHC

SEQ ID NO: 879104 - protein, 747 aa, Homo sapiens; identical to SEQ ID NO: 879103

SEQ ID NO: 879105 - protein, 783 aa, Homo sapiens
MSQVKSSYSYDAPSDFINFSSLDDEGDTQNIDSWFEEKANLENKLLGKNGTGGLFQGKTPLRKANLQQAIVTPLKPVDNTYYKEAEKENLVEQSIPSNACSSLEVEAAISRKTPAQPQRRSLRLSAQKDLEQKEKHHVKMKAKRCATPVIIDEILPSKKMKVSNNKKKPEEEGSAHQDTAEKNASSPEKAKGRHTVPCMPPAKQKFLKSTEEQELEKSMKMQQEVVEMRKKNEEFKKLALAGIGQPVKKSVSQVTKSVDFHFRTDERIKQHPKNQEEYKEVNFTSELRKHPSSPARVTKGCTIVKPFNLSQGKKRTFDETVSTYVPLAQQVEDFHKRTPNRYHLRSKKDDIKTGSCSVTQAGVQWRDHGSLQCPTPGLKQSSCLSLPNLLPSKSSVTKICRDPQTPVLQTKHRARAVTCKSTAELEAEELEKLQQYKFKARELDPRILEGGPILPKKPPVKPPTEPIGFDLEIEKRIQERESKKKTEDEHFEFHSRPCPTKILEDVVGVPEKKVLPITVPKSPAFALKNRIRMPTKEDEEEDEPVVIKAQPVPHYGVPFKPQIPEARTVEICPFSFDSRDKERQLQKEKKIKELQKGEVPKFKALPLPHFDTINLPEKKVKNVTQIEPFCLETDRRGALKAQTWKHQLEEELRQQKEAACFKARPNTVISQEPFVPKKEKKSVAEGLSGSLVQEPFQLATEKRAKERQELEKRMAEVEAQKAQQLEEARLQEEEQKKEELARLRRELVHKANPIRKYQGLEIKSSDQPLTVPVSPKFSTRFHC

SEQ ID NO: 879106 - protein, 747 aa, Homo sapiens; identical to SEQ ID NO: 879103

SEQ ID NO: 879107 - protein, 608 aa, Homo sapiens [sequence omitted]

SEQ ID NO: 879108 - protein, 608 aa, Homo sapiens [sequence omitted]

SEQ ID NO: 879109 - protein, 729 aa, Homo sapiens
MSQVKSSYSYDAPSDFINFSSLDDEGDTQNIDSWFEEKANLENKLLGKNGTGGLFQGKTPLRKANLQQAIVTPLKPVDNTYYKEAEKENLVEQSIPSNACSSLEVEAAISRKTPAQPQRRSLRLSAQKDLEQKEKHHVKMKAKRCATPVIIDEILPSKKMKVSNNKKKPEEEGSAHQDTAEKNASSPEKAKGRHTVPCMPPAKQKFLKSTEEQELEKSMKMQQEVVEMRKKNEEFKKLALAGIGQPVKKSVSQVTKSVDFHFRTDERIKQHPKNQEEYKEVNFTSELRKHPSSPARVTKGCTIVKPFNLSQGKKRTFDETVSTYVPLAQQVEDFHKRTPNRYHLRSKKDDINLLPSKSSVTKICRDPQTPVLQTKHRARAVTCKSTAELEAEELEKLQQYKFKARELDPRILEGGPILPKKPPVKPPTEPIGFDLEIEKRIQERESKKKTEDEHFEFHSRPCPTKILEDVVGVPEKKVLPITVPKSPAFALKNRIRMPTKEDEEEDEPVVIKAQPVPHYGVPFKPQIPEARTVEICPFSFDSRDKERQLQKEKKIFDTINLPEKKVKNVTQIEPFCLETDRRGALKAQTWKHQLEEELRQQKEAACFKARPNTVISQEPFVPKKEKKSVAEGLSGSLVQEPFQLATEKRAKERQELEKRMAEVEAQKAQQLEEARLQEEEQKKEELARLRRELVHKANPIRKYQGLEIKSSDQPLTVPVSPKFSTRFHC

SEQ ID NO: 879110 - protein, 251 aa, Homo sapiens [sequence omitted]

SEQ ID NO: 879111 - protein, 588 aa, Homo sapiens
MSQVKSSYSYDAPSDFINFSSLDDEGDTQNIDSWFEEKANLENKLLGKNGTGGLFQGKTPLRKANLQQAIVTPLKPVDNTYYKEAEKENLVEQSIPSNACSSLEVEAAISRKTPAQPQRRSLRLSAQKDLEQKEKHHVKMKAKRCATPVIIDEILPSKKMKVSNNKKKPEEEGSAHQDTAEKNASSPEKAKGRHTVPCMPPAKQKFLKSTEEQELEKSMKMQQEVVEMRKKNEEFKKLALAGIGQPVKKSVSQVTKSVDFHFRTDERIKQHPKNQEEYKEVNFTSELRKHPSSPARVTKGCTIVKPFNLSQGKKRTFDETVSTYVPLAQQVEDFHKRTPNRYHLRSKKDDINLLPSKSSVTKICRDPQTPVLQTKHRARAVTCKSTAELEAEELEKLQQYKFKARELDPRILEGGPILPKKPPVKPPTEPIGFDLEIEKRIQERESKKKTEDEHFEFHSRPCPTKILEDVVGVPEKKVLPITVPKSPAFALKNRIRMPTKEDEEEDEPVVIKAQPVPHYGVPFKPQIPEARTVEICPFSFDSRDKERQLQKEKKIKELQKGEVPKFKALPLPHFDTINLLLWQVNGRR

SEQ ID NO: 879112 - protein, 129 aa, Homo sapiens
VHVCATCSFQGAYVYASPACAPIFFLFLYLEGLSGSLVQEPFQLATEKRAKERQELEKRMAEVEAQKAQQLEEARLQEEEQKKEELARLRRELVHKANPIRKYQGLEIKSSDQPLTVPVSPKFSTRFHC

SEQ ID NO: 879113 - protein, 416 aa, Homo sapiens
MSQVKSSYSYDAPSDFINFSSLDDEGDTQNIDSWFEEKANLENKLLGKNGTGGLFQGKTPLRKANLQQAIVTPLKPVDNTYYKEAEKENLVEQSIPSNACSSLEVEAAISRKTPAQPQRRSLRLSAQKDLEQKEKHHVKMKAKRCATPVIIDEILPSKKMKVSNNKKKPEEEGSAHQDTAEKNASSPEKAKGRHTVPCMPPAKQKFLKSTEEQELEKSMKMQQEVVEMRKKNEEFKKLALAGIGQPVKKSVSQVTKSVDFHFRTDERIKQHPKNQEEYKEVNFTSELRKHPSSPARVTKGCTIVKPFNLSQGKKRTFDETVSTYVPLAQQVEDFHKRTPNRYHLRSKKDDINLLPSKSSVTKICRDPQTPVLQTKHRARAVTCKSTAELEAEELEKLQQYKFKALKLDAQPSLGTH

SEQ ID NO: 879114 - protein, 747 aa, Homo sapiens; identical to SEQ ID NO: 879103

SEQ ID NO: 879115 - protein, 747 aa, Homo sapiens; identical to SEQ ID NO: 879103

SEQ ID NO: 879116 - protein, 747 aa, Homo sapiens; identical to SEQ ID NO: 879103

SEQ ID NO: 879117 - protein, 747 aa, Homo sapiens; identical to SEQ ID NO: 879103

SEQ ID NO: 879118 - protein, 755 aa, Homo sapiens
MSQVKSSYSYDAPSDFINFSSLDDEGDTQNIDSWFEEKANLENKLLGKNGTGGLFQGKTPLRKANLQQAIVTPLKPVDNTYYKEAEKENLVEQSIPSNACSSLEVEAGLEFFDMAASTSREELQPSLRSLRLSAQKDLEQKEKHHVKMKAKRCATPVIIDEILPSKKMKVSNNKKKPEEEGSAHQDTAEKNASSPEKAKGRHTVPCMPPAKQKFLKSTEEQELEKSMKMQQEVVEMRKKNEEFKKLALAGIGQPVKKSVSQVTKSVDFHFRTDERIKQHPKNQEEYKEVNFTSELRKHPSSPARVTKGCTIVKPFNLSQGKKRTFDETVSTYVPLAQQVEDFHKRTPNRYHLRSKKDDINLLPSKSSVTKICRDPQTPVLQTKHRARAVTCKSTAELEAEELEKLQQYKFKARELDPRILEGGPILPKKPPVKPPTEPIGFDLEIEKRIQERESKKKTEDEHFEFHSRPCPTKILEDVVGVPEKKVLPITVPKSPAFALKNRIRMPTKEDEEEDEPVVIKAQPVPHYGVPFKPQIPEARTVEICPFSFDSRDKERQLQKEKKIKELQKGEVPKFKALPLPHFDTINLPEKKVKNVTQIEPFCLETDRRGALKAQTWKHQLEEELRQQKEAACFKARPNTVISQEPFVPKKEKKSVAEGLSGSLVQEPFQLATEKRAKERQELEKRMAEVEAQKAQQLEEARLQEEEQKKEELARLRRELVHKANPIRKYQGLEIKSSDQPLTVPVSPKFSTRFHC

SEQ ID NO: 879119 - protein, 747 aa, Homo sapiens; identical to SEQ ID NO: 879103

SEQ ID NO: 879120 - protein, 747 aa, Homo sapiens; identical to SEQ ID NO: 879103

SEQ ID NO: 879121 - protein, 895 aa, Homo sapiens
MSQVKSSYSYDAPSDFINFSSLDDEGDTQNIDSWFEEKANLENKLLGKNGTGGLFQGKTPLRKANLQQAIVTPLKPVDNTYYKEAEKENLVEQSIPSNACSSLEVEAAISRKTPAQPQRRSLRLSAQKDLEQKEKHHVKMKAKRCATPVIIDEILPSKKMKVSNNKKKPEEEGSAHQDTAEKNASSPEKAKGRHTVPCMPPAKQKFLKSTEEQELEKSMKMQQEVVEMRKKNEEFKKLALAGIGQPVKKSVSQVTKSVDFHFRTDERIKQHPKNQEEYKEVNFTSELRKHPSSPARVTKGCTIVKPFNLSQGKKRTFDETVSTYVPLAQQVEDFHKRTPNRYHLRSKKDDINLLPSKSSVTKICRDPQTPVLQTKHRARAVTCKSTAELEAEELEKLQQYKFKARELDPRILEGGPILPKKPPVKPPTEPIGFDLEIEKRIQERESKKKTEDEHFEFHSRPCPTKILEDVVGVPEKKVLPITVPKSPAFALKNRIRMPTKEDEEEDEPVVIKAQPVPHYGVPFKPQIPEARTVEICPFSFDSRDKERQLQKEKKIKELQKGEVPKFKALPLPHFDTINLPEKKVKNVTQIEPFCLETDRRGALKAQTWKHQLEEELRQQKEAACFKARPNTVISQEPFVPKKEKKSVAEGLSGSLVQEPFQLATEKRAKERQELEKRMAEVEAQKAQQLEEARLQEEEQKKEELARLRRELVHKANPIRKYQGLEIKSSDQPLTVPVSPKFSTRFHCRAVSELTAENYSSGTYADTARQWDLHLNLKTMTKQEDHRETPRNPGMRQAEHHWQEQSQRSQDREGHNGQHNRQKTILGQMRHPDEHHNNTYNETIMNDTKGLSPKHIRDPMRMHGRTHKKPKKAVTVTLERHQQKQHQRNKERTTIK

SEQ ID NO: 879122 - protein, 485 aa, Homo sapiens [sequence omitted]

SEQ ID NO: 879123 - protein, 134 aa, Homo sapiens
MSQVKSSYSYDAPSDFINFSSLDDEGDTQNIDSWFEEKANLENKLLGKNGTGGLFQGKTPLRKANLQQAIVTPLKPVDNTYYKEAEKENLVEQSIPSNACSSLEVEAAISRKTPAQPQSSRGTLVDISVLKTRL

SEQ ID NO: 879124 - protein, 158 aa, Homo sapiens
MKPKMKYSTNKISTAKWKNTASKALCFKLGKSQQKAKEVCPMYFMKLRSGLMIKKEACYFRRETTKRPSLKTGRKHKRHLVLAACQQQSTVECFAFGISGVQKYTRALHDSSITGISPITEYLASLSTYNDQSITFALEDESYEIYVEDLKKDEKKGR

SEQ ID NO: 879125 - protein, 103 aa, Homo sapiens
MKPKMKYSTNKISTAKWKNTASKALCFKLGKSQQKAKEVCPMYFMKLRSGLMIKKEACYFRRETTKRPSLKTALVYQGSRNILEHFMIQVSQEFHLLQSILLL

SEQ ID NO: 879126 - protein, 270 aa, Homo sapiens
MKPKMKYSTNKISTAKWKNTASKALCFKLGKSQQKAKEVCPMYFMKLRSGLMIKKEACYFRRETTKRPSLKTGRKHKRHLVLAACQQQSTVECFAFGISGVQKYTRALHDSSITGISPITEYLASLSTYNDQSITFALEDESYEIYVEDLKKDEKKDKVLLSYYESQHPSNESGDGVDGKMLMVTLSPTKDFWLHANNKEHSVELHKCEKPLPDQAFFVLHNMHSNCVSFECKTDPGVFIGVKDNHLALIKVDSSENLCTENILFKLSET

SEQ ID NO: 879127 - protein, 270 aa, Homo sapiens; identical to SEQ ID NO: 879126

SEQ ID NO: 879128 - protein, 270 aa, Homo sapiens; identical to SEQ ID NO: 879126

SEQ ID NO: 879129 - protein, 270 aa, Homo sapiens; identical to SEQ ID NO: 879126

SEQ ID NO: 879130 - protein, 158 aa, Homo sapiens; identical to SEQ ID NO: 879124

SEQ ID NO: 879131 - protein, 417 aa, Homo sapiens
AARLLGGTEAAAGLWARGWMPPACGSLRFPPSRGTSHGRRSRSGAAPAACRASARLLLLATSVLLLFAFSLPGSRASNQPPGGGGGSGGDCPGGKGKSINCSELNVRESDVRVCDESSCKYGGVCKEDGDGLKCACQFQCHTNYIPVCGSNGDTYQNECFLRRAACKHQKEITVIARGPCYSDNGSGSGEGEEEGSGAEVHRKHSKCGPCKYKAECDEDAENVGCVCNIDCSGYSFNPVCASDGSSYNNPCFVREASCIKQEQIDIRHLGHCTDTDDTSLLGKKDDGLQYRPDVKDASDQREDVYIGNHMPCPENLNGYCIHGKCEFIYSTQKASCRCESGYTGQHCEKTDFSILYVVPSRQKLTHVLIAAIIGAVQIAIIVAIVMCITRKCPKNNRGRRQKQNLGHFTSDTSSRMV

SEQ ID NO: 879132 - protein, 380 aa, Homo sapiens
MGAAAAEAPLRLPAAPPLAFCCYTSVLLLFAFSLPGSRASNQPPGGGGGSGGDCPGGKGKSINCSELNVRESDVRVCDESSCKYGGVCKEDGDGLKCACQFQCHTNYIPVCGSNGDTYQNECFLRRAACKHQKEITVIARGPCYSDNGSGSGEGEEEGSGAEVHRKHSKCGPCKYKAECDEDAENVGCVCNIDCSGYSFNPVCASDGSSYNNPCFVREASCIKQEQIDIRHLGHCTDTDDTSLLGKKDDGLQYRPDVKDASDQREDVYIGNHMPCPENLNGYCIHGKCEFIYSTQKASCRCESGYTGQHCEKTDFSILYVVPSRQKLTHVLIAAIIGAVQIAIIVAIVMCITRKCPKNNRGRRQKQNLGHFTSDTSSRMV

SEQ ID NO: 879133 - protein, 384 aa, Homo sapiens
KKCWENIKARTKKIMAHERREKVKRSVSPLLSTHVLGKEKIASMLPEQLYFLQSPPEEEPEYHPDASAQELNVRESDVRVCDESSCKYGGVCKEDGDGLKCACQFQCHTNYIPVCGSNGDTYQNECFLRRAACKHQKEITVIARGPCYSDNGSGSGEGEEEGSGAEVHRKHSKCGPCKYKAECDEDAENVGCVCNIDCSGYSFNPVCASDGSSYNNPCFVREASCIKQEQIDIRHLGHCTDTDDTSLLGKKDDGLQYRPDVKDASDQREDVYIGNHMPCPENLNGYCIHGKCEFIYSTQKASCRCESGYTGQHCEKTDFSILYVVPSRQKLTHVLIAAIIGAVQIAIIVAIVMCITRKCPKNNRGRRQKQNLGHFTSDTSSRMV

SEQ ID NO: 879134 - protein, 522 aa, Homo sapiens
SSRSGSSVEMKRIFSLLEKTWLGAPIQFAWQKTSGNYLAVTGADYIVKIFDRHGQKRSEINLPGNCVAMDWDKDGDVLAVIAEKSSCIYLWDANTNKTSQLDNGMRDQMSFLLWSKVGSFLAVGTVKGNLVIYNHQTSRKIPVLGKHTKRITCGCWNAENLPALGGEDKMITVSNQEGDTIRQTQVRSEPSNMQFFLMKMDDRTSAAESMISVVLGKKTLFFLNLNEPDNPADLEFQQDFGNIVCYNWYGDGRIMIGFSCGHFVVISTHTGELGQEIFQARNHKDNLTSIAVSQTLNKVATCGDNCIKIQDLVDLKDMYVILNLDEENKGLGTLSWTDDGQLLALSTQRGSLHVFLTKLPILGDACSTRIAYLTSLLEVTVANPVEGELPITVSVDVEPNFVAVGLYHLAVGMNNRAWFYVLGENAVKKLKDMEYLGTVASICLHSDYAAALFEGKVQLHLIESEILDAQEERETRLFPAVDDKCRILCHALTSDFLIYGTDTGVVQYFYISILRIEDHAKH

SEQ ID NO: 879135 - protein, 1015 aa, Homo sapiens
QALDRQVEGLYQDKGKKCLSSRELEFKFHVMKPRRHTGELGQEIFQARNHKDNLTSIAVSQTLNKVATCGDNCIKIQDLVDLKDMYVILNLDEENKGLGTLSWTDDGQLLALSTQRGSLHVFLTKLPILGDACSTRIAYLTSLLEVTVANPVEGELPITVSVDVEPNFVAVGLYHLAVGMNNRAWFYVLGENAVKKLKDMEYLGTVASICLHSDYAAALFEGKVQLHLIESEILDAQEERETRLFPAVDDKCRILCHALTSDFLIYGTDTGVVQYFYIEDWQFVNDYRHPVSVKKIFPDPNGTRLVFIDEKSDGFVYCPVNDATYEIPDFSPTIKGVLWENWPMDKGVFIAYDDDKVYTYVFHKDTIQGAKVILAGSTKVPFAHKPLLLYNGELTCQTQSGKVNNIYLSTHGFLSNLKDTGPDELRPMLAQNLMLKRFSDAWEMCRILNDEAAWNELARACLHHMEVEFAIRVYRRIGNVGIVMSLEQIKGIEDYNLLAGHLAMFTNDYNLAQDLYLASSCPIAALEMRRDLQHWDSALQLAKHLAPDQIPFISKEYAIQLEFAGDYVNALAHYEKGITGDNKEHDEACLAGVAQMSIRMGDIRRGVNQALKHPSRVLKRDCGAILENMKQFSEAAQLYEKGLYYDKAASVYIRSKNWAKVGDLLPHVSSPKIHLQYAKAKEADGRYKEAVVAYENAKQWQSVIRIYLDHLNNPEKAVNIVRETQSLDGAKMVARFFLQLGDYGSAIQFLVMSKCNNEAFTLAQQHNKMEIYADIIGSEDTTNEDYQSIALYFEGEKRYLQAGKFFLLCGQYSRALKHFLKCPSSEDNVAIEMAIETVGQAKDELLTNQLIDHLLGENDGMPKDAKYLFRLYMALKQYREAAQTAIIIAREEQSAGNYRNAHDVLFSMYAELKSQKIKIPSEMATNLMILHSYILVKIHVKNGDHMKGARMLIRVANNISKFPSHIVPILTSTVIECHRAGLKNSAFSFAAMLMRPEYRSKIDAKYKKKIEGMVR

SEQ ID NO: 879136 - protein, 1351 aa, Homo sapiens
SSRSGSSVEMKRIFSLLEKTWLGAPIQFAWQKTSGNYLAVTGADYIVKIFDRHGQKRSEINLPGNCVAMDWDKDGDVLAVIAEKSSCIYLWDANTNKTSQLDNGMRDQMSFLLWSKVGSFLAVGTVKGNLVIYNHQTSRKIPVLGKHTKRITCGCWNAENLPALGGEDKMITVSNQEGDTIRQTQVRSEPSNMQFFLMKMDDRTSAAESMISVVLGKKTLFFLNLNEPDNPADLEFQQDFGNIVCYNWYGDGRIMIGFSCGHFVVISTHTGELGQEIFQARNHKDNLTSIAVSQTLNKVATCGDNCIKIQDLVDLKDMYVILNLDEENKGLGTLSWTDDGQLLALSTQRGSLHVFLTKLPILGDACSTRIAYLTSLLEVTVANPVEGELPITVSVDVEPNFVAVGLYHLAVGMNNRAWFYVLGENAVKKLKDMEYLGTVASICLHSDYAAALFEGKVQLHLIESEILDAQEERETRLFPAVDDKCRILCHALTSDFLIYGTDTGVVQYFYIEDWQFVNDYRHPVSVKKIFPDPNGTRLVFIDEKSDGFVYCPVNDATYEIPDFSPTIKGVLWENWPMDKGVFIAYDDDKVYTYVFHKDTIQGAKVILAGSTKVPFAHKPLLLYNGELTCQTQSGKVNNIYLSTHGFLSNLKDTGPDELRPMLAQNLMLKRFSDAWEMCRILNDEAAWNELARACLHHMEVEFAIRVYRRIGNVGIVMSLEQIKGIEDYNLLAGHLAMFTNDYNLAQDLYLASSCPIAALEMRRDLQHWDSALQLAKHLAPDQIPFISKEYAIQLEFAGDYVNALAHYEKGITGDNKEHDEACLAGVAQMSIRMGDIRRGVNQALKHPSRVLKRDCGAILENMKQFSEAAQLYEKGLYYDKAASVYIRSKNWAKVGDLLPHVSSPKIHLQYAKAKEADGRYKEAVVAYENAKQWQSVIRIYLDHLNNPEKAVNIVRETQSLDGAKMVARFFLQLGDYGSAIQFLVMSKCNNEAFTLAQQHNKMEIYADIIGSEDTTNEDYQSIALYFEGEKRYLQAGKFFLLCGQYSRALKHFLKCPSSEDNVAIEMAIETVGQAKDELLTNQLIDHLLGENDGMPKDAKYLFRLYMALKQYREAAQTAIIIAREEQSAGNYRNAHDVLFSMYAELKSQKIKIPSEMATNLMILHSYILVKIHVKNGDHMKGARMLIRVANNISKFPSHIVPILTSTVIECHRAGLKNSAFSFAAMLMRPEYRSKIDAKYKKKIEGMVRRPDISEIEEATTPCPFCKFLLPECELLCPGCKNSIPYCIATGRHMLKDDWTVCPHCDFPALYSELKIMLNTESTCPMCSERLNAAQLKKISDCTQYLRTEEEL

SEQ ID NO: 879137 - protein, 127 aa, Homo sapiens
MLSLCHPRYMNKTAFLNDMILPHRRPDISEIEEATTPCPFCKFLLPECELLCPGCKNSIPYCIATGRHMLKDDWTVCPHCDFPALYSELKIMLNTESTCPMCSERLNAAQLKKISDCTQYLRTEEEL

SEQ ID NO: 879138 - protein, 804 aa, Homo sapiens
SSRSGSSVEMKRIFSLLEKTWLGAPIQFAWQKTSGNYLAVTGADYIVKIFDRHGQKRSEINLPGNCVAMDWDKDGDVLAVIAEKSSCIYLWDANTNKTSQLDNGMRDQMSFLLWSKVGSFLAVGTVKGNLVIYNHQTSRKIPVLGKHTKRITCGCWNAENLPALGGEDKMITVSNQEGDTIRQTQVRSEPSNMQFFLMKMDDRTSAAESMISVVLGKKTLFFLNLNEPDNPADLEFQQDFGNIVCYNWYGDGRIMIGFSCGHFVVISTHTGELGQEIFQARNHKDNLTSIAVSQTLNKVATCGDNCIKIQDLVDLKDMYVILNLDEENKGLGTLSWTDDGQLLALSTQRGSLHVFLTKLPILGDACSTRIAYLTSLLEVTVANPVEGELPITVSVDVEPNFVAVGLYHLAVGMNNRAWFYVLGENAVKKLKDMEYLGTVASICLHSDYAAALFEGKVQLHLIESEILDAQEERETRLFPAVDDKCRILCHALTSDFLIYGTDTGVVQYFYIEDWQFVNDYRHPVSVKKIFPDPNGTRLVFIDEKSDGFVYCPVNDATYEIPDFSPTIKGVLWENWPMDKGVFIAYDDDKVYTYVFHKDTIQGAKVILAGSTKVPFAHKPLLLYNGELTCQTQSGKVNNIYLSTHGFLSNLKDTGPDELRPMLAQNLMLKRFSDAWEMCRILNDEAAWNELARACLHHMEVEFAIRVYRRIGNVGIVMSLEQIKGIEDYNLLAGHLAMFTNDYNLAQDLYLASSCPIAALEMRRDLQHWDSALQLAKHLAPDQIPFISKEYAIQLEFALPHFCSL

SEQ ID NO: 879139 - protein, 1248 aa, Homo sapiens
SSRSGSSVEMKRIFSLLEKTWLGAPIQFAWQKTSGNYLAVTGADYIVKIFDRHGQKRSEINLPGNCVAMDWDKDGDVLAVIAEKSSCIYLWDANTNKTSQLDNGMRDQMSFLLWSKVGSFLAVGTVKGNLVIYNHQTSRKIPVLGKHTKRITCGCWNAENLPALGGEDKMITVSNQEGDTIRQTQVRSEPSNMQFFLMKMDDRTSAAESMISVVLGKKTLFFLNLNEPDNPADLEFQQDFGNIVCYNWYGDGRIMIGFSCGHFVVISTHTGELGQEIFQARNHKDNLTSIAVSQTLNKVATCGDNCIKIQDLVDLKDMYVILNLDEENKGLGTLSWTDDGQLLALSTQRGSLHVFLTKLPILGDACSTRIAYLTSLLEVTVANPVEGELPITVSVDVEPNFVAVGLYHLAVGMNNRAWFYVLGENAVKKLKDMEYLGTVASICLHSDYAAALFEGKVQLHLIESEILDAQEERETRLFPAVDDKCRILCHALTSDFLIYGTDTGVVQYFYIEDWQFVNDYRHPVSVKKIFPDPNGTRLVFIDEKSDGFVYCPVNDATYEIPDFSPTIKGVLWENWPMDKGVFIAYDDDKVYTYVFHKDTIQGAKVILAGSTKVPFAHKPLLLYNGELTCQTQSGKVNNIYLSTHGFLSNLKDTGPDELRPMLAQNLMLKRFSDAWEMCRILNDEAAWNELARACLHHMEVEFAIRVYRRIGNVGIVMSLEQIKGIEDYNLLAGHLAMFTNDYNLAQDLYLASSCPIAALEMRRDLQHWDSALQLAKHLAPDQIPFISKEYAIQLEFAGDYVNALAHYEKGITGDNKEHDEACLAGVAQMSIRMGDIRRGVNQALKHPSRVLKRDCGAILENMKQFSEAAQLYEKGLYYDKAASVYIRSKNWAKVGDLLPHVSSPKIHLQYAKAKEADGRYKEAVVAYENAKQWQSVIRIYLDHLNNPEKAVNIVRETQSLDGAKMVARFFLQLGDYGSAIQFLVMSKCNNEAFTLAQQHNKMEIYADIIGSEDTTNEDYQSIALYFEGEKRYLQAGKFFLLCGQYSRALKHFLKCPSSEDNVAIEMAIETVGQAKDELLTNQLIDHLLGENDGMPKDAKYLFRLYMALKQYREAAQTAIIIAREEQSAGNYRNAHDVLFSMYAELKSQKIKIPSEMATNLMILHSYILVKIHVKNGDHMKGARMLIRVANNISKFPSHIVPILTSTVIECHRAGLKNSAFSFAAMLMRPEYRSKIDAKYKKKIEGMVR

SEQ ID NO: 879140 - protein, 127 aa, Homo sapiens
MLMRPEYRSKIDAKYKKKIEGMVRRPDISEIEEATTPCPFCKFLLPECELLCPGCKNSIPYCIATGRHMLKDDWTVCPHCDFPALYSELKIMLNTESTCPMCSERLNAAQLKKISDCTQYLRTEEEL

SEQ ID NO: 879141 - protein, 1369 aa, Homo sapiens
SSRSGSSVEMKRIFSLLEKTWLGAPIQFAWQKTSGNYLAVTGADYIVKIFDRHGQKRSEINLPGNCVAMDWDKDGDVLAVIAEKSSCIYLWDANTNKTSQLDNGMRDQMSFLLWSKVGSFLAVGTVKGNLVIYNHQTSRKIPVLGKHTKRITCGCWNAENLPALGGEDKMITVSNQEGDTIRQTQVRSEPSNMQFFLMKMDDRTSAAESMISVVLGKKTLFFLNLNEPDNPADLEFQQDFGNIVCYNWYGDGRIMIGFSCGHFVVISTHTGELGQEIFQARNHKDNLTSIAVSQTLNKVATCGDNCIKIQDLVDLKDMYVILNLDEENKGLGTLSWTDDGQLLALSTQRGSLHVFLTKLPILGDACSTRIAYLTSLLEVTVANPVEGELPITVSVDVEPNFVAVGLYHLAVGMNNRAWFYVLGENAVKKLKDMEYLGTVASICLHSDYAAALFEGKVQLHLIESEILDAQEERETRLFPAVDDKCRILCHALTSDFLIYGTDTGVVQYFYIEDWQFVNDYRHPVSVKKIFPDPNGTRLVFIDEKSDGFVYCPVNDATYEIPDFSPTIKGVLWENWPMDKGVFIAYDDDKVYTYVFHKDTIQGAKVILAGSTKVPFAHKPLLLYNGELTCQTQSGKVNNIYLSTHGFLSNLKDTGPDELRPMLAQNLMLKRFSDAWEMCRILNDEAAWNELARACLHHMEVEFAIRVYRRIGNVGIVMSLEQIKGIEDYNLLAGHLAMFTNDYNLAQDLYLASSCPIAALEMRRDLQHWDSALQLAKHLAPDQIPFISKEYAIQLEFAGDYVNALAHYEKGITGDNKEHDEACLAGVAQMSIRMGDIRRGVNQALKHPSRVLKRDCGAILENMKQFSEAAQLYEKGLYYDKAASVYIRSKNWAKVGDLLPHVSSPKIHLQYAKAKEADGRYKEAVVAYENAKQWQSVIRIYLDHLNNPEKAVNIVRETQSLDGAKMVARFFLQLGDYGSAIQFLVMSKCNNEAFTLAQQHNKMEIYADIIGSEDTTNEDYQSIALYFEGEKRYLQAGKFFLLCGQYSRALKHFLKCPSSEDNVAIEMAIETVGQAKDELLTNQLIDHLLGENDGMPKDAKYLFRLYMALKQYREAAQTAIIIAREEQSAGNYRNAHDVLFSMYAELKSQKIKIPSEMATNLMILHSYILVKIHVKNGDHMKGARMLIRVANNISKFPSHIVPILTSTVIECHRAGLKNSAFSFAAMLMRPEYRSKIDAKYKKKIEGMVRRPDISEIEEATTPCPFCKFLLPECELLCPGCKNSIPYCIATGRHMLKDDWTVCPHCDFPALYSELKIMLNTESTCPMCSERLNAAQLKKISDCTQYLRTEPQEAVSSPGGFKRRSFLDTEK

SEQ ID NO: 879142 - protein, 114 aa, Homo sapiens
MKYKALSQPFILLNALYFLNAFTSQTLYTSTINKEDHTLGNIIKSQLLKDPQVLFAGYKVPHPLEHKIIIRVQTTPDYSPQEAFTNAITDLISELSLLEERFRVAIKDKQEGIE

SEQ ID NO: 879143 - protein, 116 aa, Homo sapiens
NQSVPSTRRGGGGGGPLGSGRNGGGSMNAPPAFESFLLFEGEKKITINKDTKVPNACLFTINKEDHTLGNIIKSQLLKDPQVLFAGYKVPHPVGWSTPSGGAPRRVEHPVGWSPSG

SEQ ID NO: 879144 - protein, 77 aa, Homo sapiens
IRTLGRRWRTLGVWTQRRREHERPSSLRVVLALRGREVSDAGCGGPRITINKDTKVPNACLFTINKEDHTLGNIIKS

SEQ ID NO: 879145 - protein, 143 aa, Homo sapiens
LGLWGGGGGHLGSGRNGGGSMNAPPAFESFLLFEGEKITINKDTKVPNACLFTINKEDHTLGNIIKSQLLKDPQVLFAGYKVPHPLEHKIIIRVQTTPDYSPQEAFTNAITDLISELSLLEERFRTCLLPLRLPKAQRRPKAQ

SEQ ID NO: 879146 - protein, 82 aa, Homo sapiens
AAAYYYYCSEFKLLTMYGDMARLVATPPPWPALWPPLTLTPTCPVHRLGFIFLIKYSGRDLDVDLSSGDFASKWIVRLDAGR

SEQ ID NO: 879147 - protein, 141 aa, Homo sapiens
DPSSADAGGGGGGPLGSGRNGGGSMNAPPAFESFLLFEGEKKITINKDTKVPNACLFTINKEDHTLGNIIKSQLLKDPQVLFAGYKVPHPLEHKIIIRVQTTPDYSPQEAFTNAITDLISELSLLEERFRVAIKDKQEGIE

SEQ ID NO: 879148 - protein, 263 aa, Homo sapiens
MDNSWRLGPAIGLSAGQSQLLVSLLLLLTRVQPGTDVAAPEHISYVPQLSNDTLAGRLTLSTFTLEQPLGQFSSHNISDLDTIWLVVALSNATQSFTAPRTNQDIPAPANFSQRGYYLTLRANRVLYQTRGQLHVLRVGNDTHCQPTKIGCNHPLPGPGPYRVKFLVMNDEGPVAETKWSSDTRLQQAQALRAVPGPQSPGTVVIIAILSILLAVLLTVLLAVLIYTCFNSCRSTSLSGPEEAGSVRRYTTHLAFSTPAEGAS

SEQ ID NO: 879149 - protein, 274 aa, Homo sapiens
MPVYSPSTKKTTHWETSLNHVPASPSPSAVIVSFLRPPQPRFLYSLQNSAPEHISYVPQLSNDTLAGRLTLSTFTLEQPLGQFSSHNISDLDTIWLVVALSNATQSFTAPRTNQDIPAPANFSQRGYYLTLRANRVLYQTRGQLHVLRVGNDTHCQPTKIGCNHPLPGPGPYRVKFLVMNDEGPVAETKWSSDTRLQQAQALRAVPGPQSPGTVVIIAILSILLAVLLTVLLAVLIYTCFNSCRSTSLSGPEEAGSVRRYTTHLAFSTPAEGAS

SEQ ID NO: 879150 - protein, 140 aa, Homo sapiens
DPSSADAGGGGGGPLGSGRNGGGSMNAPPAFESFLLFEGEKKITINKDTKVPNACLFTINKEDHTLGNIIKSQLLKDPQVLFAGYKVPHPLEHKIIIRVQTTPDYSPQEAFTNAITDLISELSLLEERFRTCLLPLRLLP

SEQ ID NO: 879151 - protein, 274 aa, Homo sapiens; identical to SEQ ID NO: 879149

SEQ ID NO: 879152 - protein, 140 aa, Homo sapiens; identical to SEQ ID NO: 879150

SEQ ID NO: 879153 - protein, 263 aa, Homo sapiens; identical to SEQ ID NO: 879148

SEQ ID NO: 879154 - protein, 263 aa, Homo sapiens; identical to SEQ ID NO: 879148

SEQ ID NO: 879155 - protein, 298 aa, Homo sapiens
MKEEETAGPLDKEHSTDYRQGSLWGCRHCRRTDRQMDNSWRLGPAIGLSAGQSQLLVSLLLLLTRVQPGTDVAAPEHISYVPQLSNDTLAGRLTLSTFTLEQPLGQFSSHNISDLDTIWLVVALSNATQSFTAPRTNQDIPAPANFSQRGYYLTLRANRVLYQTRGQLHVLRVGNDTHCQPTKIGCNHPLPGPGPYRVKFLVMNDEGPVAETKWSSDTRLQQAQALRAVPGPQSPGTVVIIAILSILLAVLLTVLLAVLIYTCFNSCRSTSLSGPEEAGSVRRYTTHLAFSTPAEGAS

SEQ ID NO: 879156 - protein, 263 aa, Homo sapiens; identical to SEQ ID NO: 879148

SEQ ID NO: 879157 - protein, 381 aa, Homo sapiens
GCNLRLGSEAGGGGGGPLGSGRNGGGSMNAPPAFESFLLFEGEKKITINKDTKVPNACLFTINKEDHTLGNIIKSRACFPFAFCRDCQFPEASPATLPVQPAELLAWKSPCATGKDINKHQEVSKSTRSHRHHVDIHLPVFPGKILLNCAALAKRAAPEHISYVPQLSNDTLAGRLTLSTFTLEQPLGQFSSHNISDLDTIWLVVALSNATQSFTAPRTNQDIPAPANFSQRGYYLTLRANRVLYQTRGQLHVLRVGNDTHCQPTKIGCNHPLPGPGPYRVKFLVMNDEGPVAETKWSSDTRLQQAQALRAVPGPQSPGTVVIIAILSILLAVLLTVLLAVLIYTCFNSCRSTSLSGPEEAGSVRRYTTHLAFSTPAEGAS

SEQ ID NO: 879158 - protein, 255 aa, Homo sapiens
MDNSWRLGPAIGLSAGQSQLLVSLLLLLTRVQPGTDVAAPEHISYVPQLSNDTLAGRLTLSTFTLEQPLGQFSSHNISDLDTIWLVVALSNATQSFTAPRTNQDIPAPANFSQRGYYLTLRANRVLYQTRGQLHVLRVGNDTHCQPTKIGCNHPLPGPGPYRVKFLVMNDEGPVAETKWSSDTRLQQAQALRAVPGPQSPGTVVIIAILSILLAVLLTVLLAVLIYTWTCLLPKSSLGALGHGTAGQPPEATVRV

SEQ ID NO: 879159 - protein, 141 aa, Homo sapiens; identical to SEQ ID NO: 879147

SEQ ID NO: 879160 - protein, 310 aa, Homo sapiens
MPVYSPSTKKTTHWETSLNHVPASPSPSAVIVSFLRPPQPRFLYSLQNSAPEHISYVPQLSNDTLAGRLTLSTFTLEQPLGQFSSHNISDLDTIWLVVALSNATQSFTAPRTNQDIPAPANFSQRGYYLTLRANRVLYQTRGQLHVLRVGNDTHCQPTKIGCNHPLPGPGPYRVKFLVMNDEGPVAETKWSSDTRLQQAQALRAVPGPQSPGTVVIIAILSILLAVLLTVLLAVLIYTCTGSSDPYCIVKVDNEPIIRTATVWKTLCPFWGEEYQVHLPPTFHAVAFYVMDEDALSRDDVIGKVCLTRDT

SEQ ID NO: 879161 - protein, 140 aa, Homo sapiens; identical to SEQ ID NO: 879150

SEQ ID NO: 879162 - protein, 141 aa, Homo sapiens; identical to SEQ ID NO: 879147

SEQ ID NO: 879163 - protein, 186 aa, Homo sapiens
GCNLRLGSEAGGGGGGPLGSGRNGGGSMNAPPAFESFLLFEGEKKITINKDTKVPNACLFTINKEDHTLGNIIKSQLLKDPQVLFAGYKVPHPLEHKIIIRVQTTPDYSPQEAFTNAITDLISELSLLEERFRVRAGPGGADGVGWTLARVPRPGTALACFFGGPQGEAAVMEEQGLPPQAPGHVD

SEQ ID NO: 879164 - protein, 104 aa, Homo sapiens
GCNLRLGSEAGGGGGGPLGSGRNGGGSMNAPPAFESFLLFEGEKKITINKDTKVPNACLFTINKEDHTLGNIIKSRACFPFAFCRDCQFPEASPATLPVQPAEL

SEQ ID NO: 879165 - protein, 152 aa, Homo sapiens
GCNLRLGSEAGGGGGGPLGSGRNGGGSMNAPPAFESFLLFEGEKKITINKDTKVPNACLFTINKEDHTLGNIIKSQLLKDPQVLFAGYKVPHPLEHKIIIRVQTTPSPKHSCAWGTAAKPQQLAVPTKVTRGRAPLVGLWRTRFLVQGGLSS

SEQ ID NO: 879166 - protein, 87 aa, Homo sapiens
GCNLRLGSEAGGGGGGPLGSGRNGGGSMNAPPAFESFLLFEGEKKITINKDTKVPNACLFTINKEDHTLGNIIKSVSFPSQALRGCV

SEQ ID NO: 879167 - protein, 79 aa, Homo sapiens
GCNLRLGSEAGGGGGGPLGSGRNGGGSMNAPPAFESFLLFEGEKKITINKDTKVPNACLFTINKEDHTLGNIIKSGTIK

SEQ ID NO: 879168 - protein, 95 aa, Homo sapiens
NITSEFTSNITSEFTSEYTLGNIIKSQLLKDPQVLFAGYKVPHPLEHKIIIRVQTTPDYSPQEAFTNAITDLISELSLLEERFRVAIKDKQEGIE

SEQ ID NO: 879169 - protein, 119 aa, Homo sapiens
KKLNEAAGRRHCRRTDRQMDNSWRLGPAIGLSAGQSQLLVSLLLLLTRVQPGTDVAAPEHISYVPQLSNDTLAGRLTLSTFTLEQPLGQFSSHNISDLDTIWLVVALSNATQSVCLGIL

SEQ ID NO: 879170 - protein, 70 aa, Homo sapiens
TRLSDGDRGAEMLCGRKMKLKRRRVSLVLAEHHEAFNRLIGMEDTPESTSNPVLSKNRKLPVSILFQWGT

SEQ ID NO: 879171 - protein, 274 aa, Homo sapiens; identical to SEQ ID NO: 879149

SEQ ID NO: 879172 - protein, 263 aa, Homo sapiens; identical to SEQ ID NO: 879148

SEQ ID NO: 879173 - protein, 263 aa, Homo sapiens; identical to SEQ ID NO: 879148

SEQ ID NO: 879174 - protein, 263 aa, Homo sapiens; identical to SEQ ID NO: 879148

SEQ ID NO: 879175 - protein, 209 aa, Homo sapiens
MDNSWRLGPAIGLSAGQSQLLVSLLLLLTRVQPGTDVATQSFTAPRTNQDIPAPANFSQRGYYLTLRANRVLYQTRGQLHVLRVGNDTHCQPTKIGCNHPLPGPGPYRVKFLVMNDEGPVAETKWSSDTRLQQAQALRAVPGPQSPGTVVIIAILSILLAVLLTVLLAVLIYTCFNSCRSTSLSGPEEAGSVRRYTTHLAFSTPAEGAS

SEQ ID NO: 879176 - protein, 274 aa, Homo sapiens; identical to SEQ ID NO: 879149

SEQ ID NO: 879177 - protein, 274 aa, Homo sapiens; identical to SEQ ID NO: 879149

SEQ ID NO: 879178 - protein, 274 aa, Homo sapiens; identical to SEQ ID NO: 879149

SEQ ID NO: 879179 - protein, 141 aa, Homo sapiens; identical to SEQ ID NO: 879147

SEQ ID NO: 879180 - protein, 141 aa, Homo sapiens; identical to SEQ ID NO: 879147

SEQ ID NO: 879181 - protein, 140 aa, Homo sapiens; identical to SEQ ID NO: 879150

SEQ ID NO: 879182 - protein, 204 aa, Homo sapiens
MDNSWRLGPAIGLSAGQSQLLVSLLLLLTRVQPGTDVAAPEHISYVPQLSNDTLAGRLTLSTFTLEQPLGQFSSHNISDLDTIWLVVALSNATQSFTAPRTNQDIPAPANFSQRGYYLTLRANRVLYQTRGQLHVLRVGNDTHCQPTKIGCNHPLPGPGPYSQGEVLVMMTKDRGETVVQETRCRSQGLGCPGQNGRAHRPLSR

SEQ ID NO: 879183 - protein, 156 aa, Homo sapiens
MPVYSPSTKKTTHWETSLNHVPASPSPSAVIVSFLRPPQPRFLYSLQNSAPEHISYVPQLSNDTLAGRLTLSTFTLEQPLGQFSSHNISDLDTIWLVVALSNATQSFTAPRTNQDIPAPANFSQRGYYLTLRANRVLYQTRGQLHVLRLKETKIKE

SEQ ID NO: 879184 - protein, 143 aa, Homo sapiens
GCNLRLGSEAGGGGGGPLGSGRNGGGSMNAPPAFESFLLFEGEKKITINKDTKVPNACLFTINKEDHTLGNIIKSQLLKDPQVLFAGYKVPHPLEHKIIIRVQTTPDYSPQEAFTNAITDLISELSLLEERFRTCLLPLRLLP

SEQ ID NO: 879185 - protein, 87 aa, Homo sapiens
SSVPGTSCGGFLLQQREWEHQDLGLGTRLCTDVLRKWQDCFKKMADKPDMGEIASFDKAKLKKTETQEKNTLPTKETIEQEKRSEIS

SEQ ID NO: 879186 - protein, 87 aa, Homo sapiens; identical to SEQ ID NO: 879185

SEQ ID NO: 879187 - protein, 87 aa, Homo sapiens; identical to SEQ ID NO: 879185

SEQ ID NO: 879188 - protein, 87 aa, Homo sapiens; identical to SEQ ID NO: 879185

SEQ ID NO: 879189 - protein, 110 aa, Homo sapiens
PLGRGVAYESAHVQHVFPAKGSKKGSVSMKTLSMNGWKGAHKSSSFEVVPSRTVPLGRDCTDCFKKMADKPDMGEIASFDKAKLKKTETQEKNTLPTKETIEQEKRSEIS

SEQ ID NO: 879190 - protein, 73 aa, Homo sapiens
TSPRLAGGATVAEQAGRQLRNACTAPPPTNLRSGRWEVPARGLWPHSGTQDPRKADSGKQLRGGAFLLWTTDL

SEQ ID NO: 879191 - protein, 82 aa, Homo sapiens
GSPGFVRSDQREWEHQDLGLGTRLCTDVLRKWQDCFKKMADKPDMGEIASFDKAKLKKTETQEKNTLPTKETIEQEKRSEIS

SEQ ID NO: 879192 - protein, 87 aa, Homo sapiens; identical to SEQ ID NO: 879185

SEQ ID NO: 879193 - protein, 87 aa, Homo sapiens; identical to SEQ ID NO: 879185

SEQ ID NO: 879194 - protein, 87 aa, Homo sapiens; identical to SEQ ID NO: 879185

SEQ ID NO: 879195 - protein, 110 aa, Homo sapiens; identical to SEQ ID NO: 879189

SEQ ID NO: 879196 - protein, 87 aa, Homo sapiens; identical to SEQ ID NO: 879185

SEQ ID NO: 879197 - protein, 72 aa, Homo sapiens
RERERERERERERQRERERESEGERGGTRVGAPGSRARNETLHGCFKKMAIVLRKWQTNQTWGKSPASIRPS

SEQ ID NO: 879198 - protein, 100 aa, Homo sapiens
YRCHEVGAGVPVCTLPSRSGSWGSCVHAALTKWELGFLCARCLQEVGAGVPVCTLPSQSGSWGSCVHIAFTSWEHFVGSAANASGSTRISGSERDFARMF

SEQ ID NO: 879199 - protein, 87 aa, Homo sapiens; identical to SEQ ID NO: 879185

SEQ ID NO: 879200 - protein, 80 aa, Homo sapiens
SSVPGTSCGGFLLQQREWEHQDLGLGTRLCTDVLRKWQDKPDMGEIASFDKAKLKKTETQEKNTLPTKETIEQEKRSEIS

SEQ ID NO: 879201 - protein, 80 aa, Homo sapiens; identical to SEQ ID NO: 879200

SEQ ID NO: 879202 - protein, 80 aa, Homo sapiens; identical to SEQ ID NO: 879200

SEQ ID NO: 879203 - protein, 80 aa, Homo sapiens; identical to SEQ ID NO: 879200

SEQ ID NO: 879204 - protein, 83 aa, Homo sapiens
QLGTWYFLWGFLAAATRVGAPGSRARNETLHGCFKKMADKPDMGEIASFDKAKLKKTETQEKNTLPTKETIEQERPLPALHSH

SEQ ID NO: 879205 - protein, 100 aa, Homo sapiens; identical to SEQ ID NO: 879198

SEQ ID NO: 879206 - protein, 100 aa, Homo sapiens; identical to SEQ ID NO: 879198

SEQ ID NO: 879207 - protein, 100 aa, Homo sapiens; identical to SEQ ID NO: 879198

SEQ ID NO: 879208 - protein, 119 aa, Homo sapiens
QLGTWYFLWGFLAAATRVGAPGSRARNETLHGCFKKMADKPDMGEIASFDKAKLKKTETQEKNTLPTKETIEQELSRRSGVKFPKILGGFPTPVLFETPVVMWRKSHLARMGHEPQAAL

SEQ ID NO: 879209 - protein, 80 aa, Homo sapiens; identical to SEQ ID NO: 879200

SEQ ID NO: 879210 - protein, 87 aa, Homo sapiens; identical to SEQ ID NO: 879185

SEQ ID NO: 879211 - protein, 87 aa, Homo sapiens; identical to SEQ ID NO: 879185

SEQ ID NO: 879212 - protein, 87 aa, Homo sapiens; identical to SEQ ID NO: 879185

SEQ ID NO: 879213 - protein, 80 aa, Homo sapiens; identical to SEQ ID NO: 879200

SEQ ID NO: 879214 - protein, 106 aa, Homo sapiens
MKENFPYFRSACDDEGSDYLSDVFEFKDKDEDYKIDFSEFLSLSGRHSHRRTSEQSHGSSALFRGQPMTQPHQWASRDPRYHKMLFSAIEVCTLRSLEQEKRSEIS

SEQ ID NO: 879215 - protein, 87 aa, Homo sapiens; identical to SEQ ID NO: 879185

SEQ ID NO: 879216 - protein, 87 aa, Homo sapiens; identical to SEQ ID NO: 879185

SEQ ID NO: 879217 - protein, 155 aa, Homo sapiens
QLGTWYFLWGFLAAATRVGAPGSRARNETLHGCFKKMAVSAAPGRGAHPGCGRIRCTGRARRNRDRRPSRTGRRGRRPRPGTEKRGAGRAQILGLGAARHALARVPRREASAGSAEGDAGPQAQVKRLGLPTRIVLRKWQTNQTWGKSPASIRPS

SEQ ID NO: 879218 - protein, 87 aa, Homo sapiens; identical to SEQ ID NO: 879185

SEQ ID NO: 879219 - protein, 87 aa, Homo sapiens; identical to SEQ ID NO: 879185

SEQ ID NO: 879220 - protein, 80 aa, Homo sapiens; identical to SEQ ID NO: 879200

SEQ ID NO: 879221 - protein, 155 aa, Homo sapiens; identical to SEQ ID NO: 879217

SEQ ID NO: 879222 - protein, 80 aa, Homo sapiens; identical to SEQ ID NO: 879200

SEQ ID NO: 879223 - protein, 157 aa, Homo sapiens
MGHSAPDATGLVGLLKGPPPQFGLPNSPVVPRDIIRTIIVYELTENKTHLRGMAKREKRGGQGRGASMIHPNVPAIMIAPMCPQSLSFRPIVGPPGVRAEDHAVTGSREHSMGAPWMDRKRQEIRQGDQHQHQYPHGYPFRSICVRGPCERLGLKAS

SEQ ID NO: 879224 - protein, 100 aa, Homo sapiens; identical to SEQ ID NO: 879198

SEQ ID NO: 879225 - protein, 100 aa, Homo sapiens; identical to SEQ ID NO: 879198

SEQ ID NO: 879226 - protein, 119 aa, Homo sapiens; identical to SEQ ID NO: 879208

SEQ ID NO: 879227 - protein, 100 aa, Homo sapiens; identical to SEQ ID NO: 879198

SEQ ID NO: 879228 - protein, 551 aa, Homo sapiens
MAENWKNCFEEELICPICLHVFVEPVQLPCKHNFCRGCIGEAWAKDSGLVRCPECNQAYNQKPGLEKNLKLTNIVEKFNALHVEKPPAALHCVFCRRGPPLPAQKVCLRCEAPCCQSHVQTHLQQPSTARGHLLVEADDVRAWSCPQHNAYRLYHCEAEQVAVCQYCCYYSGAHQGHSVCDVEIRRNEIRKMLMKQQDRLEEREQDIEDQLYKLESDKRLVEEKVNQLKEEVRLQYEKLHQLLDEDLRQTVEVLDKAQAKFCSENAAQALHLGERMQEAKKLLGSLQLLFDKTEDVSFMKNTKSVKILMDRTQTCTSSSLSPTKIGHLNSKLFLNEVAKKEKQLRKMLEGPFSTPVPFLQSVPLYPCGVSSSGAEKRKHSTAFPEASFLETSSGPVGGQYGAAGTASGEGQSGQPLGPCSSTQHLVALPGGAQPVHSSPVFPPSQYPNGSAAQQPMLPQYGGRKILVCSVDNCYCSSVANHGGHQPYPRSGHFPWTVPSQEYSHPLPPTPSVPQSLPSLAVRDWLDASQQPGHQDFYRVYGQPSTKHYVTS

SEQ ID NO: 879229 - protein, 551 aa, Homo sapiens; identical to SEQ ID NO: 879228

SEQ ID NO: 879230 - protein, 368 aa, Homo sapiens
PTQMSLQKMLMKQQDRLEEREQDIEDQLYKLESDKRLVEEKVNQLKEEVRLQYEKLHQLLDEDLRQTVEVLDKAQAKFCSENAAQALHLGERMQEAKKLLGSLQLLFDKTEDVSFMKNTKSVKILMDRTQTCTSSSLSPTKIGHLNSKLFLNEVAKKEKQLRKMLEGPFSTPVPFLQSVPLYPCGVSSSGAEKRKHSTAFPEASFLETSSGPVGGQYGAAGTASGEGQSGQPLGPCSSTQHLVALPGGAQPVHSSPVFPPSQYPNGSAAQQPMLPQYGGRKILVCSVDNCYCSSVANHGGHQPYPRSGHFPWTVPSQEYSHPLPPTPSVPQSLPSLAVRDWLDASQQPGHQDFYRVYGQPSTKHYVTS

SEQ ID NO: 879231 - protein, 551 aa, Homo sapiens; identical to SEQ ID NO: 879228

SEQ ID NO: 879232 - protein, 230 aa, Homo sapiens [sequence omitted]

SEQ ID NO: 879233 - protein, 252 aa, Homo sapiens
MAENWKNCFEEELICPICLHVFVEPVQLPCKHNFCRGCIGEAWAKDSGLVRCPECNQAYNQKPGLEKNLKLTNIVEKFNALHVEKPPAALHCVFCRRGPPLPAQKVCLRLGNLPPQPPGSGVMHPETCPSTFLASPLPHSIAPGLFLLDFVLVLALFLIFFYYESPGRRGDSGSWPGPGRQVALEMGKCLCRGAELSLCFSFFPLLLPLHTPVAGRNLGFPESLGVPPFLPHPGGTPRAPGLFLLLFSFWAV

SEQ ID NO: 879234 - protein, 341 aa, Homo sapiens
MAENWKNCFEEELICPICLHVFVEPVQLPCKHNFCRGCIGEAWAKDSGLVRCPECNQAYNQKPGLEKNLKLTNIVEKFNALHVEKPPAALHCVFCRRGPPLPAQKVCLRCEAPCCQSHVQTHLQQPSTARGHLLVEADDVRAWSCPQHNAYRLYHCEAEQVAVCQYCCYYSGAHQGHSVCDVEIRRNEIRKMLMKQQDRLEEREQDIEDQLYKLESDKRLVEEKVNQLKEEVRLQYEKLHQLLDEDLRQTVEVLDKAQAKFCSENAAQALHLGERMQEAKKLLGSLQLLFDKTEDVSFMKNTKSVKILMDRTQTCTSSSLSPTKIGHLNSKLFLILARSTS

SEQ ID NO: 879235 - protein, 551 aa, Homo sapiens; identical to SEQ ID NO: 879228

SEQ ID NO: 879236 - protein, 559 aa, Homo sapiens
MAENWKNCFEEELICPICLHVFVEPVQLPCKHNFCRGCIGEAWAKDSGLVRCPECNQAYNQKPGLEKNLKLTNIVEKFNALHVEKPPAALHCVFCRRGPPLPAQKVCLRCEAPCCQSHVQTHLQQPSTARGHLLVEADDVRAWSCPQHNAYRLYHCEAEQVAVCQYCCYYSGAHQGHSVCDVEIRRNEIRKMLMKQQDRLEEREQDIEDQLYKLESDKRLVEEKVNQLKEEVRLQYEKLHQLLDEDLRQTVEVLDKAQAKFCSENAAQALHLGERMQEAKKLLGSLQLLFDKTEDVSFMKNTKSVKILMDSSAPSTAPRTQTCTSSSLSPTKIGHLNSKLFLNEVAKKEKQLRKMLEGPFSTPVPFLQSVPLYPCGVSSSGAEKRKHSTAFPEASFLETSSGPVGGQYGAAGTASGEGQSGQPLGPCSSTQHLVALPGGAQPVHSSPVFPPSQYPNGSAAQQPMLPQYGGRKILVCSVDNCYCSSVANHGGHQPYPRSGHFPWTVPSQEYSHPLPPTPSVPQSLPSLAVRDWLDASQQPGHQDFYRVYGQPSTKHYVTS

SEQ ID NO: 879237 - protein, 360 aa, Homo sapiens [sequence omitted]

SEQ ID NO: 879238 - protein, 338 aa, Homo sapiens
MASSGYVLQAELSPSTENSSQLDFEDVWNSSYGVNDSFPDGDYDANLEAAAPCHSCNLLDDSALPFFILTSVLGILASSTVLFMLFRPLFRWQLCPGWPVLAQLAVGSALFSIVVPVLAPGLGSTRSSALCSLGYCVWYGSAFAQALLLGCHASLGHRLGAGQVPGLTLGLTVGIWGVAALLTLPVTLASGASGGLCTLIYSTELKALQATHTVACLAIFVLLPLGLFGAKGLKKALGMGPGPWMNILWAWFIFWWPHGVVLGLDFLVRSKLLLLSTCLAQQALDLLLNLAEALAILHCVATPLLLALFCHQATRTLLPSLPLPEGWSSHLDTLGSKS

SEQ ID NO: 879239 - protein, 336 aa, Homo sapiens [sequence omitted]

SEQ ID NO: 879240 - protein, 134 aa, Homo sapiens
PGSINTAYTTTNFAAAQTLPLGLFGAKGLKKALGMGPGPWMNILWAWFIFWWPHGVVLGLDFLVRSKLLLLSTCLAQQALDLLLNLAEALAILHCVATPLLLALFCHQATRTLLPSLPLPEGWSSHLDTLGSKS

SEQ ID NO: 879241 - protein, 338 aa, Homo sapiens; identical to SEQ ID NO: 879238

SEQ ID NO: 879242 - protein, 958 aa, Homo sapiens
PQISQETRTDLPALLPFVALLFTLSLQSPGVKMLQVHRTGLGRLGVSLSKGLHHKAVLAVRREDVNAWERRAPLAPKHIKGITNLGYKVLIQPSNRRAIHDKDYVKAGGILQEDISEACLILGVKRPPEEKLMSRKTYAFFSHTIKAQEANMGLLDEILKQEIRLIDYEKMVDHRGVRVVAFGQWAGVAGMINILHGMGLRLLALGHHTPFMHIGMAHNYRNSSQAVQAVRDAGYEISLGLMPKSIGPLTFVFTGTGNVSKGAQAIFNELPCEYVEPHELKEVSQTGDLRKVYGTVLSRHHHLVRKTDAVYDPAEYDKHPERYISRFNTDIAPYTTCLINGIYWEQNTPRLLTRQDAQSLLAPGKFSPAGVEGCPALPHKLVAICDISADTGGSIEFMTECTTIEHPFCMYDADQHIIHDSVEGSGILMCSIDNLPAQLPIEATECFGDMLYPYVEEMILSDATQPLESQNFSPVVRDAVITSNGTLPDKYKYIQTLRESRERAQSLSMGTRRKVLVLGSGYISEPVLEYLSRDGNIEITVGSDMKNQIEQLGKKYNINPVSMDICKQEEKLGFLVAKQDLVISLLPYVLHPLVAKACITNKVNMVTASYITPALKELEKSVEDAGITIIGELGLDPGLDHMLAMETIDKAKEVGATIESYISYCGGLPAPEHSNNPLRYKFSWSPVGVLMNVMQSATYLLDGKVVNVAGGISFLDAVTSMDFFPGLNLEGYPNRDSTKYAEIYGISSAHTLLRGTLRYKGYMKALNGFVKLGLINREALPAFRPEANPLTWKQLLCDLVGISPSSEHDVLKEAVLKKLGGDNTQLEAAEWLGLLGDEQVPQAESILDALSKHLVMKLSYGPEEKDMIVMRDSFGIRHPSGHLEHKTIDLVAYGDINGFSAMAKTVGLPTAMAAKMLLDGEIGAKGLMGPFSKEIYGPILERIKAEGIIYTTQSTIKP

SEQ ID NO: 879243 - protein, 969 aa, Homo sapiens
LLLPGLPSQFLLGIRSLPCSDSEDSRRRGTSRRPRADESPGVKMLQVHRTGLGRLGVSLSKGLHHKAVLAVRREDVNAWERRAPLAPKHIKGITNLGYKVLIQPSNRRAIHDKDYVKAGGILQEDISEACLILGVKRPPEEKLMSRKTYAFFSHTIKAQEANMGLLDEILKQEIRLIDYEKMVDHRGVRVVAFGQWAGVAGMINILHGMGLRLLALGHHTPFMHIGMAHNYRNSSQAVQAVRDAGYEISLGLMPKSIGPLTFVFTGTGNVSKGAQAIFNELPCEYVEPHELKEVSQTGDLRKVYGTVLSRHHHLVRKTDAVYDPAEYDKHPERYISRFNTDIAPYTTCLINGIYWEQNTPRLLTRQDAQSLLAPGKFSPAGVEGCPALPHKLVAICDISADTGGSIEFMTECTTIEHPFCMYDADQHIIHDSVEGSGILMCSIDNLPAQLPIEATECFGDMLYPYVEEMILSDATQPLESQNFSPVVRDAVITSNGTLPDKYKYIQTLRESRERAQSLSMGTRRKVLVLGSGYISEPVLEYLSRDGNIEITVGSDMKNQIEQLGKKYNINPVSMDICKQEEKLGFLVAKQDLVISLLPYVLHPLVAKACITNKVNMVTASYITPALKELEKSVEDAGITIIGELGLDPGLDHMLAMETIDKAKEVGATIESYISYCGGLPAPEHSNNPLRYKFSWSPVGVLMNVMQSATYLLDGKVVNVAGGISFLDAVTSMDFFPGLNLEGYPNRDSTKYAEIYGISSAHTLLRGTLRYKGYMKALNGFVKLGLINREALPAFRPEANPLTWKQLLCDLVGISPSSEHDVLKEAVLKKLGGDNTQLEAAEWLGLLGDEQVPQAESILDALSKHLVMKLSYGPEEKDMIVMRDSFGIRHPSGHLEHKTIDLVAYGDINGFSAMAKTVGLPTAMAAKMLLDGEIGAKGLMGPFSKEIYGPILERIKAEGIIYTTQSTIKP

SEQ ID NO: 879244 - protein, 834 aa, Homo sapiens
LLLPGLPSQFLLGIRSLPCSDSEDSRRRGTSRRPRADESPGVKMLQVHRTGLGRLGVSLSKGLHHKAVLAVRREDVNAWERRAPLAPKHIKGITNLGYKVLIQPSNRRAIHDKDYVKAGGILQEDISEACLILGVKRPPEEKLMSRKTYAFFSHTIKAQEANMGLLDEILKQEIRLIDYEKMVDHRGVRVVAFGQWAGVAGMINILHGMGLRLLALGHHTPFMHIGMAHNYRNSSQAVQAVRDAGYEISLGLMPKSIGPLTFVFTGTGNVSKGAQAIFNELPCEYVEPHELKEVSQTGDLRKVYGTVLSRHHHLVRKTDAVYDPAEYDKHPERYISRFNTDIAPYTTCLINGIYWEQNTPRLLTRQDAQSLLAPGKFSPAGVEGCPALPHNLVGDFRISSSHLSIDVIFRLVAICDISADTGGSIEFMTECTTIEHPFCMYDADQHIIHDSVEGSGILMCSIDNLPAQLPIEATECFGDMLYPYVEEMILALLPRLECSDAIAAHCNLHLPGSSDSSCLSLPSSQDQQILSDATQPLESQNFSPVVRDAVITSNGTLPDKYKYIQTLRESRERAQSLSMGTRRKVLVLGSGYISEPVLEYLSRDGNIEITVGSDMKNQIEQLGKKYNINPVSMDICKQEEKLGFLVAKQDLVISLLPYVLHPLVAKACITNKVNMVTASYITPALKELEKSVEDAGITIIGELGLDPGLDHMLAMETIDKAKEVGATIESYISYCGGLPAPEHSNNPLRYKFSWSPVGVLMNVMQSATYLLDGKVVNVAGGISFLDAVTSMDFFPGLNLEGYPNRDSTKYAEIYGISSAHTLLRGTLRYKGLEC

SEQ ID NO: 879245 - protein, 958 aa, Homo sapiens; identical to SEQ ID NO: 879242

SEQ ID NO: 879246 - protein, 217 aa, Homo sapiens
LLLPGLPSQFLLGIRSLPCSDSEDSRRRGTSRRPRADESPGVKMLQVHRTGLGRLGVSLSKGLHHKAVLAVRREDVNAWERRAPLAPKHIKGITNLGYKVLIQPSNRRAIHDKDYVKAGGILQEDISEACLILGVKRPPEEKLMSRKTYAFFSHTIKAQEANMGLLDEILKQEIRLIDYEKMVDHRGVRVVAFGQWAGVAGKYARAYITHFLNWLGE

SEQ ID NO: 879247 - protein, 142 aa, Homo sapiens
MPCPAPVWRDLFVFIPLWGPSSGHPNQQPWVAEPSGTEGRQLYLAESPKATGLSKAGERGKLGSGTMVLAPCCSGHVGGSWRGPKWQLLPDYPGLPSPSSCTLLQWDVWPSLWLASGQVPLLKITLWGSWCPLGLPHSAHTI

SEQ ID NO: 879248 - protein, 142 aa, Homo sapiens; identical to SEQ ID NO: 879247

SEQ ID NO: 879249 - protein, 335 aa, Homo sapiens
IQQILSTVFWQVRNAGSSPLSAACPLFRTPAPQPCGSWGRCCIPHASTGCRPMAERGELDLTGAKQNTGVWLVKVPKYLSQQWAKASGRGEVGKLRIAKTQGRTEVSFTLNEDLANIHDIGGKPASVSAPREHPFVLQSVGGQTLTVFTESSSDKLSLEGIVVQRAECRPAASENYMRLKRLQIEESSKPVRLSQQLDKVVTTNYKPVANHQYNIEYERKKKEDGKRARADKQHVLDMLFSAFEKHQYYNLKDLVDITKQPVVSEGILQEMVFRLVTVPKHLELRPSTNHPGRKVVGRSSVLESYRCCKGFGGTVYGKTFLRITDVSGGNITVHI

SEQ ID NO: 879250 - protein, 301 aa, Homo sapiens
IQQILSTVFWQVRNAGSSPLSAACPLFRTPAPQPCGSWGRCCIPHASTGCRPMAERGELDLTGAKQNTGVWLVKVPKYLSQQWAKASGRGEVGKLRIAKTQGRTEVSFTLNEDLANIHDIGGKPASVSAPREHPFVLQSVGGQTLTVFTESSSDKLSLEGIVVQRAECRPAASENYMRLKRLQIEESSKPVRLSQQLDKVVTTNYKPVANHQYNIEYERKKKEDGKRARADKQHVLDMLFSAFEKHQYYNLKDLVDITKQPVVYLKEILKEIGVQNVKGIHKNTWELKPEYRHYQGEEKSD

SEQ ID NO: 879251 - protein, 310 aa, Homo sapiens
AQSRLLAACSSFPRFPVFWQVRNAGSSPLSAACPLFRTPAPQPCGSWGRCCIPHASTGCRPMAERGELDLTGAKQNTGVWLVKVPKYLSQQWAKASGRGEVGKLRIAKTQGRTEVSFTLNEDLANIHDIGGKPASVSAPREHPFVLQSVGGQTLTVFTESSSDKLSLEGIVVQRAECRPAASENYMRLKRLQIEESSKPVRLSQQLDKVVTTNYKPVANHQYNIEYERKKKEDGKRARADKQHVLDMLFSAFEKHQYYNLKDLVDITKQPVVYLKEILKEIGVQNVKGIHKNTWELKPEYRHYQGEEKSD

SEQ ID NO: 879252 - protein, 162 aa, Homo sapiens [sequence omitted]

SEQ ID NO: 879253 - protein, 310 aa, Homo sapiens; identical to SEQ ID NO: 879251

SEQ ID NO: 879254 - protein, 310 aa, Homo sapiens; identical to SEQ ID NO: 879251

SEQ ID NO: 879255 - protein, 216 aa, Homo sapiens
AQSRLLAACSSFPRFPVFWQVRNAGSSPLSAACPLFRTPAPQPCGSWGRCCIPHASTGCRPMAERGELDLTGAKQNTGVWLVKVPKYLSQQWAKASGRGEVGKLRIAKTQGRTEVSFTLNEDLANIHDIGGKPASVSAPREHPFVLQSVGGQTLTVFTESSSGGSRMTAGVTTVISTSQASKGKQDGEESFLVTQARVQWHDLGSQQPLPPGLKQL

SEQ ID NO: 879256 - protein, 130 aa, Homo sapiens
SVAKFPVTIRHPVIPKLYDPGPERKLRNLVTIATKTFLRPHKLMIMLRSIREYYPDLTVIVADDSQKPLEIKDNHVEYYTMPFGKGWFAGRNLAISQVTTKYVLWVDDDFLFNEETKIEVLVDVLEKTEL

SEQ ID NO: 879257 - protein, 106 aa, Homo sapiens
PRRQKAPMAAPAEPCAGQGVWNQTEPEPAATSLLSLCFLRTAGVWVPPMYLWVLGPIYLLFIHHHGRGYLQMSPLFKAKMVAAIPGSLEPGNGGGRQGTGWNLVKS

SEQ ID NO: 879258 - protein, 97 aa, Homo sapiens
PRRQKAPMAAPAEPCAGQGVWNQTEPEPAATSLLSLCFLRTAGVWVPPMYLWVLGPIYLLFIHHHGRGYLQMSPLFKAKMVAAIPGSLEPGWNLVKS

SEQ ID NO: 879259 - protein, 214 aa, Homo sapiens
MGRRSTSSTKSGKFMNPTDQARKEARKRELKKNKKQRMMVRAAVLKMKDPKQIIRDMEKLDEMEFNPVQQPQLNEKVLKDKRKKLRETFERILRLYEKENPDIYKELRKLEVEYEQKRAQLSQYFDAVIQYFSFNCGCCVTLVASEPSRTGQDDHGRAVAIFANMLGVSLFYACRSLSLQWAVKNPKKPGMKSGRLFRPKVSPDIILRHEGGAS

SEQ ID NO: 879260 - protein, 641 aa, Homo sapiens
MGRRSTSSTKSGKFMNPTDQARKEARKRELKKNKKQRMMVRAAVLKMKDPKQIIRDMEKLDEMEFNPVQQPQLNEKVLKDKRKKLRETFERILRLYEKENPDIYKELRKLEVEYEQKRAQLSQYFDAVKNAQHVEVESIPLPDMPHAPSNILIQDIPLPGAQPPSILKKTSAYGPPTRAVSILPLLGHGVPRLPPGRKPPGPPPGPPPPQVVQMYGRKVGFALDLPPRRRDEDMLYSPELAQRGHDDDVSSTSEDDGYPEDMDQDKHDDSTDDSDTDKSDGESDGDEFVHRDNGERDNNEEKKSGLSVRFADMPGKSRKKKKNMKELTPLQAMMLRMAGQEIPEEGREVEEFSEDDDEDDSDDSEAEKQSQKQHKEESHSDGTSTASSQQQAPPQSVPPSQIQAPPMPGPPPLGPPPAPPLRPPGPPTGLPPGPPPGAPPFLRPPGMPGLRGPLPRLLPPGPPPGRPPGPPPGPPPGLPPGPPPRGPPPRLPPPAPPGIPPPRPGMMRPPLVPPLGPAPPGLFPPAPLPNPGVLSAPPNLIQRPKADDTSAATIEKKATATISAKPQITNPKAEITRFVPTALRVRRENKGATAAPQRKSEDDSAVPLAKAAPKSGPSVPVSVQTKDDVYEAFMKEMEGLL

SEQ ID NO: 879261 - protein, 602 aa, Homo sapiens
MGRRSTSSTKSGKFMNPTDQARKEARKRELKKNKKQRMMVRAAVLKMKDPKQIIRDMEKLDEMEFNPVQQPQLNEKVLKDKRKKLRETFERILRLYEKENPDIYKELRKLEVEYEQKRAQLSQYFDAVKNAQHVEVESIPLPDMPHAPSNILIQDIPLPGAQPPSILKKTSAYGPPTRAVSILPLLGHGVPRLPPGRKPPGPPPGPPPPQVVQMYGRKVGFALDLPPRRRDEDMLYSPELAQRGHDDDVSSTSEDDGYPEDMDQDKHDDSTDDSDTDKSDGESDGDEFVHRDNGERDNNEEKKSGLSVRFADMPGKSRKKKKNMKELTPLQAMMLRMAGQEIPEEGREVEEFSEDDDEDDSDDSEAEKQSQKQHKEESHSDGTSTASSQQQAPPQSVRAPPFLRPPGMPGLRGPLPRLLPPGPPPGRPPGPPPGPPPGLPPGPPPRGPPPRLPPPAPPGIPPPRPGMMRPPLVPPLGPAPPGLFPPAPLPNPGVLSAPPNLIQRPKADDTSAATIEKKATATISAKPQITNPKAEITRFVPTALRVRRENKGATAAPQRKSEDDSAVPLAKAAPKSGPSVPVSVQTKDDVYEAFMKEMEGLL

SEQ ID NO: 879262 - protein, 428 aa, Homo sapiens
MYGRKVGFALDLPPRRRDEDMLYSPELAQRGHDDDVSSTSEDDGYPEDMDQDKHDDSTDDSDTDKSDGESDGDEFVHRDNGERDNNEEKKSGLSVRFADMPGKSRKKKKNMKELTPLQAMMLRMAGQEIPEEGREVEEFSEDDDEDDSDDSEAEKQSQKQHKEESHSDGTSTASSQQQAPPQSVPPSQIQAPPMPGPPPLGPPPAPPLRPPGPPTGLPPGPPPGAPPFLRPPGMPGLRGPLPRLLPPGPPPGRPPGPPPGPPPGLPPGPPPRGPPPRLPPPAPPGIPPPRPGMMRPPLVPPLGPAPPGLFPPAPLPNPGVLSAPPNLIQRPKADDTSAATIEKKATATISAKPQITNPKAEITRFVPTALRVRRENKGATAAPQRKSEDDSAVPLAKAAPKSGPSVPVSVQTKDDVYEAFMKEMEGLL

SEQ ID NO: 879263 - protein, 209 aa, Homo sapiens
MGRRSTSSTKSGKFMNPTDQARKEARKRELKKNKKQRMMVRAAVLKMKDPKQIIRDMEKLDEMEFNPVQQPQLNEKVLKDKRKKLRETFERILRLYEKENPDIYKELRKLEVEYEQKRAQLSQYFDAVKNAQHVEVESIPLPDMPHAPSNILIQDIPLPGAQPPSILKKTSAYGPPTRAVSILPLLGHGVPRLPPGRNSRLIRFPMGIL

SEQ ID NO: 879264 - protein, 641 aa, Homo sapiens; identical to SEQ ID NO: 879260

SEQ ID NO: 879265 - protein, 641 aa, Homo sapiens; identical to SEQ ID NO: 879260

SEQ ID NO: 879266 - protein, 641 aa, Homo sapiens; identical to SEQ ID NO: 879260

SEQ ID NO: 879267 - protein, 641 aa, Homo sapiens; identical to SEQ ID NO: 879260

SEQ ID NO: 879268 - protein, 308 aa, Homo sapiens
MGRRSTSSTKSGKFMNPTDQARKEARKRELKKNKKQRMMVRAAVLKMKDPKQIIRDMEKLDEMEFNPVQQPQLNEKVLKDKRKKLRETFERILRLYEKENPDIYKELRKLEVEYEQKRAQLSQYFDAVKNAQHVEVESIPLPDMPHAPSNILIQDIPLPGAQPPSILKKTSAYGPPTRAVSILPLLGHGVPRLPPGRKPPGPPPGPPPPQVVQMYGRKVGFALDLPPRRRDEDMLYSPELAQRGHDDDVSSTSEDDGYPEDMDQDKHDDSTDDSDTDKSDGESDGDEFVHRDNGERDNNEEKKSGMCR

SEQ ID NO: 879269 - protein, 251 aa, Homo sapiens
MTRLTVLALLAGLLASSRAGSSPLLDIVGGRKARPRQFPFLASIQNQGRHFCGGALIHARFVMTAASCFQSQNPGVSTVVLGAYDLRRRERQSRQTFSISSMSENGYDPQQNLNDLMLLQLDREANLTSSVTILPLPLQNATVEAGTRCQVAGWGSQRSGGRLSRFPRFVNVTVTPEDQCRPNNVCTGVLTRRGGICNGDGGTPLVCEGLAHGVASFSLGPCGRGPDFFTRVALFRDWIDGVLNNPGPGPA

SEQ ID NO: 879270 - protein, 212 aa, Homo sapiens
MTRLTVLALLAGLLASSRAGSSPLLDIVGGRKARPRQFPFLASIQNQGRHFCGGALIHARFVMTAASCFQSQNPGVSTVVLGAYDLRRRERQSRQTFSISSMSENGYDPQQNLNDLMLLQLDREANLTSSVTILPLPLQNATVEAGTRCQVAGWGSQRSGGRLSRFPRFVNVTVTPEDQCRPNNVCTGVLTRRGGICNVSAPCGGRRGPERY

SEQ ID NO: 879271 - protein, 226 aa, Homo sapiens
AEGKWGLAHGRAEAHVWPGQGGWRLGPPQGRWTGSSPLLDIVGGRKARPRQFPFLASIQNQGRHFCGGALIHARFVMTAASCFQSQNPGVSTVVLGAYDLRRRERQSRQTFSISSMSENGYDPQQNLNDLMLLQLDREANLTSSVTILPLPLQNATVEAGTRCQVAGWGSQRSGGRLSRFPRFVNVTVTPEDQCRPNNVCTGVLTRRGGICNVSAPCGGRRGPERY

SEQ ID NO: 879272 - protein, 160 aa, Homo sapiens
MFEELKSRLDTLAQEVALLKEQQALQTVCLKGTKVHMKCFLAFTQTKTFHEASEDCISRGGTLSTPQTGSENDALYEYLRQSVGNEAEIWLGLNDMAAEGTWVDMTGARIAYKNWETEITAQPDGGKTENCAVLSGAANGKWFDKRCRDQLPYICQFGIV

SEQ ID NO: 879273 - protein, 192 aa, Homo sapiens
MASSSASATPEFEGRGGDDLGTEIANTLYRIFNNKSSVDLKTLCISPREHCWVLYVDVAVCLKGTKVHMKCFLAFTQTKTFHEASEDCISRGGTLSTPQTGSENDALYEYLRQSVGNEAEIWLGLNDMAAEGTWVDMTGARIAYKNWETEITAQPDGGKTENCAVLSGAANGKWFDKRCRDQLPYICQFGIV

SEQ ID NO: 879274 - protein, 218 aa, Homo sapiens
MELWGAYLLLCLFSLLTQVTTEPPTQKPKKIVNAKKDVVNTKMFEELKSRLDTLAQEVALLKEQQALQTVCLKGTKVHMKCFLAFTQTKTFHEASEDCISRGGTLSTPQTGSENDALYEYLRQSVGNEAEIWLGLNDMAAEGTWVDMTGARIAYKNWETEITAQPDGGKTENCAVLSGAANGKWFDKRCRDQLPYNCLFGDSCLTGYLLYLSSIFLLF

SEQ ID NO: 879275 - protein, 202 aa, Homo sapiens
MELWGAYLLLCLFSLLTQVTTEPPTQKPKKIVNAKKDVVNTKMFEELKSRLDTLAQEVALLKEQQALQTVCLKGTKVHMKCFLAFTQTKTFHEASEDCISRGGTLSTPQTGSENDALYEYLRQSVGNEAEIWLGLNDMAAEGTWVDMTGARIAYKNWETEITAQPDGGKTENCAVLSGAANGKWFDKRCRDQLPYICQFGIV

SEQ ID NO: 879276 - protein, 169 aa, Homo sapiens
MELWGAYLLLCLFSLLTQVTTEPPTQKPKKIVNAKKVCLKGTKVHMKCFLAFTQTKTFHEASEDCISRGGTLSTPQTGSENDALYEYLRQSVGNEAEIWLGLNDMAAEGTWVDMTGARIAYKNWETEITAQPDGGKTENCAVLSGAANGKWFDKRCRDQLPYICQFGIV

SEQ ID NO: 879277 - protein, 110 aa, Homo sapiens
AGWEMPEIVGSQQIFVAFSSPLPIPSSLLKVMQMKSFCLIFRKYLLGAYLRLNRLYPVASDGFIHWCQEHTFASRNGINYFGGFEEESIIAFLVQTGNRCICRTITEKLR

SEQ ID NO: 879278 - protein, 293 aa, Homo sapiens
MSHGHSHGGGGCRCAAEREEPPEQRGLAYGLYLRIDLERLQCLNESREGSGRGVFKPWEERTDRSKFVESDADEELLFNIPFTGNVKLKGIIIMGEDDDSHPSEMRLYKNIPQMSFDDTEREPDQTFSLNRDLTGELEYATKISRFSNVYHLSIHISKNFGADTTKVFYIGLRGEWTELRRHEVTICNYEASANPADHRVHQVTPQTHYVRLPVGKDKGMRLQRELAATASAKLCLWGLLQKPGLRKIRHHWEGCVGARGPSWFSRALWKLGLGLGGIWQSWITLAFPVNVAM

SEQ ID NO: 879279 - protein, 118 aa, Homo sapiens
MGEDDDSHPSEMRLYKNIPQMSFDDTEREPDQTFSLNRDLTGELEYATKISRFSNVYHLSIHISKNFGADTTKVFYIGLRGEWTELRRHEVTICNYEASANPADHRVHQVTPQTHFIS

SEQ ID NO: 879280 - protein, 191 aa, Homo sapiens
MSHGHSHGGGGCRCAAEREEPPEQRGLAYGLYLRIDLERLQCLNESREGSGRGVFKPWEERTDRSKFVESDADEELLFNIPFTGNVKLKGIIIMGEDDEEREPDQTFSLNRDLTGELEYATKISRFSNVYHLSIHISKNFGADTTKVFYIGLRGEWTELRRHEVTICNYEASANPADHRVHQVTPQTHFIS

SEQ ID NO: 879281 - protein, 165 aa, Homo sapiens
MSHGHSHGGGGCRCAAEREEPPEQRGLAYGLYLRIDLERLQCLNESREGSGRGVFKPWEERTDRSKFVESDADEELLFNIPFTGNVKLKGIIIMGEDDDSHPSEMRLYKNIPQMSFDDTEREPDQTFSLNRDLTGELEYATKISRFSNVYHLSIHISKNFGAVIS

SEQ ID NO: 879282 - protein, 211 aa, Homo sapiens
MSHGHSHGGGGCRCAAEREEPPEQRGLAYGLYLRIDLERLQCLNESREGSGRGVFKPWEERTDRSKFVESDADEELLFNIPFTGNVKLKGIIIMGEDDDSHPSEMRLYKNIPQMSFDDTEREPDQTFSLNRDLTGELEYATKISRFSNVYHLSIHISKNFGADTTKVFYIGLRGEWTELRRHEVTICNYEASANPADHRVHQVTPQTHFIS

SEQ ID NO: 879283 - protein, 211 aa, Homo sapiens; identical to SEQ ID NO: 879282

SEQ ID NO: 879284 - protein, 118 aa, Homo sapiens; identical to SEQ ID NO: 879279

SEQ ID NO: 879285 - protein, 147 aa, Homo sapiens [sequence omitted]

SEQ ID NO: 879286 - protein, 165 aa, Homo sapiens; identical to SEQ ID NO: 879281

SEQ ID NO: 879287 - protein, 699 aa, Homo sapiens
PASFDGWRPPRRRRKQGWRLLRRLRRGPGWAPRSGPGSEARAAGPVGWAAGPAAALAPLPAPGGPMWLQQRLKGLPGLLSSSWARRLLCLLGLLLLLLWFGGSGARRAAGGLHLLPWSRGEPGAAEPSACLEAATRAWRGLRERGEVVPLGPGVPALVANGFLALDVAANRLWVTPGEREPAVAPDFVPFVQLRPLSALAEAGEAVLLLREGLLRRVRCLQLGSPGPGPVAAGPGPASVSGLAAGSGRDCVLLQEDFLAHRGRPHVYLQRIQLNNPTERVAALQTVGPTAGPAPKAFTSTLEKVGDHQFLLYSGRSPPTPTGLVHLVVVAAKKLVNRLQVAPKTQLDETVLWVVHVSGPINPQVLKSKAAKELKALQDLARKEMLELLDMPAAELLQDHQLLWAQLFSPGVEMKKITDTHTPSGLTVNLTLYYMLSCSPAPLLSPSLSHRERDQMESTLNYEDHCFSGHATMHAENLWPGRLSSVQQILQLSDLWRLTLQKRGCKGLVKVGAPGILQGMVLSFGGLQFTENHLQFQADPDVLHNSYALHGIRYKNDHINLAVLADAEGKPYLHVSVESRGQPVKIYACKAGCLDEPVELTSAPTGHTFSVMVTQPITPLLYISTDLTHLQDLRHTLHLKAILAHDEHMAQQDPGLPFLFWFSVASLITLFHLFLFKLIYNEYCGPGAKPLFRSKEDPSV

SEQ ID NO: 879288 - protein, 699 aa, Homo sapiens; identical to SEQ ID NO: 879287

SEQ ID NO: 879289 - protein, 719 aa, Homo sapiens
PASFDGWRPPRRRRKQGWRLLRRLRRGPGWAPRSGPGSEARAAGPVGWAAGPAAALAPLPAPGGPMWLQQRLKGLPGLLSSSWARRLLCLLGLLLLLLWFGGSGARRAAGGLHLLPWSRGEPGAAEPSACLEAATRAWRGLRERGEVVPLGPGVPALVANGFLALDVAANRLWVTPGEREPAVAPDFVPFVQLRPLSALAEAGEAVLLLREGLLRRVRCLQLGSPGPGPVAAGPGPASVSGLAAGSGRDCVLLQEDFLAHRGRPHVYLQRIQLNNPTERVAALQTVGPTAGPAPKAFTSTLEKVGDHQFLLYSGRSPPTPTGLVHLVVVAAKKLVNRLQVAPKTQLDETVLWVVHVSGPINPQVLKSKAAKELKALQDLARKEMLELLDMPAAELLQDHQLLWAQLFSPGVEMKKITDTHTPSGLTVNLTLYYMLSCSPAPLLSPSLSHRERDQMESTLNYEDHCFSGHATMHAENLWPGRLSSVQQILQLSDLWRLTLQKRGCKGLVKVGAPGILQGMVLSFGGLQFTENHLQFQADPDVLHNSYALHGIRYKNDHINLAVLADAEGKPYLHVSVESRGQPVKIYACKAGCLDEPVELTSAPTGHTFSVMVTQPITPLLYISTDLTHLQDLRHTLHLKAILAHDEHMAQQDPGLPFLFWFSVASLITLFHLFLFKLIYNEYCGPGAKPLFRSKAQAGPCQSGASEHSAPEGPRPLSPW

SEQ ID NO: 879290 - protein, 699 aa, Homo sapiens; identical to SEQ ID NO: 879287

SEQ ID NO: 879291 - protein, 699 aa, Homo sapiens; identical to SEQ ID NO: 879287

SEQ ID NO: 879292 - protein, 719 aa, Homo sapiens; identical to SEQ ID NO: 879289

SEQ ID NO: 879293 - protein, 732 aa, Homo sapiens
PASFDGWRPPRRRRKQGWRLLRRLRRGPGWAPRSGPGSEARAAGPVGWAAGPAAALAPLPAPGGPMWLQQRLKGLPGLLSSSWARRLLCLLGLLLLLLWFGGSGARRAAGGLHLLPWSRGEPGAAEPSACLEAATRAWRGLRERGEVVPLGPGVPALVANGFLALDVAANRLWVTPGEREPAVAPDFVPFVQLRPLSALAEAGEAVLLLREGLLRRVRCLQLGSPGPGPVAAGPGPASVSGLAAGSGRDCVLLQEDFLAHRGRPHVYLQRIQLNNPTERVAALQTVGPTAGPAPKAFTSTLEKVGDHQFLLYSGRSPPTPTGLVHLVVVAAKKLVNRLQVAPKTQLDETVLWVVHVSGPINPQVLKSKAAKELKALQDLARKEMLELLDMPAAELLQDHQLLWAQLFSPGVEMKKITDTHTPSGLTVNLTLYYMLSCSPAPLLSPSLSHRERDQMESTLNYEDHCFSGHATMHAENLWPGRLSSVQQILQLSDLWRLTLQKRGCKGLVKVGAPGILQGMVLSFGGLQFTENHLQFQADPDVLHNSYALHGIRYKNDHINLAVLADAEGKPYLHVSVESRGQPVKIYACKAGCLDEPVELTSAPTGHTFSVMVTQPITPLLYISTDLTHLQDLRHTLHLKAILAHDEHMAQQDPGLPFLFWFSVASLITLFHLFLFKLIYNEYCGPGAKPLFRSKVGSRHLVETRGLGLALSPVSRKGLAWRGGVRPGQEWVS

SEQ ID NO: 879294 - protein, 602 aa, Homo sapiens
PASFDELEATEKKEEAGVAAAAAVAAGAGVGAAVRAATRAWRGLRERGEVVPLGPGVPALVANGFLALDVAANRLWVTPGEREPAVAPDFVPFVQLRPLSALAEAGEAVLLLREGLLRRVRCLQLGSPGPGPVAAGPGPASVSGLAAGSGRDCVLLQEDFLAHRGRPHVYLQRIQLNNPTERVAALQTVGPTAGPAPKAFTSTLEKVGDHQFLLYSGRSPPTPTGLVHLVVVAAKKLVNRLQVAPKTQLDETVLWVVHVSGPINPQVLKSKAAKELKALQDLARKEMLELLDMPAAELLQDHQLLWAQLFSPGVEMKKITDTHTPSGLTVNLTLYYMLSCSPAPLLSPSLSHRERDQMESTLNYEDHCFSGHATMHAENLWPGRLSSVQQILQLSDLWRLTLQKRGCKGLVKVGAPGILQGMVLSFGGLQFTENHLQFQADPDVLHNSYALHGIRYKNDHINLAVLADAEGKPYLHVSVESRGQPVKIYACKAGCLDEPVELTSAPTGHTFSVMVTQPITPLLYISTDLTHLQDLRHTLHLKAILAHDEHMAQQDPGLPFLFWFSVASLITLFHLFLFKLIYNEYCGPGAKPLFRSKEDPSV

SEQ ID NO: 879295 - protein, 674 aa, Homo sapiens
PASFDGWRPPRRRRKQGWRLLRRLRRGPGWAPRSGPGSEARAAGPVGWAAGPAAALAPLPAPGGPMWLQQRLKGLPGLLSSSWARRLLCLLGLLLLLLWFGGSGARRAAGGLHLLPWSRGEPGAAEPSACLEAATRAWRGLRERGEVVPLGPGVPALVANGFLALDVAANRLWVTPGEREPAVAPDFVPFVQLRPLSALAEAGEAVLLLREGLLRRVRCLQLGSPGPGPVAAGPGPASVSGLAAGSGRDCVLLQEDFLAHRGRPHVYLQRIQLNNPTERVAALQTVGPTAGPAPKAFTSTLEKVGDHQFLLYSGRSPPTPTGLVHLVVVAAKKLVNRLQVAPKTQLDETVLWVVHVSGPINPQVLKSKAAKELKALQDLARKEMLELLDMPAAELLQDHQLLWAQLFSPGVEMKKITDTHTPSGLTVNLTLYYMLSCSPAPLLSPSLSHRERDQMESTLNYEDHCFSGHATMHAENLWPGRLSSVQQILQLSDLWRLTLQKRGCKGLVKFQADPDVLHNSYALHGIRYKNDHINLAVLADAEGKPYLHVSVESRGQPVKIYACKAGCLDEPVELTSAPTGHTFSVMVTQPITPLLYISTDLTHLQDLRHTLHLKAILAHDEHMAQQDPGLPFLFWFSVASLITLFHLFLFKLIYNEYCGPGAKPLFRSKEDPSV

SEQ ID NO: 879296 - protein, 732 aa, Homo sapiens; identical to SEQ ID NO: 879293

SEQ ID NO: 879297 - protein, 725 aa, Homo sapiens
PASFDGWRPPRRRRKQGWRLLRRLRRGPGWAPRSGPGSEARAAGPVGWAAGPAAALAPLPAPGGPMWLQQRLKGLPGLLSSSWARRLLCLLGLLLLLLWFGGSGARRAAGGLHLLPWSRGEPGAAEPSACLEAATRAWRGLRERGEVVPLGPGVPALVANGFLALDVAANRLWVTPGEREPAVAPDFVPFVQLRPLSALAEAGEAVLLLREGLLRRVRCLQLGSPGPGPVAAGPGPASVSGLAAGSGRDCVLLQEDFLAHRGRPHVYLQRIQLNNPTERVAALQTVGPTAGPAPKAFTSTLEKVGDHQFLLYSGRSPPTPTGLVHLVVVAAKKLVNRLQVAPKTQLDETVLWVVHVSGPINPQVLKSKAAKELKALQDLARKEMLELLDMPAAELLQDHQLLWAQLFSPGVEMKKITDTHTPSGLTVNLTLYYMLSCSPAPLLSPSLSHRERDQMESTLNYEDHCFSGHATMHAENLWPGRLSSVQQILQLSDLWRLTLQKRGCKGLVKVGAPGILQGMVLSFGGLQFTENHLQFQADPDVLHNSYALHGIRYKNDHINLAVLADAEGKPYLHVSVESRGQPVKIYACKAGCLDEPVELTSAPTGHTFSVMVTQPITPLLYISTDLTHLQDLRHTLHLKAILAHDEHMAQQDPGLPFLFWFSVASLITLFHLFLFKLIYNEYCGPGAKPLFRSKAQAGPCQSGASEHSAPEGPRPLSPWKIPVSE

SEQ ID NO: 879298 - protein, 445 aa, Homo sapiens
PASFDGWRPPRRRRKQGWRLLRRLRRGPGWAPRSGPGSEARAAGPVGWAAGPAAALAPLPAPGGPMWLQQRLKGLPGLLSSSWARRLLCLLGLLLLLLWFGGSGARRAAGGLHLLPWSRGEPGAAEPSACLEAATRAWRGLRERGEVVPLGPGVPALVANGFLALDVAANRLWVTPGEREPAVAPDFVPFVQLRPLSALAEAGEAVLLLREGLLRRVRCLQLGSPGPGPVAAGPGPASVSGLAAGSGRDCVLLQEDFLAHRGRPHVYLQRIQLNNPTERVAALQTVGPTAGPAPKAFTSTLEKVGDHQFLLYSGRSPPTPTGLVHLVVVAAKKLVNRLQVAPKTQLDETVLWVVHVSGPINPQVLKSKAAKELKALQDLARKEMLELLDMPAAELLQDHQLLWAQLFSPALLVQRGLPNHPLPPLPLQAHLQRVLWAWSQAPLQE

SEQ ID NO: 879299 - protein, 61 aa, Homo sapiens
FAGLRRMGAWQAFRCGSRTTVEAPAPRARGGVSSTPASAPPALPEVPSSSGGQDGESDSLR

SEQ ID NO: 879300 - protein, 56 aa, Homo sapiens
MQAPDSVRSVKVEREAKTWIEKPRGAGLRVAQKTPVHATTSLTLGTVVHLAFIILP

SEQ ID NO: 879301 - protein, 794 aa, Homo sapiens
MAGWIQAQQLQGDALRQMQVLYGQHFPIEVRHYLAQWIESQPWDAIDLDNPQDRAQATQLLEGLVQELQKKAEHQVGEDGFLLKIKLGHYATQLQKTYDRCPLELVRCIRHILYNEQRLVREANNCSSPAGILVDAMSQKHLQINQTFEELRLVTQDTENELKKLQQTQEYFIIQYQESLRIQAQFAQLAQLSPQERLSRETALQQKQVSLEAWLQREAQTLQQYRVELAEKHQKTLQLLRKQQTIILDDELIQWKRRQQLAGNGGPPEGSLDVLQSWCEKLAEIIWQNRQQIRRAEHLCQQLPIPGPVEEMLAEVNATITDIISALVTSTFIIEKQPPQVLKTQTKFAATVRLLVGGKLNVHMNPPQVKATIISEQQAKSLLKNENTRNECSGEILNNCCVMEYHQATGTLSAHFRNMSLKRIKRADRRGAESVTEEKFTVLFESQFSVGSNELVFQVKTLSLPVVVIVHGSQDHNATATVLWDNAFAEPGRVPFAVPDKVLWPQLCEALNMKFKAEVQSNRGLTKENLVFLAQKLFNNSSSHLEDYSGLSVSWSQFNRENLPGWNYTFWQWFDGVMEVLKKHHKPHWNDGAILGFVNKQQAHDLLINKPDGTFLLRFSDSEIGGITIAWKFDSPERNLWNLKPFTTRDFSIRSLADRLGDLSYLIYVFPDRPKDEVFSKYYTPVLAKAVDGYVKPQIKQVVPEFVNASADAGGSSATYMDQAPSPAVCPQAPYNMYPQNPDHVLDQDGEFDLDETMDVARHVEELLRRPMDSLDSRLSPPAGLFTSARGSLS

SEQ ID NO: 879302 - protein, 109 aa, Homo sapiens
MAGWIQAQQLQGDALRQMQVLYGQHFPIEVRHYLAQWIESQPWDAIDLDNPQDRAQATQLLEGLVQELQKKAEHQVGEDGFLLKIKLGHYATQLQKTYDRWPTDMPWIL

SEQ ID NO: 879303 - protein, 794 aa, Homo sapiens; identical to SEQ ID NO: 879301

SEQ ID NO: 879304 - protein, 424 aa, Homo sapiens
MPSESGAERRDRAAAQVGTAAATAVATAAPAGGGPDPEALSAFPGRHLSGLSWPQVKRLDALLSEPIPIHGRGNFPTLSVQPRQIVQVVRSTLEEQGLHVHSVRLHGSAASHVLHPESGLGYKDLDLVFRVDLRSEASFQLTKAVVLACLLDFLPAGVSRAKITPLTLKEAYVQKLVKVCTDSDRWSLISLSNKSGKNVELKFVDSVRRQFEFSIDSFQIILDSLLLFGQCSSTPMSEAFHPTVTGESLYGDFTEALEHLRHRVIATRSPEEIRGGGLLKYCHLLVRGFRPRPSTDVRALQRYMCSRFFIDFPDLVEQRRTLERYLEAHFGGADAARRYACLVTLHRVVNESTVCLMNHERRQTLDLIAALALQALAEQGPAATAALAWRPPGTDGVVPATVNYYVTPVQPLLAHAYPTWLPCN

SEQ ID NO: 879305 - protein, 346 aa, Homo sapiens
KGLGVESARGTVRLQSAASPAARSAPAWPGPQVGAAEGRGARFPAPPAPRAPRSRRPLRGFSPLATMSESFDCAKCNESLYGRKYIQTDSGPYCVPCYDNTFANTCAECQQLIGHDSRELFYEDRHFHEGCFRCCRCQRSLADEPFTCQDSELLCNDCYCSAFSSQCSACGETVMPGSRKLEYGGQTWHEHCFLCSGCEQPLGSRSFVPDKGAHYCVPCYENKFAPRCARCSKTLTQGGVTYRDQPWHRECLVCTGCQTPLAGQQFTSRDEDPYCVACFGELFAPKCSSCKRPIVGLGGGKYVSFEDRHWHHNCFSCARCSTSLVGQGFVPDGDQVLCQGCSQAGP

SEQ ID NO: 879306 - protein, 389 aa, Homo sapiens
EEGAGRWRRKEVGAGSGPRGGLGVPGCVWSGLGLVPCAHFLGEWVGAALPLAHTVRLQSAASPAARSAPAWPGPQVGAAEGRGARFPAPPAPRAPRSRRPLRGFSPLATMSESFDCAKCNESLYGRKYIQTDSGPYCVPCYDNTFANTCAECQQLIGHDSRELFYEDRHFHEGCFRCCRCQRSLADEPFTCQDSELLCNDCYCSAFSSQCSACGETVMPGSRKLEYGGQTWHEHCFLCSGCEQPLGSRSFVPDKGAHYCVPCYENKFAPRCARCSKTLTQGGVTYRDQPWHRECLVCTGCQTPLAGQQFTSRDEDPYCVACFGELFAPKCSSCKRPIVGLGGGKYVSFEDRHWHHNCFSCARCSTSLVGQGFVPDGDQVLCQGCSQAGP

SEQ ID NO: 879307 - protein, 346 aa, Homo sapiens; identical to SEQ ID NO: 879305

SEQ ID NO: 879308 - protein, 215 aa, Homo sapiens
MTRGSCSMKTAISTRAASAAALLCNDCYCSAFSSQCSACGETVMPGSRKLEYGGQTWHEHCFLCSGCEQPLGSRSFVPDKGAHYCVPCYENKFAPRCARCSKTLTQGGVTYRDQPWHRECLVCTGCQTPLAGQQFTSRDEDPYCVACFGELFAPKCSSCKRPIVGLGGGKYVSFEDRHWHHNCFSCARCSTSLVGQGFVPDGDQVLCQGCSQAGP

SEQ ID NO: 879309 - protein, 229 aa, Homo sapiens
EEGAGRWRRKEVGAGSGPRGGLGVPGCVWSGLGLVPCAHFLGEWVGAALPLAHTVRLQSAASPAARSAPAWPGPQVGAAEGRGARFPAPPAPRAPRSRRPLRGFSPLATMSESFDCAKCNESLYGRKYIQTDSGPYCVPCYDNTFANTCAECQQLIGHDSRELFYEDRHFHEGCFRCCRCQRSLADEPFTCQDSELLCNDCYCSAFSSQCSACGETVMPDADTGWSDIP

SEQ ID NO: 879310 - protein, 147 aa, Homo sapiens
MNPSPARTVSCSAMTATAVRFPRSAPLVGRLSCLTLTQGGVTYRDQPWHRECLVCTGCQTPLAGQQFTSRDEDPYCVACFGELFAPKCSSCKRPIVGLGGGKYVSFEDRHWHHNCFSCARCSTSLVGQGFVPDGDQVLCQGCSQAGP

SEQ ID NO: 879311 - protein, 346 aa, Homo sapiens; identical to SEQ ID NO: 879305

SEQ ID NO: 879312 - protein, 361 aa, Homo sapiens
EEGAGRWRRKEVGAGSGPRGGLGGRGAVVRAVGWALRSLPRGVGWGRAPTRPHGPSAVGSLAGSSLGPRLARPAGFSPLATMSESFDCAKCNESLYGRKYIQTDSGPYCVPCYDNTFANTCAECQQLIGHDSRELFYEDRHFHEGCFRCCRCQRSLADEPFTCQDSELLCNDCYCSAFSSQCSACGETVMPGSRKLEYGGQTWHEHCFLCSGCEQPLGSRSFVPDKGAHYCVPCYENKFAPRCARCSKTLTQGGVTYRDQPWHRECLVCTGCQTPLAGQQFTSRDEDPYCVACFGELFAPKCSSCKRPIVGLGGGKYVSFEDRHWHHNCFSCARCSTSLVGQGFVPDGDQVLCQGCSQAGP

SEQ ID NO: 879313 - protein, 119 aa, Homo sapiens
MSESFDCAKCNESLYGRKYIQTDSGPYCVPCYDNTFANTCAECQQLIGHDSRELFYEDRHFHEGCFRCCRCQRSLADEPFTCQDSELLCNDCYCSAFSSQCSACGETVMPGMCSGAHLV

SEQ ID NO: 879314 - protein, 361 aa, Homo sapiens; identical to SEQ ID NO: 879312

SEQ ID NO: 879315 - protein, 172 aa, Homo sapiens
MPGSRKLEYGGQTWHEHCFLCSGCEQPLGSRSFVPDKGAHYCVPCYENKFAPRCARCSKTLTQGGVTYRDQPWHRECLVCTGCQTPLAGQQFTSRDEDPYCVACFGELFAPKCSSCKRPIVGLGGGKYVSFEDRHWHHNCFSCARCSTSLVGQGFVPDGDQVLCQGCSQAGP

SEQ ID NO: 879316 - protein, 177 aa, Homo sapiens
MGPLFPTGSRKLEYGGQTWHEHCFLCSGCEQPLGSRSFVPDKGAHYCVPCYENKFAPRCARCSKTLTQGGVTYRDQPWHRECLVCTGCQTPLAGQQFTSRDEDPYCVACFGELFAPKCSSCKRPIVGLGGGKYVSFEDRHWHHNCFSCARCSTSLVGQGFVPDGDQVLCQGCSQAGP

SEQ ID NO: 879317 - protein, 382 aa, Homo sapiens
KGLGVESARGTVRLQSAASPAARSAPAWPGPQVGAAEGRGARFPAPPAPRAPRSRRPLRGFSPLATMSESFDCAKCNESLYGRKYIQTDSGPYCVPCYDNTFANTCAECQQLIGHDSRELFYEDRHFHEGCFRCCRCQRSLADEPFTCQDSELLCNDCYCSAFSSQCSACGETVMPGSRKLEYGGQTWHEHCFLCSGCEQPLGSRSFVPDKGAHYCVPCYENKFAPRCARCSKTLTQGGVTYRDQPWHRECLVCTGCQRSLADEPFTCQDSELLCNDCYCSAFSSQCSACGETVMPGSRKLEMEARHGMSTASCFGELFAPKCSSCKRPIVGLGGGKYVSFEDRHWHHNCFSCARCSTSLVGQGFVPDGDQVLCQGCSQAGP

SEQ ID NO: 879318 - protein, 346 aa, Homo sapiens; identical to SEQ ID NO: 879305

SEQ ID NO: 879319 - protein, 220 aa, Homo sapiens
MKSVIYHALSQKEANDSDVQPSGAQRAEAFVRAFLKRSTPRMSPQAREDQLQRKAVVLEYFTRHKRKEKKKKAKGLSARQRRELRLFDIKPEQQRYSLFLPLHELWKQYIRDLCSGLKPDTQPQMIQAKLLKADLHGAIISVTKSKCPSYVGITGILLQETKHIFKIITKEDRLKVIPKLNCVFTVETDGFISYIYGSKFQLRSSERSAKKFKAKGTIDL

SEQ ID NO: 879320 - protein, 220 aa, Homo sapiens; identical to SEQ ID NO: 879319

SEQ ID NO: 879321 - protein, 220 aa, Homo sapiens; identical to SEQ ID NO: 879319

SEQ ID NO: 879322 - protein, 220 aa, Homo sapiens; identical to SEQ ID NO: 879319

SEQ ID NO: 879323 - protein, 202 aa, Homo sapiens
MKSVIYHALSQKEANDSDVQPSGAQRAEAFVRAFLKRSTPRMSPQAREDQLQRKAVVLEYFTRHKRKEKKKKAKGLSARQRRELRLFDIKPEQQRYSLFLPLHELWKQYIRDLCSGLKPDTQPQMIQAKLLKADLHGAIISVTKSKCPSYVGITGILLQETKHIFFTVETDGFISYIYGSKFQLRSSERSAKKFKAKGTIDL

SEQ ID NO: 879324 - protein, 220 aa, Homo sapiens; identical to SEQ ID NO: 879319

SEQ ID NO: 879325 - protein, 220 aa, Homo sapiens; identical to SEQ ID NO: 879319

SEQ ID NO: 879326 - protein, 131 aa, Homo sapiens
MTPMSRYSLFLPLHELWKQYIRDLCSGLKPDTQPQMIQAKLLKADLHGAIISVTKSKCPSYVGITGILLQETKHIFKIITKEDRLKVIPKLNCVFTVETDGFISYIYGSKFQLRSSERSAKKFKAKGTIDL

SEQ ID NO: 879327 - protein, 102 aa, Homo sapiens
ADRRVTESAEVGCEKTTEGETALRSPKKLLPRQPRRSYQNEALPLPPTHHQPPGYGTDTNWTLRTKRHQPNQQPLSIQQHERRHFPFLRGQCHNPPLLLQLR

SEQ ID NO: 879328 - protein, 101 aa, Homo sapiens
RLLCLLVQKQLNQKKPPDSTALRSPKKLLPRQPRRSYQNEALPLPPTHHQPPGYGTDTNWTLRTKRHQPNQQPLSIQQHERRHFPFLRGQCHNPPLLLQLR

SEQ ID NO: 879329 - protein, 102 aa, Homo sapiens; identical to SEQ ID NO: 879327

SEQ ID NO: 879330 - protein, 101 aa, Homo sapiens; identical to SEQ ID NO: 879328

SEQ ID NO: 879331 - protein, 102 aa, Homo sapiens; identical to SEQ ID NO: 879327

SEQ ID NO: 879332 - protein, 101 aa, Homo sapiens; identical to SEQ ID NO: 879328

SEQ ID NO: 879333 - protein, 116 aa, Homo sapiens
MRYSLSPDNHLEDGIMNMANFLRGFEEKGIKNDRPEDQLSKEKKKILFSFCEVCNIQLNSAAQAQVHSNGKSHRKRVKQLSDGQPPPPAQASPSSNSSTGKIHELFVTSRNICYTH

SEQ ID NO: 879334 - protein, 94 aa, Homo sapiens
EVCNIQLNSAAQAQVHSNGKSHRKRVKQLSDGQPPPPAQASPSSNSSTGRRQGPGFHVLRGEMVLVWKMKDLEQDLIFTLKLGYHDNMYSFSYR

SEQ ID NO: 879335 - protein, 116 aa, Homo sapiens; identical to SEQ ID NO: 879333

SEQ ID NO: 879336 - protein, 662 aa, Homo sapiens
RSGAGGEASRNALGARTRVQSPGPGGQTKREEAQNSSTPSVPMSKSKCSVGLMSSVVAPAKEPNAVGPKEVELILVKEQNGVQLTSSTLTNPRQSPVEAQDRETWGKKIDFLLSVIGFAVDLANVWRFPYLCYKNGGGAFLVPYLLFMVIAGMPLFYMELALGQFNREGAAGVWKICPILKGVGFTVILISLYVGFFYNVIIAWALHYLFSSFTTELPWIHCNNSWNSPNCSDAHPGDSSGDSSGLNDTFGTTPAAEYFERGVLHLHQSHGIDDLGPPRWQLTACLVLVIVLLYFSLWKGVKTSGKVVWITATMPYVVLTALLLRGVTLPGAIDGIRAYLSVDFYRLCEASVWIDAATQVCFSLGVGFGVLIAFSSYNKFTNNCYRDAIVTTSINSLTSFSSGFVVFSFLGYMAQKHSVPIGDVAKDGPGLIFIIYPEAIATLPLSSAWAVVFFIMLLTLGIDSAMGGMESVITGLIDEFQLLHRHRELFTLFIVLATFLLSLFCVTNGGIYVFTLLDHFAAGTSILFGVLIEAIGVAWFYGVGQFSDDIQQMTGQRPSLYWRLCWKLVSPCFLLFVVVVSIVTFRPPHYGAYIFPDWANALGWVIATSSMAMVPIYAAYKFCSLPGSFREKLAYAIAPEKDRELVDRGEVRQFTLRHWLKV

SEQ ID NO: 879337 - protein, 102 aa, Homo sapiens
DWKIAAAAAQLVPETAVSCSYRDAIVTTSINSLTSFSSGFVVFSFLGYMAQKHSVPIGDVAKDGEPLLLHLGLLRVAPAPSSQQSLFPCERGRRRMGPERLQ

SEQ ID NO: 879338 - protein, 617 aa, Homo sapiens
MKVSLGNGEMGVSAHLQPCKAGTTRFFTSNTHSSVVLQGFDQLRIEGLLCDVTLVPGDGDEIFPVHRAMMASASDYFKAMFTGGMKEQDLMCIKLHGVNKVGLKKIIDFIYTAKLSLNMDNLQDTLEAASFLQILPVLDFCKVFLISGVSLDNCVEVGRIANTYNLIEVDKYVNNFILKNFPALLSTGEFLKLPFERLAFVLSSNSLKHCTELELFKAACRWLRLEDPRMDYAAKLMKNIRFPLMTPQDLINYVQTVDFMRTDNTCVNLLLEASNYQMMPYMQPVMQSDRTAIRSDSTHLVTLGGVLRQQLVVSKELRMYDERAQEWRSLAPMDAPRYQHGIAVIGNFLYVVGGQSNYDTKGKTAVDTVFRFDPRYNKWMQVASLNEKRTFFHLSALKGHLYAVGGRSAAGELATVECYNPRMNEWSYVAKMSEPHYGHAGTVYGGLMYISGGITHDTFQNELMCFDPDTDKWMQKAPMTTVRGLHCMCTVGDKLYVIGGNHFRGTSDYDDVLSCEYYSPTLDQWTPIAAMLRGQSDVGVAVFENKIYVVGGYSWNNRCMVEIVQKYDPEKDEWHKVFDLPESLGGIRACTLTVFPPEENPGSPSRESPLSAPSDHS

SEQ ID NO: 879339 - protein, 590 aa, Homo sapiens
MGVSAHLQPCKAGTTRFFTSNTHSSVVLQGFDQLRIEGLLCDVTLVPGDGDEIFPVHRAMMASASDYFKAMFTGGMKEQDLMCIKLHGVNKVGLKKIIDFIYTAKLSLNMDNLQDTLEAASFLQILPVLDFCKVFLISGVSLDNCVEVGRIANTYNLIEVDKYVNNFILKNFPALLSTGEFLKLPFERLAFVLSSNSLKHCTELELFKAACRWLRLEDPRMDYAAKLMKNIRFPLMTPQDLINYVQTVDFMRTDNTCVNLLLEASNYQMMPYMQPVMQSDRTAIRSDSTHLVTLGGVLRQQLVVSKELRMYDERAQEWRSLAPMDAPRYQHGIAVIGNFLYVVGGQSNYDTKGKTAVDTVFRFDPRYNKWMQVASLNEKRTFFHLSALKGHLYAVGGRSAAGELATVECYNPRMNEWSYVAKMSEPHYGHAGTVYGGLMYISGGITHDTFQNELMCFDPDTDKWMQKAPMTTVRGLHCMCTVGDKLYVIGGNHFRGTSDYDDVLSCEYYSPTLDQWTPIAAMLRGQSDVGVAVFENKIYVVGGYSWNNRCMVEIVQKYDPEKDEWHKVFDLPESLGGIRACTLTVFPPEA

SEQ ID NO: 879340 - protein, 617 aa, Homo sapiens; identical to SEQ ID NO: 879338

SEQ ID NO: 879341 - protein, 511 aa, Homo sapiens
MRITITAETIQHKLLQHKLLQHKLLQHTIPVLDFCKVFLISGVSLDNCVEVGRIANTYNLIEVDKYVNNFILKNFPALLSTGEFLKLPFERLAFVLSSNSLKHCTELELFKAACRWLRLEDPRMDYAAKLMKNIRFPLMTPQDLINYVQTVDFMRTDNTCVNLLLEASNYQMMPYMQPVMQSDRTAIRSDSTHLVTLGGVLRQQLVVSKELRMYDERAQEWRSLAPMDAPRYQHGIAVIGNFLYVVGGQSNYDTKGKTAVDTVFRFDPRYNKWMQVASLNEKRTFFHLSALKGHLYAVGGRSAAGELATVECYNPRMNEWSYVAKMSEPHYGHAGTVYGGLMYISGGITHDTFQNELMCFDPDTDKWMQKAPMTTVRGLHCMCTVGDKLYVIGGNHFRGTSDYDDVLSCEYYSPTLDQWTPIAAMLRGQSDVGVAVFENKIYVVGGYSWNNRCMVEIVQKYDPEKDEWHKVFDLPESLGGIRACTLTVFPPEENPGSPSRESPLSAPSDHS

SEQ ID NO: 879342 - protein, 617 aa, Homo sapiens; identical to SEQ ID NO: 879338

SEQ ID NO: 879343 - protein, 183 aa, Homo sapiens
MSLSRDLKDDFHSDTVLSILNEQRIRGILCDVTIIVEDTKFKAHSNVLAASSLYFKNIFWSHTICISSHVLELDDLKAEVFTEILNYIYSSTVVVKRQETVTDLAAAGKKLGISFLEDLTDRNFSNSPGPYVFCITEKGVVKEEKNEKRHEEPAITNGPRITNAFSIIETENSNNMFSPLDLR

SEQ ID NO: 879344 - protein, 183 aa, Homo sapiens; identical to SEQ ID NO: 879343

SEQ ID NO: 879345 - protein, 183 aa, Homo sapiens; identical to SEQ ID NO: 879343

SEQ ID NO: 879346 - protein, 186 aa, Homo sapiens
MTVMSLSRDLKDDFHSDTVLSILNEQRIRGILCDVTIIVEDTKFKAHSNVLAASSLYFKNIFWSHTICISSHVLELDDLKAEVFTEILNYIYSSTVVVKRQETVTDLAAAGKKLGISFLEDLTDRNFSNSPGPYVFCITEKGVVKEEKNEKRHEEPAITNGPRITNAFSIIETENSNNMFSPLDLR

SEQ ID NO: 879347 - protein, 735 aa, Homo sapiens
GAFYWSWVPSMGAASVRAGARLVEVALCSFTVTCLEVMRRFLLLYATQQGQAKAIAEEMCEQAVVHGFSADLHCISESDKYDLKTETAPLVVVVSTTGTGDPPDTARKFVKEIQNQTLPVDFFAHLRYGLLGLGDSEYTYFCNGGKIIDKRLQELGARHFYDTGHADDCVGLELVVEPWIAGLWPALRKHFRSSRGQEEISGALPVASPASSRTDLVKSELLHIESQVELLRFDDSGRKDSEVLKQNAVNSNQSNVVIEDFESSLTRSVPPLSQASLNIPGLPPEYLQVHLQESLGQEESQVSVTSADPVFQVPISKAVQLTTNDAIKTTLLVELDISNTDFSYQPGDAFSVICPNSDSEVQSLLQRLQLEDKREHCVLLKIKADTKKKGATLPQHIPAGCSLQFIFTWCLEIRAIPKKAFLRALVDYTSDSAEKRRLQELCSKQGAADYSRFVRDACACLLDLLLAFPSCQPPLSLLLEHLPKLQPRPYSCASSSLFHPGKLHFVFNIVEFLSTATTEVLRKGVCTGWLALLVASVLQPNIHASHEDSGKALAPKISISPRTTNSFHLPDDPSIPIIMVGPGTGIAPFIGFLQHREKLQEQHPDGNFGAMWLFFGCRHKDRDYLFRKELRHFLKHGILTHLKVSFSRDAPVGEEEAPAKYVQDNIQLHGQQVARILLQENGHIYVCGDAKNMAKDVHDALVQIISKEVGVEKLEAMKTLATLKEEKRYLQDIWS

SEQ ID NO: 879348 - protein, 157 aa, Homo sapiens
MVGPGTGIAPFIGFLQHREKLQEQHPDGNFGAMWLFFGCRHKDRDYLFRKELRHFLKHGILTHLKVSFSRDAPVGEEEAPAKYVQDNIQLHGQQVARILLQENGHIYVCGDAKNMAKDVHDALVQIISKEVGVEKLEAMKTLATLKEEKRYLQDIWS

SEQ ID NO: 879349 - protein, 103 aa, Homo sapiens
SFLLVLGTEHGRCVSARWRKVGGSRVVQVRARLARRGFTVTCLEVMRRFLLLYATQQGQAKAIAEEMCEQAVVHGFSADLHCISESDKVSVIQNTPTFAMGGR

SEQ ID NO: 879350 - protein, 103 aa, Homo sapiens; identical to SEQ ID NO: 879349

SEQ ID NO: 879351 - protein, 356 aa, Homo sapiens
MNPFPVFTCKGATLPQHIPAGCSLQFIFTWCLEIRAIPKKAFLRALVDYTSDSAEKRRLQELCSKQGAADYSRFVRDACACLLDLLLAFPSCQPPLSLLLEHLPKLQPRPYSCASSSLFHPGKLHFVFNIVEFLSTATTEVLRKGVCTGWLALLVASVLQPNIHASHEDSGKALAPKISISPRTTNSFHLPDDPSIPIIMVGPGTGIAPFIGFLQHREKLQEQHPDGNFGAMWLFFGCRHKDRDYLFRKELRHFLKHGILTHLKVSFSRDAPVGEEEAPAKYVQDNIQLHGQQVARILLQENGHIYVCGDAKNMAKDVHDALVQIISKEVGVEKLEAMKTLATLKEEKRYLQDIWS

SEQ ID NO: 879352 - protein, 103 aa, Homo sapiens; identical to SEQ ID NO: 879349

SEQ ID NO: 879353 - protein, 103 aa, Homo sapiens; identical to SEQ ID NO: 879349

SEQ ID NO: 879354 - protein, 743 aa, Homo sapiens
SFLLVLGTEHGRCVSARWRKVGGSRVVQVRARLARRGFTVTCLEVMRRFLLLYATQQGQAKAIAEEMCEQAVVHGFSADLHCISESDKYDLKTETAPLVVVVSTTGTGDPPDTARKFVKEIQNQTLPVDFFAHLRYGLLGLGDSEYTYFCNGGKIIDKRLQELGARHFYDTGHADDCVGLELVVEPWIAGLWPALRKHFRSSRGQEEISGALPVASPASSRTDLVKSELLHIESQVELLRFDDSGRKDSEVLKQNAVNSNQSNVVIEDFESSLTRSVPPLSQASLNIPGLPPEYLQVHLQESLGQEESQVSVTSADPVFQVPISKAVQLTTNDAIKTTLLVELDISNTDFSYQPGDAFSVICPNSDSEVQSLLQRLQLEDKREHCVLLKIKADTKKKGATLPQHIPAGCSLQFIFTWCLEIRAIPKKAFLRALVDYTSDSAEKRRLQELCSKQGAADYSRFVRDACACLLDLLLAFPSCQPPLSLLLEHLPKLQPRPYSCASSSLFHPGKLHFVFNIVEFLSTATTEVLRKGVCTGWLALLVASVLQPNIHASHEDSGKALAPKISISPRTTNSFHLPDDPSIPIIMVGPGTGIAPFIGFLQHREKLQEQHPDGNFGAMWLFFGCRHKDRDYLFRKELRHFLKHGILTHLKVSFSRDAPVGEEEAPAKYVQDNIQLHGQQVARILLQENGHIYVCGDAKNMAKDVHDALVQIISKEVGVEKLEAMKTLATLKEEKRYLQDIWS

SEQ ID NO: 879355 - protein, 103 aa, Homo sapiens; identical to SEQ ID NO: 879349

SEQ ID NO: 879356 - protein, 555 aa, Homo sapiens
CLLRIHSEQDNQLEEGQEEISGALPVASPASSRTDLVKSELLHIESQVELLRFDDSGRKDSEVLKQNAVNSNQSNVVIEDFESSLTRSVPPLSQASLNIPGLPPEYLQVHLQESLGQEESQVSVTSADPVFQVPISKAVQLTTNDAIKTTLLVELDISNTDFSYQPGDAFSVICPNSDSEVQSLLQRLQLEDKREHCVLLKIKADTKKKGATLPQHIPAGCSLQFIFTWCLEIRAIPKKAFLRALVDYTSDSAEKRRLQELCSKQGAADYSRFVRDACACLLDLLLAFPSCQPPLSLLLEHLPKLQPRPYSCASSSLFHPGKLHFVFNIVEFLSTATTEVLRKGVCTGWLALLVASVLQPNIHASHEDSGKALAPKISISPRTTNSFHLPDDPSIPIIMVGPGTGIAPFIGFLQHREKLQEQHPDGNFGAMWLFFGCRHKDRDYLFRKELRHFLKHGILTHLKVSFSRDAPVGEEEAPAKYVQDNIQLHGQQVARILLQENGHIYVCGDAKNMAKDVHDALVQIISKEVGVEKLEAMKTLATLKEEKRYLQDIWS

SEQ ID NO: 879357 - protein, 157 aa, Homo sapiens; identical to SEQ ID NO: 879348

SEQ ID NO: 879358 - protein, 103 aa, Homo sapiens; identical to SEQ ID NO: 879349

SEQ ID NO: 879359 - protein, 103 aa, Homo sapiens; identical to SEQ ID NO: 879349

SEQ ID NO: 879360 - protein, 152 aa, Homo sapiens
LGTSIHTGTRAMAQTAIKAMHQAQTMEGCSSPMVVKFADTQKDKEQKRMAQQLQQQMQQISAASVWGNLAGLNTLGPQYLAVSLCGLLSADCASSQLFLLLLSLANKHSGIYNFWHIEIICKNSGSTISFSPVSLFLSIYICISGHASLVIS

SEQ ID NO: 879361 - protein, 486 aa, Homo sapiens
MNGTLDHPDQPDLDAIKMFVGQVPRTWSEKDLRELFEQYGAVYEINVLRDRSQNPPQSKGCCFVTFYTRKAALEAQNALHNMKVLPGMHHPIQMKPADSEKNNAVEDRKLFIGMISKKCTENDIRVMFSSFGQIEECRILRGPDGLSRGCAFVTFTTRAMAQTAIKAMHQAQTMEGCSSPMVVKFADTQKDKEQKRMAQQLQQQMQQISAASVWGNLAGLNTLGPQYLALYLQLLQQTASSGNLNTLSSLHPMGGLNAMQLQNLAALAAAASAAQNTPSGTNALTTSSSPLSVLTSSGSSPSSSSSNSVNPIASLGALQTLAGATAGLNVGSLAGMAALNGGLGSSGLSNGTGSTMEALTQAYSGIQQYAAAALPTLYNQNLLTQQSIGAAGSQKEGPEGANLFIYHLPQEFGDQDLLQMFMPFGNVVSAKVFIDKQTNLSKCFGFVSYDNPVSAQAAIQSMNGFQIGMKRLKVQLKRSKNDSKPY

SEQ ID NO: 879362 - protein, 486 aa, Homo sapiens; identical to SEQ ID NO: 879361

SEQ ID NO: 879363 - protein, 486 aa, Homo sapiens; identical to SEQ ID NO: 879361

SEQ ID NO: 879364 - protein, 178 aa, Homo sapiens
MNGTLDHPDQPDLDAIKMFVGQVPRTWSEKDLRELFEQYGAVYEINVLRDRSQNPPQSKGCCFVTFYTRKAALEAQNALHNMKVLPGMHHPIQMKPADSEKNNAVEDRKLFIGMISKKCTENDIRVMFSSFGQIEECRILRGPDGLSRGCAFVTFTTRAMAQTAIKAMHQAQTMEQPY

SEQ ID NO: 879365 - protein, 109 aa, Homo sapiens
MKEGIPAGFLLWGWQVAWYYAQGRSAWGKGQPGRGPVSGRLLNFLEGVIGWKEARNPSLRDCCAPHSLTAQSRLCWQEALRLPFLCIEKQCLPIYFAFNSKRSSGKTCG

SEQ ID NO: 879366 - protein, 189 aa, Homo sapiens
MGKEKTHINIVVIGHVDSGKSTTTGHLIYKCGGIDKRTIEKFEKEAAEMGKGSFKYAWVLDKLKAERERGITIDISLWKFETSKYYVTIIDAPGHRDFIKNMITGTSQADCAVLIVAAGVGEFEAGISKNGQTREHALLAYTLGVKQLIVGVNKMDSTEPPYSQKRYEEIVTVCGGFNGFETLERQLPF

SEQ ID NO: 879367 - protein, 184 aa, Homo sapiens
MNGTLDHPDQPDLDAIKMFVGQVPRTWSEKDLRELFEQYGAVYEINVLRDRSQNPPQSKGCCFVTFYTRKAALEAQNALHNMKVLPGMHHPIQMKPADSEKNNAVEDRKLFIGMISKKCTENDIRVMFSSFGQIEECRILRGPDGLSRGCAFRHLLTRAWTDGIRHAHSRPGSVESPEMQVTVY

SEQ ID NO: 879368 - protein, 486 aa, Homo sapiens; identical to SEQ ID NO: 879361

SEQ ID NO: 879369 - protein, 106 aa, Homo sapiens
TSGSLRIVVLLEARKEGPEGANLFIYHLPQEFGDQDLLQMFMPFGNVVSAKVFIDKQTNLSKCFGFVSYDNPVSAQAAIQSMNGFQIGMKRLKVQLKRSKNDSKPY

SEQ ID NO: 879370 - protein, 486 aa, Homo sapiens; identical to SEQ ID NO: 879361

SEQ ID NO: 879371 - protein, 486 aa, Homo sapiens; identical to SEQ ID NO: 879361

SEQ ID NO: 879372 - protein, 300 aa, Homo sapiens [sequence omitted]

SEQ ID NO: 879373 - protein, 113 aa, Homo sapiens
SCRIRQSHGYTHDSRAVKFLFEILSSFDNEQQRLFLQFVTGSPRLPVGGFRSLNPPLTIVRKTFESTENPDDFLPSVMTCVNYLKLPDYSSIEIMREKLLIAAREGQQSFHLS

SEQ ID NO: 879374 - protein, 1992 aa, Homo sapiens
MSNRPNNNPGGSLRRSQRNTAGAQPQDDSIGGRSCSSSSAVIVPQPEDPDRANTSERQKTGQVPKKDNSRGVKRSASPDYNRTNSPSSAKKPKALQHTESPSETNKPHSKSKKRHLDQEQQLKSAQSPSTSKAHTRKSGATGGSRSQKRKRTESSCVKSGSGSESTGAEERSAKPTKLASKSATSAKAGCSTITDSSSAASTSSSSSAVASASSTVPPGARVKQGKDQNKARRSRSASSPSPRRSSREKEQSKTGGSSKFDWAARFSPKVSLPKTKLSLPGSSKSETSKPGPSGLQAKLASLRKSTKKRSESPPAELPSLRRSTRQKTTGSCASTSRRGSGLGKRGAAEARRQEKMADPESNQEAVNSSAARTDEAPQGAAGAVGMTTSGESESDDSEMGRLQALLEARGLPPHLFGPLGPRMSQLFHRTIGSGASSKAQQLLQGLQASDESQQLQAVIEMCQLLVMGNEETLGGFPVKSVVPALITLLQMEHNFDIMNHACRALTYMMEALPRSSAVVVDAIPVFLEKLQVIQCIDVAEQALTALEMLSRRHSKAILQAGGLADCLLYLEFFSINAQRNALAIAANCCQSITPDEFHFVADSLPLLTQRLTHQDKKSVESTCLCFARLVDNFQHEENLLQQVASKDLLTNVQQLLVVTPPILSSGMFIMVVRMFSLMCSNCPTLAVQLMKQNIAETLHFLLCGASNGSCQEQIDLVPRSPQELYELTSLICELMPCLPKEGIFAVDTMLKKGNAQNTDGAIWQWRDDRGLWHPYNRIDSRIIEQINEDTGTARAIQRKPNPLANSNTSGYSESKKDDARAQLMKEDPELAKSFIKTLFGVLYEVYSSSAGPAVRHKCLRAILRIIYFADAELLKDVLKNHAVSSHIASMLSSQDLKIVVGALQMAEILMQKLPDIFSVYFRREGVMHQVKHLAESESLLTSPPKACTNGSGSMGSTTSVSSGTATAATHAAADLGSPSLQHSRDDSLDLSPQGRLSDVLKRKRLPKRGPRRPKYSPPRDDDKVDNQAKSPTTTQSPKSSFLASLNPKTWGRLSTQSNSNNIEPARTAGGSGLARAASKDTISNNREKIKGWIKEQAHKFVERYFSSENMDGSNPALNVLQRLCAATEQLNLQVDGGAECLVEIRSIVSESDVSSFEIQHSGFVKQLLLYLTSKSEKDAVSREIRLKRFLHVFFSSPLPGEEPIGRVEPVGNAPLLALVHKMNNCLSQMEQFPVKVHDFPSGNGTGGSFSLNRGSQALKFFNTHQLKCQLQRHPDCANVKQWKGGPVKIDPLALVQAIERYLVVRGYGRVREDDEDSDDDGSDEEIDESLAAQFLNSGNVRHRLQFYIGEHLLPYNMTVYQAVRQFSIQAEDERESTDDESNPLGRAGIWTKTHTIWYKPVREDEESNKDCVGGKRGRAQTAPTKTSPRNAKKHDELWHDGVCPSVSNPLEVYLIPTPPENITFEDPSLDVILLLRVLHAISRYWYYLYDNAMCKEIIPTSEFINSKLTAKANRQLQDPLVIMTGNIPTWLTELGKTCPFFFPFDTRQMLFYVTAFDRDRAMQRLLDTNPEINQSDSQDSRVAPRLDRKKRTVNREELLKQAESVMQDLGSSRAMLEIQYENEVGTGLGPTLEFYALVSQELQRADLGLWRGEEVTLSNPKGSQEGTKYIQNLQGLFALPFGRTAKPAHIAKVKMKFRFLGKLMAKAIMDFRLVDLPLGLPFYKWMLRQETSLTSHDLFDIDPVVARSVYHLEDIVRQKKRLEQDKSQTKESLQYALETLTMNGCSVEDLGLDFTLPGFPNIELKKGGKDIPVTIHNLEEYLRLVIFWALNEGVSRQFDSFRDGFESVFPLSHLQYFYPEELDQLLCGSKADTWDAKTLMECCRPDHGYTHDSRAVKFLFEILSSFDNEQQRLFLQFVTGSPRLPVGGFRSLNPPLTIVRKTFESTENPDDFLPSVMTCVNYLKLPDYSSIEIMREKLLIAAREGQQSFHLS

SEQ ID NO: 879375 - protein, 2032 aa, Homo sapiens
MSNRPNNNPGGSLRRSQRNTAGAQPQDDSIGGRSHLGQAKHKGYSPPESRKSNSKAPKVQSNTTSELSRGHLSKRSCSSSSAVIVPQPEDPDRANTSERQKTGQVPKKDNSRGVKRSASPDYNRTNSPSSAKKPKALQHTESPSETNKPHSKSKKRHLDQEQQLKSAQSPSTSKAHTRKSGATGGSRSQKRKRTESSCVKSGSGSESTGAEERSAKPTKLASKSATSAKAGCSTITDSSSAASTSSSSSAVASASSTVPPGARVKQGKDQNKARRSRSASSPSPRRSSREKEQRSSKSETSKPGPSGLQAKLASLRKSTKKRSESPPAELPSLRRSTRQKTTGSCASTSRRGSGLGKRGAAEARRQEKMADPESNQEAVNSSAARTDEAPQGAAGAVGMTTSGESESDDSEMGRLQALLEARGLPPHLFGPLGPRMSQLFHRTIGSGASSKAQQLLQGLQASDESQQLQAVIEMCQLLVMGNEETLGGFPVKSVVPALITLLQMEHNFDIMNHACRALTYMMEALPRSSAVVVDAIPVFLEKLQVIQCIDVAEQALTALEMLSRRHSKAILQAGGLADCLLYLEFFSINAQRNALAIAANCCQSITPDEFHFVADSLPLLTQRLTHQDKKSVESTCLCFARLVDNFQHEENLLQQVASKDLLTNVQQLLVVTPPILSSGMFIMVVRMFSLMCSNCPTLAVQLMKQNIAETLHFLLCGASNGSCQEQIDLVPRSPQELYELTSLICELMPCLPKEGIFAVDTMLKKGNAQNTDGAIWQWRDDRGLWHPYNRIDSRIIEAAHQVGEDEISLSTLGRVYTIDFNSMQQINEDTGTARAIQRKPNPLANSNTSGYSESKKDDARAQLMKEDPELAKSFIKTLFGVLYEVYSSSAGPAVRHKCLRAILRIIYFADAELLKDVLKNHAVSSHIASMLSSQDLKIVVGALQMAEILMQKLPDIFSVYFRREGVMHQVKHLAESESLLTSPPKACTNGSGSMGSTTSVSSGTATAATHAAADLGSPSLQHSRDDSLDLSPQGRLSDVLKRKRLPKRGPRRPKYSPPRDDDKVDNQAKSPTTTQSPKSSFLASLNPKTWGRLSTQSNSNNIEPARTAGGSGLARAASKDTISNNREKIKGWIKEQAHKFVERYFSSENMDGSNPALNVLQRLCAATEQLNLQVDGGAECLVEIRSIVSESDVSSFEIQHSGFVKQLLLYLTSKSEKDAVSREIRLKRFLHVFFSSPLPGEEPIGRVEPVGNAPLLALVHKMNNCLSQMEQFPVKVHDFPSGNGTGGSFSLNRGSQALKFFNTHQLKCQLQRHPDCANVKQWKGGPVKIDPLALVQAIERYLVVRGYGRVREDDEDSDDDGSDEEIDESLAAQFLNSGNVRHRLQFYIGEHLLPYNMTVYQAVRQFSIQAEDERESTDDESNPLGRAGIWTKTHTIWYKPVREDEESNKDCVGGKRGRAQTAPTKTSPRNAKKHDELWHDGVCPSVSNPLEVYLIPTPPENITFEDPSLDVILLLRVLHAISRYWYYLYDNAMCKEIIPTSEFINSKLTAKANRQLQDPLVIMTGNIPTWLTELGKTCPFFFPFDTRQMLFYVTAFDRDRAMQRLLDTNPEINQSDSQDSRVAPRLDRKKRTVNREELLKQAESVMQDLGSSRAMLEIQYENEVGTGLGPTLEFYALVSQELQRADLGLWRGEEVTLSNPKGSQEGTKYIQNLQGLFALPFGRTAKPAHIAKVKMKFRFLGKLMAKAIMDFRLVDLPLGLPFYKWMLRQETSLTSHDLFDIDPVVARSVYHLEDIVRQKKRLEQDKSQTKESLQYALETLTMNGCSVEDLGLDFTLPGFPNIELKKGGKDIPVTIHNLEEYLRLVIFWALNEGVSRQFDSFRDGFESVFPLSHLQYFYPEELDQLLCGSKADTWDAKTLMECCRPDHGYTHDSRAVKFLFEILSSFDNEQQRLFLQFVTGSPRLPVGGFRSLNPPLTIVRKTFESTENPDDFLPSVMTCVNYLKLPDYSSIEIMREKLLIAAREGQQSFHLS

SEQ ID NO: 879376 - protein, 1573 aa, Homo sapiens
GLAGEWRRLSVSCEFCLPAAHTELPYQAGNHNLYSHKASWCIRRQGLKIYLMNHACRALTYMMEALPRSSAVVVDAIPVFLEKLQVIQCIDVAEQALTALEMLSRRHSKAILQAGGLADCLLYLEFFSINAQRNALAIAANCCQSITPDEFHFVADSLPLLTQRLTHQDKKSVESTCLCFARLVDNFQHEENLLQQVASKDLLTNVQQLLVVTPPILSSGMFIMVVRMFSLMCSNCPTLAVQLMKQNIAETLHFLLCGASNGSCQEQIDLVPRSPQELYELTSLICELMPCLPKEGIFAVDTMLKKGNAQNTDGAIWQWRDDRGLWHPYNRIDSRIIEAAHQVGEDEISLSTLGRVYTIDFNSMQQINEDTGTARAIQRKPNPLANSNTSGYSESKKDDARAQLMKEDPELAKSFIKTLFGVLYEVYSSSAGPAVRHKCLRAILRIIYFADAELLKDVLKNHAVSSHIASMLSSQDLKIVVGALQMAEILMQKLPDIFSVYFRREGVMHQVKHLAESESLLTSPPKACTNGSGSMGSTTSVSSGTATAATHAAADLGSPSLQHSRDDSLDLSPQGRLSDVLKRKRLPKRGPRRPKYSPPRDDDKVDNQAKSPTTTQSPKSSFLASLNPKTWGRLSTQSNSNNIEPARTAGGSGLARAASKDTISNNREKIKGWIKEQAHKFVERYFSSENMDGSNPALNVLQRLCAATEQLNLQVDGGAECLVEIRSIVSESDVSSFEIQHSGFVKQLLLYLTSKSEKDAVSREIRLKRFLHVFFSSPLPGEEPIGRVEPVGNAPLLALVHKMNNCLSQMEQFPVKVHDFPSGNGTGGSFSLNRGSQALKFFNTHQLKCQLQRHPDCANVKQWKGGPVKIDPLALVQAIERYLVVRGYGRVREDDEDSDDDGSDEEIDESLAAQFLNSGNVRHRLQFYIGEHLLPYNMTVYQAVRQFSIQAEDERESTDDESNPLGRAGIWTKTHTIWYKPVREDEESNKDCVGGKRGRAQTAPTKTSPRNAKKHDELWHDGVCPSVSNPLEVYLIPTPPENITFEDPSLDVILLLRVLHAISRYWYYLYDNAMCKEIIPTSEFINSKLTAKANRQLQDPLVIMTGNIPTWLTELGKTCPFFFPFDTRQMLFYVTAFDRDRAMQRLLDTNPEINQSDSQDSRVAPRLDRKKRTVNREELLKQAESVMQDLGSSRAMLEIQYENEVGTGLGPTLEFYALVSQELQRADLGLWRGEEVTLSNPKGSQEGTKYIQNLQGLFALPFGRTAKPAHIAKVKMKFRFLGKLMAKAIMDFRLVDLPLGLPFYKWMLRQETSLTSHDLFDIDPVVARSVYHLEDIVRQKKRLEQDKSQTKESLQYALETLTMNGCSVEDLGLDFTLPGFPNIELKKGGKDIPVTIHNLEEYLRLVIFWALNEGVSRQFDSFRDGFESVFPLSHLQYFYPEELDQLLCGSKADTWDAKTLMECCRPDHGYTHDSRAVKFLFEILSSFDNEQQRLFLQFVTGSPRLPVGGFRSLNPPLTIVRKTFESTENPDDFLPSVMTCVNYLKLPDYSSIEIMREKLLIAAREGQQSFHLS

SEQ ID NO: 879377 - protein, 1805 aa, Homo sapiens
MSNRPNNNPGGSLRRSQRNTAGAQPQDDSIGGRSCSSSSAVIVPQPEDPDRANTSERQKTGQVPKKDNSRGVKRSASPDYNRTNSPSSAKKPKALQHTESPSETNKPHSKSKKRHLDQEQQLKSAQSPSTSKAHTRKSGATGGSRSQKRKRTESSCVKSGSGSESTGAEERSAKPTKLASKSATSAKAGCSTITDSSSAASTSSSSSAVASASSTVPPGARVKQGKDQNKARRSRSASSPSPRRSSREKEQRSSKSETSKPGPSGLQAKLASLRKSTKKRSESPPAELPSLRRSTRQKTTGSCASTSRRGSGLGKRGAAEARRQEKMADPESNQEAVNSSAARTDEAPQGAAGAVGMTTSGESESDDSEMGRLQALLEARGLPPHLFGPLGPRMSQLFHRTIGSGASSKAQQLLQGLQASDESQQLQAVIEMCQLLVMGNEETLGGFPVKSVVPALITLLQMEHNFDIMNHACRALTYMMEALPRSSAVVVDAIPVFLEKLQVIQCIDVAEQALTALEMLSRRHSKAILQAGGLADCLLYLEFFSINAQRNALAIAANCCQSITPDEFHFVADSLPLLTQRLTHQDKKSVESTCLCFARLVDNFQHEENLLQQVASKDLLTNVQQLLVVTPPILSSGMFIMVVRMFSLMCSNCPTLAVQLMKQNIAETLHFLLCGASNGSCQEQIDLVPRSPQELYELTSLICELMPCLPKEGIFAVDTMLKKGNAQNTDGAIWQWRDDRGLWHPYNRIDSRIIEAAHQVGEDEISLSTLGRVYTIDFNSMQQINEDTGTARAIQRKPNPLANSNTSGYSESKKDDARAQLMKEDPELAKSFIKTLFGVLYEVYSSSAGPAVRHKCLRAILRIIYFADAELLKDVLKNHAVSSHIASMLSSQDLKIVVGALQMAEILMQKLPDIFSVYFRREGVMHQVKHLAESESLLTSPPKACTNGSGSMGSTTSVSSGTATAATHAAADLGSPSLQHSRDDSLDLSPQGRLSDVLKRKLTAKTRAKKLPGEEPIGRVEPVGNAPLLALVHKMNNCLSQMEQFPVKVHDFPSGNGTGGSFSLNRGSQALKFFNTHQLKCQLQRHPDCANVKQWKGGPVKIDPLALVQAIERYLVVRGYGRVREDDEDSDDDGSDEEIDESLAAQFLNSGNVRHRLQFYIGEHLLPYNMTVYQAVRQFSIQAEDERESTDDESNPLGRAGIWTKTHTIWYKPVREDEESNKDCVGGKRGRAQTAPTKTSPRNAKKHDELWHDGVCPSVSNPLEVYLIPTPPENITFEDPSLDVILLLRVLHAISRYWYYLYDNAMCKEIIPTSEFINSKLTAKANRQLQDPLVIMTGNIPTWLTELGKTCPFFFPFDTRQMLFYVTAFDRDRAMQRLLDTNPEINQSDSQDSRVAPRLDRKKRTVNREELLKQAESVMQDLGSSRAMLEIQYENEVGTGLGPTLEFYALVSQELQRADLGLWRGEEVTLSNPKGSQEGTKYIQNLQGLFALPFGRTAKPAHIAKVKMKFRFLGKLMAKAIMDFRLVDLPLGLPFYKWMLRQETSLTSHDLFDIDPVVARSVYHLEDIVRQKKRLEQDKSQTKESLQYALETLTMNGCSVEDLGLDFTLPGFPNIELKKGGKDIPVTIHNLEEYLRLVIFWALNEGVSRQFDSFRDGFESVFPLSHLQYFYPEELDQLLCGSKADTWDAKTLMECCRPDHGYTHDSRAVKFLFEILSSFDNEQQRLFLQFVTGSPRLPVGGFRSLNPPLTIVRKTFESTENPDDFLPSVMTCVNYLKLPDYSSIEIMREKLLIAAREGQQSFHLS

SEQ ID NO: 879378 - protein, 500 aa, Homo sapiens [sequence omitted]

SEQ ID NO: 879379 - protein, 539 aa, Homo sapiens
DTSNTQYRLIACDPSFKSFTCYQSIQVIPVSTDSMYDNAMCKEIIPTSEFINSKLTAKANRQLQDPLVIMTGNIPTWLTELGKTCPFFFPFDTRQMLFYVTAFDRDRAMQRLLDTNPEINQSDSQDSRVAPRLDRKKRTVNREELLKQAESVMQDLGSSRAMLEIQYENEVGTGLGPTLEFYALVSQELQRADLGLWRGEEVTLSNPKGSQEGTKYIQNLQGLFALPFGRTAKPAHIAKVKMKFRFLGKLMAKAIMDFRLVDLPLGLPFYKWMLRQETSLTSHDLFDIDPVVARSVYHLEDIVRQKKRLEQDKSQTKESLQYALETLTMNGCSVEDLGLDFTLPGFPNIELKKGGKDIPVTIHNLEEYLRLVIFWALNEGVSRQFDSFRDGFESVFPLSHLQYFYPEELDQLLCGSKADTWDAKTLMECCRPDHGYTHDSRAVKFLFEILSSFDNEQQRLFLQFVTGSPRLPVGGFRSLNPPLTIVRKTFESTENPDDFLPSVMTCVNYLKLPDYSSIEIMREKLLIAAREGQQSFHLS

SEQ ID NO: 879380 - protein, 1990 aa, Homo sapiens
MSNRPNNNPGGSLRRSQRNTAGAQPQDDSIGGRSCSSSSAVIVPQPEDPDRANTSERQKTGQVPKKDNSRGVKRSASPDYNRTNSPSSAKKPKALQHTESPSETNKPHSKSKKRHLDQEQQLKSAQSPSTSKAHTRKSGATGGSRSQKRKRTESSCVKSGSGSESTGAEERSAKPTKLASKSATSAKAGCSTITDSSSAASTSSSSSAVASASSTVPPGARVKQGKDQNKARRSRSASSPSPRRSSREKEQRSSKSETSKPGPSGLQAKLASLRKSTKKRSESPPAELPSLRRSTRQKTTGSCASTSRRGSGLGKRGAAEARRQEKMADPESNQEAVNSSAARTDEAPQGAAGAVGMTTSGESESDDSEMGRLQALLEARGLPPHLFGPLGPRMSQLFHRTIGSGASSKAQQLLQGLQASDESQQLQAVIEMCQLLVMGNEETLGGFPVKSVVPALITLLQMEHNFDIMNHACRALTYMMEALPRSSAVVVDAIPVFLEKLQVIQCIDVAEQALTALEMLSRRHSKAILQAGGLADCLLYLEFFSINAQRNALAIAANCCQSITPDEFHFVADSLPLLTQRLTHQDKKSVESTCLCFARLVDNFQHEENLLQQVASKDLLTNVQQLLVVTPPILSSGMFIMVVRMFSLMCSNCPTLAVQLMKQNIAETLHFLLCGASNGSCQEQIDLVPRSPQELYELTSLICELMPCLPKEGIFAVDTMLKKGNAQNTDGAIWQWRDDRGLWHPYNRIDSRIIEAAHQVGEDEISLSTLGRVYTIDFNSMQQINEDTGTARAIQRKPNPLANSNTSGYSESKKDDARAQLMKEDPELAKSFIKTLFGVLYEVYSSSAGPAVRHKCLRAILRIIYFADAELLKDVLKNHAVSSHIASMLSSQDLKIVVGALQMAEILMQKLPDIFSVYFRREGVMHQVKHLAESESLLTSPPKACTNGSGSMGSTTSVSSGTATAATHAAADLGSPSLQHSRDDSLDLSPQGRLSDVLKRKRLPKRGPRRPKYSPPRDDDKVDNQAKSPTTTQSPKSSFLASLNPKTWGRLSTQSNSNNIEPARTAGGSGLARAASKDTISNNREKIKGWIKEQAHKFVERYFSSENMDGSNPALNVLQRLCAATEQLNLQVDGGAECLVEIRSIVSESDVSSFEIQHSGFVKQLLLYLTSKSEKDAVSREIRLKRFLHVFFSSPLPGEEPIGRVEPVGNAPLLALVHKMNNCLSQMEQFPVKVHDFPSGNGTGGSFSLNRGSQALKFFNTHQLKCQLQRHPDCANVKQWKGGPVKIDPLALVQAIERYLVVRGYGRVREDDEDSDDDGSDEEIDESLAAQFLNSGNVRHRLQFYIGEHLLPYNMTVYQAVRQFSIQAEDERESTDDESNPLGRAGIWTKTHTIWYKPVREDEESNKDCVGGKRGRAQTAPTKTSPRNAKKHDELWHDGVCPSVSNPLEVYLIPTPPENITFEDPSLDVILLLRVLHAISRYWYYLYDNAMCKEIIPTSEFINSKLTAKANRQLQDPLVIMTGNIPTWLTELGKTCPFFFPFDTRQMLFYVTAFDRDRAMQRLLDTNPEINQSDSQDSRVAPRLDRKKRTVNREELLKQAESVMQDLGSSRAMLEIQYENEVGTGLGPTLEFYALVSQELQRADLGLWRGEEVTLSNPKGSQEGTKYIQNLQGLFALPFGRTAKPAHIAKVKMKFRFLGKLMAKAIMDFRLVDLPLGLPFYKWMLRQETSLTSHDLFDIDPVVARSVYHLEDIVRQKKRLEQDKSQTKESLQYALETLTMNGCSVEDLGLDFTLPGFPNIELKKGGKDIPVTIHNLEEYLRLVIFWALNEGVSRQFDSFRDGFESVFPLSHLQYFYPEELDQLLCGSKADTWDAKTLMECCRPDHGYTHDSRAVKFLFEILSSFDNEQQRLFLQFVTGSPRLPVGGFRSLNPPLTIVRKTFESTENPDDFLPSVMTCVNYLKLPDYSSIEIMREKLLIAAREGQQSFHLS

SEQ ID NO: 879381 - protein, 140 aa, Homo sapiens
SVCFTSTKELIQFLRVEVLKMLSGKTLMECCRPDHGYTHDSRAVKFLFEILSSFDNEQQRLFLQFVTGSPRLPVGGFRSLNPPLTIVRKTFESTENPDDFLPSVMTCVNYLKLPDYSSIEIMREKLLIAAREGQQSFHLS

SEQ ID NO: 879382 - protein, 113 aa, Homo sapiens; identical to SEQ ID NO: 879373

SEQ ID NO: 879383 - protein, 1691 aa, Homo sapiens
MSNRPNNNPGGSLRRSQRNTAGAQPQDDSIGGRSCSSSSAVIVPQPEDPDRANTSERQKTGQVPKKDNSRGVKRSASPDYNRTNSPSSAKKPKALQHTESPSETNKPHSKSKKRHLDQEQQLKSAQSPSTSKAHTRKSGATGGSRSQKRKRTESSCVKSGSGSESTGAEERSAKPTKLASKSATSAKAGCSTITDSSSAASTSSSSSAVASASSTVPPGARVKQGKDQNKARRSRSASSPSPRRSSREKEQRSSKSETSKPGPSGLQAKLASLRKSTKKRSESPPAELPSLRRSTRQKTTGSCASTSRRGSGLGKRGAAEARRQEKMADPESNQEAVNSSAARTDEAPQGAAGAVGMTTSGESESDDSEMGRLQALLEARGLPPHLFGPLGPRMSQLFHRTIGSGASSKAQQLLQGLQASDESQQLQAVIEMCQLLVMGNEETLGGFPVKSVVPALITLLQMEHNFDIMNHACRALTYMMEALPRSSAVVVDAIPVFLEKLQVIQCIDVAEQALTALEMLSRRHSKAILQAGGLADCLLYLEFFSINAQRNALAIAANCCQSITPDEFHFVADSLPLLTQRLTHQDKKSVESTCLCFARLVDNFQHEENLLQQVASKDLLTNVQQLLVVTPPILSSGMFIMVVRMFSLMCSNCPTLAVQLMKQNIAETLHFLLCGASNGSCQEQIDLVPRSPQELYELTSLICELMPCLPKEGIFAVDTMLKKGNAQNTDGAIWQWRDDRGLWHPYNRIDSRIIEAAHQVGEDEISLSTLGRVYTIDFNSMQQINEDTGTARAIQRKPNPLANSNTSGYSESKKDDARAQLMKEDPELAKSFIKTLFGVLYEVYSSSAGPAVRHKCLRAILRIIYFADAELLKDVLKNHAVSSHIASMLSSQDLKIVVGALQMAEILMQKLPDIFSVYFRREGVMHQVKHLAESESLLTSPPKACTNGSGSMGSTTSVSSGTATAATHAAADLGSPSLQHSRDDSLDLSPQGRLSDVLKRKRLPKRGPRRPKYSPPRDDDKVDNQAKSPTTTQSPKSSFLASLNPKTWGRLSTQSNSNNIEPARTAGGSGLARAASKDTISNNREKIKGWIKEQAHKFVERYFSSENMDGSNPALNVLQRLCAATEQLNLQVDGGAECLVEIRSIVSESDVSSFEIQHSGFVKQLLLYLTSKSEKDAVSREIRLKRFLHVFFSSPLPGEEPIGRVEPVGNAPLLALVHKMNNCLSQMEQFPVKVHDFPSGNGTGGSFSLNRGSQALKFFNTHQLKCQLQRHPDCANVKQWKGGPVKIDPLALVQAIERYLVVRGYGRVREDDEDSDDDGSDEEIDESLAAQFLNSGNVRHRLQFYIGEHLLPYNMTVYQAVRQFSIQAEDERESTDDESNPLGRAGIWTKTHTIWYKPVREDEESNKDCVGGKRGRAQTAPTKTSPRNAKKHDELWHDGVCPSVSNPLEVYLIPTPPENITFEDPSLDVILLLRVLHAISRYWYYLYDNAMCKEIIPTSEFINSKLTAKANRQLQDPLVIMTGNIPTWLTELGKTCPFFFPFDTRQMLFYVTAFDRDRAMQRLLDTNPEINQSDSQDSRVAPRLDRKKRTVNREELLKQAESVMQDLGSSRAMLEIQYENEVGTGLGPTLEFYALVSQELQRADLGLWRGEEVTLSNPKGSQEGTKYIQNLQGLFALPFGRSFAWDTLGTS

SEQ ID NO: 879384 - protein, 1397 aa, Homo sapiens
MSNRPNNNPGGSLRRSQRNTAGAQPQDDSIGGRSCSSSSAVIVPQPEDPDRANTSERQKTGQVPKKDNSRGVKRSASPDYNRTNSPSSAKKPKALQHTESPSETNKPHSKSKKRHLDQEQQLKSAQSPSTSKAHTRKSGATGGSRSQKRKRTESSCVKSGSGSESTGAEERSAKPTKLASKSATSAKAGCSTITDSSSAASTSSSSSAVASASSTVPPGARVKQGKDQNKARRSRSASSPSPRRSSREKEQRSSKSETSKPGPSGLQAKLASLRKSTKKRSESPPAELPSLRRSTRQKTTGSCASTSRRGSGLGKRGAAEARRQEKMADPESNQEAVNSSAARTDEAPQGAAGAVGMTTSGESESDDSEMGRLQALLEARGLPPHLFGPLGPRMSQLFHRTIGSGASSKAQQLLQGLQASDESQQLQAVIEMCQLLVMGNEETLGGFPVKSVVPALITLLQMEHNFDIMNHACRALTYMMEALPRSSAVVVDAIPVFLEKLQVIQCIDVAEQALTALEMLSRRHSKAILQAGGLADCLLYLEFFSINAQRNALAIAANCCQSITPDEFHFVADSLPLLTQRLTHQDKKSVESTCLCFARLVDNFQHEENLLQQVASKDLLTNVQQLLVVTPPILSSGMFIMVVRMFSLMCSNCPTLAVQLMKQNIAETLHFLLCGASNGSCQEQIDLVPRSPQELYELTSLICELMPCLPKEGIFAVDTMLKKGNAQNTDGAIWQWRDDRGLWHPYNRIDSRIIEAAHQVGEDEISLSTLGRVYTIDFNSMQQINEDTGTARAIQRKPNPLANSNTSGYSESKKDDARAQLMKEDPELAKSFIKTLFGVLYEVYSSSAGPAVRHKCLRAILRIIYFADAELLKDVLKNHAVSSHIASMLSSQDLKIVVGALQMAEILMQKLPDIFSVYFRREGVMHQVKHLAESESLLTSPPKACTNGSGSMGSTTSVSSGTATAATHAAADLGSPSLQHSRDDSLDLSPQGRLSDVLKRKRLPKRGPRRPKYSPPRDDDKVDNQAKSPTTTQSPKSSFLASLNPKTWGRLSTQSNSNNIEPARTAGGSGLARAASKDTISNNREKIKGWIKEQAHKFVERYFSSENMDGSNPALNVLQRLCAATEQLNLQVDGGAECLVEIRSIVSESDVSSFEIQHSGFVKQLLLYLTSKSEKDAVSREIRLKRFLHVFFSSPLPGEEPIGRVEPVGNAPLLALVHKMNNCLSQMEQFPVKVHDFPSGNGTGGSFSLNRGSQALKFFNTHQLKCQLQRHPDCANVKQWKGGPVKIDPLALVQAIERYLVVRGYGRVREDDEDSDDDGSDEEIDESLAAQFLNSGNVRHRLQFYIGEHLLPYNMTVYQAVRQFSIQAEDERESTDDESNPLGRAGIWTKTHTIWQV

SEQ ID NO: 879385 - protein, 767 aa, Homo sapiens
MSNRPNNNPGGSLRRSQRNTAGAQPQDDSIGGRSCSSSSAVIVPQPEDPDRANTSERQKTGQVPKKDNSRGVKRSASPDYNRTNSPSSAKKPKALQHTESPSETNKPHSKSKKRHLDQEQQLKSAQSPSTSKAHTRKSGATGGSRSQKRKRTESSCVKSGSGSESTGAEERSAKPTKLASKSATSAKAGCSTITDSSSAASTSSSSSAVASASSTVPPGARVKQGKDQNKARRSRSASSPSPRRSSREKEQRSSKSETSKPGPSGLQAKLASLRKSTKKRSESPPAELPSLRRSTRQKTTGSCASTSRRGSGLGKRGAAEARRQEKMADPESNQEAVNSSAARTDEAPQGAAGAVGMTTSGESESDDSEMGRLQALLEARGLPPHLFGPLGPRMSQLFHRTIGSGASSKAQQLLQGLQASDESQQLQAVIEMCQLLVMGNEETLGGFPVKSVVPALITLLQMEHNFDIMNHACRALTYMMEALPRSSAVVVDAIPVFLEKLQVIQCIDVAEQALTALEMLSRRHSKAILQAGGLADCLLYLEFFSINAQRNALAIAANCCQSITPDEFHFVADSLPLLTQRLTHQDKKSVESTCLCFARLVDNFQHEENLLQQVASKDLLTNVQQLLVVTPPILSSGMFIMVVRMFSLMCSNCPTLAVQLMKQNIAETLHFLLCGASNGSCQEQIDLVPRSPQELYELTSLICELMPCLPKEGIFAVDTMLKKGNAQNTDGAIWQWRDDRGLWHPYNRIDSRIIEVVVSSYRLNVSI

SEQ ID NO: 879386 - protein, 160 aa, Homo sapiens
MSNRPNNNPGGSLRRSQRNTAGAQPQDDSIGGRSHLGQAKHKGYSPPESRKSNSKAPKVQSNTTSELSRGHLSKRSCSSSSAVIVPQPEDPDRANTSERQKTGQVPKKDNSRGVKRSASPDYNRTNSPSSAKKPKALQHTESPKKKAEKKERERIKRDRP

SEQ ID NO: 879387 - protein, 1990 aa, Homo sapiens; identical to SEQ ID NO: 879380

SEQ ID NO: 879388 - protein, 1990 aa, Homo sapiens; identical to SEQ ID NO: 879380

SEQ ID NO: 879389 - protein, 1087 aa, Homo sapiens
MWGITGRVPDIFSIYFRREGVMHQVKHLAESESLLTSPPKACTNGSGSMGSTTSVSSGTATAATHAAADLGSPSLQHSRDDSLDLSPQGRLSDVLKRKRLPKRGPRRPKYSPPRDDDKVDNQAKSPTTTQSPKSSFLASLNPKTWGRLSTQSNSNNIEPARTAGGSGLARAASKDTISNNREKIKGWIKEQAHKFVERYFSSENMDGSNPALNVLQRLCAATEQLNLQVDGGAECLVEIRSIVSESDVSSFEIQHSGFVKQLLLYLTSKSEKDAVSREIRLKRFLHVFFSSPLPGEEPIGRVEPVGNAPLLALVHKMNNCLSQMEQFPVKVHDFPSGNGTGGSFSLNRGSQALKFFNTHQLKCQLQRHPDCANVKQWKGGPVKIDPLALVQAIERYLVVRGYGRVREDDEDSDDDGSDEEIDESLAAQFLNSGNVRHRLQFYIGEHLLPYNMTVYQAVRQFSIQAEDERESTDDESNPLGRAGIWTKTHTIWYKPVREDEESNKDCVGGKRGRAQTAPTKTSPRNAKKHDELWHDGVCPSVSNPLEVYLIPTPPENITFEDPSLDVILLLRVLHAISRYWYYLYDNAMCKEIIPTSEFINSKLTAKANRQLQDPLVIMTGNIPTWLTELGKTCPFFFPFDTRQMLFYVTAFDRDRAMQRLLDTNPEINQSDSQDSRVAPRLDRKKRTVNREELLKQAESVMQDLGSSRAMLEIQYENEVGTGLGPTLEFYALVSQELQRADLGLWRGEEVTLSNPKGSQEGTKYIQNLQGLFALPFGRTAKPAHIAKVKMKFRFLGKLMAKAIMDFRLVDLPLGLPFYKWMLRQETSLTSHDLFDIDPVVARSVYHLEDIVRQKKRLEQDKSQTKESLQYALETLTMNGCSVEDLGLDFTLPGFPNIELKKGGKDIPVTIHNLEEYLRLVIFWALNEGVSRQFDSFRDGFESVFPLSHLQYFYPEELDQLLCGSKADTWDAKTLMECCRPDHGYTHDSRAVKFLFEILSSFDNEQQRLFLQFVTGSPRLPVGGFRSLNPPLTIVRKTFESTENPDDFLPSVMTCVNYLKLPDYSSIEIMREKLLIAAREGQQSFHLS

SEQ ID NO: 879390 - protein, 1935 aa, Homo sapiens
MSNRPNNNPGGSLRRSQRNTAGAQPQDDSIGGRSCSSSSAVIVPQPEDPDRANTSERQKTGQVPKKDNSRGVKRSASPDYNRTNSPSSAKKPKALQHTESPSETNKPHSKSKKRHLDQEQQLKSAQSPSTSKAHTRKSGATGGSRSQKRKRTESSCVKSGSGSESTGAEERSAKPTKLASKSATSAKAGCSTITDSSSAASTSSSSSAVASASSTVPPGARVKQGKDQNKARRSRSASSPSPRRSSREKEQRSSKSETSKPGPSGLQAKLASLRKSTKKRSESPPAELPSLRRSTRQKTTGSCASTSRRGSGLGKRGAAEARRQEKMADPESNQEAVNSSAARTDEAPQGAAGAVGMTTSGESESDDSEMGRLQALLEARGLPPHLFGPLGPRMSQLFHRTIGSGASSKAQQLLQGLQASDESQQLQAVIEMCQLLVMGNEETLGGFPVKSVVPALITLLQMEHNFDIMNHACRALTYMMEALPRSSAVVVDAIPVFLEKLQVIQCIDVAEQALTALEMLSRRHSKAILQAGGLADCLLYLEFFSINAQRNALAIAANCCQSITPDEFHFVADSLPLLTQRLTHQDKKSVESTCLCFARLVDNFQHEENLLQQVASKDLLTNVQQLLVVTPPILSSGMFIMVVRMFSLMCSNCPTLAVQLMKQNIAETLHFLLCGASNGSCQEQIDLVPRSPQELYELTSLICELMPCLPKEGIFAVDTMLKKGNAQNTDGAIWQWRDDRGLWHPYNRIDSRIIEAAHQVGEDEISLSTLGRVYTIDFNSMQQINEDTGTARAIQRKPNPLANSNTSGYSESKKDDARAQLMKEDPELAKSFIKTLFGVLYEVYSSSAGPAVRHKCLRAILRIIYFADAELLKDVLKNHAVSSHIASMLSSQDLKIVVGALQMAEILMQKLPDIFSVYFRREGVMHQVKHLAESESLLTSPPKACTNGSGSMGSTTSVSSGTATAATHAAADLGSPSLQHSRDDSLDLSPQGRLSDVLKRKRLPKRGPRRPKYSPPRDDDKVDNQAKSPTTTQSPKSSFLASLNPKTWGRLSTQSNSNNIEPARTAGGSGLARAASKDTISNNREKIKGWIKEQAHKFVERYFSSENMDGSNPALNVLQRLCAATEQLNLQVDGGAECLVEIRSIVSESDVSSFEIQHSGFVKQLLLYLTSKSEKDAVSREIRLKRFLHVFFSSPLPGEEPIGRVEPVGNAPLLALVHKMNNCLSQMEQFPVKVHDFPSGNGTGGSFSLNRGSQALKFFNTHQLKCQLQRHPDCANVKQWKGGPVKIDPLALVQAIERYLVVRGYGRVREDDEDSDDDGSDEEIDESLAAQFLNSGNVRHRLQFYIGEHLLPYNMTVYQAVRQFSIQAEDERESTDDESNPLGRAGIWTKTHTIWYKPVREDEESNKDCVGGKRGRAQTAPTKTSPRNAKKHDELWHDGVCPSVSNPLEVYLIPTPPENITFEDPSLDVILLLRVLHAISRYWYYLYDNAMCKEIIPTSEFINSKLTAKANRQLQDPLVIMTGNIPTWLTELGKTCPFFFPFDTRQMLFYVTAFDRDRAMQRLLDTNPEINQSDSQDSRVAPRLDRKKRTVNREELLKQAESVMQDLGSSRAMLEIQYENEVGTGLGPTLEFYALVSQELQRADLGLWRGEEVTLSNPKGSQEGTKYIQNLQGLFALPFGRTAKPAHIAKVKMKFRFLGKLMAKAIMDFRLVDLPLGLPFYKWMLRQETSLTSHDLFDIDPVVARSVYHLEDIVRQKKRLEQDKSQLVIFWALNEGVSRQFDSFRDGFESVFPLSHLQYFYPEELDQLLCGSKADTWDAKTLMECCRPDHGYTHDSRAVKFLFEILSSFDNEQQRLFLQFVTGSPRLPVGGFRSLNPPLTIVRKTFESTENPDDFLPSVMTCVNYLKLPDYSSIEIMREKLLIAAREGQQSFHLS

SEQ ID NO: 879391 - protein, 299 aa, Homo sapiens
SEDPFDGGHLMAKAIMDVRYVDLPLGLPFYKWMLRQETSLTSHDLFDIDPVVARSVYHLEDIVRQKKRLEQDKSQTKESLQYALETLTMNGCSVEDLGLDFTLPGFPNIELKKGGKDIPVTIHNLEEYLRLVIFWALNEGVSRQFDSFRDGFESVFPLSHLQYFYPEELDQLLCGSKADTWDAKTLMECCRPDHGYTHDSRAVKFLFEILSSFDNEQQRLFLQFVTGSPRLPVGGFRSLNPPLTIVRKTFESTENPDDFLPSVMTCVNYLKLPDYSSIEIMREKLLIAAREGQQSFHLS

SEQ ID NO: 879392 - protein, 392 aa, Homo sapiens
DYLIPTQKSLHARSRAMQRLLDTNPEINQSDSQDSRVAPRLDRKKRTVNREELLKQAESVMQDLGSSRAMLEIQYENEVGTGLGPTLEFYALVSQELQRADLGLWRGEEVTLSNPKGSQEGTKYIQNLQGLFALPFGRTAKPAHIAKVKMKFRFLGKLMAKAIMDFRLVDLPLGLPFYKWMLRQETSLTSHDLFDIDPVVARSVYHLEDIVRQKKRLEQDKSQLVIFWALNEGVSRQFDSFRDGFESVFPLSHLQYFYPEELDQLLCGSKADTWDAKTLMECCRPDHGYTHDSRAVKFLFEILSSFDNEQQRLFLQFVTGSPRLPVGGFRSLNPPLTIVRKTFESTENPDDFLPSVMTCVNYLKLPDYSSIEIMREKLLIAAREGQQSFHLS

SEQ ID NO: 879393 - protein, 1829 aa, Homo sapiens
MSNRPNNNPGGSLRRSQRNTAGAQPQDDSIGGRSCSSSSAVIVPQPEDPDRANTSERQKTGQVPKKDNSRGVKRSASPDYNRTNSPSSAKKPKALQHTESPSETNKPHSKSKKRHLDQEQQLKSAQSPSTSKAHTRKSGATGGSRSQKRKRTESSCVKSGSGSESTGAEERSAKPTKLASKSATSAKAGCSTITDSSSAASTSSSSSAVASASSTVPPGARVKQGKDQNKARRSRSASSPSPRRSSREKEQRSSKSETSKPGPSGLQAKLASLRKSTKKRSESPPAELPSLRRSTRQKTTGSCASTSRRGSGLGKRGAAEARRQEKMADPESNQEAVNSSAARTDEAPQGAAGAVGMTTSGESESDDSEMGRLQALLEARGLPPHLFGPLGPRMSQLFHRTIGSGASSKAQQLLQGLQASDESQQLQAVIEMCQLLVMGNEETLGGFPVKSVVPALITLLQMEHNFDIMNHACRALTYMMEALPRSSAVVVDAIPVFLEKLQVIQCIDVAEQALTALEMLSRRHSKAILQAGGLADCLLYLEFFSINAQRNALAIAANCCQSITPDEFHFVADSLPLLTQRLTHQDKKSVESTCLCFARLVDNFQHEENLLQQVASKDLLTNVQQLLVVTPPILSSGMFIMVVRMFSLMCSNCPTLAVQLMKQNIAETLHFLLCGASNGSCQEQIDLVPRSPQELYELTSLICELMPCLPKEGIFAVDTMLKKGNAQNTDGAIWQWRDDRGLWHPYNRIDSRIIEAAHQVGEDEISLSTLGRVYTIDFNSMQQINEDTGTARAIQRKPNPLANSNTSGYSESKKDDARAQLMKEDPELAKSFIKTLFGVLYEVYSSSAGPAVRHKCLRAILRIIYFADAELLKDVLKNHAVSSHIASMLSSQDLKIVVGALQMAEILMQKLPDIFSVYFRREGVMHQVKHLAESESLLTSPPKACTNGSGSMGSTTSVSSGTATAATHAAADLGSPSLQHSRDDSLDLSPQGRLSDVLKRKRLPKRGPRRPKYSPPRDDDKVDNQAKSPTTTQSPKSSFLASLNPKTWGRLSTQSNSNNIEPARTAGGSGLARAASKDTISNNREKIKGWIKEQAHKFVERYFSSENMDGSNPALNVLQRLCAATEQLNLQVDGGAECLVEIRSIVSESDVSSFEIQHSGFVKQLLLYLTSKSEKDAVSREIRLKRFLHVFFSSPLPGEEPIGRVEPVGNAPLLALVHKMNNCLSQMEQFPVKVHDFPSGNGTGGSFSLNRGSQALKFFNTHQLKCQLQRHPDCANVKQWKGGPVKIDPLALVQAIERYLVVRGYGRVREDDEDSDDDGSDEEIDESLAAQFLNSGNVRHRLQFYIGEHLLPYNMTVYQAVRQFSIQAEDERESTDDESNPLGRAGIWTKTHTIWYKPVREDEESNKDCVGGKRGRAQTAPTKTSPRNAKKHDELWHDGVCPSVSNPLEVYLIPTPPENITFEDPSLDVILLLRVLHAISRYWYYLYDNAMCKEIIPTSEFINSKLTAKANRQLQDPLVIMTGNIPTWLTELGKTCPFFFPFDTRQMLFYVTAFDRDRAMQRLLDTNPEINQSDSQDSRVAPRLDRKKRTVNREELLKQAESVMQDLGSSRAMLEIQYENEVGTGLGPTLEFYALVSQELQRADLGLWRGEEVTLSNPKGSQEGTKYIQNLQGLFALPFGRTAKPAHIAKVKMKFRFLGKLMAKAIMDFRLVDLPLGLPFYKWMLRQETSLTSHDLFDIDPVVARSVYHLEDIVRQKKRLEQDKSQTKESLQYALETLTMNGCSVEDLGLDFTLPGFPNIELKKGGKDIPVTIHNLEEYLRVCNCVFGG

SEQ ID NO: 879394 - protein, 1595 aa, Homo sapiens
MSNRPNNNPGGSLRRSQRNTAGAQPQDDSIGGRSCSSSSAVIVPQPEDPDRANTSERQKTGQVPKKDNSRGVKRSASPDYNRTNSPSSAKKPKALQHTESPSETNKPHSKSKKRHLDQEQQLKSAQSPSTSKAHTRKSGATGGSRSQKRKRTESSCVKSGSGSESTGAEERSAKPTKLASKSATSAKAGCSTITDSSSAASTSSSSSAVASASSTVPPGARVKQGKDQNKARRSRSASSPSPRRSSREKEQRSSKSETSKPGPSGLQAKLASLRKSTKKRSESPPAELPSLRRSTRQKTTGSCASTSRRGSGLGKRGAAEARRQEKMADPESNQEAVNSSAARTDEAPQGAAGAVGMTTSGESESDDSEMGRLQALLEARGLPPHLFGPLGPRMSQLFHRTIGSGASSKAQQLLQGLQASDESQQLQAVIEMCQLLVMGNEETLGGFPVKSVVPALITLLQMEHNFDIMNHACRALTYMMEALPRSSAVVVDAIPVFLEKLQVIQCIDVAEQALTALEMLSRRHSKAILQAGGLADCLLYLEFFSINAQRNALAIAANCCQSITPDEFHFVADSLPLLTQRLTHQDKKSVESTCLCFARLVDNFQHEENLLQQVASKDLLTNVQQLLVVTPPILSSGMFIMVVRMFSLMCSNCPTLAVQLMKQNIAETLHFLLCGASNGSCQEQIDLVPRSPQELYELTSLICELMPCLPKEGIFAVDTMLKKGNAQNTDGAIWQWRDDRGLWHPYNRIDSRIIEAAHQVGEDEISLSTLGRVYTIDFNSMQQINEDTGTARAIQRKPNPLANSNTSGYSESKKDDARAQLMKEDPELAKSFIKTLFGVLYEVYSSSAGPAVRHKCLRAILRIIYFADAELLKDVLKNHAVSSHIASMLSSQDLKIVVGALQMAEILMQKLPDIFSVYFRREGVMHQVKHLAESESLLTSPPKACTNGSGSMGSTTSVSSGTATAATHAAADLGSPSLQHSRDDSLDLSPQGRLSDVLKRKRLPKRGPRRPKYSPPRDDDKVDNQAKSPTTTQSPKSSFLASLNPKTWGRLSTQSNSNNIEPARTAGGSGLARAASKDTISNNREKIKGWIKEQAHKFVERYFSSENMDGSNPALNVLQRLCAATEQLNLQVDGGAECLVEIRSIVSESDVSSFEIQHSGFVKQLLLYLTSKSEKDAVSREIRLKRFLHVFFSSPLPGEEPIGRVEPVGNAPLLALVHKMNNCLSQMEQFPVKVHDFPSGNGTGGSFSLNRGSQALKFFNTHQLKCQLQRHPDCANVKQWKGGPVKIDPLALVQAIERYLVVRGYGRVREDDEDSDDDGSDEEIDESLAAQFLNSGNVRHRLQFYIGEHLLPYNMTVYQAVRQFSIQAEDERESTDDESNPLGRAGIWTKTHTIWYKPVREDEESNKDCVGGKRGRAQTAPTKTSPRNAKKHDELWHDGVCPSVSNPLEVYLIPTPPENITFEDPSLDVILLLRVLHAISRYWYYLYDNAMCKEIIPTSEFINSKLTAKANRQLQDPLVIMTGNIPTWLTELGKTCPFFFPFDTRQMLFYVTAFDRDRAMQRLLDTNPEINQSDSQDSRVAPRLDRKKLLTDCDS

SEQ ID NO: 879395 - protein, 553 aa, Homo sapiens
MSNRPNNNPGGSLRRSQRNTAGAQPQDDSIGGRSCSSSSAVIVPQPEDPDRANTSERQKTGQVPKKDNSRGVKRSASPDYNRTNSPSSAKKPKALQHTESPSETNKPHSKSKKRHLDQEQQLKSAQSPSTSKAHTRKSGATGGSRSQKRKRTESSCVKSGSGSESTGAEERSAKPTKLASKSATSAKAGCSTITDSSSAASTSSSSSAVASASSTVPPGARVKQGKDQNKARRSRSASSPSPRRSSREKEQRSSKSETSKPGPSGLQAKLASLRKSTKKRSESPPAELPSLRRSTRQKTTGSCASTSRRGSGLGKRGAAEARRQEKMADPESNQEAVNSSAARTDEAPQGAAGAVGMTTSGESESDDSEMGRLQALLEARGLPPHLFGPLGPRMSQLFHRTIGSGASSKAQQLLQGLQASDESQQLQAVIEMCQLLVMGNEETLGGFPVKSVVPALITLLQMEHNFDIMNHACRALTYMMEALPRSSAVVVDAIPVFLEKVILLLPRLFKSRHRESSFKLLNFSFHFLNKVYFLAREMFYVQQINSLKVKINH

SEQ ID NO: 879396 - protein, 153 aa, Homo sapiens
MCVSTSPSDSVLTRSRNQVSPSDLKLCPCFGYKTLTCTDTHTRTHCLSGWECPRTGPVSFSLPAHLCLPTASAWHTEMVVPQVGKVGVAVRDHEPGALQDSKPRSLYPDEGLFPPCSCRPRPLLPLSKNLNVRTREGRGGLLTASPSEPRLPN

SEQ ID NO: 879397 - protein, 51 aa, Homo sapiens
MLDSYINAFTREPKINNSMNRRPGVFNHSIQTTEMIRVHRYLGEVRGLTAD

SEQ ID NO: 879398 - protein, 595 aa, Homo sapiens
MSFRDLRNFTEMMRALGYPRHISMENFRTPNFGLVSEVLLWLVKRYEPQTDIPPDVDTEQDRVFFIKAIAQFMATKAHIKLNTKKLYQADGYAVKELLKITSVLYNAMKTKGMEGSEIVEEDVNKFKFDLGSKIADLKAARQLASEITSKGASLYDLLGMEVELREMRTEAIARPLEINETEKVMRIAIKEILTQVQKTKDLLNNVASDEANLEAKIEKRKLELERNRKRLETLQSVRPCFMDEYEKTEEELQKQYDTYLEKFQNLTYLEQQLEDHHRMEQERFEEAKNTLCLIQNKLKEEEKRLLKSGSNDDSDIDIQEDDESDSELEERRLPKPQTAMEMLMQGRPGKRIVGTMQGGDSDDNVSPPLPSVVLCTLGLAVPKMGVAELLSAAREPSMVSPAVPRCVAGFGLMRLWTLRCSWMAHLFSSECACSAFFAFSLFFPFSLSKDGSSTSLLGKCKTSSSKKQVGFLFCLMCLWVSVSPPGASQGPLPRSDASSLLGKKATQKRSCGDSGITEGPCAKVEAQARSLEAGKAQAGPSSGPGPPPRNEGGRRGPGSGPTPLPVLCWGRNGEAALSPDQALEVPGMRLRHKLP

SEQ ID NO: 879399 - protein, 419 aa, Homo sapiens
RHPELHLHPFCRADFTEMMRALGYPRHISMENFRTPNFGLVSEVLLWLVKRYEPQTDIPPDVDTEQDRVFFIKAIAQFMATKAHIKLNTKKLYQADGYAVKELLKITSVLYNAMKTKGMEGSEIVEEDVNKFKFDLGSKIADLKAARQLASEITSKGASLYDLLGMEVELREMRTEAIARPLEINETEKVMRIAIKEILTQVQKTKDLLNNVASDEANLEAKIEKRKLELERNRKRLETLQSVRPCFMDEYEKTEEELQKQYDTYLEKFQNLTYLEQQLEDHHRMEQERFEEAKNTLCLIQNKLKEEEKRLLKSGSNDDSDIDIQEDDESDSELEERRLPKPQTAMEMLMQGRPGKRIVGTMQGGDSDDNEDSEESEIDMEDDDDEDDDLEDESISLSPTKPNRRVRKSEPLDESDNDF

SEQ ID NO: 879400 - protein, 398 aa, Homo sapiens
RAGPVIAEGRAVATLGSWGPERYVFPRPPQYEPQTDIPPDVDTEQDRVFFIKAIAQFMATKAHIKLNTKKLYQADGYAVKELLKITSVLYNAMKTKGMEGSEIVEEDVNKFKFDLGSKIADLKAARQLASEITSKGASLYDLLGMEVELREMRTEAIARPLEINETEKVMRIAIKEILTQVQKTKDLLNNVASDEANLEAKIEKRKLELERNRKRLETLQSVRPCFMDEYEKTEEELQKQYDTYLEKFQNLTYLEQQLEDHHRMEQERFEEAKNTLCLIQNKLKEEEKRLLKSGSNDDSDIDIQEDDESDSELEERRLPKPQTAMEMLMQGRPGKRIVGTMQGGDSDDNEDSEESEIDMEDDDDEDDDLEDESISLSPTKPNRRVRKSEPLDESDNDF

SEQ ID NO: 879401 - protein, 413 aa, Homo sapiens
MSFRDLRNFTEMMRALGYPRHISMENFRTPNFGLVSEVLLWLVKRYEPQTDIPPDVDTEQDRVFFIKAIAQFMATKAHIKLNTKKLYQADGYAVKELLKITSVLYNAMKTKGMEGSEIVEEDVNKFKFDLGSKIADLKAARQLASEITSKGASLYDLLGMEVELREMRTEAIARPLEINETEKVMRIAIKEILTQVQKTKDLLNNVASDEANLEAKIEKRKLELERNRKRLETLQSVRPCFMDEYEKTEEELQKQYDTYLEKFQNLTYLEQQLEDHHRMEQERFEEAKNTLCLIQNKLKEEEKRLLKSGSNDDSDIDIQEDDESDSELEERRLPKPQTAMEMLMQGRPGKRIVGTMQGGDSDDNEDSEESEIDMEDDDDEDDDLEDESISLSPTKPNRRVRKSEPLDESDNDF

SEQ ID NO: 879402 - protein, 247 aa, Homo sapiens
MRTEAIARPLEINETEKVMRIAIKEILTQVQKTKDLLNNVASDEANLEAKIEKRKLELERNRKRLETLQSVRPCFMDEYEKTEEELQKQYDTYLEKFQNLTYLEQQLEDHHRMEQERFEEAKNTLCLIQNKLKEEEKRLLKSGSNDDSDIDIQEDDESDSELEERRLPKPQTAMEMLMQGRPGKRIVGTMQGGDSDDNEDSEESEIDMEDDDDEDDDLEDESISLSPTKPNRRVRKSEPLDESDNDF

SEQ ID NO: 879403 - protein, 94 aa, Homo sapiens
LACSGLEVELREMRTEAIARPLEINETEKVMRIAIKEILTQVQKTKDLLNNVASDEANLEAKIEKRKLELERNRKRLETLQSVRPCFMDEYEKT

SEQ ID NO: 879404 - protein, 338 aa, Homo sapiens
RAGPVIAEGRAVATLGSWGPERYVFPRPPQYEPQTDIPPDVDTEQDRVFFIKAIAQFMIADLKAARQLASEITSKGASLYDLLGMEVELREMRTEAIARPLEINETEKVMRIAIKEILTQVQKTKDLLNNVASDEANLEAKIEKRKLELERNRKRLETLQSVRPCFMDEYEKTEEELQKQYDTYLEKFQNLTYLEQQLEDHHRMEQERFEEAKNTLCLIQNKLKEEEKRLLKSGSNDDSDIDIQEDDESDSELEERRLPKPQTAMEMLMQGRPGKRIVGTMQGGDSDDNEDSEESEIDMEDDDDEDDDLEDESISLSPTKPNRRVRKSEPLDESDNDF

SEQ ID NO: 879405 - protein, 432 aa, Homo sapiens
MSFRDLRNFTEMMRALGYPRHISMENFRTPNFGLVSEVLLWLVKRYEPQTDIPPDVDTEQDRVFFIKAIAQFMATKAHIKLNTKKLYQADGYAVKELLKITSVLYNAMKTKGMEGSEIVEEDVNKFKFDLGSKIADLKAARQLASEITSKGASLYDLLGMEVELREMRTEAIARPLEINETEKVMRIAIKEILTQVQKTKDLLNNVASDEANLEAKIEKRKLELERNRKRLETLQSVRPCFMDEYEKTEEELQKQYDTYLEKFQNLTYLEQQLEDHHRMEQERFEEAKNTLCLIQNKLKEEEKRLLKSGSNDDSDIDIQEDDESDSELEERRLPKPQTAMEMLMQGRPGKRIVGTMQGGDSDDNMEAAPALLGKCKTSSSKKQEDSEESEIDMEDDDDEDDDLEDESISLSPTKPNRRVRKSEPLDESDNDF

SEQ ID NO: 879406 - protein, 291 aa, Homo sapiens
MSFRDLRNFTEMMRALGYPRHISMENFRTPNFGLVSEVLLWLVKRYEPQTDIPPDVDTEQDRVFFIKAIAQFMATKAHIKLNTKKLYQADGYAVKELLKITSVLYNAMKTKGMEGSEIVEEDVNKFKFDLGSKIADLKAARQLASEITSKGASLYDLLGMEVELREMRTEAIARPLEINETEKVMRIAIKEILTQVQKTKDLLNNVASDEANLEAKIEKRKLELERNRKRLETLQSVRPCFMDEYEKTEEELQKQYDTYLEKFQNLTYLEQQLEDHHRMEQERFEVTMTRT

SEQ ID NO: 879407 - protein, 452 aa, Homo sapiens
MWQLTSLLLFVATWGISGTPAPLDSVFSSSERAHQVLRIRKRANSFLEELRHSSLERECIEEICDFEEAKEIFQNVDDTGDQCLVLPLEHPCASLCCGHGTCIDGIGSFSCDCRSGWEGRFCQREVSFLNCSLDNGGCTHYCLEEVGWRRCSCAPGYKLGDDLLQCHPAVKFPCGRPWKRMEKKRSHLKRDTEDQEDQVDPRLIDGKMTRRGDSPWQVVLLDSKKKLACGAVLIHPSWVLTAAHCMDESKKLLVRLGEYDLRRWEKWELDLDIKEVFVHPNYSKSTTDNDIALLHLAQPATLSQTIVPICLPDSGLAERELNQAGQETLVTGWGYHSSREKEAKRNRTFVLNFIKIPVVPHNECSEVMSNMVSENMLCAGILGDRQDACEGDSGGPMVASFHGTWFLVGLVSWGEGCGLLHNYGVYTKVSRYLDWIHGHIRDKEAPQKSWAP

SEQ ID NO: 879408 - protein, 227 aa, Homo sapiens
CRGGGGGGLSWRQDGELAVSPRPAPTGASASRMWQLTSLLLFVATWGISGTPAPLDSVFSSSERAHQVLRIRKRANSFLEELRHSSLERECIEEICDFEEAKEIFQNVDDTTVTSAWSCPWSTRAPACAAGTARASTASAASAATAAAAGRAASASAVRGRGGCWRAAGRGWGRVGAWPRVVYFYVDDTTGVKVPMYVQSISHQIPLLMRSLLCQLAAHHPPSPNGD

SEQ ID NO: 879409 - protein, 229 aa, Homo sapiens
CRGGGGGGLSWRQDGELAVSPRPAPTGASASRMWQLTSLLLFVATWGISGTPAPLDSVFSSSERAHQVLRIRKRANSFLEELRHSSLERECIEEICDFEEAKEIFQNVDDTLAFWSKHVDGDQCLVLPLEHPCASLCCGHGTCIDGIGSFSCDCRSGWEGRFCQRGEERTHSYRDDYGIIWATWDTRRHSMNNPLYEDYPMNRLTIGGQYDSLVGALHAGDAAPPISSA

SEQ ID NO: 879410 - protein, 461 aa, Homo sapiens
MWQLTSLLLFVATWGISGTPAPLDSVFSSSERAHQVLRIRKRANSFLEELRHSSLERECIEEICDFEEAKEIFQNVDDTLAFWSKHVDGDQCLVLPLEHPCASLCCGHGTCIDGIGSFSCDCRSGWEGRFCQREVSFLNCSLDNGGCTHYCLEEVGWRRCSCAPGYKLGDDLLQCHPAVKFPCGRPWKRMEKKRSHLKRDTEDQEDQVDPRLIDGKMTRRGDSPWQVVLLDSKKKLACGAVLIHPSWVLTAAHCMDESKKLLVRLGEYDLRRWEKWELDLDIKEVFVHPNYSKSTTDNDIALLHLAQPATLSQTIVPICLPDSGLAERELNQAGQETLVTGWGYHSSREKEAKRNRTFVLNFIKIPVVPHNECSEVMSNMVSENMLCAGILGDRQDACEGDSGGPMVASFHGTWFLVGLVSWGEGCGLLHNYGVYTKVSRYLDWIHGHIRDKEAPQKSWAP

SEQ ID NO: 879411 - protein, 495 aa, Homo sapiens
MWQLTSLLLFVATWGISGTPAPLDSVFSSSERAHQVLRIRKRANSFLEELRHSSLERECIEEICDFEEAKEIFQNVDDTLAFWSKHVDGDQCLVLPLEHPCASLCCGHGTCIDGIGSFSCDCRSGWEGRFCQRGEGERWMLAGGGAGLGPGWGRGTSTSCPRPPLPAEVSFLNCSLDNGGCTHYCLEEVGWRRCSCAPGYKLGDDLLQCHPAVKFPCGRPWKRMEKKRSHLKRDTEDQEDQVDPRLIDGKMTRRGDSPWQVVLLDSKKKLACGAVLIHPSWVLTAAHCMDESKKLLVRLGEYDLRRWEKWELDLDIKEVFVHPNYSKSTTDNDIALLHLAQPATLSQTIVPICLPDSGLAERELNQAGQETLVTGWGYHSSREKEAKRNRTFVLNFIKIPVVPHNECSEVMSNMVSENMLCAGILGDRQDACEGDSGGPMVASFHGTWFLVGLVSWGEGCGLLHNYGVYTKVSRYLDWIHGHIRDKEAPQKSWAP

SEQ ID NO: 879412 - protein, 239 aa, Homo sapiens
CRGGGGGGLSWRQDGELAVSPRPAPTGASASRMWQLTSLLLFVATWGISGTPAPLDSVFSSSERAHQVLRIRKRANSFLEELRHSSLERECIEEICDFEEAKEIFQNVDDTLAFWSKHVDGDQCLVLPLEHPCASLCCGHGTCIDGIGSFSCDCRSGWEGRFCQRGEGERWMLAGGGAGLGPGWTMLTVLCHAMVGPSFSLFPPVSEELRTNKATLSSILTDVYLAYRSEYWQASYHPR

SEQ ID NO: 879413 - protein, 1089 aa, Homo sapiens
MAVFDTPEEAFGVLRPVCVQLTKTQTVENVEHLQTRLQAVSDSALQELQQYILFPLRFTLKTPGPKRERLIQSVVECLTFVLSSTCVKEQELLQELFSELSACLYSPSSQKPAAVSEELKLAVIQGLSTLMHSAYGDIILTFYEPSILPRLGFAVSLLLGLAEQEKSKQIKIAALKCLQVLLLQCDCQDHPRSLDELEQKQLGDLFASFLPGISTALTRLITGDFKQGHSIVVSSLKIFYKTVSFIMADEQLKRISKVQAKPAVEHRVAELMVYREADWVKKTGDKLTILIKKIIECVSVHPHWKVRLELVELVEDLLLKCSQSLVECAGPLLKALVGLVNDESPEIQAQCNKVLRHFADQKVVVGNKALADILSESLHSLATSLPRLMNSQDDQGKFSTLSLLLGYLKLLGPKINFVLNSVAHLQRLSKALIQVLELDVADIKIVEERRWNSDDLNASPKTSATQPWNRIQRRYFRFFTDERIFMLLRQVCQLLGYYGNLYLLVDHFMELYHQSVVYRKQAAMILNELVTGAAGLEVEDLHEKHIKTNPEELREIVTSILEEYTSQENWYLVTCLETEEMGEELMMEHPGLQAITSGEHTCQVTSFLAFSKPSPTICSMNSNIWQICIQLEGIGQFAYALGKDFCLLLMSALYPVLEKAGDQTLLISQVATSTMMDVCRACGYDSLQHLINQNSDYLVNGISLNLRHLALHPHTPKVLEVMLRNSDANLLPLVADVVQDVLATLDQFYDKRAASFVSVLHALMAALAQWFPDTGNLGHLQEQSLGEEGSHLNQRPAALEKSTTTAEDIEQFLLNYLKEKDVADGNVSDFDNEEEEQSVPPKVDENDTRPDVEPPLPLQIQIAMDVMERCIHLLSDKNLQIRLKVLDVLDLCVVVLQSHKNQLLPLAHQAWPSLVHRLTRDAPLAVLRAFKVLRTLGSKCGDFLRSRFCKDVLPKLAGSLVTQAPISARAGPVYSHTLAFKLQLAVLQGLGPLCERLDLGEGDLNKVADACLIYLSVKQPVKLQEAARSVFLHLMKVDPDSTWFLLNELYCPVQFTPPHPSLHPVQLHGASGQQNPYTTNVLQLLKELQ

SEQ ID NO: 879414 - protein, 618 aa, Homo sapiens
MPHICPFFTDERIFMLLRQVCQLLGYYGNLYLLVDHFMELYHQSVVYRKQAAMILNELVTGAAGLEVEDLHEKHIKTNPEELREIVTSILEEYTSQENWYLVTCLETEEMGEELMMEHPGLQAITSGEHTCQVTSFLAFSKPSPTICSMNSNIWQICIQLEGIGQFAYALGKDFCLLLMSALYPVLEKAGDQTLLISQVATSTMMDVCRACGYDSLQHLINQNSDYLVNGISLNLRHLALHPHTPKVLEVMLRNSDANLLPLVADVVQDVLATLDQFYDKRAASFVSVLHALMAALAQWFPDTGNLGHLQEQSLGEEGSHLNQRPAALEKSTTTAEDIEQFLLNYLKEKDVADGNVSDFDNEEEEQSVPPKVDENDTRPDVEPPLPLQIQIAMDVMERCIHLLSDKNLQIRLKVLDVLDLCVVVLQSHKNQLLPLAHQAWPSLVHRLTRDAPLAVLRAFKVLRTLGSKCGDFLRSRFCKDVLPKLAGSLVTQAPISARAGPVYSHTLAFKLQLAVLQGLGPLCERLDLGEGDLNKVADACLIYLSVKQPVKLQEAARSVFLHLMKVDPDSTWFLLNELYCPVQFTPPHPSLHPVQLHGASGQQNPYTTNVLQLLKELQ

SEQ ID NO: 879415 - protein, 240 aa, Homo sapiens
HVGGKPALAAHAGGKPALAVVLTAACDTDAGSLFSVLDVLDLCVVVLQSHKNQLLPLAHQAWPSLVHRLTRDAPLAVLRAFKVLRTLGSKCGDFLRSRFCKDVLPKLAGSLVTQAPISARAGPVYSHTLAFKLQLAVLQGLGPLCERLDLGEGDLNKVADACLIYLSVKQPVKLQEAARSVFLHLMKVDPDSTWFLLNELYCPVQFTPPHPSLHPVQLHGASGQQNPYTTNVLQLLKELQ

SEQ ID NO: 879416 - protein, 1089 aa, Homo sapiens; identical to SEQ ID NO: 879413

SEQ ID NO: 879417 - protein, 509 aa, Homo sapiens
MGEELMMEHPGLQAITSGEHTCQVTSFLAFSKPSPTICSMNSNIWQICIQLEGIGQFAYALGKDFCLLLMSALYPVLEKAGDQTLLISQVATSTMMDVCRACGYDSLQHLINQNSDYLVNGISLNLRHLALHPHTPKVLEVMLRNSDANLLPLVADVVQDVLATLDQFYDKRAASFVSVLHALMAALAQWFPDTGNLGHLQEQSLGEEGSHLNQRPAALEKSTTTAEDIEQFLLNYLKEKDVADGNVSDFDNEEEEQSVPPKVDENDTRPDVEPPLPLQIQIAMDVMERCIHLLSDKNLQIRLKVLDVLDLCVVVLQSHKNQLLPLAHQAWPSLVHRLTRDAPLAVLRAFKVLRTLGSKCGDFLRSRFCKDVLPKLAGSLVTQAPISARAGPVYSHTLAFKLQLAVLQGLGPLCERLDLGEGDLNKVADACLIYLSVKQPVKLQEAARSVFLHLMKVDPDSTWFLLNELYCPVQFTPPHPSLHPVQLHGASGQQNPYTTNVLQLLKELQ

SEQ ID NO: 879418 - protein, 130 aa, Homo sapiens
MMDVCRACGYDSLQHLINQNSDYLVNGISLNLRHLALHPHTPKVLEVMLRNSDANLLPLVADVVQDVLATLDQFYDKRAASFVSVLHALMAALGTLRALFNADVWGTGLSLLVCLASFFALFVVMLWRTF

SEQ ID NO: 879419 - protein, 111 aa, Homo sapiens
FQNREMLPFWMNSTGRREGWQRGWHGYDNELMDMRGIFLAFGPDFKSNFRAAPIRSVDVYNVMCNVVGITPLPNNGSWSRVMCMLKGRASTAPPVWPSHCALALILLFLLA

SEQ ID NO: 879420 - protein, 109 aa, Homo sapiens
FQNREMLPFWMNSTGRREGWQRGWHGYDNELMDMRGIFLAFGPGRRGNDQMLSDPIPKEVSVRGATGARRGCRDFLTDPLYEPSRANPAGLHETSFAGFLSNASWVWQM

SEQ ID NO: 879421 - protein, 1145 aa, Homo sapiens
MDDWKSRLVIKSMLPHFAMVGNRQEPRKLQESGKKPSWMEEEDLSFLYKSSPGRKHQGTVKRRQEEDHFQFPDMADGGYPNKIKRPCLEDVTLAMGPGAHPSTACAELQVPPLTINPSPAAMGVAGQSLLLENNPMNGNIMGSPFVVPQTTEVGLKGPTVPYYEKINSVPAVDQELQELLEELTKIQDPSPNELDLEKILGTKPEEPLVLDHPQATLSTTPKPSVQMSHLESLASSKEFASSCSQVTGMSLQIPSSSTGISYSIPSTSKQIVSPSSSMAQSKSQVQAMLPVALPPLPVPQWHHAHQLKALAASKQGSATKQQGPTPSWSGLPPPGLSPPYRPVPSPHPPPLPLPPPPPPFSPQSLMVSCMSSNTLSGSTLRGSPNALLSSMTSSSNAALGPAMPYAPEKLPSPALTQQPQFGPQSSILANLMSSTIKTPQGHLMSALPASNPGPSPPYRPEKLSSPGLPQQSFTPQCSLIRSLTPTSNLLSQQQQQQQQQQQANVIFKPISSNSSKTLSMIMQQGMASSSPGATEPFTFGNTKPLSHFVSEPGPQKMPSMPTTSRQPSLLHYLQQPTPTQASSATASSTATATLQLQQQQQQQQQQPDHSSFLLQQMMQQPQRFQRSVASDSMPALPRQVCCHLFAWTSAASSVKPQHQHGNSFTSRQDPQPGDVSPSNITHVDKACKLGEARHPQVSLGRQPPSCQALGSESFLPGSSFAHELARVTSSYSTSEAAPWGSWDPKAWRQVPAPLLPSCDATARGTEIRSYGKTPERQNAYISQQMSPFEAVQEQVTSKCSRIKASPPSSKHLMPPRTGLLQNNLSPGMIPLTRHQSCEGMGVISPTLGKRQGIFTSSPQCPILSHSGQTPLGRLDSVCQHMQSPKATPPEVPLPGFCPSSLGTQSLSPHQLRRPSVPRMPTAFNNAAWVTAAAAVTTAVSGKTPLSQVDNSVQQHSPSGQACLQRPSDWEAQVPAAMGTQVPLANNPSFSLLGSQSLRQSPVQGPVPVANTTKFLQQGMASFSPLSPIQGIEPPSYVAAAATAAAASAVAASQFPGPFDRTDIPPELPPADFLRQPQPPLNDLISSPDCNEVDFIEALLKGSCVSPDEDWVCNLRLIDDILEQHAAAQNATAQNSGQVTQDAGAL

SEQ ID NO: 879422 - protein, 1145 aa, Homo sapiens; identical to SEQ ID NO: 879421

SEQ ID NO: 879423 - protein, 1142 aa, Homo sapiens
MDDWKSRLVIKSMLPHFAMVGNRQEPRKLQESGKKPSWMEEEDLSFLYKSSPGRKHQGTVKRRQEEDHFQFPDMADGGYPNKIKRPCLEDVTLAMGPGAHPSTACAELQVPPLTINPSPAAMGVAGQSLLLENNPMNGNIMGSPFVVPQTTEVGLKGPTVPYYEKINSVPAVDQELQELLEELTKIQDPSPNELDLEKILGTKPEEPLVLDHPQATLSTTPKPSVQMSHLESLASSKEFASSCSQVTGMSLQIPSSSTGISYSIPSTSKQIVSPSSSMAQSKSQVQAMLPVALPPLPVPQWHHAHQLKALAASKQGSATKQQGPTPSWSGLPPPGLSPPYRPVPSPHPPPLPLPPPPPPFSPQSLMVSCMSSNTLSGSTLRGSPNALLSSMTSSSNAALGPAMPYAPEKLPSPALTQQPQFGPQSSILANLMSSTIKTPQGHLMSALPASNPGPSPPYRPEKLSSPGLPQQSFTPQCSLIRSLTPTSNLLSQQQQQQQQQQQANVIFKPISSNSSKTLSMIMQQGMASSSPGATEPFTFGNTKPLSHFVSEPGPQKMPSMPTTSRQPSLLHYLQQPTPTQASSATASSTATATLQLQQQQQQQQQQPDHSSFLLQQMMQQPQRFQRSVASDSMPALPRQVCCHLFAWTSAASSVKPQHQHGNSFTSRQDPQPGDVSPSNITHVDKACKLGEARHPQVSLGRQPPSCQALGSESFLPGSSFAHELARVTSSYSTSEAAPWGSWDPKAWRQVPAPLLPSCDATARGTEIRSYGKTPERQNAYISQQMSPFEAVQEQVTSKCSRIKASPPSSKHLMPPRTGLLQNNLSPGMIPLTRHQSCEGMGVISPTLGKRQGIFTSSPQCPILSHSGQTPLGRLDSVCQHMQSPKATPPEVPLPGFCPSSLGTQSLSPHQLRRPSVPRMPTAFNNAAWVTAAAAVTTAVSGKTPLSQVDNSVQQHSPSGQACLQRPSDWEAQVPAAMGTQVPLANNPSFSLLGSQSLRQSPVQGPVPVANTTKFLQQGMASFSPLSPIQGIEPPSYVAAAATAAAASAVAASQFPGPFDRTDIPPELPPADFLRQPQPPLNDLISSPHPPPLPLPPPPPPFSPQSLMVSCMSSNTLSGSTLRGSPNALLSSMTSTSNAALGP

SEQ ID NO: 879424 - protein, 1474 aa, Homo sapiens
MVENADSLQAQERKDILMKYDKGHRAGLPEDKGPEPVGINSSIDRFGILHETELPPVTAREAKKIRREMTRTSKWMEMLGEWETYKHSSKLIDRVYKGIPMNIRGPVWSVLLNIQEIKLKNPGRYQIMKERGKRSSEHIHHIDLDVRTTLRNHVFFRDRYGAKQRELFYILLAYSEYNPEVGYCRDLSHITALFLLYLPEEDAFWALVQLLASERHSLPGFHSPNGGTVQGLQDQQEHVVPKSQPKTMWHQDKEGLCGQCASLGCLLRNLIDGISLGLTLRLWDVYLVEGEQVLMPITSIALKVQQKRLMKTSRCGLWARLRNQFFDTWAMNDDTVLKHLRASTKKLTRKQGDLPPPGPTALGRRCVAGSPQPAEPWGQSQEPPTMPQRLPHARQHTPLPLGSADYRRVVSVRPQGPHRDPKDSRDAAKREQGSLAPRPVPASRGGKTLCKGYRQAPPGPPAQFQRPICSASPPWASRFSTPCPGGAVREDTYPVGTQGVPSLALAQGGPQGSWRFLEWKSMPRLPTDLDIGGPWFPHYDFERSCWVRAISQEDQLATCWQAEHCGEVHNKDMSWPEEMSFTANSSKIDRQKVPTEKGATGLSNLGNTCFMNSSIQCVSNTQPLTQYFISGRHLYELNRTNPIGMKGHMAKCYGDLVQELWSGTQKSVAPLKLRRTIAKYAPKFDGFQQQDSQELLAFLLDGLHEDLNRVHEKPYVELKDSDGRPDWEVAAEAWDNHLRRNRSIIVDLFHGQLRSQVKCKTCGHISVRFDPFNFLSLPLPMDSYMDLEITVIKLDGTTPVRYGLRLNMDEKYTGLKKQLRDLCGLNSEQILLAEVHDSNIKNFPQDNQKVQLSVSGFLCAFEIPVPSSPISASSPTQIDFSSSPSTNGMFTLTTNGDLPKPIFIPNGMPNTVVPCGTEKNFTNGMVNGHMPSLPDSPFTGYIIAVHRKMMRTELYFLSPQENRPSLFGMPLIVPCTVHTQKKDLYDAVWIQVSWLARPLPPQEASIHAQDRDNCMGYQYPFTLRVVQKDGISCAWCPQYRFCRGCKIDCGEDRAFIGNAYIAVDWHPTALHLRYQTSQERVVDKHESVEQSRRAQAEPINLDSCLRAFTSEEELGESEMYYCSKCKTHCLATKKLDLWRLPPFLIIHLKRFQFVNDQWIKSQKIVRFLRESFDPSAFLVPRDPALCQHKPLTPQGDELSKPRILAREVKKVDAQSSAGKEDMLLSKSPSSLSANISSSPKGSPSSSRKSGTSCPSSKNSSPNSSPRTLGRSKGRLRLPQIGSKNKPSSSKKNLDASKENGAGQICELADALSRGHMRGGSQPELVTPQDHEVALANGFLYEHEACGNGCGDGYSNGQLGNHSEEDSTDDQREDTHIKPIYNLYAISCHSGILSGGHYITYAKNPNCKWYCYNDSSCEELHPDEIDTDSAYILFYEQQGIDYAQFLPKIDGKKMADTSSTDEDSESDYEKYSMLQ

SEQ ID NO: 879425 - protein, 99 aa, Homo sapiens
VLRILEKRAKMKIPQAYDAVLIFEFVDFSSSPSTNGMFTLTTNGDLPKPIFIPNGMPNTVVPCGTEKNFTNGMVNGHMPSLPDSPFTGYIIAVHRKMVS

SEQ ID NO: 879426 - protein, 1367 aa, Homo sapiens
MVENADSLQAQERKDILMKYDKGHRAGLPEDKGPEPVGINSSIDRFGILHETELPPVTAREAKKIRREMTRTSKWMEMLGEWETYKHSSKLIDRVYKGIPMNIRGPVWSVLLNIQEIKLKNPGRYQIMKERGKRSSEHIHHIDLDVRTTLRNHVFFRDRYGAKQRELFYILLAYSEYNPEVGYCRDLSHITALFLLYLPEEDAFWALVQLLASERHSLPGFHSPNGGTVQGLQDQQEHVVPKSQPKTMWHQDKEGLCGQCASLGCLLRNLIDGISLGLTLRLWDVYLVEGEQVLMPITSIALKVQQKRLMKTSRCGLWARLRNQFFDTWAMNDDTVLKHLRASTKKLTRKQGDLPPPAKREQGSLAPRPVPASRGGKTLCKGYRQAPPGPPAQFQRPICSASPPWASRFSTPCPGGAVREDTYPVGTQGVPSLALAQGGPQGSWRFLEWKSMPRLPTDLDIGGPWFPHYDFERSCWVRAISQEDQLATCWQAEHCGEVHNKDMSWPEEMSFTANSSKIDRQKVPTEKGATGLSNLGNTCFMNSSIQCVSNTQPLTQYFISGRHLYELNRTNPIGMKGHMAKCYGDLVQELWSGTQKSVAPLKLRRTIAKYAPKFDGFQQQDSQELLAFLLDGLHEDLNRVHEKPYVELKDSDGRPDWEVAAEAWDNHLRRNRSIIVDLFHGQLRSQVKCKTCGHISVRFDPFNFLSLPLPMDSYMDLEITVIKLDGTTPVRYGLRLNMDEKYTGLKKQLRDLCGLNSEQILLAEVHDSNIKDFSSSPSTNGMFTLTTNGDLPKPIFIPNGMPNTVVPCGTEKNFTNGMVNGHMPSLPDSPFTGYIIAVHRKMMRTELYFLSPQENRPSLFGMPLIVPCTVHTQKKDLYDAVWIQVSWLARPLPPQEASIHAQDRDNCMGYQYPFTLRVVQKDGISCAWCPQYRFCRGCKIDCGEDRAFIGNAYIAVDWHPTALHLRYQTSQERVVDKHESVEQSRRAQAEPINLDSCLRAFTSEEELGESEMYYCSKCKTHCLATKKLDLWRLPPFLIIHLKRFQFVNDQWIKSQKIVRFLRESFDPSAFLVPRDPALCQHKPLTPQGDELSKPRILAREVKKVDAQSSAGKEDMLLSKSPSSLSANISSSPKGSPSSSRKSGTSCPSSKNSSPNSSPRTLGRSKGRLRLPQIGSKNKPSSSKKNLDASKENGAGQICELADALSRGHMRGGSQPELVTPQDHEVALANGFLYEHEACGNGCGDGYSNGQLGNHSEEDSTDDQREDTHIKPIYNLYAISCHSGILSGGHYITYAKNPNCKWYCYNDSSCEELHPDEIDTDSAYILFYEQQGIDYAQFLPKIDGKKMADTSSTDEDSESDYEKYSMLQ

SEQ ID NO: 879427 - protein, 1428 aa, Homo sapiens
MVENADSLQAQERKDILMKYDKGHRAGLPEDKGPEPVGINSSIDRFGILQSCPSWESEPQEGPCPPFPVPSPGLSPELDRDRASPFWGSAPRLGRLQALCTSSALPGLPYSETELPPVTAREAKKIRREMTRTSKWMEMLGEWETYKHSSKLIDRVYKGIPMNIRGPVWSVLLNIQEIKLKNPGRYQIMKERGKRSSEHIHHIDLDVRTTLRNHVFFRDRYGAKQRELFYILLAYSEYNPEVGYCRDLSHITALFLLYLPEEDAFWALVQLLASERHSLPGFHSPNGGTVQGLQDQQEHVVPKSQPKTMWHQDKEGLCGQCASLGCLLRNLIDGISLGLTLRLWDVYLVEGEQVLMPITSIALKVQQKRLMKTSRCGLWARLRNQFFDTWAMNDDTVLKHLRASTKKLTRKQGDLPPPAKREQGSLAPRPVPASRGGKTLCKGYRQAPPGPPAQFQRPICSASPPWASRFSTPCPGGAVREDTYPVGTQGVPSLALAQGGPQGSWRFLEWKSMPRLPTDLDIGGPWFPHYDFERSCWVRAISQEDQLATCWQAEHCGEVHNKDMSWPEEMSFTANSSKIDRQKVPTEKGATGLSNLGNTCFMNSSIQCVSNTQPLTQYFISGRHLYELNRTNPIGMKGHMAKCYGDLVQELWSGTQKSVAPLKLRRTIAKYAPKFDGFQQQDSQELLAFLLDGLHEDLNRVHEKPYVELKDSDGRPDWEVAAEAWDNHLRRNRSIIVDLFHGQLRSQVKCKTCGHISVRFDPFNFLSLPLPMDSYMDLEITVIKLDGTTPVRYGLRLNMDEKYTGLKKQLRDLCGLNSEQILLAEVHDSNIKDFSSSPSTNGMFTLTTNGDLPKPIFIPNGMPNTVVPCGTEKNFTNGMVNGHMPSLPDSPFTGYIIAVHRKMMRTELYFLSPQENRPSLFGMPLIVPCTVHTQKKDLYDAVWIQVSWLARPLPPQEASIHAQDRDNCMGYQYPFTLRVVQKDGISCAWCPQYRFCRGCKIDCGEDRAFIGNAYIAVDWHPTALHLRYQTSQERVVDKHESVEQSRRAQAEPINLDSCLRAFTSEEELGESEMYYCSKCKTHCLATKKLDLWRLPPFLIIHLKRFQFVNDQWIKSQKIVRFLRESFDPSAFLVPRDPALCQHKPLTPQGDELSKPRILAREVKKVDAQSSAGKEDMLLSKSPSSLSANISSSPKGSPSSSRKSGTSCPSSKNSSPNSSPRTLGRSKGRLRLPQIGSKNKPSSSKKNLDASKENGAGQICELADALSRGHMRGGSQPELVTPQDHEVALANGFLYEHEACGNGCGDGYSNGQLGNHSEEDSTDDQREDTHIKPIYNLYAISCHSGILSGGHYITYAKNPNCKWYCYNDSSCEELHPDEIDTDSAYILFYEQQGIDYAQFLPKIDGKKMADTSSTDEDSESDYEKYSMLQ

SEQ ID NO: 879428 - protein, 541 aa, Homo sapiens
GSPAETEFLSERTEQLLFQSPEMTSTFNPRECKLSKQEGQNYGFFLRIEKDTEGHLVRVVEKCSPAEKAGLQDGDRVLRINGVFVDKEEHMQVVDLVRKSGNSVTLLVLDGDSYEKAVKTRVDLKELGQSQKEQGLSDNILSPVMNGGVQTWTQPRLCYLVKEGGSYGFSLKTVQGKKGVYMTDITPQGVAMRAGVLADDHLIEVNGENVEDASHEEVVEKVKKSGSRVMFLLVDKETDKRHVEQKIQFKRETASLKLLPHQPRIVEMKKGSNGYGFYLRAGSEQKGQIIKDIDSGSPAEEAGLKNNDLVVAVNGESVETLDHDSVVEMIRKGGDQTSLLVVDKETDNMYRLAHFSPFLYYQSQELPNGSVKEAPAPTPTSLEVSSPPDTTEEVDHKPKLCRLAKGENGYGFHLNAIRGLPGSFIKEVQKGGPADLAGLEDEDVIIEVNGVNVLDEPYEKVVDRIQSSGKNVTLLVCGKKAYDYFQAKKIPIVSSLADPLDTPPDSKEGIVVESNHDSHMAKERAHSTASHSSSNSEDTEM

SEQ ID NO: 879429 - protein, 530 aa, Homo sapiens
GSPAETEFLSERTEQLLFQSPEMTSTFNPRECKLSKQEGQNYGFFLRIEKDTEGHLVRVVEKCSPAEKAGLQDGDRVLRINGVFVDKEEHMQVVDLVRKSGNSVTLLVLDGDSYEKAVKTRVDLKELGQSQKEQGLSDNILSPVMNGGVQTWTQPRLCYLVKEGGSYGFSLKTVQGKKGVYMTDITPQGVAMRAGVLADDHLIEVNGENVEDASHEEVVEKVKKSGSRVMFLLVDKETDKRHVEQKIQFKRETASLKLLPHQPRIVEMKKGSNGYGFYLRAGSEQKGQIIKDIDSGSPAEEAGLKNNDLVVAVNGESVETLDHDSVVEMIRKGGDQTSLLVVDKETDNMYRLAHFSPFLYYQSQELPNGSVKEAPAPTPTSLEVSSPPDTTEEVDHKPKLCRLAKGENGYGFHLNAIRGLPGSFIKEVQKGGPADLAGLEDEDVIIEVNGVNVLDEPYEKVVDRIQSSGKNVTLLVCGKKAYDYFQAKKIPIVSSLADPLDTPPDSKEGIVVESNHDSHMAKERAAIADG

SEQ ID NO: 879430 - protein, 302 aa, Homo sapiens
MLVEGVVVVLSMPFLSISSGLWAPAENLFYFFRGLTDNFIFWGWGRVGQIIKDIDSGSPAEEAGLKNNDLVVAVNGESVETLDHDSVVEMIRKGGDQTSLLVVDKETDNMYRLAHFSPFLYYQSQELPNGSVKEAPAPTPTSLEVSSPPDTTEEVDHKPKLCRLAKGENGYGFHLNAIRGLPGSFIKEVQKGGPADLAGLEDEDVIIEVNGVNVLDEPYEKVVDRIQSSGKNVTLLVCGKKAYDYFQAKKIPIVSSLADPLDTPPDSKEGIVVESNHDSHMAKERAHSTASHSSSNSEDTEM

SEQ ID NO: 879431 - protein, 204 aa, Homo sapiens
MVTTKLMFFPFIFQKAHFSPFLYYQSQELPNGSVKEAPAPTPTSLEVSSPPDTTEEVDHKPKLCRLAKGENGYGFHLNAIRGLPGSFIKEVQKGGPADLAGLEDEDVIIEVNGVNVLDEPYEKVVDRIQSSGKNVTLLVCGKKAYDYFQAKKIPIVSSLADPLDTPPDSKEGIVVESNHDSHMAKERAHSTASHSSSNSEDTEM

SEQ ID NO: 879432 - protein, 541 aa, Homo sapiens; identical to SEQ ID NO: 879428

SEQ ID NO: 879433 - protein, 512 aa, Homo sapiens
MTSTFNPRECKLSKQEGQNYGFFLRIEKDTEGHLVRVVEKCSPAEKAGLQDGDRVLRINGVFVDKEEHMQVVDLVRKSGNSVTLLVLDGDSYEKAVKTRVDLKELGQSQKEQGLSDNILSPVMNGGVQTWTQPRLCYLVKEGGSYGFSLKTVQGKKGVYMTDITPQGVAMRAGVLADDHLIEVNGENVEDASHEEVVEKVKKSGSRVMFLLVDKETDKRHVEQKIQFKRETASLKLLPHQPRIVEMKKGSNGYGFYLRAGSEQKGQIIKDIDSGSPAEEAGLKNNDLVVAVNGESVETLDHDSVVEMIRKGGDQTSLLVVDKETDNMYRLAHFSPFLYYQSQELPNGSVKEAPAPTPTSLEVSSPPDTTEEVDHKPKLCRLAKGENGYGFHLNAIRGLPGSFIKEVQKGGPADLAGLEDEDVIIEVNGVNVLDEPYEKVVDRIQSSGKNVTLLVCGKKAYDYFQAKKIPIVSSLADPLDTPPDSKEGIVVESNHDSHMAKERLYTIAVNCML

SEQ ID NO: 879434 - protein, 299 aa, Homo sapiens
MLVEGVVVVLSMPFLSISSGLWAPAENLFYFFRGLTDNFIFWGWGRVGQIIKDIDSGSPAEEAGLKNNDLVVAVNGESVETLDHDSVVEMIRKGGDQTSLLVVDKETDNMYRLRTLIEKEACPHHLLPRSPNQELPNGSVKEAPAPTPTSLEVSSPPDTTEEVDHKPKLCRLAKGENGYGFHLNAIRGLPGSFIKEVQKGGPADLAGLEDEDVIIEVNGVNVLDEPYEKVVDRIQSSGKNVTLLVCGKKAYDYFQAKKIPIVSSLADPLDTPPDSKEGIVVESNHDSHMAKERAAIADG

SEQ ID NO: 879435 - protein, 392 aa, Homo sapiens
GSPAETEFLSERTEQLLFQSPEMTSTFNPRECKLSKQEGQNYGFFLRIEKDTEGHLVRVVEKCSPAEKAGLQDGDRVLRINGVFVDKEEHMQVVDLVRKSGNSVTLLVLDGDSYEKAVKTRVDLKELGQSQKEQGLSDNILSPVMNGGVQTWTQPRLCYLVKEGGSYGFSLKTVQGKKGVYMTDITPQGVAMRAGVLADDHLIEVNGENVEDASHEEVVEKVKKSGSRVMFLLVDKETDKRHVEQKIQFKRETASLKLLPHQPRIVEMKKGSNGYGFYLRAGSEQKGQIIKDIDSGSPAEEAGLKNNDLVVAVNGESVETLDHDSVVEMIRKGGDQTSLLVVDKETDNMYRLVSNTRPYIHALRLGPFTHDLNFCTELGLCSSNWKRHNNHH

SEQ ID NO: 879436 - protein, 638 aa, Homo sapiens
MSALAGEDVWRCPGCGDHIAPSQIWYRTVNETWHGSCFRCSECQDSLTNWYYEKDGKLYCPKDYWGKFGEFCHGCSLLMTGPFMVAGEFKYHPECFACMSCKVIIEDGDAYALVQHATLYCGKCHNEVVLAPMFERLSTESVQEQLPYSVTLISMPATTEGRRGFSVSVESACSNYATTVQVKEVNRMHISPNNRNAIHPGDRILEINGTPVRTLRVEEVEDAISQTSQTLQLLIEHDPVSQRLDQLRLEARLAPHMQNAGHPHALSTLDTKENLEGTLRRRSLRRSNSISKSPGPSSPKEPLLFSRDISRSESLRCSSSYSQQIFRPCDLIHGEVLGKGFFGQAIKVTHKATGKVMVMKELIRCDEETQKTFLTEVKVMRSLDHPNVLKFIGVLYKDKKLNLLTEYIEGGTLKDFLRSMDPFPWQQKVRFAKGIASGMAYLHSMCIIHRDLNSHNCLIKLDKTVVVADFGLSRLIVEERKRAPMEKATTKKRTLRKNDRKKRYTVVGNPYWMAPEMLNGKSYDETVDIFSFGIVLCEIIGQVYADPDCLPRTLDFGLNVKLFWEKFVPTDCPPAFFPLAAICCRLEPESRPAFSKLEDSFEALSLYLGELGIPLPAELEELDHTVSMQYGLTRDSPP

SEQ ID NO: 879437 - protein, 617 aa, Homo sapiens
MGSYLSVPAYFTSRDLFRCSECQDSLTNWYYEKDGKLYCPKDYWGKFGEFCHGCSLLMTGPFMVAGEFKYHPECFACMSCKVIIEDGDAYALVQHATLYCGKCHNEVVLAPMFERLSTESVQEQLPYSVTLISMPATTEGRRGFSVSVESACSNYATTVQVKEVNRMHISPNNRNAIHPGDRILEINGTPVRTLRVEEVEDAISQTSQTLQLLIEHDPVSQRLDQLRLEARLAPHMQNAGHPHALSTLDTKENLEGTLRRRSLRRSNSISKSPGPSSPKEPLLFSRDISRSESLRCSSSYSQQIFRPCDLIHGEVLGKGFFGQAIKVTHKATGKVMVMKELIRCDEETQKTFLTEVKVMRSLDHPNVLKFIGVLYKDKKLNLLTEYIEGGTLKDFLRSMDPFPWQQKVRFAKGIASGMAYLHSMCIIHRDLNSHNCLIKLDKTVVVADFGLSRLIVEERKRAPMEKATTKKRTLRKNDRKKRYTVVGNPYWMAPEMLNGKSYDETVDIFSFGIVLCEIIGQVYADPDCLPRTLDFGLNVKLFWEKFVPTDCPPAFFPLAAICCRLEPESRPAFSKLEDSFEALSLYLGELGIPLPAELEELDHTVSMQYGLTRDSPP

SEQ ID NO: 879438 - protein, 686 aa, Homo sapiens
MGSYLSVPAYFTSRDLFRCSECQDSLTNWYYEKDGKLYCPKDYWGKFGEFCHGCSLLMTGPFMVAGEFKYHPECFACMSCKVIIEDGDAYALVQHATLYCGKCHNEVVLAPMFERLSTESVQEQLPYSVTLISMPATTEGRRGFSVSVESACSNYATTVQVKEVNRMHISPNNRNAIHPGDRILEINGTPVRTLRVEEVEDAISQTSQTLQLLIEHDPVSQRLDQLRLEARLAPHMQNAGHPHALSTLDTKENLEGTLRRRSLRRSNSISKSPGPSSPKEPLLFSRDISRSESLRCSSSYSQQIFRPCDLIHGEVLGKGFFGQAIKVTHKATGKVMVMKELIRCDEETQKTFLTEVKVMRSLDHPNVLKFIGVLYKDKKLNLLTEYIEGGTLKDFLRSMDPFPWQQKVRFAKGIASGMAYLHSMCIIHRDLNSHNCLIKLDKTVVVADFGLSRLIVEERKRAPMEKATTKKRTLRKNDRKKRYTVVGNPYWMAPEMLNGKSYDETVDIFSFGIVLCEIIGQVYADPDCLPRTLDFGLNVKLFWEKFVPTDCPPAFFPLAAICCRLEPESRAPPGAAGEGPGCADDEGPVRRQGKVTIKYDPKELRKHLNLEEWILEQLTRLYDCQEEEISELEIDVDELLDMESDDAWASRVKELLVDCYKPTEAFISGLLDKIRAMQKLSTPQKK

SEQ ID NO: 879439 - protein, 182 aa, Homo sapiens
MEKATTKKRTLRKNDRKKRYTVVGNPYWMAPEMLNGKSYDETVDIFSFGIVLCEIIGQVYADPDCLPRTLDFGLNVKLFWEKFVPTDCPPAFFPLAAICCRLEPESRLVSCLFLPAHRVLGRLPLSKATPEPSASTGVREALRSRMWLSTPEPSDNTYVQVGEERGKDIAASNLDRTQKHSH

SEQ ID NO: 879440 - protein, 686 aa, Homo sapiens; identical to SEQ ID NO: 879438

SEQ ID NO: 879441 - protein, 549 aa, Homo sapiens
MGSYLSVPAYFTSRDLFRCSECQDSLTNWYYEKDGKLYCPKDYWGKFGEFCHGCSLLMTGPFMVAGEFKYHPECFACMSCKVIIEDGDAYALVQHATLYCGKCHNEVVLAPMFERLSTESVQEQLPYSVTLISMPATTEGRRGFSVSVESACSNYATTVQVKEVNRMHISPNNRNAIHPGDRILEINGTPVRTLRVEEVEDAISQTSQTLQLLIEHDPVSQRLDQLRLEARLAPHMQNAGHPHALSTLDTKENLEGTLRRRSLRRSNSISKSPGPSSPKEPLLFSRDISRSESLRCSSSYSQQIFRPCDLIHGEVLGKGFFGQAIKVTHKATGKVMVMKELIRCDEETQKTFLTEVKVMRSLDHPNVLKFIGVLYKDKKLNLLTEYIEGGTLKDFLRSMDPFPWQQKVRFAKGIASGMAYLHSMCIIHRDLNSHNCLIKLDKTVVVADFGLSRLIVEERKRAPMEKATTKKRTLRKNDRKKRYTVVGNPYWMAPEMLNGKSYDETVDIFSFGIVLCEIIGQVYADPDCLPRTLDFGLNILLTPNSTLPG

SEQ ID NO: 879442 - protein, 282 aa, Homo sapiens [sequence omitted]

SEQ ID NO: 879443 - protein, 109 aa, Homo sapiens
MTARYEAGGAGHPAACRAGGVGPHCEHAVRPDPGLTSLALAQPPAGGCSTASIAPLCPIPAVSRAVRASCGLAECLEAEQAIPITSPGGKWAQHQGNVSPQVLGPSYCL

SEQ ID NO: 879444 - protein, 117 aa, Homo sapiens
NTHTTTTSPTHLRYEELVFSIRCCRAGGVGPHCEHAVRPDPGLTSLALAQPPAGGCSTASIAPLCPIPAVSRAVRASCGLAECLEAEQAIPITSPGGKWAQHQGNVSPQVLGPSYCL

SEQ ID NO: 879445 - protein, 686 aa, Homo sapiens; identical to SEQ ID NO: 879438

SEQ ID NO: 879446 - protein, 95 aa, Homo sapiens
HQGESGGDTEETFPKVPPPTLALFCPMSVSRMKLSWLSEACRVRKGTSWPGTDYEDCADPAAPVGITVYSQSLCGPSCLPGFLRNLRVSLCPLNS

SEQ ID NO: 879447 - protein, 66 aa, Homo sapiens
MEKATTKKRTLRKNDRKKRYTVVGNPYWMAPEMLNGEILKPWRGHPQREDRCCPCIRALGIPGEAC

SEQ ID NO: 879448 - protein, 617 aa, Homo sapiens; identical to SEQ ID NO: 879437

SEQ ID NO: 879449 - protein, 129 aa, Homo sapiens
MAVAAKDHASTFRAPPGAAGEGPGCADDEGPVRRQGKVTIKYDPKELRKHLNLEEWILEQLTRLYDCQEEEISELEIDVDELLDMESDDAWASRVKELLVDCYKPTEAFISGLLDKIRAMQKLSTPQKK

SEQ ID NO: 879450 - protein, 129 aa, Homo sapiens; identical to SEQ ID NO: 879449

SEQ ID NO: 879451 - protein, 617 aa, Homo sapiens; identical to SEQ ID NO: 879437

SEQ ID NO: 879452 - protein, 617 aa, Homo sapiens; identical to SEQ ID NO: 879437

SEQ ID NO: 879453 - protein, 645 aa, Homo sapiens [sequence omitted]

SEQ ID NO: 879454 - protein, 709 aa, Homo sapiens
MGSQGKQMLKSAAFTPEFQLISQLTKEWTQTMSRQFTQEYKNGKQTFEKVLNLSELCNTIKIPLDSAILLVKIYPTEIHKYSKIQEQGYSLVAWETGSKPYDHDKVLLSKLQSIHTMLKRINWHVNCLGHVKQISMKHSMYGMYLLWLRKCVHRKELWGNLCYSNSGYLWDDRMFMEGFHFYSISANIFYDDYVLIYTFISRKTIPTLPSTPTIKSPVSFCQSQWKINQSKGFIIRAELDLTKGKLHGLWQVTKPKLRFPDCYTGGISQGYLMILCDRFCEALSIMPGIEQALNALQSPLLLLDKACGRRAILQTMPGDGRSPVPHFYGSTSTTRRSELASQMSWPLCLSTWSPNLRFCLLPHIPGTLHLHCPLLTDALWYHIAPGGGGIFLLVSSRVLGEKVYTVCFSKNKAEHQPRQCHPQRRKHLIHISLNFFVCFFVFSRDEVSLCCPGWSRTPGFKRPSCLGLPKCCDYQHEPPCPALNYFFNGWGSWGIEKEMFSHKVAYVDIKTEDIRESRVLIQNLLAIDCPGCVRECGIPDQGSKLTQGHRACRRAPNHFPASAHYPSIFSLVSEGHCPRREHEPFNIIRLGLANPQIYFSSFWIHSQPEPLPACRVLSGICSLPIPKRSRGRPQDPFPLPRYKDNEVGISCYLVPQLRLDVSPERTQYVACKLICGRAMPLENQETPGKQNSHPVEKLKLCQPPMARAH

SEQ ID NO: 879455 - protein, 349 aa, Homo sapiens
MLRKHVEFRKQKDIDNIISWQPPEVIQQYLSGGMCGYDLDGCPVWYDIIGPLDAKGLLFSASKQDLLRTKMRECELLLQECAHQTTKLGRKVETITIIYDCEGLGLKHLWKPAVEAYGEFLCMFEENYPETLKRLFVVKAPKLFPVAYNLIKPFLSEDTRKKIMVLGANWKEVLLKHISPDQVPVEYGGTMTDPDGNPKCKSKINYGGDIPRKYYVRDQVKQQYEHSVQISRGSSHQVEYEILFPGCVLRWQFMSDGADVGFGIFLKTKMGERQRAGEMTEVLPNQRYNSHLVPEDGTLTCSDPGIYVLRFDNTYSFIHAKKVNFTVEVLLPDKASEEKMKQLGAGTPK

SEQ ID NO: 879456 - protein, 279 aa, Homo sapiens
MRECELLLQECAHQTTKLGRKVETITIIYDCEGLGLKHLWKPAVEAYGEFLCMFEENYPETLKRLFVVKAPKLFPVAYNLIKPFLSEDTRKKIMVLGANWKEVLLKHISPDQVPVEYGGTMTDPDGNPKCKSKINYGGDIPRKYYVRDQVKQQYEHSVQISRGSSHQVEYEILFPGCVLRWQFMSDGADVGFGIFLKTKMGERQRAGEMTEVLPNQRYNSHLVPEDGTLTCSDPGIYVLRFDNTYSFIHAKKVNFTVEVLLPDKASEEKMKQLGAGTPK

SEQ ID NO: 879457 - protein, 403 aa, Homo sapiens
MSGRVGDLSPRQKEALAKFRENVQDVLPALPNPDDYFLLRWLRARSFDLQKSEAMLRKHVEFRKQKDIDNIISWQPPEVIQQYLSGGMCGYDLDGCPVWYDIIGPLDAKGLLFSASKQDLLRTKMRECELLLQECAHQTTKLGRKVETITIIYDCEGLGLKHLWKPAVEAYGEFLCMFEENYPETLKRLFVVKAPKLFPVAYNLIKPFLSEDTRKKIMVLGANWKEVLLKHISPDQVPVEYGGTMTDPDGNPKCKSKINYGGDIPRKYYVRDQVKQQYEHSVQISRGSSHQVEYEILFPGCVLRWQFMSDGADVGFGIFLKTKMGERQRAGEMTEVLPNQRYNSHLVPEDGTLTCSDPGIYVLRFDNTYSFIHAKKVNFTVEVLLPDKASEEKMKQLGAGTPK

SEQ ID NO: 879458 - protein, 76 aa, Homo sapiens
GWVRQWGQILSLLESRVILFPQFLCMFEENYPETLKRLFVVKGKLGISCDKARWKRGVKNMTAADGGSNSEPKEGV

SEQ ID NO: 879459 - protein, 403 aa, Homo sapiens; identical to SEQ ID NO: 879457

SEQ ID NO: 879460 - protein, 301 aa, Homo sapiens [sequence omitted]

SEQ ID NO: 879461 - protein, 227 aa, Homo sapiens [sequence omitted]

SEQ ID NO: 879462 - protein, 360 aa, Homo sapiens [sequence omitted]

SEQ ID NO: 879463 - protein, 1250 aa, Homo sapiens
MLRFVIHFYTTLESVHIATSFLTSTNLTKSVVGTNQNDMKKCHYYLFQRSKIIDHEKSPAIFWSKTIGNRMSHSIFKVLLEEFSLVTYIVLKDRLSCSSVPLVFKKFPMCKETSTCYILRIGSYLLNCWHMKARVYESFLKYRSLKILKSEIVSITELRAEFFCLKLIEIDAVYSTGSLMIVEKHCNVPNETGCVPDDFVNFLNSLEIVSRSHTTAVIISEHSKRLILFYFIILEVHFLKLQGISLPFYMKRFSFEYFSSLLVAVIDMTNNILVLFVCFLAVNELKRLDRSSGYVAPLLTTVNIPLCSKVENSTVTNSECSVNTLDEYEAVFSLYDTHQLILSGKRRLLSHSYLIKTELVVVQEKATDKTGYILKPLFIENPKNCRINLIEVKSKSYTKFCEDLRAIINSSKPNKESSYISSVVVKTSYLLKKRKNKTQQCPVSSENCFKKLARHSEWPTPVVRAVWEVEVGRLVGAQDFEAAVSHNCTTALQPERQRTRPCLKNKVGEGVQNYTVRSQEVSKFYLFFYSHFESLFVVSVFEFNIMFLKMEWILKMSWVQDIQHIFYIGLMSLGEVELLFLFNLHENNLYNFLIYIAKLSSSFKILNNNFFFGGKIKEGFLYIEIKMPRPGAVAHACNPNYFGGLRRVDHLRSRVQDQPGQHGETLPLLKVQKLAGRGGSCLYIPATRRLRHENHLNLGGEGCSEPRSCHCTPAWATEQNSLSKKKKKKKDAYRSKVLRCSDSCLKFQHFGSLRQEDHLSSGIQNQPGQYGKTPSLQNISLSLVARVCGPSYLEELRWEGSLEPGEVEAAVSYIHTIALYLNNKVRSCLKKKKEKLQLTAVIPALWEAKARRSLEVRSLRPANMVSPFSTKNTKISQVSWRVPVIPATREAEEENRLTQEAEITVNQDDTSDSSLGNRLKDSVLKKIKNLYSHNIFSFKLVAFKSLSTNKSCVGQVWWLMLVIPALWEAEAGGSPEVGSSRAAYPICRNPASTKNTKLARRGRMPVILATREAEAGESLNPGGGGCGWANITPLHSNLGNKSKSPSKKRAVYTTLICPWASDLNILLNSKNTNKLNLKARRSIIVIRHPCVFKLEFSDGLRKIKEIIVISMTQLFNLNKLSWRLEYFYYLFSCEMGNVLTFITKFEGDTLYVEFEVLMKYKSRGQVLTSVIPALWEAKAHRSLEVRSLRPAWPHGENPSLTKNTKISWMWWCGPVIPATREAEAGNRLNLAGRGCGEPRLRHCTPAWTRE

SEQ ID NO: 879464 - protein, 1236 aa, Homo sapiens
MPLVLVSEKKIIDHEKSPAIFWSKTIGNRMSHSIFKVLLEEFSLVTYIVLKDRLSCSSVPLVFKKFPMCKETSTCYILRIGSYLLNCWHMKARVYESFLKNRSLKILKSEIVSITELRAEFFCLKLIEIDACIYWLPDDSRKALVMYQMKLVVYQMMFVNFLNSLEIVSRSHTTAVIISEHSKRLILFYFIILEVHFLKLQGISLPFYMKRFSFEYFSSLLVAVIDMTNNILVLFVCFLAVNELKRLDRSSGYVAPLLTTVNIPLCSKVENSTVTNSECSVNTLDEYEAVFSLYDTHQLILSGKRRLLSHSYLIKTELVVVQEKATDKTGYILKPLFIENPKNCRINLIEVKSKSYTKFCEDLRAIINSSKPNKESSYISSVVVKTSYLLKKRKNKTQQCPVSSENCFKKLARHSEWPTPVVRAVWEVEVGRLVGAQDFEAAVSHNCTTALQPERQRTRPCLKNKVGEGVQNYTVRSQEVSKFYLFFYVIFNHYLLFQCLNLNYVFKDGVDSKDELGSRYPTYLLYWAYVTYGEVELLFLFNLHENNLYNFLIEIAKLSSSFKILNNNFFFGGKIKEGFLYIEIKMPRPGAVAHACNPNDFGGLRRVDHLRSRVQDQPGQHGETLPLLKVQKLAGRGGSCLYIPATRRLRHENHLNLGGEGCSEPRSCHCTPAWATEQNSLSKKKKKKKDAYRSKVLRCSDSCLKFQHFGSLRQEDHLSSGIQNQPGQYGKTPSLQNISLSLVARVCGPSYLEELRWEGSLEPGRLKLQCAIFTPLHSSLNNKVRSCLKKKKEKLQLTAVIPALWEAKARRSLEVRSLRPANMVSPFSTKNTKISQVSWRVPVIPATREAEEENRLTQEAEITVNQDDTSDSSLGNRLKDSVLKKNKNLYSHNIFSFKLVAFKSLSTNKSCVGQVWWLMLVIPALWEAEAGGSPEVGSSRAAYPICRNPASTKNTKLARRGRMPVILATREAEAGESLNPGGGGCGWANITPLHSNLGNKSKSPSKKRAVYTTLICPWASDLNILLNSKILTKLNLKARRSIIVIRHPCVFKLEFSDGLRKIKEIIVISMTQLFNLNKLSWRLEYFYYLFSCEMGNVLTFITKFEGDTLYVEFEVLMKYKSRGQVLTSVIPALWEAKAHRSLEVRSLRPAWPTWENPSLTKNTKISWMWWCGPVIPATREAEAGESLEPGRQRLRRAKIASLHSGVDKRVRLRHKKKKKRRKVLDSHILKMLVICG

SEQ ID NO: 879465 - protein, 1289 aa, Homo sapiens
MRLLSHSYLIKTELVVVQEKATDKTGYILKPLFIENPKNCRINLIEVKSKSYTKFCEDLRAIINSSKPNKESSYISSVVVKTSYLLKKRKNKTQQCPVSSENCFKKLARHSEWPTPVVRAVWEVEVGRLVGAQDFEAAVSHNCTTALQPERQRTRPCLKNKVGEGVQNYTVRSQEVSKFYLFFYVIFNHYLLFQCLNLNYVFKDGVDSKDELGSRYPTYLLYWAYVTYGEVELLFLFNLHENNLYNFLIYIAKLSSSFKILNNNFFFGGKIKEGFLYIEIKMPRPGAVAHACNPNYFGGLRRVDHLRSRVQDQPGQHGETLPLLKVQKLAGRGGSCLYIPATRRLRHENHLNLGGEGCSEPRSCHCTPAWATEQNSLSKKKKKKKDAYRSKVLRCSDSCLKFQHFGSLRQEDHLSSGIQNQPGQYGKTPSLQNISLSLVARVCGPSYLEELRWEGSLEPGRLKLQGAIFTPLHSSLNNKVRSCLKKKKEKLQLTAVIPALWEAKARRSLEVRSLRPANMVSPFSTKNTKISQVSWRVPVIPATREAEAGESLEPRRQRLQGTKMTPLHSSLGNRLKDSVLKKIKNLYSHNIFSFKLVAFKSLSTNKSCVGQVWWLMLVIPALWEAEAGGSPEVGSSRAAYPICRNPASTKNTKLARRGRMPVILATREAEAGESLNPGGGGCGWANITPLHSNLGNKSKSPSKKRAVYTTLICPWASDLNILLNSKNTNKLNLKARRSIIVIRHPCVFKLEFSDGLRKIKEIIVISMTQLFNLNKLSWRLEYFYYLFSCEMGNVLTFITKFEGDTLYVEFEVLMKYKSRGQVLTSVIPALWEAKAHRSLEVRSLRPAWPHGENPSLTKNTKISWMWWCGPVIPATREAEAGESLEPGRQRLLVSQDCVTALRRGQESETPSQKKKKKKKSIGFTYSQKCSSFVANFIKSSLISYLQSLVNSELALLEVINHIINLEPTLCLLEFLCIIACHHHHNMLVLHYASRGDIHQYLKIWLVRVQWCLQLIDHNTVTDFVSSPVLLLHLTSLLKKRKKIEKILTYIYLLYVVISLIEGSLILNNEVSPQQFIDLVLMYPCVLLYNVDYLAILDFVYKLMHKLILNMAKYKSLMSHLRSFSQKTAFMFLVNFFQCPFPKVAVSSCLQNKETVGMMLLKSFIQCIVCLFHKKSNYSIRDQLGQHSETVSLKKKKKLKISRCGDDTPVVLAIREAEEEDRLSQVFEVRMSYDRTTYTPAWATEQDPNGSWLLCLFSLLSASVYFEQSSVNGLLALESFIIEPYLIYHF

SEQ ID NO: 879466 - protein, 1250 aa, Homo sapiens; identical to SEQ ID NO: 879463

SEQ ID NO: 879467 - protein, 1250 aa, Homo sapiens; identical to SEQ ID NO: 879463

SEQ ID NO: 879468 - protein, 1250 aa, Homo sapiens; identical to SEQ ID NO: 879463

SEQ ID NO: 879469 - protein, 489 aa, Homo sapiens
AEDVNEEQDYYPLPAGIIDEYFYVNEQSGESQWEFPDGEEEEEESQAQENRDETLAKQTLKDKTGTDSNSTESSETSTVGIEMGDWQEVWDENTGCYYYWNTQTNEVTWELPQYLATQVQGLQHYQPSSVPGAETSFVVNTDIYSKEKTISVSSSKSGPVIAKREVKKEVNEGIQALSNSEEEKKGVAASLLAPLLPEGIKEEEERWRRKVICKEEPVSEVKETSTTVEEATTIVKPQEIMLDNIEDPSQEDLCSVVQSGESEEEEEQDTLELELVLERKKAELRALEEGDGSVSGSSPRSDISQPASQDGMRRLMSKRGKWKMFVRATSPESTSRSSSKTGRDTPENGETAIGAENSEKIDENSDKEMEVEESPEKIKVQTTPKVEEEQDLKFQIGELANTLTSKFEFLGINRQSISNFHVLLLQTETRIADWREGALNGNYLKRKLQDAAEQLKQYEINATPKGWSCHWDRYALFSPFHLSPLTSQT

SEQ ID NO: 879470 - protein, 1250 aa, Homo sapiens; identical to SEQ ID NO: 879463

SEQ ID NO: 879471 - protein, 883 aa, Homo sapiens
AEDVNEEQDYYPLPAGIIDEYFYVNEQSGESQWEFPDGEEEEEESQAQENRDETLAKQTLKDKTGTDSNSTESSETSTVGIEMGDWQEVWDENTGCYYYWNTQTNEVTWELPQYLATQVQGLQHYQPSSVPGAETSFVVNTDIYSKEKTISVSSSKSGPVIAKREVKKEVNEGIQALSNSEEEKKGVAASLLAPLLPEGIKEEEERWRRKVICKEEPVSEVKETSTTVEEATTIVKPQEIMLDNIEDPSQEDLCSVVQSGESEEEEEQDTLELELVLERKKAELRALEEGDGSVSGSSPRSDISQPASQDGMRRLMSKRGKWKMFVRATSPESTSRSSSKTGRDTPENGETAIGAENSEKIDENSDKEMEVEESPEKIKVQTTPKVEEEQDLKFQIGELANTLTSKFEFLGINRQSISNFHVLLLQTETRIADWREGALNGNYLKRKLQDAAEQLKQYEINATPKGWSCHWDRDHRRYFYVNEQSGESQWEFPDGEEEEEESQAQENRDETLAKQTLKDKTGTDSNSTESSETSTGSLCKESFSGQVSSSSLMPLTPFWTLLQSNVPVLQPPLPLEMPPPPPPPPESPPPPPPPPPPAEDGEIQEVEMEDEGSEEPPAPGTEEDTPLKPSAQTTVVTSQSSVDSTISSSSSTKGIKRKATEISTAVVQRSATIGSSPVLYSQSAIATGHQAAGIGNQATGIGHQTIPVSLPAAGMGHQARGMSLQSNYLGLAAAPAIMSYAECSVPIGVTAPSLQPVQARGAVPTATIIEPPPPPPPPPPPPPPAPKMPPPEKTKKGRKDKAKKSKTKMPSLVKKWQSIQRELDEEDNSSSSEEDRESTAQKRIEEWKQQQLVSGMAERNANFEALPEDWRARLKRRKMAPNT

SEQ ID NO: 879472 - protein, 1250 aa, Homo sapiens; identical to SEQ ID NO: 879463

SEQ ID NO: 879473 - protein, 489 aa, Homo sapiens; identical to SEQ ID NO: 879469

SEQ ID NO: 879474 - protein, 1250 aa, Homo sapiens; identical to SEQ ID NO: 879463

SEQ ID NO: 879475 - protein, 1250 aa, Homo sapiens; identical to SEQ ID NO: 879463

SEQ ID NO: 879476 - protein, 412 aa, Homo sapiens
AEDVNEEQDYYPLPAGIIDEYFYVNEQSGESQWEFPDGEEEEEESQAQENRDETLAKQTLKDKTGTDSNSTESSETSTVGIEMGDWQEVWDENTGCYYYWNTQTNEVTWELPQYLATQVQGLQHYQPSSVPGAETSFVVNTDIYSKEKTISVSSSKSGPVIAKREVKKEVNEGIQALSNSEEEKKGVAASLLAPLLPEGIKEEEERWRRKVICKEEPVSEVKETSTTVEEATTIVKPQEIMLDNIEDPSQEDLCSVVQSGESEEEEEQDTLELELVLERKKAELRALEEGDGSVSGSSPRSDISQPASQDGMRRLMSKRGKWKMFVRATSPESTSRSSSKTGRDTPENGETGNLCFTLNFRVERYRGEGNSCLFLFPLQQNRRLYFYSLGEVLGRKLPSTSLPFPDLFLVEE

SEQ ID NO: 879477 - protein, 374 aa, Homo sapiens
SSPVPLVLEVSLASSETSTVGIEMGDWQEVWDENTGCYYYWNTQTNEVTWELPQYLATQVQGLQHYQPSSVPGAETSFVVNTDIYSKEKTISVSSSKSGPVIAKREVKKEVNEGIQALSNSEEEKKGVAASLLAPLLPEGIKEEEERWRRKVICKEEPVSEVKETSTTVEEATTIVKPQEIMLDNIEDPSQEDLCSVVQSGESEEEEEQDTLELELVLERKKAELRALEEGDGSVSGSSPRSDISQPASQDGMRRLMSKRGKWKMFVRATSPESTSRSSSKTGRDTPENGETAIGAGNSGKNKDEKDKARKKLDPNAILGKKGGQSIPAGSYDRRGAQIPKFPRLEKKGIGGIPIGGKEKGKFGPTGDRRTQVG

SEQ ID NO: 879478 - protein, 1015 aa, Homo sapiens
MGKKSRAVPGRRPILQLSPPGPRGSTPGRDPEPEPDTEPDSTAAVPSQPAPSAATTTAVTAAAASDDSPSEDEQEAVQEVPRVVQNPPKPVMTTRPTAVKATGGLCLLGAYADSDDDDNDVSEKLAQSKETNGNQSTDIDSTLANFLAEIDAITAPQPAAPVGASAPPPTPPRPEPKEAATSTLSSSTSNGTDSTQTSGWQYDTQCSLAGVGIEMGDWQEVWDENTGCYYYWNTQTNEVTWELPQYLATQVQGLQHYQPSSVPGAETSFVVNTDIYSKEKTISVSSSKSGPVIAKREVKKEVNEGIQALSNSEEEKKGVAASLLAPLLPEGIKEEEERWRRKVICKEEPVSEVKETSTTVEEATTIVKPQEIMLDNIEDPSQEDLCSVVQSGESEEEEEQDTLELELVLERKKAELRALEEGDGSVSGSSPRSDISQPASQDGMRRLMSKRGKWKMFVRATSPESTSRSSSKTGRDTPENGETAIGAENSEKIDENSDKEMEVEESPEKIKVQTTPKVEEEQDLKFQIGELANTLTSKFEFLGINRQSISNFHVLLLQTETRIADWREGALNGNYLKRKLQDAAEQLKQYEINATPKGWSCHWDRDHRRYFYVNEQSGESQWEFPDGEEEEEESQAQENRDETLAKQTLKDKTGTDSNSTESSETSTGSLCKESFSGQVSSSSLMPLTPFWTLLQSNVPVLQPPLPLEMPPPPPPPPESPPPPPPPPPPAEDGEIQEVEMEDEGSEEPPAPGTEEDTPLKPSAQTTVVTSQSSVDSTISSSSSTKGIKRKATEISTAVVQRSATIGSSPVLYSQSAIATGHQAAGIGNQATGIGHQTIPVSLPAAGMGHQARGMSLQSNYLGLAAAPAIMSYAECSVPIGVTAPSLQPVQARGAVPTATIIEPPPPPPPPPPPPPPAPKMPPPEKTKKGRKDKAKKSKTKMPSLVKKWQSIQRELDEEDNSSSSEEDRESTAQKRIEEWKQQQLVSGMAERNANFEALPEDWRARLKRRKMAPNT

SEQ ID NO: 879479 - protein, 1210 aa, Homo sapiens
MAYEGKSLRVVSKVIDLLKILKSEIVSITELRAEFFCLKLIEIDACIYWLPDDSRKALVMYQMKLVVYQMMFVNFLNSLEIVSRSHTTAVIISEHSKRLILFYFIILEVHFLKLQGISLPFYMKRFSFEYFSSLLVAVIDMTNNILVLFVCFLAVNELKRLDRSSGYVAPLLTTVNIPLCSKVENSTVTNSECSVNTLDEYEAVFSLYDTHQLILSGKRRLLSHSYLIKTELVVVQEKATDKTGYILKPLFIENPKNCRINLIEVKSKSYTKFCEDLRAIINSSKPNKESSYISSVVVKTSYLLKKRKNKTQQCPVSSENCFKKLARHSEWPTPVVRAVWEVEVGRLVGAQDFEAAVSHNCTTALQPERQRTRPCLKNKVGEGVQNYTVRSQEVSKFYLFFYVIFNHYLLFQCLNLTYVFKDGVDSKDELGSRYPTYLLYWAYVTYGEVELLFLFNLHENNLYNFLIEIAKLSSSFKILNNEFLFGGKIKEGFLYIEIKMPRPGAVAHACNPNTLGELRRVDHLRSRVQDQPGQHGETLPLLKVQKLAGRGGSCLYIPATRRLRHENHLNLGGEGCSEPRSCHCTPAWATEQNSLSKKKKKKKDAYRSKVLRCSDSCLKFQHFGSLRQEDHLSSGIQNQPGQYGKTPSLQNISLSLVARVCGPSYLEELRWEGSLEPGRLKLQCAIFTPLHSSLNNKVRSCLKKKKEKLQLTAVIPALWEAKARRSLEVRSLRPANMVSPFSTKNTKISQVSWRVPVIPATREAEAGESLEPRRQRLQGTKMTPLHSSLGNRLKDSVLKKIKNLYSHNIFSFKLVAFKSLSTNKSCVGQVWWLMLVIPALWEAEAGGSPEVGSSRAAYPICRNPASTKNTKLARRGRMPVILATREAEAGESLNPGGGGCGWANITPLHSNLGNKSKSPSKKRAVYTTLICPWASDLNILLNSKNTNKLNLKARRSIIVIRHPCVFKLEFSDGLRKIKEIIVISMTQLFNLNKLSWRLEYFYYLFSCEMGNVLTFITKFEGDTLYVEFEVLMKYKSRGQVLTSVIPALWEAKAHRSLEVRSLRPAWPHGENPSLTKNTKISWMWWCGPVIPATREAEAGESLEPGRQRLRCAKIASLHSGVDKRVRLRHKKKKKRRKVLDSHILKCSSFVANFIKSSLISYLQSLVNSELALLEVINHIINLEPTLCLLEFLCIIACHHHHKHVGIALCF

SEQ ID NO: 879480 - protein, 1262 aa, Homo sapiens
MLVLYWLPDDSRKALVMYQMKLVVYQMMFVNFLNSLEIVSRSHTTAVIISEHSKRLILFYFIILEVHFLKLQGISLPFYMKRFSFEYFSSLLVAVIDMTNNILVLFVCFLAVNELKRLDRSSGYVAPLLTTVNIPLCSKVENSTVTNSECSVNTLDEYEAVFSLYDTHQLILSGKRRLLSHSYLIKTELVVVQEKATDKTGYILKPLFIENPKNCRINLIEVKSKSYTKFCEDLRAIINSSKPNKESSYISSVVVKTSYLLKKRKNKTQQCPVSSENCFKKLARHSEWPTPVVRAVWEVEVGRLVGAQDFEAAVSHNCTTALQPERQRTRPCLKNKVGEGVQNYTVRSQEVSKFYLFFYVIFNHYLLFQCLNLTYVFKDGVDSKDELGSRYPTYLLYWAYVTYGEVELLFLFNLHENNLYNFLIYIAKLSSSFKILNNNFFFGGKIKEGFLYIEIKMPRPGAVAHACNPNYFGGLRRVDHLRSRVQDQPGQHGETLPLLKVQKLAGRGGSCLYIPATRRLRHENHLNLGGEGCSEPRSCHCTPAWATEQNSLSKKKKKKKDAYRSKVLRCSDSCLKFQHFGSLRQEDHLSSGIQNQPGQYGKTPSLQNISLSLVARVCGPSYLEELRWEGSLEPGRLKLQCAIFTPLHSSLNNKVRSCLKKKKEKLQLTAVIPALWEAKARRSLEVRSLRPANMVSPFSTKNTKISQVSWRVPVIPATREAEEENRLTQEAEITVNQDDTSDSSLGNRLKDSVLKKIKNLYSHNIFSFKLVAFKSLSTNKSCVGQVWWLMLVIPALWEAEAGGSPEVGSSRAAYPICRNPASTKNTKLARRGRMPVILATREAEAGESLNPGGGGCGWANITPLHSNLGNKSKSPSKKRAVYTTLICPWASDLNILLNSKNTNKLNLKARRSIIVIRHPCVFKLEFSDGLRKIKEIIVISMTQLFNLNKLSWRLEYFYYLFSCEMGNVLTFITKFEGDTLYVEFEVLMKYKSRGQVLTSVIPALWEAKAHRSLEVRSLRPAWPHGENPSLTKNTKISWMWWCGPVIPATREAEAGESLEPGRQRLRRAKIASLHSGVDKRVRLRHKKKKKRRKVLDSHILKMLVIVANFIKSSLISYLQSLVNSELALLEVINHIINLEPTLCLLEFLCIIACHHHHNMLVLHYASRGDIHQYLKIWLVRVQWCLQLIDHNTVTDFVSSPVLLLHLTSLLKKRKKIEKILTYIYLLYVVISLIEGSLILNNEVSPQRLLTYSDVVLVYYCIM

SEQ ID NO: 879481 - protein, 1250 aa, Homo sapiens; identical to SEQ ID NO: 879463

SEQ ID NO: 879482 - protein, 883 aa, Homo sapiens; identical to SEQ ID NO: 879471

SEQ ID NO: 879483 - protein, 1514 aa, Homo sapiens
MSSSFKILNNNFFFGGKIKEGFLYIEIKMPRPGAVAHACNPNYFGGLRRVDHLRSRVQDQPGQHGETLPLLKVQKLAGRGGSCLYIPATRRLRHENHLNLGGEGCSEPRSCHCTPAWATEQNSLSKKKKKKKDAYRSKVLRCSDSCLKFQHFGSLRQEDHLSSGIQNQPGQYGKTPSLQNISLSLVARVCGPSYLEELRWEGSLEPGRLKLQCAIFTPLHSSLNNKVRSCLKKKKEKLQLTAVIPALWEAKARRSLEVRSLRPANMVSPFSTKNTKISQVSWRVPVIPATREAEAGESLEPRRQRLQGTKMTPLHSSLGNRLKDSVLKKIKNLYSHNIFSFKLVAFKSLSTNKSCVGQVWWLMLVIPALWEAEAGGSPEVGSSRAAYPICRNPASTKNTKLARRGRMPVILATREAEAGESLNPGGGGCGWANITPLHSNLGNKSKSPSKKRAVYTTLICPWASDLNILLNSKNTNKLNLKARRSIIVIRHPCVFKLEFSDGLRKIKEIIVISMTQLFNLNKLSWRLEYFYYLFSCEMGNVLTFITKFEGDTLYVEFEVLMKYKSRGQVLTSVIPALWEAKAHRSLEVRSLRPAWPHGENPSLTKNTKISWMWWCGPVIPATREAEAGESLEPGRQRLRRAKIASLHSGVDKRVRLRHKKKKKRRKVLDSHILKCSSFVANFIKSSLISYLQSLVNSELALLEVINHIINLEPTLCLLEFLCIIACHHHHNMLVLHYASRGDIHQYLKIWLVRVQWCLQLIDHNTVTDFVSSPVLLLHLTSLLKKRKKIEKILTYIYLLYVVISLIEGSLILKIKLVLNVYCLSSDVVLVYYCIMYDYLAILDFVYKLMHKLILNMAKYKSLMSHLRSFSQKTAFMFLVNFFQCPFPKVAVSSCLQNKETVGMMLLKSFIQCIVCLFHKKKNYSIRDQLGQHSETVSLKKKKKLKISRCGDATPVVLAIREAEEEDRLSQVFEVRMSYDRTTYTPAWATEQDPNGSWLLCLFSLLSASVYFEQSSVNGLLALESFIIEPYLIYHFVTMKFNSDFFWVSTPGEVIFFLTEMSKALGFLVSHQDILVKQQVSDEESDLSSSSGLATNIDMILGKLVPAWVSLPLTEEVEIDDFSCLFYSYNSMILGRKSPSTFLGYISNSPIYCETSLLTIRGLGKATSSLCKESFSGQVSSSSLMPLTPFWTLLQSNVPVLQPPLPLEMPPPPPPPPESPPPPPPPPPPAEDGEIQEVEMEDEGSEEPPAPGTEEDTPLKPSAQTTVVTSQSSVDSTISSSSSTKGIKRKATEISTAVVQRSATIGSSPVLYSQSAIATGHQAAGIGNQATGIGHQTIPVSLPAAGMGHQARGMSLQSNYLGLAAAPAIMSYAECSVPIGVTAPSLQPVQARGAVPTATIIEPPPPPPPPPPPPPPAPKMPPPEKTKKGRKDKAKKSKTKMPSLVKKWQSIQRELDEEDNSSSSEEDRESTAQKRIEEWKQQQLVSGMAERNANFEALPEDWRARLKRRKMAPNT

SEQ ID NO: 879484 - protein, 659 aa, Homo sapiens
MAKYKSLMSHLRSFSQKTAFMFLVNFFQCPFPKVAVSSCLQNKETVGMMLLKSFIQCIVCLFHKKSNYSIRDQLGQHSETVSLKKKKKLKISRCGDATPVVLAIREAEEEDRLSQVFEVRMSYDRTTYTPAWATEQDPNGSWLLCLFSLLSASVYFEQSSVNGLLALESFIIEPYLIYHFVTMKFNRYFFWVSTPGEVIFFLTEMSKALGFLVSHQDILVKQQVSDEESDLSSSSGLATNIDMILGKLVPAWVSLPLTEEVEIDDFSCLFYSYNSMILGRKSPSTFLGYISNSPIYCETSLLTIRGLGKATSSLCKESFSGQVSSSSLMPLTPFWTLLQSNVPVLQPPLPLEMPPPPPPPPESPPPPPPPPPPAEDGEIQEVEMEDEGSEEPPAPGTEEDTPLKPSAQTTVVTSQSSVDSTISSSSSTKGIKRKATEISTAVVQRSATIGSSPVLYSQSAIATGHQAAGIGNQATGIGHQTIPVSLPAAGMGHQARGMSLQSNYLGLAAAPAIMSYAECSVPIGVTAPSLQPVQARGAVPTATIIEPPPPPPPPPPPPPPAPKMPPPEKTKKGRKDKAKKSKTKMPSLVKKWQSIQRELDEEDNSSSSEEDRESTAQKRIEEWKQQQLVSGMAERNANFEALPEDWRARLKRRKMAPNT

SEQ ID NO: 879485 - protein, 480 aa, Homo sapiens
AEDVNEEQDYYPLPAGIIDEYFYVNEQSGESQWEFPDGEEEEEESQAQENRDETLAKQTLKDKTGTDSNSTESSETSTVGIEMGDWQEVWDENTGCYYYWNTQTNEVTWELPQYLATQVQGLQHYQPSSVPGAETSFVVNTDIYSKEKTISVSSSKSGPVIAKREVKKEVNEGIQALSNSEEEKKGVAASLLAPLLPEGIKEEEERWRRKVICKEEPVSEVKETSTTVEEATTIVKPQEIMLDNIEDPSQEDLCSVVQSGESEEEEEQDTLELELVLERKKAELRALEEGDGSVSGSSPRSDISQPASQDGMRRLMSKRGKWKMFVRATSPESTSRSSSKTGRDTPENGETAIGAENSEKIDENSDKEMEVEESPEKIKVQTTPKVEEEQDLKFQIGELANTLTSKFEFLGINRQSISNFHVLLLQTETRIADWREGALNGNYLKRKLQDAAEQLKQYEINATPKGWSCHWDRTSGSNYS

SEQ ID NO: 879486 - protein, 1250 aa, Homo sapiens; identical to SEQ ID NO: 879463

SEQ ID NO: 879487 - protein, 1250 aa, Homo sapiens; identical to SEQ ID NO: 879463

SEQ ID NO: 879488 - protein, 1250 aa, Homo sapiens; identical to SEQ ID NO: 879463

SEQ ID NO: 879489 - protein, 99 aa, Homo sapiens
RGSLGLQDFGTRKEGMTAKKSKTKMPSLVKKWQSIQRELDEEDNSSSSEEDRESTAQKRIEEWKQQQLVSGMAERNANFEALPEDWRARLKRRKMAPNT

SEQ ID NO: 879490 - protein, 478 aa, Homo sapiens
AEDVNEEQDYYPLPAGIIDEYFYVNEQSGESQWEFPDGEEEEEESQAQENRDETLAKQTLKDKTGTDSNSTESSETSTVGIEMGDWQEVWDENTGCYYYWNTQTNEVTWELPQYLATQVQGLQHYQPSSVPGAETSFVVNTDIYSKEKTISVSSSKSGPVIAKREVKKEVNEGIQALSNSEEEKKGVAASLLAPLLPEGIKEEEERWRRKVICKEEPVSEVKETSTTVEEATTIVKPQEIMLDNIEDPSQEDLCSVVQSGESEEEEEQDTLELELVLERKKAELRALEEGDGSVSGSSPRSDISQPASQDGMRRLMSKRGKWKMFVRATSPESTSRSSSKTGRDTPENGETAIGAENSEKIDENSDKEMEVEESPEKIKVQTTPKVEEEQDLKFQIGELANTLTSKFEFLGINRQSISNFHVLLLQTEVSLFFFFFGHKQLSFWNEMLYVLTILSCLHFKPKFKFLTLEEYLSRQSRK

SEQ ID NO: 879491 - protein, 102 aa, Homo sapiens
AASGRWAGSPYPTQVGLRHPGRCWDGDGFSYLHKNKGSCSTQSRGDERGERGCQANFSSSTIKTALIMQETTVSPQIGCVEVDAALGLPRCLRAAAWSPPSP

SEQ ID NO: 879492 - protein, 109 aa, Homo sapiens
MILDEPPPSATFPKLQGRLRPPLPAVTLGLHHAHGFHSCQRRAADPVSLSHLLPPAPGDRPPPALAALELRVGPPCTVGPASIQALRVAVATASAWHHLPVPRPGAQSP

SEQ ID NO: 879493 - protein, 89 aa, Homo sapiens
ILAASMGPSYGLLMEWWGANPQLAQIQHHWTQTCHLLRVRKEEDLLPLFPLVAQSTGYRREVSELEGDVRSPSPTPRGPGSTWLSLYEL

SEQ ID NO: 879494 - protein, 117 aa, Homo sapiens
MSTGVWTEGVGYSGRRLLVMCHGFHPLLHPQPFLYQAGTPSPGAPHLLVSWLALEAAVGHLLHPAPPLPPCSLSAPLFTCCPASILPIPLCRCLPGDSGEISAPVQVITFKWKLAFI

SEQ ID NO: 879495 - protein, 109 aa, Homo sapiens
MTSEVIEDEKQFYSKAKTYWKQIPPTVDGMLGGYGHISSIDINSSRKFLQRFLRVGRSGVLSRRGCGSGGTAESMWGATFYTCNTAGSLAISWYLPQSLEELGWVGTVG

SEQ ID NO: 879496 - protein, 81 aa, Homo sapiens
MCLRCLSYLGFLGCLGFLALTGVPGVSGVAGVPGVPGISGVPFVSVVSGVPGVSGVPASRQLWAGPEPLEHRGHFSPNAED

SEQ ID NO: 879497 - protein, 106 aa, Homo sapiens
MAPSSGRGLGSPCCHCWLCHPILFMAAGWVRSMVEPGPSQGCGENLLSSSRASPEASNQKGCVSCSNSAPETAQSQKAPRDSSEPEGTPRQLRARRHRGLWPKWGS

SEQ ID NO: 879498 - protein, 106 aa, Homo sapiens; identical to SEQ ID NO: 879497

SEQ ID NO: 879499 - protein, 126 aa, Homo sapiens
MSDHFTFLPHGELTHWGLFFPLEKCGYWKFPVFGKNRIGGALWGVLLPSSLLKASWCSGSTSDTRRRFSFILRPHSISATQISSGSGASTFRGSSSNDSSDSSHHSIFLFQQKDLCGGLGSTPGAE

SEQ ID NO: 879500 - protein, 92 aa, Homo sapiens
TGSVCATLPSSRGFQFPLGSVGDVRALRTSPVPVTKRLLPRLWDNALEDLRVDGRGCEDYRCVEVETDVVSNTSGSARVKLVTTDILMEASR

SEQ ID NO: 879501 - protein, 307 aa, Homo sapiens
EGTRADDVRLVGQLGSMASVTLSEAEKVYIVHGVQEDLRVDGRGCEDYRCVEVETDVVSNTSGSARVKLGHTDILVGVKAEMGTPKLEKPNEGYLEFFVDCSASATPEFEGRGGDDLGTEIANTLYRIFNNKSSVDLKTLCISPREHCWVLYVDVLLLECGGNLFDAISIAVKAALFNTRIPRVRVLEDEEGSKDIELSDDPYDCIRLSVENVPCIVTLCKIGYRHVVDATLQEEACSLASLLVSVTSKGVVTCMRKVGKGSLDPESIFEMMETGKRVGKVLHASLQSVLHKEESLGPKRQKVGFLG

SEQ ID NO: 879502 - protein, 307 aa, Homo sapiens; identical to SEQ ID NO: 879501

SEQ ID NO: 879503 - protein, 307 aa, Homo sapiens; identical to SEQ ID NO: 879501

SEQ ID NO: 879504 - protein, 307 aa, Homo sapiens; identical to SEQ ID NO: 879501

SEQ ID NO: 879505 - protein, 562 aa, Homo sapiens
EGTRADDVRLVGQLGSMASVTLSEAEKVYIVHGVQEDLRVDGRGCEDYRCVEVETDVVSNTSGSARVKLGHTDILVGVKAEMGTPKLEKPNEGYLEFFVDCSASATPEFEGRGGDDLGTEIANTLYRIFNNKSSVDLKTLCISPREHCWVLYVDVLLLECGGNLFDAISIAVKAALFNTRIPRVRVLEDEEGSKDIELSDDPYDCIRLSVENVPCIVTLCKIGYRHVVDATLQEEACSLASLLVSVTSKGVVTCMRKVGKGSLDPESIFEMMETGKRVGKVLHASLQSVLHKDQLLNCGLFFTFPFKPVRIYFSSLLRIYSSICTCKIKGYFLVKKKKKKIGGINARGRETRGHTNGPMGHSWYHGPISRAQRANPAGHPIGEPDKFRIRPEVKPGIKKERWEKRRREQRDRGGTREKHETEDGDDDHREQHRKRAGERRDDTDDRHRQQSTEKEGERQQPEEGAATSATGRGKPEANHAREEKEEGRNGEEGGGAREEKRARKTAERTARRKREQTEEEGRGEQRLAEEEKDGERSGAKGKREERGKGGERTKALRKEEEE

SEQ ID NO: 879506 - protein, 378 aa, Homo sapiens
RSLGSYNLMSSVFYIKSLVMTTPERGLKNVGPGNELPCILLRLCLHLLTYGVVLLSEFFIPSLAEFWRQSYLFFLMPFLCQYQLQSQWSRDVAIGLKRPAIIEVPQEDLRVDGRGCEDYRCVEVETDVVSNTSGSARVKLGHTDILVGVKAEMGTPKLEKPNEGYLEFFVDCSASATPEFEGRGGDDLGTEIANTLYRIFNNKSSVDLKTLCISPREHCWVLYVDVLLLECGGNLFDAISIAVKAALFNTRIPRVRVLEDEEGSKDIELSDDPYDCIRLSVENVPCIVTLCKIGYRHVVDATLQEEACSLASLLVSVTSKGVVTCMRKVGKGSLDPESIFEMMETGKRVGKVLHASLQSVLHKEESLGPKRQKVGFLG

SEQ ID NO: 879507 - protein, 214 aa, Homo sapiens
LEDPTIDTSASATPEFEGRGGDDLGTEIANTLYRIFNNKSSVDLKTLCISPREHCWVLYVDVLLLECGGNLFDAISIAVKAALFNTRIPRVRVLEDEEGSKDIELSDDPYDCIRLSVENVPCIVTLCKIGYRHVVDATLQEEACSLASLLVSVTSKGVVTCMRKVGKGSLDPESIFEMMETGKRVGKVLHASLQSVLHKEESLGPKRQKVGFLG

SEQ ID NO: 879508 - protein, 140 aa, Homo sapiens
MASRTRVEKCWTWIPRVRVLEDEEGSKDIELSDDPYDCIRLSVENVPCIVTLCKIGYRHVVDATLQEEACSLASLLVSVTSKGVVTCMRKVGKGSLDPESIFEMMETGKRVGKVLHASLQSVLHKEESLGPKRQKVGFLG

SEQ ID NO: 879509 - protein, 307 aa, Homo sapiens; identical to SEQ ID NO: 879501

SEQ ID NO: 879510 - protein, 307 aa, Homo sapiens; identical to SEQ ID NO: 879501

SEQ ID NO: 879511 - protein, 307 aa, Homo sapiens; identical to SEQ ID NO: 879501

SEQ ID NO: 879512 - protein, 307 aa, Homo sapiens; identical to SEQ ID NO: 879501

SEQ ID NO: 879513 - protein, 301 aa, Homo sapiens
YKKQAVPVRYSRIVTLSEAEKVYIVHGVQEDLRVDGRGCEDYRCVEVETDVVSNTSGSARVKLGHTDILVGVKAEMGTPKLEKPNEGYLEFFVDCSASATPEFEGRGGDDLGTEIANTLYRIFNNKSSVDLKTLCISPREHCWVLYVDVLLLECGGNLFDAISIAVKAALFNTRIPRVRVLEDEEGSKDIELSDDPYDCIRLSVENVPCIVTLCKIGYRHVVDATLQEEACSLASLLVSVTSKGVVTCMRKVGKGSLDPESIFEMMETGKRVGKVLHASLQSVLHKEESLGPKRQKVGFLG

SEQ ID NO: 879514 - protein, 320 aa, Homo sapiens
EGTRADDVRLVGQLGSMASVTLSEAEKVYIVHGVQEDLRVDGRGCEDYRLFDKVGGQKKTPGNCWVDSQNPPKWVLPRVQSLGHTDILVGVKAEMGTPKLEKPNEGYLEFFVDCSASATPEFEGRGGDDLGTEIANTLYRIFNNKSSVDLKTLCISPREHCWVLYVDVLLLECGGNLFDAISIAVKAALFNTRIPRVRVLEDEEGSKDIELSDDPYDCIRLSVENVPCIVTLCKIGYRHVVDATLQEEACSLASLLVSVTSKGVVTCMRKVGKGSLDPESIFEMMETGKRVGKVLHASLQSVLHKEESLGPKRQKVGFLG

SEQ ID NO: 879515 - protein, 265 aa, Homo sapiens
EGTRADDVRLVGQLGSMASVTLSEAEKVYIVHGVQEDLRVDGRGCEDYRCVEVETDVVSNTSGSARVKLGHTDILVGVKAEMGTPKLEKPNEGYLEFFVDCSASATPEFEGRGGDDLGTEIANTLYRIFNNKSSVDLKTLCISPREHCWVLYVDVLLLECGGNLFDAISIAVKAALFNTRIPRVRVLEDEEGSKDIELSDDPYDCIRLSVENVPCIVTLCKIGYRHLRDDETGKRVGKVLHASLQSVLHKEESLGPKRQKVGFLG

SEQ ID NO: 879516 - protein, 297 aa, Homo sapiens
NAHTPTRPSQGVGVGFFSGNCSQLPVITSIKPGFPVPARKRGDVRALRTSPVPVTKRLLPRLWDNALEDLRVDGRGCEDYRCVEVETDVVSNTSGSARVKLGHTDILVGVKAEMGTPKLEKPNEGYLEFFVDCSASATPEFEGRGGDDLGTEIANTLYRIFNNKSSVDLKTLCISPREHCWVLYVDVLLLECGGNLFDAISIAVKAALFNTRIPRVRVLEDEEGSKDIELSDDPYDCIRLSVENVPCIVTLCKIGYRHLRDDETGKRVGKVLHASLQSVLHKEESLGPKRQKVGFLG

SEQ ID NO: 879517 - protein, 71 aa, Homo sapiens
MNEAPGPINFTMFGEKLNGTDPEDVIRNASACFDEEATGTIQEDYLRELMTTMGDQFTDEEVDELHREAPI

SEQ ID NO: 879518 - protein, 35 aa, Homo sapiens
MVGGPSCEVLLCDEEWIGNLLNQQSDHILVKKSCY

SEQ ID NO: 879519 - protein, 95 aa, Homo sapiens
ERRVKCPQVDRGWDPRKASEVEVKNEIVANVGKREILHNTEKEQHTEDTVKDCVDIEVFTAGENTEDQKSSEDTAPFLGTLAGATYEEQVQSQIL

SEQ ID NO: 879520 - protein, 108 aa, Homo sapiens
MTRVPQAPPPTGPGPVVPPCANTKSPRPLPAPPVDSASWRLSNPLPVPILCWPQPAPSSPVLPINSRVGPDLVPLPSPSTVPNWPETGHRKPMNAPPQWPTEGSLCLS

SEQ ID NO: 879521 - protein, 152 aa, Homo sapiens
MVNDPPVPALLWAQEVGHVLAGRARMLLLPFGGLFCTILLLLWVSVFLYGSFYYSYMPTVSHLSPVHFYYRTDCDSSSSSLCSFPVANVSLTKGGRDRVLMYGQPYRVTLELELPEPCESRLGMCLVTISWYTRGGRIISISSRTVMLYYRS

SEQ ID NO: 879522 - protein, 153 aa, Homo sapiens
MVNDPPGTCLTCGPTEVGHVLAGRARMLLLPFGGLFCTILLLLWVSVFLYGSFYYSYMPTVSHLSPVHFYYRTDCDSSSSSLCSFPVANVSLTKGGRDRVLMYGQPYRVTLELELPEPCESRLGMCLVTISWYTRGGRIISISSRTVMLYYRS

SEQ ID NO: 879523 - protein, 153 aa, Homo sapiens; identical to SEQ ID NO: 879522

SEQ ID NO: 879524 - protein, 157 aa, Homo sapiens
GTQAMPPLFSLGYHQCRWNYEDEQDVKAVDAGFDEHDIPYDAMWLDIEHTEGKRYFTWDKNRFPNPKRMQELLRSKKRKLVVISDPHIKIDPDYSVYVKAKDQGFFVKNQEGEDFEGVCWPGLSSYLDFTNPKVREWYSSLFAFPVYQVGFYSFVLF

SEQ ID NO: 879525 - protein, 213 aa, Homo sapiens
GTQAMPPLFSLGYHQCRWNYEDEQDVKAVDAGFDEHDIPYDAMWLDIEHTEGKRYFTWDKNRFPNPKRMQELLRSKKRKLVVISDPHIKIDPDYSVYVKAKDQGFFVKNQEGEDFEGVCWPGLSSYLDFTNPKVREWYSSLFAFPVYQGSTDILFLWNDMNEPSVFRGPEQTMQKNAIHHGNWEHRELHNIYGFYHVRHPKRIKLGLCDPPFG

SEQ ID NO: 879526 - protein, 262 aa, Homo sapiens
GTQAMPPLFSLGYHQCRWNYEDEQDVKAVDAGFDEHDIPYDAMWLDIEHTEGKRYFTWDKNRFPNPKRMQELLRSKKRKLVVISDPHIKIDPDYSVYVKAKDQGFFVKNQEGEDFEGVCWPGLSSYLDFTNPKVREWYSSLFAFPVYQGSTDILFLWNDMNEPSVFRGPEQTMQKNAIHHGNWEHRELHNIYGFYHQMATAEGLIKRSKGKERPFVLTRSFFAGSQKYGAVWTGDNTAEWSNLKISIPMLLTLSITGISFCG

SEQ ID NO: 879527 - protein, 103 aa, Homo sapiens
VQWRDLGSLQPRPPGFKRFSFLSLQSSWDYRHVPPCPANFYIFSRDGVSPCWPRCSQSPDLVIRLPPKCWDYRREPPRPALRSHFYGEREQQLNHRFIFKSVH

SEQ ID NO: 879528 - protein, 133 aa, Homo sapiens
FLLVPAGENSFAENFSLSMGSVLNQQYTSGASKGGGEEPGKLPEPAEEESQVLRGTGHCKWFNVRMGFGFISMINREGSPLDIPVDVFVHQSKLFMEGFRSLKEGEPVEFTFKKSSKGLESIRVTGPGGSPCL

SEQ ID NO: 879529 - protein, 231 aa, Homo sapiens
DDSFSEAHSEFLKAASNLRDNYRFAHTNVESLVNEYDDNGDGIILFRPSHLTNKLEDKTVAYTVQKMTSGKIKKFIQENIFGICPHMTEDNKDLIQGKDLLIAYYDVDYEKNAKGSNYWRNRVMMVAKKFLDAGHKLNFAVASRKTFSHELSDFGLESTAGEIPVVAIRTAKGEKFVMQEDFSRDGNALERFLQDYFDGNLKRYLKSEPIPESNDGPVKVVVAENFECDMK

SEQ ID NO: 879530 - protein, 301 aa, Homo sapiens
DDSFSEAHSEFLKAASNLRDNYRFAHTNVESLVNEYDDNGDGIILFRPSHLTNKLEDKTVAYTVQKMTSGKIKKFIQENIFGICPHMTEDNKDLIQGKDLLIAYYDVDYEKNAKGSNYWRNRVMMVAKKFLDAGHKLNFAVASRKTFSHELSDFGLESTAGEIPVVAIRTAKGEKFVMQEDFSRDGNALERFLQDYFDGNLKRYLKSEPIPESNDGPVKVVVAENFDEIVNNENKDVLIEFYAPWCGHCKNLEPKYKELGEKLSKDLNIVIAKMDATANDVPSPYEVRVFLPYTSLQPTRS

SEQ ID NO: 879531 - protein, 283 aa, Homo sapiens
DDSFSEAHSEFLKAASNLRDNYRFAHTNVESLVNEYDDNGDGIILFRPSHLTNKLEDKTVAYTVQKMTSGKIKKFIQENIFGICPHMTEDNKDLIQGKDLLIAYYDVDYEKFLDAGHKLNFAVASRKTFSHELSDFGLESTAGEIPVVAIRTAKGEKFVMQEDFSRDGNALERFLQDYFDGNLKRYLKSEPIPESNDGPVKVVVAENFDEIVNNENKDVLIEFYAPWCGHCKNLEPKYKELGEKLSKDLNIVIAKMDATANDVPSPYEVRVFLPYTSLQPTRS

SEQ ID NO: 879532 - protein, 193 aa, Homo sapiens
MLVEFFAPWCGHCKRLAPEYEAAATRLKGIVPLAKADCTANTNTCNKYGVSGYPTLNMFRDGEEAGAYDGPRTADGIVSHLKKQAGPASVPLRTEEEFKKFISDKDASIVGFFDDSFSEAHSEFLKAASNLRDNYRFAHTNVESLVNEYDDNGDGIILFRPSHLTNKLEDKTVAYTVQKMTSGKIKKFIQENI

SEQ ID NO: 879533 - protein, 165 aa, Homo sapiens
MVNPTVFFDIAVDGEPLGRVSFELFADKVPKTAENFRALSTGEKGFGYKGSCFHRIIPGFMCQGGDFTRHNGTGGKSIYGEKFEDENFILKHTGPGILSMANAGPNTNGSQFFICTAKTEWLDGKHVVFGKVKEGMNIVEAMERFGSRNGKTSKKITIADCGQLE

SEQ ID NO: 879534 - protein, 118 aa, Homo sapiens
RASASPGPRRPPCCGGEGRLAATAADGGGGPRAFGTSLEGAEPRAPASPRPPGGGVHGPGSRRAWGRDAVRRFRDCPAAAARRLLSPPRFPSALPGLKAAKLRLRKKRENCNPCLQPD

SEQ ID NO: 879535 - protein, 133 aa, Homo sapiens
MMEIRNDALTHTGIVDWYTHHQADKRMSLDHTIQAPHARVKTQKIALLSLERSMMRTLLYVEELLFSYTQEVENQMIDPYGDQRIADRSNKDLYSSVWNSPRVARSHLLLTPPLSNPLQDCHLCIGHALCKST

SEQ ID NO: 879536 - protein, 64 aa, Homo sapiens
MDPPFYLPTLSLVMRHHISSHSLGHQSHCPLPWMPSNVCLLVGDCEDTRIQYSWPRGPLLTIGC

SEQ ID NO: 879537 - protein, 102 aa, Homo sapiens
HPLEKPRHRVGWELPSRPRPHIRKAWLAGFSGPWAPAQDPGGPVCLLSLRSLVPSPPLLARGRRDCACTTSPGPRPVSPGPGVNRALARSSDRSAPAAVLTV

SEQ ID NO: 879538 - protein, 102 aa, Homo sapiens; identical to SEQ ID NO: 879537

SEQ ID NO: 879539 - protein, 102 aa, Homo sapiens
MKFRNNLELFKPGIWKKLTLLFSGKRQESASKSPGSNHGSTVMPLEHEVLQEDAIGMASIPGPGEQPETRRVAQEGTGSQCYTVACQSQSQDLITGSPINQS

SEQ ID NO: 879540 - protein, 102 aa, Homo sapiens; identical to SEQ ID NO: 879539

SEQ ID NO: 879541 - protein, 236 aa, Homo sapiens
MCVCAGCRAAPSRRGAGPLQVAGGWSEGADMDYDSYQHYFYDYDCGEDFYRSTAPSEDIWKKFELVPSPPTSPPWGLGPGAGDPAPGIGPPEPWPGGCTGDEAESRGHSKGWGRNYASIIRRDCMWSGFSARERLERAVSDRLAPGAPRGNPPKASAAPDCTPSLEAGNPAPAAPCPLGEPKTQACSGSESPSDSGKDLPEPSKRGPPHGWPKLCPCLRSGIGSSQALGPSPPLFG

SEQ ID NO: 879542 - protein, 394 aa, Homo sapiens [sequence omitted]

SEQ ID NO: 879543 - protein, 236 aa, Homo sapiens; identical to SEQ ID NO: 879541

SEQ ID NO: 879544 - protein, 272 aa, Homo sapiens
GCRAAPSRRGAGPLQVAGGWSEVRLRVARARARVPRCGLAAGCLLGTARPRPAPPGPGSCAPGGAGKVCFELAAHSRVRALRLASPTTLTRGPASRDARTGRRLQAGGVGEEREPGSRLCRGTRGHLLRPAGTRSARPPFPPAGADMDYDSYQHYFYDYDCGEDFYRSTAPSEDIWKKFELVPSPPTSPPWGLGPGAGDPAPGIGPPEPWPGGCTGDEAESRGHSKGWGRNYASIIRRDCMWSGFSARERLERAVSDRLAPGAPRGNPPKAS

SEQ ID NO: 879545 - protein, 98 aa, Homo sapiens
IFCISRLLCSHGAPVAPMTPYLMLCQPHKRCGDKFYDPLQHCCYDDAVVPLARTQTCGNCTFRVCFEQCCPWTFMVKLINQNCDSARTSDDRLCRSVS

SEQ ID NO: 879546 - protein, 72 aa, Homo sapiens
PSSIPLSLFYDPLQHCCYDDAVVPLARTQTCGNCTFRVCFEQCCPWTFMVKLINQNCDSARTSDDRLCRSVS

SEQ ID NO: 879547 - protein, 38 aa, Homo sapiens
LPGDPRLGPTCHYLLDLTSSVSSSGPHDSLPDAVPATQ

SEQ ID NO: 879548 - protein, 190 aa, Homo sapiens
MWQEAMRRRRYLRDRSEEAAGGGDGLPRSRDWLYESYYCMSQQHPLIVFLLLIVMGSCLALLAVFFALGLEVEDHVAFLITVPTALAIFFAIFILVCIESVFKKLLRLFSLVIWICLVAMGYLFMCFGGTVSPWDQVSFFLFIIFVVYTMLPFNMRDAIIASVLTSSSHTIVLSVCLSATPGGKEHLVWQ

SEQ ID NO: 879549 - protein, 136 aa, Homo sapiens
MRRRRYLRDRSEEAAGGGDGLPRSRDWLYESYYCMSQQHPLIVFLLLIVMGSCLALLAVFFALGLVSGLPAVSSAAPSPALRGARPAEPRPAPGCPSARGSPSARGSLLLLLARGPVDSGKGCGREKSFLGRLFPK

SEQ ID NO: 879550 - protein, 246 aa, Homo sapiens
EQVGSIKERYDHRLMLKHLPPEFSIFLDHISSLDYFTKPDYQLLTSVFDNSIKTFGVIESDPFDWEKTGNDGSLTTTTTSTTPQLHTRLTPAAIGIANATPIPGDLLRENTDEVFPDEQLSDGENGIPVGVSPDKLPGSLGHPRPQEKDVWEEMDANKNKIKLGICKAATEEENSHGQANGLLNAPSLGSPIRVRSEITQPDRDIPLVRKLRSIHSFELEKRLTLEPKPDTDKFLETWYKIVYFSF

SEQ ID NO: 879551 - protein, 177 aa, Homo sapiens
MAWMLLLILIMVHPGSCALWVSQPPEIRTLEGSSAFLPCSFNASQGRLAIGSVTWFRDEVVPGKEVRNGTPEFRGRLAPLASSRFLHDHQAELHIRDVRGHDASIYVCRVEVLGLGVGTGNGTRLVVEKEHPQLGAGTVLLLRAGFYAVSFLSVAVGSTVYYQGKYAKSTLSGFPQL

SEQ ID NO: 879552 - protein, 190 aa, Homo sapiens
MAWMLLLILIMVHPGSCALWVSQPPEIRTLEGSSAFLPCSFNASQGRLAIGSVTWFRDEVVPGKEVRNGTPEFRGRLAPLASSRFLHDHQAELHIRDVRGHDASIYVCRVEVLGLGVGTGNGTRLVVEKEHPQLGAGTVLLLRAGFYAVSFLSVAVGSTVYYQGKCHCHMGTHCHSSDGPRGVIPEPRCP

SEQ ID NO: 879553 - protein, 201 aa, Homo sapiens
MAWMLLLILIMVHPGSCALWVSQPPEIRTLEGSSAFLPCSFNASQGRLAIGSVTWFRDEVVPGKEVRNGTPEFRGRLAPLASSRFLHDHQAELHIRDVRGHDASIYVCRVEVLGLGVGTGNGTRLVVEKEHPQLGAGTVLLLRAGFYAVSFLSVAVGSTVYYQGKCLTWKGPRRQLPAVVPAPLPPPCGSSAHLLPPVPGG

SEQ ID NO: 879554 - protein, 504 aa, Homo sapiens
MLAFSEPYEFVSLEWLQKWLDESTPTKPIDNHACLCSHDKLHPDKISIMKRISEYAADIFYSRYGGGPRLTVKALCKECVVERCRILRLKNQLNEDYKTVNNLLKAAVKGDGFWVGKSSLRSWRQLALEQLDEQDGDAEQSNGKMNGSTLNKDESKEERKEEEELNFNEDILCPHGELCISENERRLVSKEAWSKLQQYFPKAPEFPSYKECCSQCKILEREGEENEALHKMIANEQKTSLPNLFQDKNRPCLSNWPEDTDVLYIVSQFFVEEWRKFVRKPTRCSPVSSVGNSALLCPHGGLMFTFASMTKEDSKLIALIWPSEWQMIQKLFVVDHVIKITRIEVGDVNPSETQYISEPKLCPECREGLLCQQQRDLREYTQATIYVHKVVDNKKVMKDSAPELNVSSSETEEDKEEAKPDGEKDPDFNQIMHAFSVAPFDQNLSIDGKILSDDCATLGTLGVIPESVILLKADEPIADYAAMDDVMQVCMPEEGFKGTGLLGH

SEQ ID NO: 879555 - protein, 556 aa, Homo sapiens [sequence omitted]

SEQ ID NO: 879556 - protein, 556 aa, Homo sapiens [sequence omitted]

SEQ ID NO: 879557 - protein, 413 aa, Homo sapiens
DLEDPTVNKDESKEERKEEEELNFNEDILCPHGELCISENERRLVSKEAWSKLQQYFPKAPEFPSYKECCSQCKILEREGEENEALHKMIANEQKTSLPNLFQDKNRPCLSNWPEDTDVLYIVSQFFVEEWRKFVRKPTRCSPVSSVGNSALLCPHGGLMFTFASMTKEDSKLIALIWPSEWQMIQKLFVVDHVIKITRIEVGDVNPSETQYISEPKLCPECREGLLCQQQRDLREYTQATIYVHKVVDNKKVMKDSAPELNVSSSETEEDKEEAKPDGEKDPDFNQSNGGTKRQKISHQNYIAYQKQVIRRSMRHRKVRGEKALLVSANQTLKELKIQIMHAFSVAPFDQNLSIDGKILSDDCATLGTLGVIPESVILLKADEPIADYAAMDDVMQVCMPEEGFKGTGLLGH

SEQ ID NO: 879558 - protein, 504 aa, Homo sapiens; identical to SEQ ID NO: 879554

SEQ ID NO: 879559 - protein, 550 aa, Homo sapiens
MLAFSEPYEFVSLEWLQKWLDESTPTKPIDNHACLCSHDKLHPDKISIMKRISEYAADIFYSRYGGGPRLTVKALCKECVVERCRILRLKNQLNEDYKTVNNLLKAAVKGDGFWVGKSSLRSWRQLALEQLDEQDGDAEQSNGKMNGSTLNKDESKEERKEEEELNFNEDILCPHGELCISENERRLVSKEAWSKLQQYFPKAPEFPSYKECCSQCKILEREGEENEALHKMIANEQKTSLPNLFQDKNRPCLSNWPEDTDVLYIVSQFFVEEWRKFVRKPTRCSPVSSVGNSALLCPHGGLMFTFASMTKEDSKLIALIWPSEWQMIQKLFVVDHVIKITRIEVGDVNPSETQYISEPKLCPECREGLLCQQQRDLREYTQATIYVHKVVDNKKVMKDSAPELNVSSSETEEDKEEAKPDGEKDPDFNQSNGGTKRQKISHQNYIAYQKQVIRRSMRHRKVRGEKALLVSANQTLKELKIQIMHAFSVAPFDQNLSIDGKILSDDCATLGTLGVIPESVILLKADEPIADYAAMDDVMQGKDEFVLGIC

SEQ ID NO: 879560 - protein, 413 aa, Homo sapiens
MLAFSEPYEFVSLEWLQKWLDESTPTKPIDNHACLCSHDKLHPDKISIMKRISEYAADIFYSRYGGGPRLTVKALCKECVVERCRILRLKNQLNEDYKTVNNLLKAAVKGDGFWVGKSSLRSWRQLALEQLDEQDGDAEQSNGKMNGSTLNKDESKEERKEEEELNFNEDILCPHGELCISENERRLVSKEAWSKLQQYFPKAPEFPSYKECCSQCKILEREGEENEALHKMIANEQKTSLPNLFQDKNRPCLSNWPEDTDVLYIVSQFFVEEWRKFVRKPTRCSPVSSVGNSALLCPHGGLMFTFASMTKEDSKLIALIWPSEWQMIQKLFVVDHVIKITRIEVGDVNPSETQYISEPKLCPECREGLLCQQQRDLREYTQATIYVHKVVDNKKVLVPLVAMTSNDQACSLA

SEQ ID NO: 879561 - protein, 154 aa, Homo sapiens
MKDSAPELNVSSSETEEDKEEAKPDGEKDPDFNQSNGGTKRQKISHQNYIAYQKQVIRRSMRHRKVRGEKALLVSANQTLKELKIQIMHAFSVAPFDQNLSIDGKILSDDCATLGTLGVIPESVILLKADEPIADYAAMDDVMQGKDEFVLGIC

SEQ ID NO: 879562 - protein, 158 aa, Homo sapiens
MRASRSPPSPRRCHHHHEATGAASGAAAGGPGAGCVGLCRLALTPSAQDGRNSTFQTYKKEVCLPRHSMHPGPWAICCECQTRFGGRLPVSRVEAALPYWVPLSLRPRKQHPCWMHAAGTTAGGSAVMSACCPSSSSSRPPTRTSYRLLQRVCCPSAS

SEQ ID NO: 879563 - protein, 148 aa, Homo sapiens [sequence omitted]

SEQ ID NO: 879564 - protein, 114 aa, Homo sapiens
RTLEDIFHEHMQELILMKFIYTSQYDNCLTYRRIYLPPSRPDDLIKPGPPPGHPEGHHGHSPVFWGLKLESSATVKNSHKNVSRSRSLRVHQSGGVCDSRCLLRTESTPRIQPK

SEQ ID NO: 879565 - protein, 236 aa, Homo sapiens
PAGQQTVEIDLRHRIQLPDLENQRNFNELSRIVLEVRERVRQEQQEGGHEAGEGRGRQGPRESQPSPAQPRAEAPSKGPDGTPGEDGGEPGDAVAAAEQPAQCGQGQPFVLPVGVSSRNEDYPRTCRMWNSTFQTYKKEVCLPRHSMHPGPWAICCECQTRFGGRLPVSRVEAALPYWVPLSLRPRKQHPCWMHAAGTTAGGSAVMSACCPSSSSSRPPTRTSYRLLQRVCCPSAS

SEQ ID NO: 879566 - protein, 239 aa, Homo sapiens
MRASRSPPSPRRCHHHHEATGAASGAAAGGPGAGCVGLCRLALTPSAQDGRNSTFQTYKKEVCLPRHSMHPGPWAICCECQTRFGGRLPVSRVEAALPYWVPLSLRPRKQSQKTVQFPIPQTAKMCPCLCHRFGGRLPMPRDQAVMPYWVPQVLRSQQQIVRRQQSLKGIQAPLLDACCWHNCWRICGDECLLSKFQQLQAPYQDQLPAPAARLLPLGLLTLLQAIPRVIMAIRQCFGV

SEQ ID NO: 879567 - protein, 158 aa, Homo sapiens; identical to SEQ ID NO: 879562

SEQ ID NO: 879568 - protein, 120 aa, Homo sapiens
RKKGFRSRPLEKVLGSHAGRNSRHGLTLSPKLECSGAMIAHCNLELLGSGNLPASAFQSTGIPGTNHRAQPALHFFVAFKEILQFNSVMSRTIYHLNVFTKKGIIQLNPRHRACVTTKSN

SEQ ID NO: 879569 - protein, 195 aa, Homo sapiens
QELRSSEQVILTPPLGRGRGHGFTFQLDYKGCEVSLTEQKGREDSTPGKWNEQQSPKGPPAYPLPSTWKKLSTCSLGASSRSAGSYRLKAQLSLSSTVPRRITDKPATKSWEGGRRELCPRVLFTQLLLWVWPGDPGPELQETGFPGPPRPAHLKTDRAIMVGVKGIEEKSGIGAGVCRVSVEKLASTQERTSSL

SEQ ID NO: 879570 - protein, 349 aa, Homo sapiens
SLTLVPPPPFAASSCPAVGVQRLCLFVCVSLQALFMGSPLRFDGRVVLVTGAGAGLGRAYALAFAERGALVVVNDLGGDFKGVGKGSLAADKVVEEIRRRGGKAVANYDSVEEGEKVVKTALDAFGRIDVVVNNAGILRDHSFARISDEDWDIIHRVHLRGSFQVTRAAWEHMKKQKYGRIIMTSSASGIYGNFGQANYSAAKLGLLGLANSLAIEGRKSNIHCNTIAPNAGSRMTQTVMPEDLVEALKPEYVAPLVLWLCHESCEENGGLFEVGAGWIGKLRWERTLGAIVRQKNHPMTPEAVKANWKKICDFENASKPQSIQESTGRIIEVLSTQQLRKRKFTQLHT

SEQ ID NO: 879571 - protein, 177 aa, Homo sapiens
MKKQKYGRIIMTSSASGIYGNFGQANYSAAKLGLLGLANSLAIEGRKSNIHCNTIAPNAGSRMTQTVMPEDLVEALKPEYVAPLVLWLCHESCEENGGLFEVGAGWIGKLRWERTLGAIVRQKNHPMTPEAVKANWKKICDFENASKPQSIQESTGRIIEVLSTQQLRKRKFTQLHT

SEQ ID NO: 879572 - protein, 330 aa, Homo sapiens
SLTLVPPPPFAASSCPAVGVQRLCLFVCVSLQALFMGSPLRFDGRVVLVTGAGAGLGRAYALAFAERGALVVVNDLGGDFKGVGKGSLAADKVVEEIRRRGGKAVANYDSVEEGEKVVKTALDAFGRIDVVVNNAGILRDHSFARISDEDWDIIHRVHLRGSFQVTRAAWEHMKKQKYGRIIMTSSASGIYGNFGQANYSAAKLGLLGLANSLAIEGRKSNIHYLVEALKPEYVAPLVLWLCHESCEENGGLFEVGAGWIGKLRWERTLGAIVRQKNHPMTPEAVKANWKKICDFENASKPQSIQESTGRIIEVLSTQQLRKRKFTQLHT

SEQ ID NO: 879573 - protein, 358 aa, Homo sapiens
SLTLVPPPPFAASSCPAVGVQRLCLFVCVSLQALFMGSPLRFDGRVVLVTGAGAGLGRAYALAFAERGALVVVNDLGGDFKGVGKGSLAADKVVEEIRRRGGKAVANYDSVEEGEKVVKTALDAFGRIDELVSFYIVDVVVNNAGILRDHSFARISDEDWDIIHRVHLRGSFQVTRAAWEHMKKQKYGRIIMTSSASGIYGNFGQANYSAAKLGLLGLANSLAIEGRKSNIHCNTIAPNAGSRMTQTVMPEDLVEALKPEYVAPLVLWLCHESCEENGGLFEVGAGWIGKLRWERTLGAIVRQKNHPMTPEAVKANWKKICDFENASKPQSIQESTGRIIEVLSTQQLRKRKFTQLHT

SEQ ID NO: 879574 - protein, 177 aa, Homo sapiens; identical to SEQ ID NO: 879571

SEQ ID NO: 879575 - protein, 137 aa, Homo sapiens
RVRNTSYLYLWDRVLVSLTSTRCLERGPRAPSSDPMRPPCSSCTAAPPRTGAPRRGRTTTPRPTPPPPPWSPGSPARRPARGISSVQGAEPFCSGNSTKSELSLASSTSTRTSASLLSAVEPRSEAPTRNSNSCRAS

SEQ ID NO: 879576 - protein, 91 aa, Homo sapiens
RVRNTSYLYLWDRVLVSLTSTKMPGKGSSGTEQRPNEASLLLLHSRTATNRSTEKRKNDDTKANATTTIAVLNAEKSCNGLRRIFADGACE

SEQ ID NO: 879577 - protein, 267 aa, Homo sapiens
MVSNSAGSNSRQLPLPLSADAPPASSSHWSWQPSRHTNQPIDRAILRSRPCCRLSRTCHWSLQPPPPPPARQWLGGLAGAGRSSCACALGLPSAGCSAGRARLRGAALEETEAAGGPEAQEEDEDEEEALPHSEAMDVFQEGLAMVVQDPLLCDLPIQVTLEEVNSQIALEYGQAMTVRVCKMDGEVMPVVVVQSATVLDLKKAIQRYVQLKQEREGGIQHISWSYVWRTYHLTSAGEKLTEDRKKLRDYGIRNRDEVSFIKKLRQK

SEQ ID NO: 879578 - protein, 261 aa, Homo sapiens
MGSLPSRRKSLPSPSLSSSVQGQGPVTMEAERSKATAVALGSFPAGGPAELSLRLGEPLTIVSEDGDWWTVLSEVSGREYNIPSVHVAKVSHGWLYEGLSREKAEELLLLPGNPGGAFLIRESQTRRGSYSLSVRLSRPASWDRIRHYRIHCLDNGWLYISPRLTFPSLQALVDHYSELADDICCLLKEPCVLQRAGPLPGKDIPLPVTVQRTPLNWKELDSSLLFSEAATGEESLLSEGLRESLSFYISLNDEAVSLDDA

SEQ ID NO: 879579 - protein, 261 aa, Homo sapiens; identical to SEQ ID NO: 879578

SEQ ID NO: 879580 - protein, 619 aa, Homo sapiens
MDDQQALNSIMQDLAVLHKASRPALSLQETRKAKSSSPKKQNDVRVKFEHRGEKRILQFPRPVKLEDLRSKAKIAFGQSMDLHYTNNELVIPLTTQDDLDKALELLDRSIHMKSLKILLVINGSTQATNLEPLPSLEDLDNTVFGAERKKRLSIIGPTSRDRSSPPPGYIPDELHQVARNGSFTSINSEGEFIPESMEQMLDPLSLSSPENSGSGSCPSLDSPLDGESYPKSRMPRAQSYPDNHQEFSDYDNPIFEKFGKGGTYPRRYHVSYHHQEYNDGRKTFPRARRTQGNQLTSPVSFSPTDHSLSTSSGSSIFTPEYDDSRIRRRGSDIDNPTLTVMDISPPSRSPRAPTNWRLGKLLGQGAFGRVYLCYDVDTGRELAVKQVQFDPDSPETSKEVNALECEIQLLKNFLHERIVQYYGCLRDPQEKTLSIFMEYMPGGSIKDQLKAYGALTENGTRKYTRQILEGVHYLHSNMILHRDIKGANILRDSTGNVKLGDFGASKRLQTICLSGTGMKSVTGTPYWMSPEVISGQGYGRKADIWSVACTVVEMLTEKPPWAEFEAMAAIFKIATQPTNPKLPPHVSDYTRDFLKRIFVEAKLRPSADELLRHMFVHYH

SEQ ID NO: 879581 - protein, 619 aa, Homo sapiens; identical to SEQ ID NO: 879580

SEQ ID NO: 879582 - protein, 363 aa, Homo sapiens
EDAGDTRLGSAAPFWVPRPKPLAVFVSGREVTLSSAAPAALCPRWIPRRGSFKSLAGRPPLGRSPAMRALRAGLTLALGAGLGAVVEGWRRRREDARAAPGLLGRLPVLPVAAAAELPPVPGGPRGPGELAKYGLPGLAQLKSRESYVLCYDPRTRGALWVVEQLRPERLRGDGDRRECDFREDDSVHAYHRATNADYRGSGFDRGHLAAAANHRWSQKAMDDTFYLSNVAPQVPHLNQNAWNNLEKYSRSLTRSYQNVYVCTGPLFLPRTEADGKSYVKYQVIGKNHVAVPTHFFKVLILEAAGGQIELRTYVMPNAPVDEAIPLERFLVPIESIERASGLLFVPNILARAGSLKAITAGSK

SEQ ID NO: 879583 - protein, 106 aa, Homo sapiens
MAPCPRVPGSAHRTEADGKSYVKYQVIGKNHVAVPTHFFKVLILEAAGGQIELRTYVMPNAPVDEAIPLERFLVPIESIERASGLLFVPNILARAGSLKAITAGSK

SEQ ID NO: 879584 - protein, 142 aa, Homo sapiens
LGVNRPRQALPPSVSALLGAPRTWAGRVALCRSAVHQALPPSVSALLGALPSTLLGSLNLDLPDPGPPLLLLCSPASQVEATEHLWVCSVVFLACRGLGLRGNRSRLSSSLWNPQARDGVQASSPSSLVLWANDLCPPLQNL

SEQ ID NO: 879585 - protein, 363 aa, Homo sapiens; identical to SEQ ID NO: 879582

SEQ ID NO: 879586 - protein, 104 aa, Homo sapiens
MSHASPGPGPWTEADGKSYVKYQVIGKNHVAVPTHFFKVLILEAAGGQIELRTYVMPNAPVDEAIPLERFLVPIESIERASGLLFVPNILARAGSLKAITAGSK

SEQ ID NO: 879587 - protein, 851 aa, Homo sapiens
MSSKQEIMSDQRFRRVAKDPRFWEMPEKDRKVKIDKRFRAMFHDKKFKLNYAVDKRGRPISHSTTEDLKRFYDLSDSDSNLSGEDSKALSQKKIKKKKTQTKKEIDSKNLVEKKKETKKANHKGSENKTDLDNSIGIKKMKTSCKFKIDSNISPKKDSKEFTQKNKKEKKNIVQHTTDSSLEEKQRTLDSGTSEIVKSPRIECSKTRREMQSVVQLIMTRDSDGYENSTDGEMCDKDALEEDSESVSEIGSDEESENEITSVGRASGDDDGSEDDEEEDEDEEEDEDEDSEDDDKSDSGPDLARGKGNIETSSEDEDDTADLFPEESGFEHAWRELDKDAPRADEITRRLAVCNMDWDRLKAKDLLALFNSFKPKGGVIFSVKIYPSEFGKERMKEEQVQGPVELLSIPEDAPEKDWTSREKLRDYQFKRLKYYYAVVDCDSPETASKIYEDCDGLEFESSCSFIDLRFIPDDITFDDEPKDVASEVNLTAYKPKYFTSAAMGTSTVEITWDETDHERITMLNRKFKKEELLDMDFQAYLASSSEDEEEIEEELQGDDGVNVEEDGKTKKSQKDDEEQIAKYRQLLQVIQEKEKKGKENDMEMEIKWVPGLKESAEEMVKNKLEGKDKLTPWEQFLEKKKEKKRLKRKQKALAEEASEEELPSDVDLNDPYFAEEVKQIGINKKSVKSAKDGTSPEEEIEIERQKAEMALLMMDEDEDSKKHFNYNKIVEHQNLSKKKKKQLMKKKELIEDDFEVNVNDARFQAMYTSHLFNLDPSDPNFKKTKAMEKILEEKARQRERKEQELTQAIKKKESEIEKESQRKSIDPALSMLIKSIKTKTEQFQARKKQKVK

SEQ ID NO: 879588 - protein, 851 aa, Homo sapiens; identical to SEQ ID NO: 879587

SEQ ID NO: 879589 - protein, 866 aa, Homo sapiens
MSSKQEIMSDQRFRRVAKDPRFWEMPEKDRKVKIDKRFRAMFHDKKFKLNYAVDKRGRPISHSTTEDLKRFYDLSDSDSNLSGEDSKALSQKKIKKKKTQTKKEIDSKNLVEKKKETKKANHKGSENKTDLDNSIGIKKMKTSCKFKIDSNISPKKDSKEFTQKNKKEKKNIVQHTTDSSLEEKQRTLDSGTSEIVKSPRIECSKTRREMQSVVQLIMTRDSDGYENSTDGEMCDKDALEEDSESVSEIGSDEESENEITSVGRASGDDDGSEDDEEEDEDEEEDEDEDSEDDDKSDSGPDLARGKGNIETSSEDEDDTADLFPEESGFEHAWRELDKDAPRADEITRRLAVCNMDWDRLKAKDLLALFNSFKPKGGVIFSVKIYPSEFGKERMKEEQVQGPVELLSIPEDAPEKDWTSREKLRDYQFKRLKYYYAVVDCDSPETASKIYEDCDGLEFESSCSFIDLRFIPDDITFDDEPKDVASEVNLTAYKPKYFTSAAMGTSTVEITWDETDHERITMLNRKFKKEELLDMDFQAYLASSSEDEEEIEEELQGDDGVNVEEDGKTKKSQKDDEEQIAKYRQLLQVIQEKEKKGKENDMEMEIKWVPGLKESAEEMVKNKLEGKDKLTPWEQFLEKKKEKKRLKRKQKALAEEASEEELPSDVDLNDPYFAEEVKQIGINKKSVKSAKDGTSPEEEIEIERQKAEMALLMMDEDEDSKKHFNYNKIVEHQNLSKKKKKQLMKKKELIEDDFEVNVNDARFQAMYTSHLFNLDPSDPNFKKTKAMEKILEEKARQRERKEQELTQNLSKKKKKQLMKKKELIEDDFEVNVNDARFQAMYTSHLFNLDPSDPNFKKTKLWKKSLRR

SEQ ID NO: 879590 - protein, 851 aa, Homo sapiens; identical to SEQ ID NO: 879587

SEQ ID NO: 879591 - protein, 851 aa, Homo sapiens; identical to SEQ ID NO: 879587

SEQ ID NO: 879592 - protein, 253 aa, Homo sapiens
ERHLDFGLLDSGTVRDEVILIYATKFVEFVTEPEDPSRERVPMEMGLKRKQKALAEEASEEELPSDVDLNDPYFAEEVKQIGINKKSVKSAKDGTSPEEEIEIERQKAEMALLMMDEDEDSKKHFNYNKIVEHQNLSKKKKKQLMKKKELIEDDFEVNVNDARFQAMYTSHLFNLDPSDPNFKKTKAMEKILEEKARQRERKEQELTQAIKKKESEIEKESQRKSIDPALSMLIKSIKTKTEQFQARKKQKVK

SEQ ID NO: 879593 - protein, 174 aa, Homo sapiens
MAGSGAWKRLKSMLRKDDAPLFLNDTSAFDFSDEAGDEGLSRFNKLRVVVADDGSEAPERPVNGAHPTLQADDDSLLDQDLPLTNSQLSLKVDSCDNCSKQREILKQRKVKARLTIAAVLYLLFMIGELVGELCCQLTFRLPFLESLCQAVVTQALRFNPSFQEVCIYQDTDLM

SEQ ID NO: 879594 - protein, 181 aa, Homo sapiens [sequence omitted]

SEQ ID NO: 879595 - protein, 417 aa, Homo sapiens [sequence omitted]

SEQ ID NO: 879596 - protein, 429 aa, Homo sapiens
MAGSGAWKRLKSMLRKDDAPLFLNDTSAFDFSDEAGDEGLSRFNKLRVVVADDGSEAPERPVNGAHPTLQADDDSLLDQDLPLTNSQLSLKVDSCDNCSKQREILKQRKVKARLTIAAVLYLLFMIGELVGGYIANSLAIMTDALHMLTDLSAIILTLLALWLSSKSPTKRFTFGFHRLEVLSAMISVLLVYILMGFLLYEAVQRTIHMNYEINGDIMLITAAVGVAVNVIMGFLLNQSGHRHSHSHSLPSNSPTRGSGCERNHGQDSLAVRAAFVHALGDLVQSVGVLIAAYIIRFKPEYKIADPICTYVFSLLVAFTTFRIIWDTVVIILEGVPSHLNVDYIKEALMKIEDVYSVEDLNIWSLTSGKSTAIVHIQLIPGSSSKWEEVQSKANHLLLNTFGMYRCTIQLQSYRQEVDRTCANCQSSSP

SEQ ID NO: 879597 - protein, 52 aa, Homo sapiens
MSHKASGRQCYSLIPGSLRPKFSLNHLPFLGLIVSSFMFFLATTSLDLILVS

SEQ ID NO: 879598 - protein, 116 aa, Homo sapiens
MCCIHSGLNGLRAVQDGFVKQMLEGSMLLKSHHHSLISSTQGHKHCGRPQGPLPRKTRDLCSLVYLLTFPPLLSCDPANIPLYEKHPRMINKKKRKKKNLFLCEMGLISPTGGAEE

SEQ ID NO: 879599 - protein, 110 aa, Homo sapiens
PLFLILFPGLSPRGSELCTQVCIWHFSSRFLNNFIYHNYFHQDRNLSIFFIKILYHENCQIYAKTKRMTLHIPLLRYTEYQDFVILSSSVVSLFFVKVKISDVSFHPYLL

SEQ ID NO: 879600 - protein, 341 aa, Homo sapiens
SRAAGDRTPQAPPACSRGSLAYPSPTSSAPPGEQPRLSKSLNACGAEPAVLSYPSRLCTADCSGQLHSDTIPQANRTQTCWALIPWFWALHRLALLQGAVLPEVAKPPDPTPTLGSVFHEDTEDERSSGRARGQMACQAVSREQLPFPKAGLTPRIHCGPVRPQNLQPSKAGYALRQDPGGPSEPLRGAEGAQQGGAEPEGWEPNNSSLQGHHQKLRPGAQMGQASESASPGGHGPERRPESLGHQLLVPEGHVKERCGRMRLGRGRGRSQVKGQFPAPDGAWREAEARLSGLPTLRLRTSPAPPTGMATSPLGQQEQARQRSTESRDAVRGGQGTLDGSQ

SEQ ID NO: 879601 - protein, 517 aa, Homo sapiens
MPSPLGPPCLPVMDPETTLEEPETARLRFRGFCYQEVAGPREALARLRELCCQWLQPEAHSKEQMLEMLVLEQFLGTLPPEIQAWVRGQRPGSPEEAAALVEGLQHDPGQLLGWITAHVLKQEVLPAAQKTEEPLGSPHPSGTVESPGEGPQDTRIEGSVQLSCSVKEEPNVDGQEVAPSSPPLAAQSPEGNHGHQEPASTSFHPPRIQEEWGLLDRSQKELYWDAMLEKYGTVVSLGEDQPAPPRPFPGACTHPAAGLAGQGLCATSPTQLSHLPEEHPVTYQNRPHPSFMQTPCLTVPPTRAGLPPHQPEAQAQSELGMLLTGTGVCRSLRSGNESEGPPGCPEAQPPQGPGPAAWEGLSGAATPAPTVRPGTPPVPTQPTPAETRLEPAATPRKPYTCEQCGRGFDWKSVFVIHHRTHTSGPGVQSPGLATGESTEKPPQGEVAFPHHPRRSLTGPRSYPCEECGCSFSWKSQLVIHRKSHTGQRRHFCSDCGRAFDWKSQLVIHRKGHRPEVP

SEQ ID NO: 879602 - protein, 450 aa, Homo sapiens
MPSPLGPPCLPVMDPETTLEEPETARLRFRGFCYQEVAGPREALARLRELCCQWLQPEAHSKEQMLEMLVLEQFLGTLPPEIQAWVRGQRPGSPEEAAALVEGLQHDPGQLLGWITAHVLKQEVLPAAQKTEEPLGSPHPSGTVESPGEGPQDTRIEGSVQLSCSVKEEPNVDGQEVAPSSPPLAAQSPEGNHGHQEPASTSFHPPRIQEEWGLLDRSQKELYWDAMLEKYGTVVSLGLPPHQPEAQAQSELGMLLTGTGVCRSLRSGNESEGPPGCPEAQPPQGPGPAAWEGLSGAATPAPTVRPGTPPVPTQPTPAETRLEPAATPRKPYTCEQCGRGFDWKSVFVIHHRTHTSGPGVQSPGLATGESTEKPPQGEVAFPHHPRRSLTGPRSYPCEECGCSFSWKSQLVIHRKSHTGQRRHFCSDCGRAFDWKSQLVIHRKGHRPEVP

SEQ ID NO: 879603 - protein, 450 aa, Homo sapiens; identical to SEQ ID NO: 879602

SEQ ID NO: 879604 - protein, 230 aa, Homo sapiens
MPSPLGPPCLPVMDPETTLEEPETARLRFRGFCYQEVAGPREALARLRELCCQWLQPEAHSKEQMLEMLVLEQFLGTLPPEIQAWVRGQRPGSPEEAAALVEGLQHDPGQLLGWITAHVLKQEVLPAAQKTEEPLGSPHPSGTVESPGEGPQDTRIEGSVQLSCSVKEEPNVDGQEVAPSSPPLAAQSPEGNHGHQEPASTSFHPPRIQEEWGQVARDRKDVPGIARGDR

SEQ ID NO: 879605 - protein, 146 aa, Homo sapiens
MSVAPQNTNGPNGNPTPNFLRELLWRRLAPHVVALGTTDSGGQSALDPESAAQGRVPTSPHPFVRHRMERHWGSSVRSVGGTGWTKGLPNSRFGGEQPGPDPRPQHRSRPRSPISRLCTNSSRKPRNPEALLVSKPFISPHQKVGV

SEQ ID NO: 879606 - protein, 146 aa, Homo sapiens; identical to SEQ ID NO: 879605

SEQ ID NO: 879607 - protein, 87 aa, Homo sapiens
IYIFRVMYKIKLKYYILLIYWLTFAVGRSFRGFGYGLTFLPLLSMLMWNLYYMFVVEPERMLTATESRLDYPDHARSASDYRPRPWG

SEQ ID NO: 879608 - protein, 394 aa, Homo sapiens
MTEQETLALLEVKRSDSPEKSSPQALVPNGRQPEGEGGAESPGAESLRVGSSAGSPTAIEGAEDGLDSTVSEAATLPWGTGPQPSAPFPDPPGWRDIEPEPPESEPLTKLEELPEDDANLLPEKAARAFVPIDLQCIERQPQEDLIVRCEAGEGECRTFMPPRVTHPDPTERKWAEAVVRPPGCSCGGCGSCGDREWLRAVASVGAALILFPCLLYGAYAFLPFDVPRLPTMSSRLIYTLRCGVFATFPIVLGILVYGLSLLCFSALRPFGEPRREVEIHRRYVAQSVQLFILYFFNLAVLSTYLPQDTLKLLPLLTGLFAVSRLIYWLTFAVGRSFRGFGYGLTFLPLLSMLMWNLYYMFVVEPERMLTATESRLDYPDHARSASDYRPRPWG

SEQ ID NO: 879609 - protein, 394 aa, Homo sapiens; identical to SEQ ID NO: 879608

SEQ ID NO: 879610 - protein, 394 aa, Homo sapiens; identical to SEQ ID NO: 879608

SEQ ID NO: 879611 - protein, 394 aa, Homo sapiens; identical to SEQ ID NO: 879608

SEQ ID NO: 879612 - protein, 394 aa, Homo sapiens; identical to SEQ ID NO: 879608

SEQ ID NO: 879613 - protein, 87 aa, Homo sapiens
CNIMIYIFYVFDFLQTRLIYWLTFAVGRSFRGFGYGLTFLPLLSMLMWNLYYMFVVEPERMLTATESRLDYPDHARSASDYRPRPWG

SEQ ID NO: 879614 - protein, 133 aa, Homo sapiens
RPPYSYSALIAMAIQSAPERKLTLSHIYQFVADSFPFYQRSKAGWQNSIRHNLSLNDCFKKVPRDEDDPGKGNYWTLDPNCEKMFDNGNFRRKRKRRSEASNGSTVAAGTSKSEEGLSSGLGSGVGGKPEEES

SEQ ID NO: 879615 - protein, 174 aa, Homo sapiens
RPPYSYSALIAMAIQSAPERKLTLSHIYQFVADSFPFYQRSKAGWQNSIRHNLSLNDCFKKVPRDEDDPGEGRWQVLPSRGGRTRVARAGAGVGVRLEDLPGVFLSRLRVGADGGITTQPRGQREGAGDLRKEDSVRKELDLYIHIRRGGPIRETKKICIPEQKATPGWCSLGL

SEQ ID NO: 879616 - protein, 1052 aa, Homo sapiens
FILRPSRFIQRTFTDIGIKYYRNEFKMKVPIIMVNSVSDLHGYIDKSQLTRELGGTLEYRHGQWVNHRTAIENFALTLKTTAQMLQTFGSCLATAELPRSMLSTEDLLMSHTRQRDKLQDELKLLGKQGTTLLSCIQEPATKCPNSKLNLNQLENVTTMERLLVQLDETEKAFSHFWSEHHLKLNQCLQLQHFEHDFCKAKLALDNLLEEQAEFTGIGDSVMHVEQILKEHKKLEEKSQEPLEKAQLLALVGDQLIQSHHYAADAIRPRCVELRHLCDDFINGNKKKWDILGKSLEFHRQLDKVSQWCEAGIYLLASQAVDKCQSREGVDIALNDIATFLGTVKEYPLLSPKEFYNEFELLLTLDAKAKAQKVLQRLDDVQEIFHKRQVSLMKLAAKQTRPVQPVAPHPESSPKWVSSKTSQPSTSVPLARPLRTSEEPYTEAELNSRGKEDDETKFEVKSEEIFESHHERGNPELEQQARLGDLSPRRRIIRDLLETEEIYIKEIKSIIDGYITPMDFIWLKHLIPDVLQNNKDFLFGNIRELYEFHNRTFLKELEKCAENPELLAHCFLKRKEDLQIYFKYHKNLPRARAIWQECQDCAYFGVCQRQLDHNLPLFKYLKGPSQRLIKYQMLLKGLLDFESPEDMEIDPGELGGSAKDGPKRTKDSAFSTELQQALAVIEDLIKSCELAVDLAAVTECPDDIGKLGKLLLHGPFSVWTIHKDRYKMKDLIRFKPSQRQIYLFERGIVFCKIRMEPGDQGLSPHYSFKKAMKLMTLSIRQLGRGSHRKFEIASRNGLEKYILQAASKEIRDCWFSEISKLLMEQQNNIKDQGNPQFEMSTSKGSGAGSGPWIKNMERATTSKEDPASSTGGIKGCSSREFSSMDTFEDCEGAEDMEKESSALSLAGLFQSDDSHETCSSKSAFLERGESSQGEKEERDEEETATRSTEEERAGASTGRLAPAGATAGFQAGRCARGPPPRRADLPADAPAPRLQSARIPGRGGVGARALPSYAESSRSLGGGRKGTTRASSEEPEGCPGCAPSSARGTSELL

SEQ ID NO: 879617 - protein, 605 aa, Homo sapiens
MLISPYCYNCLTFQAIENFALTLKTTAQMLQTFGSCLATAELPRSMLSTEDLLMSHTRQRDKLQDELKLLGKQGTTLLSCIQEPATKCPNSKLNLNQLENVTTMERLLVQLDETEKAFSHFWSEHHLKLNQCLQLQHFEHDFCKAKLALDNLLEEQAEFTGIGDSVMHVEQILKEHKKLEEKSQEPLEKAQLLALVGDQLIQSHHYAADAIRPRCVELRHLCDDFINGNKKKWDILGKSLEFHRQLDKVSQWCEAGIYLLASQAVDKCQSREGVDIALNDIATFLGTVKEYPLLSPKEFYNEFELLLTLDAKAKAQKVLQRLDDVQEIFHKRQVSLMKLAAKQTRPVQPVAPHPESSPKWVSSKTSQPSTSVPLARPLRTSEEPYTEAELNSRGKEDDETKFEVKSEEIFESHHERGNPELEQQARLGDLSPRRRIIRDLLETEEIYIKEIKSIIDGYITPMDFIWLKHLIPDVLQNNKDFLFGNIRELYEFHNRTFLKELEKCAENPELLAHCFLKRKEDLQIYFKYHKNLPRARAIWQECQDCAYFGVMLRRQTSSWKMFLCIKLLKKSKVGLGRGTWHCDLCLFKVSHTLKLHMKSCNGIGL

SEQ ID NO: 879618 - protein, 524 aa, Homo sapiens
SHRPIWMPVEMNANLNITFSFFLERLLVQLDETEKAFSHFWSEHHLKLNQCLQLQHFEHDFCKAKLALDNLLEEQAEFTGIGDSVMHVEQILKEHKKLEEKSQEPLEKAQLLALVGDQLIQSHHYAADAIRPRCVELRHLCDDFINGNKKKWDILGKSLEFHRQLDKVSQWCEAGIYLLASQAVDKCQSREGVDIALNDIATFLGTVKEYPLLSPKEFYNEFELLLTLDAKAKAQKVLQRLDDVQEIFHKRQVSLMKLAAKQTRPVQPVAPHPESSPKWVSSKTSQPSTSVPLARPLRTSEEPYTEAELNSRGKEDDETKFEVKSEEIFESHHERGNPELEQQARLGDLSPRRRIIRDLLETEEIYIKEIKSIIDGYITPMDFIWLKHLIPDVLQNNKDFLFGNIRELYEFHNRTFLKELEKCAENPELLAHCFLKRKEDLQIYFKYHKNLPRARAIWQECQDCAYFGVMLRRQTSSWKMFLCIKLLKKSKVGLGRGTWHCDLCLFKVSHTLKLHMKSCNGIGL

SEQ ID NO: 879619 - protein, 311 aa, Homo sapiens
FILRPSRFIQRTFTDIGIKYYRNEFKMKVPIIMVNSVSDLHGYIDKSQLTRELGGTLEYRHGQWVNHRTAIENFALTLKTTAQMLQTFGSCLATAELPRSMLSTEDLLMSHTRQRDKLQDELKLLGKQGTTLLSCIQEPATKCPNSKLNLNQLENVTTMERLLVQLDETEKAFSHFWSEHHLKLNQCLQLQHFEHDFCKAKLALDNLLEEQAEFTGIGDSVMHVEQILKEHKKLEEKSQEPLEKAQLLALVGDQLIQSHHYAADAIRPRCVELRHLCDDFINGNKKKWDILGKSLEFHRQLDKVSKTQPRT

SEQ ID NO: 879620 - protein, 290 aa, Homo sapiens [sequence omitted]

SEQ ID NO: 879621 - protein, 111 aa, Homo sapiens
MKNATIVMSVRREQGSSSGEGSLSFEDVAVGFTREEWQFLDQSQKVLYKEVMLENYINLVSIGYRGTKPDSLFKLEQGEPPGIAEGAAHSQICPGYSFRRRTLQMEGMQES

SEQ ID NO: 879622 - protein, 290 aa, Homo sapiens [sequence omitted]

SEQ ID NO: 879623 - protein, 193 aa, Homo sapiens
RYLWFWPLCCTVIIKEVPPPPAEESEEEDDDGLPKKKWPTVDASYYGGRGVGGIKRMEVRWGEKGSTEEGAKLEKAKNARVKMPEQEYEFPEPRNLNNNMRRPSSPRKWYSPIKGKLDALWVLLRKGYDRVSVMRPQPGDTGRRINFTRVKNNQPAKYPLNNARTYKYLTTTSGKAQNRQKRENILELLAPKS

SEQ ID NO: 879624 - protein, 84 aa, Homo sapiens
MKTISLQPPPLYQRRQISLEILKKPHPQSNVIIYLVLQLHKLSKLCCAGLSYLAFALRSDTSLPVTRGWNPAYTIAETSSQDTK

SEQ ID NO: 879625 - protein, 149 aa, Homo sapiens
MALAGRHPRNLASVASAVCGVRGAAGRVEHFCHLQIILARWQVYGLWSKKYLPLPLTWGSLSFEDVAVGFTREEWQFLDQSQKVLYKEVMLENYINLVSIGYRGTKPDSLFKLEQGEPPGIAEGAAHSQICPGYSFRRRTLQMEGMQES

SEQ ID NO: 879626 - protein, 290 aa, Homo sapiens [sequence omitted]

SEQ ID NO: 879627 - protein, 111 aa, Homo sapiens; identical to SEQ ID NO: 879621

SEQ ID NO: 879628 - protein, 68 aa, Homo sapiens
SALPLENSSLRTTVAMKTISLQPPPLYQRRQISLEILKKPHPQSNVIIYLVLQLHDVVPFFVLTHSLT

SEQ ID NO: 879629 - protein, 372 aa, Homo sapiens
MSRRRFDCRSISGLLTTTPQIPIKMENFNNFYILTSKELGRGKFAVVRQCISKSTGQEYAAKFLKKRRRGQDCRAEILHEIAVLELAKSCPRVINLHEVYENTSEIILILEYAAGGEIFSLCLPELAEMVSENDVIRLIKQILEGVYYLHQNNIVHLDLKPQNILLSSIYPLGDIKIVDFGMSRKIGHACELREIMGTPEYLAPEILNYDPITTATDMWNIGIIAYMLLTHTSPFVGEDNQETYLNISQVNVDYSEETFSSVSQLATDFIQSLLVKNPEKRPTAEICLSHSWLQQWDFENLFHPEETSSSSQTQDHSVRSSEDKTSKSSCNGTCGDREDKENIPEDSSMVSKRFRFDDSLPNPHELVSDLLC

SEQ ID NO: 879630 - protein, 372 aa, Homo sapiens; identical to SEQ ID NO: 879629

SEQ ID NO: 879631 - protein, 372 aa, Homo sapiens; identical to SEQ ID NO: 879629

SEQ ID NO: 879632 - protein, 186 aa, Homo sapiens
MRVNFLGKSGGTPEYLAPEILNYDPITTATDMWNIGIIAYMLLTHTSPFVGEDNQETYLNISQVNVDYSEETFSSVSQLATDFIQSLLVKNPEKRPTAEICLSHSWLQQWDFENLFHPEETSSSSQTQDHSVRSSEDKTSKSSCNGTCGDREDKENIPEDSSMVSKRFRFDDSLPNPHELVSDLLC

SEQ ID NO: 879633 - protein, 107 aa, Homo sapiens
TTVGDDWPAKRQRLKRPTAEICLSHSWLQQWDFENLFHPEETSSSSQTQDHSVRSSEDKTSKSSCNGTCGDREDKENIPEDSSMVSKRFRFDDSLPNPHELVSDLLC

SEQ ID NO: 879634 - protein, 372 aa, Homo sapiens; identical to SEQ ID NO: 879629

SEQ ID NO: 879635 - protein, 372 aa, Homo sapiens; identical to SEQ ID NO: 879629

SEQ ID NO: 879636 - protein, 213 aa, Homo sapiens [sequence omitted]

SEQ ID NO: 879637 - protein, 111 aa, Homo sapiens
MSRRRFDCRSISGLLTTTPQIPIKMENFNNFYILTSKELGRGKFAVVRQCISKSTGQEYAAKFLKKRRRGQDCRAEILHEIAVLELAKSCPRVINLHEVYENTSEIILILE

SEQ ID NO: 879638 - protein, 71 aa, Homo sapiens
SPKSQLAHGPSGLMATSRACQPTHPCALTASAPGNAAARVCMCVHSVCVCVYVGDLAAPGRLALLGNGFCL

SEQ ID NO: 879639 - protein, 106 aa, Homo sapiens
SLRMSLSLMRLSAKSAKPGCGYFPGEVLLESCLPSAVGQPLLWVPLLKLPSSESSKVPLPVSPVHSLLEEFFRTFKDLDEATVRKTHFAVIQKQVTQCVMFASKLV

SEQ ID NO: 879640 - protein, 106 aa, Homo sapiens; identical to SEQ ID NO: 879639

SEQ ID NO: 879641 - protein, 70 aa, Homo sapiens
MSFLFGSRSSKTFKPKKNIPEGSHQYELLKHAEATLGSGNLRMAVMLPEGEDLNEWVAVNTVDFLQSDQP

SEQ ID NO: 879642 - protein, 306 aa, Homo sapiens
PRTQTDYENSLTMKMFLFQFVNYYSSCFYIAFFKGKFVGYPGDPVYWLGKYRNEECDPGGCLLELTTQLTIIMGGKAIWNNIQEVLLPWIMNLIGRFHRVSGSEKITPRWEQDYHLQPMGKLGLFYEYLEMIIQFGFVTLFVASFPLAPLLALVNNILEIRVDAWKLTTQFRRLVPEKAQDIGAWQPIMQGIAILAVVTNAMIIAFTSDMIPRLVYYWSFSVPPYGDHTSYTMEGYINNTLSIFKVADFKNKSKGNPYSDLGNHTTCRYRDFRYPPGHPQEYKHNIYYWHVIAAKLAFIIVMEHVI

SEQ ID NO: 879643 - protein, 102 aa, Homo sapiens
IRKSGPRWVIAEEGGHAVFSCSGDGDPAPTVSWMRPHGAWLGRAGRVRVLEDGTLEIRSVQLRDRGAYVCVVSNVAGNDSLRTWLEVIQVEPPNGTLSDPNI

SEQ ID NO: 879644 - protein, 342 aa, Homo sapiens
MNAIVALCHFCELHGPRTLFCTEVLHAPLPQGDGNEDSPGQGEQAEEEEGGIQMNSRMRAHSPAEGASVESSSPGPKKSDMCEGCRSLAAGHPGYISHDKETSIKYVSHQHPSHPQLFSIVRQACVRSLSCEVCPGREGPIFFGDEQHGFVFSHTFFIKDSLARGFQRWYSIITIMMDRIYLINSWPFLLGKVRGIIDELQGKALKVFEAEQFGCPQRAQRMNTAFTPFLHQRNGNAARSLTSLTSDDNLWACLHTSFAWLLKACGSRLTEKLLEGAPTEDTLVQMEKLAGEAGVLLPGPWPGWPWGGTSCLLSWQESLREGNAALNQPRTSLREAHPPISV

SEQ ID NO: 879645 - protein, 289 aa, Homo sapiens [sequence omitted]

SEQ ID NO: 879646 - protein, 342 aa, Homo sapiens; identical to SEQ ID NO: 879644

SEQ ID NO: 879647 - protein, 197 aa, Homo sapiens
MNAIVALCHFCELHGPRTLFCTEVLHAPLPQGDGNEDSPGQGEQAEEEEGGIQMNSRMRAHSPAEGASVESSSPGPKKSDMCEGCRSLAAGHPGYISHDKETSIKYVSHQHPSHPQLFSIVRQACVRSLSCEVSLVATEPVSVGAHMLPGALGGLGASIAQGGRHWSSLRADPQISTAQGTGRLPCPELREESCWTC

SEQ ID NO: 879648 - protein, 219 aa, Homo sapiens
MNAIVALCHFCELHGPRTLFCTEVLHAPLPQGDGNEDSPGQGEQAEEEEGGIQMNSRMRAHSPAEGASVESSSPGPKKSDMCEGCRSLAAGHPGYISHDKETSIKYVSHQHPSHPQLFSIVRQACVRSLSCEVCPGREGPIFFGDEQHGFVFSHTFFIKDSLARGFQRWYSIITIMMDRIYLINSWPFLLGKVRGIIDELQGKALKMIPGLPSRRAGVD

SEQ ID NO: 879649 - protein, 189 aa, Homo sapiens
NDWTGGTLCALHGESIVGLILQESGPGVGCERVGVRAAGSFGLKRPSLPFAFQVFEAEQFGCPQRAQRMNTAFTPFLHQRNGNAARSLTSLTSDDNLWACLHTSFAWLLKACGSRLTEKLLEGAPTEDTLVQMEKLAGEAGVLLPGPWPGWPWGGTSCLLSWQESLREGNAALNQPRTSLREAHPPISV

SEQ ID NO: 879650 - protein, 165 aa, Homo sapiens
MNSRMRAHSPAEGASVESSSPGPKKSDMCEGCRSLAAGHPGYISHDKETSIKYVSHQHPSHPQLFSIVRQACVRSLSCEVCPGREGPIFFGDEQHGFVFSHTFFIKDSLARGFQRWYSIITIMMDRIYLINSWPFLLGKVRGIIDELQGKALKVERESWCPAVQG

SEQ ID NO: 879651 - protein, 342 aa, Homo sapiens; identical to SEQ ID NO: 879644

SEQ ID NO: 879652 - protein, 222 aa, Homo sapiens
MNAIVALCHFCELHGPRTLFCTEVLHAPLPQGDGNEDSPGQGEQAEEEEGGIQMNSRMRAHSPAEGASVESSSPGPKKSDMCEGCRSLAAGHPGYISHDKETSIKYVSHQHPSHPQLFSIVRQACVRSLSCEVCPGREGPIFFGDEQHGFVFSHTFFIKDSLARGFQRWYSIITIMMDRIYLINSWPFLLGKVRGIIDELQGKALKVNSEMRCRGGRGPCTA

SEQ ID NO: 879653 - protein, 197 aa, Homo sapiens; identical to SEQ ID NO: 879647

SEQ ID NO: 879654 - protein, 83 aa, Homo sapiens
MLKKQFQAWAAGREAGCSTPHHHAHRALLLPRVSGFGRPCLVCVHSLPVRSEDRTSDFWIRNRGGGSPEEKRLWVLASVHYSV

SEQ ID NO: 879655 - protein, 470 aa, Homo sapiens
MGIWTSGTDIFLSLWEIYVSPRSPGWMDFIQHLGVCCLVALISVGLLSVAACWFLPSIIAAAASWIITCVLLCCSKHARCFILLVFLSCGLREGRNALIAAGTGIVILGHVENIFHNFKGLLDGMTCNLRAKSFSIHFPLLKKYIEAIQWIYGLATPLSVFDDLVSWNQTLAVSLFSPSHVLEAQLNDSKGEVLSVLYQMATTTEVLSSLGQKLLAFAGLSLVLLGTGLFMKRFLGPCGWKYENIYITRQFVQFDERERHQQRPCVLPLNKEERRKYVIIPTFWPTPKERKNLGLFFLPILIHLCIWVLFAAVDYLLYRLIFSVSKQFQSLPGFEVHLKLHGEKQGTQDIIHDSSFNISVFEPNCIPKPKFLLSETWVPLSVILLILVMLGLLSSILMQLKILVSASFYPSVERKRIQYLHAKLLKKRSKQPLGEVKRRLSLYLTKIHFWLPVLKMIRKKQMDMASADKS

SEQ ID NO: 879656 - protein, 470 aa, Homo sapiens; identical to SEQ ID NO: 879655

SEQ ID NO: 879657 - protein, 470 aa, Homo sapiens; identical to SEQ ID NO: 879655

SEQ ID NO: 879658 - protein, 494 aa, Homo sapiens
MIELQASPCGQKLYLGGASRDFWMSSNLHQLQKLDNGEKLFKVDGDQASFMMNCRFHVSGKPFTFGEVGRDFSATSGLLQHQVTPTIERPHSRIRHLRVPTGRKPLKYTESRKSFREKSVFIQHQRADSGERPYKCSECGKSFSQSSGFLRHRKAHGRTRTHECSECGKSFSRKTHLTQHQRVHTGERPYDCSECGKSFRQVSVLIQHQRVHTGERPYECSECGKSFSHSTNLYRHRSAHTSTRPYECSECGKSFSHSTNLFRHWRVHTGVRPYECSECGKAFSCNIYLIHHQRFHTGERPYVCSECGKSFGQKSVLIQHQRVHTGERPYECSECGKVFSQSSGLFRHRRAHTKTKPYECSECEKSFSCKTDLIRHQTVHTGERPYECSVCGKSFIRKTHLIRHQTVHTNERPYECDECGKSYSQSSALLQHRRVHTGERPYECRECGKSFTRKNHLIQHKTVHTGERPYECSECGKSFSQSSGLLRHRRVHVQ

SEQ ID NO: 879659 - protein, 91 aa, Homo sapiens
DRPPLPARSAQSPMAAALRAPTQIATSTYRSEEALEDPTRQVFVAFEDVAIYFSQEEWELLDEMQRLLYRDVMLENFAVMASLGIIECFQE

SEQ ID NO: 879660 - protein, 81 aa, Homo sapiens
RTTLLLLFFHFLLFLSPAEEEPPLPLLEPEPGLSSLGLINCLSQGLLGESPSLLASSMSSQPGRISLLLAGSQELSMTMLY

SEQ ID NO: 879661 - protein, 399 aa, Homo sapiens
MGDGAVKQGFLYLQQQQTFGKKWRRFGASLYGGSDCALARLELQEGPEKPRRCEAARKVIRLSDCLRVAEAGGEASSPRDTSAFFLETKERLYLLAAPAAERGDWVQAICLLAFPGQRKELSGPEGKQSRPCMEENELYSSAVTVGPHKEFAVTMRPTEASERCHLRGSYTLRAGESALELWGGPEPGTQLYDWPYRFLRRFGRDKAVAASLERATLSSKPGKAMRSSWPWKRPSLPRRMLHPLHPNRSQPQSPRRCPGLIAPTLGRMTHCRRLHPPHRCLLHGLGARRGSMPCPSMRWPVPWGRTSGASWQSLLSSWPTLCTTALRRPCPLDLTTYTMSPREWLPCPSMTARRSPGVRHGGGRRQLTGTLLASSMSSQPGRISLLLAGSQELSMTMLY

SEQ ID NO: 879662 - protein, 258 aa, Homo sapiens
MRPTEASERCHLRGSYTLRAGESALELWGGPEPGTQLYDWPYRFLRRFGRDKVTFSFEAGRRCVSGEGNFEFETRQGNEIFLALEEAISAQKNAAPATPQPQPATIPASLPRPDSPYSRPHDSLPPPSPTTPVPAPRPRGQEGEYAVPFDAVARSLGKNFRGILAVPPQLLADPLYDSIEETLPPRPDHIYDEPEGVAALSLYDSPQEPRGEAWRRQATADRDPAGLQHVQPAGQDFSASGWQPGTEYDNVVLKKGPK

SEQ ID NO: 879663 - protein, 382 aa, Homo sapiens
MGDGAVKQGFLYLQQQQTFGKKWRRFGASLYGGSDCALARLELQEGPEKPRRCEAARKVIRLSDCLRVAEAGGEASSPRDTSAFFLETKERLYLLAAPAAERGDWVQAICLLAFPGQRKELSGPEGKQSRPCMEENELYSSAVTVGPHKEFAVTMRPTEASERCHLRGSYTLRAGESALELWGGPEPGTQLYDWPYRFLRRFGRDKVTFSFEAGRRCVSGEGNFEFETRQGNEIFLALEEAISAQKNAAPATPQPQPATIPASLPRPDSPYSRPHDSLPPPSPTTPVPAPRPRGQEGEYAVPFDAVARSLGKNFRRARRSLVGVRLPGRSSASVTACGVGRGRRRGQQPPGHQCLLPGDQERLYSWRPLQRSAGTGVPAIWL

SEQ ID NO: 879664 - protein, 412 aa, Homo sapiens
MGDGAVKQGFLYLQQQQTFGKKWRRFGASLYGGSDCALARLELQEGPEKPRRCEAARKVIRLSDCLRVAEAGGEASSPRDTSAFFLETKERLYLLAAPAAERGDWVQAICLLAFPGQRKELSGPEGKQSRPCMEENELYSSAVTVGPHKEFAVTMRPTEASERCHLRGSYTLRAGESALELWGGPEPGTQLYDWPYRFLRRFGRDKVTFSFEAGRRCVSGEGNFEFETRQGNEIFLALEEAISAQKNAAPATPQPQPATIPASLPRPDSPYSRPHDSLPPPSPTTPVPAPRPRGQEGEYAVPFDAVARSLGKNFRGILAVPPQLLADPLYDSIEETLPPRPDHIYDEPEGVAALSLYDSPQEPRGEAWRRQATADRDPAGLQHVQPAGQDFSASGWQPGTEYDNVVLKKGPK

SEQ ID NO: 879665 - protein, 258 aa, Homo sapiens; identical to SEQ ID NO: 879662

SEQ ID NO: 879666 - protein, 104 aa, Homo sapiens
MGRRLFLFQGEAVFMALRCPLTYSPPTHQVLCKRSRGRGERLQPPAHIPRHRLTEPVAAGTAELCEMSRGVMLIGSLASVSLWLAYSSISTVFITWKSEGTIKR

SEQ ID NO: 879667 - protein, 193 aa, Homo sapiens
NITLLKGVAVIVVAIMGSGIFVTPTGVLKEAGSPGLALVVWAACGVFSIVGALCYAELGTTISKSGGDYAYMLDVYGSLPAFLKLWIELLIIRPSSQYIVALVFATYLLKPLFPTCPVPEEAAKLVACHSVRWSVTLSPRLECSGAISAHCQLHLLGSRHSPASASRVAGIAGARHHAWLIFCIFSRDRVSPC

SEQ ID NO: 879668 - protein, 237 aa, Homo sapiens
MVHVDPTLLDAFVPESSLLRYMFIQLTQDLGMFSSIRGINLALAKSFPYNFQQPALMMAGSTWILQFFPQMFPICLCCMPCDSGGAASGAGRRGSSGRVSVRSCRHRLFLVVLLLGGPGDVGRAGPWKRRRLPFIRLSLTAPLPPPRPVLRAQAEPGTVVLFPRPPPPPPPPPSRLPSQPRAGAGCWRRPVRVATRASLGGGAWPYRVGEGNEPQSPGVSAERRRRHQRHQLFAELE

SEQ ID NO: 879669 - protein, 132 aa, Homo sapiens
NITLLKGVAVIVVAIMGSGIFVTPTGVLKEAGSPGLALVVWAACGVFSIVGALCYAELGTTISKSGGDYAYMLDVYGSLPAFLKLWIELLIIRPSSQYIVALVFATYLLKPLFPTCPVPEEAAKLVACHSVP

SEQ ID NO: 879670 - protein, 302 aa, Homo sapiens
NITLLKGVAVIVVAIMGSGIFVTPTGVLKEAGSPGLALVVWAACGVFSIVGALCYAELGTTISKSGGDYAYMLDVYGSLPAFLKLWIELLIIRPSSQYIVALVFATYLLKPLFPTCPVPEEAAKLVACHSVRTAGPTPPLAPSMPCDSGGAASGAGRRGSSGRVSVRSCRHRLFLVVLLLGGPGDVGRAGPWKRRRLPFIRLSLTAPLPPPRPVLRAQAEPGTVVLFPRPPPPPPPPPSRLPSQPRAGAGCWRRPVRVATRASLGGGAWPYRVGEGNEPQSPGVSAERRRRHQRHQLFAELE

SEQ ID NO: 879671 - protein, 194 aa, Homo sapiens
NITLLKGVAVIVVAIMGSGIFVTPTGVLKEAGSPGLALVVWAACGVFSIVGALCYAELGTTISKSGGDYAYMLDVYGSLPAFLKLWIELLIIRPSSQYIVALVFATYLLKPLFPTCPVPEEAAKLVACHSVQAILGKRSSFAYKAAQLTGLGPFLPQPQHWPPGTASRSHLESTEKHWTLPSKGLCVTAQVACL

SEQ ID NO: 879672 - protein, 105 aa, Homo sapiens
ELLCQVHPGGPGCLGFLELVKLPPLPLCSLQQAILGKRSSFAYKAAQLTGLGPFLPQPQHWPFGQTLKPCAERTLSLQMTPGGSPRGPGRSTCVSVGSENDRPIA

SEQ ID NO: 879673 - protein, 170 aa, Homo sapiens
NITLLKGVAVIVVAIMGSGIFVTPTGVLKEAGSPGLALVVWAACGVFSIVGALCYAELGTTISKSGGDYAYMLDVYGSLPAFLKLWIELLIIRPSSQYIVALVFATYLLKPLFPTCPVPEEAAKLVACHSVLIPDQPQGLPAEPLQHPARWERGHRLPGPGLLPPGVTQC

SEQ ID NO: 879674 - protein, 205 aa, Homo sapiens
NITLLKGVAVIVVAIMGSGIFVTPTGVLKEAGSPGLALVVWAACGVFSIVGALCYAELGTTISKSGGDYAYMLDVYGSLPAFLKLWIELLIIRPSSQYIVALVFATYLLKPLFPTCPVPEEAAKLVACHSVQAILGKRSSFAYKAAQLTGLGPFLPQPQHWPFGQTLKPCAERTLSLQMTPGGSPRGPGRSTCVSVGSENDRPIA

SEQ ID NO: 879675 - protein, 189 aa, Homo sapiens
MHRQSPKEKASKTTTVRRRKRPHAHLRVPHLEEVMSPVTTPTDEDVGHRIKHVAGSTQTRHIPEDTPNGFHLQSVSKLLLVISCVLVLLVILNMMLFYKLWMLEYTTQTLTAWQGLRLQERLPQSQTEWAQLLESQQKYHDTELQKWREIIKSSVMLLDQMKDSLINLQNGIRSRDYTSESEEKRNRYH

SEQ ID NO: 879676 - protein, 115 aa, Homo sapiens
LLLRVSTELRYRKQPWGLVKTFIEKNFWSGLEDYFRHLESELAKTESTYLAEMHRQSPKEKASKTTTVRRRKRPHAHLRVPHLEEVMSPVTTPTDEDVGHRIKHVAGVCQVGTGR

SEQ ID NO: 879677 - protein, 87 aa, Homo sapiens
KKKKKKKKDLQRRAPGTLHQSTRTDLHHLGHGTAHCGPQTPQQPSTARLCASTAATGDACLDGDPAVRLHPGTGASRTTAELPGTEE

SEQ ID NO: 879678 - protein, 378 aa, Homo sapiens
ALTWAQGNTEDMGKSIPQYLGQLDIRKSVVSLATGAGAIYLLYKAIKAGIKCKPPLCSNSPICIARECPGPGERALPQEAPAPEASAVGGPKGLAVERERHGRDSGELRRLLNSLECKQDEYAKSMILHSITRCVYLLEAEASACTTDDIVLLGYMLDDKDNSVKTQALNTLKAFSGIRKFRLKIQEHSIKVLELISTIWDTELHIAGLRLLNNLPLPDYVHPQLRRVMPALMEILQSDYILAQVQAVRLLSYLAQKNDLLYDILNCQVHSNFLNLFQPTQSGSLLYEVLVFAERLSEGRNAPHYHVVKWHYNEQSLHESLFGEESRLADRLLALVIHPEEDVQIQACKVIVSLQYPQDLRARPSSCQPSRSYFKNTE

SEQ ID NO: 879679 - protein, 378 aa, Homo sapiens; identical to SEQ ID NO: 879678

SEQ ID NO: 879680 - protein, 198 aa, Homo sapiens
MCKGGLEHSIKVLELISTIWDTELHIAGLRLLNNLPLPDYVHPQLRRVMPALMEILQSDYILAQVQAVRLLSYLAQKNDLLYDILNCQVHSNFLNLFQPTQSGSLLYEVLVFAERLSEGRNAPHYHVVKWHYNEQSLHESLFGEESRLADRLLALVIHPEEDVQIQACKVIVSLQYPQDLRARPSSCQPSRSYFKNTE

SEQ ID NO: 879681 - protein, 351 aa, Homo sapiens
ALTWAQGNTEDMGKSIPQYLGQLDIRKSVVSLATGAGAIYLLYKAIKAGIKCKPPLCSNSPICIARLAVERERHGRDSGELRRLLNSLECKQDEYAKSMILHSITRCVYLLEAEASACTTDDIVLLGYMLDDKDNSVKTQALNTLKAFSGIRKFRLKIQEHSIKVLELISTIWDTELHIAGLRLLNNLPLPDYVHPQLRRVMPALMEILQSDYILAQVQAVRLLSYLAQKNDLLYDILNCQVHSNFLNLFQPTQSGSLLYEVLVFAERLSEGRNAPHYHVVKWHYNEQSLHESLFGEESRLADRLLALVIHPEEDVQIQACKVIVSLQYPQDLRARPSSCQPSRSYFKNTE

SEQ ID NO: 879682 - protein, 378 aa, Homo sapiens; identical to SEQ ID NO: 879678

SEQ ID NO: 879683 - protein, 179 aa, Homo sapiens
PRWAGNQPPVSNSFSNREAAMTQPTRPSVTCDQGSSTIGGTAAQATTSSSATSGSNYQRDRLGRRPEIGVGGQPQICFPRPRSAQQPVLFSLMNSSEAAMKKTLPKSHLSRVIIHDNRITQRIYEMEVSALEKTKKKISHYYEHLKKKFMTEQLRKLGRWREESVNSNRYLTFGIPPPV

SEQ ID NO: 879684 - protein, 95 aa, Homo sapiens
MGCMKSKQTFPFPTIYEGEKQHESEEPFMPEERCLPRMASPVNVKEEVKEPPGTNIVILEYAHRLSQDILCDALQQWACNNIKYHDIPYIESEGP

SEQ ID NO: 879685 - protein, 527 aa, Homo sapiens
GLRSPGYGCTQQRRRGPQPRGGGKVTDPPWGAACAACSRLRKTLPMAQGRERDEGPHSAGGASLSVRWVQGFPKQNVHFVNDNTICYPCGNYVIFINIETKKKTVLQCSNGIVGVMATNIPCEVVAFSDRKLKPLIYVYSFPGLTRRTKLKGNILLDYTLLSFSYCGTYLASYSSLPEFELALWNWESSIILCKKSQPGMDVNQMSFNPMNWRQLCLSSPSTVSVWTIERSNQEHCFRARSVKLPLEDGSFFNETDVVFPQSLPKDLIYGPVLPLSAIAGLVGKEAETFRPKDDLYPLLHPTMHCWTPTSDLYIGCEEGHLLMINGDTLQVTVLNKIEEESPLEDRRNFISPVTLVYQKEGVLASGIDGFVYSFIIKDRSYMIEDFLEIERPVEHMTFSPNYTVLLIQTDKGSVYIYTFGKEPTLNKVLDACDGKFQAIDFITPGTQYFMTLTYSGEICVWWLEDCACVSKIYLNTLATVLACCPSSLSAAVGTEDGSVYFISVYDKESPQVVHKAFLSESSVQHVV

SEQ ID NO: 879686 - protein, 567 aa, Homo sapiens
GLRSPGYGCTQQRRRGPQPRGGGKVTDPPWGAACAACSRLRKTLPMAQGRERDEGPHSAGGASLSVRWVQGFPKQNVHFVNDNTICYPCGNYVIFINIETKKKTVLQCSNGIVGVMATNIPCEVVAFSDRKLKPLIYVYSFPGLTRRTKLKGNILLDYTLLSFSYCGTYLASYSSLPEFELALWNWESSIILCKKSQPGMDVNQMSFNPMNWRQLCLSSPSTVSVWTIERSNQEHCFRARSVKLPLEDGSFFNETDVVFPQSLPKDLIYGPVLPLSAIAGLVGKEAETFRPKDDLYPLLHPTMHCWTPTSDLYIGCEEGHLLMINGDTLQVTVLNKIEEESPLEDRRNFISPVTLVYQKEGVLASGIDGFVYSFIIKDRSYMIEDFLEIERPVEHMTFSPNYTVLLIQTDKGSVYIYTFGKEPTLNKVLDACDGKFQAIDFITPGTQYFMTLTYSGEICVWWLEDCACVSKIYLNTLATVLACCPSSLSAAVGTEDGSVYFISVYDKESPQVVHKAFLSESSVQHVVYDQQGIFLLVGTAEGKVFIINANSSSSFQIIGFTGTTENA

SEQ ID NO: 879687 - protein, 418 aa, Homo sapiens
GLRSPGYGCTQQRRRGPQPRGGGKVTDPPWGAACAACSRLRKTLPMAQGRERDEGPHSAGGASLSVRWVQGFPKQNVHFVNDNTICYPCGNYVIFINIETKKKTVLQCSNGIVGVMATNIPCEVVAFSDRKLKPLIYVYSFPGLTRRTKLKGNILLDYTLLSFSYCGTYLASYSSLPEFELALWNWESSIILCKKSQPGMDVNQMSFNPMNWRQLCLSSPSTVSVWTIERSNQEHCFRARSVKLPLEDGSFFNETDVVFPQSLPKDLIYGPVLPLSAIAGLVGKEAETFRPKDDLYPLLHPTMHCWTPTSDLYIGCEEGHLLMINGDTLQVTVLNKIEEESPLEDRRNFISPVTLVYQKEGVLASGIDGFVYSFIIKDRSYMIEDFLEIERPVEHMTFSPNYTVLLIQTDKVCWMVIS

SEQ ID NO: 879688 - protein, 365 aa, Homo sapiens
MDVNQMSFNPMNWRQLCLSSPSTVSVWTIERSNQEHCFRARSVKLPLEDGSFFNETDVVFPQSLPKDLIYGPVLPLSAIAGLVGKEAETFRPKDDLYPLLHPTMHCWTPTSDLYIGCEEGHLLMINGDTLQVTVLNKIEEESPLEDRRNFISPVTLVYQKEGVLASGIDGFVYSFIIKDRSYMIEDFLEIERPVEHMTFSPNYTVLLIQTDKGSVYIYTFGKEPTLNKVLDACDGKFQAIDFITPGTQYFMTLTYSGEICVWWLEDCACVSKIYLNTLATVLACCPSSLSAAVGTEDGSVYFISVYDKESPQVVHKAFLSESSVQHVVYDQQGIFLLVGTAEGKVFIINANSSSSFQIIGFTGTT

SEQ ID NO: 879689 - protein, 390 aa, Homo sapiens
PPSHTPGPARTRQLLEAPPGPTSTRHLEPLAPMDPLRRSPSPCLSSQPSSPSTPPCEMLGPVGIEAVLDQLKIKAMKMGFEFNIMVVGQSGLGKSTMVNTLFKSKVWKSNPPGLGVPTPQTLQLHSLTHVIEEKGVKLKLTVTDTPGFGDQINNDNCWDPILGYINEQYEQYLQEEILITRQRHIPDTRVHCCVYFVPPTGHCLRALDIEFLQRLCRTVNVVPVIARADSLTMEEREAFRRRIQQNLRTHCIDVYPQMCFDEDINDKILNSKLRDRIPFAVVGADQEHLVNGRCVLGRKTKWGIIEVENMAHCEFPLLRDLLIRSHLQDLKDITHNIHYENYRVIRLNESHLLPRGPGWVNLAPASPGQLTTPRTFKVCRGAHDDSDDEF

SEQ ID NO: 879690 - protein, 318 aa, Homo sapiens
PPSHTPGPARTRQLLEAPPGPTSTRHLEPLAPMDPLRRSPSPCLSSQPSSPSTPPCEMLGPVGIEAVLDQLKIKAMKMGFEFNIMVVGQSGLGKSTMVNTLFKSKVWKSNPPGLGVPTPQTLQLHSLTHVIEEKGVKLKLTVTDTPGFGDQINNDNCWDPILGYINEQYEQQQNLRTHCIDVYPQMCFDEDINDKILNSKLRDRIPFAVVGADQEHLVNGRCVLGRKTKWGIIEVENMAHCEFPLLRDLLIRSHLQDLKDITHNIHYENYRVIRLNESHLLPRGPGWVNLAPASPGQLTTPRTFKVCRGAHDDSDDEF

SEQ ID NO: 879691 - protein, 257 aa, Homo sapiens
GSGAASALARSRPLSPARQPALLPPQTRAPRSGAMQRLAMDLRMLSRELSLYLEHQVRVGFFGSGVGLSLILGFSVAYAFYYLSSIAKKPQLVTGGESFSRFLQDHCPVVTETYYPTVWCWEGRGQTLLRPFITSKPPVQYRNELIKTADGGQISLDWFDNDNSTCYMDASTRPTILLLPGLTGTSKESYILHMIHLSEELGYRCVVFNNRGVAGENLLTPRTYCCANTEDLETVIHHVHSLYPSAPFLAAGVSMGG

SEQ ID NO: 879692 - protein, 224 aa, Homo sapiens
GSGAASALARSRPLSPARQPALLPPQTRAPRSGAMQRLAMDLRMLSRELSLYLEHQVRVGFFGSGVGLSLILGFSVAYAFYYLSSIAKKPQLVTGGESFSRFLQDHCPVVTETYYPTVWCWEGRGQTLLRPFITSKPPVQYRNELIKTADGGQISLDWFDNDNSTCYMDASTRPTILLLPGLTGTSKESYILHMIHLSEELGYRCVVFNNRGVAGENLLVSKFK

SEQ ID NO: 879693 - protein, 224 aa, Homo sapiens; identical to SEQ ID NO: 879692

SEQ ID NO: 879694 - protein, 257 aa, Homo sapiens; identical to SEQ ID NO: 879691

SEQ ID NO: 879695 - protein, 219 aa, Homo sapiens
GSGAASALARSRPLSPARQPALLPPQTRAPRSGAMQRLAMDLRMLSRELSLYLEHQVRVGFFGSGVGLSLILGFSVAYAFYYLSSIAKKPQLVTGGESFSRFLQDHCPVVTETYYPTVWCWEGRGQTLLRPFITSKPPVQYRNELIKTADGGQISLDWFDNDNSTCYMDASTRPTILLLPGLTGTSKESYILHMIHLSEELGYRCVVFNNRGVAGENLL

SEQ ID NO: 879696 - protein, 74 aa, Homo sapiens
TCPRQPASPSSASKLPKRLHWSWDSRLWLLCLFEGPRKWRGMCPRLRPLIVSPQRKSCTEGNRLPARVRRLHLL

SEQ ID NO: 879697 - protein, 74 aa, Homo sapiens; identical to SEQ ID NO: 879696

SEQ ID NO: 879698 - protein, 74 aa, Homo sapiens; identical to SEQ ID NO: 879696

SEQ ID NO: 879699 - protein, 724 aa, Homo sapiens
MGDEDWEAEINPHMSSYVPIFEKDRYSGENGDNFNRTPASSSEMDDGPSRRDHFMKSGFASGRNFGNRDAGECNKRDNTSTMGGFGVGKSFGNRGFSNSRFEDGDSSGFWRESSNDCEDNPTRNRGFSKRGGYRDGNNSEASGPYRRGGRGSFRGCRGGFGLGSPNNDLDPDECMQRTGGLFGSRRPVLSGTGNGDTSQSRSGSGSERGGYKGLNEEVITGSGKNSWKSEAEGGESSDTQGPKVTYIPPPPPEDEDSIFAHYQTGINFDKYDTILVEVSGHDAPPAILTFEEANLCQTLNNNIAKAGYTKLTPVQKYSIPIILAGRDLMACAQTGSGKTAAFLLPILAHMMHDGITASRFKELQEPECIIVAPTRELVNQIYLEARKFSFGTCVRAVVIYGGTQLGHSIRQIVQGCNILCATPGRLMDIIGKEKIGLKQIKYLVLDEADRMLDMGFGPEMKKLISCPGMPSKEQRQTLMFSATFPEEIQRLAAEFLKSNYLFVAVGQVGGACRDVQQTVLQVGQFSKREKLVEILRNIGDERTMVFVETKKKADFIATFLCQEKISTTSIHGDREQREREQALGDFRFGKCPVLVATSVAARGLDIENVQHVINFDLPSTIDEYVHRIGRTGRCGNTGRAISFFDLESDNHLAQPLVKVLTDAQQDVPAWLEEIAFSTYIPGFSGSTRGNVFASVDTRKGKSTLNTAGFSSSQAPNPVDDESWD

SEQ ID NO: 879700 - protein, 149 aa, Homo sapiens
MGDEDWEAEINPHMSSYVPIFEKDRYSGENGDNFNRTPASSSEMDDGPSRRDHFMKSGFASGRNFGNRDAGECNKRDNTSTMGGFGVGKSFGNRGFSNSRFEDGDSSGFWRESSNDCEDNPTRNRGFSKRGGKDHILEQFVLNTETLNW

SEQ ID NO: 879701 - protein, 690 aa, Homo sapiens
MGDEDWEAEINPHMSSYVPIFEKDRYSGENGDNFNRTPASSSEMDDGPSRRDHFMKSGFASGRNFGNRDAGECNKRDNTSTMGGFGVGKSFGNRGFSNSRFEDGDSSGFWRESSNDCEDNPTRNRGFSKRGDNDLDPDECMQRTGGLFGSRRPVLSGTGNGDTSQSRSGSGSERGGYKGLNEEVITGSGKNSWKSEAEGGESSDTQGPKVTYIPPPPPEDEDSIFAHYQTGINFDKYDTILVEVSGHDAPPAILTFEEANLCQTLNNNIAKAGYTKLTPVQKYSIPIILAGRDLMACAQTGSGKTAAFLLPILAHMMHDGITASRFKELQEPECIIVAPTRELVNQIYLEARKFSFGTCVRAVVIYGGTQLGHSIRQIVQGCNILCATPGRLMDIIGKEKIGLKQIKYLVLDEADRMLDMGFGPEMKKLISCPGMPSKEQRQTLMFSATFPEEIQRLAAEFLKSNYLFVAVGQVGGACRDVQQTVLQVGQFSKREKLVEILRNIGDERTMVFVETKKKADFIATFLCQEKISTTSIHGDREQREREQALGDFRFGKCPVLVATSVAARGLDIENVQHVINFDLPSTIDEYVHRIGRTGRCGNTGRAISFFDLESDNHLAQPLVKVLTDAQQDVPAWLEEIAFSTYIPGFSGSTRGNVFASVDTRKGKSTLNTAGFSSSQAPNPVDDESWD

SEQ ID NO: 879702 - protein, 704 aa, Homo sapiens
MGDEDWEAEINPHMSSYVPIFEKDRYSGENGDNFNRTPASSSEMDDGPSRRDHFMKSGFASGRNFGNRDAGECNKRDNTSTMGGFGVGKSFGNRGFSNSRFEDGDSSGFWRGYRDGNNSEASGPYRRGGRGSFRGCRGGFGLGSPNNDLDPDECMQRTGGLFGSRRPVLSGTGNGDTSQSRSGSGSERGGYKGLNEEVITGSGKNSWKSEAEGGESSDTQGPKVTYIPPPPPEDEDSIFAHYQTGINFDKYDTILVEVSGHDAPPAILTFEEANLCQTLNNNIAKAGYTKLTPVQKYSIPIILAGRDLMACAQTGSGKTAAFLLPILAHMMHDGITASRFKELQEPECIIVAPTRELVNQIYLEARKFSFGTCVRAVVIYGGTQLGHSIRQIVQGCNILCATPGRLMDIIGKEKIGLKQIKYLVLDEADRMLDMGFGPEMKKLISCPGMPSKEQRQTLMFSATFPEEIQRLAAEFLKSNYLFVAVGQVGGACRDVQQTVLQVGQFSKREKLVEILRNIGDERTMVFVETKKKADFIATFLCQEKISTTSIHGDREQREREQALGDFRFGKCPVLVATSVAARGLDIENVQHVINFDLPSTIDEYVHRIGRTGRCGNTGRAISFFDLESDNHLAQPLVKVLTDAQQDVPAWLEEIAFSTYIPGFSGSTRGNVFASVDTRKGKSTLNTAGFSSSQAPNPVDDESWD

SEQ ID NO: 879703 - protein, 724 aa, Homo sapiens; identical to SEQ ID NO: 879699

SEQ ID NO: 879704 - protein, 724 aa, Homo sapiens; identical to SEQ ID NO: 879699

SEQ ID NO: 879705 - protein, 698 aa, Homo sapiens
MGDEDWEAEINPHMSSYVPIFEKDRYSGENGDNFNRTPASSSEMDDGPSRRDHFMKSGFASGRNFGNRGFSNSRFEDGDSSGFWRESSNDCEDNPTRNRGFSKRGGYRDGNNSEASGPYRRGGRGSFRGCRGGFGLGSPNNDLDPDECMQRTGGLFGSRRPVLSGTGNGDTSQSRSGSGSERGGYKGLNEEVITGSGKNSWKSEAEGGESSDTQGPKVTYIPPPPPEDEDSIFAHYQTGINFDKYDTILVEVSGHDAPPAILTFEEANLCQTLNNNIAKAGYTKLTPVQKYSIPIILAGRDLMACAQTGSGKTAAFLLPILAHMMHDGITASRFKELQEPECIIVAPTRELVNQIYLEARKFSFGTCVRAVVIYGGTQLGHSIRQIVQGCNILCATPGRLMDIIGKEKIGLKQIKYLVLDEADRMLDMGFGPEMKKLISCPGMPSKEQRQTLMFSATFPEEIQRLAAEFLKSNYLFVAVGQVGGACRDVQQTVLQVGQFSKREKLVEILRNIGDERTMVFVETKKKADFIATFLCQEKISTTSIHGDREQREREQALGDFRFGKCPVLVATSVAARGLDIENVQHVINFDLPSTIDEYVHRIGRTGRCGNTGRAISFFDLESDNHLAQPLVKVLTDAQQDVPAWLEEIAFSTYIPGFSGSTRGNVFASVDTRKGKSTLNTAGFSSSQAPNPVDDESWD

SEQ ID NO: 879706 - protein, 221 aa, Homo sapiens
MWSAGRGGAAWPVLLGLLLALLVPGGGAAKTGAELVTCGSVLKLLNTHHRVRLHSHDIKYGSGSGQQSVTGVEASDDANSYWRIRGGSEGGCPRGSPVRCGQAVRLTHVLTGKNLHTHHFPSPLSNNQEVSAFGEDGEGDDLDLWTVRCSGQHWEREAAVRFQHVGTSVFLSVTGEQYGSPIRGQHEVHGMPSANTHNTWKAMEGIFIKPSVEPSAGHDEL

SEQ ID NO: 879707 - protein, 235 aa, Homo sapiens
MWSAGRGGAAWPVLLGLLLALLVPGGGAAKTGAELVTCGSVLKLLNTHHRVRLHSHDIKYGSGSGQQSVTGVEASDDANSYWRIRGGSEGGCPRGSPVRCGQAVRLTHVLTGKNLHTHHFPSPLSNNQEVSAFGEDGEGDDLDLWTVRCSGQHWEREAAVRFQHVGTSVFLSVTGEQYGSPIRGQHEVHGMPSANTHNTWKAMEDGWVDGGWQVGRLQGHSWQRLWVCRGPQVPL

SEQ ID NO: 879708 - protein, 221 aa, Homo sapiens; identical to SEQ ID NO: 879706

SEQ ID NO: 879709 - protein, 120 aa, Homo sapiens
ALISRALTSLDCDCPQDTCPSSPKDCRAEHVSEVTLSAHSPPWLTSVVFGADTLIPKPGSPKGLHDPGVPHTVQPCLAGTPVLLYLQQELPGLPSGPTPTGVSRIFIKPSVEPSAGHDEL

SEQ ID NO: 879710 - protein, 335 aa, Homo sapiens
EVADSRILCLALVHLPVEKESWIVSGTQSGTLLVINTEDGKKRHTLEKMTDSVTCLYCNSFSKQSKQKNFLLVGTADGKLAIFEDKTVKLKGAAPLKILNIGNVSTPLMCLSESTNSTERNVMWGGCGTKIFSFSNDFTIQKLIETRTSQLFSYAAFSDSNIITVVVDTALYIAKQNSPVVEVWDKKTEKLCGLIDCVHFLREVTVKENKESKHKMSYSGRVKTLCLQKNTALWIGTGGGHILLLDLSTRRLIRVIYNFCNSVRVMMTAQLGSLKNVMLVLGYNRKNTEGTQKQKEIQSCLTVWDINLPHEVQNLEKHIEVRKELAEKMRRTSVE

SEQ ID NO: 879711 - protein, 101 aa, Homo sapiens
EVADSRILCLALVHLPVEKESWIVSGTQSGTLLVINTEDGKKRHTLEKMTDSVTCLYCNSFSKQSKQKNFLLVGTADGKLAIFEDKTVKVNVECILHLNLF

SEQ ID NO: 879712 - protein, 329 aa, Homo sapiens
EVADSRILCLALVHLPVEKESWIVSGTQSGTLLVINTEDGKKRHTLEKMTDSVTCLYCNSFSKQSKQKNFLLVGTADGKLAIFEDKTVKLKGAAPLKILNIGNVSTPLMCLSESTNSTERNVMWGGCGTKIFSFSNDFTIQKLIETRTSQLFSYAAFSDSNIITVVVDTALYIAKQNSPVVEVWDKKTEKLCGLIDCVHFLREVTVKENKESKHKMSYSGRVKTLCLQKNTALWIGTGGGHILLLDLSTRRLIRVIYNFCNSVRVMMTAQLGSLKNVMLVLGYNRKNTEEIQSCLTVWDINLPHEVQNLEKHIEVRKELAEKMRRTSVE

SEQ ID NO: 879713 - protein, 108 aa, Homo sapiens
SCGGSGEGEPRGLGASVCLHLTRTQSEHDPHFSFCFKRKYRSYSIELQYLDIRNNRSRSRYGTARHTWSLRPGCRSANVRGIGLGLLSPTEPVAHSFSIIEYLLCARH

SEQ ID NO: 879714 - protein, 755 aa, Homo sapiens
MIYEEDAEEWALYLTEVFLHVVKREAILLYRLENFSFRHLELLNLTSYKCKLLILSNSLLRDLTPKKCQFLEKILHSPKSVVTLLCGVKSSDQLYELLNISQSRWEISTEQEPEDYISVIQSIIFKDSEDYFEVNIPTDLRAKHSGEISERKEIEELSEASRNTIPLAVVLPTEIPCENPGEIFIILRDEVIGDTVEVEFTSSNKRIRTRPALWNKKVWCMKALEFPAGSVHVNVYCDGIVKATTKIKYYPTAKAKECLFRMADSGESLCQNSIEELDGVLTSIFKHEIPYYEFQSLQTEICSQNKYTHFKELPTLLHCAAKFGLKNLAIHLLQCSGATWASKMKNMEGSDPAHIAERHGHKELKKIFEDFSIQEIDINNEQENDYEEDIASFSTYIPSTQNPAFHHESRKTYGQSADGAEANEMEGEGKQNGSGMETKHSPLEVGSESSEDQYDDLYVFIPGADPENNSQEPLMSSRPPLPPPRPVANAFQLERPHFTLPGTMVEGQMERSQNWGHPGVRQETGDEPKGEKEKKEEEKEQEEEEDPYTFAEIDDSEYDMILANLSIKKKTGSRSFIINRPPAPTPRPTSIPPKEETTPYIAQVFQQKTARRQSDDDKFRGLPKKQDRARIESPAFSTLRGCLTDGQEELILLQEKVKNGKMSMDEALEKFKHWQMGKSGLEMIQQEKLRQLRDCIIGKRPEEENVYNKLTIVHHPGGKETAHNENKFYNVHFSNKLPARPQVEKEFGFCCKKDH

SEQ ID NO: 879715 - protein, 835 aa, Homo sapiens
RPGRSLRGWQAGWGEPRAKGRENRGESLAGRVQVALGGQQCAGPSASTATMLPAAPGKGLGSPDPAPCGPAPPGNTKDIIMIYEEDAEEWALYLTEVFLHVVKREAILLYRLENFSFRHLELLNLTSYKCKLLILSNSLLRDLTPKKCQFLEKILHSPKSVVTLLCGVKSSDQLYELLNISQSRWEISTEQEPEDYISVIQSIIFKDSEDYFEVNIPTDLRAKHSGEISERKEIEELSEASRNTIPLAVVLPTEIPCENPGEIFIILRDEVIGDTVEVEFTSSNKRIRTRPALWNKKVWCMKALEFPAGSVHVNVYCDGIVKATTKIKYYPTAKAKECLFRMADSGESLCQNSIEELDGVLTSIFKHEIPYYEFQSLQTEICSQNKYTHFKELPTLLHCAAKFGLKNLAIHLLQCSGATWASKMKNMEGSDPAHIAERHGHKELKKIFEDFSIQEIDINNEQENDYEEDIASFSTYIPSTQNPAFHHESRKTYGQSADGAEANEMEGEGKQNGSGMETKHSPLEVGSESSEDQYDDLYVFIPGADPENNSQEPLMSSRPPLPPPRPVANAFQLERPHFTLPGTMVEGQMERSQNWGHPGVRQETGDEPKGEKEKKEEEKEQEEEEDPYTFAEIDDSEYDMILANLSIKKKTGSRSFIINRPPAPTPRPTSIPPKEETTPYIAQVFQQKTARRQSDDDKFRGLPKKQDRARIESPAFSTLRGCLTDGQEELILLQEKVKNGKMSMDEALEKFKHWQMGKSGLEMIQQEKLRQLRDCIIGKRPEEENVYNKLTIVHHPGGKETAHNENKFYNVHFSNKLPARPQVEKEFGFCCKKDH

SEQ ID NO: 879716 - protein, 755 aa, Homo sapiens; identical to SEQ ID NO: 879714

SEQ ID NO: 879717 - protein, 585 aa, Homo sapiens
RPGRSLRGWQAGWGEPRAKGRENRGESLAGRVQVALGGQQCAGPSASTATMLPAAPGKGLGSPDPAPCGPAPPGNTKDIIMIYEEDAEEWALYLTEVFLHVVKREAILLYRLENFSFRHLELLNLTSYKCKLLILSNSLLRDLTPKKCQFLEKILHSPKSVVTLLCGVKSSDQLYELLNISQSRWEISTEQEPEDYISVIQSIIFKDSEDYFEVNIPTDLRAKHSGEISERKEIEELSEASRNTIPLAVVLPTEIPCENPGEIFIILRDEVIGDTVEVEFTSSNKRIRTRPALWNKKVWCMKALEFPAGSVHVNVYCDGIVKATTKIKYYPTAKAKECLFRMADSGESLCQNSIEELDGVLTSIFKHEIPYYEFQSLQTEICSQNKYTHFKELPTLLHCAAKFGLKNLAIHLLQCSGATWASKMKNMEGSDPAHIAERHGHKELKKIFEDFSIQEIDINNEQENDYEEDIASFSTYIPSTQNPAFHHESRKTYGQSADGAEANEMEGEGKQNGSGMETKHSPLEVGSESSEDQYDDLYVFIPGADPENNSQEPLMSSRPPLPPPRPVANAFQLERPHFTLPGGDI

SEQ ID NO: 879718 - protein, 149 aa, Homo sapiens
MSVLAAAHLTSSSFSADEEFAMGTLKQWLPKEEDEGKVEMVSGIEVDEEQLEPRSDDDDTNFEESEDELRDEVVEYLEKLATFKGEEKTEEASSTSKDSRKSREREGISMQKSEELREGLENISTTSNDHICITDEDQGTSTTSQNIQV

SEQ ID NO: 879719 - protein, 94 aa, Homo sapiens
HSSLGDRARLHLKKKPKKPVASALSSVPGITPSGRKQVSCQGDTQTALWRVQCHEELRSPPTAVQPCRELEGESPSTVKSSDDSSPSSILIAAS

SEQ ID NO: 879720 - protein, 106 aa, Homo sapiens
LFHFLRLKTLSLLNTNSPFSPPPAPGNHILLSVYANWTTPGATDDWSHAVLSLCDWNPVSLTSLDLSLLSLLTALPLMISVSTVVSKLVPCLSSPSFLSSLNSASK

SEQ ID NO: 879721 - protein, 135 aa, Homo sapiens
PYRELCSWCLRNMMANHLVKPDNRNCKRPRELESPVPDSPQLSSLGKSDSSFSEISGLFYKDEALEKDLNDVSKEINLMLSTYAKLLSERAAVDASYIDEIDELFKEANAIENFLIQKREFLRQRFTVIANTLHR

SEQ ID NO: 879722 - protein, 122 aa, Homo sapiens
MANHLVKPDNRNCKRPRELESPVPDSPQLSSLGKSDSSFSEISGLFYKDEALEKDLNDVSKEINLMLSTYAKLLSERAAVDASYIDEIDELFKEANAIENFLIQKREFLRQRFTVIANTLHR

SEQ ID NO: 879723 - protein, 895 aa, Homo sapiens
MSAETPITLNIDPQDLQVQTFTVEKLLEPLIIQVTTLVNCPQNPSSRKKGRSKRASVLLASVEEATWNLLDKGEKIAQEATVLKDELTASLEEVRKESEALKVSAERFTDDPCFLPKREAVVQAARALLAAVTRLLILADMIDVMCLLQHVSAFQRTFESLKNVANKSDLQKTYQKLGKELENLDYLAFKRQQDLKSPNQRDEIAGARASLKENSPLLHSICSACLEHSDVASLKASKDTVCEEIQNALNVISNASQGIQNMTTPPEPQAATLGSALDELENLIVLNPLTVTEEEIRPSLEKRLEAIISGAALLADSSCTRDLHRERIIAECNAIRQALQDLLSEYMNNAGKKERSNTLNIALDNMCKKTRDLRRQLRKAIIDHVSDSFLDTTVPLLVLIEAAKNGREKEIKEYAAIFHEHTSRLVEVANLACSMSTNEDGIKIVKIAANHLETLCPQIINAALALAARPKSQAVKNTMEMYKRTWENHIHVLTEAVDDITSIDDFLAVSESHILEDVNKCIIALRDQDADNLDRAAGAIRGRAARVAHIVTGEMDSYEPGAYTEGVMRNVNFLTSTVIPEFVTQVNVALEALSKSSLNVLDDNQFVDISKKIYDTIHDIRCSVMMIRTPEELEDVSDLEEEHEVRSHTSIQTEGKTDRAKMTQLPEAEKEKIAEQVADFKKVKSKLDAEIEIWDDTSNDIIVLAKNMCMIMMEMTDFTRGKGPLKHTTDVIYAAKMISESGSRMDVLARQIANQCPDPSCKQDLLAYLEQIKFYSHQLKICSQVKAEIQNLGGELIMSALDSVTSLIQAAKNLMNAVVQTVKMSYIASTKIIRIQSPAGPRHPVVMWRMKAPAKKPLIKREKPEETCAAVRRGSAKKKIHPLQVMSEFRGRQIY

SEQ ID NO: 879724 - protein, 895 aa, Homo sapiens; identical to SEQ ID NO: 879723

SEQ ID NO: 879725 - protein, 895 aa, Homo sapiens; identical to SEQ ID NO: 879723

SEQ ID NO: 879726 - protein, 895 aa, Homo sapiens; identical to SEQ ID NO: 879723

SEQ ID NO: 879727 - protein, 142 aa, Homo sapiens
MQCPDPSCKQDLLAYLEQIKFYSHQLKICSQVKAEIQNLGGELIMSALDSVTSLIQAAKNLMNAVVQTVKMSYIASTKIIRIQSPAGPRHPVVMWRMKAPAKKPLIKREKPEETCAAVRRGSAKKKIHPLQVMSEFRGRQIY

SEQ ID NO: 879728 - protein, 234 aa, Homo sapiens
MTQLPEAEKEKIAEQVADFKKVKSKLDAEIEIWDDTSNDIIVLAKNMCMIMMEMTDFTRGKGPLKHTTDVIYAAKMISESGSRMDVLARQIANQCPDPSCKQDLLAYLEQIKFYSHQLKICSQVKAEIQNLGGELIMSALDSVTSLIQAAKNLMNAVVQTVKMSYIASTKIIRIQSPAGPRHPVVMWRMKAPAKKPLIKREKPEETCAAVRRGSAKKKIHPLQVMSEFRGRQIY

SEQ ID NO: 879729 - protein, 946 aa, Homo sapiens
SGLFRLFAYRCIISQIVSHDSGTEFLNTRNCLDNWFSICIWAILCPAVEGSMSAETPITLNIDPQDLQVQTFTVEKLLEPLIIQVTTLVNCPQNPSSRKKGRSKRASVLLASVEEATWNLLDKGEKIAQEATVLKDELTASLEEVRKESEALKVSAERFTDDPCFLPKREAVVQAARALLAAVTRLLILADMIDVMCLLQHVSAFQRTFESLKNVANKSDLQKTYQKLGKELENLDYLAFKRQQDLKSPNQRDEIAGARASLKENSPLLHSICSACLEHSDVASLKASKDTVCEEIQNALNVISNASQGIQNMTTPPEPQAATLGSALDELENLIVLNPLTVTEEEIRPSLEKRLEAIISGAALLADSSCTRDLHRERIIAECNAIRQALQDLLSEYMNNAGKKERSNTLNIALDNMCKKTRDLRRQLRKAIIDHVSDSFLDTTVPLLVLIEAAKNGREKEIKEYAAIFHEHTSRLVEVANLACSMSTNEDGIKIVKIAANHLETLCPQIINAALALAARPKSQAVKNTMEMYKRTWENHIHVLTEAVDDITSIDDFLAVSESHILEDVNKCIIALRDQDADNLDRAAGAIRGRAARVAHIVTGEMDSYEPGAYTEGVMRNVNFLTSTVIPEFVTQVNVALEALSKSSLNVLDDNQFVDISKKIYDTIHDIRCSVMMIRTPEELEDVSDLEEEHEVRSHTSIQTEGKTDRAKMTQLPEAEKEKIAEQVADFKKVKSKLDAEIEIWDDTSNDIIVLAKNMCMIMMEMTDFTRGKGPLKHTTDVIYAAKMISESGSRMDVLARQIANQCPDPSCKQDLLAYLEQIKFYSHQLKICSQVKAEIQNLGGELIMSALDSVTSLIQAAKNLMNAVVQTVKMSYIASTKIIRIQSPAGPRHPVVMWRMKAPAKKPLIKREKPEETCAAVRRGSAKKKIHPLQVMSEFRGRQIY

SEQ ID NO: 879730 - protein, 66 aa, Homo sapiens
DIEKGEELLETIFNSTATAGRVSAKNLMNAVVQTVKMSYIASTKIIRIQSPSCDVENEGSCKKTLD

SEQ ID NO: 879731 - protein, 895 aa, Homo sapiens; identical to SEQ ID NO: 879723

SEQ ID NO: 879732 - protein, 895 aa, Homo sapiens; identical to SEQ ID NO: 879723

SEQ ID NO: 879733 - protein, 895 aa, Homo sapiens; identical to SEQ ID NO: 879723

SEQ ID NO: 879734 - protein, 153 aa, Homo sapiens
VLRYSDSLIPPIQCPDPSCKQDLLAYLEQIKFYSHQLKICSQVKAEIQNLGGELIMSALDSVTSLIQAAKNLMNAVVQTVKMSYIASTKIIRIQSPAGPRHPVVMWRMKAPAKKPLIKREKPEETCAAVRRGSAKKKIHPLQVMSEFRGRQIY

SEQ ID NO: 879735 - protein, 433 aa, Homo sapiens
MSAETPITLNIDPQDLQVQTFTVEKLLEPLIIQVTTLVNCPQNPSSRKKGRSKRASVLLASVEEATWNLLDKGEKIAQEATVLKDELTASLEEVRKESEALKVSAERFTDDPCFLPKREAVVQAARALLAAVTRLLILADMIDVMCLLQHVSAFQRTFESLKNVANKSDLQKTYQKLGKELENLDYLAFKRQQDLKSPNQRDEIAGARASLKENSPLLHSICSACLEHSDVASLKASKDTVCEEIQNALNVISNASQGIQNMTTPPEPQAATLGSALDELENLIVLNPLTVTEEEIRPSLEKRLEAIISGAALLADSSCTRDLHRERIIAECNAIRQALQDLLSEYMNNAGKKERSNTLNIALDNMCKKTRDLRRQLRKAIIDHVSDSFLDTTVPLLVLIEAAKNGREKEIKEYAAIFHEHTSRLVEVSMLEL

SEQ ID NO: 879736 - protein, 359 aa, Homo sapiens
MNLNPPTSALQIEGKGSHIMARNVSCFLVRHTPHPRRVCHIKGLNNIPICTVNDDENAFGTLWEVGQSNYLEKNRIPFANCSYPPSTAVQKSPVRGMSPAPNGAKVPPRPHSEPSRKIKECFKTSSENPLVIKKEEIKAKRPPSPPKACSTPGSCSSGMTSTKNDVKANTICIPNYLDQEIKILAKLCSILHTDSLAEVLQWLLHATSKEKEWVSALIHSELAEINLLTHHRRNTSMEPAAETGKPPTVKSPPTVKLPPNFTAKSKVLTRDTEGDQPTRVSSQGSEENKEVPKEAEHKPPLLIRRNNMKIPVAEYFSKPNSPPRPNTQESGSAKPVSARSIQEYNLCPQRACYPSTHRR

SEQ ID NO: 879737 - protein, 189 aa, Homo sapiens
MNLNPPTSALQIEGKGSHIMARNVSCFLVRHTPHPRRVCHIKGLNNIPICTVNDDENAFGTLWEVGQSNYLEKNRIPFANCSYPPSTAVQKSPVRGMSPAPNGAKVPPRPHSEPSRKIKECFKTSSENPLVIKKEEIKAKRPPSPPKACSTPGSCSSGMTSTKNDVKANTICIPNYLDQEIKKKSGSQL

SEQ ID NO: 879738 - protein, 69 aa, Homo sapiens
LTWGSVGVHDIVLHQHLGHRGVWNREGLVVRRLELVEGLLPIPKGPPAGAVGRTMAASSGSMKQSRRQR

SEQ ID NO: 879739 - protein, 88 aa, Homo sapiens
TRAPARATPPRGVLSCLALVLGLTDSKDSLDEARQKIFDIREEYRNKLLEAEHLKLETLAAQEAAMKLETEKMTPAPDTQKKKKGKKK

SEQ ID NO: 879740 - protein, 390 aa, Homo sapiens
MHEHATPVTSAYGERHEELINLGSPDSHTISEGQKSSVTSKTTRKGKEKSSEKEKTAKEKQAPRFEPQISTVHPQQEDPNKPYWILRLVTEHNESELFEVKKDTERADEIRAMKQAWETTEPGRAIKASQARLHYLSGFIKKTSDAESPPISESQTKPKEEVETAARGVKEPNSKNSAGSESKEMTQTGSGSAVWKKWQLTKGLRDVAKSTSSESGGVSSPGKEEREQSTRKENIQTGPRTRSPTILETSPRLIRKALEFMDLSQYVRKTDTDPLLQTDELNQQQAMQKAEEIHQFRQHRTRVLSIRNIDQEERLKLKDEVLDMYKEMQDSLDEARQKIFDIREEYRNKLLEAEHLKLETLAAQEAAMKLETEKMTPAPDTQKKKKGKKK

SEQ ID NO: 879741 - protein, 390 aa, Homo sapiens; identical to SEQ ID NO: 879740

SEQ ID NO: 879742 - protein, 737 aa, Homo sapiens
GSGFRPRRTLPWAGLSRGTRWNRGERGAPGAANMDDYSLDEFRRRWQEELAQAQAPKKRRRPEAAERRARRPENEMNDVPFFDIQLPYELAINIFQYLDRKELEKMGTDEQTDFGLGDAHQSDGLNLEREIVSQTTATQEKSQEELPTTNNSVSKEIWLDFEDFCVCFQNIYIFHKPSSYCLNFQKSEFKFSEERVSYYLFVDSLKPIELLVCFSALVRWGEYGALTKDSPPIEPGLLTAETFSWKSLKPGSLVLKIHTYATKATVVRLPVGRHMLLFNAYSPVGHSIHICSMVSFVIGDEHVVLPNFEPESCRFTEQSLLIMKAIGNVIANFKDKGKLSAALKDLQTAHYPVPFHDKELTAQHFRVFHLSLWRLMKKVQITKPPPNFKFAFRAMVLDLELLNSSLEEVSLVEWLDVKYCMPTSDKEYSAEEVAAAIKIQAMWRGTYVRLLMKARIPDTKENISVADTLQKVWAVLEMNLEQYAVSLLRLMFKSKCKSLESYPCYQDEETKIAFADYTVTYQEQPPNSWFIVFRETFLVHQDMILVPKVYTTLPICILHIVNNDTMEQVPKVFQKVVPYLYTKNKKGYTFVAEAFTGDTYVAASRWKLRLIGSSAPLPCLSRDSPCNSFAIKEIRDYYIPNDKKILFRYSVKVLTPQPATIQVRTSKPDAFIKLQVLENEETMVSSTGKGQAIIPAFHFLKSEKGLSSQCKCTFMNRIVRFINGYLCFHDTLKMKIK

SEQ ID NO: 879743 - protein, 1049 aa, Homo sapiens
GSGFRPRRTLPWAGLSRGTRWNRGERGAPGAANMDDYSLDEFRRRWQEELAQAQAPKKRRRPEAAERRARRPENEMNDVPFFDIQLPYELAINIFQYLDRKELEKMGTDEQTDFGLGDAHQSDGLNLEREIVSQTTATQEKSQEELPTTNNSVSKEIWLDFEDFCVCFQNIYIFHKPSSYCLNFQKSEFKFSEERVSYYLFVDSLKPIELLVCFSALVRWGEYGALTKDSPPIEPGLLTAETFSWKSLKPGSLVLKIHTYATKATVVRLPVGRHMLLFNAYSPVGHSIHICSMVSFVIGDEHVVLPNFEPESCRFTEQSLLIMKAIGNVIANFKDKGKLSAALKDLQTAHYPVPFHDKELTAQHFRVFHLSLWRLMKKVQITKPPPNFKFAFRAMVLDLELLNSSLEEVSLVEWLDVKYCMPTSDKEYSAEEVAAAIKIQAMWRGTYVRLLMKARIPDTKENISVADTLQKVWAVLEMNLEQYAVSLLRLMFKSKCKSLESYPCYQDEETKIAFADYTVTYQEQPPNSWFIVFRETFLVHQDMILVPKVYTTLPICILHIVNNDTMEQVPKVFQKVVPYLYTKNKKGYTFVAEAFTGDTYVAASRWKLRLIGSSAPLPCLSRDSPCNSFAIKEIRDYYIPNDKKILFRYSVKVLTPQPATIQVRTSKPDAFIKLQVLENEETMVSSTGKGQAIIPAFHFLKSEKGLSSQSYGERHEELINLGSPDSHTISEGQKSSVTSKTTRKGKEKSSEKEKTAKEKQAPRFEPQISTVHPQQEDPNKPYWILRLLRLVCITLAGSLRKHLMLRVRLYLKAKLNQKKKYETAARGVKEPNSKNSAGSESKEMTQTGSGSAVWKKWQLTKGLRDVAKSTSSESGGVSSPGKEEREQSTRKENIQTGPRTRSPTILETSPRLIRKALEFMDLSQYVRKTDTDPLLQTDELNQQQAMQKAEEIHQFRQHRTRVLSIRNIDQEERLKLKDEVLDMYKEMQDSLDEARQKIFDIREEYRNKLLEAEHLKLETLAAQEAAMKLETEKMTPAPDTQKKKKGKKK

SEQ ID NO: 879744 - protein, 1089 aa, Homo sapiens
GSGFRPRRTLPWAGLSRGTRWNRGERGAPGAANMDDYSLDEFRRRWQEELAQAQAPKKRRRPEAAERRARRPENEMNDVPFFDIQLPYELAINIFQYLDRKELEKMGTDEQTDFGLGDAHQSDGLNLEREIVSQTTATQEKSQEELPTTNNSVSKEIWLDFEDFCVCFQNIYIFHKPSSYCLNFQKSEFKFSEERVSYYLFVDSLKPIELLVCFSALVRWGEYGALTKDSPPIEPGLLTAETFSWKSLKPGSLVLKIHTYATKATVVRLPVGRHMLLFNAYSPVGHSIHICSMVSFVIGDEHVVLPNFEPESCRFTEQSLLIMKAIGNVIANFKDKGKLSAALKDLQTAHYPVPFHDKELTAQHFRVFHLSLWRLMKKVQITKPPPNFKFAFRAMVLDLELLNSSLEEVSLVEWLDVKYCMPTSDKEYSAEEVAAAIKIQAMWRGTYVRLLMKARIPDTKENISVADTLQKVWAVLEMNLEQYAVSLLRLMFKSKCKSLESYPCYQDEETKIAFADYTVTYQEQPPNSWFIVFRETFLVHQDMILVPKVYTTLPICILHIVNNDTMEQVPKVFQKVVPYLYTKNKKGYTFVAEAFTGDTYVAASRWKLRLIGSSAPLPCLSRDSPCNSFAIKEIRDYYIPNDKKILFRYSVKVLTPQPATIQVRTSKPDAFIKLQVLENEETMVSSTGKGQAIIPAFHFLKSEKGLSSQSYGERHEELINLGSPDSHTISEGQKSSVTSKTTRKGKEKSSEKEKTAKEKQAPRFEPQISTVHPQQEDPNKPYWILRLVTEHNESELFEVKKDTERADEIRAMKQAWETTEPGRAIKASQARLHYLSGFIKKTSDAESPPISESQTKPKEEVETAARGVKEPNSKNSAGSESKEMTQTGSGSAVWKKWQLTKGLRDVAKSTSSESGGVSSPGKEEREQSTRKENIQTGPRTRSPTILETSPRLIRKALEFMDLSQYVRKTDTDPLLQTDELNQQQAMQKAEEIHQFRQHRTRVLSIRNIDQEERLKLKDEVLDMYKEMQDSLDEARQKIFDIREEYRNKLLEAEHLKLETLAAQEAAMKLETEKMTPAPDTQKKKKGKKK

SEQ ID NO: 879745 - protein, 78 aa, Homo sapiens
YRSAPPLLNPTPPPPPLDSLDEARQKIFDIREEYRNKLLEAEHLKLETLAAQEAAMKLETEKMTPAPDTQKKKKGKKK

SEQ ID NO: 879746 - protein, 74 aa, Homo sapiens
NGESLEHHGYRGNGTDGESLEHRGYHGNGTHSESLEHHGYHGNGTDRESLEHRGYHGNGFQKGFCMLVFSQVKK

SEQ ID NO: 879747 - protein, 132 aa, Homo sapiens [sequence omitted]

SEQ ID NO: 879748 - protein, 138 aa, Homo sapiens
QHIQAKGCEKTPSYNYAPNMDKHWIMQYTGPMLPIHMEFTNILQRKRLQTLMSVDDSVERLYNMLVETGELENTYIIYTADHGYHIGQFGLVKGKSMPYDFDIRVPFFIRGPSVEPGSMFRTNKKAKIWRDTFLVERG

SEQ ID NO: 879749 - protein, 871 aa, Homo sapiens
MKYSCCALVLAVLGTELLGSLCSTVRSPRFRGRIQQERKNIRPNIILVLTDDQDVELGSLQVMNKTRKIMEHGGATFINAFVTTPMCCPSRSSMLTGKYVHNHNVYTNNENCSSPSWQAMHEPRTFAVYLNNTGYRTAFFGKYLNEYNGSYIPPGWREWLGLIKNSRFYNYTVCRNGIKEKHGFDYAKDYFTDLITNESINYFKMSKRMYPHRPVMMVISHAAPHGPEDSAPQFSKLYPNASQHITPSYNYAPNMDKHWIMQYTGPMLPIHMEFTNILQRKRLQTLMSVDDSVERLYNMLVETGELENTYIIYTADHGYHIGQFGLVKGKSMPYDFDIRVPFFIRGPSVEPGSIVPQIVLNIDLAPTILDIAGLDTPPDVDGKSVLKLLDPEKPGNRFRTNKKAKIWRDTFLVERGKFLRKKEESSKNIQQSNHLPKYERVKELCQQARYQTACEQPGQKWQCIEDTSGKLRIHKCKGPSDLLTVRQSTRNLYARGFHDKDKECSCRESGYRASRSQRKSQRQFLRNQGTPKYKPRFVHTRQTRSLSVEFEGEIYDINLEEEEELQVLQPRNIAKRHDEGHKGPRDLQASSGGNRGRMLADSSNAVGPPTTVRVTHKCFILPNDSIHCERELYQSARAWKDHKAYIDKEIEALQDKIKNLREVRGHLKRRKPEECSCSKQSYYNKEKGVKKQEKLKSHLHPFKEAAQEVDSKLQLFKENNRRRKKERKEKRRQRKGEECSLPGLTCFTHDNNHWQTAPFWNLGSFCACTSSNNNTYWCLRTVNETHNFLFCEFATGFLEYFDMNTDPYQLTNTVHTVERGILNQLHVQLMELRSCQGYKQCNPRPKNLDVGNKDGGSYDLHRGQLWDGWEG

SEQ ID NO: 879750 - protein, 892 aa, Homo sapiens
MCYGTPSYNYAPNMDKHWIMQYTGPMLPIHMEFTNILQRKRLQTLMSVDDSVERLYNMLVETGELENTYIIYTADHGYHIGQFGLVKGKSMPYDFDIRVPFFIRGPSVEPGSIVPQIVLNIDLAPTILDIAGLDTPPDVDGKSVLKLLDPEKPGNRFRTNKKAKIWRDTFLVERGKFLRKKEESSKNIQQSNHLPKYERVKELCQQARYQTACEQPGQKWQCIEDTSGKLRIHKCKGPSDLLTVRQSTRNLYARGFHDKDKECSCRESGYRASRSQRKSQRQFLRNQGTPKYKPRFVHTRQTRSLSVEFEGEIYDINLEEEEELQVLQPRNIAKRHDEGHKGPRDLQASSGGNRGRMLADSSNAVGPPTTVRVTHKCFILPNDSIHCERELYQSARAWKDHKAYIDKEIEALQDKIKNLREVRGHLKRRKPEECSCSKQSYYNKEKGVKKQEKLKSHLHPFKEAAQEVDSKLQLFKENNRRRKKERKEKRRQRKGEECSLPGLTCFTHDNNHWQTAPFWNLGSFCACTSSNNNTYWCLRTVNETHNFLFCEFATGFLEYFDMNTDPYQLTNTVHTVERGILNQLHVQLMELRSCQGYKQCNPRPKNLDVGNKDGGAMTYTEDSYGMDGKVNQPRLTADINWQGLEELHSVNENIYEYRQNYRLSLVDWTNYLKDLDRVFALLKSHYEQNKTNKTQTAQSDGFLVVSAEHAVSMEMASADSDEDPRHKVGKTPHLTLPADLQTLHLNRPTLSPESKLEWNNDIPEVNHLNSEHWRKTEKWTGHEETNHLETDFSGDGMTELELGPSPRLQPIRRHPKELPQYGGPGKDIFEDQLYLPVHSDGISVHQMFTMATAEHRSNSSIAGKMLTKVEKNHEKEKSQHLEGSASSSLSSD

SEQ ID NO: 879751 - protein, 175 aa, Homo sapiens
CGTDWSTVVQSQLTDNLRPLGFKRFSCLSLPRSWNYRHAPPRPANFVFLVKMVFLHVGQAGLELPTSGDPPTSASQSAGMTELELGPSPRLQPIRRHPKELPQYGGPGKDIFEDQLYLPVHSDGISVHQMFTMATAEHRSNSSIAGKMLTKVEKNHEKEKSQHLEGSASSSLSSD

SEQ ID NO: 879752 - protein, 416 aa, Homo sapiens
MKYSCCALVLAVLGTELLGSLCSTVRSPRFRGRIQQERKNIRPNIILVLTDDQDVELGSLQVMNKTRKIMEHGGATFINAFVTTPMCCPSRSSMLTGKYVHNHNVYTNNENCSSPSWQAMHEPRTFAVYLNNTGYRTAFFGKYLNEYNGSYIPPGWREWLGLIKNSRFYNYTVCRNGIKEKHGFDYAKDYFTDLITNESINYFKMSKRMYPHRPVMMVISHAAPHGPEDSAPQFSKLYPNASQHITPSYNYAPNMDKHWIMQYTGPMLPIHMEFTNILQRKRLQTLMSVDDSVERLYNMLVETGELENTYIIYTADHGYHIGQFGLVKGKSMPYDFDIRVPFFIRGPSVEPGSIVPQIVLNIDLAPTILDIAGLDTPPDVDGKSVLKLLDPEKPGNRFRTNKKAKIWRDTFLVERG

SEQ ID NO: 879753 - protein, 666 aa, Homo sapiens
MKYSCCALVLAVLGTELLGSLCSTVRSPRFRGRIQQERKNIRPNIILVLTDDQDVELGSLQVMNKTRKIMEHGGATFINAFVTTPMCCPSRSSMLTGKYVHNHNVYTNNENCSSPSWQAMHEPRTFAVYLNNTGYRTAFFGKYLNEYNGSYIPPGWREWLGLIKNSRFYNYTVCRNGIKEKHGFDYAKDYFTDLITNESINYFKMSKRMYPHRPVMMVISHAAPHGPEDSAPQFSKLYPNASQHITPSYNYAPNMDKHWIMQYTGPMLPIHMEFTNILQRKRLQTLMSVDDSVERLYNMLVETGELENTYIIYTADHGYHIGQFGLVKGKSMPYDFDIRVPFFIRGPSVEPGSIVPQIVLNIDLAPTILDIAGLDTPPDVDGKSVLKLLDPEKPGNRFRTNKKAKIWRDTFLVERGKFLRKKEESSKNIQQSNHLPKYERVKELCQQARYQTACEQPGQKWQCIEDTSGKLRIHKCKGPSDLLTVRQSTRNLYARGFHDKDKECSCRESGYRASRSQRKSQRQFLRNQGTPKYKPRFVHTRQTRSLSVEFEGEIYDINLEEEEELQVLQPRNIAKRHDEGHKGPRDLQASSGGNRGRMLADSSNAVGPPTTVRVTHKCFILPNDSIHCERELYQSARAWKDHKAYIDKEIEALQDKIKNLKEVRGL

SEQ ID NO: 879754 - protein, 67 aa, Homo sapiens
DLSHHRVPLYRVPQIVLNIDLAPTILDIAGLDTPPDVDGKSVLKLLDPEKPGNRCVIVPPLSQPQIH

SEQ ID NO: 879755 - protein, 871 aa, Homo sapiens; identical to SEQ ID NO: 879749

SEQ ID NO: 879756 - protein, 546 aa, Homo sapiens
MSHCCRKSSPKCHLPLALDLSHHRVPLYRVPQIVLNIDLAPTILDIAGLDTPPDVDGKSVLKLLDPEKPGNRFRTNKKAKIWRDTFLVERGKFLRKKEESSKNIQQSNHLPKYERVKELCQQARYQTACEQPGQKWQCIEDTSGKLRIHKCKGPSDLLTVRQSTRNLYARGFHDKDKECSCRESGYRASRSQRKSQRQFLRNQGTPKYKPRFVHTRQTRSLSVEFEGEIYDINLEEEEELQVLQPRNIAKRHDEGHKGPRDLQASSGGNRGRMLADSSNAVGPPTTVRVTHKCFILPNDSIHCERELYQSARAWKDHKAYIDKEIEALQDKIKNLREVRGHLKRRKPEECSCSKQSYYNKEKGVKKQEKLKSHLHPFKEAAQEVDSKLQLFKENNRRRKKERKEKRRQRKGEECSLPGLTCFTHDNNHWQTAPFWNLGSFCACTSSNNNTYWCLRTVNETHNFLFCEFATGFLEYFDMNTDPYQLTNTVHTVERGILNQLHVQLMELRSCQGYKQCNPRPKNLDVGNKDGGSYDLHRGQLWDGWEG

SEQ ID NO: 879757 - protein, 871 aa, Homo sapiens; identical to SEQ ID NO: 879749

SEQ ID NO: 879758 - protein, 1133 aa, Homo sapiens
MKYSCCALVLAVLGTELLGSLCSTVRSPRFRGRIQQERKNIRPNIILVLTDDQDVELGSLQVMNKTRKIMEHGGATFINAFVTTPMCCPSRSSMLTGKYVHNHNVYTNNENCSSPSWQAMHEPRTFAVYLNNTGYRTAFFGKYLNEYNGSYIPPGWREWLGLIKNSRFYNYTVCRNGIKEKHGFDYAKDYFTDLITNESINYFKMSKRMYPHRPVMMVISHAAPHGPEDSAPQFSKLYPNASQHITPSYNYAPNMDKHWIMQYTGPMLPIHMEFTNILQRKRLQTLMSVDDSVERLYNMLVETGELENTYIIYTADHGYHIGQFGLVKGKSMPYDFDIRVPFFIRGPSVEPGSIVPQIVLNIDLAPTILDIAGLDTPPDVDGKSVLKLLDPEKPGNRFRTNKKAKIWRDTFLVERGKFLRKKEESSKNIQQSNHLPKYERVKELCQQARYQTACEQPGQKWQCIEDTSGKLRIHKCKGPSDLLTVRQSTRNLYARGFHDKDKECSCRESGYRASRSQRKSQRQFLRNQGTPKYKPRFVHTRQTRSLSVEFEGEIYDINLEEEEELQVLQPRNIAKRHDEGHKGPRDLQASSGGNRGRMLADSSNAVGPPTTVRVTHKCFILPNDSIHCERELYQSARAWKDHKAYIDKEIEALQDKIKNLREVRGHLKRRKPEECSCSKQSYYNKEKGVKKQEKLKSHLHPFKEAAQEVDSKLQLFKENNRRRKKERKEKRRQRKGEECSLPGLTCFTHDNNHWQTAPFWNLGSFCACTSSNNNTYWCLRTVNETHNFLFCEFATGFLEYFDMNTDPYQLTNTVHTVERGILNQLHVQLMELRSCQGYKQCNPRPKNLDVGNKDGGAMTYTEDSYGMDGKVNQPRLTADINWQGLEELHSVNENIYEYRQNYRLSLVDWTNYLKDLDRVFALLKSHYEQNKTNKTQTAQSDGFLVVSAEHAVSMEMASADSDEDPRHKVGKTPHLTLPADLQTLHLNRPTLSPESKLEWNNDIPEVNHLNSEHWRKTEKWTGHEETNHLETDFSGDGMTELELGPSPRLQPIRRHPKELPQYGGPGKDIFEDQLYLPVHSDGISVHQMFTMATAEHRSNSSIAGKMLTKVEKNHEKEKSQHLEGSASSSLSSD

SEQ ID NO: 879759 - protein, 677 aa, Homo sapiens
MKYSCCALVLAVLGTELLGSLCSTVRSPRFRGRIQQERKNIRPNIILVLTDDQDVELGSLQVMNKTRKIMEHGGATFINAFVTTPMCCPSRSSMLTGKYVHNHNVYTNNENCSSPSWQAMHEPRTFAVYLNNTGYRTAFFGKYLNEYNGSYIPPGWREWLGLIKNSRFYNYTVCRNGIKEKHGFDYAKDYFTDLITNESINYFKMSKRMYPHRPVMMVISHAAPHGPEDSAPQFSKLYPNASQHITPSYNYAPNMDKHWIMQYTGPMLPIHMEFTNILQRKRLQTLMSVDDSVERLYNMLVETGELENTYIIYTADHGYHIGQFGLVKGKSMPYDFDIRVPFFIRGPSVEPGSIVPQIVLNIDLAPTILDIAGLDTPPDVDGKSVLKLLDPEKPGNRFRTNKKAKIWRDTFLVERGKFLRKKEESSKNIQQSNHLPKYERVKELCQQARYQTACEQPGQKWQCIEDTSGKLRIHKCKGPSDLLTVRQSTRNLYARGFHDKDKECSCRESGYRASRSQRKSQRQFLRNQGTPKYKPRFVHTRQTRSLSVEFEGEIYDINLEEEEELQVLQPRNIAKRHDEGHKGPRDLQASSGGNRGRMLADSSNAVGPPTTVRVTHKCFILPNDSIHCERELYQSARAWKDHKAYIDKEIEALQDKIKNLKEVSLDLWTGILLDLRL

SEQ ID NO: 879760 - protein, 120 aa, Homo sapiens
KKEKRKKLRQQLLINNTWSRIGKLLSRWLLQKWQCIEDTSGKLRIHKCKGPSDLLTVRQSTRNLYARGFHDKDKECSCRESGYRASRSQRKSQRQFLRNQGTPSKPRFCDHLNGGLGLWE

SEQ ID NO: 879761 - protein, 126 aa, Homo sapiens
DLGTESVSGTLSSLQQCNPRDGFDMFAQTRGNSLAEQRKTVTYEDPQAVGGLASALDNRKQSSEGKGDDLEEGVTSEEFDKFLEERAKAAEMVPDLPSPPMEAPAPASNPSGRKKPERSEDALFAL

SEQ ID NO: 879762 - protein, 146 aa, Homo sapiens
DLGTESVSGTLSSLQQCNPRDGFDMFAQTRGNSLAEQRKTVTYEDPQAVGGLASALDNRKQSSEGIPVAQPSVMDDIEVWLRTDLKGDDLEEGVTSEEFDKFLEERAKAAEMVPDLPSPPMEAPAPASNPSGRKKPERSEDALFAL

SEQ ID NO: 879763 - protein, 146 aa, Homo sapiens; identical to SEQ ID NO: 879762

SEQ ID NO: 879764 - protein, 102 aa, Homo sapiens
ERMHQIPSERRLPRARLQLYFQPCCGKQFRAGFSSLCTTSTSPPVSMRQFSFSAQGFRSAPTQGWQKRAQPEDLWREVASTEPASIWGAQAPPGECFCQAVI

SEQ ID NO: 879765 - protein, 356 aa, Homo sapiens
GVDFAPAACPSEDRDTVLGHTMGRPLHLVLLSASLAGLLLLGESLFIRREQANNILARVTRANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRIVGGQECKDGECPWQALLINEENEGFCGGTILSEFYILTAAHCLYQAKRFKVREGTGTRSRRRAVRRCTRWRWSSSTTGSQRRPMTSTSPCSGSRPPSPSA

SEQ ID NO: 879766 - protein, 509 aa, Homo sapiens
GVDFAPAACPSEDRDTVLGHTMGRPLHLVLLSASLAGLLLLGESLFIRREQANNILARVTRANSFLEEMKKGHLERECMEETCSYEEAREVFEDSDKTNEFWNKYKDGDQCETSPCQNQGKCKDGLGEYTCTCLEGFEGKNCELFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRIVGGQECKDGECPWQALLINEENEGFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGRTHEKGRQSTRLKMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 879767 - protein, 144 aa, Homo sapiens
GVDFAPAACPSEDRDTVLGHTMGRPLHLVLLSASLAGLLLLGESLFIRREQANNILARVTRANSFLEEMKKGHLERECMEETCSYEEAREVFEDSDKTNEFWNKYKDGDQCETSPCQNQGKCKDGLGEYTCTCLEGFEGKNCEL

SEQ ID NO: 879768 - protein, 147 aa, Homo sapiens
MCESMSLAELSTVPLSVPGDRNTEQEEGGEAVHEVEVVIKHNRFTKETYDFDIAVLRLKTPITFRMNVAPACLPERDWAESTLMTQKTGIVSGFGRTHEKGRQSTRLKMLEVPYVDRNSCKLSSSFIITQNMFCAGYDTKQEDACQG

SEQ ID NO: 879769 - protein, 372 aa, Homo sapiens
MHVDWNYFTRKLCSLDNGDCDQFCHEEQNSVVCSCARGYTLADNGKACIPTGPYPCGKQTLERRKRSVAQATSSSGEAPDSITWKPYDAADLDPTENPFDLLDFNQTQPERGDNNLTRIVGGQECKDGECPWQALLINEENEGFCGGTILSEFYILTAAHCLYQAKRFKVRVGDRNTEQEEGGEAVHEVEVVIKHNRFTKETYDFDIAVLRLKTPITFRMNVAPACLPERDWAESTLMTQKTGIVSGFGRTHEKGRQSTRLKMLEVPYVDRNSCKLSSSFIITQNMFCAGYDTKQEDACQGDSGGPHVTRFKDTYFVTGIVSWGEGCARKGKYGIYTKVTAFLKWIDRSMKTRGLPKAKSHAPEVITSSPLK

SEQ ID NO: 879770 - protein, 92 aa, Homo sapiens
MKKGHLERECMEETCSYEEAREVFEDSDKTVRAGDSLAVGKELRPQRPRWPCCSVHPGGRPGGRGSVREGFQGRGPANRGLGGVLPTGTSVP

SEQ ID NO: 879771 - protein, 33 aa, Homo sapiens
MGDNSKNSLLCDLITKQLASLRTMSKASSLATY

SEQ ID NO: 879772 - protein, 111 aa, Homo sapiens
QGQSLLQLPRTAVKSVSTLMVSALQSGWQMCSWKSSVSSASVSSQVRTQSPLKTPEAELLWEVYLVLWAVRKHLRRLYRRQERHRRHHVRCHAAPRPNPAQSLKLDAQSPL

SEQ ID NO: 879773 - protein, 111 aa, Homo sapiens
MTKHWSLQPLIVTQTFLSIDNSFNQLPIRKSLNLPVTSKPHLPTATPSDCPTFLDQTNVYLTCIDAYVFLKCIKPSCGPTTSGTCSQDLLRVVLQAIGHSYLPQNKFLKTC

SEQ ID NO: 879774 - protein, 346 aa, Homo sapiens
CVQTSEEECSSTLAVWVKWPIHPSAPELAGHKRQFGSVCHQDPRVCDEPSSEDPHEWPEDITKWPICTKNSAGNHTNHPHMDCVITGRPCCIGTKGRCEITSREYCDFMRGYFHEEATLCSQVHCMDDVCGLLPFLNPEVPDQFYRLWLSLFLHAGILHCLVSICFQMTVLRDLEKLAGWHRIAIIYLLSGVTGNLASAIFLPYRAEVGPAGSQFGILACLFVELFQSWQILARPWRAFFKLLAVVLFLFTFGLLPWIDNFAHISGFISGLFLSFAFLPYISFGKFDLYRKRCQIIIFQVVFLGLLAGLVVLFYVYPVRCEWCEFLTCIPFTDKFCEKYELDAQLH

SEQ ID NO: 879775 - protein, 122 aa, Homo sapiens
CVQTSEEECSSTLAVWVKWPIHPSAPELAGHKRQFGSVCHQDPRVCDEPSSEDPHEWPEDITKWPVSCSGGVVREPSVSCGRECHTPPTGDTRDSHHGTTSRFQRLCTCPLYSLSINQRLPL

SEQ ID NO: 879776 - protein, 120 aa, Homo sapiens
MTGSSIINAWLAWWSSSTSILSAVSGVSSSPASPSLTSSVRSTNWTLSSTELAAGSSGRVLQQARARHDLPEPHRLTGVTCSMWGLACFLNTDLFLVPCSLLLNPSYCRAFIILLPVITF

SEQ ID NO: 879777 - protein, 386 aa, Homo sapiens
CVQTSEEECSSTLAVWVKWPIHPSAPELAGHKRQFGSVCHQDPRVCDEPSSEDPHEWPEDITKWPICTKNSAGNHTNHPHMDCVITGRPCCIGTKGRCEITSREYCDFMRGYFHEEATLCSQVHCMDDVCGLLPFLNPEVPDQFYRLWLSLFLHAGQVTLWAGSGVSGPSGLAGWGWQKGHFLLNVSRPPPATDYRILHCLVSICFQMTVLRDLEKLAGWHRIAIIYLLSGVTGNLASAIFLPYRAEVGPAGSQFGILACLFVELFQSWQILARPWRAFFKLLAVVLFLFTFGLLPWIDNFAHISGFISGLFLSFAFLPYISFGKFDLYRKRCQIIIFQVVFLGLLAGLVVLFYVYPVRCEWCEFLTCIPFTDKFCEKYELDAQLH

SEQ ID NO: 879778 - protein, 213 aa, Homo sapiens
MHLLVPPPQHSLFTAFSQFGLLYSVRVFPNAAVAHPGFYAVIKFYSARAAHRAQKACDRKQLFQKSPVKVRLGTRHKAVQHQALALNSSKCQELANYYFGFNGCSKRIIKLQELSDLEERENEDSMVPLPKQSLKFFCALEVVLPSCDCRSPGIGLVEEPMDKVEEGPLSFLMKRKTAQKLAIQKALSDAFQKLLIVVLGKTVLIILEVLQFQ

SEQ ID NO: 879779 - protein, 236 aa, Homo sapiens
MAELVPFAVPIESDKTLLVWELSSGPTAEALHHSLFTAFSQFGLLYSVRVFPNAAVAHPGFYAVIKFYSARAAHRAQKACDRKQLFQKSPVKVRLGTRHKAVQHQALALNSSKCQELANYYFGFNGCSKRIIKLQELSDLEERENEDSMVPLPKQSLKFFCALEVVLPSCDCRSPGIGLVEEPMDKVEEGPLSFLMKRKTAQKLAIQKALSDAFQKLLIVVLGKTVLIILEVLQFQ

SEQ ID NO: 879780 - protein, 116 aa, Homo sapiens
MHLLVPPPQHSLFTAFSQFGLLYSVRVFPNAAVAHPGFYAVIKFYSARAAHRAQKACDRKQLFQKSPVKVRLGTRHKAVQHQALALNSSKCQELANYYFGFNGCSKRIIKDHYHSL

SEQ ID NO: 879781 - protein, 546 aa, Homo sapiens
MDVVEVAGSWWAQEREDIIMKYEKIMKEKGKRSSEHIQQMDLDVKRDIKEAYILQGSIRNQETAIKYMTDGCLLKHILGDPSLTKFRVIILDEAHERTLTTDILFGLLKKLFQEKSANRKEHLKVVIVKVTMDIHLNEMAGDILVFLTDQQRRIFLPPPPGIRKCVISTNISATSLTIDGIRYVVDGGFVKQLNHNPRLGLDILEVVPISKSEALQRSGRAGRTSSGKCFRIYSKDFWNQCMPDHVIPEIKRTSLTSVVLTLKCLAIHDVIRFPYLDPPNERLILEALKQLYQCDAIDRSGHVTRLGLSMVEFPLPPHLTCAVIKAASLDCEDLLLPIAAMLSVENVFIRPVDPEYQKEAEQRHRELAAKAGGFNDFATLAVIFEQCKSSGAPASWCQKHWIHWRCLFSAFRVEAQLRELIRKLKQQSDFPKETFEGPKHEVLRRCLCAGYFKNVARRSVGRTFCTMDGRGSPVHIHPSSALHEQETKLEWIIFHGVLVTTKVYARIVCPIRYEWVRDLLPKLHEFNAHDLSSVARREVMKIYYFQ

SEQ ID NO: 879782 - protein, 488 aa, Homo sapiens
MDVVEVAGSWWAQEREDIIMKYEKIMKEKGKRSSEHIQQMDLDVKRDIKEAYILQGSIRNQETAIKYMTDGCLLKHILGDPSLTKFRVIILDEAHERTLTTDILFGLLKKLFQEKSANRKEHLKVVIVKVTMDIHLNEMAGDILVFLTDQQRRIFLPPPPGIRKCVISTNISATSLTIDGIRYVVDGGFVKQLNHNPRLGLDILEVVPISKSEALQRSGRAGRTSSGKCFRIYSKDFWNQCMPDHVIPEIKRTSLTSVVLTLKCLAIHDVIRFPYLDPPNERLILEALKQLYQCDAIDRSGHVTRLGLSMVEFPLPPHLTCAVIKAASLDCEDLLLPIAAMLSVENVFIRPVDPEYQKEAEQRHRELAAKAGGFNDFATLAVIFEQCKSSGAPASWCQKHWIHWRCLFSAFRVEAQLRELIRKLKQWLPEVPGPQRQGAGSAADVQQILLCRDHSPCFLQEPQSHRGKSCPTGHQSHQPQCQAAQQRK

SEQ ID NO: 879783 - protein, 84 aa, Homo sapiens
MLPSGFRKFLVHNVKELEVLLMCNKSYCAEITHHVSSKNRKAIVERAAQLAIKVTNPNARLRSKENEETARVHVFCLNKSKNCQ

SEQ ID NO: 879784 - protein, 402 aa, Homo sapiens
YLLYALKQRRNPQVLTSLLVCREDRINMSTAGKVIKCKAAVLWELKKPFSIEEVEVAPPKAHEVRIKMVAAGICRSDEHVVSGNLVTPLPVILGHEAAGIVESVGEGVTTVKPGDKVIPLFTPQCGKCRICKNPESNYCLKNDLGNPRGTLQDGTRRFTCSGKPIHHFVGVSTFSQYTVVDENAVAKIDAASPLEKVCLIGCGFSTGYGSAVKVAKVTPGSTCAVFGLGGVGLSVVMGCKAAGAARIIAVDINKDKFAKAKELGATECINPQDYKKPIQEVLKEMTDGGVDFSFEVIGRLDTMMASLLCCHEACGTSVIVGVPPDSQNLSINPMLLLTGRTWKGAIFGGFKSKESVPKLVADFMAKKFSLDALITNILPFEKINEGFDLLRSGKSIRTVLTF

SEQ ID NO: 879785 - protein, 47 aa, Homo sapiens
AQARRRLTTQGTRLSPRHGAGSPRREHASRPGTAQAHHAGNTPLAHS

SEQ ID NO: 879786 - protein, 89 aa, Homo sapiens
VPRNWVSSQTDPQFASMAQRCPASPSAPSRPLNAFTALGKRDLVREPSGACFLAVGHSPTAGSPKIASGHYALGSGEMESHLAAQQPGT

SEQ ID NO: 879787 - protein, 1115 aa, Homo sapiens
MERAISPGLLVRALLLLLLLGLAARTVAAGRARGLPAPTAEAAFGLGAAAAPTSATRVPAAGAVAAAEVTVEDAEALPAAAGEQEPRGPEPDDETELRPRGRSLVIISTLDGRIAALDPENHGKKQWDLDVGSGSLVSSSLSKPEVFGNKMIIPSLDGALFQWDRDRESMETVPFTVESLLESSYKFGDDVVLVGGKSLTTYGLSAYSGKVRYICSALGCRQWDSDEMEQEEDILLLQRTQKTVRAVGPRSGNEKWNFSVGHFELRYIPDMETRAGFIESTFKPNENTEESKIISDVEEQEAAIMDIVIKVSVADWKVMAFSKKGGHLEWEYQFCTPIASAWLLKDGKVIPISLFDDTSYTSNDDVLEDEEDIVEAARGATENSVYLGMYRGQLYLQSSVRISEKFPSSPKALESVTNENAIIPLPTIKWKPLIHSPSRTPVLVGSDEFDKCLSNDKFSHEEYSNGALSILQYPYDNGYYLPYYKRERNKRSTQITVRFLDNPHYNKNIRKKDPVLLLHWWKEIVATILFCIIATTFIVRRLFHPHPHRQRKESETQCQTENKYDSVSGEANDSSWNDIKNSGYISRYLTDFEPIQCLGRGGFGVVFEAKNKVDDCNYAIKRIRLPNRELAREKVMREVKALAKLEHPGIVRYFNAWLEAPPEKWQEKMDEIWLKDESTDWPLSSPSPMDAPSVKIRRMDPFSTKEHIEIIAPSPQRSRSFSVGISCDQTSSSESQFSPLEFSGMDHEDISESVDAAYNLQDSCLTDCDVEDGTMDGNDEGHSFELCPSEASPYVRSRERTSSSIVFEDSGCDNASSKEEPKTNRLHIGNHCANKLTAFKPTSSKSSSEATLSISPPRPTTLSLDLTKNTTEKLQPSSPKVYLYIQMQLCRKENLKDWMNGRCTIEERERSVCLHIFLQIAEAVEFLHSKGLMHRDLKPSNIFFTMDDVVKVGDFGLVTAMDQDEEEQTVLTPMPAYARHTGQVGTKLYMSPEQIHGNSYSHKVDIFSLGLILFELLYPFSTQMERVRTLTDVRNLKFPPLFTQKYPCEYVMVQDMLSPSPMERPEAINIIENAVFEDLDFPGKTVLRQRSRSLSSSGTKHSRQSNNSHSPLPSN

SEQ ID NO: 879788 - protein, 130 aa, Homo sapiens
MWTEGDFSASLAGACSKLADALCACWARRGLTSATVSGLQRTLELRAGQPAQAQAAHGAAGRLPHSGGGHPGAADLLCPSPQHRGNLTGRGRASSLWNSGSVKDKVSSKSSWKTCVVTKLAWLSSFFAPK

SEQ ID NO: 879789 - protein, 915 aa, Homo sapiens
MDRKDLCMKVMRERTGYTKTYQAHAKQKFSRLWSSKSVTEIHLYFEEEVKQEECDHLDRLFAPKETGKQPRTVIIQGPQGIGKTTLLMKLMMAWSDNKIFRDRFLYTFYFCCRELRELPPTSLADLISREWLTRCSYNRDRVSTGETLVRHRQLRRAAGRLNEPDSDLCGDLMEKRPVQVLLSSLLRKKMLPEASLLIAIKPVCPKELRDQVTISEIYQPRGFNESDRLVYFCCFFKDPKRAMEAFNLVRESEQLFSICQIPLLCWILCTSLKQEMQKGKDLALTCQSTTSVYSSFVFNLFTPEGAEGPTPQTQHQLKALCSLAAEGMWTDTFEFCEDDLRRNGVVDADIPALLGTKILLKYGERESSYVFLHVCIQEFCAALFYLLKSHLDHPHPAVRCVQELLVANFEKARRAHWIFLGCFLTGLLNKKEQEKLDAFFGFQLSQEIKQQIHQCLKSLGERGNPQGQVDSLAIFYCLFEMQDPAFVKQAVNLLQEANFHIIDNVDLVVSAYCLKYCSSLRKLCFSVQNVFKKEDEHSSTSDYSLICWHHICSVLTTSGHLRELQVQDSTLSESTFVTWCNQLRHPSCRLQKLGINNVSFSGQSVLLFEVLFYQPDLKYLSFTLTKLSRDDIRSLCDALNYPAGNVKELALVNCHLSPIDCEVLAGLLTNNKKLTYLNVSCNQLDTGVPLLCEALCSPDTVLVYLMLAFCHLSEQCCEYISEMLLRNKSVRYLDLSANVLKDEGLKTLCEALKHPDCCLDSLCLVKCFITAAGCEDLASALISNQNLKILQIGCNEIGDVGVQLLCRALTHTDCRLEILGLEECGLTSTCCKDLASVLTCSKTLQQLNLTLNTLDHTGVVVLCEALRHPECALQVLGLRKTDFDEETQALLTAEEERNPNLTITDDCDTITRVEI

SEQ ID NO: 879790 - protein, 915 aa, Homo sapiens; identical to SEQ ID NO: 879789

SEQ ID NO: 879791 - protein, 858 aa, Homo sapiens
MDRKDLCMKVMRERTGYTKTYQAHAKQKFSRLWSSKSVTEIHLYFEEEVKQEECDHLDRLFAPKETGKQPRTVIIQGPQGIGKTTLLMKLMMAWSDNKIFRDRFLYTFYFCCRELRELPPTSLADLISREWLTRCSYNRDRVSTGETLVRHRQLRRAAGRLNEPDSDLCGDLMEKRPVQVLLSSLLRKKMLPEASLLIAIKPVCPKELRDQVTISEIYQPRGFNESDRLVYFCCFFKDPKRAMEAFNLVRESEQLFSICQIPLLCWILCTSLKQEMQKGKDLALTCQSTTSVYSSFVFNLFTPEGAEGPTPQTQHQLKALCSLAAEGMWTDTFEFCEDDLRRNGVVDADIPALLGTKILLKYGERESSYVFLHVCIQEFCAALFYLLKSHLDHPHPAVRCVQELLVANFEKARRAHWIFLGCFLTGLLNKKEQEKLDAFFGFQLSQEIKQQIHQCLKSLGERGNPQGQVDSLAIFYCLFEMQDPAFVKQAVNLLQEANFHIIDNVDLVVSAYCLKYCSSLRKLCFSVQNVFKKEDEHSSTSDYSLICWHHICSVLTTSGHLRELQVQDSTLSESTFVTWCNQLRHPSCRLQKLGINNVSFSGQSVLLFEVLFYQPDLKYLSFTLTKLSRDDIRSLCDALNYPAGNVKELALVNCHLSPIDCEVLAGLLTNNKKLTYLNVSCNQLDTGVPLLCEALCSPDTVLVYLMLAFCHLSEQCCEYISEMLLRNKSVRYLDLSANVLKDEGLKTLCEALKHPDCCLDSLWLEECGLTSTCCKDLASVLTCSKTLQQLNLTLNTLDHTGVVVLCEALRHPECALQVLGLRKTDFDEETQALLTAEEERNPNLTITDDCDTITRVEI

SEQ ID NO: 879792 - protein, 140 aa, Homo sapiens
MQECLTLWVFSPLALTDSGYTKTYQAHAKQKFSRLWSSKSVTEIHLYFEEEVKQEECDHLDRLFAPKETGKQPRTVIIQGPQGIGKTTLLMKLMMAWSDNKIFRDRFLYTFYFCCRELRELPPTSLADLISREWLTPLLL

SEQ ID NO: 879793 - protein, 116 aa, Homo sapiens
TRTGGWEILGRRERVLVKAPPSSLELQPKVRTCIPVFLLKCCLFQNHPWPTLPPILCHPRLCQQSRRGEDEKQLDIGNWFGAGEKKSRPLDFRKRSSSCSIPFPAPLAAESHFHRQ

SEQ ID NO: 879794 - protein, 123 aa, Homo sapiens
KRDWTAELGIRHVLLTIKCLLIHPNPESALNEEAGRLLLENYEEYAARARLLTEIHGGAGGPSGRAEAGRALASGTEASSTDSGAPGGLGGAEGPMAKKHAGERDKKLAAKKKTDKKRALRRL

SEQ ID NO: 879795 - protein, 99 aa, Homo sapiens
RHEAGARAKLEMDDADPEERNYDNMLKMLSDLNKDLEKLLEEMEKISVQATWMAYDMVVMRTNPTLAESMRRLEDAFVNCKEEMEKNWQELLHETKQRL

SEQ ID NO: 879796 - protein, 200 aa, Homo sapiens
SSQLQTGRDLEDEVVVSYSHPHVRLLRQRMDRLDNLTCHLLKKQAFRPQLPAYESLVQEIHHYVTSIAKAPAVQDLLTRLLQALHIDGPRSAQVAQSLLKEEASWQQSHHQFRKRLSEEYTFYPDAVSPLQASILQLQHGMRLVASELHTSLHSSMVGADRLGTLATALLAFPSVGPTFPTYYAHADTLCSVKSEEVLRG

SEQ ID NO: 879797 - protein, 252 aa, Homo sapiens
DGVPSLELGLPRKQSEMQMKAGVTCEVCMNVVQKLDHWLMSNSSELMITHALERVCSVMPASITKECIILVDTYSPSLVQLVAKITPEKVCKFIRLCGNRRRARAVHDAYAIVPSPEWDAENQGSFCNGCKRLLTVSSHNLESKSTKRDILVAFKGGCSILPLPYMIQCKHFVTQYEPVLIESLKDMMDPVAVCKKVGACHGPRTPLLGTDQCALGPSFWCRSQEAAKLCNAVQHCQKHVWKEMHLHAGEHA

SEQ ID NO: 879798 - protein, 252 aa, Homo sapiens; identical to SEQ ID NO: 879797

SEQ ID NO: 879799 - protein, 113 aa, Homo sapiens
MLSKLLQMQVIIIKGKRSPVCLGTVPCFADWRSSVSLGAVSCFADCQSPVSLGTVPCFADHGAGCLPLVQTHLHPRHALCCRRLTAWARPQRLLCSLASGQVGSQGERVEGGR

SEQ ID NO: 879800 - protein, 124 aa, Homo sapiens
EPNPANIMSEKKNCKNSSTNNNQTQDPSRNELQVPRSFVDRVVQDERDVQSQSSSTINTLLTLLDCLADYIMERVGLEASNNGSMRNTSQDREREVDNNREPHSAESDVTRFLFDEMPKSRKND

SEQ ID NO: 879801 - protein, 103 aa, Homo sapiens
AENGDNEKMAALEAKICHQIEYYLGDLRLPRDKFLKEKIKLDEGWVSLEIMIKFNRLNRLTTDFNVIVEALSKSKAEVMEISEDKTKIRRSPSKSLPEVTDEY

SEQ ID NO: 879802 - protein, 137 aa, Homo sapiens
MASEAEKTFHRFAAFGESSSSGTEMNNKNFSKLCKDCGIMDGKTVTSTDVDIVFSKVKAKNARTITFQQFKEAVKELGQKRFKGKSPDEVLENIYGLMEGKDPATTGATWMLSSRLDSTHTPTPVRLNSNISLIQLQ

SEQ ID NO: 879803 - protein, 170 aa, Homo sapiens
MASEAEKTFHRFAAFGESSSSGTEMNNKNFSKLCKDCGIMDGKTVTSTDVDIVFSKVKAKNARTITFQQFKEAVKELGQKRFKGKSPDEVLENIYGLMEGKDPATTGATKATTVGAVDRLTDTSKYTGTHKERFDESGKGKGIAGREEMTDNTGYVSGYKGSGTYDKKTK

SEQ ID NO: 879804 - protein, 118 aa, Homo sapiens
MASEAEKTFHRFAAFGESSSSGTEMNNKNFSKLCKDCGIMDGKTVTSTDVDIVFSKVKAKNARTITFQQFKEAVKELGQKRFKGKSPDEVLENIYGLMEGKDPATTGATFPWLPMQET

SEQ ID NO: 879805 - protein, 124 aa, Homo sapiens
MASEAEKTFHRFAAFGESSSSGTEMNNKNFSKLCKDCGIMDGKTVTSTDVDIVFSKVKAKNARTITFQQFKEAVKELGQKRFKGKSPDEVLENIYGLMEGKDPATTGATLLPRTGWKNIFGVKR

SEQ ID NO: 879806 - protein, 110 aa, Homo sapiens
YLGPKKAAPHASGRARAPSTCSKYLGPSLGKGYDSVRKGRELKSIPGLQKATTVGAVDRLTDTSKYTGTHKERFDESGKGKGIAGREEMTDNTGYVSGYKGSGTYDKKTK

SEQ ID NO: 879807 - protein, 261 aa, Homo sapiens [sequence omitted]

SEQ ID NO: 879808 - protein, 261 aa, Homo sapiens [sequence omitted]

SEQ ID NO: 879809 - protein, 68 aa, Homo sapiens
QALIVLHSKSLQNVERNFSGFCWVGLKETPVKPTPVKMLLTVGLLSLGSWSQSIFLQIIGFAFLVVSL

SEQ ID NO: 879810 - protein, 87 aa, Homo sapiens
TGCRGNRPPVEGGDPRKPAGWRSLVCLGRPLVQSFPGVSVQGLKRNALWFSREPPRRMHWDLRTVGQSHELFHDQLQPTSTRPFALH

SEQ ID NO: 879811 - protein, 75 aa, Homo sapiens
KVTEDVRRETQRQRRGRQPPSLGGALSSPAPAPTLSGGLLKPSAPTPGSPWKPAVPQEEQEEVESAECPRCARGP

SEQ ID NO: 879812 - protein, 593 aa, Homo sapiens
MENTPPGTVFPLKNTQDLDVAINNIQNYTIYPYSHVHALTQNGSEGRKYPELVLDKALDREEQAEIRLTLMAVDGGTPPRTGTALVLIEILDINDNAPEFVEPLYQVQISENSPLDSLVATVSARDSDMGINGEIFYFIFYGDEEISKTFALNERRGEIKIIRKLDFEKIVSYQVDIKASDGAGLSGKCTVIIQVVDINDNAPELTMASFTSPIRENSPETVAALFSIQDRDSGKNGRIVRSIQNDVPFMPKPSVENLYWLLTEGPLDKEIRAEYNITNTATDLGTPRLKTEYNITVLVSYVNDKAPTFTYNLLHPVRPREQQPRPAYWQRQHRRDSGTNIQVTYSLLPPRNPHLPLASLVSINTDNGHLFALRSLDYEALQEFEFRVGASDRGSTALSSEALVRVLVLDANDSSLFVLFPLQNGSAPCTELMPRAGRRAGLPGDQGGGGGRCLGPERLAVVAVAQGHGARAVRRVGAQCTDRLLSERDTAKHRLMVLVKDNGEPPRSATATLHVLLVDGFSLPYLPFPEAAPAQAQADLLTVYLVVALALVSSFFLFSVLLFVAVRLCRRSREASLGRCSVPEDPFPGIWWT

SEQ ID NO: 879813 - protein, 88 aa, Homo sapiens
RHEERWAAAAEELNMREMYLYATWEKAWRRGSSLRPARTWQLWRRIMKRWAWIPWKPRLKKVKNTEGRVWWVLHSTATPSVAAFKFFC

SEQ ID NO: 879814 - protein, 450 aa, Homo sapiens
MRECISIHVGQAGVQIGNACWELYCLEHGIQPDGQMPSDKTIGGGDDSFNTFFSETGAGKHVPRAVFVDLEPTVVDEVRTGTYRQLFHPEQLITGKEDAANNYARGHYTIGKEIVDLVLDRIRKLADLCTGLQGFLIFHSFGGGTGSGFASLLMERLSVDYGKKSKLEFAIYPAPQVSTAVVEPYNSILTTHTTLEHSDCAFMVDNEAIYDICRRNLDIERPTYTNLNRLIGQIVSSITASLRFDGGLNVDLTEFQTNLVPYPRIHFPLATYAPVISAEKAYHEQLSVAEITNACFEPANQMVKCDPRHGKYMACCMLYRGDVVPKDVNAAIATIKTKRTIQFVDWCPTGFKVGINYQPPTVVPGGDLAKVQRAVCMLSNTTAIAEAWARLDHKFDLMYAKRAFVHWYVGEGMEEGEFSEAREDLAALEKDYEEVGVDSVEAEAEEGEEY

SEQ ID NO: 879815 - protein, 418 aa, Homo sapiens
MRECISIHVGQAGVQIGNACWELYCLEHGIQPDGQMPSDKTIGGGDDSFNTFFSETGAGKHVPRAVFVDLEPTVVDEVRTGTYRQLFHPEQLITGKEDAANNYARGHYTIGKEIVDLVLDRIRKLADLCTGLQGFLIFHSFGGGTGSGFASLLMERLSVDYGKKSKLEFAIYPAPQVSTAVVEPYNSILTTHTTLEHSDCAFMVDNEAIYDICRRNLDIERPTYTNLNRLIGQIVSSITASLRFDGGLNVDLTEFQTNLVPYPRIHFPLATYAPVISAEKAYHEQLSVAEITNACFEPANQMVKCDPRHGKYMACCMLYRGDVVPKDVNAAIATIKTKRTIQFVDWCPTGFKVGINYQPPTVVPGGDLAKVQRAVCMLSNTTAIAEAWARLDLAALEKDYEEVGVDSVEAEAEEGEEY

SEQ ID NO: 879816 - protein, 78 aa, Homo sapiens
MALTHRITLANIHLAYAPTSCSPTQHTEAFVVFYFPLTHCGTTMQVAGDQLIYENWLVSGIHIQKGPQGSITRDSTFQ

SEQ ID NO: 879817 - protein, 524 aa, Homo sapiens
LVEKYCEKSITVKVNSTYGNSSRNIVNQNVRENLKTLYRLTMDLCSKLKDYGLWQLFRTLELPLIPILAVMESHAIQVNKEEMEKTSALLGARLKELEQEAHFVAGERFLITSNNQLREILFGKLKLHLLSQRNSLPRTGLQKYPSTVSEALNALRDLHPLPKIILEYRQVHKIKSTFVDGLLACMKKGSISSTWNQTGTVTGRLSAKHPNIQGISKHPIQITTPKNFKGKEDKILTISPRAMFVSSKGHTFLAADFSQIELRILTHLSGDPELLKLFQESERDDVFSTLTSQWKDVPVEQVTHADREQTKKVVYAVVYGAGKERLAACLGVPIQEAAQFLESFLQKYKKIKDFARAAIAQCHQTGCVVSIMGRRRPLPRIHAHDQQLRAQAERQAVNFVVQGSAADLCKLAMIHVFTAVAASHTLTARLVAQIHDELLFEVEDPQIPECAALVRRTMESLEQVPLKVSLSAGRSWGHLVPLQEASGPPPGPCRTESPSNSLAAPGSPASTQPPPLHFSPSFCL

SEQ ID NO: 879818 - protein, 442 aa, Homo sapiens
LVEKYCEKSITVKVNSTYGNSSRNIVNQNVRENLKTLYRLTMDLCSKLKDYGLWQLFRTLELPLIPILAVMESHAIQVNKEEMEKTSALLGARLKELEQEAHFVAGERFLITSNNQLREILFGKLKLHLLSQRNSLPRTGLQKYPSTVSEALNALRDLHPLPKIILEYRQVHKIKSTFVDGLLACMKKGSISSTWNQTGTVTGRLSAKHPNIQGISKHPIQITTPKNFKGKEDKILTISPRAMFVSSKGHTFLAADFSQIELRILTHLSGDPELLKLFQESERDDVFSTLTSQWKDVPVEQVTHADREQTKKVVYAVVYGAGKERLAACLGVPIQEAAQFLESFLQKYKKIKDFARAAIAQCHQTGCVVSIMGRRRPLPRIHAHDQQLRAQAERQAVNFVVQGSAADLCKLAMIHVFTAVAASHTLTASPCGIDKGSWHVRS

SEQ ID NO: 879819 - protein, 324 aa, Homo sapiens
MASEALHQVGDGEEAVLKKENFNMMNALDQLPKPFSNPKSMNRTVTTKGLPLASKGNLVNFLEDDTINLLKPLPVEDSDCSSDETSISAFSSTLLNPIKLAVTQPNSSFFAGMLEGELNKLSFSPMAKNAENEDLALGPCPCPSKSQMATRGLLDLDNPELETETSSTHSESSVVVDLPDTPFIFEHTVNNSTAVISWTYALGKQPVSFYQLLLQEVAKTQENELPEAKNRPWIFNKILGTTVKLMELKPNTCYCLSVRAANTAGVGKWCKPYKFATLATDFSSFPENYPIQITVRRKEPRQKIVSIGPEEMRRLEDLEYLFPC

SEQ ID NO: 879820 - protein, 234 aa, Homo sapiens [sequence omitted]

SEQ ID NO: 879821 - protein, 943 aa, Homo sapiens
MTQRSIAGPICNLKFVTLLVALSSELPFLGAGVQLQDNGYNGLLIAINPQVPENQNLISNIKEMITEASFYLFNATKRRVFFRNIKILIPATWKANNNSKIKQESYEKANVIVTDWYGAHGDDPYTLQYRGCGKEGKYIHFTPNFLLNDNLTAGYGSRGRVFVHEWAHLRWGVFDEYNNDKPFYINGQNQIKVTRCSSDITGIFVCEKGPCPQENCIISKLFKEGCTFIYNSTQNATASIMFMQSLSSVVEFCNASTHNQEAPNLQNQMCSLRSAWDVITDSADFHHSFPMNGTELPPPPTFSLVQAGDKVVCLVLDVSSKMAEADRLLQLQQAAEFYLMQIVEIHTFVGIASFDSKGEIRAQLHQINSNDDRKLLVSYLPTTVSAKTDISICSGLKKGFEVVEKLNGKAYGSVMILVTSGDDKLLGNCLPTVLSSGSTIHSIALGSSAAPNLEELSRLTGGLKFFVPDISNSNSMIDAFSRISSGTGDIFQQHIQLESTGENVKPHHQLKNTVTVDNTVGNDTMFLVTWQASGPPEIILFDPDGRKYYTNNFITNLTFRTASLWIPGTAKPGHWTYTLNNTHHSLQALKVTVTSRASNSAVPPATVEAFVERDSLHFPHPVMIYANVKQGFYPILNATVTATVEPETGDPVTLRLLDDGAGADVIKNDGIYSRYFFSFAANGRYSLKVHVNHSPSISTPAHSIPGSHAMYVPGYTANGNIQMNAPRKSVGRNEEERKWGFSRVSSGGSFSVLGVPAGPHPDVFPPCKIIDLEAVKVEEELTLSWTAPGEDFDQGQATSYEIRMSKSLQNIQDDFNNAILVNTSKRNPQQAGIREIFTFSPQISTNGPEHQPNGETHESHRIYVAIRAMDRNSLQSAVSNIAQAPLFIPPNSDPVPARDYLILKGVLTAMGLIGIICLIIVVTHHTLSRKKRADKKENGTKLL

SEQ ID NO: 879822 - protein, 616 aa, Homo sapiens
MTQRSIAGPICNLKFVTLLVALSSELPFLGAGVQLQDNGYNGLLIAINPQVPENQNLISNIKEMITEASFYLFNATKRRVFFRNIKILIPATWKANNNSKIKQESYEKANVIVTDWYGAHGDDPYTLQYRGCGKEGKYIHFTPNFLLNDNLTAGYGSRGRVFVHEWAHLRWGVFDEYNNDKPFYINGQNQIKVTRCSSDITGIFVCEKGPCPQENCIISKLFKEGCTFIYNSTQNATASIMFMQSLSSVVEFCNASTHNQEAPNLQNQMCSLRSAWDVITDSADFHHSFPMNGTELPPPPTFSLVQAGDKVVCLVLDVSSKMAEADRLLQLQQAAEFYLMQIVEIHTFVGIASFDSKGEIRAQLHQINSNDDRKLLVSYLPTTVSAKTDISICSGLKKGFEVVEKLNGKAYGSVMILVTSGDDKLLGNCLPTVLSSGSTIHSIALGSSAAPNLEELSRLTGGLKFFVPDISNSNSMIDAFSRISSGTGDIFQQHIQLESTGENVKPHHQLKNTVTVDNTVGNDTMFLVTWQASGPPEIILFDPDGRKYYTNNFITNLTFRTASLWIPGTAKLRRFAFIPDGRLNLSVVDFDTLALFLFLIYCLGHKVKGNNKVYFH

SEQ ID NO: 879823 - protein, 696 aa, Homo sapiens
MTQRSIAGPICNLKFVTLLVALSSELPFLGAGVQLQDNGYNGLLIAINPQVPENQNLISNIKEMITEASFYLFNATKRRVFFRNIKILIPATWKANNNSKIKQESYEKANVIVTDWYGAHGDDPYTLQYRGCGKEGKYIHFTPNFLLNDNLTAGYGSRGRVFVHEWAHLRWGVFDEYNNDKPFYINGQNQIKVTRCSSDITGIFVCEKGPCPQENCIISKLFKEGCTFIYNSTQNATASIMFMQSLSSVVEFCNASTHNQEAPNLQNQMCSLRSAWDVITDSADFHHSFPMNGTELPPPPTFSLVQAGDKVVCLVLDVSSKMAEADRLLQLQQAAEFYLMQIVEIHTFVGIASFDSKGEIRAQLHQINSNDDRKLLVSYLPTTVSAKTDISICSGLKKGFEVVEKLNGKAYGSVMILVTSGDDKLLGNCLPTVLSSGSTIHSIALGSSAAPNLEELSRLTGGLKFFVPDISNSNSMIDAFSRISSGTGDIFQQHIQLESTGENVKPHHQLKNTVTVDNTVGNDTMFLVTWQASGPPEIILFDPDGRKYYTNNFITNLTFRTASLWIPGTAKPGHWTYTLNNTHHSLQALKVTVTSRASNSAVPPATVEAFVERDSLHFPHPVMIYANVKQGFYPILNATVTATVEPETGDPVTLRLLDDGAADVSIEDSVISLSGDHCIIGRTLVAHEEADDLANK

SEQ ID NO: 879824 - protein, 265 aa, Homo sapiens
MTQRSIAGPICNLKFVTLLVALSSELPFLGAGVQLQDNGYNGLLIAINPQVPENQNLISNIKEMITEASFYLFNATKRRVFFRNIKILIPATWKANNNSKIKQESYEKANVIVTDWYGAHGDDPYTLQYRGCGKEGKYIHFTPNFLLNDNLTAGYGSRGRVFVHEWAHLRWGVFDEYNNDKPFYINGQNQIKVTRCSSDITGIFVCEKGPCPQENCIISKLFKEGCTFIYNSTQNATASIMFMQSLSSVVEFCNASTTSRVSGSS

SEQ ID NO: 879825 - protein, 515 aa, Homo sapiens
MGDWNLLGDTLEEVHIHSTMIGKIWLTILFIFRMLVLGVAAEDVWNDEQSGFICNTEQPGCRNVCYDQAFPISLIRYWVLQVIFVSSPSLVYMGHALYRLRVLEEERQRMKAQLRVELEEVEFEMPRDRRRLEQELCQLEKRKLNKAPLRGTLLCTYVIHIFTRSVVEVGFMIGQYLLYGFHLEPLFKCHGHPCPNIIDCFVSRPTEKTIFLLFMQSIATISLFLNILEIFHLGFKKIKRGLWGKYKLKKEHNEFHANKAKQNVAKYQSTSANSLKRLPSAPDYNLLVEKQTHTAVYPSLNSSSVFQPNPDNHSVNDEKCILDEQETVLSNEISTLSTSCSHFQHISSNNNKDTHKIFGKELNGNQLMEKRETEGKDSKRNYYSRGHRSIPGVAIDGENNMRQSPQTVFSLPANCDWKPRWLRATWGSSTEHENRGSPPKGNLKGQFRKGTVRTLPPSQGDSQSLDIPNTADSLGGLSFEPGLVRTCNNPVCPPNHVVSLTNNLIGRRVPTDLQI

SEQ ID NO: 879826 - protein, 515 aa, Homo sapiens; identical to SEQ ID NO: 879825

SEQ ID NO: 879827 - protein, 151 aa, Homo sapiens
IQDEEKHQKLPTFLHFLQQGSRVRHGTTHPEDVIFRSSGHSLLHGLVQLLLSGEISRDGPSDLRPDVMQCAQASLESKGRMVRTTLPFLQAPQPATASGQDLSLQGPGILHPASRPSGREKLVWLGTGLGMRALPSTFQERSFFGLVLDLG

SEQ ID NO: 879828 - protein, 149 aa, Homo sapiens
DVGVGAGGRVAARGEGGVHQLLVGWRLSVALAAARLVDVQRALSGEGLGEGAPAVALVVADVVAEQATGPLLKMSSSEAADTASFMALSSSSSAVRSPEMARRISGPMSCSVRKPACRDSAFLWEGLPTRPCSLRFLNFRKYSWIRNVA

SEQ ID NO: 879829 - protein, 413 aa, Homo sapiens
MENMLLWLIFFTPGWTLIDGSEMEWDFMWHLRKVPRIVSERTFHLTSPAFEADAKMMVNTVCGIECQKELPTPSLSELEDYLSYETVFENGTRTLTRVKVQDLVLEPTQNITTKGVSVRRKRQVYGTDSRFSILDKRFLTNFPFSTAVKLSTGCSGILISPQHVLTAAHCVHDGKDYVKGSKKLRVGLLKMRNKSGGKKRRGSKRSRREASGGDQREGTREHLQERAKGGRRRKKSGRGQRIAEGRPSFQWTRVKNTHIPKGWARGGMGDATLDYDYALLELKRAHKKKYMELGISPTIKKMPGGMIHFSGFDNDRADQLVYRFCSVSDESNDLLYQYCDAESGSTGSGVYLRLKDPDKKNWKRKIIAVYSGHQWVDVHGVQKDYNVAVRITPLKYAQICLWIHGNDANCAYG

SEQ ID NO: 879830 - protein, 107 aa, Homo sapiens
MDSLTSAKLTLKEADPSSKVAIRRKDSPPPGKVSSQKQPAEKAASDEKDSVSNIATEIKEGPISGTVSSQKQPAEKAASDEKDSVSNIATEIKDGQQSGRHNFAKQI

SEQ ID NO: 879831 - protein, 107 aa, Homo sapiens; identical to SEQ ID NO: 879830

SEQ ID NO: 879832 - protein, 484 aa, Homo sapiens
MPKKEKMAKTPLSDEKQLLLFQQKLLAEEEMAKKKERLLSQFLKDKLAKEEHNSALNLNKINTQWRTVLREVKTRELHKDIEILSQTFERVVDCKDNVIKSLAKDLSEAEEQYAHALRSHLHNVDQLLALQRHRLSLLEESYNMELEALTKEFETERKTIIDQHEKEIHYLQDIFMAMEQNYIDSEYESKLEFQSMWNDLKNMNLEEKHFLRLHLENRVEDLWRKFQDVLKNYTDATEDRKAAFETLQVKDEKSSKEIEVQMKKIQKLQDAITISKGKIMIHSRESEDENRYIRNDKELVLVQLRKLKAQRTQARAASQKNLVRLTLESNATLKALRKIVDKGEKILKLAEICRKFETEEEKVLPFYSSVLTPKEQEGIQKNNLEELTEELTKVMVDYIGMENFWKRYNKVKLEQLSLQHRRAQLLDINGKLREMLKQYLDGISVSDEVLSQLNPLFIVNYQSNLLQPLSIRIAHPGDKQHPTT

SEQ ID NO: 879833 - protein, 484 aa, Homo sapiens; identical to SEQ ID NO: 879832

SEQ ID NO: 879834 - protein, 445 aa, Homo sapiens
MPKKEKMAKTPLSDEKQLLLFQQKLLAEEEMAKKKERLLSQFLKDKLAKEEHNSALNLNKINTQWRTVLREVKTRELHKDIEILSQTFERVVDCKDNVIKSLAKDLSEAEEQYAHALRSHLHNVDQLLALQRHRLSLLEESYNMELEALTKEFETERKTIIDQHEKEIHYLQDIFMAMEQNYIDSEYESKLEFQSMWNDLKNMNLEEKHFLRLHLENRVEDLWRKFQDVLKNYTDATEDRKAAFETLQVKDEKSSKEIEVQMKKIQKLQDAITISKGKIMIHSRESEDENRYIRNDKELVLVQLRKLKAQRTQARAASQKNLVRLTLESNATLKALRKIVDKGEKILKLAEICRKFETEEEKVLPFYSSVLTPKEQEGIQKNNLEELTEELTKVMVDYIGMENFWKRYNKVKLEQLSLQHRRAQLLDINGKLREMLKQYLDGISG

SEQ ID NO: 879835 - protein, 172 aa, Homo sapiens
MGGSHYVAQASLELPGSCNPPTLATQSVGITNASHLAQPLPSLLLYTRVRGTASILKVKELALGTKKKLPAEYIFIFSQRCYSAGMVTLSFWPESLAKDLSEAEEQYAHALRSHLHNVDQLLALQRHRLSLLEESYNMELEALTKEFETERYGGLREDGELNPGECPESVSR

SEQ ID NO: 879836 - protein, 64 aa, Homo sapiens
MPSCSQGRRAEVRLTVGCRFFCLFFVFAMESHSVARLECSGMILAHCRTSTSQVQAILLPQPPK

SEQ ID NO: 879837 - protein, 79 aa, Homo sapiens
RLLARDRAPEEAGCACGTVVRGRKITYLKRRSIPENRGRPVFCVPGCGVPGHGVEGAERRDLRASSSGDGALCDCTASA

SEQ ID NO: 879838 - protein, 129 aa, Homo sapiens
MSGGRFDFDDGGAYCGGWEGGKAHGHGLCTGPKGQGEYSGSWNFGFEVAGVYTWPSGNTFEGYWSQGKRHGLGIETKGRWLYKGEWTHGFKGRYGIRQSSSSGAKYEGTWNNGLQDGYGTETYADGGMC

SEQ ID NO: 879839 - protein, 211 aa, Homo sapiens
MSGGRFDFDDGGAYCGGWEGGKAHGHGLCTGPKGQGEYSGSWNFGFEVAGVYTWPSGNTFEGYWSQGKRHGLGIETKGRWLYKGEWTHGFKGRYGIRQSSSSGAKYEGTWNNGLQDGYGTETYADGGTYQGQFTNGMRHGYGVRQSVPYGMAVVVRSPLRTSLSSLRSEHSNGTVAPDSPASPASDGPALPSPAIPRGGFALSLLANAEAA

SEQ ID NO: 879840 - protein, 67 aa, Homo sapiens
GYEEAASCLPACGPTRQRKISKGEFLQGLITRKKAISSASSKAVWKLLSSCHHNKPLETCIYFVTDY

SEQ ID NO: 879841 - protein, 295 aa, Homo sapiens
WLASACSARAWSWELGPRSGPEMAAADGALPEAAALEQPAELPASVRASIERKRQRALMLRQARLAARPYSATAAAATGGMANVKAAPKIIDTGGGFILEEEEEEEQKIGKVVHQPGPVMEFDYVICEECGKEFMDSYLMNHFDLPTCDNCRDADDKHKLITKTEAKQEYLLKDCDLEKREPPLKFIVKKNPHHSQWGDMKLYLKLQIVKRSLEVWGSQEALEEAKEVRQENREKMKQKKFDKKVKELRRAVRSSVWKRETIVHQHEYGPEENLEDDMYRKTCTMCGHELTYEKM

SEQ ID NO: 879842 - protein, 286 aa, Homo sapiens
WLASACSARAWSWELGPRSGPEMAAADGALPEAAALEQPAELPASVRASIERKRQRALMLRQARLAARPYSATAAAATGGMANVKAAPKIIDTGGGFILEEEEEEEQKIGKVVHQPGPVMEFDYVICEECGKEFMDSYLMNHFDLPTCDNCRDADDKHKLITKTEAKQEYLLKDCDLEKREPPLKFIVKKNPHHSQWGDMKLYLKLQIVKRSLEVWGSQEALEEAKEVRQENREKMKQKKFDKKVKEVVPAFLNRPQRAETGVDTVEIRHKELTVQFSQKAQNREE

SEQ ID NO: 879843 - protein, 90 aa, Homo sapiens
ARLGVQCACVELGARSSEWAGDGGGRRGFAGGGGFRATRGAACLGMANVKAAPKIIDTGGGFILEEEEEEEQKIGKVVHQPEMLMINTSL

SEQ ID NO: 879844 - protein, 284 aa, Homo sapiens
WLASACSARAWSWELGPRSGPEMAAADGALPEAAALEQPAELPASVRASIERKRQRALMLRQARLAARPYSATAAAATGGMANVKAAPKIIDTGGGFILEEEEEEEQKIGKVVHQPGPVMEFDYVICEECGKEFMDSYLMNHFDLPTCDNCRDADDKHKLITKTEAKQEYLLKDCDLEKREPPLKFIVKKNPHHSQWGDMKLYLKLQIVKRSLEVWGSQEALEEAKEVRQENREKMKQKKFDKKVKELRRAVRSSVWKRETIVHQHEYGPEENLEDDMYPLKYQ

SEQ ID NO: 879845 - protein, 222 aa, Homo sapiens
WLASACSARAWSWELGPRSGPEMAAADGALPEAAALEQPAELPASVRASIERKRQRALMLRQARLAARPYSATAAAATGGMANVKAAPKIIDTGGGFILEEEEEEEQKIGKVVHQPGPVMEFDYVICEECGKEFMDSYLMNHFDLPTCDNCRDADDKHKLITKTEAKQEYLLKDCDLEKREPPLKFIVKKNPHHSQWGDMKLYLKLQVSNKLYLLFFTLVNS

SEQ ID NO: 879846 - protein, 84 aa, Homo sapiens
SFKALQKSRNKTTLHPILPPALRAHLRRARVTAIWGKEMGSLVLPATRPAAAPQPSVPTTMMLKSKPVFMVFLRICSMMVSMPM

SEQ ID NO: 879847 - protein, 108 aa, Homo sapiens
GREAKVVTMVTATHSETSTSDGQATYNRSQSRKRVRHRGRTWRVGPGRAGRLDRELVAFTLAARRPRRPLPDPGRGSQLPALAQRAELEFPEASAAAFLLLHSCFPHK

SEQ ID NO: 879848 - protein, 116 aa, Homo sapiens
WRARRADLTRRKGLRRGEPGSRGLGEGPAAARRPQVQSIDTTPSGEGAPSFSRAQRPGRSGPSPSLASDPAPGRGAAWGSLRPGKRQQALESEAGGRASREARAAEVRERIPGGGS

SEQ ID NO: 879849 - protein, 129 aa, Homo sapiens
WRARRADLTRRKGLRRGEPGSRGLGEGPAAARRPQVQSIDTTPSGEGAPSFSRAQRPGRSGPSPSLASDPAPGRGAAWGSLRPGKRQQALESEAGGRASREARAAEVRERIPGGGSCCHAGSHRPLSRS

SEQ ID NO: 879850 - protein, 73 aa, Homo sapiens
RLHRKTRKEPGVLRRPGPRPELSSGREERILGARKRCPGRRDWLTPPCAGSSSQLTEPSVIQQPSISAPNMPN

SEQ ID NO: 879851 - protein, 78 aa, Homo sapiens
APGSKVSATSTCPGVVSEGLMLPRAAEPIPRKTGHGQHAQRCPGRRDWLTPPCAGSSSQLTEPSVIQQPSISAPNMPN

SEQ ID NO: 879852 - protein, 78 aa, Homo sapiens; identical to SEQ ID NO: 879851

SEQ ID NO: 879853 - protein, 125 aa, Homo sapiens
PGPLRVRPRWVCQACTWAADAQEAEPSLPRLCVHLSAPCLTLRSRERDFSLAASHPEENISSQQNIRPSSPASWATAVTLIGDPFPSPLPRLLQTECIQGVTSQVKTCCDTITLQHRPQSQASHS

SEQ ID NO: 879854 - protein, 223 aa, Homo sapiens
RLPLSPPQYGSGLVLRLRQLGVQAMGQPWAAGSTDGAPAQLPLVLTALWAAAVGLELAYVLVLGPGPPPLGPLARALQLALAAFQLLNLLGNVGLFLRSDPSIRGVMLAGRGLGQGWAYCYQCQSQVPPRSGHCSACRVCILRRDHHCRLLGRCVGFGNYRPFLCLLLHAAGVLLHVSVLLGPALSALLRAHTPLHMAALLLLPWLMLLTAPSSLRNSDLQAT

SEQ ID NO: 879855 - protein, 307 aa, Homo sapiens
RLPLSPPQYGSGLVLRLRQLGVQAMGQPWAAGSTDGAPAQLPLVLTALWAAAVGLELAYVLVLGPGPPPLGPLARALQLALAAFQLLNLLGNVGLFLRSDPSIRGVMLAGRGLGQGWAYCYQCQSQVPPRSGHCSACRVCILRRDHHCRLLGRCVGFGNYRPFLCLLLHAAGVLLHVSVLLGPALSALLRAHTPLHMAALLLLPWLMLLTGRVSLAQFALAFVTDTCVAGALLCGAGLLFHGMLLLRGQTTWEWARGQHSYDLGPCHNLQAALGPAGPRLALAFLASPLPGDGITFQTTADVGHTAS

SEQ ID NO: 879856 - protein, 51 aa, Homo sapiens
MGMGNPRGEGIWKRDPYLQATPGEGASSHRTGPPVLVGPPHWATKAFPGGT

SEQ ID NO: 879857 - protein, 67 aa, Homo sapiens
WLYTEEQAQRLPEGPACGQGDADIHLWDPPGAIQLQCASAEPDLEPNRQHGLEEALEGKSERRGFPP

SEQ ID NO: 879858 - protein, 80 aa, Homo sapiens
HGPKRQHSTTPPNEGGTGSAPQDIQAPWLLQLDALSTSQQESRVRAFEHIQCEHAFSKHFLSPALCQAVLSAQDTQGRNK

SEQ ID NO: 879859 - protein, 291 aa, Homo sapiens
DYLKTLTERLARLRRARRALRRRNSIKKMAALTPRKRKQDSLKCDSLLHFTENLFPSPNKKHCFYQNSDKNEENLHCSQQEHFVLSALKTTEINRLPSANQGSPFKSALSTVSFYNQNKWYLNPLERKLIKESRSTCLKTNDEDKSFPIVTEKMQGKPVCSKKNNKKPQKSLTAKYQPKYRHIKPVSRNSRNSKQNRVIYKPIVEKENNCHSAENNSNAPRVLSQKIKPQVTLQGGAAFFVRKKSSLRKSSLENEPSLGRTQKSKSEVIEDSDVETVSEKKTFATRQVPKC

SEQ ID NO: 879860 - protein, 101 aa, Homo sapiens
SSQLTVNQGEFRRYPFPYMSLQTPSIQCRVGIGPISQNRKPKGFTGWFIESGSEGLCFLFLVRPLHSSFTRNQAVFWDFGSPPLPALWRGWTGYFIFFPRF

SEQ ID NO: 879861 - protein, 723 aa, Homo sapiens
MSLLKERKPKKPHYIPRPPGKPFKYKCFQCPFTCNEKSHLFNHMKYGLCKNSITLVSEQDRVPKCPKSNSLDPKQTNQPDATAKPASSKSVANGLSAFDSKLQHSSAREDIKENLELQARGTHRCLGQKPALHRASPCKSPAPEAALGAQPALEGAARPSAFVPVGEHRLKGPDNAEAPETLALHNPTAKAVSFHTKSAFHTPGYPWKAGSPFLPPEFPHKISSTKGLGAISPYMHPTIPEYPPHFYTEHGLATIYSPYLLAGSSPECDAPLLSVYGTQDPRHFLPHPGPIPKHLAPSPATYDHYRFFQQYPSNLPIPYGFYRPESAFSSYGLRLPPVTGLTRDQSSHLLEEATLVYPASSPSRLNPSDPNRKHVEFESPIPEAKDSSKAGQRDTEGSKMSPRAGSAATGSPGRPSPTDFMQTSQTCEGLYDLSNKAASSALGRLYPPEQSLTAFRPVKKSTECLPAQAAETTAESPVSLNVVNGDPPAPTGSASLVSEAAPSSPDDSSGMGPLNLSKKSEINLAATHEPTYQGSPQAETASFSELQDLPLNLSVKDPCNTQAPRPAFPGRPRAAEPAAAVPQKTGTEGSEDGPSHPETKPGSLDGDGAPPTGPGEEAPDACAVDSSEEQKQTAAVALCQLAAYSPRNIRVGDGDAAAPEPACRQDTPTLSSMESQEAQCDLRPKGQKRTSLRDAGKSQQGAKKAKLQDTARVFTLRRRARVS

SEQ ID NO: 879862 - protein, 66 aa, Homo sapiens
WVAERQLAAREWVRRTAAAPRDEYRDGGFRRVEEWLYHFTSLPAMYGVIQFLSILASIWCYQCFSF

SEQ ID NO: 879863 - protein, 112 aa, Homo sapiens
AEVKEPCSLPMLSVDMENKENGSVGVKNSMENGRPPDPADWAVMDVVNYFRTVGFEEQASAFQEQEIDGKSLLLMTRNDVLTGLQLKLGPALKIYEYHVKPLQTKHLKNNSS

SEQ ID NO: 879864 - protein, 92 aa, Homo sapiens
AEVKEPCSLPMLSVDMENKENGSVGVKNSMENGRPPDPADWAVMDVVNYFRTVGFEEQASAFQEQDKVTDRDKYLECTPIESWSGQIKGLLL

SEQ ID NO: 879865 - protein, 107 aa, Homo sapiens
LRTKVSKQEWLLQSTAEHLKIDNQQKESMEQFIVSQLTRTHDVLKNARTNLELRKLLHQSEAPSLSPTHHHLLADLVGDAWPAFAFQEKISSPLVKSLRALPCTPAL

SEQ ID NO: 879866 - protein, 107 aa, Homo sapiens; identical to SEQ ID NO: 879865

SEQ ID NO: 879867 - protein, 73 aa, Homo sapiens
TTTKFAAASQRSNPGLGFLVTNPHPEAGQGLPAINQSLACKKTYFGDSKDFRNSMAENGDEHQIEGRAQWRRL

SEQ ID NO: 879868 - protein, 121 aa, Homo sapiens
MQGSATWGKRHWYATSARTTRKDDSFPNSKPQQKRPQQSRLLSLIPTSPCGQRVGLFWPELMGFHISPAGQNASLLTARHRLGTRETQLAPQGRADTEPGEGCGGPHCMSLQGEGTPCVGC

SEQ ID NO: 879869 - protein, 177 aa, Homo sapiens
FPAPAPDPAAAEMLMPKKNRIAIYELLFKEGVMVAKKDVHMPKHPELADKNVPNLHVMKAMQSLKSRGYVKEQFAWRHFYWYLTNEGIQYLRDYLHLPPEIVPATLRRSRPETGRPRPKGLEGERPARLTRGEADRDTYRRSAVPPGADKKAEAGAGSATEFQFRGGFGRGRGQPPQ

SEQ ID NO: 879870 - protein, 229 aa, Homo sapiens
MDLLQFLAFLFVLLLSGMGATGTLRTSLDPSLEIYKKMFEVKRREQLLALKNLAQLNDIHQQYKILDVMLKGLFKVLEDSRTVLTAADVLPDGPFPQDEKLKDAFSHVVENTAFFGDVVLRFPRIVHYYFDHNSNWNLLIRWGISFCNQTGVFNQGPHSPILSLMAQELGISEKDSNFQNPFKIDRTEFIPSTDPFQKALREEEKRRKKEEKRKEIRKGPRISRSQSEL

SEQ ID NO: 879871 - protein, 229 aa, Homo sapiens; identical to SEQ ID NO: 879870

SEQ ID NO: 879872 - protein, 229 aa, Homo sapiens; identical to SEQ ID NO: 879870

SEQ ID NO: 879873 - protein, 122 aa, Homo sapiens
RWDQPWGQRHWADCDGVSEMGQGQWAGVWVHGHVGRVPSPSPWSPFSLRSPPSRASPCHTLERAEACGCVSTVFWKYYYGHYLDDYHTKRTSSLVSLSGLGASLNASLHTALNATSAQGGWD

SEQ ID NO: 879874 - protein, 891 aa, Homo sapiens
MSQVGGRGDRCTQEVQGLVHGAGDLSASLAENSPTMSQNGYFEDSSYYKCDTDDTFEAREEILGDEAFDTANSSIVSGESIRFFVNVNLEMQATNTENEATSGGCVLLHTSRKYLKLKNFKEEIRAHRDLDGFLAQASIVLNETATSLDNVLRTMLRRFARDPDNNEPNCNLDLLMAMLFTDAGAPMRGKVHLLSDTIQGVTATVTGVRYQQSWLCIICTMKALQKRHVCISRLVRPQNWGENSCEVRFVILVLAPPKMKSTKTAMEVARTFATMFSDIAFRQKLLETRTEEEFKEALVHQRQLLTMVSHGPVAPRTKERSTVSLPAHRHPEPPKCKDFVPFGKGIREDIARRFPLYPLDFTDGIIGKNKAVGKYITTTLFLYFACLLPTIAFGSLNDENTDGAIDVQKTIAGQSIGGLLYALFSGQPLVILLTTAPLALYIQVIRVICDDYDLDFNSFYAWTGLWNSFFLALYAFFNLSLVMSLFKRSTEEIIALFISITFVLDAVKGTVKIFWKYYYGHYLDDYHTKRTSSLVSLSGLGASLNASLHTALNASFLASPTELPSATHSGQATAVLSLLIMLGTLWLGYTLYQFKKSPYLHPCVREILSDCALPIAVLAFSLISSHGFREIEMSKFRYNPSESPFAMAQIQSLSLRAVSGAMGLGFLLSMLFFIEQNLVAALVNAPENRLVKGTAYHWDLLLLAIINTGLSLFGLPWIHAAYPHSPLHVRALALVEERVENGHIYDTIVNVKETRLTSLGASVLVGLSLLLLPVPLQWIPKPVLYGLFLYIALTSLDGNQLVQRVALLLKEQTAYPPTHYIRRVPQRKIHYFTGLQVLQLLLLCAFGMSSLPYMKMIFPLIMIAMIPIRYILLPRIIEAKYLDVMDAEHRP

SEQ ID NO: 879875 - protein, 199 aa, Homo sapiens
RRVWGPEAPERRVRSPAVSARVCHGRGHQARVPSAAVRWVPEPGGAAGRPPGSPPPSPVGDPGENADAVCLRGPGPVGERAAGFPAAGRRARVREARGGFAATARLVSLGLCCRRLEFLTRFEQLMQRVEGGELESGQGGAVGLPAPRAPSFWEPGGPPPRKVSFYLPPGHLPVRRRGGSPGTPGVLGVPGPLTVPCAA

SEQ ID NO: 879876 - protein, 875 aa, Homo sapiens
MAAATRRVFHLQPCENSPTMSQNGYFEDSSYYKCDTDDTFEAREEILGDEAFDTANSSIVSGESIRFFVNVNLEMQATNTENEATSGGCVLLHTSRKYLKLKNFKEEIRAHRDLDGFLAQASIVLNETATSLDNVLRTMLRRFARDPDNNEPNCNLDLLMAMLFTDAGAPMRGKVHLLSDTIQGVTATVTGVRYQQSWLCIICTMKALQKRHVCISRLVRPQNWGENSCEVRFVILVLAPPKMKSTKTAMEVARTFATMFSDIAFRQKLLETRTEEEFKEALVHQRQLLTMVSHGPVAPRTKERSTVSLPAHRHPEPPKCKDFVPFGKGIREDIARRFPLYPLDFTDGIIGKNKAVGKYITTTLFLYFACLLPTIAFGSLNDENTDGAIDVQKTIAGQSIGGLLYALFSGQPLVILLTTAPLALYIQVIRVICDDYDLDFNSFYAWTGLWNSFFLALYAFFNLSLVMSLFKRSTEEIIALFISITFVLDAVKGTVKIFWKYYYGHYLDDYHTKRTSSLVSLSGLGASLNASLHTALNASFLASPTELPSATHSGQATAVLSLLIMLGTLWLGYTLYQFKKSPYLHPCVREILSDCALPIAVLAFSLISSHGFREIEMSKFRYNPSESPFAMAQIQSLSLRAVSGAMGLGFLLSMLFFIEQNLVAALVNAPENRLVKGTAYHWDLLLLAIINTGLSLFGLPWIHAAYPHSPLHVRALALVEERVENGHIYDTIVNVKETRLTSLGASVLVGLSLLLLPVPLQWIPKPVLYGLFLYIALTSLDGNQLVQRVALLLKEQTAYPPTHYIRRVPQRKIHYFTGLQVLQLLLLCAFGMSSLPYMKMIFPLIMIAMIPIRYILLPRIIEAKYLDVMDAEHRP

SEQ ID NO: 879877 - protein, 952 aa, Homo sapiens
LPGGRDAVPGLETVACRPPCDPGRVTGVGGTAPAMGVYGPQDRSESEKRDVQRDPPPWHPRREGERPARARSLPLAAAGQGFLRKTWISEHENSPTMSQNGYFEDSSYYKCDTDDTFEAREEILGDEAFDTANSSIVSGESIRFFVNVNLEMQATNTENEATSGGCVLLHTSRKYLKLKNFKEEIRAHRDLDGFLAQASIVLNETATSLDNVLRTMLRRFARDPDNNEPNCNLDLLMAMLFTDAGAPMRGKVHLLSDTIQGVTATVTGVRYQQSWLCIICTMKALQKRHVCISRLVRPQNWGENSCEVRFVILVLAPPKMKSTKTAMEVARTFATMFSDIAFRQKLLETRTEEEFKEALVHQRQLLTMVSHGPVAPRTKERSTVSLPAHRHPEPPKCKDFVPFGKGIREDIARRFPLYPLDFTDGIIGKNKAVGKYITTTLFLYFACLLPTIAFGSLNDENTDGAIDVQKTIAGQSIGGLLYALFSGQPLVILLTTAPLALYIQVIRVICDDYDLDFNSFYAWTGLWNSFFLALYAFFNLSLVMSLFKRSTEEIIALFISITFVLDAVKGTVKIFWKYYYGHYLDDYHTKRTSSLVSLSGLGASLNASLHTALNASFLASPTELPSATHSGQATAVLSLLIMLGTLWLGYTLYQFKKSPYLHPCVREILSDCALPIAVLAFSLISSHGFREIEMSKFRYNPSESPFAMAQIQSLSLRAVSGAMGLGFLLSMLFFIEQNLVAALVNAPENRLVKGTAYHWDLLLLAIINTGLSLFGLPWIHAAYPHSPLHVRALALVEERVENGHIYDTIVNVKETRLTSLGASVLVGLSLLLLPVPLQWIPKPVLYGLFLYIALTSLDGNQLVQRVALLLKEQTAYPPTHYIRRVPQRKIHYFTGLQVLQLLLLCAFGMSSLPYMKMIFPLIMIAMIPIRYILLPRIIEAKYLDVMDAEHRP

SEQ ID NO: 879878 - protein, 398 aa, Homo sapiens
GDPLPQLQWSHGPGPLPLGALAQGGTLSIPSVQARDSGYYNCTATNNVGNPAKKTVNLLVRSMKNATFQITPDVIKESENIQLGQDLKLSCHVDAVPQEKVTYQWFKNGKPARMSKRLLVTRNDPELPAVTSSLELIDLHFSDYGTYLCMASFPGAPVPDLSVEVNISSETVPPTISVPKGRAVVTVREGSPAELQCEVRGKPRPPVLWSRVDKEAALLPSGLPLEETPDGKLRLERVSRDMSGTYRCQTARYNGFNVRPREAQVQLNVQFPPEVEPSSQDVRQALGRPVLLRCSLLRGSPQRIASAVWRFKGQLLPPPPVVPAAAEAPDHAELRLDAVTRDSSGSYECSVSNDVGSAACLFQVSAKAYSPEFYFDTPNPTRSHKLSKNYSYVLQWTQ

SEQ ID NO: 879879 - protein, 321 aa, Homo sapiens
GDPLPQLQWSHGPGPLPLGALAQGGTLSIPSVQARDSGYYNCTATNNVGNPAKKTVNLLVRSMKNATFQITPDVIKESENIQLGQDLKLSCHVDAVPQEKVTYQWFKNGKPARMSKRLLVTRNDPELPAVTSSLELIDLHFSDYGTYLCMASFPGAPVPDLSVEVNISSETVPPTISVPKGRAVVTVREGSPAELQCEVRGKPRPPVLWSRVDKEAALLPSGLPLEETPDGKLRLERVSRDMSGTYRCQTARYNGFNVRPREAQVQLNVQCESTTPPGLPSQLSFWLPAGLSPLHPLTHPSPTKPHQLLLIPLMLLDSPML

SEQ ID NO: 879880 - protein, 322 aa, Homo sapiens
NKYGVNEAKALGCFKNFGARKGEKVTYQWFKNGKPARMSKRLLVTRNDPELPAVTSSLELIDLHFSDYGTYLCMASFPGAPVPDLSVEVNISSETVPPTISVPKGRAVVTVREGSPAELQCEVRGKPRPPVLWSRVDKEAALLPSGLPLEETPDGKLRLERVSRDMSGTYRCQTARYNGFNVRPREAQVQLNVQFPPEVEPSSQDVRQALGRPVLLRCSLLRGSPQRIASAVWRFKGQLLPPPPVVPAAAEAPDHAELRLDAVTRDSSGSYECSVSNDVGSAACLFQVSAKAYSPEFYFDTPNPTRSHKLSKNYSYVLQWTQ

SEQ ID NO: 879881 - protein, 129 aa, Homo sapiens
CSSTLNITQSQIHFLSPDSFVNNSHGANNELELVTCLSSDMFMKDNSQPVHLESTIAHEIYQKILSPDSFIKDNYGLNQDLESESVNPILSPNQFLKDNMAYMCTSQQTCKVPLSNENSQVPQSPEDWR

SEQ ID NO: 879882 - protein, 114 aa, Homo sapiens
MPWERQTHPSVHITGSSSTLSQQIYNRLKNNENILTTHYELTGGQGTGTLASAGAVRMEMWKCVPLQENRSFHEQCLWVKDDKASHQLPPPQALMAVGRLCHSASSWMTTPIPA

SEQ ID NO: 879883 - protein, 67 aa, Homo sapiens
LSLSGCKRAQQEEPPAEASNHTLGVEGCLTLAFLAWAACSLTWYTSCFPCVFPAIFRCAGDYCRKGW

SEQ ID NO: 879884 - protein, 38 aa, Homo sapiens
KTQQIRMEATQHHTETDMSPAFLNALKEKPASWEGRVS

SEQ ID NO: 879885 - protein, 115 aa, Homo sapiens
RPRLTERSPDSELLCRPFSCPCLEEAYQVDQALLPPVDEKGRWPRVGVEEEDWMPMILISLCHQGWSAAAEFQLTATSTCWVQGISQVAGTTGAHHHAWLIFCRDGVLPCCPGWS

SEQ ID NO: 879886 - protein, 68 aa, Homo sapiens
IKGEARTHLRGMQSRYHHALRSFGEDCNFNFSFVLPAFLMCNELTTCNVITIAKLKMNDLAQRGGSCL

SEQ ID NO: 879887 - protein, 259 aa, Homo sapiens
KLLWLRRRKNYKRNKRNYKMYGQSLRTFNSSKQVMPNSPSTQLEASQLQQTPCTQQPNNVLNTHIMQTVQSTVASPSKQLNENQLVRKQDVLGPSTTPPAHSSSNTIRSGISPNLNVVDGRLTYPTCGIGYPVSSAFAFQNTFPHSISAKNTSHPGSGTKVQFNLQFTKPNASLGDVQSGATISMPCSTDKENGENVGLESKYLKKREDSIPLRGLSQNLFSNSDHQRDGTLGALHTSSKPTALPSASSAYFPGQLPNS

SEQ ID NO: 879888 - protein, 161 aa, Homo sapiens
KLLWLRRRKNYKRNKRNYKMYGQSLRTFNSSKQVMPNSPSTQLEASQLQQTPCTQQPNNVLNTHIMQTVQSTVASPSKQLNENQLVRKQDVLGPSTTPPAHSSSNTIRSGISPNLNVVDGRLTYPTCGIGYPVSSAFAFQNTFPHSISAKNTSHPGSGTKW

SEQ ID NO: 879889 - protein, 161 aa, Homo sapiens; identical to SEQ ID NO: 879888

SEQ ID NO: 879890 - protein, 161 aa, Homo sapiens; identical to SEQ ID NO: 879888

SEQ ID NO: 879891 - protein, 102 aa, Homo sapiens
MAAASKLMGSGSIWSLGQAILAVSESIVSSSSSSSSPAEFSQSSCGRWHAASFRHTNRPSSLFRSWVCRKLKQESSRLCMRRNSAQRMTSRMFSLLSNSLAV

SEQ ID NO: 879892 - protein, 97 aa, Homo sapiens
QRARESFTWLAVLIMVAWGWEEVPFLSHRNRPHPVGVLEGCENPEETLTQPAGRRLPLEAALKDDSSRWKNQEGPSHVEAPAGANVPGVFRQRATGE

SEQ ID NO: 879893 - protein, 192 aa, Homo sapiens
MAEQQGRELEAECPVCWNPFNNTFHTPKMLDCCHSFCVECLAHLSLVTPARRRLLCPLCRQPTVLASGQPVTDLPTDTAMLALLRLEPHHVILEGHQLCLKDQPKSRYFLRQPQVYTLDLGPQPGGQTGPPPDTASATVSTPILIPSHHSLRECFRNPQFRIFAYLMAVILSVTLLLIFSIFWTKQFLWGVG

SEQ ID NO: 879894 - protein, 227 aa, Homo sapiens
EGEEALEGLIWGLGQGSFCKASRTSPARPPRVWLRMAEQQGRELEAECPVCWNPFNNTFHTPKMLDCCHSFCVECLAHLSLVTPARRRLLCPLCRQPTVLASGQPVTDLPTDTAMLALLRLEPHHVILEGHQLCLKDQPKSRYFLRQPQVYTLDLGPQPGGQTGPPPDTASATVSTPILIPSHHSLRECFRNPQFRIFAYLMAVILSVTLLLIFSIFWTKQFLWGVG

SEQ ID NO: 879895 - protein, 315 aa, Homo sapiens
PRPRLRTGHADGAMAAAAAETPEVLRECGCKGIRTCLICERQRGSDPPWELPPAKTYRFIYCSDTGWAVGTEESDFEGWAFPFPGVMLIEDFVTREEEAELVRLMDRDPWKLSQSGRRKQDYGPKVNFRKQKLKTEGFCGLPSFSREVVRRMGLYPGLEGFRPVEQCNLDYCPERGSAIDPHLDDAWLWGERLVSLNLLSPTVLSMCREAPGSLLLCSAPSAAPEALVDSVIAPSRSVLCQEVEVAIPLPARSLLVLTGAARHQWKHAIHRRHIEARRVCVTFRELSAEFGPGGRQQELGQELLRIALSFQGRPV

SEQ ID NO: 879896 - protein, 229 aa, Homo sapiens
MLIEDFVTREEEAELVRLMDRDPWKLSQSGRRKQDYGPKVNFRKQKLKTEGFCGLPSFSREVVRRMGLYPGLEGFRPVEQCNLDYCPERGSAIDPHLDDAWLWGERLVSLNLLSPTVLSMCREAPGSLLLCSAPSAAPEALVDSVIAPSRSVLCQEVEVAIPLPARSLLVLTGAARHQWKHAIHRRHIEARRVCVTFRELSAEFGPGGRQQELGQELLRIALSFQGRPV

SEQ ID NO: 879897 - protein, 315 aa, Homo sapiens; identical to SEQ ID NO: 879895

SEQ ID NO: 879898 - protein, 253 aa, Homo sapiens
PRPRLRTGHADGAMAAAAAETPEVLRECGCKGIRTCLICERQRGSDPPWELPPAKTYRFIYCSDTGWAVGTEESDFEGWAFPFPGVMLIEDFVTREEEAELVRLMDRDPWKLSQSGRRKQDYGPKVNFRKQKLKTEGFCGLPSFSREVVRRMGLYPGLEGFRPVEQCNLDYCPERGSAIDPHLDDAWLWGERLVSLNLLSPTVLSMCREAPGSLLLCSAPSAAPEALVDSVIAPSRSVLCQEVEDCLRPAWAT

SEQ ID NO: 879899 - protein, 253 aa, Homo sapiens
MHSWERLAVLVLLGAAACAAPPRGRILGGREAEAHARPYMASVQLNGAHLCGGVLVAEQWVLSAAHCLEDAADGKVQVLLGAHSLSQPEPSKRLYDVLRAVPHPDSQPDTIDHDLLLLQLSEKATLGPAVRPLPWQRVDRDVAPGTLCDVAGWGIVNHAGRRPDSLQHVLLPVLDRATCNRRTHHDGAITERLMCAESNRRDSCKGDSGGPLVCGGVLEGVVTSGSRVCGNRKKPGIYTRVASYAAWIDSVLA

SEQ ID NO: 879900 - protein, 116 aa, Homo sapiens
MHSWERLAVLVLLGAAACAAPPRGRILGGREAEAHARPYMASVQLNGAHLCGGVLVAEQWVLSAAHCLEDAADGKVQVLLGAHSLSQPEPSKRLYDVLRAVPHPDSQPDTIDSVLA

SEQ ID NO: 879901 - protein, 106 aa, Homo sapiens
ISHLSFQSLRTGEQGREKKGLGEVPPFHLSSFSAPFRRASSSGMLGQSIRRFTTSVVRRSHYEEGPGKNLPFSVENKWSLLAKMCLYFGSAFATPFLVVRHQLLKT

SEQ ID NO: 879902 - protein, 106 aa, Homo sapiens; identical to SEQ ID NO: 879901

SEQ ID NO: 879903 - protein, 107 aa, Homo sapiens
RPPTTTKFAAASTEQGREKKGLGEVPPFHLSSFSAPFRRASSSGMLGQSIRRFTTSVVRRSHYEEGPGKNLPFSVENKWSLLAKMCLYFGSAFATPFLVVRHQLLKT

SEQ ID NO: 879904 - protein, 107 aa, Homo sapiens
RGRRHGCERRRRGEQGREKKGLGEVPPFHLSSFSAPFRRASSSGMLGQSIRRFTTSVVRRSHYEEGPGKNLPFSVENKWSLLAKMCLYFGSAFATPFLVVRHQLLKT

SEQ ID NO: 879905 - protein, 106 aa, Homo sapiens; identical to SEQ ID NO: 879901

SEQ ID NO: 879906 - protein, 106 aa, Homo sapiens; identical to SEQ ID NO: 879901

SEQ ID NO: 879907 - protein, 106 aa, Homo sapiens; identical to SEQ ID NO: 879901

SEQ ID NO: 879908 - protein, 106 aa, Homo sapiens; identical to SEQ ID NO: 879901

SEQ ID NO: 879909 - protein, 104 aa, Homo sapiens
LVRLGLIGRGEQGREKKGLGEVPPFHLSSFSAPFRRASSSGMLGQSIRRFTTSVVRRSHYEEGPGKNLPFSVENKWSLLAKMCLYFGSAFATPFLVVRHQLLKT

SEQ ID NO: 879910 - protein, 106 aa, Homo sapiens; identical to SEQ ID NO: 879901

SEQ ID NO: 879911 - protein, 104 aa, Homo sapiens; identical to SEQ ID NO: 879909

SEQ ID NO: 879912 - protein, 107 aa, Homo sapiens; identical to SEQ ID NO: 879904

SEQ ID NO: 879913 - protein, 107 aa, Homo sapiens; identical to SEQ ID NO: 879903

SEQ ID NO: 879914 - protein, 106 aa, Homo sapiens; identical to SEQ ID NO: 879901

SEQ ID NO: 879915 - protein, 106 aa, Homo sapiens; identical to SEQ ID NO: 879901

SEQ ID NO: 879916 - protein, 106 aa, Homo sapiens; identical to SEQ ID NO: 879901

SEQ ID NO: 879917 - protein, 106 aa, Homo sapiens; identical to SEQ ID NO: 879901

SEQ ID NO: 879918 - protein, 30 aa, Homo sapiens
YKCRTMFLALIIQGCAKLTGIPALMELTVT

SEQ ID NO: 879919 - protein, 90 aa, Homo sapiens
AAAAAWDSLRAGFGSIPPPGVSLCALPFETRPRARPAVDQAARKPTVSGGAAREVARASRNTAAPGSRPARRAHSNPPRERCVALGASRV

SEQ ID NO: 879920 - protein, 131 aa, Homo sapiens
AAAAAWDSLRAGFGSIPPPGVSLCALPFETRPRARPAVDQAARKPTVSGGAAREVARASRNTAAPGSRPARRAHSNPPRERMKPAWKIPSLETEPDRGRCTGRTLSGFSNQAAILAPQVWDFWVFSWLASC

SEQ ID NO: 879921 - protein, 117 aa, Homo sapiens
MDCGEMGSFREAPKFPCHRISHNLWGSRTAVAFTSPAGGPWNKSQCRSQCRVSGHGKMSRVCDQKLSVFGLCSLVSALVEGGLGCARLVCDTLAGGSKPSLLTLLGRRQQAQATAYF

SEQ ID NO: 879922 - protein, 111 aa, Homo sapiens [sequence omitted]

SEQ ID NO: 879923 - protein, 642 aa, Homo sapiens
MDKLKCPSFFKCREKEKVSASSENFHVGENDENQDRGNWSKKSDYLLSMIGYAVGLGNVWRFPYLTYSNGGGAFLIPYAIMLALAGLPLFFLECSLGQFASLGPVSVWRILPLFQGVGITMVLISIFVTIYYNVIIAYSLYYMFASFQSELPWKNCSSWSDKNCSRSPIVTHCNVSTVNKGIQEIIQMNKSWVDINNFTCINGSEIYQPGQLPSEQYWNKVALQRSSGMNETGVIVWYLALCLLLAWLIVGAALFKGIKSSGKVVYFTALFPYVVLLILLVRGATLEGASKGISYYIGAQSNFTKLKEAEVWKDAATQIFYSLSVAWGGLVALSSYNKFKNNCFSDAIVVCLTNCLTSVFAGFAIFSILGHMAHISGKEVSQVVKSGFDLAFIAYPEALAQLPGGPFWSILFFFMLLTLGLDSQFASIETITTTIQDLFPKVMKKMRVPITLGCCLVLFLLGLVCVTQAGIYWVHLIDHFCAGWGILIAAILELVGIIWIYGGNRFIEDTEMMIGAKRWIFWLWWRACWFVITPILLIAIFIWSLVQFHRPNYGAIPYPDWGVALGWCMIVFCIIWIPIMAIIKIIQAKGNIFQRLISCCRPASNWGPYLEQHRGERYKDMVDPKKEADHEIPTVSGSRKPE

SEQ ID NO: 879924 - protein, 586 aa, Homo sapiens
MDKLKCPSFFKCREKEKVSASSENFHVGENDENQDRGNWSKKSDYLLSMIGYAVGLGNVWRFPYLTYSNGGGAFLIPYAIMLALAGLPLFFLECSLGQFASLGPVSVWRILPLFQGVGITMVLISIFVTIYYNVIIAYSLYYMFASFQSELPWKNCSSWSDKNCSRSPIVTHCNVSTVNKGIQEIIQMNKSWVDINNFTCINGSEIYQPGQLPSEQYWNKVALQRSSGMNETGVIVWYLALCLLLAWLIVGAALFKGIKSSGKVVYFTALFPYVVLLILLVRGATLEGASKGISYYIGAQSNFTKLKEAEVWKDAATQIFYSLSVAWGGLVALSSYNKFKNNCFSDAIVVCLTNCLTSVFAGFAIFSILGHMAHISGKEVSQVVKSGFDLAFIAYPEALAQLPGGPFWSILFFFMLLTLGLDSQFASIETITTTIQDLFPKVMKKMRVPITLGCCLVLFLLGLVCVTQAGIYWVHLIDHFCAGWGILIAAILELVGIIWIYGGNRFIEDTEMMIGAKRWIFWLWWRACWFVITPILLIRLISCCRPASNWGPYLEQHRGERYKDMVDPKKEADHEIPTVSGSRKPE

SEQ ID NO: 879925 - protein, 78 aa, Homo sapiens
MRRSRIQQCSAVIPVSVETLGLWRSRLGCWRCPSSPEIAVSHRICILFTRLNKKKYRPGALAYACNPSTLGGHGGWIT

SEQ ID NO: 879926 - protein, 183 aa, Homo sapiens
HAQVSHTAVQCRYSSLRRNAGTMAEPTGLLEMSELPGDSSVPQVGTASGVSDVLRGAVGGGVRVQEAREGPVAEAARSMARMPGPVPGPIPSSVPGLASAPDPHQQLAFLEINRQLLFREYLDGSSMIPVRLLRDFEERRRLFVEGCKAREAAFDADPPQMDFAAVAFTVALTASEALSPLAD

SEQ ID NO: 879927 - protein, 202 aa, Homo sapiens
LFMASLETNCNFISFPCRSYKDYKTSLCVDCDCFKEKSCPRLGYQAKLFKGVLKERMEGRPLRTTVFLDTSGTYPFCTYYFVLSIIVPDKTMMDGSFSFKLLNQLGMIEEPRLYEKNKPFYKLQEVKILAQFYNDFVNISSIGLTYFQSSNLQCSTCTYKIQSLMLKSLTYPERPPLCRYNIVLKDREEVFLNPNTCTPKNT

SEQ ID NO: 879928 - protein, 117 aa, Homo sapiens
MPSPGTVCSLLLLGMLWLDLAMAGSSFLSPEHQRVQQRKESKKPPAKLQPRALAGWLRPEDGGQAEGAEDELEVRFNAPFDVGIKLSGVQYQQHSQALGKFLQDILWEEAKEAPADK

SEQ ID NO: 879929 - protein, 105 aa, Homo sapiens
LGMLWLDLAMAGSSFLSPEHQRVQVRPPHKAPHVVPALPLSNQLCDLEQQRHLWASVFSQSTKDSGSDLTVSGRTWGLRVLNRLFPPSSRERSRRSHQPSCSPEL

SEQ ID NO: 879930 - protein, 220 aa, Homo sapiens
MELGLGGLSTLSHCPWPRRQPALWPTLAALALLSSVAEASLGSAPRSPAPREGPPPVLASPAGHLPGGRTARWCSGRARRPPPQPSRPAPPPPAPPSALPRGGRAARAGGPGSRARAAGARGCRLRSQLVPVRALGLGHRSDELVRFRFCSGSCRRARSPHDLSLASLLGAGALRPPPGSRPVSQPCCRPTRYEAVSFMDVNSTWRTVDRLSATACGCLG

SEQ ID NO: 879931 - protein, 220 aa, Homo sapiens; identical to SEQ ID NO: 879930

SEQ ID NO: 879932 - protein, 220 aa, Homo sapiens; identical to SEQ ID NO: 879930

SEQ ID NO: 879933 - protein, 237 aa, Homo sapiens
MPGLISARGQPLLEVLPPQAHLGALFLPEAPLGLSAQPALWPTLAALALLSSVAEASLGSAPRSPAPREGPPPVLASPAGHLPGGRTARWCSGRARRPPPQPSRPAPPPPAPPSALPRGGRAARAGGPGSRARAAGARGCRLRSQLVPVRALGLGHRSDELVRFRFCSGSCRRARSPHDLSLASLLGAGALRPPPGSRPVSQPCCRPTRYEAVSFMDVNSTWRTVDRLSATACGCLG

SEQ ID NO: 879934 - protein, 228 aa, Homo sapiens
MELGLGGLSTLSHCPWPRRQAPLGLSAQPALWPTLAALALLSSVAEASLGSAPRSPAPREGPPPVLASPAGHLPGGRTARWCSGRARRPPPQPSRPAPPPPAPPSALPRGGRAARAGGPGSRARAAGARGCRLRSQLVPVRALGLGHRSDELVRFRFCSGSCRRARSPHDLSLASLLGAGALRPPPGSRPVSQPCCRPTRYEAVSFMDVNSTWRTVDRLSATACGCLG

SEQ ID NO: 879935 - protein, 220 aa, Homo sapiens; identical to SEQ ID NO: 879930

SEQ ID NO: 879936 - protein, 228 aa, Homo sapiens; identical to SEQ ID NO: 879934

SEQ ID NO: 879937 - protein, 448 aa, Homo sapiens
MWNRPCQRLPQQPLVAEPTAEGEPHLPTGRELTEANRFAYAALCGISLSQLFPEPEHSSFCTEFMAGLVQWLELSEAVLPTMTAFASGLGGEGADVFVQILLKDPILKDDPTVITQDLLSFSLKDGHYDARARVLVCHMTSLLQVPLEELDVLEEMFLESLKEIKEEESEMAEASRKKKENRRKWKRYLLIGLATVGGGTVIGVTGGLAAPLVAAGAATIIGSAGAAALGSAAGIAIMTSLFGAAGAGLTGYKMKKRVGAIEEFTFLPLTEGRQLHITIAVTGWLASGKYRTFSAPWAALAHSREQYCLAWEAKYLMELGNALETILSGLANMVAQEALKYTVLSGIVAALTWPASLLSVANVIDNPWGVCLHRSAEVGKHLAHILLSRQQGRRPVTLIGFSLGARVIYFCLQEMAQEKDCQGIIVILPGAPVEGRAKHWESGSGVRE

SEQ ID NO: 879938 - protein, 448 aa, Homo sapiens; identical to SEQ ID NO: 879937

SEQ ID NO: 879939 - protein, 408 aa, Homo sapiens
MWNRPCQRLPQQPLVAEPTAEGEPHLPTGRELTEANRFAYAALCGISLSQLFPEPEHSSFCTEFMAGLVQWLELSEAVLPTMTAFASGLGGEGADVFVQILLKDPILKDDPTVITQDLLSFSLKDGHYDARARVLVCHMTSLLQVPLEELDVLEEMFLESLKEIKEEESEMAEASRKKKENRRKWKRYLLIGLATVGGGTVIGVTGGLAAPLVAAGAATIIGSAGAAALGSAAGIAIMTSLFGAAGAGLTGTFSAPWAALAHSREQYCLAWEAKYLMELGNALETILSGLANMVAQEALKYTVLSGIVAALTWPASLLSVANVIDNPWGVCLHRSAEVGKHLAHILLSRQQGRRPVTLIGFSLGARVIYFCLQEMAQEKDCQGIIVILPGAPVEGRAKHWESGSGVRE

SEQ ID NO: 879940 - protein, 408 aa, Homo sapiens
RLGRGRCNRPRIPEPDHSSFCTEFMAGLVQWLELSEAVLPTMTAFASGLGGEGADVFVQILLKDPILKDDPTVITQDLLSFSLKDGHYDARARVLVCHMTSLLQVPLEELDVLEEMFLESLKEIKEEESEMAEASRKKKENRRKWKRYLLIGLATVGGGTVIGVTGGLAAPLVAAGAATIIGSAGAAALGSAAGIAIMTSLFGAAGAGLTGYKMKKRVGAIEEFTFLPLTEGRQLHITIAVTGWLASGKYRTFSAPWAALAHSREQYCLAWEAKYLMELGNALETILSGLANMVAQEALKYTVLSGIVAALTWPASLLSVANVIDNPWGVCLHRSAEVGKHLAHILLSRQQGRRPVTLIGFSLGARVIYFCLQEMAQEKDCQGIIVILPGAPVEGRAKHWESGSGVRE

SEQ ID NO: 879941 - protein, 296 aa, Homo sapiens
MWNRPCQRLPQQPLVAEPTAEGEPHLPTGRELTEANRFAYAALCGISLSQLFPEPEHRMAEASRKKKENRRKWKRYLLIGLATVGGGTVIGVTGGLAAPLVAAGAATIIGSAGAAALGSAAGIAIMTSLFGAAGAGLTGTFSAPWAALAHSREQYCLAWEAKYLMELGNALETILSGLANMVAQEALKYTVLSGIVAALTWPASLLSVANVIDNPWGVCLHRSAEVGKHLAHILLSRQQGRRPVTLIGFSLGARVIYFCLQEMAQEKDCQGIIVILPGAPVEGRAKHWESGSGVRE

SEQ ID NO: 879942 - protein, 61 aa, Homo sapiens
TFSAPWAALAHSREQYCLAWEAKYLMELGNALETILSGLANMVAQEALKYTVLSGKCPHLP

SEQ ID NO: 879943 - protein, 536 aa, Homo sapiens
MATPDAGLPGAEGVEPAPWAQLEAPARLLLQALQAGPEGARRGLGVLRALGSRGWEPFDWGRLLEALCREEPVVQGPDGRLELKPLLLRLPRICQRNLMSLLMAVRPSLPESGLLSVLQIAQQDLAPDPDAWLRALGELLRRDLGVGTSMEGASPLSERCQRQLQSLCRGLGLGGRRLKSPQAPDPEEEENRDSQQPGKRRKDSEEEAASPEGKRVPKRLRCWEEEEDHEKERPEHKSLESLADGGSASPIKDQPVMAVKTGEDGSNLDDAKGLAESLELPKAIQDQLPRLQQLLKTLEEGLEGLEDAPPVELQLLHECSPSQMDLLCAQLQLPQLSDLGLLRLCTWLLALSPDLSLSNATVLTRSLFLGRILSLTSSASRLLTTALTSFCAKYTYPVCSALLDPVLQAPGTGPAQTELLCCLVKMESLEPDAQVLMLGQILELPWKEETFLVLQSLLERQVEMTPEKFSVLMEKLCKKGLAATTSMAYAKLMLTVMTKYQANITETQRLGLAMALEPNTTFLRKSLKAALKHLGP

SEQ ID NO: 879944 - protein, 438 aa, Homo sapiens
MSLLMAVRPSLPESGLLSVLQIAQQDLAPDPDAWLRALGELLRRDLGVGTSMEGASPLSERCQRQLQSLCRGLGLGGRRLKSPQAPDPEEEENRDSQQPGKRRKDSEEEAASPEGKRVPKRLRCWEEEEDHEKERPEHKSLESLADGGSASPIKDQPVMAVKTGEDGSNLDDAKGLAESLELPKAIQDQLPRLQQLLKTLEEGLEGLEDAPPVELQLLHECSPSQMDLLCAQLQLPQLSDLGLLRLCTWLLALSPDLSLSNATVLTRSLFLGRILSLTSSASRLLTTALTSFCAKYTYPVCSALLDPVLQAPGTGPAQTELLCCLVKMESLEPDAQVLMLGQILELPWKEETFLVLQSLLERQVEMTPEKFSVLMEKLCKKGLAATTSMAYAKLMLTVMTKYQANITETQRLGLAMALEPNTTFLRKSLKAALKHLGP

SEQ ID NO: 879945 - protein, 513 aa, Homo sapiens
MATPDAGLPGAEGVEPAPWAQLEAPARLLLQALQAGPEGARRGLGVLRALGSRGWEPFDWGRLLEALCREEPVVQGPDGRLELKPLLLRLPRICQRNLMSLLMAVRPSLPESGLLSVLQIAQQDLAPDPDAWLRALGELLRRDLGVGTSMEGASPLSERCQRQLQSLCRGLGLGGRRLKSPQAPDPEEEENRDSQQPGKRRKDSEEEAASPEGKRVPKRLRCWEEEEDHEKERPEHKSLESLADGGSASPIKDQPVMAVKTGEDGSNLDDAKGLAESLELPKAIQDQLPRLQQLLKTLEEMDLLCAQLQLPQLSDLGLLRLCTWLLALSPDLSLSNATVLTRSLFLGRILSLTSSASRLLTTALTSFCAKYTYPVCSALLDPVLQAPGTGPAQTELLCCLVKMESLEPDAQVLMLGQILELPWKEETFLVLQSLLERQVEMTPEKFSVLMEKLCKKGLAATTSMAYAKLMLTVMTKYQANITETQRLGLAMALEPNTTFLRKSLKAALKHLGP

SEQ ID NO: 879946 - protein, 213 aa, Homo sapiens [sequence omitted]

SEQ ID NO: 879947 - protein, 179 aa, Homo sapiens
MAKTAMAYKEKMKELSMLSLICSCFYPEPRNINIYTYDDMEVKQINKRASGQAFELILKPPSPISEAPRTLASPKKKDLSLEEIQKKLEAAEERRKSQEAQVLKQLAEKREHEREVLQKALEENNNFSKMAEEKLILKMEQIKENREANLAAIIERLQEKERHAAEVRRNKELQVELSG

SEQ ID NO: 879948 - protein, 179 aa, Homo sapiens; identical to SEQ ID NO: 879947

SEQ ID NO: 879949 - protein, 179 aa, Homo sapiens; identical to SEQ ID NO: 879947

SEQ ID NO: 879950 - protein, 179 aa, Homo sapiens; identical to SEQ ID NO: 879947

SEQ ID NO: 879951 - protein, 120 aa, Homo sapiens
MIAVISEAPRTLASPKKKDLSLEEIQKKLEAAEERRKSQEAQVLKQLAEKREHEREVLQKALEENNNFSKMAEEKLILKMEQIKENREANLAAIIERLQEKERHAAEVRRNKELQVELSG

SEQ ID NO: 879952 - protein, 179 aa, Homo sapiens; identical to SEQ ID NO: 879947

SEQ ID NO: 879953 - protein, 107 aa, Homo sapiens
MAKTAMAYKEKMKELSMLSLICSCFYPEPRNINIYTYDDMEVKQINKRASGQAFELILKPPSPISEAPRTLASPNQKHCGLSLKLVFLPQCKAILPTNNTNNKTLHL

SEQ ID NO: 879954 - protein, 179 aa, Homo sapiens; identical to SEQ ID NO: 879947

SEQ ID NO: 879955 - protein, 179 aa, Homo sapiens; identical to SEQ ID NO: 879947

SEQ ID NO: 879956 - protein, 179 aa, Homo sapiens; identical to SEQ ID NO: 879947

SEQ ID NO: 879957 - protein, 193 aa, Homo sapiens
MAKTAMAYKEKMKELSMLSLICSCFYPEPRNINIYTYDDMEVKQINKRASGQAFELILKPPSPISEAPRTLASPKKKDLSLEEIQKKLEAAEERRKSQEAQVLKQLAEKREHEREVLQKALEENNNFSKMAEEKLILKMEQIKENREANLAAIIERLQEKCLAEAREGLARPTNSKSPCLYYNGSCDIRMGNV

SEQ ID NO: 879958 - protein, 224 aa, Homo sapiens
VPPLSPSAGPASGSPCARAMSKKKGLSAEEKRTRMMEIFSETKDVFQLKDLEKIAPKEKGITAMSVKEVLQSLVDDGMVDCERIGTSNYYWAFPSKALHARKHKLEVLESQLSEGSQKHASLQKSIEKAKIGRCETEERTRLAKELSSLRDQREQLKAEVEKYKDCDPQVVEEIRQANKVAKEAANRWTDNIFAIKSWAKRKFGFEENKIDRTFGIPEDFDYID

SEQ ID NO: 879959 - protein, 224 aa, Homo sapiens; identical to SEQ ID NO: 879958

SEQ ID NO: 879960 - protein, 145 aa, Homo sapiens
VPPLSPSAGPASGSPCARAMSKKKGLSAEEKRTRMMEIFSETKDVFQLKDLEKIAPKEKGITAMSVKEVLQSLVDDGMVDCERIGTSNYYWAFPSKALHARKHKLEVLESQDPGCCFHEIIKVSYYRKFWLGAVAHACNPSTLGG

SEQ ID NO: 879961 - protein, 141 aa, Homo sapiens
VPPLSPSAGPASGSPCARAMSKKKGLSAEEKRTRMMEIFSETKDVFQLKDLEKIAPKEKGITAMSVKEVLQSLVDDGMVDCERIGTSNYYWAFPSKALHARKHKLEVLESQLSEGSQKHASLQKSIEKAKIGRCETAKQIK

SEQ ID NO: 879962 - protein, 135 aa, Homo sapiens
VPPLSPSAGPASGSPCARAMSKKKGLSAEEKRTRMMEIFSETKDVFQLKDLEKIAPKEKGITAMSVKEVLQSLVDDGMVDCERIGTSNYYWAFPSKALHARKHKLEVLESQAWCSRLLSQDFGRLWQEDRMRPGV

SEQ ID NO: 879963 - protein, 578 aa, Homo sapiens
MNISVDLETNYAELVLDVGRVTLGENSRKKMKDCKLRKKQNERVSRAMCALLNSGGGVIKAEIENEDYSYTKDGIGLDLENSFSNILLFVPEYLDFMQNGNYFLIFVKSWSLNTSGLRITTLSSNLYKRDITSAKVMNATAALEFLKDMKKTRGRLYLRPELLAKRPCVDIQEENNMKALAGVFFDRTELDRKEKLTFTESTHVEIKNFSTEKLLQRIKEILPQYVSAFANTDGGYLFIGLNEDKEIIGFKAEMSDLDDLEREIEKSIRKMPVHHFCMEKKKINYSCKFLGVYDKGSLCGYVCALRVERFCCAVFAKEPDSWHVKDNRVMQLTRKEWIQFMVEAEPKFSSSYEEVISQINASLPAPHSWPLLEWQRQRHHCPGLSGRITYTPENLCRKLFLQHEGLKQLICEEMDSVRKGSLIFSRSWSVDLGLQENHKVLCDALLISQDSPPVLYTFHMVQDEEFKGYSTQTALTLKQKLAKIGGYTKKVCVMTKIFYLSPEGMTSCQYDLRSQVIYPESYYFTRRKYLLKALFKALKRLKSLRDQFSFAENLYQIIGIDCFQKNDKKMFKSCRRLT

SEQ ID NO: 879964 - protein, 578 aa, Homo sapiens; identical to SEQ ID NO: 879963

SEQ ID NO: 879965 - protein, 578 aa, Homo sapiens; identical to SEQ ID NO: 879963

SEQ ID NO: 879966 - protein, 136 aa, Homo sapiens
YIINFAFANLLPFITHLLSTKYCFALGDSVIIFPPPPPPYFPESSASAVAESPGTNSLLPNENPPSYYSIFNYGTPTSEGAASERDCESIYTISGTNSSSEASHTPHLPSELPPRYEEKENAAATFLPLSSEPSPP

SEQ ID NO: 879967 - protein, 387 aa, Homo sapiens
SGGRAVGRVQGGRRSRGRVRRRTPRPASAHSSAVSQAPDPASELLKSWREENTSHPASGKGPLLDMSPAAAAEPDGDQQDRHVSKLIFCFFVFGAVLLCVGVLLSIFGFQACQYKPLPDCPMVLKVAGPACAVVGLGAVILARSRAQLQLRAGLQRGQQMDPDRAFICGESRQFAQCLIFGFLFLTSGMLISVLGIWVPGCGSNWAQEPLNETDTGDSEPRMCGFLSLQIMGPLIVLVGLCFFVVAHVKKRNTLNAGQDASEREEGQIQIMEPVQVTVGDSVIIFPPPPPPYFPESSASAVAESPGTNSLLPNENPPSYYSIFNYGTPTSEGAASERDCESIYTISGTNSSSEASHTPHLPSELPPRYEEKDMDSSSVLYAMDHYFI

SEQ ID NO: 879968 - protein, 388 aa, Homo sapiens
SGGRAVGRVQGGRRSRGRVRRRTPRPASAHSSAVSQAPDPASELLKSWREENTSHPASGKGPLLDMSPAAAAEPDGDQQDRHVSKLIFCFFVFGAVLLCVGVLLSIFGFQACQYKPLPDCPMVLKVAGPACAVVGLGAVILARSRAQLQLRAGLQRGQQMDPDRAFICGESRQFAQCLIFGFLFLTSGMLISVLGIWVPGCGSNWAQEPLNETDTGDSEPRMCGFLSLQIMGPLIVLVGLCFFVVAHVKKRNTLNAGQDASEREEGQIQIMEPVQVTVGDSVIIFPPPPPPYFPESSASAVAESPGTNSLLPNENPPSYYSIFNYGTPTSEGAASERDCESIYTISGTNSSSEASHTPHLPSELPPRYEEKENAAATFLPLSSEPSPP

SEQ ID NO: 879969 - protein, 143 aa, Homo sapiens [sequence omitted]

SEQ ID NO: 879970 - protein, 358 aa, Homo sapiens
MSSLGCWCGVEDEAAPSKQSIYIQRETQVRTPMAGVSPKKAHPCEMCGPILGDILHVADHQGTHHKQKLHRCEAWGNKLYDSGNFHQHQNEHIGEKPYRGSVEEALFAKRCKLHVSGESSVFSESGKDFLLRSGLLQQEATHTGKSNSKTECVSLFHGGKSHYSCGGCMKHFSTKDILSQHERLLPTEEPSVWCECGKSSSKYDSFSNHQGVHTREKPYTCGICGKLFNSKSHLLVHQRIHTGEKPYECEVCQKFFRHKYHLIAHQRVHTGERPYECSDCGKSFTHSSTFRVHKRVHTGQKPYECSECGKSFAESSSLTKHRRVHTGEKPYGCSECEKKFRQISSLRHHQRVHKRKGL

SEQ ID NO: 879971 - protein, 407 aa, Homo sapiens
MAAAALRFPVQGTVTFEDVAVKFTQEEWNLLSEAQRCLYRDVTLENLALMSSLGCWCGVEDEAAPSKQSIYIQRETQVRTPMAGVSPKKAHPCEMCGPILGDILHVADHQGTHHKQKLHRCEAWGNKLYDSGNFHQHQNEHIGEKPYRGSVEEALFAKRCKLHVSGESSVFSESGKDFLLRSGLLQQEATHTGKSNSKTECVSLFHGGKSHYSCGGCMKHFSTKDILSQHERLLPTEEPSVWCECGKSSSKYDSFSNHQGVHTREKPYTCGICGKLFNSKSHLLVHQRIHTGEKPYECEVCQKFFRHKYHLIAHQRVHTGERPYECSDCGKSFTHSSTFRVHKRVHTGQKPYECSECGKSFAESSSLTKHRRVHTGEKPYGCSECEKKFRQISSLRHHQRVHKRKGL

SEQ ID NO: 879972 - protein, 364 aa, Homo sapiens [sequence omitted]

SEQ ID NO: 879973 - protein, 358 aa, Homo sapiens; identical to SEQ ID NO: 879970

SEQ ID NO: 879974 - protein, 176 aa, Homo sapiens
RSHHTHTTKQRTGKKGTHTLLPFTPNQNQNPNQSIQKSKPGQNQNESIKQSKSSQKQKPKCRYRHAVGDQATLPLKWSGQVPKTSLTKFQMSGLQVPVPSQCSAAALILCGGLPHATLARCSTGAIAYPGVLSGSASLKLARVPCRDAPQGRPKLPKGLPRLSVNHLASQSGNQEM

SEQ ID NO: 879975 - protein, 176 aa, Homo sapiens; identical to SEQ ID NO: 879974

SEQ ID NO: 879976 - protein, 54 aa, Homo sapiens
MLLAHLISPHALLAGRGEGSRFLSEEYIFRIALWLGCPYKSGVIYDRVCMPKCV

SEQ ID NO: 879977 - protein, 176 aa, Homo sapiens; identical to SEQ ID NO: 879974

SEQ ID NO: 879978 - protein, 358 aa, Homo sapiens; identical to SEQ ID NO: 879970

SEQ ID NO: 879979 - protein, 462 aa, Homo sapiens
AAAAMGPRGVSWVESSGRRERAAESRLCKEKNDSRPPGSSHHHGPNTALQGLPNANGNGRAKVPRSGTVTFEDVAVKFTQEEWNLLSEAQRCLYRDVTLENLALMSSLGCWCGVEDEAAPSKQSIYIQRETQVRTPMAGVSPKKAHPCEMCGPILGDILHVADHQGTHHKQKLHRCEAWGNKLYDSGNFHQHQNEHIGEKPYRGSVEEALFAKRCKLHVSGESSVFSESGKDFLLRSGLLQQEATHTGKSNSKTECVSLFHGGKSHYSCGGCMKHFSTKDILSQHERLLPTEEPSVWCECGKSSSKYDSFSNHQGVHTREKPYTCGICGKLFNSKSHLLVHQRIHTGEKPYECEVCQKFFRHKYHLIAHQRVHTGERPYECSDCGKSFTHSSTFRVHKRVHTGQKPYECSECGKSFAESSSLTKHRRVHTGEKPYGCSECEKKFRQISSLRHHQRVHKRKGL

SEQ ID NO: 879980 - protein, 176 aa, Homo sapiens; identical to SEQ ID NO: 879974

SEQ ID NO: 879981 - protein, 176 aa, Homo sapiens; identical to SEQ ID NO: 879974

SEQ ID NO: 879982 - protein, 75 aa, Homo sapiens
AGELVTAAESRPHPASRARACARRISPGDGGECEGGGEVVTDAEAVLAAEAKSPSQACMGSYCTSGFGGMQNRGL

SEQ ID NO: 879983 - protein, 68 aa, Homo sapiens
RPLGGRGLRFRTSSCCWMAPVCDVPRNLALRKKQSKPGKYVALNRSNQGQKGRKRVSYLHGTTLTSSA

SEQ ID NO: 879984 - protein, 105 aa, Homo sapiens
MNNHHLSREKRNYQHFADDETDSGRGGGGQSVCHLESGNVRIQTQIPGSSRHHMALTLGREFQEIPEEEGEKLAGTGGVNGANTGVWESISWRKVIAVFAIESNV

SEQ ID NO: 879985 - protein, 120 aa, Homo sapiens
PRSRGRPSRREPVRDVGRRRPEDYDIHNSRKKPRIDYPPEFHQRPGYLKDPRYQEVDRRFSGVRRDVFLNGSYNDYVREFHNMGPPPPWQGMPLTQEWNNLHTILTISTMLHLLKLIPRR

SEQ ID NO: 879986 - protein, 111 aa, Homo sapiens
MARINFCIIQNCSHISESKFQNLIYNLWFVVCDSHILRDLCHHQGIPRSVLGKCHLAQFHVIQPLVIRRESLLVVFNLVGHFMVFLLLQVVQVLTQLLVSKKKKSRRVISN

SEQ ID NO: 879987 - protein, 74 aa, Homo sapiens
HPQTLNQRGKLPLNTFRSIFYTGSIFLETNLSWELPVLQLPSGQAALWACNVAGILGLAGSNILCTPQHSLLCL

SEQ ID NO: 879988 - protein, 79 aa, Homo sapiens
FPRRTKPPVTRAGSTSSKQREQQVLKPKANALTEKSLMTKCVASVCAEITKRVPQKGEKKGPQERVAGLQVLEKGSKHG

SEQ ID NO: 879989 - protein, 82 aa, Homo sapiens
GLCILQWKFHSMPVCTISSLPQVDDVLASLQISSHNCKVMYYTKVIGSEDFRGSMTSLESSHSGFSQLSAPPPSPASLTPAP

SEQ ID NO: 879990 - protein, 137 aa, Homo sapiens
MEAVHTCSHTAVHTYTHTPIRDGGSAHLLTHSGAHIHSHIDRRWRQCTPAHTQRCTHTHTHTDRRWRQCTPAHTQRCTHTLTHTPIRDGGSVPQYHRCAFLDAGISGHFYFQLYRIFYFSYLMSLYYFYNQKHAISI

SEQ ID NO: 879991 - protein, 360 aa, Homo sapiens
LPTLDTKAPTGRRTKPWGRLKRRARSPQGQTAKPRAAAELNTEVPKPSAKDVEILEQESEVLEPSVEQDAESPGLSTAAGFESPEPGRDDPGPSEAQRAEVQGQHPPPGPKTSSSRSGSEAPHLRFPPCPEAPQRPPEERFMETPIEREIRRSCEREESLRRSRGLSPGRAGRELVELRVRPVLNLPGPGPALPRALERARAGAQMQRDIEREAHRQAALARPAVPEPRARSPPQPLGELKRFFEAAAGSGSSAGAGDGAGPQRLPEPGGRPRSAVQGGCRVLGSAPPPFTPSLLEQEVRAVREREQELQRQRRSVYGTAEFKEPTPSLTASRGDGKLVVIWPPRRKVSENGLEQEERKP

SEQ ID NO: 879992 - protein, 335 aa, Homo sapiens
LPTLDTKAPTGRRTKPWGRLKRRARSPQGQTAKPRAAAELNTEVPKPSAKDVEILEQESEVLEPSVEQDAESPGLSTAAGFESPEPGRDDPGPSEAQRAEVQGQHPPPGPKTSSSRSGSEAPHLRFPPCPEAPQRPPEERFMETPIEREIRRSCEREESLRRSRGLSPGRAGRELVELRVRPVLNLPGPGPALPRALERARAGAQMQRDIEREAHRQAALARPAVPEPRARSPPQPLGELKRFFEAAAGSGSSAGAGDGAGPQRLPEPGGRPRSAVQGGCRVLGSAPPPFTPSLLEQEVRAVREREQELQRQRRSVYGTAEFKEPTPSLTGKPRA

SEQ ID NO: 879993 - protein, 345 aa, Homo sapiens
LPTLDTKAPTGRRTKPWGRLKRRARSPQGQTAKPRAAAELNTEVPKPSAKDVEILEQESEVLEPSVEQDAESPGLSTAAGFESPEPGRDDPGPSEAQRAEVQGQHPPPGPKTSSSRSGSEAPHLRFPPCPEAPQRPPEERFMETPIEREIRRSCEREESLRRSRGLSPGRAGRELVELRVRPVLNLPGPGPALPRALERARAGAQMQRDIEREAHRQAALARPAVPEPRARSPPQPLGELKRFFEAAAGSGSSAGAGDGAGPQRLPEPGGRPRSAVQGGCRVLGSAPPPFTPSLLEQEVRAVREREQELQRQRRSVYGTAEFKEPTPSLTGVRPAFHPGCRQLVS

SEQ ID NO: 879994 - protein, 224 aa, Homo sapiens
MVAAVLLGLSWLCSPLGALVLDFNNIRSSADLHGARKGSQCLSDTDCNTRKFCLQPRDEKPFCATCRGLRRRCQRDAMCCPGTLCVNDVCTTMEDATPILERQLDEQDGTHAEGTTGHPVQENQPKRKPSIKKSQGRKGQEGESCLRTFDCGPGLCCARHFWTKICKPVLLEGQVCSRRGHKDTAQAPEIFQRCDCGPGLLCRSQLTSNRQHARLRVCQKIEKL

SEQ ID NO: 879995 - protein, 76 aa, Homo sapiens
VVDATPLEVFLLSQHLEEFLPIFKREQIDLEALLLCSDEDLQSIQMQLGPRKKVLNAINRRKQVLQQPGQLVDTSL

SEQ ID NO: 879996 - protein, 76 aa, Homo sapiens; identical to SEQ ID NO: 879995

SEQ ID NO: 879997 - protein, 159 aa, Homo sapiens
PRRGRRGRAPSASRPSAGNVCGKNSESRAVASRGWVTWLLSFRKHCFVQSSDPGPSRAASHHRVRLRFSSWLELSAFFFRDRASFLRGPGVSGQGRGSRLVCPLNGSWASEILRNAHQPWYHRERRLRGFRNGVSGLGSHLSSPHFGRPRQADHMRSGV

SEQ ID NO: 879998 - protein, 461 aa, Homo sapiens
GWKAHSSSSSQQLCLEVPQSLCSCPQIVGLGDSKKAAKDSAGAAPQGPHRLEVLPGFYAQGVFWVPQSPLKHGEAEGSSPISGICSLEATAMAGPRYPVSVQGAALVQIKRLQTFAFSVRWSDGSDTFVRRSWDEFRQLKTLKETFPVEAGLLRRSDRVLPKLLDAPLLGRVGRTSRGLARLQLLETYSRRLLATAERVARSPTITGFFAPQPLDLEPALPPGSRVILPTPEEQPLSRAAGRLSIHSLEAQSLRCLQPFCTQDTRDRPFQAQAQESLDVLLRHPSGWWLVENEDRQTAWFPAPYLEEAAPGQGREGGPSLGSSGPQFCASRAYESSRADELSVPAGARVRVLETSDRGWWLCRYGDRAGLLPAVLLRPEGLGALLSGTGFRGGDDPAGEARGFPEPSQATAPPPTVPTRPSPGAIQSRCCTVTRRALERRPRRQGRPRGCVDSVPHPTTEQ

SEQ ID NO: 879999 - protein, 171 aa, Homo sapiens
PPSADSSKENVEKGAGGPRPLWPRGDSKHPLPPGPQFCASRAYESSRADELSVPAGARVRVLETSDRGWWLCRYGDRAGLLPAVLLRPEGLGALLSGTGFRGGDDPAGEARGFPEPSQATAPPPTVPTRPSPGAIQSRCCTVTRRALERRPRRQGRPRGCVDSVPHPTTEQ

SEQ ID NO: 880000 - protein, 184 aa, Homo sapiens
GWKAHSSSSSQQLCLEVPQSLCSCPQIVGLGDSKKAAKDSAGAAPQGPHRLEVLPGFYAQGVFWVPQSPLKHGEAEGSSPISGICSLEATAMAGPRYPVSVQGAALVQIKRLQTFAFSVRWSDGSDTFVRRSWDEFRQLKTLKETFPVEAGLLRRSDRVLPKLLGQASLGTGAGKAVACLGAPG

SEQ ID NO: 880001 - protein, 176 aa, Homo sapiens
GCLPLDCLPSVTPTGGPSSLLKLPAPAIRVRDPALSRVHSGLWKTNALVPALRRPSRRPSRWRRACCGDLTAFSQSFSVRPAWVRERGRRWLAWGRQGPVKPKAAYHSTFLWCLKMHHCWDAWGARAAAWRACSCWKPILGGCWRLQSAWHGARRSLASSHRNPWTWSPRCHPAGA

SEQ ID NO: 880002 - protein, 1168 aa, Homo sapiens
EATMQDVQGPRPGSPGDAEDRRELGLHRGEVNFGGSGKKRGKFVRVPSGVAPSVLFDLLLAEWHLPAPNLVVSLVGEEQPFAMKSWLRDVLRKGLVKAAQSTGAWILTSALRVGLARHVGQAVRDHSLASTSTKVRVVAVGMASLGRVLHRRILEEAQEDFPVHYPEDDGGSQGPLCSLDSNLSHFILVEPGPPGKGDGLTELRLRLEKHISEQRAGYGGTGSIEIPVLCLLVNGDPNTLERISRAVEQAAPWLILVGSGGIADVLAALVNQPHLLVPKVAEKQFKEKFPSKHFSWEDIVRWTKLLQNITSHQHLLTVYDFEQEGSEELDTVILKALVKACKSHSQEPQDYLDELKLAVAWDRVDIAKSEIFNGDVEWKSCDLEEVMVDALVSNKPEFVRLFVDNGADVADFLTYGRLQELYRSVSRKSLLFDLLQRKQEEARLTLAGLGTQQAREPPAGPPAFSLHEVSRVLKDFLQDACRGFYQDGRPGDRRRAEKGPAKRPTGQKWLLDLNQKSENPWRDLFLWAVLQNRHEMATYFWAMGQEGVAAALAACKILKEMSHLETEAEAARATREAKYERLALDLFSECYSNSEARAFALLVRRNRCWSKTTCLHLATEADAKAFFAHDGVQAFLTRIWWGDMAAGTPILRLLGAFLCPALVYTNLITFSEEAPLRTGLEDLQDLDSLDTEKSPLYGLQSRVEELVEAPRAQGDRGPRAVFLLTRWRKFWGAPVTVFLGNVVMYFAFLFLFTYVLLVDFRPPPQGPSGPEVTLYFWVFTLVLEEIRQGFFTDEDTHLVKKFTLYVGDNWNKCDMVAIFLFIVGVTCRMLPSAFEAGRTVLAMDFMVFTLRLIHIFAIHKQLGPKIIVVERMMKDVFFFLFFLSVWLVAYGVTTQALLHPHDGRLEWIFRRVLYRPYLQIFGQIPLDEIDEARVNCSTHPLLLEDSPSCPSLYANWLVILLLVTFLLVTNVLLMNLLIAMFSYTFQVVQGNADMFWKFQRYNLIVEYHERPALAPPFILLSHLSLTLRRVFKKEAEHKREHLERDLPDPLDQKVVTWETVQKENFLSKMEKRRRDSEGEVLRKTAHRVDFIAKYLGGLREQEKRIKCLESQINYCSVLVSSVADVLAQGGGPRSSQHCGEGSQLVAADHRGGLDGWEQPGAGQPPSDT

SEQ ID NO: 880003 - protein, 1000 aa, Homo sapiens
EATMQDVQGPRPGSPGDAEDRRELGLHRGEVNFGGSGKKRGKFVRVPSGVAPSVLFDLLLAEWHLPAPNLVVSLVGEEQPFAMKSWLRDVLRKGLVKAAQSTGAWILTSALRVGLARHVGQAVRDHSLASTSTKVRVVAVGMASLGRVLHRRILEEAQEDFPVHYPEDDGGSQGPLCSLDSNLSHFILVEPGPPGKGDGLTELRLRLEKHISEQRAGYGGTGSIEIPVLCLLVNGDPNTLERISRAVEQAAPWLILVGSGGIADVLAALVNQPHLLVPKVAEKQFKEKFPSKHFSWEDIVRWTKLLQNITSHQHLLTVYDFEQEGSEELDTVILKALVKACKSHSQEPQDYLDELKLAVAWDRVDIAKSEIFNGDVEWKSCDLEEVMVDALVSNKPEFVRLFVDNGADVADFLTYGRLQELYRSVSRKSLLFDLLQRKQEEARLTLAGLGTQQAREPPAGPPAFSLHEVSRVLKDFLQDACRGFYQDGRPGDRRRAEKGPAKRPTGQKWLLDLNQKSENPWRDLFLWAVLQNRHEMATYFWAMGQEGVAAALAACKILKEMSHLETEAEAARATREAKYERLALDLFSECYSNSEARAFALLVRRNRCWSKTTCLHLATEADAKAFFAHDGVQAFLTRIWWGDMAAGTPILRLLGAFLCPALVYTNLITFSEEAPLRTGLEDLQDLDSLDTEKSPLYGLQSRVEELVEAPRAQGDRGPRAVFLLTRWRKFWGAPVTVFLGNVVMYFAFLFLFTYVLLVDFRPPPQGPSGPEVTLYFWVFTLVLEEIRQGFFTDEDTHLVKKFTLYVGDNWNKCDMVAIFLFIVGVTCRMLPSAFEAGRTVLAMDFMVFTLRLIHIFAIHKQLGPKIIVVERMMKDVFFFLFFLSVWLVAYGVTTQALLHPHDGRLEWIFRRVLYRPYLQIFGQIPLDEIDEARVNCSTHPLLLEDSPSCPSLYANWLVILQPPSRQWPSWCLTTDPHPKEPLLVPPGLPGGTAVSWGCLP

SEQ ID NO: 880004 - protein, 648 aa, Homo sapiens
MVYIHGGSYMEGTGNMIDGSILASYGNVIVITINYRLGILGFLSTGDQAAKGNYGLLDQIQALRWIEENVGAFGGDPKRVTIFGSGAGASCVSLLTLSHYSEGLFQKAIIQSGTALSSWAVNYQPAKYTRILADKVGCNMLDTTDMVECLKNKNYKELIQQTITPATYHIAFGPVIDGDVIPDDPQILMEQGEFLNYDIMLGVNQGEGLKFVDGIVDNEDGVTPNDFDFSVSNFVDNLYGYPEGKDTLRETIKFMYTDWADKENPETRRKTLVALFTDHQWVAPAVATADLHAQYGSPTYFYAFYHHCQSEMKPSWADSAHGDEVPYVFGIPMIGPTELFSCNFSKNDVMLSAVVMTYWTNFAKTGDPNQPVPQDTKFIHTKPNRFEEVAWSKYNPKDQLYLHIGLKPRVRDHYRATKVAFWLELVPHLHNLNEIFQYVSTTTKVPPPDMTSFPYGTRRSPAKIWPTTKRPAITPANNPKHSKDPHKTGPEDTTVLIETKRDYSTELSVTIAVGASLLFLNILAFAALYYKKDKRRHETHRHPSPQRNTTNDITHIQNEEIMSLQMKQLEHDHECESLQAHDTLRLTCPPDYTLTLRRSPDDIPFMTPNTITMIPNTLMGMQPLHTFKTFSGGQNSTNLPHGHSTTRV

SEQ ID NO: 880005 - protein, 236 aa, Homo sapiens
LNSNVLLWITALAIKFTLIDSQAQYPVVNTNYGKIQGLRTPLPSEILGPVEQYLGVPYASPPTGERRFQPPESPSSWTGIRNATQFSAVCPQHLDERFLLHDMLPIWFTTSLDTLMTYVQDQNEDCLYLNIYVPMEDGTNIKRNADDITSNDHGEDKDIHEQNSKKPVMVYIHGGSYMEGTGNMIDGSILASYGNVIVITINYRLGILGMQEARLCGSSKMFNYFKSPFTNLINFF

SEQ ID NO: 880006 - protein, 124 aa, Homo sapiens
MGAVENVRRNEFNQTVSPRVFFLNVPFDSIMERLTLRRIDPVTGERYHLMYKPPPTMEIQARLLQNPKDAEEQVKLKMDLFYRNSADLEQLYGSAITLNGDQDPYTVFEYIESGIINPLPKKIP

SEQ ID NO: 880007 - protein, 118 aa, Homo sapiens
ELIQPFFEEGDGRVFFLNVPFDSIMERLTLRRIDPVTGERYHLMYKPPPTMEIQARLLQNPKDAEEQVKLKMDLFYRNSADLEQLYGSAITLNGDQDPYTVFEYIESGIINPLPKKIP

SEQ ID NO: 880008 - protein, 106 aa, Homo sapiens
MVFFLNVPFDSIMERLTLRRIDPVTGERYHLMYKPPPTMEIQARLLQNPKDAEEQVKLKMDLFYRNSADLEQLYGSAITLNGDQDPYTVFEYIESGIINPLPKKIP

SEQ ID NO: 880009 - protein, 113 aa, Homo sapiens
RLGYNPNRVFFLNVPFDSIMERLTLRRIDPVTGERYHLMYKPPPTMEIQARLLQNPKDAEEQVKLKMDLFYRNSADLEQLYGSAITLNGDQDPYTVFEYIESGIINPLPKKIP

SEQ ID NO: 880010 - protein, 83 aa, Homo sapiens
HPERLGATRRPAGPRPGTPAEPPGLQSQQVSCPSQASSPGQAPGHPLSRAQLKGSRLHKPSRVPEVECLLVIPIPTHPICPVD

SEQ ID NO: 880011 - protein, 112 aa, Homo sapiens
VQTPSPSSFRPRSPDPQPLLPQTQESRPQPLLPQTQESRPPAPPPSDPGVQTPAPPSPRPEGELGLWTCLRKEREGRKEKKGLGGGRSPSPAPCGRSHCPRSLLGVGPAVDS

SEQ ID NO: 880012 - protein, 563 aa, Homo sapiens
AGLDAVSLSRPFLCFRLFLLTASFRQYLFSFLVPSVPGAGKGRIVCRDWSKYPVGGKPGLPRLAGSDVTIAATARWNGRWVQVPAWPGPGCGTNASGERQRQLPRAWRPVGRTLGSEPIALAWSPPLYLFPIPLPSWAVSQPTPTLGTMFADLDYDIEEDKLGIPTVPGKVTLQKDAQNLIGISIGGGAQYCPCLYIVQVFDNTPAALDGTVAAGDEITGVNGRSIKGKTKVEVAKMIQEVKGEVTIHYNKLQADPKQGMSLDIVLKKVKHRLVENMSSGTADALGLSRAILCNDGLVKRLEELERTAELYKGMTEHTKNLLRAFYELSQTHRAFGDVFSVIGVREPQPAASEAFVKFADAHRSIEKFGIRLLKTIKPMLTDLNTYLNKAIPDTRLTIKKYLDVKFEYLSYCLKVKEMDDEEYSCIALGEPLYRVSTGNYEYRLILRCRQEARARFSQMRKDVLEKMELLDQKHVQDIVFQLQRLVSTMSKYYNDCYAVLRDADVFPIEVDLAHTTLAYGLNQEEFTDGEEEEEEEDTAAGEPSRDTRGAAGPLDKGGSWCDS

SEQ ID NO: 880013 - protein, 415 aa, Homo sapiens
MFADLDYDIEEDKLGIPTVPGKVTLQKDAQNLIGISIGGGAQYCPCLYIVQVFDNTPAALDGTVAAGDEITGVNGRSIKGKTKVEVAKMIQEVKGEVTIHYNKLQADPKQGMSLDIVLKKVKHRLVENMSSGTADALGLSRAILCNDGLVKRLEELERTAELYKGMTEHTKNLLRAFYELSQTHRAFGDVFSVIGVREPQPAASEAFVKFADAHRSIEKFGIRLLKTIKPMLTDLNTYLNKAIPDTRLTIKKYLDVKFEYLSYCLKVKEMDDEEYSCIALGEPLYRVSTGNYEYRLILRCRQEARARFSQMRKDVLEKMELLDQKHVQDIVFQLQRLVSTMSKYYNDCYAVLRDADVFPIEVDLAHTTLAYGLNQEEFTDGEEEEEEEDTAAGEPSRDTRGAAGPLDKGGSWCDS

SEQ ID NO: 880014 - protein, 415 aa, Homo sapiens; identical to SEQ ID NO: 880013

SEQ ID NO: 880015 - protein, 485 aa, Homo sapiens
AGLDAVSLSRPFLCFRLFLLTASFRQYLFSFLVPSVPGAGKGRIVCRDWSKYPVGGKPGLPRLAGSDVTIAATARWNGRWVQVPAWPGPGCGTNASGERQRQLPRAWRPVGRTLGSEPIALAWSPPLYLFPIPLPSWAVSQPTPTLGTMFADLDYDIEEDKLGIPTVPGKVTLQKDAQNLIGISIGGGAQYCPCLYIVQVFDNTPAALDGTVAAGDEITGVNGRSIKGKTKVEVAKMIQEVKGEVTIHYNKLQADPKQGMSLDIVLKKVKHRLVENMSSGTADALGLSRAILCNDGLVKRLEELERTAELYKGMTEHTKNLLRAFYELSQTHRAFGDVFSVIGVREPQPAASEAFVKFADAHRSIEKFGIRLLKTIKPMLTDLNTYLNKAIPDTRLTIKKYLDVKFEYLSYCLKVKEMDDEEYSCIVSVGGGGGLVLPPTWSARDSRWLRPTRERPGGLGWTLVPGDLGPSSQSRSLGLGVLGTR

SEQ ID NO: 880016 - protein, 421 aa, Homo sapiens
VRYEAWVWLRLDYDIDEDKLGIPTVPGKVTLQKDAQNLIGISIGGGAQYCPCLYIVQVFDNTPAALDGTVAAGDEITGVNGRSIKGKTKVEVAKMIQEVKGEVTIHYNKLQADPKQGMSLDIVLKKVKHRLVENMSSGTADALGLSRAILCNDGLVKRLEELERTAELYKGMTEHTKNLLRAFYELSQTHRAFGDVFSVIGVREPQPAASEAFVKFADAHRSIEKFGIRLLKTIKPMLTDLNTYLNKAIPDTRLTIKKYLDVKFEYLSYCLKVKEMDDEEYSCIALGEPLYRVSTGNYEYRLILRCRQEARARFSQMRKDVLEKMELLDQKHVQDIVFQLQRLVSTMSKYYNDCYAVLRDADVFPIEVDLAHTTLAYGLNQEEFTDGEEEEEEEDTAAGEPSRDTRGAAGPLDKGGSWCDS

SEQ ID NO: 880017 - protein, 105 aa, Homo sapiens
MRKDVLEKMELLDQKHVQDIVFQLQRLVSTMSKYYNDCYAVLRDADVFPIEVDLAHTTLAYGLNQEEFTDGEEEEEEEDTAAGEPSRDTRGAAGPLDKGGSWCDS

SEQ ID NO: 880018 - protein, 258 aa, Homo sapiens
AGLDAVSLSRPFLCFRLFLLTASFRQYLFSFLVPSVPGAGKGRIVCRDWSKYPVGGKPGLPRLAGSDVTIAATARWNGRWVQVPAWPGPGCGTNASGERQRQLPRAWRPVGRTLGSEPIALAWSPPLYLFPIPLPSWAVSQPTPTLGTMFADLDYDIEEDKLGIPTVPGKVTLQKDAQNLIGISIGGGAQYCPCLYIVQVFDNTPAALDGTVAAGDEITGVNGRSIKGKTKVEVAKMIQEVKVRAAAEQVSRGSNTCF

SEQ ID NO: 880019 - protein, 520 aa, Homo sapiens
MVARVGLLLRALQLLLWGHLDAQPAERGGQELRKEAEAFLEKYGYLNEQVPKAPTSTRFSDAIRAFQWVSQLPVSGVLDRATLRQMTRPRCGVTDTNSYAAWAERISDLFARHRTKMRRKKRFAKQGNKWYKQHLSYRLVNWPEHLPEPAVRGAVRAAFQLWSNVSALEFWEAPATGPADIRLTFFQGDHNDGLGNAFDGPGGALAHAFLPRRGEAHFDQDERWSLSRRRGRNLFVVLAHEIGHTLGLTHSPAPRALMAPYYKRLGRDALLSWDDVLAVQSLYGKPLGGSVAVQLPGKLFTDFETWDSYSPQGRRPETQGPKYCHSSFDAITVDRQQQLYIFKGSHFWEVAADGNVSEPRPLQERWVGLPPNIEAAAVSLNDGDFYFFKGGRCWRFRGPKPVWGLPQLCRAGGLPRHPDAALFFPPLRRLILFKGARYYVLARGGLQVEPYYPRSLQDWGGIPEEVSGALPRPDGSIIFFRDDRYWRLDQAKLQATTSGRWATELPWMGCWHANSGSALF

SEQ ID NO: 880020 - protein, 541 aa, Homo sapiens
MVARVGLLLRALQLLLWGHLDAQPAERGGQELRKEAEAFLEKYGYLNEQVPKAPTSTRFSDAIRAFQWVSQLPVSGVLDRATLRQMTRPRCGVTDTNSYAAWAERISDLFARHRTKMRRKKRFAKQGNKWYKQHLSYRLVNWPEHLPEPAVRGAVRAAFQLWSNVSALEFWEAPATGPADIRLTFFQGDHNDGLGNAFDGPGGALAHAFLPRRGEAHFDQDERWSLSRRRGRNLFVVLAHEIGHTLGLTHSPAPRALMAPYYKRLGRDALLSWDDVLAVQSLYGKPLGGSVAVQLPGKLFTDFETWDSYSPQGRRPETQGPKYCHSSFDAITVDRQQQLYIFKGSHFWEVAADGNVSEPRPLQERWVGLPPNIEAAAVSLNDGDFYFFKVQIRLIDMNTTIVGSSLKESRGGRCWRFRGPKPVWGLPQLCRAGGLPRHPDAALFFPPLRRLILFKGARYYVLARGGLQVEPYYPRSLQDWGGIPEEVSGALPRPDGSIIFFRDDRYWRLDQAKLQATTSGRWATELPWMGCWHANSGSALF

SEQ ID NO: 880021 - protein, 130 aa, Homo sapiens
MVARVGLLLRALQLLLWGHLDAQPAERGGQELRKEAEAFLEKYGYLNEQVPKAPTSTRFSDAIRAFQWVSQLPVSGVLDRATLRQMTRPRCGVTDTNSYAAWAERISDLFARHRTKMRRKKRFAKQGEHC

SEQ ID NO: 880022 - protein, 390 aa, Homo sapiens
MVARVGLLLRALQLLLWGHLDAQPAERGGQELRKEAEAFLEKYGYLNEQVPKAPTSTRFSDAIRAFQWVSQLPVSGVLDRATLRQMTRPRCGVTDTNSYAAWAERISDLFARHRTKMRRKKRFAKQGNKWYKQHLSYRLVNWPEHLPEPAVRGAVRAAFQLWSNVSALEFWEAPATGPADIRLTFFQGDHNDGLGNAFDGPGGALAHAFLPRRGEAHFDQDERWSLSRRRGRNLFVVLAHEIGHTLGLTHSPAPRALMAPYYKRLGRDALLSWDDVLAVQSLYGKPLGGSVAVQLPGKLFTDFETWDSYSPQGRRPETQGPKYCHSSFDAITVDRQQQLYIFKGSHFWEVAADGNVSEPRPLQERWVGLPPNIEAAAVSLNDGDFYFFKA

SEQ ID NO: 880023 - protein, 112 aa, Homo sapiens
DHNDGLGNAFDGPGAGTKPPSRTAGGEPNLEKQFGGGNEAFTLPVALAEAHLPAENPQSPHPKMGTVVPALLCVTCLKGQSDEALQGKCFANSQEYYAFWENLPRFHHPSSA

SEQ ID NO: 880024 - protein, 362 aa, Homo sapiens
NQPWFSFPRSGLTGGVGGEPWAPLASAGFPSQTQREMPWTILLFAAGSLAIPAPSIRLVPPYPSSQEDPIHIACMAPGNFPGANFTLYRGGQVVQLLQAPTDQRGVTFNLSGGSSKAPGGPFHCQYGVLGELNQSQLSDLSEPVNVSFPVPTWILVLSLSLAGALFLLAGLVAVALVVRKVKLRNLQKKREIENPAGPRLTSTAQTCPSITPCLPSPRKRCQKKTRPPWMITQAPLPPPATPGPGRGPLPRPPRLRPPNSALSGPASEAEDWGTPLSPGIRGPEVPPATSGGALSATFSGNWTEERKGNPGLGIFITEEWERGHRHGPGTIQTTGSSPLDLRLLRTTREGDVRTPSCPPAGP

SEQ ID NO: 880025 - protein, 362 aa, Homo sapiens
NQPWFSFPRSGLTGGVGGEPWAPLASAGFPSQTQREMPWTILLFAAGSLAIPAPSIRLVPPYPSSQEDPIHIACMAPGNFPGANFTLYRGGQVVQLLQAPTDQRGVTFNLSGGSSKAPGGPFHCQYGVLGELNQSQLSDLSEPVNVSFPVPTWILVLSLSLAGALFLLAGLVAVALVVRKGNSTQSLAHKEIENPAGPRLTSTAQTCPSITPCLPSPRKRCQKKTRPPWMITQAPLPPPATPGPGRGPLPRPPRLRPPNSALSGPASEAEDWGTPLSPGIRGPEVPPATSGGALSATFSGNWTEERKGNPGLGIFITEEWERGHRHGPGTIQTTGSSPLDLRLLRTTREGDVRTPSCPPAGP

SEQ ID NO: 880026 - protein, 117 aa, Homo sapiens
MLPTMAAGPNSILFAINIDNKDLNGQSKFAPTVSDLLKESTQNVTLLKESTQGVSSVFREITASSAISILIKPEQETDPLPVVSRNVSADAKCKKERKKKKQVTNINSFDDEEDEQN

SEQ ID NO: 880027 - protein, 132 aa, Homo sapiens
LALSPRLECSGTISAPCNLCVAGPNSILFAINIDNKDLNGQSKFAPTVSDLLKESTQNVTLLKESTQGVSSVFREITASSAISILIKPEQETDPLPVVSRNVSADAKCKKERKKKKQVTNINSFDDEEDEQN

SEQ ID NO: 880028 - protein, 126 aa, Homo sapiens
MTAHQQALQTFPFFWTGPNSILFAINIDNKDLNGQSKFAPTVSDLLKESTQNVTLLKESTQGVSSVFREITASSAISILIKPEQETDPLPVVSRNVSADAKCKKERKKKKQVTNINSFDDEEDEQN

SEQ ID NO: 880029 - protein, 110 aa, Homo sapiens
SRDSSRTFQGHGEGKGLIPSPCVVSSSCWGPFPHAPAPPSCVDCFGCGADCRSTGLRAVKDFLPGWAGIFCLALPRAVQAVGASVPGTSGMGGTQHVLSLAQPCLLSAGT

SEQ ID NO: 880030 - protein, 116 aa, Homo sapiens
LGFNIVLYGLGSKRDLLERFRTTMLQDSIHVVINGFFPGISVKSVLNSITEEVLDHMGTWWGQGREYIIILFSWDNGKNRVYRVSTQPRKHRNNTSYIWNSYCLCHDLHDTSEKPG

SEQ ID NO: 880031 - protein, 457 aa, Homo sapiens
MGNSYAGQLKTTRFEEVLHNSIEASLRSNNLVPRPIFSQLYLEAEQQLAALEGGSRVDNEEEEEEGEGGLETNGPPNPFQLHPLPEGCCTTDGFCQAGKDLRLVSISNEPMDVPAGFLLVGVKSPSLPDHLLVCAVDKRFLPDDNGHNALLGFSGNCVGCGKKGFCYFTEFSNHINLKLTTQPKKQKHLKYYLVRNAQGTLTKGPLICWKGSEFRSRQIPASTCSSSLFPALESTAAFPSEPVPGTNPSILMGAQQAGPASDHPSLNAAMGPAVFNGKDSPKCQQLAKNNLLALPRPSALGILSNSGPPKKRHKGWSPESPSAPDGGCPQGGGNRAKYESAGMSCVPQVGLVGPASVTFPVVASGEPVSVPDNLLKICKAKPVIFKGHGNFPYLCGNLNDVVVSPLLYTCYQNSQSVSRAYEQYGASAIQPISEEMQLLLTVYYLVQLAHQIRNPDV

SEQ ID NO: 880032 - protein, 409 aa, Homo sapiens
MGNSYAGQLKTTRFEEVLHNSIEASLRSNNLVPRPIFSQLYLEAEQQLAALEGGSRVDNEEEEEEGEGGLETNGPPNPFQLHPLPEGCCTTDGFCQAGKDLRLVSISNEPMDVPAGFLLVGVKSPSLPDHLLVCAVDKRFLPDDNGHNALLGFSGNCVGCGKKGFCYFTEFSNHINLKLTTQPKKQKHLKYYLVRNAQGTLTKGPLICWKGSEFRSRQIPASTCSSSLFPALESTAAFPSEPVPGTNPSILMGAQQAGPASDHPSLNAAMGPAVFNGKDSPKCQQLAKNNLLALPRPSALGILSNSGPPKKRHKGWSPESPSAPDGGCPQGGGNRAKYESAGMSCVPQVGLVGPASVTFPVVASGEPVSVPDNLLKICKAKPVIFKVFVNGATQMVALGPAEPASPRSL

SEQ ID NO: 880033 - protein, 1061 aa, Homo sapiens
MGNSYAGQLKTTRFEEVLHNSIEASLRSNNLVPRPIFSQLYLEAEQQLAALEGGSRVDNEEEEEEGEGGLETNGPPNPFQLHPLPEGCCTTDGFCQAGKDLRLVSISNEPMDVPAGFLLVGVKSPSLPDHLLVCAVDKRFLPDDNGHNALLGFSGNCVGCGKKGFCYFTEFSNHINLKLTTQPKKQKHLKYYLVRNAQGTLTKGPLICWKGSEFRSRQIPASTCSSSLFPALESTAAFPSEPVPGTNPSILMGAQQAGPASDHPSLNAAMGPAVFNGKDSPKCQQLAKNNLLALPRPSALGILSNSGPPKKRHKGWSPESPSAPDGGCPQGGGNRAKYESAGMSCVPQVGLVGPASVTFPVVASGEPVSVPDNLLKICKAKPVIFKGHGNFPYLCGNLNDVVVSPLLYTCYQNSQSVSRAYEQYGASAIQPISEEMQLLLTVYYLVQLAADQVPLMEDLEQIFLRSWRESHLTEIRQYQQAPPQPFPPAPSAAAPVTSAQLPWLASLAASSCNDSVHVIECAYSLAEGLSEMFRLLVEGKLAKTNYVVIICACRSAAIDSCIAVTGKYQARILSESLLTPAEYQKEVNYELVTGKVDSLGAFFSTLCPEGDIDILLDKFHQENQGHISSSLAASSVTKAASLDVSGTPVCTSYNLEPHSIRPFQLAVAQKLLSHVCSIADSSTQNLDLGSFEKVDFLICIPPSEVTYQQTLLHVWHSGVLLELGLKKEHMTKQRVEQYVLKLDTEAQTKFKAFLQNSFQNPHTLFVLIHDHAHWDLVSSTVHNLYSQSDPSVGLVDRLLNCREVKEAPNIVTLHVTSFPYALQTQHTLISPYNEIHWPASCSNGVDLYHENKKYFGLSEFIESTLSGHSLPLLRYDSSFEAMVTALGKRFPRLHSAVIRTFVLVQHYAAALMAVSGLPQMKNYTSVETLEITQNLLNSPKQCPCGHGLMVLLRVPCSPLAVVAYERLAHVRARLALEEHFEIILGSPSSGVTVGKHFVKQLRMWQKIEDVEWRPQTYLELEGLPCILIFSGMDPHGESLPRSLRYCDLRLINSSCLVRTAL

SEQ ID NO: 880034 - protein, 810 aa, Homo sapiens
MGAQQAGPASDHPSLNAAMGPAVFNGKDSPKCQQLAKNNLLALPRPSALGILSNSGPPKKRHKGWSPESPSAPDGGCPQGGGNRAKYESAGMSCVPQVGLVGPASVTFPVVASGEPVSVPDNLLKICKAKPVIFKGHGNFPYLCGNLNDVVVSPLLYTCYQNSQSVSRAYEQYGASAIQPISEEMQLLLTVYYLVQLAADQVPLMEDLEQIFLRSWRESHLTEIRQYQQAPPQPFPPAPSAAAPVTSAQLPWLASLAASSCNDSVHVIECAYSLAEGLSEMFRLLVEGKLAKTNYVVIICACRSAAIDSCIAVTGKYQARILSESLLTPAEYQKEVNYELVTGKVDSLGAFFSTLCPEGDIDILLDKFHQENQGHISSSLAASSVTKAASLDVSGTPVCTSYNLEPHSIRPFQLAVAQKLLSHVCSIADSSTQNLDLGSFEKVDFLICIPPSEVTYQQTLLHVWHSGVLLELGLKKEHMTKQRVEQYVLKLDTEAQTKFKAFLQNSFQNPHTLFVLIHDHAHWDLVSSTVHNLYSQSDPSVGLVDRLLNCREVKEAPNIVTLHVTSFPYALQTQHTLISPYNEIHWPASCSNGVDLYHENKKYFGLSEFIESTLSGHSLPLLRYDSSFEAMVTALGKRFPRLHSAVIRTFVLVQHYAAALMAVSGLPQMKNYTSVETLEITQNLLNSPKQCPCGHGLMVLLRVPCSPLAVVAYERLAHVRARLALEEHFEIILGSPSSGVTVGKHFVKQLRMWQKIEDVEWRPQTYLELEGLPCILIFSGMDPHGESLPRSLRYCDLRLINSSCLVRTAL

SEQ ID NO: 880035 - protein, 719 aa, Homo sapiens
MSCVPQVGLVGPASVTFPVVASGEPVSVPDNLLKICKAKPVIFKGHGNFPYLCGNLNDVVVSPLLYTCYQNSQSVSRAYEQYGASAIQPISEEMQLLLTVYYLVQLAADQVPLMEDLEQIFLRSWRESHLTEIRQYQQAPPQPFPPAPSAAAPVTSAQLPWLASLAASSCNDSVHVIECAYSLAEGLSEMFRLLVEGKLAKTNYVVIICACRSAAIDSCIAVTGKYQARILSESLLTPAEYQKEVNYELVTGKVDSLGAFFSTLCPEGDIDILLDKFHQENQGHISSSLAASSVTKAASLDVSGTPVCTSYNLEPHSIRPFQLAVAQKLLSHVCSIADSSTQNLDLGSFEKVDFLICIPPSEVTYQQTLLHVWHSGVLLELGLKKEHMTKQRVEQYVLKLDTEAQTKFKAFLQNSFQNPHTLFVLIHDHAHWDLVSSTVHNLYSQSDPSVGLVDRLLNCREVKEAPNIVTLHVTSFPYALQTQHTLISPYNEIHWPASCSNGVDLYHENKKYFGLSEFIESTLSGHSLPLLRYDSSFEAMVTALGKRFPRLHSAVIRTFVLVQHYAAALMAVSGLPQMKNYTSVETLEITQNLLNSPKQCPCGHGLMVLLRVPCSPLAVVAYERLAHVRARLALEEHFEIILGSPSSGVTVGKHFVKQLRMWQKIEDVEWRPQTYLELEGLPCILIFSGMDPHGESLPRSLRYCDLRLINSSCLVRTAL

SEQ ID NO: 880036 - protein, 837 aa, Homo sapiens
GLCGDILSQLTLPDSPGRMQGRILPAWSQGGKTWQAAPSEALEGALPTRCPIGGAGGVTGGGCLALGKSLPPAPSLVKNKRIGRNEPASGTAPLVRKGDSSHPRLQEGEQVHSMSKASQDRALEGPGAAHLSPSVPSPPENPHVWDRKLCTRLGAKSLLSSAGHGNFPYLCGNLNDVVVSPLLYTCYQNSQSVSRAYEQYGASAIQPISEEMQLLLTVYYLVQLAADQVPLMEDLEQIFLRSWRESHLTEIRQYQQAPPQPFPPAPSAAAPVTSAQLPWLASLAASSCNDSVHVIECAYSLAEGLSEMFRLLVEGKLAKTNYVVIICACRSAAIDSCIAVTGKYQARILSESLLTPAEYQKEVNYELVTGKVDSLGAFFSTLCPEGDIDILLDKFHQENQGHISSSLAASSVTKAASLDVSGTPVCTSYNLEPHSIRPFQLAVAQKLLSHVCSIADSSTQNLDLGSFEKVDFLICIPPSEVTYQQTLLHVWHSGVLLELGLKKEHMTKQRVEQYVLKLDTEAQTKFKAFLQNSFQNPHTLFVLIHDHAHWDLVSSTVHNLYSQSDPSVGLVDRLLNCREVKEAPNIVTLHVTSFPYALQTQHTLISPYNEIHWPASCSNGVDLYHENKKYFGLSEFIESTLSGHSLPLLRYDSSFEAMVTALGKRFPRLHSAVIRTFVLVQHYAAALMAVSGLPQMKNYTSVETLEITQNLLNSPKQCPCGHGLMVLLRVPCSPLAVVAYERLAHVRARLALEEHFEIILGSPSSGVTVGKHFVKQLRMWQKIEDVEWRPQTYLELEGLPCILIFSGMDPHGESLPRSLRYCDLRLINSSCLVRTAL

SEQ ID NO: 880037 - protein, 719 aa, Homo sapiens; identical to SEQ ID NO: 880035

SEQ ID NO: 880038 - protein, 137 aa, Homo sapiens
MGNSYAGQLKTTRFEEVLHNSIEASLRSNNLVPRPIFSQLYLEAEQQLAALEGGSRVDNEEEEEEGEGGLETNGPPNPFQLHPLPEGCCTTDGEPLPAPGQAVPAMLPGGSGQAGDWACDCVLQGSSLLFLFAFPEV

SEQ ID NO: 880039 - protein, 150 aa, Homo sapiens
MAVSGLPQMKNYTSVETLEITQNLLNSPKQCPCGHGLMVLLRVPCSPLAVVAYERLAHVRARLALEEHFEIILGSPSSGVTVGKHFVKQLRMWQKIEDVEWRPQTYLELEGLPCILIFSGMDPHGESLPRSLRYCDLRLINSSCLVRTAL

SEQ ID NO: 880040 - protein, 86 aa, Homo sapiens
ILLKMGNSYAGQLKTTRFEEVLHNSIEASLRSNNLVPRPIFSQLYLEAEQQLAALEGGRRTLLLSVYFFYCAQLMLAPELETLFFM

SEQ ID NO: 880041 - protein, 120 aa, Homo sapiens
MSVSSKETCPAPPGPERSPAARAPAAASSLGPVSTAGRAPRGLDMSAQEPPQGRRFPIEAGDSRGLAAAPESQDSPEAVATEHNPVRPLRRCPGCHCLTLLHVPIDVYLAMGGSPRARAT

SEQ ID NO: 880042 - protein, 127 aa, Homo sapiens
MLPSSTPGPGHATETCPAPPGPERSPAARAPAAASSLGPVSTAGRAPRGLDMSAQEPPQGRRFPIEAGDSRGLAAAPESQDSPEAVATEHNPVRPLRRCPGCHCLTLLHVPIDVYLAMGGSPRARAT

SEQ ID NO: 880043 - protein, 105 aa, Homo sapiens
MGAGARRRRPATRERPDRHSPRRAPRGLDMSAQEPPQGRRFPIEAGDSRGLAAAPESQDSPEAVATEHNPVRPLRRCPGCHCLTLLHVPIDVYLAMGGSPRARAT

SEQ ID NO: 880044 - protein, 130 aa, Homo sapiens
MARAPPPPPPVPRPRPPSHLAPPAVRTPHPRPDPRGPQVHSLGAPHRMGQAPASAAPVARQFPQAASSLPWMPLPDAAARAHRRLPRHGREPPGPRHVSAPAPCGSAGAGRERGPQRATTLRSHAPSTRQ

SEQ ID NO: 880045 - protein, 107 aa, Homo sapiens
MSVSSKETCPAPPGPERSPAARAPAAASSLGPVSTAGRAPRGLDMSAQEPPQGRRFPIEAGDSRGLAAAPESQDSPEAVATEHNPVSGPCRASISPGRFVAALDATA

SEQ ID NO: 880046 - protein, 210 aa, Homo sapiens
MDNCLAAAALNGVDRRSLQRSARLALEVLERAKRRAVDWHALERPKGCMGVLAREAPHLEKQPAAGPQRVLPGEREERPPTLSASFRTMAEFMDYTSSQCGKYYSSVPEEGGATHVYRYHRGESKLHMCLDIGNGQRKDRKKTSLGPGGSYQISEHAPEASQPAENISKDLYIEVYPGTYSVTVGSNDLTKKTHVVAVDSGQSVDLVFPV

SEQ ID NO: 880047 - protein, 183 aa, Homo sapiens
MDNCLAAAALNGVDRRSLQRSARLALEVLERAKRRAVDWHALERPKGCMGVLAREAPHLEKQPAAGPQRVLPGEKYYSSVPEEGGATHVYRYHRGESKLHMCLDIGNGQRKDRKKTSLGPGGSYQISEHAPEASQPAENISKDLYIEVYPGTYSVTVGSNDLTKKTHVVAVDSGQSVDLVFPV

SEQ ID NO: 880048 - protein, 156 aa, Homo sapiens
MDNCLAAAALNGVDRRSLQRSARLALEVLERAKRRAVDWHALERPKGCMGVLAREAPHLEKQPAAGPQRVLPGEKYYSSVPEEGGATHVYRYHRGESKLHMCLDIGNGQAENISKDLYIEVYPGTYSVTVGSNDLTKKTHVVAVDSGQSVDLVFPV

SEQ ID NO: 880049 - protein, 168 aa, Homo sapiens
MDNCLAAAALNGVDRRSLQRSARLALEVLERAKRRAVDWHALERPKGCMGVLAREAPHLEKQPAAGPQRVLPGEKYYSSVPEEGGATHVYRYHRGESKLHMCLDIGNGQRKDRKKTSLGPGGSYQISEHAPEASQPVSTELLTHWVSPPLQLHEPVDMVLRGLFELSL

SEQ ID NO: 880050 - protein, 97 aa, Homo sapiens
GVDRRSLQRSARLALEVLERAKRRAVDWHALERPKGCMGVLAREAPHLEKQPAAGPQRVLPGEVRVAVPGAAPVLRAAVARWEPGVRSAEAAEETFP

SEQ ID NO: 880051 - protein, 89 aa, Homo sapiens
NVVFFFLCPNDRLVPDVPALATKITARALPGQAGGGRQPGDAVSVSKLRIWAVSQGRSGSWMRGLEFPGDLQTCTATLPCSCLLASVQC

SEQ ID NO: 880052 - protein, 118 aa, Homo sapiens
TPLYRGSHGIILSSLFREAAPGISHPHPWVGSLTSAHTDPGGGSALRRCPSYQLGCSFWGQGAHRGSHVWPWCALSAREAAVRCWLRGRVVGVGPSRMAAVCRTCWETPGLQTVAPVP

SEQ ID NO: 880053 - protein, 111 aa, Homo sapiens
LQQCLRSVTTQMLGYLRKESFKNCSLHCSHCVLFFVCMYVFIHTEMGSCSVTRVACSGAITACSSGSFCLSLPATDVAEAGESFEPGRCRLQCAEIAPLHPSLGKRAELSL

SEQ ID NO: 880054 - protein, 231 aa, Homo sapiens
PVGSHAGLHTGTDSCAHHQGTWWGCGIQNYIHTSAWHPLIESQGSVTRELHAQVLASAHLAHHSRQEKAITTPSQHPLGPQLPQVIAATGAARGQGPGPQASAGSSSRSAECSLAVSVEEERVEVGGRGGTPRPLASSGVRTRSSGAPATPLLPAPCSSTYFFLGARDLNVAVLRLSEGSQRPASPSPLGSSAGPGAGSPGCSSSGGPSAPGPRSASSSSPSSASSGPDCG

SEQ ID NO: 880055 - protein, 48 aa, Homo sapiens
MGGSGCHNDKGAWLTSRQGCAMGDCQAGQPHPQHKQCPAEKPSPSPAG

SEQ ID NO: 880056 - protein, 54 aa, Homo sapiens
LSRLIPNGRKRSSLCPPTPAPKQMQVSPFPWSYFTPLPPGIRIIISSSLDWLCF

SEQ ID NO: 880057 - protein, 190 aa, Homo sapiens
MPLEVVVELQIRAISCPGVFLPGKQDVYLGVYLMNQYLETNSFPSAFPIMIQESMRFEKVFESAVDPGAVVDLLEMWDELAYYEENTRDFLFPEPKLTPSHPRRCREVLMKTALGFPGIAPKIEFSTRTAIRECVFLHRNRFLGWGNKGKMLVQQEHRSLKKKLNRNGTQTSGEGLLSWMLLQEFEGRKT

SEQ ID NO: 880058 - protein, 306 aa, Homo sapiens
DPSRWEGPGLGGTVGEQGRGTGEASGNICSRYSAKLRKMVQGSAQKDLLIPVLSPTQGTMPLEVVVELQIRAISCPGVFLPGKQDVYLGVYLMNQYLETNSFPSAFPIMIQESMRFEKVFESAVDPGAVVDLLEMWDELAYYEENTRDFLFPEPKLTPSHPRRCREVLMKTALGFPGIAPKIEFSTRTAIRECVFLHRNRFLEERHESRRPLSTSHEPIFPLNTIKMKLKENNLNRLPKGMQARAPSQYSTRHFFQDQPAQLNLGNNFKISGGSKPPFVVRHVSLKLFFRAFCNSEDMDEGGRKEG

SEQ ID NO: 880059 - protein, 165 aa, Homo sapiens
MPLEVVVELQIRAISCPGVFLPGKQDVYLGVYLMNQYLETNSFPSAFPIMIQESMRFEKVFESAVDPGAVVDLLESFLARFELIQLVPPVWDELAYYEENTRDFLFPEPKLTPSHPRRCREVLMKTALGFPGIAPKIEFSTRTAIRECVFLHRNRFLVDSKSWLL

SEQ ID NO: 880060 - protein, 313 aa, Homo sapiens
MPLEVVVELQIRAISCPGVFLPGKQDVYLGVYLMNQYLETNSFPSAFPIMIQESMRFEKVFESAVDPGAVVDLLESFLARFELIQLVPPVWDELAYYEENTRDFLFPEPKLTPSHPRRCREVLMKTALGFPGIAPKIEFSTRTAIRECVFLHRNRFLEERHESRRPLSTSHEPIFPLNTIKMKLKENNLNRLPKGMQARAPSQYSTRHFFQDQPAQLNLGNNFKISGGSKPPFVVRHVDSAKPFGENISEHHLRRSRRKSKFSDFPFPTRRASSLDSLAANVKVIKEPDERIVLRSDSSSCLDSSQFGKSSSQ

SEQ ID NO: 880061 - protein, 151 aa, Homo sapiens [sequence omitted]

SEQ ID NO: 880062 - protein, 158 aa, Homo sapiens
DPSRWEGPGLGGTVGEQGRGTGEASGNICSRYSAKLRKMVQGSAQKDLLIPVLSPTQGTMPLEVVVELQIRAISCPGVFLPGKQDVYLGVYLMNQYLETNSFPSAFPIMIQESMRFEKVFESAVDPGAVVDLLESFLARFELIQLVPPGNVAVNPFLN

SEQ ID NO: 880063 - protein, 685 aa, Homo sapiens
ARIRRAVFRAGLGAESMGSDPSAPGRPGWTGSLLGDREEAARPRLLPLLLVLLGCLGLGVAAEDAEVHAENWLRLYGYLPQPSRHMSTMRSAQILASALAEMQRFYGIPVTGVLDEETKEWMKRPRCGVPDQFGVRVKANLRRRRKRYALTGRKWNNHHLTFSIQNYTEKLGWYHSMEAVRRAFRVWEQATPLVFQEVPYEDIRLRRQKEADIMVLFASGFHGDSSPFDGTGGFLAHAYFPGPGLGGDTHFDADEPWTFSSTDLHGNNLFLVAVHELGHALGLEHSSNPNAIMAPFYQWKDVDNFKLPEDDLRGIQQLYGTPDGQPQPTQPLPTVTPRRPGRPDHRPPRPPQPPPPGGKPERPPKPGPPVQPRATERPDQYGPNICDGDFDTVAMLRGEMFVFKGRWFWRVRHNRVLDNYPMPIGHFWRGLPGDISAAYERQDGRFVFFKGDRYWLFREANLEPGYPQPLTSYGLGIPYDRIDTAIWWEPTGHTFFFQEDRYWRFNEETQRGDPGYPKPISVWQGIPASPKGAFLSNDAAYTYFYKGTKYWKFDNERLRMEPGYPKSILRDFMGCQEHVEPGPRWPDVARPPFNPHGGAEPGADSAEGDVGDGDGDFGAGVNKDGGSRVVVQMEEVARTVNVVMVLVPLLLLLCVLGLTYALVQMQRKGAPRVLLYCKRSLQEWV

SEQ ID NO: 880064 - protein, 264 aa, Homo sapiens [sequence omitted]

SEQ ID NO: 880065 - protein, 685 aa, Homo sapiens; identical to SEQ ID NO: 880063

SEQ ID NO: 880066 - protein, 85 aa, Homo sapiens
PRILGGETLLGIGHTAHQTVTHRRTPYSLRAPLLCSVLSDRGLLPRMPSPSKQEPVATVENGTVTARLSLPSWRLSGPPGPLLPK

SEQ ID NO: 880067 - protein, 90 aa, Homo sapiens
NNLFLVAVHELGHALGLEHSSNPNAIMAPFYQWKDVDNFKLPEDDLRGIQQLYGAWAVTSGLCMPLSSPWPMRSRHCCHPHFVDEEPKAQ

SEQ ID NO: 880068 - protein, 685 aa, Homo sapiens; identical to SEQ ID NO: 880063

SEQ ID NO: 880069 - protein, 685 aa, Homo sapiens; identical to SEQ ID NO: 880063

SEQ ID NO: 880070 - protein, 141 aa, Homo sapiens
IESAPFVVSSNERLRMEPGYPKSILRDFMGCQEHVEPGPRWPDVARPPFNPHGGAEPGADSAEGDVGDGDGDFGAGVNKDGGSRVVVQMEEVARTVNVVMVLVPLLLLLCVLGLTYALVQMQRKGAPRVLLYCKRSLQEWV

SEQ ID NO: 880071 - protein, 158 aa, Homo sapiens
LLGCLGLGVAAEDAEVHAEVRPPPCPLAAGWGLGGRGATSAGWDLEVEGAETRPLFWAVAGKQADLAVCPSPARPLQRTSSQTLEGAGPRSPPRYSYSPVLGTEPPPRPPYIQPVSREPLPPPPALASPPSFPPGQPIPREPGWRAVALFASGEGAAL

SEQ ID NO: 880072 - protein, 528 aa, Homo sapiens
SVHSSFQPWRGPVVNSLSLWRLDAVGSCSSTGSASRRCAGPAGAVARPGGAPGLWVQKGARVKLSAGSAALRCHAGGGQHWESSFSCCSGFLDGMPSEILLKIFSYLDAVSLLCTGCVSRRFYHLANDNFIWIGIYSTAFSPARSNWKFNSVEKIAMSMSFLSVQDKEAGYWKKEYITKQIASVKAALADILKPVNPYTGLPVKTKEALRIFGLGWAIILKEKGGKEYIMEHVDLSINDTSVTVIWYGKKWPCLASLSTLDLCGMTPVFTDWYKTPTKHRLRWHSLIAKYNLSHLTISTMIGCDRLIRIFCLHPGLLVGVWKKEEELAFVMANLHFHHLVERSTLGSATIPYELPPHSPFLDDSPEYGLHGYQLHVDLHSGGVFYLCGTFRNLFTKRGNIENGHVKLIVIHLKNNREHLPLIGKVGLSWKTDIFDGCIKSCSMMDVTLLDEHGKPFWCFSSPVCLRSPATPSDSSSFLGQTYNVDYVDAEGRVHVELVWIRETEEYLIVNLVLYLSIAKINHWFGTEY

SEQ ID NO: 880073 - protein, 528 aa, Homo sapiens; identical to SEQ ID NO: 880072

SEQ ID NO: 880074 - protein, 528 aa, Homo sapiens; identical to SEQ ID NO: 880072

SEQ ID NO: 880075 - protein, 528 aa, Homo sapiens; identical to SEQ ID NO: 880072

SEQ ID NO: 880076 - protein, 571 aa, Homo sapiens
SVHSSFQPWRGPVVNSLSLWRLDAVGSCSSTGSASRRCAGPAGAVARPGGAPGLWVQVTVGPAGGVPWREARHCAAPLSSPCILFVQLGARPVAVFNVRRKGARVKLSAGSAALRCHAGGGQHWESSFSCCSGFLDGMPSEILLKIFSYLDAVSLLCTGCVSRRFYHLANDNFIWIGIYSTAFSPARSNWKFNSVEKIAMSMSFLSVQDKEAGYWKKEYITKQIASVKAALADILKPVNPYTGLPVKTKEALRIFGLGWAIILKEKGGKEYIMEHVDLSINDTSVTVIWYGKKWPCLASLSTLDLCGMTPVFTDWYKTPTKHRLRWHSLIAKYNLSHLTISTMIGCDRLIRIFCLHPGLLVGVWKKEEELAFVMANLHFHHLVERSTLGSATIPYELPPHSPFLDDSPEYGLHGYQLHVDLHSGGVFYLCGTFRNLFTKRGNIENGHVKLIVIHLKNNREHLPLIGKVGLSWKTDIFDGCIKSCSMMDVTLLDEHGKPFWCFSSPVCLRSPATPSDSSSFLGQTYNVDYVDAEGRVHVELVWIRETEEYLIVNLVLYLSIAKINHWFGTEY

SEQ ID NO: 880077 - protein, 209 aa, Homo sapiens
MTKKEEELAFVMANLHFHHLVERSTLGSATIPYELPPHSPFLDDSPEYGLHGYQLHVDLHSGGVFYLCGTFRNLFTKRGNIENGHVKLIVIHLKNNREHLPLIGKVGLSWKTDIFDGCIKSCSMMDVTLLDEHGKPFWCFSSPVCLRSPATPSDSSSFLGQTYNVDYVDAEGRVHVELVWIRETEEYLIVNLVLYLSIAKINHWFGTEY

SEQ ID NO: 880078 - protein, 588 aa, Homo sapiens
SVHSSFQPWRGPVVNSLSLWRLDAVGSCSSTGSASRRCAGPAGAVARPGGAPGLWVQVTVGPAGGVPWREARHCAAPLSSPCILFVQLGARPVAVFNVRRPTVRVYISKPLGESTSEKGPGVKLSAGSAALRCHAGGGQHWESSFSCCSGFLDGMPSEILLKIFSYLDAVSLLCTGCVSRRFYHLANDNFIWIGIYSTAFSPARSNWKFNSVEKIAMSMSFLSVQDKEAGYWKKEYITKQIASVKAALADILKPVNPYTGLPVKTKEALRIFGLGWAIILKEKGGKEYIMEHVDLSINDTSVTVIWYGKKWPCLASLSTLDLCGMTPVFTDWYKTPTKHRLRWHSLIAKYNLSHLTISTMIGCDRLIRIFCLHPGLLVGVWKKEEELAFVMANLHFHHLVERSTLGSATIPYELPPHSPFLDDSPEYGLHGYQLHVDLHSGGVFYLCGTFRNLFTKRGNIENGHVKLIVIHLKNNREHLPLIGKVGLSWKTDIFDGCIKSCSMMDVTLLDEHGKPFWCFSSPVCLRSPATPSDSSSFLGQTYNVDYVDAEGRVHVELVWIRETEEYLIVNLVLYLSIAKINHWFGTEY

SEQ ID NO: 880079 - protein, 401 aa, Homo sapiens
SVHSSFQPWRGPVVNSLSLWRLDAVGSCSSTGSASRRCAGPAGAVARPGGAPGLWVQKGARVKLSAGSAALRCHAGGGQHWESSFSCCSGFLDGMPSEILLKIFSYLDAVSLLCTGCVSRRFYHLANDNFIWIGIYSTAFSPARSNWKFNSVEKIAMSMSFLSVQDKEAGYWKKEYITKQIASVKAALADILKPVNPYTGLPVKTKEALRIFGLGWAIILKEKGGKEYIMEHVDLSINDTSVTVIWYGKKWPCLASLSTLDLCGMTPVFTDWYKTPTKHRLRWHSLIAKYNLSHLTISTMIGCDRLIRIFCLHPGLLVGVWKKEEELAFVMANLHFHHLVERSTLGSATIPYELPPHSPFLDDSPEYGLHGYQLHVDLHSGGVFYLCGTFRNLFTKRGEID

SEQ ID NO: 880080 - protein, 98 aa, Homo sapiens
LQPWRWTWGSGLKKLSGRGCASQGVQTSHSWLSPLHCSASLHPDSSSPAASGQPVSLKNISTDTSGYYICTSSNEEGTQFCNITVAVRSRKSSLRGEG

SEQ ID NO: 880081 - protein, 319 aa, Homo sapiens
MVGKMWPVLWTLCAVRVTVDAISVETPQDVLRASQGKSVTLPCTYHTSTSSREGLIQWDKLLLTHTERVVIWPFSNKNYIHGELYKNRVSISNNAEQSDASITIDQLTMADNGTYECSVSLMSDLEGNTKSRVRLLVLVPPSKPECGIEGETIIGNNIQLTCQSKEGSPTPQYSWKRYNILNQEQPLAQPASGQPVSLKNISTDTSGYYICTSSNEEGTQFCNITVAVRSPSMNVALYVGIAVGVVAALIIIGIIIYCCCCRGKDDNTEDKEDARPNREAYEEPPEQLRELSREREEEDDYRQEEQRSTGRESPDHLDQ

SEQ ID NO: 880082 - protein, 80 aa, Homo sapiens
AAASLPEEPDGGGGPDDLLPLPLWLVAEGIFRPQGERRKSGRKDKSGQSGDGRGETRDKTRSSGLPNTVKRTFNEIQRKR

SEQ ID NO: 880083 - protein, 513 aa, Homo sapiens
MASVLSRRLGKRSLLGARVLGPSASEGPSAAPPSEPLLEGAAPQPFTTSDDTPCQEQPKEVLKAPSTSGLQQVAFQPGQKVYVWYGGQECTGLVEQHSWMEGQVTVWLLEQKLQVCCRVEEVWLAELQGPCPQAPPLEPGAQALAYRPVSRNIDVPKRKSDAVEMDEMMAAMVLTSLSCSPVVQSPPGTEANFSASRAACDPWKESGDISDSGSSTTSGHWSGSSGVSTPSPPHPQASPKYLGDAFGSPQTDHGFETDPDPFLLDEPAPRKRKNSVKVMYKCLWPNCGKVLRSIVGIKRHVKALHLGDTVDSDQFKREEDFYYTEVQLKEESAAAAAAAAAGTPVPGTPTSEPAPTPSMTGLPLSALPPPLHKAQSSGPEHPGPESSLPSGALSKSAPGSFWHIQADHAYQALPSFQIPVSPHIYTSVSWAAAPSAACSLSPVRSRSLSFSEPQQPAPAMKSHLIVTSPPRAQSGARKARGEAKKCRKVYGIEHRDQWCTACRWKKACQRFLD

SEQ ID NO: 880084 - protein, 513 aa, Homo sapiens; identical to SEQ ID NO: 880083

SEQ ID NO: 880085 - protein, 513 aa, Homo sapiens; identical to SEQ ID NO: 880083

SEQ ID NO: 880086 - protein, 513 aa, Homo sapiens; identical to SEQ ID NO: 880083

SEQ ID NO: 880087 - protein, 540 aa, Homo sapiens
RVLWTQAGSLRGSAEQGPGEEERRGSSMASVLSRRLGKRSLLGARVLGPSASEGPSAAPPSEPLLEGAAPQPFTTSDDTPCQEQPKEVLKAPSTSGLQQVAFQPGQKVYVWYGGQECTGLVEQHSWMEGQVTVWLLEQKLQVCCRVEEVWLAELQGPCPQAPPLEPGAQALAYRPVSRNIDVPKRKSDAVEMDEMMAAMVLTSLSCSPVVQSPPGTEANFSASRAACDPWKESGDISDSGSSTTSGHWSGSSGVSTPSPPHPQASPKYLGDAFGSPQTDHGFETDPDPFLLDEPAPRKRKNSVKVMYKCLWPNCGKVLRSIVGIKRHVKALHLGDTVDSDQFKREEDFYYTEVQLKEESAAAAAAAAAGTPVPGTPTSEPAPTPSMTGLPLSALPPPLHKAQSSGPEHPGPESSLPSGALSKSAPGSFWHIQADHAYQALPSFQIPVSPHIYTSVSWAAAPSAACSLSPVRSRSLSFSEPQQPAPAMKSHLIVTSPPRAQSGARKARGEAKKCRKVYGIEHRDQWCTACRWKKACQRFLD

SEQ ID NO: 880088 - protein, 470 aa, Homo sapiens
TLAGSSVAVSGDHECTGLVEQHSWMEGQVTVWLLEQKVYVWYGGQECTGLVEQHSWMEGQVTVWLLEQKLQVCCRVEEVWLAELQGPCPQAPPLEPGAQALAYRPVSRNIDVPKRKSDAVEMDEMMAAMVLTSLSCSPVVQSPPGTEANFSASRAACDPWKESGDISDSGSSTTSGHWSGSSGVSTPSPPHPQASPKYLGDAFGSPQTDHGFETDPDPFLLDEPAPRKRKNSVKVMYKCLWPNCGKVLRSIVGIKRHVKALHLGDTVDSDQFKREEDFYYTEVQLKEESAAAAAAAAAGTPVPGTPTSEPAPTPSMTGLPLSALPPPLHKAQSSGPEHPGPESSLPSGALSKSAPGSFWHIQADHAYQALPSFQIPVSPHIYTSVSWAAAPSAACSLSPVRSRSLSFSEPQQPAPAMKSHLIVTSPPRAQSGARKARGEAKKCRKVYGIEHRDQWCTACRWKKACQRFLD

SEQ ID NO: 880089 - protein, 513 aa, Homo sapiens; identical to SEQ ID NO: 880083

SEQ ID NO: 880090 - protein, 149 aa, Homo sapiens [sequence omitted]

SEQ ID NO: 880091 - protein, 513 aa, Homo sapiens; identical to SEQ ID NO: 880083

SEQ ID NO: 880092 - protein, 513 aa, Homo sapiens; identical to SEQ ID NO: 880083

SEQ ID NO: 880093 - protein, 1070 aa, Homo sapiens
MCFSFIMPPAMADILDIWAVDSQIASDGSIPVDFLLPTGIYIQLEVPREATISYIKQMLWKQVHNYPMFNLLMDIDSYMFACVNQTAVYEELEDETRRLCDVRPFLPVLKLVTRSCDPGEKLDSKIGVLIGKGLHEFDSLKDPEVNEFRRKMRKFSEEKILSLVGLSWMDWLKQTYPPEHEPSIPENLEDKLYGGKLIVAVHFENCQDVFSFQVSPNMNPIKVNELAIQKRLTIHGKEDEVSPYDYVLQVSGRVEYVFGDHPLIQFQYIRNCVMNRALPHFILVECCKIKKMYEQEMIAIEAAINRNSSNLPLPLPPKKTRIISHVWENNNPFQIVLVKGNKLNTEETVKVHVRAGLFHGTELLCKTIVSSEVSGKNDHIWNEPLEFDINICDLPRMARLCFAVYAVLDKVKTKKSTKTINPSKYQTIRKAGKVHYPVAWVNTMVFDFKGQLRTGDIILHSWSSFPDELEEMLNPMGTVQTNPYTENATALHVKFPENKKQPYYYPPFDKIIEKAAEIASSDSANVSSRGGKKFLPVLKEILDRDPLSQLCENEMDLIWTLRQDCREIFPQSLPKLLLSIKWNKLEDVAQLQALLQIWPKLPPREALELLDFNYPDQYVREYAVGCLRQMSDEELSQYLLQLVQVLKYEPFLDCALSRFLLERALGNRRIGQFLFWHLRSEVHIPAVSVQFGVILEAYCRGSVGHMKVLSKQVEALNKLKTLNSLIKLNAVKLNRAKGKEAMHTCLKQSAYREALSDLQSPLNPCVILSELYVEKCKYMDSKMKPLWLVYNNKVFGEDSVGVIFKNGDDLRQDMLTLQMLRLMDLLWKEAGLDLRMLPYGCLATGDRSGLIEVVSTSETIADIQLNSSNVAAAAAFNKDALLNWLKEYNSGDDLDRAIEEFTLSCAGYCVASYVLGIGDRHSDNIMVKKTGQLFHIDFGHILGNFKSKFGIKRERVPFILTYDFIHVIQQGKTGNTEKFGRFRQCCEDAYLILRRHGNLFITLFALMLTAGLPELTSVKDIQYLKDSLALGKSEEEALKQFKQKFDEALRESWTTKVNWMAHTVRKDYRS

SEQ ID NO: 880094 - protein, 1070 aa, Homo sapiens; identical to SEQ ID NO: 880093

SEQ ID NO: 880095 - protein, 1053 aa, Homo sapiens
MCFSFIMPPAMADILDIWAVDSQIASDGSIPVDFLLPTGIYIQLEVPREATISYIKQMLWKQVHNYPMFNLLMDIDSYMFACVNQTAVYEELEDETRRLCDVRPFLPVLKLVTRSCDPGEKLDSKIGVLIGKGLHEFDSLKDPEVNEFRRKMRKFSEEKILSLVGLSWMDWLKQTYPPEHEPSIPENLEDKLYGGKLIVAVHFENCQDVFSFQVSPNMNPIKVNELAIQKRLTIHGKEDEVSPYDYVLQVSGRVEYVFGDHPLIQFQYIRNCVMNRALPHFILVECCKIKKMYEQEMIAIEAAINRNSSNLPLPLPPKKTRIISHVWENNNPFQIVLVKGNKLNTEETVKVHVRAGLFHGTELLCKTIVSSEVSGKNDHIWNEPLEFDINICDLPRMARLCFAVYAVLDKVKTKKSTKTINPSKYQTIRKAGKVHYPVAWVNTMVFDFKGQLRTGDIILHSWSSFPDELEEMLNPMGTVQTNPYTENATALHVKFPENKKQPYYYPPFDKSRGGKKFLPVLKEILDRDPLSQLCENEMDLIWTLRQDCREIFPQSLPKLLLSIKWNKLEDVAQLQALLQIWPKLPPREALELLDFNYPDQYVREYAVGCLRQMSDEELSQYLLQLVQVLKYEPFLDCALSRFLLERALGNRRIGQFLFWHLRSEVHIPAVSVQFGVILEAYCRGSVGHMKVLSKQVEALNKLKTLNSLIKLNAVKLNRAKGKEAMHTCLKQSAYREALSDLQSPLNPCVILSELYVEKCKYMDSKMKPLWLVYNNKVFGEDSVGVIFKNGDDLRQDMLTLQMLRLMDLLWKEAGLDLRMLPYGCLATGDRSGLIEVVSTSETIADIQLNSSNVAAAAAFNKDALLNWLKEYNSGDDLDRAIEEFTLSCAGYCVASYVLGIGDRHSDNIMVKKTGQLFHIDFGHILGNFKSKFGIKRERVPFILTYDFIHVIQQGKTGNTEKFGRFRQCCEDAYLILRRHGNLFITLFALMLTAGLPELTSVKDIQYLKDSLALGKSEEEALKQFKQKFDEALRESWTTKVNWMAHTVRKDYRS

SEQ ID NO: 880096 - protein, 1027 aa, Homo sapiens
MCFSFIMPPAMADILDIWAVDSQIASDGSIPVDFLLPTGIYIQLEVPREATISYIKQMLWKQVHNYPMFNLLMDIDSYMFACVNQTAVYEELEDETRRLCDVRPFLPVLKLVTRSCDPGEKLDSKIGVLIGKGLHEFDSLKDPEVNEFRRKMRKFSEEKILSLVGLSWMDWLKQTYPPEHEPSIPENLEDKLYGGKLIVAVHFENCQDVFSFQVSPNMNPIKVNELAIQKRLTIHGKEDEVSPYDYVLQVSGRVEYVFGDHPLIQFQYIRNCVMNRALPHFILVECCKIKKMYEQEMIAIEAAINRNSSNLPLPLPPKKTRIISHVWENNNPFQIVLVKGNKLNTEETVKVHVRAGLFHGTELLCKTIVSSEVSGKNDHIWNEPLEFDINICDLPRMARLCFAVYAVLDKVKTKKSTKTINPSKYQTIRKAGKVHYPVAWVNTMVFDFKGQLRTGDIILHSWSSFPDELEEMLNPMGTVQTNPYTENATALHVKFPENKKQPYYYPPFDKIIEKAAEIASSDSANVSSRGGKKFLPVLKEILDRDPLSQLCENEMDLIWTLRQDCREIFPQSLPKLLLSIKWNKLEDVAQLQALLQIWPKLPPREALELLDFNYPDQYVREYAVGCLRQMSDEELSQYLLQLVQVLKYEPFLDCALSRFLLERALGNRRIGQFLFWHLRSEVHIPAVSVQFGVILEAYCRGSVGHMKVLSKQVEALNKLKTLNSLIKLNAVKLNRAKGKEAMHTCLKQSAYREALSDLQSPLNPCVILSELYVEKCKYMDSKMKPLWLVYNNKVFGEDSVGVIFKNGDDLRQDMLTLQMLRLMDLLWKEAGLDLRMLPYGCLATGDRSGLIEVVSTSETIADIQLNSSNVAAAAAFNKDALLNWLKEYNSGDDLDRAIEEFTLSCAGYCVASYVLGIGDRHSDNIMVKKTGQLFHIDFGHILGNFKSKFGIKRERVPFILTYDFIHVIQQGKTGNTEKFGRFRQCCEDAYLILRRHGNLFITLFALMLTAGLPELTSVKDIQYLKDY

SEQ ID NO: 880097 - protein, 981 aa, Homo sapiens
MCFSFIMPPAMADILDIWAVDSQIASDGSIPVDFLLPTGIYIQLEVPREATISYIKQMLWKQVHNYPMFNLLMDIDSYMFACVNQTAVYEELEDETRRLCDVRPFLPVLKLVTRSCDPGEKLDSKIGVLIGKGLHEFDSLKDPEVNEFRRKMRKFSEEKILSLVGLSWMDWLKQTYPPEHEPSIPENLEDKLYGGKLIVAVHFENCQDVFSFQVSPNMNPIKVNELAIQKRLTIHGKEDEVSPYDYVLQVSGRVEYVFGDHPLIQFQYIRNCVMNRALPHFILVECCKIKKMYEQEMIAIEAAINRNSSNLPLPLPPKKTRIISHVWENNNPFQIVLVKGNKLNTEETVKVHVRAGLFHGTELLCKTIVSSEVSGKNDHIWNEPLEFDINICDLPRMARLCFAVYAVLDKVKTKKSTKTINPSKYQTIRKAGKVHYPVAWVNTMVFDFKGQLRTGDIILHSWSSFPDELEEMLNPMGTVQTNPYTENATALHVKFPENKKQPYYYPPFDKIIEKAAEIASSDSANVSSRGGKKFLPVLKEILDRDPLSQLCENEMDLIWTLRQDCREIFPQSLPKLLLSIKWNKLEDVAQLQALLQIWPKLPPREALELLDFNYPDQYVREYAVGCLRQMSDEELSQYLLQLVQVLKYEPFLDCALSRFLLERALGNRRIGQFLFWHLRSEVHIPAVSVQFGVILEAYCRGSVGHMKVLSKQVEALNKLKTLNSLIKLNAVKLNRAKGKEAMHTCLKQSAYREALSDLQSPLNPCVILSELYVEKCKYMDSKMKPLWLVYNNKVFGEDSVGVIFKNGDDLRQDMLTLQMLRLMDLLWKEAGLDLRMLPYGCLATGDRSGLIEVVSTSETIADIQLNSSNVAAAAAFNKDALLNWLKEYNSGDDLDRAIEEFTLSCAGYCVASYVLGIGDRHSDNIMVKKTGQLFHIDFGHILGNFKSKFGIKRERVPFILTYDFIHVIQQGKTGNTEKFGR

SEQ ID NO: 880098 - protein, 876 aa, Homo sapiens
MCFSFIMPPAMADILDIWAVDSQIASDGSIPVDFLLPTGIYIQLEVPREATISYIKQMLWKQVHNYPMFNLLMDIDSYMFACVNQTAVYEELEDETRRLCDVRPFLPVLKLVTRSCDPGEKLDSKIGVLIGKGLHEFDSLKDPEVNEFRRKMRKFSEEKILSLVGLSWMDWLKQTYPPEHEPSIPENLEDKLYGGKLIVAVHFENCQDVFSFQVSPNMNPIKVNELAIQKRLTIHGKEDEVSPYDYVLQVSGRVEYVFGDHPLIQFQYIRNCVMNRALPHFILVECCKIKKMYEQEMIAIEAAINRNSSNLPLPLPPKKTRIISHVWENNNPFQIVLVKGNKLNTEETVKVHVRAGLFHGTELLCKTIVSSEVSGKNDHIWNEPLEFDINICDLPRMARLCFAVYAVLDKVKTKKSTKTINPSKYQTIRKAGKVHYPVAWVNTMVFDFKGQLRTGDIILHSWSSFPDELEEMLNPMGTVQTNPYTENATALHVKFPENKKQPYYYPPFDKIIEKAAEIASSDSANVSSRGGKKFLPVLKEILDRDPLSQLCENEMDLIWTLRQDCREIFPQSLPKLLLSIKWNKLEDVAQLQALLQIWPKLPPREALELLDFNYPDQYVREYAVGCLRQMSDEELSQYLLQLVQVLKYEPFLDCALSRFLLERALGNRRIGQFLFWHLRSEVHIPAVSVQFGVILEAYCRGSVGHMKVLSKQVEALNKLKTLNSLIKLNAVKLNRAKGKEAMHTCLKQSAYREALSDLQSPLNPCVILSELYVEKCKYMDSKMKPLWLVYNNKVFGEDSVGVIFKNGDDLRQDMLTLQMLRLMDLLWKEAGLDLRWIQWLLLVILIFWKAKVRGSLEPGSSRLSWATEQDPSSVNK

SEQ ID NO: 880099 - protein, 587 aa, Homo sapiens
MCFSFIMPPAMADILDIWAVDSQIASDGSIPVDFLLPTGIYIQLEVPREATISYIKQMLWKQVHNYPMFNLLMDIDSYMFACVNQTAVYEELEDETRRLCDVRPFLPVLKLVTRSCDPGEKLDSKIGVLIGKGLHEFDSLKDPEVNEFRRKMRKFSEEKILSLVGLSWMDWLKQTYPPEHEPSIPENLEDKLYGGKLIVAVHFENCQDVFSFQVSPNMNPIKVNELAIQKRLTIHGKEDEVSPYDYVLQVSGRVEYVFGDHPLIQFQYIRNCVMNRALPHFILVECCKIKKMYEQEMIAIEAAINRNSSNLPLPLPPKKTRIISHVWENNNPFQIVLVKGNKLNTEETVKVHVRAGLFHGTELLCKTIVSSEVSGKNDHIWNEPLEFDINICDLPRMARLCFAVYAVLDKVKTKKSTKTINPSKYQTIRKAGKVHYPVAWVNTMVFDFKGQLRTGDIILHSWSSFPDELEEMLNPMGTVQTNPYTENATALHVKFPENKKQPYYYPPFDKSRGGKKFLPVLKEILDRDPLSQLCENEMDLIWTLRQDCREIFPQSLPKLLLSIKWNKLEDVAQVTKDRFYNFFWVYG

SEQ ID NO: 880100 - protein, 1070 aa, Homo sapiens; identical to SEQ ID NO: 880093

SEQ ID NO: 880101 - protein, 1070 aa, Homo sapiens; identical to SEQ ID NO: 880093

SEQ ID NO: 880102 - protein, 292 aa, Homo sapiens
MDSKMKPLWLVYNNKVFGEDSVGVIFKNGDDLRQDMLTLQMLRLMDLLWKEAGLDLRMLPYGCLATGDRSGLIEVVSTSETIADIQLNSSNVAAAAAFNKDALLNWLKEYNSGDDLDRAIEEFTLSCAGYCVASYVLGIGDRHSDNIMVKKTGQLFHIDFGHILGNFKSKFGIKRERVPFILTYDFIHVIQQGKTGNTEKFGRFRQCCEDAYLILRRHGNLFITLFALMLTAGLPELTSVKDIQYLKDSLALGKSEEEALKQFKQKFDEALRESWTTKVNWMAHTVRKDYRS

SEQ ID NO: 880103 - protein, 235 aa, Homo sapiens
MLPYGCLATGDRSGLIEVVSTSETIADIQLNSSNVAAAAAFNKDALLNWLKEYNSGDDLDRAIEEFTLSCAGYCVASYVLGIGDRHSDNIMVKKTGQLFHIDFGHILGNFKSKFGIKRERVPFILTYDFIHVIQQGKTGNTEKFGRFRQCCEDAYLILRRHGNLFITLFALMLTAGLPELTSVKDIQYLKDSLALGKSEEEALKQFKQKFDEALRESWTTKVNWMAHTVRKDYRS

SEQ ID NO: 880104 - protein, 193 aa, Homo sapiens
MCFSFIMPPAMADILDIWAVDSQIASDGSIPVDFLLPTGIYIQLEVPREATISYIKQMLWKQVHNYPMFNLLMDIDSYMFACVNQTAVYEELEDETRRLCDVRPFLPVLKLVTRSCDPGEKLDSKIGVLIGKEMESYCVTQDVGQVSSRHWYLSEIYLLPNIYQNMDSLATITSSYACQMWQIKILKIEILKK

SEQ ID NO: 880105 - protein, 134 aa, Homo sapiens [sequence omitted]

SEQ ID NO: 880106 - protein, 67 aa, Homo sapiens
RPYYYYICDRPPGVSAVTAASGERCVPLAFLAWERGQLPVFGQQDVQRLVWSHLDAPFSSRDGKLLS

SEQ ID NO: 880107 - protein, 284 aa, Homo sapiens
CRSSVRVPLFGLTPTVDYPIFRFSSGMSHVVVKNDPELDQQLANLDLNSEKQSGGASTASKGRYIPPHLRNREASKGFHDKDSSGWSCSKDKDAYSSFGSRDSRGKPGYFSERGSGSRGRFDDRGRSDYDGIGNRERPGFGRFERSGHSRWCDKSVEDDWSKPLPPSERLEQELFSGGNTGINFEKYDDIPVEATGSNCPPHIENFSDIDMGEIIMGNIELTRYTRPTPVQKHAIPIIKGKRDLMACAQTGSGKTAAFLLPILSQIYTDGPGEALKAVKVKVLL

SEQ ID NO: 880108 - protein, 333 aa, Homo sapiens
MMERGKIGLDFCKYLVLDEADRMLDMGFEPQIRRIVEQDTMPPKGVRHTMMFSATFPKEIQMLARDFLDEYIFLAVGRVGSTSENITQKVVWVEDLDKRSFLLDILGATGSDSLTLVFVETKKGADSLEDFLYHEGYACTSIHGDRSQRDREEALHQFRSGKSPILVATAVAARGLDISNVRHVINFDLPSDIEEYVHRIGRTGRVGNLGLATSFFNEKNMNITKDLLDLLVEAKQEVPSWLENMAYEHHYKGGSRGRSKSNRFSGGFGARDYRQSSGSSSSGFGASRGSSSRSGGGGYGNSRGFGGGGYGGFYNSDGYGGNYNSQGVDWWGN

SEQ ID NO: 880109 - protein, 284 aa, Homo sapiens; identical to SEQ ID NO: 880107

SEQ ID NO: 880110 - protein, 686 aa, Homo sapiens
CRSSVRVPLFGLTPTVDYPIFRFSSGMSHVVVKNDPELDQQLANLDLNSEKQSGGASTASKGRYIPPHLRNREASKGFHDKDSSGWSCSKDKDAYSSFGSRDSRGKPGYFSERGSGSRGRFDDRGRSDYDGIGNRERPGFGRFERSGHSRWCDKSVEDDWSKPLPPSERLEQELFSGGNTGINFEKYDDIPVEATGSNCPPHIENFSDIDMGEIIMGNIELTRYTRPTPVQKHAIPIIKGKRDLMACAQTGSGKTAAFLLPILSQIYTDGPGEALKAVKENGRYGRRKQYPISLVLAPTRELAVQIYEEARKFSYRSRVRPCVVYGGADIGQQIRDLERGCHLLVATPGRLVDMMERGKIGLDFCKYLVLDEADRMLDMGFEPQIRRIVEQDTMPPKGVRHTMMFSATFPKEIQMLARDFLDEYIFLAVGRVGSTSENITQKVVWVEDLDKRSFLLDILGATGSDSLTLVFVETKKGADSLEDFLYHEGYACTSIHGDRSQRDREEALHQFRSGKSPILVATAVAARGLDISNVRHVINFDLPSDIEEYVHRIGRTGRVGNLGLATSFFNEKNMNITKDLLDLLVEAKQEVPSWLENMAYEHHYKGGSRGRSKSNRFSGGFGARDYRQSSGSSSSGFGASRGSSSRSGGGGYGNSRGFGGGGYGGFYNSDGYGGNYNSQGVDWWGN

SEQ ID NO: 880111 - protein, 258 aa, Homo sapiens
MSHVVVKNDPELDQQLANLDLNSEKQSGGASTASKGRYIPPHLRNREASKGFHDKDSSGWSCSKDKDAYSSFGSRDSRGKPGYFSERGSGSRGRFDDRGRSDYDGIGNRERPGFGRFERSGHSRWCDKSVEDDWSKPLPPSERLEQELFSGGNTGINFEKYDDIPVEATGSNCPPHIENFSDIDMGEIIMGNIELTRYTRPTPVQKHAIPIIKGKRDLMACAQTGSGKTAAFLLPILSQIYTDGPGEALKAVKVKVLL

SEQ ID NO: 880112 - protein, 284 aa, Homo sapiens; identical to SEQ ID NO: 880107

SEQ ID NO: 880113 - protein, 102 aa, Homo sapiens [sequence omitted]

SEQ ID NO: 880114 - protein, 127 aa, Homo sapiens
MEMMESQTLLLTLLSVKMENNLAEFERRAEKNLLIMCKEKEKLQKKAHELKRRLLLSQRKRELADVLDAQIEMLSPFEAVATRFKEQYRTFATALDTTRHELPVRSIHLEGDGQQLLGRKRGVPVRV

SEQ ID NO: 880115 - protein, 369 aa, Homo sapiens
MADSSGRGAGKPATGPTNSSSAKKKDKRVQGGRVIESRYLQYEKKTTQKAPAGDGSQTRGKMSEGGRKSSLLQKSKADSSGVRKGDLQSTLLEGHGTAPPDLDLSAINDKSIVKKTPQLAKTISKKPESTSFSAPRKKSPDLSEAMEMMESQTLLLTLLSVKMENNLAEFERRAEKNLLIMCKEKEKLQKKAHELKRRLLLSQRKRELADVLDAQVSCKELYALQHELVTTQRLLGELDVGDSEENVQVLDLLSELKDVTAKKDLELRRSFAQVLELSAEASKEAALANQEVWEETQGMAPPSRWYFNQDSACRESGGAPKNTPLSEDDNPGASSAPAQATFISPSEDFSSSSQAEVPPSLSRSGRDLS

SEQ ID NO: 880116 - protein, 106 aa, Homo sapiens
HHDRSLSAAPLVCALRGAPCHPSPTIPLPLHALQHELVTTQRLLGELDVGDSEENVQVLDLLSELKDVTAKKDLELRRYLGKCFKKEVAPCLLRAVGGCTVGVVPS

SEQ ID NO: 880117 - protein, 410 aa, Homo sapiens [sequence omitted]

SEQ ID NO: 880118 - protein, 410 aa, Homo sapiens [sequence omitted]

SEQ ID NO: 880119 - protein, 80 aa, Homo sapiens
SSVPPPGPGPGIQASQALGDQAWGPPRLGKVHSWPPATLEGLGPHPGDLSHTVKAGTELHAWGCLKVQKELRRGVGGPPG

SEQ ID NO: 880120 - protein, 519 aa, Homo sapiens
MTSTFNPRECKLSKQEGQNYGFFLRIEKDTEGHLVRVVEKCSPAEKAGLQDGDRVLRINGVFVDKEEHMQVVDLVRKSGNSVTLLVLDGDSYEKAVKTRVDLKELGQSQKEQGLSDNILSPVMNGGVQTWTQPRLCYLVKEGGSYGFSLKTVQGKKGVYMTDITPQGVAMRAGVLADDHLIEVNGENVEDASHEEVVEKVKKSGSRVMFLLVDKETDKRHVEQKIQFKRETASLKLLPHQPRIVEMKKGSNGYGFYLRAGSEQKGQIIKDIDSGSPAEEAGLKNNDLVVAVNGESVETLDHDSVVEMIRKGGDQTSLLVVDKETDNMYRLAHFSPFLYYQSQELPNGSVKEAPAPTPTSLEVSSPPDTTEEVDHKPKLCRLAKGENGYGFHLNAIRGLPGSFIKEVQKGGPADLAGLEDEDVIIEVNGVNVLDEPYEKVVDRIQSSGKNVTLLVCGKKAYDYFQAKKIPIVSSLADPLDTPPDSKEGIVVESNHDSHMAKERAHSTASHSSSNSEDTEM

SEQ ID NO: 880121 - protein, 407 aa, Homo sapiens [sequence omitted]

SEQ ID NO: 880122 - protein, 519 aa, Homo sapiens; identical to SEQ ID NO: 880120

SEQ ID NO: 880123 - protein, 407 aa, Homo sapiens [sequence omitted]

SEQ ID NO: 880124 - protein, 407 aa, Homo sapiens [sequence omitted]

SEQ ID NO: 880125 - protein, 519 aa, Homo sapiens; identical to SEQ ID NO: 880120

SEQ ID NO: 880126 - protein, 519 aa, Homo sapiens; identical to SEQ ID NO: 880120

SEQ ID NO: 880127 - protein, 407 aa, Homo sapiens [sequence omitted]

SEQ ID NO: 880128 - protein, 108 aa, Homo sapiens
QVQKGGPADLAGLEDEDVIIEVNGVNVLDEPYEKVVDRIQSSGKNVTLLVCGKKAYDYFQAKKIPIVSSLADPLDTPPDSKEGIVVESNHDSHMAKERVSGGLFLFMI

SEQ ID NO: 880129 - protein, 78 aa, Homo sapiens
EKGKNRKGTELQVQVNHLCFSHIVIDIYPSIILIASSLLPPQPICLLCIRLEDRDPPGSQLKALEGYTLRTEVNRRYT

SEQ ID NO: 880130 - protein, 94 aa, Homo sapiens
SGIMALHDIHLKQDETEQAEKETFLTMFCYEESTFPRSPSEPPIGLIGANWLKGSFQDQAQVQGPKLARTGMTHLFSFSVISSQGHRSVWLVCE

SEQ ID NO: 880131 - protein, 762 aa, Homo sapiens
MEKLEVLEEWQSHIEGWEGSNITDTCTEMLMCGVLLKISSGNIQERVFFLFDNLLVYCKRKHRRLKNSKASTDGHRYLFRGRINTEVMEVENVDDGTADFHSSGHIVVNGWKIHNTAKNKWFVCMAKTPEEKHEWFEAILKERERRKGLKLGMEQDTWVMISEQGEKLYKMMCRQGNLIKDRKRKLTTFPKCFLGSEFVSWLLEIGEIHRPEEGVHLGQALLENGIIHHVTDKHQFKPEQMLYRFRYDDGTFYPRNEMQDVISKGVRLYCRLHSLFTPVIRDKDYHLRTYKSVVMANKLIDWLIAQGDCRTREEAMIFGVGLCDNGFMHHVLEKSEFKDEPLLFRFFSDEEMEGSNMKHRLMKHDLKVVENVIAKSLLIKSNEGSYGFGLEDKNKVPIIKLVEKGSNAEMAGMEVGKKIFAINGDLVFMRPFNEVDCFLKSCLNSRKPLRVLVSTKPRETVKIPDSADGLGFQIRGFGPSVVHAVGRGTVAAAAGLHPGQCIIKVNGINVSKETHASVIAHVTACRKYRRPTKQDSIQWVYNSIESAQEDLQKSHSKPPGDEAGDAFDCKVEEVIDKFNTMAIIDGKKEHVSLTVDNVHLEYGVVYEYDSTAGIKCNVVEKMIEPKGFFSLTAKILEALAKSDEHFVQNCTSLNSLNEVIPTDLQSKFSALCSERIEHLCQRISSYKKVQASERFYNFTARHAVWEHSFDLHSVSSTFPVPVTMEFLLLPPPLLGISQDGRQHCIPEDLPSQEMLLAERAPV

SEQ ID NO: 880132 - protein, 1389 aa, Homo sapiens
MEKLEVLEEWQSHIEGWEGSNITDTCTEMLMCGVLLKISSGNIQERVFFLFDNLLVYCKRKHRRLKNSKASTDGHRYLFRGRINTEVMEVENVDDGTADFHSSGHIVVNGWKIHNTAKNKWFVCMAKTPEEKHEWFEAILKERERRKGLKLGMEQDTWVMISEQGEKLYKMMCRQGNLIKDRKRKLTTFPKCFLGSEFVSWLLEIGEIHRPEEGVHLGQALLENGIIHHVTDKHQFKPEQMLYRFRYDDGTFYPRNEMQDVISKGVRLYCRLHSLFTPVIRDKDYHLRTYKSVVMANKLIDWLIAQGDCRTREEAMIFGVGLCDNGFMHHVLEKSEFKDEPLLFRFFSDEEMEGSNMKHRLMKHDLKVVENVIAKSLLIKSNEGSYGFGLEDKNKVPIIKLVEKGSNAEMAGMEVGKKIFAINGDLVFMRPFNEVDCFLKSCLNSRKPLRVLVSTKPRETVKIPDSADGLGFQIRGFGPSVVHAVGRGTVAAAAGLHPGQCIIKVNGINVSKETHASVIAHVTACRKYRRPTKQDSIQWVYNSIESAQEDLQKSHSKPPGDEAGDAFDCKVEEVIDKFNTMAIIDGKKEHVSLTVDNVHLEYGVVYEYDSTAGIKCNVVEKMIEPKGFFSLTAKILEALAKSDEHFVQNCTSLNSLNEVIPTDLQSKFSALCSERIEHLCQRISSYKKFSRVLKNRAWPTFKQAKSKISPLHSSDFCPTNCHVNVMEVSYPKTSTSLGSAFGVQLDSRKHNSHDKENKSSEQGKLSPMVYIQHTITTMAAPSGLSLGQQDGHGLRYLLKEEDLETQDIYQKLLGKLQTALKEVEMCVCQIDDLLSSITYSPKLERKTSEGIIPTDSDNEKGERNSKRVCFNVAGDEQEDSGHDTISNRDSYSDCNSNRNSIASFTSICSSQCSSYFHSDEMDSGDELPLSVRISHDKQDKIHSCLEHLFSQVDSITNLLKGQAVVRAFDQTKYLTPGRGLQEFQQEMEPKLSCPKRLRLHIKQDPWNLPSSVRTLAQNIRKFVEEVKCRLLLALLEYSDSETQLRRDMVFCQTLVATVCAFSEQLMAALNQMFDNSKENEMETWEASRRWLDQIANAGVLFHFQSLLSPNLTDEQAMLEDTLVALFDLEKVSFYFKPSEEEPLVANVPLTYQAEGSRQALKVYFYIDSYHFEQLPQRLKNGGGFKIHPVLFAQALESMEGYYYRDNVSVEEFQAQINAASLEKVKQYNQKLRAFYLDKSNSPPNSTSKAAYVDKLMRPLNALDELYRLVASFIRSKRTAACANTACSASGVGLLSVSSELCNRLGACHIIMCSSGVHRCTLSVTLEQAIILARSHGLPPRYIMQATDVMRKQGARVQNTAKNLGVRDRTPQSAPRLYKLCEPPPPAGEE

SEQ ID NO: 880133 - protein, 1388 aa, Homo sapiens
MEKLEVLEEWQSHIEGWEGSNITDTCTEMLMCGVLLKISSGNIQERVFFLFDNLLVYCKRKHRRLKNSKASTDGHRYLFRGRINTEVMEVENVDDGTADFHSSGHIVVNGWKIHNTAKNKWFVCMAKTPEEKHEWFEAILKERERRKGLKLGMEQDTWVMISEQGEKLYKMMCRQGNLIKDRKRKLTTFPKCFLGSEFVSWLLEIGEIHRPEEGVHLGQALLENGIIHHVTDKHQFKPEQMLYRFRYDDGTFYPRNEMQDVISKGVRLYCRLHSLFTPVIRDKDYHLRTYKSVVMANKLIDWLIAQGDCRTREEAMIFGVGLCDNGFMHHVLEKSEFKDEPLLFRFFSDEEMEGSNMKHRLMKHDLKVVENVIAKSLLIKSNEGSYGFGLEDKNKVPIIKLVEKGSNAEMAGMEVGKKIFAINGDLVFMRPFNEVDCFLKSCLNSRKPLRVLVSTKPRETVKIPDSADGLGFQIRGFGPSVVHAVGRGTVAAAAGLHPGQCIIKVNGINVSKETHASVIAHVTACRKYRRPTKQDSIQWVYNSIESAQEDLQKSHSKPPGDEAGDAFDCKVEEVIDKFNTMAIIDGKKEHVSLTVDNVHLEYGVVYEYDSTAGIKCNVVEKMIEPKGFFSLTAKILEALAKSDEHFVQNCTSLNSLNEVIPTDLQSKFSALCSERIEHLCQRISSYKKFSRVLKNRAWPTFKQAKSKISPLHSSDFCPTNCHVNVMEVSYPKTSTSLGSAFGVQLDSRKHNSHDKENKSSEQGKLSPMVYIQHTITTMAAPSGLSLGQQDGHGLRYLLKEEDLETQDIYQKLLGKLQTALKEVEMCVCQIDDLLSSITYSPKLERKTSEGIIPTDSDNEKGERNSKRVCFNVAGDEQEDSGHDTISNRDSYSDCNSNRNSIASFTSICSSQCSSYFHSDEMDSGDELPLSVRISHDKQDKIHSCLEHLFSQVDSITNLLKGQAVVRAFDQTKYLTPGRGLQEFQQEMEPKLSCPKRLRLHIKQDPWNLPSSVRTLAQNIRKFVEEVKCRLLLALLEYSDSETQLRRDMVFCQTLVATVCAFSEQLMAALNQMFDNSKENEMETWEASRRWLDQIANAGVLFHFQSLLSPNLTDEQAMLEDTLVALFDLEKVSFYFKPSEEEPLVANVPLTYQAEGSRQALKVYFYIDSYHFEQLPQRLKNGGGFKIHPVLFAQALESMEGYYYRDNVSVEEFQAQINAASLEKVKQYNQKLRAFYLDKSNSPPNSTSKAAYVDKLMRPLNALDELYRLVASFIRSKRTAACANTACSASGVGLLSVSSELCNRLGACHIIMCSSGVHRCTLSVTLEQAIILARSHGLPPRYIMQATDVMRKQILCIYFSYSCYFNSLLEFEGKIKDRREGYYVFMMFC

SEQ ID NO: 880134 - protein, 74 aa, Homo sapiens
WVDRGLWVDRGLWVERGLGIETCGLFLCALFAQVLLRARSGSLGGRVMGAMGGRMGAGSSGGTWFFQDFVYPSS

SEQ ID NO: 880135 - protein, 103 aa, Homo sapiens
VRLSLPLLPRFECSGVISAHCNLHLPGSDNPPATASGGAGITGMCHHARLIFVFFVETGFHHVGQAGLELLTSGDLPASASQSAGITGVRHCTRPDFTILAST

SEQ ID NO: 880136 - protein, 617 aa, Homo sapiens
MHTLKYYYWVINPADSSGITPKGLDGPRPSQKEIISLRAFMLLFLKQLILKDRGVKEDELQSILNYLLTMHEDENIHDVLQLLVALMSEHPASMIPAFDQRNGIRVIYKLLASKSESIWVQALKVLGYFLKHLGHKRKVEIMHTHSLFTLLGERLMLHTNTVTVTTYNTLYEILTEQVCTQVVHKPHPEPDSTVKIQNPMILKVVATLLKNSTPSAELMEVRRLFLSDMIKLFSNSRENRRCLLQCSVWQDWMFSLGYINPKNSEEQKITEMVYNIFRILLYHAIKYEWGGWRVWVDTLSIAHSKVTYEAHKEYLAKMYEEYQRQEEENIKKGKKGNVSTISGLSSQTTGAKGGMEIREIEDLSQSQSPESETDYPVSTDTRDLLMSTKVSDDILGNSDRPGSGVHVEVHDLLVDIKAEKVEATEVKLDDMDLSPETLVGGENGALVEVESLLDNVYSAAVEKLQNNVHGSVGIIKKNEEKDNGPLITLADEKEDLPNSSTSFLFDKIPKQEEKLLPELSSNHIIPNIQDTQVHLGVSDDLGLLAHMTGSVDLTCTSSIIEEKEFKIHTTSDGMSSISERDLASSTKGLEYAEMTATTLETESSSSKIVPNIDAGSI

SEQ ID NO: 880137 - protein, 104 aa, Homo sapiens
MQQRPRVVHRARNICDLALPRKSAGPWADHTICNNQNSVKLQCFWSLRVLRPGWQLPAQPQYSLVFCCLPELALGLDSHCPGDAIGLQLSRTILEPGPGIGGPV

SEQ ID NO: 880138 - protein, 276 aa, Homo sapiens
AARTRTAPSMRVAALISGGKDSCYNMMQCIAAGHQIVALANLRPAENQVGSDELDSYMYQTVGHHAIDLYAEAMALPLYRRTIRGRSLDTRQVYTKCEGDEVEDLYELLKLVKEKEEVEGISVGAILSDYQRIRVENVCKRLNLQPLAYLWQRNQEDLLREMISSNIQAMIIKVAALGLDPDKHLGKTLDQMEPYLIELSKKYGVHVCGEGGEYETFTLDCPLFKKKIIVDSSEVVIHSADAFAPVAYLRFLELHLEDKVSSVPDNYRTSNYIYNF

SEQ ID NO: 880139 - protein, 115 aa, Homo sapiens
MISSNIQAMIIKVAALGLDPDKHLGKTLDQMEPYLIELSKKYGVHVCGEGGEYETFTLDCPLFKKKIIVDSSEVVIHSADAFAPVAYLRFLELHLEDKVSSVPDNYRTSNYIYNF

SEQ ID NO: 880140 - protein, 276 aa, Homo sapiens; identical to SEQ ID NO: 880138

SEQ ID NO: 880141 - protein, 467 aa, Homo sapiens
MKLGSKSPGALRGPGLVPWIPEDTFSLLLAPDPVQIGRVQQDTPGKVLSIVNQLYLETHRGWGREQTPQETEPEAAQRHDPAPRNPAPHGVSWVKGPLSPEVDHPGPALASLLEEEEEDLEGKEEGREDDPEEEGPEDVLTIHVQSLVRARSSYVARQYRSLRVRIASDSGGPHGSGDPATELLQDVRHLLTDLQDHLAKDSYIRAVFGSRGPGLPKKDEDPGPALETAVCQAVLAPLKPALWTRLRTLRAPELRRLRRRQTALRAGAGPPGAQGPGPEGQSLAPALRSRIHERLAHLHAACAPRRKVALLLEVCRDVYAGLARGENQDPLGADAFLPALTEELIWSPDIGDTQLDVEFLMELLDPDELRGEAGYYLTTWFGALHHIAHYQPETDRAPRGLSSEARASLHQWHRRRTLHRKDHPRAQVTAHLAASRREGETWCPSDPAPTSPHRPTCPLRSHGQKRL

SEQ ID NO: 880142 - protein, 369 aa, Homo sapiens
MIQPPGTLRLTVVSWVKGPLSPEVDHPGPALASLLEEEEEDLEGKEEGREDDPEEEGPEDVLTIHVQSLVRARSSYVARQYRSLRVRIASDSGGPHGSGDPATELLQDVRHLLTDLQDHLAKDSYIRAVFGSRGPGLPKKDEDPGPALETAVCQAVLAPLKPALWTRLRTLRAPELRRLRRRQTALRAGAGPPGAQGPGPEGQSLAPALRSRIHERLAHLHAACAPRRKVALLLEVCRDVYAGLARGENQDPLGADAFLPALTEELIWSPDIGDTQLDVEFLMELLDPDELRGEAGYYLTTWFGALHHIAHYQPETDRAPRGLSSEARASLHQWHRRRTLHRKDHPRAQANLPFKEPWAEETVTGTSDN

SEQ ID NO: 880143 - protein, 435 aa, Homo sapiens
MKLGSKSPGALRGPGLVPWIPEDTFSLLLAPDPVQIGRVQQDTPGKVLSIVNQLYLETHRGWGREQTPQETEPEAAQRHDPAPRNPAPHGVSWVKGPLSPEVDHPGPALASLLEEEEEDLEGKEEGREDDPEEEGPEDVLTIHVQSLVRARSSYVARQYRSLRDHLAKDSYIRAVFGSRGPGLPKKDEDPGPALETAVCQAVLAPLKPALWTRLRTLRAPELRRLRRRQTALRAGAGPPGAQGPGPEGQSLAPALRSRIHERLAHLHAACAPRRKVALLLEVCRDVYAGLARGENQDPLGADAFLPALTEELIWSPDIGDTQLDVEFLMELLDPDELRGEAGYYLTTWFGALHHIAHYQPETDRAPRGLSSEARASLHQWHRRRTLHRKDHPRAQVTAHLAASRREGETWCPSDPAPTSPHRPTCPLRSHGQKRL

SEQ ID NO: 880144 - protein, 147 aa, Homo sapiens
RGGESLESWSQAGEGSTGGRNLCGPEDSDPLGADAFLPALTEELIWSPDIGDTQLDVEFLMELLDPDELRGEAGYYLTTWFGALHHIAHYQPETDRAPRGLSSEARASLHQWHRRRTLHRKDHPRAQANLPFKEPWAEETVTGTSDN

SEQ ID NO: 880145 - protein, 191 aa, Homo sapiens [sequence omitted]

SEQ ID NO: 880146 - protein, 139 aa, Homo sapiens
AVLRREHTGLPCSDEDNDVWPTHPPTFSLVIGRARPRTFYPGPLPYDLIPVPCPILISGELWSSLVFPPHSSLSPYHGRGVLFHRRVRCVWEVLRAAWSFKAFLKTFLPNQMVSVVGKAPFMRSSWGYRLMFLATPVQL

SEQ ID NO: 880147 - protein, 150 aa, Homo sapiens
FSHIPFSFCFTAVLRREHTGLPCSDEDNDVWPTHPPTFSLVIGRARPRTFYPGPLPYDLIPVPCPILISGELWSSLVFPPHSSLSPYHGRGVLFHRRVRCVWEVLRAAWSFKAFLKTFLPNQMVSVVGKAPFMRSSWGYRLMFLATPVQL

SEQ ID NO: 880148 - protein, 62 aa, Homo sapiens
SFNMGKGNEDPYLHCSSIQCSTDQPPFQQISFTGKGSDEKKPFKGKGKTASSHSSEKHIQRQ

SEQ ID NO: 880149 - protein, 69 aa, Homo sapiens
LISFSNAAHRGALICKERSTLFNSSSSFSVSGVSTVMTSSVDWHCGQTYSSMSSASLCKMPMQHPWYQF

SEQ ID NO: 880150 - protein, 502 aa, Homo sapiens
MLLRSAGKLNVGTKKEDGESTAPTPRPKVLRCKCHHHCPEDSVNNICSTDGYCFTMIEEDDSGLPVVTSGCLGLEGSDFQCRDTPIPHQRRSIECCTERNECNKDLHPTLPPLKNRDFVDGPIHHRALLISVTVCSLLLVLIILFCYFRYKRQETRPRYSIGLEQDETYIPPGESLRDLIEQSQSSGSGSGLPLLVQRTIAKQIQMVKQIGKGRYGEVWMGKWRGEKVAVKVFFTTEEASWFRETEIYQTVLMRHENILGFIAADIKGTGSWTQLYLITDYHENGSLYDYLKSTTLDAKSMLKLAYSSVSGLCHLHTEIFSTQGKPAIAHRDLKSKNILVKKNGTCCIADLGLAVKFISDTNEVDIPPNTRVGTKRYMPPEVLDESLNRNHFQSYIMADMYSFGLILWEVARRCVSGGIVEEYQLPYHDLVPSDPSYEDMREIVCIKKLRPSFPNRWSSDECLRQMGKLMTECWAHNPASRLTALRVKKTLAKMSESQDIKL

SEQ ID NO: 880151 - protein, 541 aa, Homo sapiens
RHVKMCLLPLCPSTVIVSFLRPHQPCLLYSLWNSNFLDNMLLRSAGKLNVGTKKEDGESTAPTPRPKVLRCKCHHHCPEDSVNNICSTDGYCFTMIEEDDSGLPVVTSGCLGLEGSDFQCRDTPIPHQRRSIECCTERNECNKDLHPTLPPLKNRDFVDGPIHHRALLISVTVCSLLLVLIILFCYFRYKRQETRPRYSIGLEQDETYIPPGESLRDLIEQSQSSGSGSGLPLLVQRTIAKQIQMVKQIGKGRYGEVWMGKWRGEKVAVKVFFTTEEASWFRETEIYQTVLMRHENILGFIAADIKGTGSWTQLYLITDYHENGSLYDYLKSTTLDAKSMLKLAYSSVSGLCHLHTEIFSTQGKPAIAHRDLKSKNILVKKNGTCCIADLGLAVKFISDTNEVDIPPNTRVGTKRYMPPEVLDESLNRNHFQSYIMADMYSFGLILWEVARRCVSGGIVEEYQLPYHDLVPSDPSYEDMREIVCIKKLRPSFPNRWSSDECLRQMGKLMTECWAHNPASRLTALRVKKTLAKMSESQDIKL

SEQ ID NO: 880152 - protein, 107 aa, Homo sapiens
VTKLVTTQGNSSVKFLPLTKSSSPCTVNLIVTEYRRMGKLGFACSRADKPVQTGIPVIGWVTAKEGTSFSFLPPPSLNNSTGMSVRVPTYYFCCLYNPDEAVVRIVQ

SEQ ID NO: 880153 - protein, 81 aa, Homo sapiens
VTKLVTTQGNSSVKFLPLTKSSSPCTVNLIVTEYRRMGKLGFACSRADKPVQTGIPVIGWVTAKEDPPGHIPISPGHPKQV

SEQ ID NO: 880154 - protein, 128 aa, Homo sapiens
MRVARRTRNVCRCPRAAGPGVPEPRAAPLPLLAMAPPPACRSPMSPPPPLLLLLLLSLALLGARARAEPAGSAVPAQSRPCVDCHAFEFMQRALQDLRKTACSLDARTETLLLQAERRALCACWPAGH

SEQ ID NO: 880155 - protein, 164 aa, Homo sapiens
MRVARRTRNVCRCPRAAGPGVPEPRLRAVVRASEWAFSRYGARTRGSLGPETGGLESGNRRAAPLPLLAMAPPPACRSPMSPPPPLLLLLLLSLALLGARARAEPAGSAVPAQSRPCVDCHAFEFMQRALQDLRKTACSLDARTETLLLQAERRALCACWPAGH

SEQ ID NO: 880156 - protein, 246 aa, Homo sapiens
KLLETQQNMNEFYNLLQPFIKTCTKNASAGKNWFRNAKSPPCELMAGHLRYRFTAGAHFVLLLHLIYLFNYVLHHCLRMQARGLLAALQVVVPFYCSCFLAVEVMLQLFALLLLWEKYGYFVYSFILLLQSPALGLGQFQATLFYYSSVVQPVLLAFLLIQTLKTLHEEFVTSLILALLGARARAEPAGSAVPAQSRPCVDCHAFEFMQRALQDLRKTACSLDARTETLLLQAERRALCACWPAGH

SEQ ID NO: 880157 - protein, 128 aa, Homo sapiens; identical to SEQ ID NO: 880154

SEQ ID NO: 880158 - protein, 102 aa, Homo sapiens
MGQKDLNSSFQPWTFPLTEPTQMRRNEKTNAGNMTKQGFSTLPQNHTSLPAMNPNQEEIPDLPEKEFRRSAIKLIREGPEKGEAQCKEIQNMIQEVKGEIFK

SEQ ID NO: 880159 - protein, 69 aa, Homo sapiens
LIQRSGRDTYADDESRTKSKQADRDPEHEFEITFVKYEHRDTSENSCSYLKLQIWAMFDKVNGTEIMMH

SEQ ID NO: 880160 - protein, 96 aa, Homo sapiens
MNKRLGSLVDEFKELVYPPDYNPEGKVTKRKHNNEGSGSKRPKVEYGEEKLKTHISKVMLGKFTVPMLKEACRVDGLKSVLKKQDLLKALTTHFQD

SEQ ID NO: 880161 - protein, 82 aa, Homo sapiens
PVQKSEELNRKPSLPYPSQNRTPEGPAIGLANPPPFLTGKRNPGRGLCLSSPAEPEGPTSLKQLLPKIHMTQAAVSPETWDL

SEQ ID NO: 880162 - protein, 69 aa, Homo sapiens
DAMTTSVCWGPGRLPVRIQGGSSVYPIPIVRCGLGSPEIAWPGSLTTQTPSSCMASPSAPPRLNSQTSE

SEQ ID NO: 880163 - protein, 72 aa, Homo sapiens
RDRPASGERGGGGNEAWVDLGVESKAYRSVLLELGLHWDSPRAGSWAGFDLSSSPSIPSACHDARNITVLHK

SEQ ID NO: 880164 - protein, 895 aa, Homo sapiens
LDGLAGAMAGAAAESGRELWTFAGSRDPSAPRLAYGYGPGSLRELRAREFSRLAGTVYLDHAGATLFSQSQLESFTSDLMENTYGNPHSQNISSKLTHDTVEQVRYRILAHFHTTAEDYTVIFTAGSTAALKLVAEAFPWVSQGPESSGSRFCYLTDSHTSVVGMRNVTMAINVISIPVRPEDLWSAEERGASASNPDCQLPHLFCYPAQSNFSGVRYPLSWIEEVKSGRLRPVSTPGKWFVLLDAASYVSTSPLDLSAHQADFVPISFYKIFGFPTGLGALLVHNRAAPLLRKTYFGGGTASAYLAGEDFYIPRQSVAQRFEDGTISFLDVIALKHGFDTLERLTGGMENIKQHTFTLAQYTYMALSSLQYPNGAPVVRIYSDSEFSSPEVQGPIINFNVLDDKGNIIGYSQVDKMASLYNIHLRTGCFCNTGACQRHLGISNEMVRKHFQAGHVCGDNMDLIDGQPTGSVRISFGYMSTLDDVQAFLRFIIDTRLHSSGDWPVPQAHADTGETGAPSADSQADVIPAVMGRRSLSPQEDALTGSRVWNNSSTVNAVPVAPPVCDVARTQPTPSEKAAGVLEGALGPHVVTNLYLYPIKSCAAFEVTRWPVGNQGLLYDRSWMVVNHNGVCLSQKQEPRLCLIQPFIDLRQRIMVIKAKGMEPIEVPLEENSERTQIRQSRVCADRVSTYDCGEKISSWLSTFFGRPCNLIKQSSNSQRNAKKKHGKDQLPGTMATLSLVNEAQYLLINTSSILELHRQLNTSDENGKEELFSLKDLSLRFRANIIINGKRAFEEEKWDEISIGSLRFQVLGPCHRCQMICIDQQTGQRNQHVFQKLSESRETKVNFGMYLMHASLDLSSPCFLSVGSQVLPVLKENVEGHDLPASEKHQDVTS

SEQ ID NO: 880165 - protein, 895 aa, Homo sapiens; identical to SEQ ID NO: 880164

SEQ ID NO: 880166 - protein, 352 aa, Homo sapiens
YRRPRGPNSSTVNAVPVAPPVCDVARTQPTPSEKAAGVLEGALGPHVVTNLYLYPIKSCAAFEVTRWPVGNQGLLYDRSWMVVNHNGVCLSQKQEPRLCLIQPFIDLRQRIMVIKAKGMEPIEVPLEENSERTQIRQSRVCADRVSTYDCGEKISSWLSTFFGRPCNLIKQSSNSQRNAKKKHGKDQLPGTMATLSLVNEAQYLLINTSSILELHRQLNTSDENGKEELFSLKDLSLRFRANIIINGKRAFEEEKWDEISIGSLRFQVLGPCHRCQMICIDQQTGQRNQHVFQKLSESRETKVNFGMYLMHASLDLSSPCFLSVGSQVLPVLKENVEGHDLPASEKHQDVTS

SEQ ID NO: 880167 - protein, 868 aa, Homo sapiens
LDGLAGAMAGAAAESGRELWTFAGSRDPSAPRLAYGYGPGSLRELRAREFSRLAGTVYLDHAGATLFSQSQLESFTSDLMENTYGNPHSQNISSKLTHDTVEQVRYRILAHFHTTAEDYTVIFTAGSTAALKLVAEAFPWVSQGPESSGSRFCYLTDSHTSVVGMRNVTMAINVISIPVRPEDLWSAEERGASASNPDCQLPHLFCYPAQSNFSGVRYPLSWIEEVKSGRLRPVSTPGKWFVLLDAASYVSTSPLDLSAHQADFVPISFYKIFGFPTGLGALLVHNRAAPLLRKTYFGGGTASAYLAGEDFYIPRQSVAQRFEDGTISFLDVIALKHGFDTLERLTGGMENIKQHTFTLAQYTYMALSSLQYPNGAPVVRIYSDSEFSSPEVQGPIINFNVLDDKGNIIGYSQVDKMASLYNIHLRTGCFCNTGACQRHLGISNEMVRKHFQAGHVCGDNMDLIDGQPTGSVRISFGYMSTLDDVQAFLRFIIDTRLHSSGDWPVPQAHADTGETGAPSADSQADVIPAVMGRRSLSPQEDALTGSRVWNNSSTVNAVPVAPPVCDVARTQPTPSEKAAGVLEGALGPHVVTNLYLYPIKSCAAFEVTRWPVGNQGLLYDRSWMVVNHNGVCLSQKQEPRLCLIQPFIDLRQRIMVIKAKGMEPIEVPLEENSERTQIRQSRVCADRVSTYDCGEKISSWLSTFFGRPCNLIKQSSNSQRNAKKKHGKDQLPGTMATLSLVNEAQYLLINTSSILELHRQLNTSDENGKEELFSLKDLSLRFRANIIINGKRAFEEEKWDEISIGSLRFQVLGPCHRCQMICIDQQTGQRNQHVFQKLSESRETKVSVIAKYDTWFPILVLSIPELCS

SEQ ID NO: 880168 - protein, 818 aa, Homo sapiens
LDGLAGAMAGAAAESGRELWTFAGSRDPSAPRLAYGYGPGSLRELRAREFSRLAGTVYLDHAGATLFSQSQLESFTSDLMENTYGNPHSQNISSKLTHDTVEQVRYRILAHFHTTAEDYTVIFTAGSTAALKLVAEAFPWVSQGPESSGSRFCYLTDSHTSVVGMRNVTMAINVISIPVRPEDLWSAEERGASASNPDCQLPHLFCYPAQSNFSGVRYPLSWIEEVKSGRLRPVSTPGKWFVLLDAASYVSTSPLDLSAHQADFVPISFYKIFGFPTGLGALLVHNRAAPLLRKTYFGGGTASAYLAGEDFYIPRQSVAQRFEDGTISFLDVIALKHGFDTLERLTGGMENIKQHTFTLAQYTYMALSSLQYPNGAPVVRIYSDSEFSSPEVQGPIINFNVLDDKGNIIGYSQVDKMASLYNIHLRTGCFCNTGACQRHLGISNEMVRKHFQAGHVCGDNMDLIDGQPTGSVRISFGYMSTLDDVQAFLRFIIDTRLHSSGDWPVPQAHADTGETGAPSADSQADVIPAVMGRRSLSPQEDALTGSRVWNNSSTVNAVPVAPPVCDVARTQPTPSEKAAGVLEGALGPHVVTNLYLYPIKSCAAFEVTRWPVGNQGLLYDRSWMVVNHNGVCLSQKQEPRLCLIQPFIDLRQRIMVIKAKGMEPIEVPLEENSERTQIRQSRVCADRVSTYDCGEKISSWLSTFFGRPCNLIKQSSNSQRNAKKKHGKDQLPGTMATLSLVNEAQYLLINTSSILELHRQLNTSDENGKEELFSLKDLSLRFRANIIINGKRAFEEEKWDEISIGSLRFQFWAHRGSL

SEQ ID NO: 880169 - protein, 742 aa, Homo sapiens
LDGLAGAMAGAAAESGRELWTFAGSRDPSAPRLAYGYGPGSLRELRAREFSRLAGTVYLDHAGATLFSQSQLESFTSDLMENTYGNPHSQNISSKLTHDTVEQVRYRILAHFHTTAEDYTVIFTAGSTAALKLVAEAFPWVSQGPESSGSRFCYLTDSHTSVVGMRNVTMAINVISIPVRPEDLWSAEERGASASNPDCQLPHLFCYPAQSNFSGVRYPLSWIEEVKSGRLRPVSTPGKWFVLLDAASYVSTSPLDLSAHQADFVPISFYKIFGFPTGLGALLVHNRAAPLLRKTYFGGGTASAYLAGEDFYIPRQSVAQRFEDGTISFLDVIALKHGFDTLERLTGGMENIKQHTFTLAQYTYMALSSLQYPNGAPVVRIYSDSEFSSPEVQGPIINFNVLDDKGNIIGYSQVDKMASLYNIHLRTGCFCNTGACQRHLGISNEMVRKHFQAGHVCGDNMDLIDGQPTGSVRISFGYMSTLDDVQAFLRFIIDTRLHSSGDWPVPQAHADTGETGAPSADSQADVIPAVMGRRSLSPQEDALTGSRVWNNSSTVNAVPVAPPVCDVARTQPTPSEKAAGVLEGALGPHVVTNLYLYPIKSCAAFEVTRWPVGNQGLLYDRSWMVVNHNGVCLSQKQEPRLCLIQPFIDLRQRIMVIKAKGMEPIEVPLEENSERTQIRQSRVCADRVSTYDCGEKISSWLSTFFGRPCNLIKQSSNSQRNAKKKHGKDQLPGTMDLKDGYR

SEQ ID NO: 880170 - protein, 101 aa, Homo sapiens
FQAAEPVPWLGSVGLGASRSKSPLGSARNPWGRLSSGCPPSLESRCHWGRGGARSSDFCFGKFLQAHPPPALGPRAKNFRNPGHKNASVCGQGLKARGVFI

SEQ ID NO: 880171 - protein, 116 aa, Homo sapiens
RVSLECNGMNLASLKPLPASASHVAGITGAHHHAQLIFVFLVETGFHHIGRAGLKLLTSDDPPVSASQSAGITGMSHRAWPLLKYFSALQTLNILQKNKNKNLIKTYFISLHVKIF

SEQ ID NO: 880172 - protein, 136 aa, Homo sapiens
MTKEKRRLLKTPPCSPMSLVSQDTKKLQETREFSGWGCPWMKHRTNWSPQGRRPATQHHRSRRLPFAGSPPLLARDAPPRFAAPPARESGGGRPARRHSVPCLPEAAAQRRGAAGTHPVLAFPVLRTSRPSLGSAG

SEQ ID NO: 880173 - protein, 57 aa, Homo sapiens
MTGLFYGPSGAQTRVQALTLPQSRGASTYEDAKLRSSPCGVSANWASNSPINLDINT

SEQ ID NO: 880174 - protein, 145 aa, Homo sapiens
MRSLRLREAEATCSEPHSKPTTLNLQITNSALCPDSVIIDGQHRHLGSTEAQSGRDWLKTMASPGLTVSDAVMDGFLEEVVPGLWEVGVSILVSGSICSRWFPWGPQKQVFALTALQAESFSAWPFLPLFPGTCCSPGAEYPTYL

SEQ ID NO: 880175 - protein, 169 aa, Homo sapiens
RGQGWSPGTKKGRGSARPEEWEEMGPGCRVPRGLGQGPRCRRKMREFGFGDLVHPGPVLPPLPPQRRASCIPFLWPEGSSVHPSQALASSHSPALGPIRLGRMGEPVVAPGRGKGGRLGKPLLGRTQYSGSSLSGKERICVTRSYRGTLRGLRGRAWSPPRGKEKFFES

SEQ ID NO: 880176 - protein, 85 aa, Homo sapiens
QSPRQQGTERLAQQGLSGPTEQGDRAQERSCCLHKGRWSQGISVHGILAVPTVSWLNLTRTEASEAQVASHLKGEVLITKGLKAA

SEQ ID NO: 880177 - protein, 112 aa, Homo sapiens
MHCEVPADGDFAAQSHLNQQLFYDGCKYTHSLTLANNMAENSKSRPHACMCAKHLHKAHKVREIRGCMLPLRFFTVENIRHKGNSLLIYRGLLSTMHAYNINILFNLCAVDP

SEQ ID NO: 880178 - protein, 193 aa, Homo sapiens [sequence omitted]

SEQ ID NO: 880179 - protein, 107 aa, Homo sapiens
MGSWVQLITSVGTSGLFLGVRVREEGAGMRCSKTIQAGQWLDSSKGPLGPSPPPVPTAGYSSSFCVHYVNLLPGVLVLSVTSQYPHLSMALCQLAAHDWPRLSCVCV

SEQ ID NO: 880180 - protein, 193 aa, Homo sapiens [sequence omitted]

SEQ ID NO: 880181 - protein, 127 aa, Homo sapiens [sequence omitted]

SEQ ID NO: 880182 - protein, 118 aa, Homo sapiens
MKSNLTLLTCLTLHGGEGWKGAAVCFETVEQFCSLRKWHVTYLTKDSGLCQQQEKLYTKFLVCIREHQMKKLRKPTGWKIPSPKGTWLLSYYQQGVLGASEAGDKPNKPKKHRKDSEK

SEQ ID NO: 880183 - protein, 199 aa, Homo sapiens
MACNIPNQRQRTLSTTGEALYEILGLHKGASNEEIKKTYRKLALKHHPDKNPDDPAATEKFKEINNAHAILTDISKRSIYDKYGSLGLYVAEQFGDENVNTYFMLSSWWAKALFVIVGLLTGCYFCCCLCCCCNCCCGHCRPESSVPEEDFYVSPEDLEEQIKSDMEKDVDFPVFLQPTNANEKTQLIKEGSRSYCTDS

SEQ ID NO: 880184 - protein, 199 aa, Homo sapiens; identical to SEQ ID NO: 880183

SEQ ID NO: 880185 - protein, 77 aa, Homo sapiens
HPETELALMLNWHLHKGMTAPDELAIQALELSLMESVCNTAGVVIDGYPVTKHQMNLLEARSIIPMVIFELSVPSKE

SEQ ID NO: 880186 - protein, 310 aa, Homo sapiens
MSLTNTKTGFSVKDILDLPDTNDEEGSVAEGPEEENEGPEPAKRAGPLGQGALDAVQSLPLKNPFYDSSDNPYTRWLASTEGLQYSLHGLAAGAPPQDSSSKSPEPSADESPDNDKETPGGGGDAGKKRKRRVLFSKAQTYELERRFRQQRYLSAPEREHLASLIRLTPTQVKIWFQNHRYKMKRARAEKGMEVTPLPSPRRVAVPVLVRDGKPCHALKAQDLAAATFQAGIPFSAYSAQSLQHMQYNAQYSSASTPQYPTAHPPALPMPLLLNLGRGLNSTPCLQNVCAASLLCLSPGGPNRPSVNVVT

SEQ ID NO: 880187 - protein, 273 aa, Homo sapiens
MSLTNTKTGFSVKDILDLPDTNDEEGSVAEGPEEENEGPEPAKRAGPLGQGALDAVQSLPLKNPFYDSSDNPYTRWLASTEGLQYSLHGLAAGAPPQDSSSKSPEPSADESPDNDKETPGGGGDAGKKRKRRVLFSKAQTYELERRFRQQRYLSAPEREHLASLIRLTPTQVKIWFQNHRYKMKRARAEKGMEVTPLPSPRRVAVPVLVRDGKPCHALKAQDLAAATFQAGIPFSAYSAQSLQHMQYNAQYSSASTPQYPTAHPLVQAQQWTW

SEQ ID NO: 880188 - protein, 523 aa, Homo sapiens
LTARYEAPVLNRKSPRVTGCDAQAFGKEMQLRSRGRGRLPLTKARAPVSQEDALNLMNENIDILETAIKQAAEQGARIIVTPEDALYGWKFTRETVFPYLEDIPDPQVNWIPCQDPHRFGHTPVQARLSCLAKDNSIYVLANLGDKKPCNSRDSTCPPNGYFQYNTNVVYNTEGKLVARYHKYHLYSEPQFNVPEKPELVTFNTAFGRFGIFTCFDIFFYDPGVTLVKDFHVDTILFPTAWMNVLPLLTAIEFHSAWAMGMGVNLLVANTHHVSLNMTGSGIYAPNGPKVYHYDMKTELGKLLLSEVDSHPLSSLAYPTAVNWNAYATTIKPFPVQKNTFRGFISRDGFNFTELFENAGNLTVCQKELCCHLSYRMLQKEENEVYVLGAFTGLHGRRRREYWQVCTMLKCKTTNLTTCGRPVETASTRFEMFSLSGTFGTEYVFPEVLLTEIHLSPGKFEVLKDGRLVNKNGSSGPILTVSLFGRWYTKDSLYSSCGTSNSAITYLLIFILLMIIALQNIVML

SEQ ID NO: 880189 - protein, 282 aa, Homo sapiens [sequence omitted]

SEQ ID NO: 880190 - protein, 520 aa, Homo sapiens
MVTSSFPISVAVFALITLQVGTQDSFIAAVYEHAVILPNKTETPVSQEDALNLMNENIDILETAIKQAAEQGARIIVTPEDALYGWKFTRETVFPYLEDIPDPQVNWIPCQDPHRFGHTPVQARLSCLAKDNSIYVLANLGDKKPCNSRDSTCPPNGYFQYNTNVVYNTEGKLVARYHKYHLYSEPQFNVPEKPELVTFNTAFGRFGIFTCFDIFFYDPGVTLVKDFHVDTILFPTAWMNVLPLLTAIEFHSAWAMGMGVNLLVANTHHVSLNMTGSGIYAPNGPKVYHYDMKTELGKLLLSEVDSHPLSSLAYPTAVNWNAYATTIKPFPVQKNTFRGFISRDGFNFTELFENAGNLTVCQKELCCHLSYRMLQKEENEVYVLGAFTGLHGRRRREYWQVCTMLKCKTTNLTTCGRPVETASTRFEMFSLSGTFGTEYVFPEVLLTEIHLSPGKFEVLKDGRLVNKNGSSGPILTVSLFGRWYTKDSLYSSCGTSNSAITYLLIFILLMIIALQNIVML

SEQ ID NO: 880191 - protein, 278 aa, Homo sapiens
MVTSSFPISVAVFALITLQVGTQDSFIAAVYEHAVILPNKTETPVSQEDALNLMNENIDILETAIKQAAEQGARIIVTPEDALYGWKFTRETVFPYLEDIPDPQVNWIPCQDPHRFGHTPVQARLSCLAKDNSIYVLANLGDKKPCNSRDSTCPPNGYFQYNTNVVYNTEGKLVARYHKYHLYSEPQFNVPEKPELVTFNTAFGRFGIFTCFDIFFYDPGVTLVKDFHVDTILFPTAWMNVLPLLTAIEFHSAWAMGMGVNLLVANTHHVSLNMTGNS

SEQ ID NO: 880192 - protein, 579 aa, Homo sapiens
MSALRPLLLLLLPLCPGPGPGPGSEAKVTRSCAETRQVLGARGYSLNLIPPALISGEHLRVCPQEYTCCSSETEQRLIRETEATFRGLVEDSGSFLVHTLAARHRKFDEFFLEMLSVAQHSLTQLFSHSYGRLYAQHALIFNGLFSRLRDFYGESGEGLDDTLADFWAQLLERVFPLLHPQYSFPPDYLLCLSRLASSTDGSLQPFGDSPRRLRLQITRTLVAARAFVQGLETGRNVVSEALKVPVSEGCSQALMRLIGCPLCRGVPSLMPCQGFCLNVVRGCLSSRGLEPDWGNYLDGLLILADKLQGPFSFELTAESIGVKISEGLMYLQENSAKVSAQVFQECGPPDPVPARNRRAPPPREEAGRLWSMVTEEERPTTAAGTNLHRLVWELRERLARMRGFWARLSLTVCGDSRMAADASLEAAPCWTGAGRGRYLPPVVGGSPAEQVNNPELKVDASGPDVPTRRRRLQLRAATARMKTAALGHDLDGQDADEDASGSGGGQQYADDWMAGAVAPPARPPRPPYPPRRDGSGGKGGGGSARYNQGRSRSGGASIGFHTQTILILSLSALALLGPR

SEQ ID NO: 880193 - protein, 321 aa, Homo sapiens
MSALRPLLLLLLPLCPGPGPGPGSEAKVTRSCAETRQVLGARGYSLNLIPPALISGEHLRVCPQEYTCCSSETEQRLIRETEATFRGLVEDSGSFLVHTLAARHRKFDEFFLEMLSVAQHSLTQLFSHSYGRLYAQHALIFNGLFSRLRDFYGESGEGLDDTLADFWAQLLERVFPLLHPQYSFPPDYLLCLSRLASSTDGSLQPFGDSPRRLRLQITRTLVAARAFVQGLETGRNVVSEALKVPVSEGCSQALMRLIGCPLCRGVPSLMPCQGFCLNVVRGCLSSRGLEPDWGNYLGEGIQESLEPGMVAHTCNHSTLRG

SEQ ID NO: 880194 - protein, 364 aa, Homo sapiens [sequence omitted]

SEQ ID NO: 880195 - protein, 98 aa, Homo sapiens
SQAESSHSVCGGHSPTLCPQVPVSEGCSQALMRLIGCPLCRGVPSLMPCQGFCLNVVRGCLSSRGLEPDWGNYLGEGIQESLEPGMVAHTCNHSTLRG

SEQ ID NO: 880196 - protein, 135 aa, Homo sapiens
MKTRALFRSAHRVHPLFCPSPPSVRSNKTYPISEEARPVPKSHWGARRPSSIYHQITRKTKTLHSCGITTLDSNTIAQYWYFRAWMFFQSSSRNRRSTKLSGKGCCSYKTLCHFTSLVFVTGWVHIILSFKLRLV

SEQ ID NO: 880197 - protein, 118 aa, Homo sapiens
VLIAVLVQSSIKNSHFETESPCPLYLSRPSLSESLLSSSALCCRKVTLGISQSTLSADFCMGSASGRGSTGKILVARKKGSPSVGQAWWLMHVIPALWESKAGGSPEVRSSRPAWLTW

SEQ ID NO: 880198 - protein, 139 aa, Homo sapiens
LGSKLSLDELTKIWKIQSGQSSTVIENIHTIIAAAAVKFNSDQLNHLFVLIQKSWETESDRVRQKLLSLIGRIGREARFETTSGKVLDVLWELAHLPTLPSSLIQQALEEHLTILSDAYAVKEAIKRSYIIKCIEDIKR

SEQ ID NO: 880199 - protein, 183 aa, Homo sapiens
AAARAPALGYKMAALSGGGGGGAEPGQALFNGDMEPEAGAGAGAAASSAADPAIPEEVWNIKQMIKLTQEHIEALLDKFGGEHNPPSIYLEAYEEYTSKLDALQQREQQLLESLGNGTDFSVSSSASMDTVTSSSSSSLSVLPSSLSVFQNPTDVARSNPKSPQKPIVRVFLPNKQRTVVSQF

SEQ ID NO: 880200 - protein, 215 aa, Homo sapiens
MRNEVVLISSKERCSLAPGNSLGASTTPWLPAYTAGFSGGTGPAGTASPRVRTGERRGQAQDTATSHPLQSTEITQRRAWAMWPLQEPHSARVRIAQGRAGHLPRQASQRRLVTRSQAGNTQPWWGLRTEEAQEHRGERWRDTGRARSVDTARTHHRGWRPAPGHVQQEQAATLGAPGGEARCQRGCPCSCESGAAGHECWTEAPTLCCPHHAVP

SEQ ID NO: 880201 - protein, 179 aa, Homo sapiens
MALCLCSRPLSPDTPPFQTLCIAGLPQTSAAWCMQGAGDQVSPQQDVPALQTPGAWTQPELITEAGVQPRVTCSRNKQPLWGHQVERQDAKEGARVLAKAGLLATSAGQRPPRSAAPITPFRDCHAESADRKGGSSGTAASACLGRQGGLPGSLEGGATISALVAFLLLLNFLKLINCL

SEQ ID NO: 880202 - protein, 215 aa, Homo sapiens; identical to SEQ ID NO: 880200

SEQ ID NO: 880203 - protein, 107 aa, Homo sapiens
MCPWELKQVMAKHPRNTPSGPVSVASMPSSSCVSTYSFMPTSPDTAILDRKAGALSPQVHPFPSWGSRGPKRGRFPSQLHSSSVPKNWPSQQSGSPEKLGGKWEKIM

SEQ ID NO: 880204 - protein, 120 aa, Homo sapiens
THDFNSFNFFSNVPWNKAHTFFKESLAHNITKFETLQLVYIIRIQFYIDFNCLSSFLPVSFNFSTVHKSCPAKDWKVHKGKCYWIAETKKSWNKSQNDCAINNSYLMVIQDITAMVRFNI

SEQ ID NO: 880205 - protein, 30 aa, Homo sapiens
RVVKRKVKSAGTGLRSDCSILKSPCPYPHS

SEQ ID NO: 880206 - protein, 130 aa, Homo sapiens
MSCPPSSAQPPPPISYEEEFTTTWTTTTCVTSRPEGSAQQRPDAAGAGVRTYRLAPGRHECRVAQKLLNGRRKCQPAPAAALAAHSPQLSLGPSPSLSSGEFVPIRNLPPGSGTMLVACPFPADKKERYR

SEQ ID NO: 880207 - protein, 111 aa, Homo sapiens
MADWARAQSPGAVEEILDRENKRMADSLASKVTRLKSLALDIDRDAEDQNRYLDGMDSDFTSMTSLLTGSVKRFSTMARSGQDNRKLLCGMAVGLIVAFFILSYFLSRART

SEQ ID NO: 880208 - protein, 37 aa, Homo sapiens
LGQQTDCFPLVGVGSLSSLITRTLCGCGVLLKRRVNP

SEQ ID NO: 880209 - protein, 86 aa, Homo sapiens
VGMTTLVMEETSVVVVALVAAMVVVDMVAVGMAIMDLVMMEAILEVVEATMTLAITTVFKFWTHEGRIGGRTSGPYGGGDQYLAKP

SEQ ID NO: 880210 - protein, 74 aa, Homo sapiens
LSQRGKVASQADQSKANSKSLPLHGKNTQIGAGLVRKDTGSVSVAILNRSQAKSSILGGTDYRGPWLPLNRGSC

SEQ ID NO: 880211 - protein, 105 aa, Homo sapiens
APPAGVFSEAFGPAEEPLPAGSLLRGVRVRPRWASPWDRQPPSGRASPDAPRSPCPAPTVRITPSLSAGAPGPPGLDPAHLVPVSPTPYSSTVPSPGTECVLSTQ

SEQ ID NO: 880212 - protein, 105 aa, Homo sapiens [sequence omitted]

SEQ ID NO: 880213 - protein, 106 aa, Homo sapiens
MPQSVKHEPPLKEHLLSQDLWACCPFYLEYPSFKTQSQKQKAFADRRGGEGCGRAWGAELVATSSGRSQAKFPWCGTWHSVIVPVSLWSGPVPIGPITLGVIQICK

SEQ ID NO: 880214 - protein, 115 aa, Homo sapiens
LITYVHQSAGMHIGITNHTLAITFFTQSSDSNTSLLAAKDQIGMTFSHSSQRSQPPDASGQFLFILQCICYSCLYKRKLKRTLGFYFISSPCIPFMCSITTVDVKQFVSTRILTD

SEQ ID NO: 880215 - protein, 157 aa, Homo sapiens
TADSAGASGVQRTKKPHRPGWGRGRSRKEPGRGGEEGDEVTAGPPHPVPGVGDPSRSARPPAGSAPQVEAPARTTRSQESGPRCGPGVPEVRVARVPGAQRGRGRLAHTAGPTSPGPTHFPRPPALDSRGQRRGWPGLGPRPAVQSLGTSTQLRQAP

SEQ ID NO: 880216 - protein, 136 aa, Homo sapiens; identical to SEQ ID NO: 741065

SEQ ID NO: 880217 - protein, 166 aa, Homo sapiens
MSSKDFFACGHSGHWARGCPRGGAGGRRGGGHGRGSQCGSTTLSYTCYCCGESGRNAKNCVLLGNICYNCGRSGHIAKDCKDPKRERRQHCYTCGRLGHLARDCDRQKEQKCYSCGKLGHIQKDCAQVKCYRCGEIGHVAINCSKARPGQLLPLRQIPTSSQGMSQ

SEQ ID NO: 880218 - protein, 86 aa, Homo sapiens
AIIYNLWFGYDVKRAVEEPRLHNQLLPNVTTVERNIDQAVTAALETRHHHTQIASTFIAVVQAIVHTAGGWAAASDSRKGGEPAGY

SEQ ID NO: 880219 - protein, 163 aa, Homo sapiens
MGIQRRSGPLLTGLSVGLLLLFSWVTLVQPTSLSALVHHPHLCQTTRDVHGRHYPGFFCPRLSDSPEEAYCCHLQAAGGSCCTRAEFEALYQVNLSALPPPPILRGPGPLLVLGLYNLLVVTLMTVDLVHFCCGRGRSLGWSHRRPPSGSSAASSLQVSAGTA

SEQ ID NO: 880220 - protein, 114 aa, Homo sapiens
GPCPAQHTGVALRQHLGCCTHGASQPEGLPAALETPAVTSPGPSPSPSSSLLGIKTLKELLLPAREAVARKKGCCKKRKKGCCQHCISVKKLPRKIYGCMLYAPNSKLYWMNGL

SEQ ID NO: 880221 - protein, 738 aa, Homo sapiens
NLSKHSSPSVPKAKMLRTSTPNLCGGLHCRAPWLSSGILCLCLIFLLGQVGLLQGHPQCLDYGPPFQPPLHLEFCSDYESFGCCDQHKDRRIAARYWDIMEYFDLKRHELCGDYIKDILCQECSPYAAHLYDAENTQTPLRNLPGLCSDYCSAFHSNCHSAISLLTNDRGLQESHGRDGTRFCHLLDLPDKDYCFPNVLRNDYLNRHLGMVAQDPQGCLQLCLSEVANGLRNPVSMVHAGDGTHRFFVAEQVGVVWVYLPDGSRLEQPFLDLKNIVLTTPWIGDERGFLGLAFHPKFRHNRKFYIYYSCLDKKKVEKIRISEMKVSRADPNKADLKSERVILEIEEPASNHNGGQLLFGLDGYMYIFTGDGGQAGDPFGLFGNAQNKSSLLGKVLRIDVNRAGSHGKRYRVPSDNPFVSEPGAHPAIYAYGIRNMWRCAVDRGDPITRQGRGRIFCGDVGQNRFEEVDLILKGGNYGWRAKEGFACYDKKLCHNASLDDVLPIYAYGHAVGKSVTGGYVYRGCESPNLNGLYIFGDFMSGRLMALQEDRKNKKWKKQDLCLGSTTSCAFPGLISTHSKFIISFAEDEAGELYFLATSYPSAYAPRGSIYKFVDPSRRAPPGKCKYKPVPVRTKSKRIPFRPLAKTVLDLLKEQSEKAARKSSSATLASGPAQGLSEKGSSKKLASPTSSKNTLRGPGTKKKARVGPHVRQGKRRKSLKSHSGRMRPSAEQKRAGRSLP

SEQ ID NO: 880222 - protein, 105 aa, Homo sapiens
VPLRKCAYREAELPGDSSKLLHLSIIHFLLLLGLCRNEQRQPTCEAGSKMESAMLDFSHCHHLCKGSFISGSPVFQLGPQVRHLSRAPPAALKTHSLKQSFSCGP

SEQ ID NO: 880223 - protein, 139 aa, Homo sapiens
LTAPTASTASSPSPQRPHRVHSVLTAPTAPSPRPQRPHRVHSVLTALTAPSPRPQRPHGPDSVLTVPTASSPSPQRPHRVHSVLTAPTASSRSPQRPHRPHSVLTASTAPSPPPQRPQCPQRSHRPHSVLIVPNVLIVT

SEQ ID NO: 880224 - protein, 129 aa, Homo sapiens
STASFLKSARPRTHRKEPIPDTRSDGSTEKKDSKDSELGVETEATDRRERRKIWGNSHWEQRLGRDYVQKNAWTSGTSDHLPIFRQKLSRSRKMEKSKVPFSGHLEPLLSLYWGQAVLQKKIKHLGFKS

SEQ ID NO: 880225 - protein, 95 aa, Homo sapiens
GLSPGAESVAGARGGREGVTSTAPASSSHTAPSPGHSGSYGGRDQGVQPGLLCLTGEGLLSFSRAAALLLKALLLLLLGVFACLQEVLESKKRSL

SEQ ID NO: 880226 - protein, 1369 aa, Homo sapiens
PRQGKSTLLEILQTGRAPQVVHGEATIRTTKWELQRPAGSRAKVESVEFNVWDIGGPASMATVNQCFFTDKALYVVVWNLALGEEAVANLQFWLLNIEAKAPNAVVLVVGTHLDLIEAKFRVERIATLRAYVLALCRSPSGSRATGFPDITFKHLHEISCKSLEGQEGLRQLIFHVTCSMKDVGSTIGCQRLAGRLIPRSYLSLQEAVLAEQQRRSRDDDVQYLTDRQLEQLVEQTPDNDIKDYEDLQSAISFLIETGTLLHFPDTSHGLRNLYFLDPIWLSECLQRIFNIKGSRSVAKNGVIRAEDLRMLLVGTGFTQQTEEQYFQFLAKFEIALPVANDSYLLPHLLPSKPGLDTHGMRHPTANTIQRVFKMSFVPVGFWQRFIARMLISLAEMDLQLFENKKNTKSRNRKVTIYSFTGNQRNRCSTFRVKRNQTIYWQEGLLVTFDGGYLSVESSDVNWKKKKSGGMKIVCQSEVRDFSAMAFITDHVNSLIDQWFPALTATESDGTPLMEQYVPCPVCETAWAQHTDPSEKSEDVQYFDMEDCVLTAIERDFISCPRHPDLPVPLQELVPELFMTDFPARLFLENSKLEHSEDEGSVLGQGGSGTVIYRARYQGQPVAVKRFHIKKFKNFANVPADTMLRHLRATDAMKNFSEFRQEASMLHALQHPCIVALIGISIHPLCFALELAPLSSLNTVLSENARDSSFIPLGHMLTQKIAYQIASGLAYLHKKNIIFCDLKSDNILVWSLDVKEHINIKLSDYGISRQSFHEGALGVEGTPGYQAPEIRPRIVYDEKVDMFSYGMVLYELLSGQRPALGHHQLQIAKKLSKGIRPVLGQPEEVQFRRLQALMMECWDTKPEKRPLALSVVSQMKDPTFATFMYELCCGKQTAFFSSQGQEYTVVFWDGKEESRNYTVVNTEKGLMEVQRMCCPGMKVSCQLQVQRSLWTATEDQKIYIYTLKGMCPLNTPQQALDTPAVVTCFLAVPVIKKNSYLVLAGLADGLVAVFPVVRGTPKDSCSYLCSHTANRSKFSIADEDARQNPYPVKAMEVVNSGSEVWYSNGPGLLVIDCASLEICRRLEPYMAPSMVTSVVCSSEGRGEEVVWCLDDKANSLVMYHSTTYQLCARYFCGVPSPLRDMFPVRPLDTEPPAASHTANPKVPEGDSIADVSIMYSEELGTQILIHQESLTDYCSMSSYSSSPPRQAARSPSSLPSSPASSSSVPFSTDCEDSDMLHTPGAASDRSEHDLTPMDGETFSQHLQAVKILAVRDLIWVPRRGGDVIVIGLEKDSEAQRGRVIAVLKARELTPHGVLVDAAVVAKDTVVCTFENENTEWCLAVWRGWGAREFDIFYQSYEELGRLEACTRKRR

SEQ ID NO: 880227 - protein, 1337 aa, Homo sapiens
PRQGKSTLLEILQTGRAPQVVHGEATIRTTKWELQRPAGSRAKVESVEFNVWDIGGPASMATVNQCFFTDKALYVVVWNLALGEEAVANLQFWLLNIEAKAPNAVVLVVGTHLDLIEAKFRVERIATLRAYVLALCRSPSGSRATGFPDITFKHLHEISCKSLEGQEGLRQLIFHVTCSMKDVGSTIGCQRLAGRLIPRSYLSLQEAVLAEQQRRSRDDDVQYLTDRQLEQLVEQTPDNDIKDYEDLQSAISFLIETGTLLHFPDTSHGLRNLYFLDPIWLSECLQRIFNIKGSRSVAKNGVIRAEDLRMLLVGTGFTQQTEEQYFQFLAKFEIALPVANDSYLLPHLLPSKPGLDTHGMRHPTANTIQRVFKMSFVPVGFWQRFIARMLISLAEMDLQLFENKKNTKSRNRKVTIYSFTGNQRNRCSTFRVKRNQTIYWQEGLLVTFDGGYLSVESSDVNWKKKKSGGMKIVCQSEVRDFSAMAFITDHVNSLIDQWFPALTATESDGTPLMEQYVPCPVCETAWAQHTDPSEKSEDVQYFDMEDCVLTAIERDFISCPRHPDLPVPLQELVPELFMTDFPARLFLENSKLEHSEDEGSVLGQGGSGTVIYRARYQGQPVAVKRFHIKKFKNFANVPADTMLRHLRATDAMKNFSEFRQEASMLHALQHPCIVALIGISIHPLCFALELAPLSSLNTVLSENARDSSFIPLGHMLTQKIAYQIASGLAYLHKKNIIFCDLKSDNILVWSLDVKEHINIKLSDYGISRQSFHEGALGVEGTPGYQAPEIRPRIVYDEKVDMFSYGMVLYELLSGQRPALGHHQLQIAKKLSKGIRPVLGQPEEVQFRRLQALMMECWDTKPEKRPLALSVVSQMKDPTFATFMYELCCGKQTAFFSSQGQEYTVVFWDGKEESRNYTVVNTEKGLMEVQRMCCPGMKVSCQLQVQRSLWTATEDQKIYIYTLKGMCPLNTPQQALDTPAVVTCFLAVPVIKKNSYLVLAGLADGLVAVFPVVRGTPKDSCSYLCSHTANRSKFSIADEDARQNPYPVKAMEVVNSGSEVWYSNGPGLLVIDCASLEICRRLEPYMAPSMVTSVVCSSEGRGEEVVWCLDDKANSLVMYHSTTYQLCARYFCGVPSPLRDMFPVRPLDTEPPAASHTANPKVPEGDSIADVSIMYSEELGTQILIHQESLTDYCSMSSYSSSPPRQAARSPSSLPSSPASSSSVPFSTDCEDSDMLHTPGAASDRSEHDLTPMDGETFSQHLQAVKILAVRDLIWVPRRGGDVIVIGLEKDSEAQRGRVIAVLKARELTPHGIMPVSSVKVCWAGWPVRDMVYMAAVM

SEQ ID NO: 880228 - protein, 534 aa, Homo sapiens
PLTGFGASTRCTHKYHRELLRGCAPRSQCWFSLGNRLRAIFCFLFRLVCLFQRFYKEQKSINNPPERVNPCNFPRPIGDPQVQVHPHGNGLGNARHFPAWVSQWTCLPLQDQKIYIYTLKGMCPLNTPQQALDTPAVVTCFLAVPVIKKNSYLVLAGLADGLVAVFPVVRGTPKDSCSYLCSHTANRSKFSIADEDARQNPYPVKAMEVVNSGSEVWYSNGPGLLVIDCASLEICRRLEPYMAPSMVTSVVCSSEGRGEEVVWCLDDKANSLVMYHSTTYQLCARYFCGVPSPLRDMFPVRPLDTEPPAASHTANPKVPEGDSIADVSIMYSEELGTQILIHQESLTDYCSMSSYSSSPPRQAARSPSSLPSSPASSSSVPFSTDCEDSDMLHTPGAASDRSEHDLTPMDGETFSQHLQAVKILAVRDLIWVPRRGGDVIVIGLEKDSEAQRGRVIAVLKARELTPHGVLVDAAVVAKDTVVCTFENENTEWCLAVWRGWGAREFDIFYQSYEELGRLEACTRKRSLQHSASGL

SEQ ID NO: 880229 - protein, 77 aa, Homo sapiens
TYIPSTDHDPTNQSRMQQRHQPKPADSNKSDPLALTANKHKDSPTSAMTVYKCHGNNPEVSLYGSRNSPTPFLENSE

SEQ ID NO: 880230 - protein, 65 aa, Homo sapiens
MAGNFDSEERSSWYWGRLSRQEAVALLQGQRHGVFLVRDSSTSPGDYVLSVSENSRVSHYIINSS

SEQ ID NO: 880231 - protein, 572 aa, Homo sapiens
MSFQGKKSIPRITSDRLLIRGGRIVNDDQSFYADVHVEDGLIKQIGENLIVPGGIKTIDAHGLMVLPGGVDVHTRLQMPVLGMTPADDFCQGTKAALAGGTTMILDHVFPDTGVSLLAAYEQWRERADSAACCDYSLHVDITRWHESIKEELEALVKEKGVNSFLVFMAYKDRCQCSDSQMYEIFSIIRDLGALAQVHAENGDIVEEEQKRLLELGITGPEGHVLSHPEEVEAEAVYRAVTIAKQANCPLYVTKVMSKGAADAIAQAKRRGVVVFGEPITASLGTDGSHYWSKNWAKAAAFVTSPPVNPDPTTADHLTCLLSSGDLQVTGSAHCTFTTAQKAVGKDNFALIPEGTNGIEERMSMVWEKCVASGKMDENEFVAVTSTNAAKIFNFYPRKGRVAVGSDADLVIWNPKATKIISAKTHNLNVEYNIFEGVECRGAPAVVISQGRVALEDGKMFVTPGAGRFVPRKTFPDFVYKRIKARNRLAEIHGVPRGLYDGPVHEVMVPAKPGSGAPARASCPGKISVPPVRNLHQSGFSLSGSQADDHIARRTAQKIMAPPGGRSNITSLS

SEQ ID NO: 880232 - protein, 154 aa, Homo sapiens
EDCKEGGVCELGLSTPPGQPQIPEAGTGEAQSRPSPPAAHAQPLMPHLWPHSCPGSAPHALSLPPPPRQLAEIHGVPRGLYDGPVHEVMVPAKPGSGAPARASCPGKISVPPVRNLHQSGFSLSGSQADDHIARRTAQKIMAPPGGRSNITSLS

SEQ ID NO: 880233 - protein, 509 aa, Homo sapiens
MVLPGGVDVHTRLQMPVLGMTPADDFCQGTKAALAGGTTMILDHVFPDTGVSLLAAYEQWRERADSAACCDYSLHVDITRWHESIKEELEALVKEKGVNSFLVFMAYKDRCQCSDSQMYEIFSIIRDLGALAQVHAENGDIVEEEQKRLLELGITGPEGHVLSHPEEVEAEAVYRAVTIAKQANCPLYVTKVMSKGAADAIAQAKRRGVVVFGEPITASLGTDGSHYWSKNWAKAAAFVTSPPVNPDPTTADHLTCLLSSGDLQVTGSAHCTFTTAQKAVGKDNFALIPEGTNGIEERMSMVWEKCVASGKMDENEFVAVTSTNAAKIFNFYPRKGRVAVGSDADLVIWNPKATKIISAKTHNLNVEYNIFEGVECRGAPAVVISQGRVALEDGKMFVTPGAGRFVPRKTFPDFVYKRIKARNRLAEIHGVPRGLYDGPVHEVMVPAKPGSGAPARASCPGKISVPPVRNLHQSGFSLSGSQADDHIARRTAQKIMAPPGGRSNITSLS

SEQ ID NO: 880234 - protein, 105 aa, Homo sapiens [sequence omitted]

SEQ ID NO: 880235 - protein, 549 aa, Homo sapiens
MSFQGKKSIPRITSDRLLIRGGRIVNDDQSFYADVHVEDGLIKQIGENLIVPGGIKTIDAHGLMVLPGGVDVHTRLQMPVLGMTPADDFCQGTKAALAGGTTMILDHVFPDTGVSLLAAYEQWRERADSAACCDYSLHVDITRWHESIKEELEALVKEKGVNSFLVFMAYKDRCQCSDSQMYEIFSIIRDLGALAQVHAENGDIVEEVEAEAVYRAVTIAKQANCPLYVTKVMSKGAADAIAQAKRRGVVVFGEPITASLGTDGSHYWSKNWAKAAAFVTSPPVNPDPTTADHLTCLLSSGDLQVTGSAHCTFTTAQKAVGKDNFALIPEGTNGIEERMSMVWEKCVASGKMDENEFVAVTSTNAAKIFNFYPRKGRVAVGSDADLVIWNPKATKIISAKTHNLNVEYNIFEGVECRGAPAVVISQGRVALEDGKMFVTPGAGRFVPRKTFPDFVYKRIKARNRLAEIHGVPRGLYDGPVHEVMVPAKPGSGAPARASCPGKISVPPVRNLHQSGFSLSGSQADDHIARRTAQKIMAPPGGRSNITSLS

SEQ ID NO: 880236 - protein, 512 aa, Homo sapiens
MSFQGKKSIPRITSDRLLIRGGRIVNDDQSFYADVHVEDGLIKQIGENLIVPGGIKTIDAHGLMVLPGGVDVHTRLQMPVLGMTPADDFCQGTKAALAGGTTMILDHVFPDTGVSLLAAYEQWRERADSAACCDYSLHVDITRWHESIKEELEALVKEKGVNSFLVFMAYKDRCQCSDSQMYEIFSIIRDLGALAQVHAENGDIVEEEQKRLLELGITGPEGHVLSHPEEVEAEAVYRAVTIAKQANCPLYVTKVMSKGAADAIAQAKRRGVVVFGEPITASLGTDGSHYWSKNWAKAAAFVTSPPVNPDPTTADHLTCLLSSGDLQVTGSAHCTFTTAQKAVGKDNFALIPEGTNGIEERMSMVWEKCVASGKMDENEFVAVTSTNAAKIFNFYPRKGRVAVGSDADLVIWNPKATKIISAKTHNLLAEIHGVPRGLYDGPVHEVMVPAKPGSGAPARASCPGKISVPPVRNLHQSGFSLSGSQADDHIARRTAQKIMAPPGGRSNITSLS

SEQ ID NO: 880237 - protein, 829 aa, Homo sapiens
EQSPFTHLRNTFRLPAPQTHLQPCPAGFAHPLLVNAPDMSQPRPRYVVDRAAYSLTLFDDEFEKKDRTYPVGEKLRNAFRCSSAKIKAVVFGLLPVLSWLPKYKIKDYIIPDLLGGLSGGSIQVPQGMAFALLANLPAVNGLYSSFFPLLTYFFLGGVHQMVPGTFAVISILVGNICLQLAPESKFQVFNNATNESYVDTAAMEAERLHVSATLACLTAIIQMGLGFMQFGFVAIYLSESFIRGFMTAAGLQILISVLKYIFGLTIPSYTGPGSIVFTFIDICKNLPHTNIASLIFALISGAFLVLVKELNARYMHKIRFPIPTEMIVVVVATAISGGCKMPKKYHMQIVGEIQRGFPTPVSPVVSQWKDMIGTAFSLAIVSYVINLAMGRTLANKHGYDVDSNQEMIALGCSNFFGSFFKIHVICCALSVTLAVDGAGGKSQVASLCVSLVVMITMLVLGIYLYPLPKSVLGALIAVNLKNSLKQLTDPYYLWRKSKLDCCIWVVSFLSSFFLSLPYGVAVGVAFSVLVVVFQTQFRNGYALAQVMDTDIYVNPKTYNRAQDIQGIKIITYCSPLYFANSEIFRQKVIAKTGMDPQKVLLAKQKYLKKQEKRRMRPTQQRRSLFMKTKTVSLQELQQDFENAPPTDPNNNQTPANGTSVSYITFSPDSSSPAQSEPPASAEAPGEPSDMLASVPPFVTFHTLILDMSGVSFVDLMGIKALAKLSSTYGKIGVKVFLVNIHAQVYNDISHGGVFEDGSLECKHVFPSIHDAVLFAQANARDVTPGHNFQGAPGDAELSLYDSEEDIRSYWDLEQEMFGSMFHAETLTAL

SEQ ID NO: 880238 - protein, 374 aa, Homo sapiens
MLFKEKKEKRGSEVVLTENGLGYIQEDFLKEVVFSPGLLLTSLFSQCIWVVSFLSSFFLSLPYGVAVGVAFSVLVVVFQTQFRNGYALAQVMDTDIYVNPKTYNRAQDIQGIKIITYCSPLYFANSEIFRQKVIAKTGMDPQKVLLAKQKYLKKQEKRRMRPTQQRRSLFMKTKTVSLQELQQDFENAPPTDPNNNQTPANGTSVSYITFSPDSSSPAQSEPPASAEAPGEPSDMLASVPPFVTFHTLILDMSGVSFVDLMGIKALAKLSSTYGKIGVKVFLVNIHAQVYNDISHGGVFEDGSLECKHVFPSIHDAVLFAQANARDVTPGHNFQGAPGDAELSLYDSEEDIRSYWDLEQEMFGSMFHAETLTAL

SEQ ID NO: 880239 - protein, 839 aa, Homo sapiens
EQSPFTHLRNTFRLPAPQTHLQPCPAGFAHPLLVNAPDMSQPRPRYVVDRAAYSLTLFDDEFEKKDRTYPVGEKLRNAFRCSSAKIKAVVFGLLPVLSWLPKYKIKDYIIPDLLGGLSGGSIQVPQGMAFALLANLPAVNGLYSSFFPLLTYFFLGGVHQMVPGTFAVISILVGNICLQLAPESKFQVFNNATNESYVDTAAMEAERLHVSATLACLTAIIQMGLGFMQFGFVAIYLSESFIRGFMTAAGLQILISVLKYIFGLTIPSYTGPGSIVFTFIDICKNLPHTNIASLIFALISGAFLVLVKELNARYMHKIRFPIPTEMIVVVVATAISGGCKMPKKYHMQIVGEIQRGFPTPVSPVVSQWKDMIGTAFSLAIVSYVINLAMGRTLANKHGYDVDSNQEMIALGCSNFFGSFFKIHVICCALSVTLAVDGAGGKSQVASLCVSLVVMITMLVLGIYLYPLPKSVLGALIAVNLKNSLKQLTDPYYLWRKSKLDCVCFVTSLFSQCIWVVSFLSSFFLSLPYGVAVGVAFSVLVVVFQTQFRNGYALAQVMDTDIYVNPKTYNRAQDIQGIKIITYCSPLYFANSEIFRQKVIAKTGMDPQKVLLAKQKYLKKQEKRRMRPTQQRRSLFMKTKTVSLQELQQDFENAPPTDPNNNQTPANGTSVSYITFSPDSSSPAQSEPPASAEAPGEPSDMLASVPPFVTFHTLILDMSGVSFVDLMGIKALAKLSSTYGKIGVKVFLVNIHAQVYNDISHGGVFEDGSLECKHVFPSIHDAVLFAQANARDVTPGHNFQGAPGDAELSLYDSEEDIRSYWDLEQEMFGSMFHAETLTAL

SEQ ID NO: 880240 - protein, 138 aa, Homo sapiens
VRAANSKVAFSAVRSTNHEPSEMSNKTRIIYFDQILVNVGNFFTLESVFVAPRKGIYSFSFHVIKVYQSQTIQVNLMLNGKPVISAFAGDKDVTREAATNGVLLYLDKEDKVYLKLEKGNLVGGWQYSTFSGFLVFPL

SEQ ID NO: 880241 - protein, 208 aa, Homo sapiens
SPTRGTLGGVTRTTNEAILLCEGAGYDIILIETVGVGQSEFAVADMVDMFVLLLPPAGGDELQGIKRGIIEMADLVAVTKSDGDLIVPARRIQAEYVSALKLLRKRSQVWKPKVIRISARSGEGISEMWDKMKDFQDLMLASGELTAKRRKQQKVWMWNLIQESVLEHFRTHPTVREQIPLLEQKVLIGALSPGLAADFLLKAFKSRD

SEQ ID NO: 880242 - protein, 155 aa, Homo sapiens
MKLFCCVKERGIKRGIIEMADLVAVTKSDGDLIVPARRIQAEYVSALKLLRKRSQVWKPKVIRISARSGEGISEMWDKMKDFQDLMLASGELTAKRRKQQKVWMWNLIQESVLEHFRTHPTVREQIPLLEQKVLIGALSPGLAADFLLKAFKSRD

SEQ ID NO: 880243 - protein, 99 aa, Homo sapiens
PVQLLRSALNTLPTLGLCCPTRSPHFNRCRHPKAPSQQPEEKPSSEETAEKQSPLGRPPRPPRLPSTRRGGGACTSRGCGNKLPHTGRLNTAEVYSTQS

SEQ ID NO: 880244 - protein, 112 aa, Homo sapiens
HLHCCQGAKRIWVTAAQAIRQARDSELSFLTASWKSHGLCVYCCLWDVILYCLGLCFANCKTTKWTRTTVLGTFQPKHPAAQPGSLAVPPGPWVVATLLALVTPWAAVVLPA

SEQ ID NO: 880245 - protein, 855 aa, Homo sapiens
MILIPRMLLVLFLLLPILSSAKAQVNPAICRYPLGMSGGQIPDEDITASSQWSESTAAKYGRLDSEEGDGAWCPEIPVEPDDLKEFLQIDLHTLHFITLVGTQGRHAGGHGIEFAPMYKINYSRDGTRWISWRNRHGKQVLDGNSNPYDIFLKDLEPPIVARFVRFIPVTDHSMNVCMRVELYGCVWLDGLVSYNAPAGQQFVLPGGSIIYLNDSVYDGAVGYSMTEGLGQLTDGVSGLDDFTQTHEYHVWPGYDYVGWRNESATNGYIEIMFEFDRIRNFTTMKVHCNNMFAKGVKIFKEVQCYFRSEASEWEPNAISFPLVLDDVNPSARFVTVPLHHRMASAIKCQYHFADTWMMFSEITFQSDAAMYNNSEALPTSPMAPTTYDPMLKVDDSNTRILIGCLVAIIFILLAIIVIILWRQFWQKMLEKASRRMLDDEMTVSLSLPSDSSMFNNNRSSSPSEQGSNSTYDRIFPLRPDYQEPSRLIRKLPEFAPGEEESGCSGVVKPVQPSGPEGVPHYAEADIVNLQGVTGGNTYSVPAVTMDLLSGKDVAVEEFPRKLLTFKEKLGEGQFGEVHLCEVEGMEKFKDKDFALDVSANQPVLVAVKMLRADANKNARNDFLKEIKIMSRLKDPNIIHLLAVCITDDPLCMITEYMENGDLNQFLSRHEPPNSSSSDVRTVSYTNLKFMATQIASGMKYLSSLNFVHRDLATRNCLVGKNYTIKIADFGMSRNLYSGDYYRIQGRAVLPIRWMSWESILLGKFTTASDVWAFGVTLWETFTFCQEQPYSQLSDEQVIENTGEFFRDQGRQTYLPQPAICPDSVYKLMLSCWRRDTKNRPSFQEIHLLLLQQGDE

SEQ ID NO: 880246 - protein, 855 aa, Homo sapiens; identical to SEQ ID NO: 880245

SEQ ID NO: 880247 - protein, 842 aa, Homo sapiens
MILIPRMLLVLFLLLPILSSAKAQVNPAICRYPLGMSGGQIPDEDITASSQWSESTAAKYGRLDSEEGDGAWCPEIPVEPDDLKEFLQIDLHTLHFITLVGTQGRHAGGHGIEFAPMYKINYSRDGTRWISWRNRHGKQVLDGNSNPYDIFLKDLEPPIVARFVRFIPVTDHSMNVCMRVELYGCVWLDGLVSYNAPAGQQFVLPGGSIIYLNDSVYDGAVGYSMTEGLGQLTDGVSGLDDFTQTHEYHVWPGYDYVGWRNESATNGYIEIMFEFDRIRNFTTMKVHCNNMFAKGVKIFKEVQCYFRSEASEWEPNAISFPLVLDDVNPSARFVTVPLHHRMASAIKCQYHFADTWMMFSEITFQSDAAMYNNSEALPTSPMAPTTYDPMLKVDDSNTRILIGCLVAIIFILLAIIVIILWRQFWQKMLEKASRRMLDDEMTVSLSLPSDSSMFNNNRSSSPSEQGSNSTYDRIFPLRPDYQEPSRLIRKLPEFAPGEEESGCSGVVKPVQPSGPEGVPHYAEADIVNLQGVTGGNTYSVPAVTMDLLSGKDVAVEEFPRKLLTFKEKLGEGQFGEVHLCEVEGMEKFKDKDFALDVSANQPVLVADDFLKEIKIMSRLKDPNIIHLLAVCITDDPLCMITEYMENGDLNQFLSRHEPPNSSSSDVRTVSYTNLKFMATQIASGMKYLSSLNFVHRDLATRNCLVGKNYTIKIADFGMSRNLYSGDYYRIQGRAVLPIRWMSWESILLGKFTTASDVWAFGVTLWETFTFCQEQPYSQLSDEQVIENTGEFFRDQGRQTYLPQPAICPDSVYKLMLSCWRRDTKNRPSFQEIHLLLLQQGDE

SEQ ID NO: 880248 - protein, 556 aa, Homo sapiens
MILIPRMLLVLFLLLPILSSAKAQVNPAICRYPLGMSGGQIPDEDITASSQWSESTAAKYGRLDSEEGDGAWCPEIPVEPDDLKEFLQIDLHTLHFITLVGTQGRHAGGHGIEFAPMYKINYSRDGTRWISWRNRHGKQVLDGNSNPYDIFLKDLEPPIVARFVRFIPVTDHSMNVCMRVELYGCVWLDGLVSYNAPAGQQFVLPGGSIIYLNDSVYDGAVGYSMTEGLGQLTDGVSGLDDFTQTHEYHVWPGYDYVGWRNESATNGYIEIMFEFDRIRNFTTMKVHCNNMFAKGVKIFKEVQCYFRSEASEWEPNAISFPLVLDDVNPSARFVTVPLHHRMASAIKCQYHFADTWMMFSEITFQSDAAMYNNSEALPTSPMAPTTYDPMLKVDDSNTRILIGCLVAIIFILLAIIVIILWRQFWQKMLEKASRRMLDDEMTVSLSLPSDSSMFNNNRSSSPSEQGSNSTYDRIFPLRPDYQEPSRLIRKLPEFAPGEEESGEDDVVGRASREKPQQASGRYDTPAPSSLHLFLVSANLLRSPHSLSRFGLPLLLA

SEQ ID NO: 880249 - protein, 855 aa, Homo sapiens; identical to SEQ ID NO: 880245

SEQ ID NO: 880250 - protein, 842 aa, Homo sapiens; identical to SEQ ID NO: 880247

SEQ ID NO: 880251 - protein, 829 aa, Homo sapiens
MILIPRMLLVLFLLLPILSSAKAQVNPAICRYPLGMSGGQIPDEDITASSQWSESTAAKYGRLDSEEGDGAWCPEIPVEPDDLKEFLQIDLHTLHFITLVGTQGRHAGGHGIEFAPMYKINYSRDGTRWISWRNRHGKQVLDGNSNPYDIFLKDLEPPIVARFVRFIPVTDHSMNVCMRVELYGCVWLDGLVSYNAPAGQQFVLPGGSIIYLNDSVYDGAVGYSMTEGLGQLTDGVSGLDDFTQTHEYHVWPGYDYVGWRNESATNGYIEIMFEFDRIRNFTTMKVHCNNMFAKGVKIFKEVQCYFRSEASEWEPNAISFPLVLDDVNPSARFVTVPLHHRMASAIKCQYHFADTWMMFSEITFQSDAAMYNNSEALPTSPMAPTTYDPMLKVDDSNTRILIGCLVAIIFILLAIIVIILWRQFWQKMLEKLSLPSDSSMFNNNRSSSPSEQGSNSTYDRIFPLRPDYQEPSRLIRKLPEFAPGEEESGCSGVVKPVQPSGPEGVPHYAEADIVNLQGVTGGNTYSVPAVTMDLLSGKDVAVEEFPRKLLTFKEKLGEGQFGEVHLCEVEGMEKFKDKDFALDVSANQPVLVADDFLKEIKIMSRLKDPNIIHLLAVCITDDPLCMITEYMENGDLNQFLSRHEPPNSSSSDVRTVSYTNLKFMATQIASGMKYLSSLNFVHRDLATRNCLVGKNYTIKIADFGMSRNLYSGDYYRIQGRAVLPIRWMSWESILLGKFTTASDVWAFGVTLWETFTFCQEQPYSQLSDEQVIENTGEFFRDQGRQTYLPQPAICPDSVYKLMLSCWRRDTKNRPSFQEIHLLLLQQGDE

SEQ ID NO: 880252 - protein, 71 aa, Homo sapiens
GMEKFKDKDFALDVSANQPVLVAVKMLRADANKNARSVVYILNFPLCISSLGPGILLDTSEQFFLLRWEGQ

SEQ ID NO: 880253 - protein, 129 aa, Homo sapiens
MEEEFLKSQISSLLKRQEQMAIKLCQELIIHTSDHRCNPCPKMWQWYQNSCYYFTTNEEKTWANSRKDCIDKNSTLVKIDSLEEKDFLMSQPLLMFSFFWLGLSWDSSGRSWFWEDGSVPSPSLYVSNY

SEQ ID NO: 880254 - protein, 129 aa, Homo sapiens; identical to SEQ ID NO: 880253

SEQ ID NO: 880255 - protein, 268 aa, Homo sapiens
MEDFLLSNGYQLGKTIGEGTYSKVKEAFSKKHQRKVAIKVIDKMGGPEEFIQRFLPRELQIVRTLDHKNIIQVYEMLESADGKICLVMELAEGGDVFDCVLNGGPLPESRAKALFRQMVEAIRYCHGCGVAHRDLKCENALLQGFNLKLTDFGFAKVLPKSHRELSQTFCGSTAYAAPEVLQGIPHDSKKGDVWSMGVVLYVMLCASLPFDDTDIPKMLWQQQKGVSFPTHLSISADCQDLLKRLLEPDMILRPSIEEVSWHPWLAST

SEQ ID NO: 880256 - protein, 83 aa, Homo sapiens
GTGGLWPWRLETGSRRPRTPEGGAAGQGNPPRGGVHAEEPRIPGPHRRGGAPSQAGLQLNAWHGGGLGGDLIRAEFGGGSEGR

SEQ ID NO: 880257 - protein, 201 aa, Homo sapiens
MEDFLLSNGYQLGKTIGEGTYSKVKEAFSKKHQRKVAIKVIDKMGGPEEFIQRFLPRELQIVRTLDHKNIIQVYEMLESADGKICLVMELAEGGDVFDCVLNGGPLPESRAKALFRQMVEAIRYCHGCGVAHRDLKCENALLQGFNLKLTDFGFAKVLPKSHRELSQTFCGSTAYAAPEVLQGISPRCCGSSRRGCPSPLI

SEQ ID NO: 880258 - protein, 113 aa, Homo sapiens
PQDFFLASQVKFEDLIKDLRKLKRQLEASEKQMVVVCKESPKEYLQPFKDKLEEFFQKGHPFPMSACCASVGVKHLFLLESAQRGFSKKWKTIATLTSDGSHVKQSAVPLFPR

SEQ ID NO: 880259 - protein, 90 aa, Homo sapiens
PQDFFLASQVKFEDLIKDLRKLKRQLEASEKQMVVVCKESPKEYLQPFKDKLEEFFQKGRKLCQPHIHVALKHPSFHESFSEAHGPWHPG

SEQ ID NO: 880260 - protein, 237 aa, Homo sapiens [sequence omitted]

SEQ ID NO: 880261 - protein, 237 aa, Homo sapiens [sequence omitted]

SEQ ID NO: 880262 - protein, 237 aa, Homo sapiens [sequence omitted]

SEQ ID NO: 880263 - protein, 237 aa, Homo sapiens [sequence omitted]

SEQ ID NO: 880264 - protein, 236 aa, Homo sapiens
VNRKGDGRIAERQRYTFELSAGPPSLALAIWVRVSNDSQAIFGSEDVGSSSYVAVDILIAVGAIIMILGFLACCGAIKESRCMLLLFFIGLLLILLLQVATGILGAVFKSKSDRIVNETLYENTKLLSATGESEKQFQEAIIVFQEEFKCCGLVNGAADWGNNFQHYPELCACLDKQRPCQSYNGKQVYKETCISFIKDFLAKNLIIVIGISFGLAVIEILGLVFSMVLYCQIGNK

SEQ ID NO: 880265 - protein, 198 aa, Homo sapiens
MAGVSACIKYSMFTFNFLFWLCGILILALAIWVRVSNDSQAIFGSEDVGSSSYVAVDILIAVGAIIMILGFLACCGAIKESRCMLLLFFIGLLLILLLQVATGILGAVFKSKSDRIVNETLYENTKLLSATGESEKQFQEAIIVFQEEFKCCGLVNGAADWGNNFQHYPELCACLDKQRPCQSYNGKQVYKETSWQKI

SEQ ID NO: 880266 - protein, 237 aa, Homo sapiens [sequence omitted]

SEQ ID NO: 880267 - protein, 195 aa, Homo sapiens
MAGVSACIKYSMFTFNFLFWLCGILILALAIWVRVSNDSQAIFGSEDVGSSSYVAVDILIAVGAIIMILGFLACCGAIKESRCMLLLFFIGLLLILLLQVATGILGAVFKSKSDRIVNETLYENTKLLSATGESEKQFQEAIIVFQEEFKCCGLVNGAADWGNNFQHYPELCACLDKQRPCQALWHTRSTETGSF

SEQ ID NO: 880268 - protein, 237 aa, Homo sapiens [sequence omitted]

SEQ ID NO: 880269 - protein, 232 aa, Homo sapiens [sequence omitted]

SEQ ID NO: 880270 - protein, 154 aa, Homo sapiens
MNPSFFIGLLLILLLQVATGILGAVFKSKSDRIVNETLYENTKLLSATGESEKQFQEAIIVFQEEFKCCGLVNGAADWGNNFQHYPELCACLDKQRPCQSYNGKQVYKETCISFIKDFLAKNLIIVIGISFGLAVIEILGLVFSMVLYCQIGNK

SEQ ID NO: 880271 - protein, 221 aa, Homo sapiens
MAGVSACIKYSMFTFNFLFWLCGILILALAIWVRVSNDSQAIFGSEDVGSSSYVAVDILIAVGAIIMILGFLACCGAIKESRCMLLLFFIGLLLILLLQVATGILGAVFKSKSDRIVNETLYENTKLLSATGFKCCGLVNGAADWGNNFQHYPELCACLDKQRPCQSYNGKQVYKETCISFIKDFLAKNLIIVIGISFGLAVIEILGLVFSMVLYCQIGNK

SEQ ID NO: 880272 - protein, 81 aa, Homo sapiens
CSRIPSRERKHPRPPASSRAPPASPARRNEDNPVEPDPGVDRWPETGYVKKLQRRDNTFYYYNKQRECDDKEVHKVKIYAY

SEQ ID NO: 880273 - protein, 101 aa, Homo sapiens
HLSDIIDNKASVTMASSDVKPKSVSHAKKWSEEIENLYRFQQAGYRDETEYRQVKQVSMVDRWPETGYVKKLQRRDNTFYYYNKQRECDDKEVHKVKIYAY

SEQ ID NO: 880274 - protein, 126 aa, Homo sapiens
CSRIPSRERKHPRPPASSRAPPASPARRNEDNPVEPDPGARKFPRSNGNDQVESQEEKKVQRCQGTSKGKMSRSQQAKEQLSCPKDCPISSSSAPDVRKRHWLYCFLTGSDGFQIICSWPQEGRGL

SEQ ID NO: 880275 - protein, 153 aa, Homo sapiens
CSRIPSRERKHPRPPASSRAPPASPARRNEDNPVEPDPGVDRWPETGYVKKLQRRDNTFYYYNKQRECDDKEVHKRRGFTMLAKRVSNSWTQVIPATQPPRVEKLRGVTDKMRDFHILDDGELSHNPTVQLGIQQAKEKGHQNEEDTEKKISV

SEQ ID NO: 880276 - protein, 126 aa, Homo sapiens; identical to SEQ ID NO: 880274

SEQ ID NO: 880277 - protein, 109 aa, Homo sapiens
TVLKKRHGEEESSPLLNYVSCHDPNNNAPLRWPDVQYQILGGRTANQIIFGHNGFYVFYISIVDPYYSYCQLETIFSIYVYGAFPVQLVSAGVVILLIISSILGSVWLA

SEQ ID NO: 880278 - protein, 113 aa, Homo sapiens
MSGHQRTRSRSRERRDDQDSNHPVGAVVAQELPSDDQLQQEEPPIESQDYTPGQERDEGALDFQVLGLAAYLWELTRSKTGGERGDGPNVKGEFLPNLEPVKIPEAGEGQPSV

SEQ ID NO: 880279 - protein, 120 aa, Homo sapiens
FSLRNACYYASNKGLKSRIYKELNSTRKNNLINKWGKDRNRHFSKEDIQEDKKHKIKCSISLTVSEMQVKTTMRCHITPVGMAIIKKSKNHRCRQRCREKGALIHRWCEYELVQPLWTTV

SEQ ID NO: 880280 - protein, 904 aa, Homo sapiens
MTKLKEALIETVQRQKEIKLVVTFKSGKFIRIFQLSNNIRSVVLRHCKKRQSHLRLTLKNNVFLFIDKLSYRDAKQLNMFLDIIHQNKSQQPMKSDDDWSVFESRNMLKEIDKTSFYSICNKPSYQKMPLFMSKSPTHVKKGILENQGGKGQNTLSSDVQTNEDILKEDNPVPNKKYKTDSLKYIQSNRKNPSSLEDLEKDRDLKLGPSFNTNCNGNPNLDETVLATQTLNAKNGLTSPLEPEHSQGDPRCNKAQVPLDSHSQQLQQGFPNLGNTCYMNAVLQSLFAIPSFADDLLTQGVPWEYIPFEALIMTLTQLLALKDFCSTKIKRELLGNVKKVISAVAEIFSGNMQNDAHEFLGQCLDQLKEDMEKLNATLNTGKECGDENSSPQMHVGSAATKVFVCPVVANFEFELQLSLICKACGHAVLKVEPNNYLSINLHQETKPLPLSIQNSLDLFFKEEELEYNCQMCKQKSCVARHTFSRLSRVLIIHLKRYSFNNAWLLVKNNEQVYIPKSLSLSSYCNESTKPPLPLSSSAPVGKCEVLEVSQEMISEINSPLTPSMKLTSESSDSLVLPVEPDKNADLQRFQRDCGDASQEQHQRDLENGSALESELVHFRDRAIGEKELPVADSLMDQGDISLPVMYEDGGKLISSPDTRLVEVHLQEVPQHPELQKYEKTNTFVEFNFDSVTESTNGFYDCKENRIPEGSQGMAEQLQQCIEESIIDEFLQQAPPPGVRKLDAQEHTEETLNQSTELRLQKADLNHLGALGSDNPGNKNILDAENTRGEAKELTRNVKMGDPLQAYRLISVVSHIGSSPNSGHYISDVYDFQKQAWFTYNDLCVSEISETKMQEARLHSGYIFFYMHNGIFEELLRKAENSRLPSTQAGVIPQGEYEGDSLYRPA

SEQ ID NO: 880281 - protein, 98 aa, Homo sapiens
LAAISPQEVGVLTGPDRHTFLQAGLSVGGRRCCVIRDHLLAEGDGVLDARTKGLDARAVCVGRAPRALLVLMGRRGVHGGILNKTVHELIRGLRMQGA

SEQ ID NO: 880282 - protein, 532 aa, Homo sapiens
MTQLYIYIRLLGAYLFIISRVQGQNLDSMLHGTGMKSDSDQKKSENGVTLAPEDTLPFLKCYCSGHCPDDAINNTCITNGHCFAIIEEDDQGETTLASGCMKYEGSDFQCKDSPKAQLRRTIECCRTNLCNQYLQPTLPPVVIGPFFDGSIRWLVLLISMAVCIIAMIIFSSCFCYKHYCKSISSRRRYNRDLEQDEAFIPVGESLKDLIDQSQSSGSGSGLPLLVQRTIAKQIQMVRQVGKGRYGEVWMGKWRGEKVAVKVFFTTEEASWFRETEIYQTVLMRHENILGFIAADIKGTGSWTQLYLITDYHENGSLYDFLKCATLDTRALLKLAYSAACGLCHLHTEIYGTQGKPAIAHRDLKSKNILIKKNGSCCIADLGLAVKFNSDTNEVDVPLNTRVGTKRYMAPEVLDESLNKNHFQPYIMADIYSFGLIIWEMARRCITGGIVEEYQLPYYNMVPSDPSYEDMREVVCVKRLRPIVSNRWNSDECLRAVLKLMSECWAHNPASRLTALRIKKTLAKMVESQDVKI

SEQ ID NO: 880283 - protein, 73 aa, Homo sapiens
AWRGAFSPYLARTFQDCGPALALSWSAMPGLGQVSVDSTLPTHTHTDTHTHALLPHMGERAWVPLPTGFPGPF

SEQ ID NO: 880284 - protein, 772 aa, Homo sapiens
YSHIFLFIDHLLRTASQHSDSSGFAEDSTDCLSLNHLQVQESLQAMGSSADSCDSETTVTSLGEDLATPTAQDQPYFNESEEESLVPLQKGLEKAAAVADKRKSGSQDFPQCNTIENTGTKQSTCSPGDHIIEITEVEEDLFPAETVELLREASAESDVGKSSESEFTQYTTHHILKSLASIEAKCSDMSSENTTGPPSSMDRVNTALQRAQMKVCSLSNQRMGRSLLKSKDLLKQRYLFAKAGYPLRRSQSLPTTLLSPVRVVSSVNVRLSPGKETRCSPPSFTYKYTPEEEQELEKRVMEHDGQSLVKSTIFISPSSVKKEEAPQSEAPRVEECHHGRTPTCSRLAPPPMSQSTCSLHSIHSEWQERPLCEHTRTLSTHSVPNISGATCSAFASPFGCPYSHRHATYPYRVCSVNPPSAIEMQLRRVLHDIRNSLQNLSQYPMMRGPDPAAAPYSTQKSSVLPLYENTFQELQVMRRSLNLFRTQMMDLELAMLRQQTMVYHHMTEEERFEVDQLQGLRNSVRMELQDLELQLEERLLGLEEQLRAVRMPSPFRSSALMGMCGSRSADNLSCPSPLNVMEPVTELMQEQSYLKSELGLGLGEMGFEIPPGESSESVFSQATSESSSVCSGPSHANRRTGVPSTASVGKSKTPLVARKKVFRASVALTPTAPSRTGSVQTPPDLESSEEVDAAEGAPEVVGPKSEVEEGHGKLPSMPAAEEMHKNVEQDELQQVIREIKESIVGEIRREIVSGLLAAVSSSKASNSKQDYH

SEQ ID NO: 880285 - protein, 226 aa, Homo sapiens
ASAPRGPLPGRALTARAGVPAAALSRAGSGWGSGAPSAAMDRPLSSSAEAEEELEWQVASRRRKAWAKCRSSWQASETEDLSTEATTQDEEEDEEEDLPGAQLPAAGGRGNVPNEKIAIWLKDCRTPLGASLDEQSSSTLKGVLVRNGGSFEDDLSLGAEANHLHCTVMLKLDNCHNISATDETITVSSDKGAQYDSHWIWHTVVATVPSASRTVATPHERQLPRP

SEQ ID NO: 880286 - protein, 1096 aa, Homo sapiens
ASAPRGPLPGRALTARAGVPAAALSRAGSGWGSGAPSAAMDRPLSSSAEAEEELEWQVASRRRKAWAKCRSSWQASETEDLSTEATTQDEEEDEEEDLPGAQLPAAGGRGNVPNEKIAIWLKDCRTPLGASLDEQSSSTLKGVLVRNGGSFEDDLSLGAEANHLHESDAQIENCNNILAKERRLQFHQKGRSMNSTGSGKSSGTVSSVSELLELYEEDPEEILYNLGFGRDEPDIASKIPSRFFNSSSFAKGIDIKVFLSAQMQRMEVENPNYALTSRFRQIEVLTTVAMRFLLYILKSPGRPCRELEVQSTEGEAPHVPATYQLGLTKSKRDHLLRTASQHSDSSGFAEDSTDCLSLNHLQVQESLQAMGSSADSCDSETTVTSLGEDLATPTAQDQPYFNESEEESLVPLQKGLEKAAAVADKRKSGSQDFPQCNTIENTGTKQSTCSPGDHIIEITEVEEDLFPAETVELLREASAESDVGKSSESEFTQYTTHHILKSLASIEAKCSDMSSENTTGPPSSMDRVNTALQRAQMKVCSLSNQRMGRSLLKSKDLLKQRYLFAKAGYPLRRSQSLPTTLLSPVRVVSSVNVRLSPGKETRCSPPSFTYKYTPEEEQELEKRVMEHDGQSLVKSTIFISPSSVKKEEAPQSEAPRVEECHHGRTPTCSRLAPPPMSQSTCSLHSIHSEWQERPLCEHTRTLSTHSVPNISGATCSAFASPFGCPYSHRHATYPYRVCSVNPPSAIEMQLRRVLHDIRNSLQNLSQYPMMRGPDPAAAPYSTQKSSVLPLYENTFQELQVMRRSLNLFRTQMMDLELAMLRQQTMVYHHMTEEERFEVDQLQGLRNSVRMELQDLELQLEERLLGLEEQLRAVRMPSPFRSSALMGMCGSRSADNLSCPSPLNVMEPVTELMQEQSYLKSELGLGLGEMGFEIPPGESSESVFSQATSESSSVCSGPSHANRRTGVPSTASVGKSKTPLVARKKVFRASVALTPTAPSRTGSVQTPPDLESSEEVDAAEGAPEVVGPKSEVEEGHGKLPSMPAAEEMHKNVEQDELQQVIREIKESIVGEIRREIVSGLLAAVSSSKASNSKQDYH

SEQ ID NO: 880287 - protein, 1039 aa, Homo sapiens
GLLPSGSRLVGDGYRTGHMSEMAACERVYAKESMGHTSISRIILFSEAARLRKPVQCLGTSRSESKSKAVLEKTALLALKKVKPEKTPVLLSYLMGRRRIFVPSAWNNVSVIEESGNKNDQKSQKIMKKKESSSMLATVKEEVSGSSAAVTENADSDRISDEANSNFNQGTENEQSKETQSHESKLGEESGIVESKLDSDFNISSHSELENSSELKSVHISTPEKEPCAPLTIPSIRNIMTQQKDSFEMEEVQSTEGEAPHVPATYQLGLTKSKRDHLLRTASQHSDSSGFAEDSTDCLSLNHLQVQESLQAMGSSADSCDSETTVTSLGEDLATPTAQDQPYFNESEEESLVPLQKGLEKAAAVADKRKSGSQDFPQCNTIENTGTKQSTCSPGDHIIEITEVEEDLFPAETVELLREASAESDVGKSSESEFTQYTTHHILKSLASIEAKCSDMSSENTTGPPSSMDRVNTALQRAQMKVCSLSNQRMGRSLLKSKDLLKQRYLFAKAGYPLRRSQSLPTTLLSPVRVVSSVNVRLSPGKETRCSPPSFTYKYTPEEEQELEKRVMEHDGQSLVKSTIFISPSSVKKEEAPQSEAPRVEECHHGRTPTCSRLAPPPMSQSTCSLHSIHSEWQERPLCEHTRTLSTHSVPNISGATCSAFASPFGCPYSHRHATYPYRVCSVNPPSAIEMQLRRVLHDIRNSLQNLSQYPMMRGPDPAAAPYSTQKSSVLPLYENTFQELQVMRRSLNLFRTQMMDLELAMLRQQTMVYHHMTEEERFEVDQLQGLRNSVRMELQDLELQLEERLLGLEEQLRAVRMPSPFRSSALMGMCGSRSADNLSCPSPLNVMEPVTELMQEQSYLKSELGLGLGEMGFEIPPGESSESVFSQATSESSSVCSGPSHANRRTGVPSTASVGKSKTPLVARKKVFRASVALTPTAPSRTGSVQTPPDLESSEEVDAAEGAPEVVGPKSEVEEGHGKLPSMPAAEEMHKNVEQDELQQVIREIKESIVGEIRREIVSGLLAAVSSSKASNSKQDYH

SEQ ID NO: 880288 - protein, 713 aa, Homo sapiens
ANSSSCCANSSSCCANSSSCSEEESLVPLQKGLEKAAAVADKRKSGSQDFPQCNTIENTGTKQSTCSPGDHIIEITEVEEDLFPAETVELLREASAESDVGKSSESEFTQYTTHHILKSLASIEAKCSDMSSENTTGPPSSMDRVNTALQRAQMKVCSLSNQRMGRSLLKSKDLLKQRYLFAKAGYPLRRSQSLPTTLLSPVRVVSSVNVRLSPGKETRCSPPSFTYKYTPEEEQELEKRVMEHDGQSLVKSTIFISPSSVKKEEAPQSEAPRVEECHHGRTPTCSRLAPPPMSQSTCSLHSIHSEWQERPLCEHTRTLSTHSVPNISGATCSAFASPFGCPYSHRHATYPYRVCSVNPPSAIEMQLRRVLHDIRNSLQNLSQYPMMRGPDPAAAPYSTQKSSVLPLYENTFQELQVMRRSLNLFRTQMMDLELAMLRQQTMVYHHMTEEERFEVDQLQGLRNSVRMELQDLELQLEERLLGLEEQLRAVRMPSPFRSSALMGMCGSRSADNLSCPSPLNVMEPVTELMQEQSYLKSELGLGLGEMGFEIPPGESSESVFSQATSESSSVCSGPSHANRRTGVPSTASVGKSKTPLVARKKVFRASVALTPTAPSRTGSVQTPPDLESSEEVDAAEGAPEVVGPKSEVEEGHGKLPSMPAAEEMHKNVEQDELQQVIREIKESIVGEIRREIVSGLLAAVSSSKASNSKQDYH

SEQ ID NO: 880289 - protein, 247 aa, Homo sapiens [sequence omitted]

SEQ ID NO: 880290 - protein, 332 aa, Homo sapiens
MKYPMMRGPDPAAAPYSTQKSSVLPLYENTFQELQVMRRSLNLFRTQMMDLELAMLRQQTMVYHHMTEEERFEVDQLQGLRNSVRMELQDLELQLEERLLGLEEQLRAVRMPSPFRSSALMGMCGSRSADNLSCPSPLNVMEPVTELMQEQSYLKSELGLGLGEMGFEIPPGESSESVFSQATSESSSVCSGPSHANRRTGVPSTASVGKSKTPLVARKKVFRASVALTPTAPSRTGSVQTPPDLESSEEVDAAEGAPEVVGPKSEVEEGHGKLPSMPAAEEMHKNVEQDELQQVIREIKESIVGEIRREIVSGLLAAVSSSKASNSKQDYH

SEQ ID NO: 880291 - protein, 247 aa, Homo sapiens [sequence omitted]

SEQ ID NO: 880292 - protein, 1253 aa, Homo sapiens
ASAPRGPLPGRALTARAGVPAAALSRAGSGWGSGAPSAAMDRPLSSSAEAEEELEWQVASRRRKAWAKCRSSWQASETEDLSTEATTQDEEEDEEEDLPGAQLPAAGGRGNVPNEKIAIWLKDCRTPLGASLDEQSSSTLKGVLVRNGGSFEDDLSLGAEANHLHESDAQIENCNNILAKERRLQFHQKGRSMNSTGSGKSSGTVSSVSELLELYEEDPEEILYNLGFGRDEPDIASKIPSRFFNSSSFAKGIDIKVFLSAQMQRMEVENPNYALTSRFRQIEVLTTVANAFSSLYSQVSGTPLQRIGSMSSVTSNKETDPPPPLTRSNTANRLMKTLSKLNLCVDKTEKGESSSPSPSAEKGKILNVSVIEESGNKNDQKSQKIMKKKESSSMLATVKEEVSGSSAAVTENADSDRISDEANSNFNQGTENEQSKETQSHESKLGEESGIVESKLDSDFNISSHSELENSSELKSVHISTPEKEPCAPLTIPSIRNIMTQQKDSFEMEEVQSTEGEAPHVPATYQLGLTKSKRDHLLRTASQHSDSSGFAEDSTDCLSLNHLQVQESLQAMGSSADSCDSETTVTSLGEDLATPTAQDQPYFNESEEESLVPLQKGLEKAAAVADKRKSGSQDFPQCNTIENTGTKQSTCSPGDHIIEITEVEEDLFPAETVELLREASAESDVGKSSESEFTQYTTHHILKSLASIEAKCSDMSSENTTGPPSSMDRVNTALQRAQMKVCSLSNQRMGRSLLKSKDLLKQRYLFAKAGYPLRRSQSLPTTLLSPVRVVSSVNVRLSPGKETRCSPPSFTYKYTPEEEQELEKRVMEHDGQSLVKSTIFISPSSVKKEEAPQSEAPRVEECHHGRTPTCSRLAPPPMSQSTCSLHSIHSEWQERPLCEHTRTLSTHSVPNISGATCSAFASPFGCPYSHRHATYPYRVCSVNPPSAIEMQLRRVLHDIRNSLQNLSQYPMMRGPDPAAAPYSTQKSSVLPLYENTFQELQVMRRSLNLFRTQMMDLELAMLRQQTMVYHHMTEEERFEVDQLQGLRNSVRMELQDLELQLEERLLGLEEQLRAVRMPSPFRSSALMGMCGSRSADNLSCPSPLNVMEPVTELMQEQSYLKSELGLGLGEMGFEIPPGESSESVFSQATSESSSVCSGPSHANRRTGVPSTASVGKSKTPLVARKKVFRASVALTPTAPSRTGSVQTPPDLESSEEVDAAEGAPEVVGPKSEVEEGHGKLPSMPAAEEMHKND

SEQ ID NO: 880293 - protein, 1295 aa, Homo sapiens
ASAPRGPLPGRALTARAGVPAAALSRAGSGWGSGAPSAAMDRPLSSSAEAEEELEWQVASRRRKAWAKCRSSWQASETEDLSTEATTQDEEEDEEEDLPGAQLPAAGGRGNVPNEKIAIWLKDCRTPLGASLDEQSSSTLKGVLVRNGGSFEDDLSLGAEANHLHESDAQIENCNNILAKERRLQFHQKGRSMNSTGSGKSSGTVSSVSELLELYEEDPEEILYNLGFGRDEPDIASKIPSRFFNSSSFAKGIDIKVFLSAQMQRMEVENPNYALTSRFRQIEVLTTVANAFSSLYSQVSGTPLQRIGSMSSVTSNKETDPPPPLTRSNTANRLMKTLSKLNLCVDKTEKGESSSPSPSAEKGKILNVSVIEESGNKNDQKSQKIMKKKESSSMLATVKEEVSGSSAAVTENADSDRISDEANSNFNQGTENEQSKETQSHESKLGEESGIVESKLDSDFNISSHSELENSSELKSVHISTPEKEPCAPLTIPSIRNIMTQQKDSFEMEEVQSTEGEAPHVPATYQLGLTKSKRDHLLRTASQHSDSSGFAEDSTDCLSLNHLQVQESLQAMGSSADSCDSETTVTSLGEDLATPTAQDQPYFNESEEESLVPLQKGLEKAAAVADKRKSGSQDFPQCNTIENTGTKQSTCSPGDHIIEITEVEEDLFPAETVELLREASAESDVGKSSESEFTQYTTHHILKSLASIEAKCSDMSSENTTGPPSSMDRVNTALQRAQMKVCSLSNQRMGRSLLKSKDLLKQRYLFAKAGYPLRRSQSLPTTLLSPVRVVSSVNVRLSPGKETRCSPPSFTYKYTPEEEQELEKRVMEHDGQSLVKSTIFISPSSVKKEEAPQSEAPRVEECHHGRTPTCSRLAPPPMSQSTCSLHSIHSEWQERPLCEHTRTLSTHSVPNISGATCSAFASPFGCPYSHRHATYPYRVCSVNPPSAIEMQLRRVLHDIRNSLQNLSQYPMMRGPDPAAAPYSTQKSSVLPLYENTFQELQVMRRSLNLFRTQMMDLELAMLRQQTMVYHHMTEEERFEVDQLQGLRNSVRMELQDLELQLEERLLGLEEQLRAVRMPSPFRSSALMGMCGSRSADNLSCPSPLNVMEPVTELMQEQSYLKSELGLGLGEMGFEIPPGESSESVFSQATSESSSVCSGPSHANRRTGVPSTASVGKSKTPLVARKKVFRASVALTPTAPSRTGSVQTPPDLESSEEVDAAEGAPEVVGPKSEVEEGHGKLPSMPAAEEMHKNVEQDELQQVIREVGMDPISCVILELSMICTGGGVICALEDTCC

SEQ ID NO: 880294 - protein, 197 aa, Homo sapiens
GQALKPGQALKPGQALKPGQALKPGQPLKLGFEIPPGESSESVFSQATSESSSVCSGPSHANRRTGVPSTASVGKSKTPLVARKKVFRASVALTPTAPSRTGSVQTPPDLESSEEVDAAEGAPEVVGPKSEVEEGHGKLPSMPAAEEMHKNVEQDELQQVIREIKESIVGEIRREIVSGLLAAVSSSKASNSKQDYH

SEQ ID NO: 880295 - protein, 1298 aa, Homo sapiens
ASAPRGPLPGRALTARAGVPAAALSRAGSGWGSGAPSAAMDRPLSSSAEAEEELEWQVASRRRKAWAKCRSSWQASETEDLSTEATTQDEEEDEEEDLPGAQLPAAGGRGNVPNEKIAIWLKDCRTPLGASLDEQSSSTLKGVLVRNGGSFEDDLSLGAEANHLHESDAQIENCNNILAKERRLQFHQKGRSMNSTGSGKSSGTVSSVSELLELYEEDPEEILYNLGFGRDEPDIASKIPSRFFNSSSFAKGIDIKVFLSAQMQRMEVENPNYALTSRFRQIEVLTTVANAFSSLYSQVSGTPLQRIGSMSSVTSNKETDPPPPLTRSNTANRLMKTLSKLNLCVDKTEKGESSSPSPSAEKGKILNVSVIEESGNKNDQKSQKIMKKKESSSMLATVKEEVSGSSAAVTENADSDRISDEANSNFNQGTENEQSKETQSHESKLGEESGIVESKLDSDFNISSHSELENSSELKSVHISTPEKEPCAPLTIPSIRNIMTQQKDSFEMEEVQSTEGEAPHVPATYQLGLTKSKRDHLLRTASQHSDSSGFAEDSTDCLSLNHLQVQESLQAMGSSADSCDSETTVTSLGEDLATPTAQDQPYFNESEEESLVPLQKGLEKAAAVADKRKSGSQDFPQCNTIENTGTKQSTCSPGDHIIEITEVEEDLFPAETVELLREASAESDVGKSSESEFTQYTTHHILKSLASIEAKCSDMSSENTTGPPSSMDRVNTALQRAQMKVCSLSNQRMGRSLLKSKDLLKQRYLFAKAGYPLRRSQSLPTTLLSPVRVVSSVNVRLSPGKETRCSPPSFTYKYTPEEEQELEKRVMEHDGQSLVKSTIFISPSSVKKEEAPQSEAPRVEECHHGRTPTCSRLAPPPMSQSTCSLHSIHSEWQERPLCEHTRTLSTHSVPNISGATCSAFASPFGCPYSHRHATYPYRVCSVNPPSAIEMQLRRVLHDIRNSLQNLSQYPMMRGPDPAAAPYSTQKSSVLPLYENTFQELQVMRRSLNLFRTQMMDLELAMLRQQTMVYHHMTEEERFEVDQLQGLRNSVRMELQDLELQLEERLLGLEEQLRAVRMPSPFRSSALMGMCGSRSADNLSCPSPLNVMEPVTELMQEQSYLKSELGLGLGEMGFEIPPGESSESVFSQATSESSSVCSGPSHANRRTGVPSTASVGKSKTPLVARKKVFRASVALTPTAPSRTGSVQTPPDLESSEEVDAAEGAPEVVGPKSEVEEGHGKLPSMPAAEEMHKNVEQDELQQVIREIKESIVGEIRREIVSGLLAAVSSSKASNSKQDYH

SEQ ID NO: 880296 - protein, 1298 aa, Homo sapiens; identical to SEQ ID NO: 880295

SEQ ID NO: 880297 - protein, 1280 aa, Homo sapiens
ASAPRGPLPGRALTARAGVPAAALSRAGSGWGSGAPSAAMDRPLSSSAEAEEELEWQVASRRRKAWAKCRSSWQASETEDLSTEATTQDEEEDEEEDLPGAQLPAAGGRGNVPNEKIAIWLKDCRTPLGASLDEQSSSTLKGVLVRNGGSFEDDLSLGAEANHLHESDAQIENCNNILAKERRLQFHQKGRSMNSTGSGKSSGTVSSVSELLELYEEDPEEILYNLGFGRDEPDIASKIPSRFFNSSSFAKGIDIKVFLSAQMQRMEVENPNYALTSRFRQIEVLTTVANAFSSLYSQVSGTPLQRIGSMSSVTSNKETDPPPPLTRSNTANRLMKTLSKLNLCVDKTEKGESSSPSPSAEKGKILNVSVIEESGNKNDQKSQKIMKKKESSSMLATVKEEVSGSSAAVTENADSDRISDEANSNFNQGTENEQSKETQSHESKLGEESGIVESKLDSDFNISSHSELENSSELKSVHISTPEKEPCAPLTIPSIRNIMTQQKDSFEMEEVQSTEGEAPHVPATYQLGLTKSKRDHLLRTASQHSDSSGFAEDSTDCLSLNHLQVQESLQAMGSSADSCDSETTVTSLGEDLATPTAQDQPYFNESEEESLVPLQKGLEKAAAVADKRKSGSQDFPQCNTIENTGTKQSTCSPGDHIIEITEVEEDLFPAETVELLREASAESDVGKSSESEFTQYTTHHILKSLASIEAKCSDMSSENTTGPPSSMDRVNTALQRAQMKVCSLSNQRMGRSLLKSKDLLKQRYLFAKAGYPLRRSQSLPTTLLSPVRVVSSVNVRLSPGKETRCSPPSFTYKYTPEEEQELEKRVMEHDGQSLVKSTIFISPSSVKKEEAPQSEAPRVEECHHGRTPTCSRLAPPPMSQSTCSLHSIHSEWQERPLCEHTRTLSTHSVPNISGATCSAFASPFGCPYSHRHATYPYRVCSVNPPSAIEMQLRRVLHDIRNSLQNLSQYPMMRGPDPAAAPYSTQKSSVLPLYENTFQELQVMRRSLNLFRTQMMDLELAMLRQQTMVYHHMTEEERFEVDQLQGLRNSVRMELQDLELQLEERLLGLEEQLRAVRMPSPFRSSALMGMCGSRSADNLSCPSPLNVMEPVTELMQEQSYLKSELGLGLGEMGFEIPPGESSESVFSQATSESSSVCSGPSHANRRTGVPSTASVGKSKTPLVARKKVFRASVALTPTAPSRTGSVQTPPDLESSEEVDAAEGAPEVVGPKSEVEEGHGKLPSMPAAEEMHKNGHMRWERHMRVERHMRWERHMRWERHMR

SEQ ID NO: 880298 - protein, 125 aa, Homo sapiens
ASAPRGPLPGRALTARAGVPAAALSRAGSGWGSGAPSAAMDRPLSSSAEAEEELEWQVASRRRKAWAKCRSSWQASETEDLSTEATTQDEEEDEEEDLPGAQLPAAGGRGNVPNEKIAIWLKDCR

SEQ ID NO: 880299 - protein, 433 aa, Homo sapiens
ASAPRGPLPGRALTARAGVPAAALSRAGSGWGSGAPSAAMDRPLSSSAEAEEELEWQVASRRRKAWAKCRSSWQASETEDLSTEATTQDEEEDEEEDLPGAQLPAAGGRGNVPNEKIAIWLKDCRTPLGASLDEQSSSTLKGVLVRNGGSFEDDLSLGAEANHLHESDAQIENCNNILAKERRLQFHQKGRSMNSTGSGKSSGTVSSVSELLELYEEDPEEILYNLGFGRDEPDIASKIPSRFFNSSSFAKGIDIKVFLSAQMQRMEVENPNYALTSRFRQIEVLTTVANAFSSLYSQVSGTPLQRIGSMSSVTSNKETDPPPPLTRSNTANRLMKTLSKLNLCVDKTEKGESSSPSPSAEKGKILNVSVIEESGNKNDQKSQKIMKKKESSSMLATVKEEVSGSSAAVTENADSDRISDGRRWRSLLPSGGA

SEQ ID NO: 880300 - protein, 385 aa, Homo sapiens
ASAPRGPLPGRALTARAGVPAAALSRAGSGWGSGAPSAAMDRPLSSSAEAEEELEWQVASRRRKAWAKCRSSWQASETEDLSTEATTQDEEEDEEEDLPGAQLPAAGGRGNVPNEKIAIWLKDCRTPLGASLDEQSSSTLKGVLVRNGGSFEDDLSLGAEANHLHESDAQIENCNNILAKERRLQFHQKGRSMNSTGSGKSSGTVSSVSELLELYEEDPEEILYNLGFGRDEPDIASKIPSRFFNSSSFAKGIDIKVFLSAQMQRMEVENPNYALTSRFRQIEVLTTVANAFSSLYSQVSGTPLQRIGSMSSVTSNKETDPPPPLTRSNTANRLMKTLSKLNLCVDKTEKGESSSPSPSAEKGKILNVSVIEESGNKNDLSVTSS

SEQ ID NO: 880301 - protein, 1298 aa, Homo sapiens; identical to SEQ ID NO: 880295

SEQ ID NO: 880302 - protein, 1280 aa, Homo sapiens
ASAPRGPLPGRALTARAGVPAAALSRAGSGWGSGAPSAAMDRPLSSSAEAEEELEWQVASRRRKAWAKCRSSWQASETEDLSTEATTQDEEEDEEEDLPGAQLPAAGGRGNVPNEKIAIWLKDCRTPLGASLDEQSSSTLKGVLVRNGGSFEDDLSLGAEANHLHESDAQIENCNNILAKERRLQFHQKGRSMNSTGSGKSSGTVSSVSELLELYEEDPEEILYNLGFGRDEPDIASKIPSRFFNSSSFAKGIDIKVFLSAQMQRMEVENPNYALTSRFRQIEVLTTVANAFSSLYSQVSGTPLQRIGSMSSVTSNKETDPPPPLTRSNTANRLMKTLSKLNLCVDKTEKGESSSPSPSAEKGKILNVSVIEESGNKNDQKSQKIMKKKESSSMLATVKEEVSGSSAAVTENADSDRISDEANSNFNQGTENEQSKETQSHESKLGEESGIVESKLDSDFNISSHSELENSSELKSVHISTPEKEPCAPLTIPSIRNIMTQQKDSFEMEEVQSTEGEAPHVPATYQLGLTKSKRDHLLRTASQHSDSSGFAEDSTDCLSLNHLQVQESLQAMGSSADSCDSETTVTSLGEDLATPTAQDQPYFNESEEESLVPLQKGLEKAAAVADKRKSGSQDFPQCNTIENTGTKQSTCSPGDHIIEITEVEEDLFPAETVELLREASAESDVGKSSESEFTQYTTHHILKSLASIEAKCSDMSSENTTGPPSSMDRVNTALQRAQMKVCSLSNQRMGRSLLKSKDLLKQRYLFAKAGYPLRRSQSLPTTLLSPVRVVSSVNVRLSPGKETRCSPPSFTYKYTPEEEQELVSPSSVKKEEAPQSEAPRVEECHHGRTPTCSRLAPPPMSQSTCSLHSIHSEWQERPLCEHTRTLSTHSVPNISGATCSAFASPFGCPYSHRHATYPYRVCSVNPPSAIEMQLRRVLHDIRNSLQNLSQYPMMRGPDPAAAPYSTQKSSVLPLYENTFQELQVMRRSLNLFRTQMMDLELAMLRQQTMVYHHMTEEERFEVDQLQGLRNSVRMELQDLELQLEERLLGLEEQLRAVRMPSPFRSSALMGMCGSRSADNLSCPSPLNVMEPVTELMQEQSYLKSELGLGLGEMGFEIPPGESSESVFSQATSESSSVCSGPSHANRRTGVPSTASVGKSKTPLVARKKVFRASVALTPTAPSRTGSVQTPPDLESSEEVDAAEGAPEVVGPKSEVEEGHGKLPSMPAAEEMHKNVEQDELQQVIREIKESIVGEIRREIVSGLLAAVSSSKASNSKQDYH

SEQ ID NO: 880303 - protein, 1129 aa, Homo sapiens
ASAPRGPLPGRALTARAGVPAAALSRAGSGWGSGAPSAAMDRPLSSSAEAEEELEWQVASRRRKAWAKCRSSWQASETEDLSTEATTQDEEEDEEEDLPGAQLPAAGGRGNVPNEKIAIWLKDCRTPLGASLDEQSSSTLKGVLVRNGGSFEDDLSLGAEANHLHESDAQIENCNNILAKERRLQFHQKGRSMNSTGSGKSSGTVSSVSELLELYEEDPEEILYNLGFGRDEPDIASKIPSRFFNSSSFAKGIDIKVFLSAQMQRMEVENPNYALTSRFRQIEVLTTVANAFSSLYSQVSGTPLQRIGSMSSVTSNKETDPPPPLTRSNTANRLMKTLSKLNLCVDKTEKGESSSPSPSAEKGKILNVSVIEESGNKNDQKSQKIMKKKESSSMLATVKEEVSGSSAAVTENADSDRISDEANSNFNQGTENEQSKETQSHESKLGEESGIVESKLDSDFNISSHSELENSSELKSVHISTPEKEPCAPLTIPSIRNIMTQQKDSFEMEEVQSTEGEAPHVPATYQLGLTKSKRDHLLRTASQHSDSSGFAEDSTDCLSLNHLQVQESLQAMGSSADSCDSETTVTSLGEDLATPTAQDQPYFNESEEESLVPLQKGLEKAAAVADKRKSGKETRCSPPSFTYKYTPEEEQELEKRVMEHDGQSLVKSTIFISPSSVKKEEAPQSEAPRVEECHHGRTPTCSRLAPPPMSQSTCSLHSIHSEWQERPLCEHTRTLSTHSVPNISGATCSAFASPFGCPYSHRHATYPYRVCSVNPPSAIEMQLRRVLHDIRNSLQNLSQYPMMRGPDPAAAPYSTQKSSVLPLYENTFQELQVMRRSLNLFRTQMMDLELAMLRQQTMVYHHMTEEERFEVDQLQGLRNSVRMELQDLELQLEERLLGLEEQLRAVRMPSPFRSSALMGMCGSRSADNLSCPSPLNVMEPVTELMQEQSYLKSELGLGLGEMGFEIPPGESSESVFSQATSESSSVCSGPSHANRRTGVPSTASVGKSKTPLVARKKVFRASVALTPTAPSRTGSVQTPPDLESSEEVDAAEGAPEVVGPKSEVEEGHGKLPSMPAAEEMHKNVEQDELQQVIREIKESIVGEIRREIVSGLLAAVSSSKASNSKQDYH

SEQ ID NO: 880304 - protein, 328 aa, Homo sapiens [sequence omitted]

SEQ ID NO: 880305 - protein, 296 aa, Homo sapiens [sequence omitted]

SEQ ID NO: 880306 - protein, 1276 aa, Homo sapiens
ASAPRGPLPGRALTARAGVPAAALSRAGSGWGSGAPSAAMDRPLSSSAEAEEELEWQVASRRRKAWAKCRSSWQASETEDLSTEATTQDEEEDEEEDLPGAQLPAAGGRGNVPNEKIAIWLKDCRTPLGASLDEQSSSTLKGVLVRNGGSFEDDLSLGAEANHLHESDAQIENCNNILAKERRLQFHQKGRSMNSTGSGKSSGTVSSVSELLELYEEDPEEILYNLGFGRDEPDIASKIPSRFFNSSSFAKGIDIKVFLSAQMQRMEVENPNYALTSRFRQIEVLTTVANAFSSLYSQVSGTPLQRIGSMSSVTSNKETDPPPPLTRSNTANRLMKTLSKLNLCVDKTEKGESSSPSPSAEKGKILNVSVIEESGNKNDQKSQKIMKKKESSSMLATVKEEVSGSSAAVTENADSDRISDEANSNFNQGTENEQSKETQSHESKLGEESGIVESKLDSDFNISSHSELENSSELKSVHISTPEKEPCAPLTIPSIRNIMTQQKDSFEMEEVQSTEGEAPHVPATYQLGLTKSKRDHLLRTASQHSDSSGFAEDSTDCLSLNHLQVQESLQAMGSSADSCDSETTVTSLGEDLATPTAQDQPYFNESEEESLVPLQKGLEKAAAVADKRKSGSQDFPQCNTIENTGTKQSTCSPGDHIIEITEVEEDLFPAETVELLREASAESDVGKSSESEFTQYTTHHILKSLASIEAKCSDMSSENTTGPPSSMDRVNTALQRAQMKVCSLSNQRMGRSLLKSKDLLKQRYLFAKAGYPLRRSQSLPTTLLSPVRVVSSVNVRLSPGKETRCSPPSFTYKYTPEEEQELEKRVMEHDGQSLVKSTIFISPSSVKKEEAPQSEAPRVEECHHGRTPTCSRLAPPPMSQSTCSLHSIHSEWQERPLCEHTRTLSTHSVPNISGATCSAFASPFGCPYSHRHATYPYRVCSVNPPSAIEMQLRRVLHDIRNSLQNLSQYPMMRGPDPAAAPYSTQKSSVLPLYENTFQELQVMRRSLNLFRTQMMDLELAMLRQQTMVYHHMTEEERFEVDQLQGLRNSVRMELQDLELQLEERLLGLEEQLRAVRMPSPFRSSALMVTELMQEQSYLKSELGLGLGEMGFEIPPGESSESVFSQATSESSSVCSGPSHANRRTGVPSTASVGKSKTPLVARKKVFRASVALTPTAPSRTGSVQTPPDLESSEEVDAAEGAPEVVGPKSEVEEGHGKLPSMPAAEEMHKNVEQDELQQVIREIKESIVGEIRREIVSGLLAAVSSSKASNSKQDYH

SEQ ID NO: 880307 - protein, 247 aa, Homo sapiens [sequence omitted]

SEQ ID NO: 880308 - protein, 1298 aa, Homo sapiens; identical to SEQ ID NO: 880295

SEQ ID NO: 880309 - protein, 1298 aa, Homo sapiens; identical to SEQ ID NO: 880295

SEQ ID NO: 880310 - protein, 1284 aa, Homo sapiens
ASAPRGPLPGRALTARAGVPAAALSRAGSGWGSGAPSAAMDRPLSSSAEAEEELEWQVASRRRKAWAKCRSSWQASETEDLSTEATTQDEEEDEEEDLPGAQLPAAGGRGNVPNEKIAIWLKDCRTPLGASLDEQSSSTLKGVLVRNGGSFEDDLSLGAEANHLHESDAQIENCNNILAKERRLQFHQKGRSMNSTGSGKSSGTVSSVSELLELYEEDPEEILYNLGFGRDEPDIASKIPSRFFNSSSFAKGIDIKVFLSAQMQRMEVENPNYALTSRFRQIEVLTTVANAFSSLYSQVSGTPLQRIGSMSSVTSNKETDPPPPLTRSNTANRLMKTLSKLNLCVDKTEKGESSSPSPSAEKGKILNVSVIEESGNKNDQKSQKIMKKKESSSMLATVKEEVSGSSAAVTENADSDRISDEANSNFNQGTENEQSKETQSHESKLGEESGIVESKLDSDFNISSHSELENSSELKSVHISTPEKEPCAPLTIPSIRNIMTQQKDSFEMEEVQSTEGEAPHVPATYQLGLTKSKRDHLLRTASQHSDSSGFAEDSTDCLSLNHLQVQESLQAMGSSADSCDSETTVTSLGEDLATPTAQDQPYFNESEEESLVPLQKGLEKAAAVADKRKSGSQDFPQCNTIENTGTKQSTCSPGDHIIEITEVEEDLFPAETVELLREASAESDVGKSSESEFTQYTTHHILKSLASIEAKCSDMSSENTTGPPSSMDRVNTALQRAQMKVCSLSNQRMGRSLLKSKDLLKQRYLFAKAGYPLRRSQSLPTTLLSPVRVVSSVNVRLSPGKETRCSPPSFTYKYTPEEEQELEKRVMEHDGQSLVKSTIFISPSSVKKEEAPQSEAPRVEECHHGRTPTCSRLAPPPMSQSTCSLHSIHSEWQERPLCEHTRTLSTHSVPNISGATCSAFASPFGCPYSHRHATYPYRVCSVNPPSAIEMQLRRVLHDIRNSLQNLSQYPMMRGPDPAAAPYSTQKSSVLPLYENTFQELQVMRRSLNLFRTQMMDLELAMLRQQTMVYHHMTEEERFEVDQLQGLRNSVRMELQDLELQLEERLLGLEEQLRAVRMPSPFRSSALMGMCGSRSADNLSCPSPLNVMEPVTELMQEQSYLKSELGLGLGEMGFEIPPGESSESVFSQATSESSSVCSGPSHANRRTGVPSTASVGKSKTPLVARKKVFRASVALTPTAPSRTGSVQTPPDLESSEEVDAAEGAPEVVGPKSEVEEGHGKLPSMPAAEEMHKNVEQDELQQVIREVGKICVSFIYLEVYVRGDFV

SEQ ID NO: 880311 - protein, 1288 aa, Homo sapiens
ASAPRGPLPGRALTARAGVPAAALSRAGSGWGSGAPSAAMDRPLSSSAEAEEELEWQVASRRRKAWAKCRSSWQASETEDLSTEATTQDEEEDEEEDLPGAQLPAAGGRGNVPNEKIAIWLKDCRTPLGASLDEQSSSTLKGVLVRNGGSFEDDLSLGAEANHLHESDAQIENCNNILAKERRLQFHQKGRSMNSTGSGKSSGTVSSVSELLELYEEDPEEILYNLGFGRDEPDIASKIPSRFFNSSSFAKGIDIKVFLSAQMQRMEVENPNYALTSRFRQIEVLTTVANAFSSLYSQVSGTPLQRIGSMSSVTSNKETDPPPPLTRSNTANRLMKTLSKLNLCVDKTEKGESSSPSPSAEKGKILNVSVIEESGNKNDQKSQKIMKKKESSSMLATVKEEVSGSSAAVTENADSDRISDEANSNFNQGTENEQSKETQSHESKLGEESGIVESKLDSDFNISSHSELENSSELKSVHISTPEKEPCAPLTIPSIRNIMTQQKDSFEMEEVQSTEGEAPHVPATYQLGLTKSKRDHLLRTASQHSDSSGFAEDSTDCLSLNHLQVQESLQAMGSSADSCDSETTVTSLGEDLATPTAQDQPYFNESEEESLVPLQKGLEKAAAVADKRKSGSQDFPQCNTIENTGTKQSTCSPGDHIIEITEVEEDLFPAETVELLREASAESDVGKSSESEFTQYTTHHILKSLASIEAKCSDMSSENTTGPPSSMDRVNTALQRAQMKVCSLSNQRMGRSLLKSKDLLKQRYLFAKAGYPLRRSQSLPTTLLSPVRVVSSVNVRLSPGKETRCSPPSFTYKYTPEEEQELEKRVMEHDGQSLVKSTIFISPSSVKKEEAPQSEAPRVEECHHGRTPTCSRLAPPPMSQSTCSLHSIHSEWQERPLCEHTRTLSTHSVPNISGATCSAFASPFGCPYSHRHATYPYRVCSVNPPSAIEMQLRRVLHDIRNSLQNLSQYPMMRGPDPAAAPYSTQKSSVLPLYENTFQELQVMRRSLNLFRTQMMDLELAMLRQQTMVYHHMTEEERFEVDQLQGLRNSVRMELQDLELQLEERLLGLEEQLRAVRMPSPFRSSALMGMCGSRSADNLSCPSPLNVMEPVTELMQEQSYLKSELGLGLGEMGFEIPPGESSESVFSQATSESSSVCSGPSHANRRTGVPSTASVGKSKTPLVARKKVFRASVALTPTAPSRTGSVQTPPDLESSEEVDAAEGAPEVVGPKSEVEEGHGKLPSMPAAEEMHKNVTTALQSHCLHQLIKSQYSCEKVPFSLNITTLIPSI

SEQ ID NO: 880312 - protein, 137 aa, Homo sapiens
ASAPRGPLPGRALTARAGVPAAALSRAGSGWGSGAPSAAMDRPLSSSAEAEEELEWQVASRRRKAWAKCRSSWQASETEDLSTEATTQDEEEDEEEDLPGAQLPAAGGRGNVPNEKIAIWLKDCRTRTLYWKCHRPF

SEQ ID NO: 880313 - protein, 237 aa, Homo sapiens
ERFHLREKDPLKRSVKSSKEPLEGTPESRVAEVSHDPAMLPVQRRKLDPLLKKYRHHKKATRTKRRRKEKMEAQCSPVPPTPSTPPQSEEDEAVDKKPTLLSAQEDTPDLLHEDRLQYLQEEGSGVMHQECQIQSCELSVAQKPRPSSPAVTSLASPPLCFGSFLSCVCQTFSRSRKQKPPRRKGNNQAEAGGDAEVLRPGPAKPELSLSKTCSHLKLIELSFVFSFIVLSVCHCSS

SEQ ID NO: 880314 - protein, 194 aa, Homo sapiens
ERFHLREKDPLKRSVKSSKEPLEGTPESRVAEVSHDPAMLPVQRRKLDPLLKKYRHHKKATRTKRRRKEKMEAQCSPVPPTPSTPPQSEEDEAVDKKPTLLSAQEDTPDLLHEDRLQYLQEEGSGVMHQECQIQSCELSVAQKPRPSSPAVTSLASPPLCFGSFLSCVCQTFSRSRKQKPPRRKGNNQAEAGER

SEQ ID NO: 880315 - protein, 119 aa, Homo sapiens
LSPLEKRSIQVGVTLFSRCRLSPLSLTRKGNSLTPCASQVRQCSPCFGPRTCAHPLTCAHCLALPREMNPVPQMEMQKSPSSASLTLGAADGSCSYSAILAPPIGHLSKVSHALILLVV

SEQ ID NO: 880316 - protein, 125 aa, Homo sapiens
STANMAEPSVESSSPGGSATSDDHEFDPSADMLVHDFDDERNHLKQKKQKKKTKQQVRGARAAGPPGKRFLRTPHGGGRPRGPARQENREDKRGPKKRVSHQEEKHAGAERERGGEGDSLHHKYI

SEQ ID NO: 880317 - protein, 512 aa, Homo sapiens
MAEPSVESSSPGGSATSDDHEFDPSADMLVHDFDDERTLEEEEMMEGETNFSSEIEDLAREGDMPIHELLSLYGYGSTVRLPEEDEEEEEEEEEGEDDEDADNDDNSGCSGENKEENIKDSSGQEDETQSSNDDPSQSVASQDAQEIIRPRRCKYFDTNSEVEEESEEDEDYIPSEDWKKEIMVGSMFQAEIPVGICRYKENEKVYENDDQLLWDPEYLPEDKVIIFLKDASRRTGDEKGVEAIPEGSHIKDNEQALYELVKCNFDTEEALRRLRFNVKAAREELSVWTEEECRNFEQGLKAYGKDFHLIQANKVRTRSVGECVAFYYMWKKSERYDFFAQQTRFGKKKYNLHPGVTDYMDRLLDESESAASSRAPSPPPTASNSSNSQSEKEDGTVSTANQNGVSSNGPGEILNKEEVKVEGLHINGPTGGNKKPLHADMDTNGYETDNLTTDPKLAHMTARNENDFDEKSERPAKRRRVNSNGKESPGSSEFFQEAVSHGKFEELENTDD

SEQ ID NO: 880318 - protein, 587 aa, Homo sapiens
KKEAGGPGLRPLPGSESPGCRRMDGASSGGGGSSEGGGGSSGSGYGVVARFSQCLAEFRTWLRTNWLRFNADKTDVMLPSVESSSPGGSATSDDHEFDPSADMLVHDFDDERTLEEEEMMEGETNFSSEIEDLAREGDMPIHELLSLYGYGSTVRLPEEDEEEEEEEEEGEDDEDADNDDNSGCSGENKEENIKDSSGQEDETQSSNDDPSQSVASQDAQEIIRPRRCKYFDTNSEVEEESEEDEDYIPSEDWKKEIMVGSMFQAEIPVGICRYKENEKVYENDDQLLWDPEYLPEDKVIIFLKDASRRTGDEKGVEAIPEGSHIKDNEQALYELVKCNFDTEEALRRLRFNVKAAREELSVWTEEECRNFEQGLKAYGKDFHLIQANKVRTRSVGECVAFYYMWKKSERYDFFAQQTRFGKKKYNLHPGVTDYMDRLLDESESAASSRAPSPPPTASNSSNSQSEKEDGTVSTANQNGVSSNGPGEILNKEEVKVEGLHINGPTGGNKKPLHADMDTNGYETDNLTTDPKLAHMTARNENDFDEKSERPAKRRRVNSNGKESPGSSEFFQEAVSHGKFEELENTDD

SEQ ID NO: 880319 - protein, 485 aa, Homo sapiens
MLVHDFDDERTLEEEEMMEGETNFSSEIEDLAREGDMPIHELLSLYGYGSTVRLPEEDEEEEEEEEEGEDDEDADNDDNSGCSGENKEENIKDSSGQEDETQSSNDDPSQSVASQDAQEIIRPRRCKYFDTNSEVEEESEEDEDYIPSEDWKKEIMVGSMFQAEIPVGICRYKENEKVYENDDQLLWDPEYLPEDKVIIFLKDASRRTGDEKGVEAIPEGSHIKDNEQALYELVKCNFDTEEALRRLRFNVKAAREELSVWTEEECRNFEQGLKAYGKDFHLIQANKVRTRSVGECVAFYYMWKKSERYDFFAQQTRFGKKKYNLHPGVTDYMDRLLDESESAASSRAPSPPPTASNSSNSQSEKEDGTVSTANQNGVSSNGPGEILNKEEVKVEGLHINGPTGGNKKPLHADMDTNGYETDNLTTDPKLAHMTARNENDFDEKSERPAKRRRVNSNGKESPGSSEFFQEAVSHGKFEELENTDD

SEQ ID NO: 880320 - protein, 512 aa, Homo sapiens; identical to SEQ ID NO: 880317

SEQ ID NO: 880321 - protein, 449 aa, Homo sapiens
MPIHELLSLYGYGSTVRLPEEDEEEEEEEEEGEDDEDADNDDNSGCSGENKEENIKDSSGQEDETQSSNDDPSQSVASQDAQEIIRPRRCKYFDTNSEVEEESEEDEDYIPSEDWKKEIMVGSMFQAEIPVGICRYKENEKVYENDDQLLWDPEYLPEDKVIIFLKDASRRTGDEKGVEAIPEGSHIKDNEQALYELVKCNFDTEEALRRLRFNVKAAREELSVWTEEECRNFEQGLKAYGKDFHLIQANKVRTRSVGECVAFYYMWKKSERYDFFAQQTRFGKKKYNLHPGVTDYMDRLLDESESAASSRAPSPPPTASNSSNSQSEKEDGTVSTANQNGVSSNGPGEILNKEEVKVEGLHINGPTGGNKKPLHADMDTNGYETDNLTTDPKLAHMTARNENDFDEKSERPAKRRRVNSNGKESPGSSEFFQEAVSHGKFEELENTDD

SEQ ID NO: 880322 - protein, 293 aa, Homo sapiens
MAEPSVESSSPGGSATSDDHEFDPSADMLVHDFDDERTLEEEEMMEGETNFSSEIEDLAREGDMPIHELLSLYGYGSTVRLPEEDEEEEEEEEEGEDDEDADNDDNSGCSGENKEENIKDSSGQEDETQSSNDDPSQSVASQDAQEIIRPRRCKYFDTNSEVEEESEEDEDYIPSEDWKKEIMVGSMFQAEIPVGICRYKENEKVYENDDQLLWDPEYLPEDKVIIFLKDASRRTGDEKGVEAIPEGSHIKDNEQALYELVKCNFDTEEALRRLRFNVKAARVTGFGNSTTIT

SEQ ID NO: 880323 - protein, 196 aa, Homo sapiens
MAEPSVESSSPGGSATSDDHEFDPSADMLVHDFDDERTLEEEEMMEGETNFSSEIEDLAREGDMPIHELLSLYGYGSTVRLPEEDEEEEEEEEEGEDDEDADNDDNSGCSGENKEENIKDSSGQEDETQSSNDDPSQSVASQDAQEIIRPRRCKYFDTNSEVEEESEEDEDYIPSEDWKKVVRTIFSQNLDKLIFF

SEQ ID NO: 880324 - protein, 138 aa, Homo sapiens
KKEAGGPGLRPLPGSESPGCRRMDGASSGGGGSSEGGGGSSGSGYGVVARFSQCLAEFRTWLRTNWLRFNADKTDVMLKMCIRCLCLIGLQTVCGLFSCQITSHLLNLQVQEVQQHQMTMNLIHQLTCWFMILMMNEH

SEQ ID NO: 880325 - protein, 126 aa, Homo sapiens
MAEPSVESSSPGGSATSDDHEFDPSADMLVHDFDDERTLEEEEMMEGETNFSSEIEDLAREGDMPIHELLSLYGYGSTVRLPEEDEEEEEEEEEGEDDEDADNDDNSGCSGENKDAIFYDFLGQVD

SEQ ID NO: 880326 - protein, 612 aa, Homo sapiens
KKEAGGPGLRPLPGSESPGCRRMDGASSGGGGSSEGGGGSSGSGYGVVARFSQCLAEFRTWLRTNWLRFNADKTDVMLKMCIRCLCLIGLQTVCGLFFLSNYQPSVESSSPGGSATSDDHEFDPSADMLVHDFDDERTLEEEEMMEGETNFSSEIEDLAREGDMPIHELLSLYGYGSTVRLPEEDEEEEEEEEEGEDDEDADNDDNSGCSGENKEENIKDSSGQEDETQSSNDDPSQSVASQDAQEIIRPRRCKYFDTNSEVEEESEEDEDYIPSEDWKKEIMVGSMFQAEIPVGICRYKENEKVYENDDQLLWDPEYLPEDKVIIFLKDASRRTGDEKGVEAIPEGSHIKDNEQALYELVKCNFDTEEALRRLRFNVKAAREELSVWTEEECRNFEQGLKAYGKDFHLIQANKVRTRSVGECVAFYYMWKKSERYDFFAQQTRFGKKKYNLHPGVTDYMDRLLDESESAASSRAPSPPPTASNSSNSQSEKEDGTVSTANQNGVSSNGPGEILNKEEVKVEGLHINGPTGGNKKPLHADMDTNGYETDNLTTDPKLAHMTARNENDFDEKSERPAKRRRVNSNGKESPGSSEFFQEAVSHGKFEELENTDD

SEQ ID NO: 880327 - protein, 511 aa, Homo sapiens
MKGLTAHESTGGSATSDDHEFDPSADMLVHDFDDERTLEEEEMMEGETNFSSEIEDLAREGDMPIHELLSLYGYGSTVRLPEEDEEEEEEEEEGEDDEDADNDDNSGCSGENKEENIKDSSGQEDETQSSNDDPSQSVASQDAQEIIRPRRCKYFDTNSEVEEESEEDEDYIPSEDWKKEIMVGSMFQAEIPVGICRYKENEKVYENDDQLLWDPEYLPEDKVIIFLKDASRRTGDEKGVEAIPEGSHIKDNEQALYELVKCNFDTEEALRRLRFNVKAAREELSVWTEEECRNFEQGLKAYGKDFHLIQANKVRTRSVGECVAFYYMWKKSERYDFFAQQTRFGKKKYNLHPGVTDYMDRLLDESESAASSRAPSPPPTASNSSNSQSEKEDGTVSTANQNGVSSNGPGEILNKEEVKVEGLHINGPTGGNKKPLHADMDTNGYETDNLTTDPKLAHMTARNENDFDEKSERPAKRRRVNSNGKESPGSSEFFQEAVSHGKFEELENTDD

SEQ ID NO: 880328 - protein, 512 aa, Homo sapiens; identical to SEQ ID NO: 880317

SEQ ID NO: 880329 - protein, 479 aa, Homo sapiens
MAEPSVESSSPGGSATSDDHEFDPSADMLVHDFDDERTLEEEEMMEGETNFSSEIEDLAREGDMPIHELLSLYGYGSTVRLPEEDEEEEEEEEEGEDDEDADNDDNSGCSGENKEENIKDSSGQEDETQSSNDDPSQSVASQDAQEIIRPRRCKYFDTNSEVEEESEEDEDYIPSEDWKKEIMVGSMFQAEIPVGICRYKENEKVYENDDQLLWDPEYLPEDKVIIFLKDASRRTGDEKGVEAIPEGSHIKDNEQALYELVKCNFDTEEALRRLRFNVKAAREELSVWTEEECRNFEQGLKAYGKDFHLIQANKVRTRSVGECVAFYYMWKKSERYDFFAQQTRFGKKKYNLHPGVTDYMDRLLDESESAASSRAPSPPPTASNSSNSQSEKEDGTVSTANQNGVSSNGPGEILNKEEVKVEGLHINGPTGGNKKPLHADMDTNGYETDNLTTDPKLAHMTARNENEKVYENDDQLLWD

SEQ ID NO: 880330 - protein, 149 aa, Homo sapiens
GTTEAEISSGNTPGSTGVTSSQEGTTVVSSGITGIPETSISGPSKEASDKTTAPGPPTTVTASTGVKETSETGVQTGSTLVTAGVPTRPQVSQPETTVVATREVETENKTECLASLPPAPGNNSTTSELFHINGSSCQSNFRGHANKSH

SEQ ID NO: 880331 - protein, 645 aa, Homo sapiens
AEKALEAVGCGLGPGAVAMAVTLEDGAEPPVLTTHLKKVENHITEAQRFSHLPKRSAVDIEFVELSYSVREGPCWRKRGYKTLLKCLSGKFCRRELIGIMGPSGAGKSTFMNILAGYRESGMKGQILVNGRPRELRTFRKMSCYIMQDDMLLPHLTVLEAMMVSANLKLSEKQEVKKELVTEILTALGLMSCSHTRTALLSGGQRKRLAIALELVNNPPVMFFDEPTSGLDSASCFQVVSLMKSLAQGGRTIICTIHQPSAKLFEMFDKLYILSQGQCIFKGVVTNLIPYLKGLGLHCPTYHNPADFIIEVASGEYGDLNPMLFRAVQNGLCAMAEKKSSPEKNEVPAPCPPCPPEVDPIESHTFATSTLTQFCILFKRTFLSILRDTVLTHLRFMSHVVIGVLIGLLYLHIGDDASKVFNNTGCLFFSMLFLMFAALMPTVLTFPLEMAVFMREHLNYWYSLKAYYLAKTMADVPFQVVCPVVYCSIVYWMTGQPAETSRFLLFSALATATALVAQSLGLLIGAASNSLQVATFVGPVTAIPVLLFSGFFVSFKTIPTYLQWSSYLSYVRYGFEGVILTIYGMERGDLTCLEERCPFREPQSILRALDVEDAKLYMDFLVLGIFFLALRLLAYLVLRYRVKSER

SEQ ID NO: 880332 - protein, 127 aa, Homo sapiens
RGGLSLTCGSAALGTSLAFHLLLVCFTSYRYGVRAQAVARLDTVLLALLVCLGALVDAYPIKPEAPGEDASPEELNRYYASLRHYLNLVTRQRYGKRDGPDRLLSKTFFPDGEDRPVRSRSEGPDLW

SEQ ID NO: 880333 - protein, 113 aa, Homo sapiens
MVFVRRPWPALTTVLLALLVCLGALVDAYPIKPEAPGEDASPEELNRYYASLRHYLNLVTRQRYGKRDGPDRLLSKTFFPDGEDRPVRSRYKAPVTTHPASESAAWPYPGNIT

SEQ ID NO: 880334 - protein, 70 aa, Homo sapiens
YFLGDTDPLLEEAHDHTAGVPFRDCQAPVAVQTLSSLHAQQGHQQDQGKGLHGIGTAHSSSLASHLVSIN

SEQ ID NO: 880335 - protein, 82 aa, Homo sapiens
VDPEGLLGGSCRLTSPAGSTSARPRNRQNVPTAVSLRWLIAPRAKMKPCQNSGSSAKASHAPSSLQKSHGSRLFRSPQIPVD

SEQ ID NO: 880336 - protein, 136 aa, Homo sapiens
HTALLHGAAAPQPRRSLLLADWLGRRVGGCYTGDLLVRKHILSHWRNDAPILSYLFLDVAQSGFSVVAARGGAPRATPLLLLHAGAGWALSPPLTWGRQGAGRGRLCLVLPLRSYLFLQISPLADSSPGKNETLPE

SEQ ID NO: 880337 - protein, 72 aa, Homo sapiens
SGAGPRRRVSGRAWLGPVLGWGQGLGPGPGVSRNLGVGRGGKWGAVRLGAGPELVLRRGSRAQGAPELEVEA

SEQ ID NO: 880338 - protein, 94 aa, Homo sapiens
SGAGPRRRVSGRAWLGPVLGWGQGLGPGPGDMAAYQQEGQMQLPRADAIRSRLIDTFSLIEHLQGLSQAVLRHTIRSYLILPARRNLCWEINTS

SEQ ID NO: 880339 - protein, 72 aa, Homo sapiens; identical to SEQ ID NO: 880337

SEQ ID NO: 880340 - protein, 199 aa, Homo sapiens
EPALSSSCVGVAGLRGRLSWRWKREVRTEWAKRTWAEVRPRSENGGEKELAPEGVLEWTHLGRDPFSKCQALAFCPISLHLVSLAWAGQALPQLHLIARFSQAQVGPRFFFVQPRAPALVAAPFLLSFLFCFVLFCLRCRLALSPTLECSGAISAHCKLCLPGSRHSPASASRVAGPTGARHHARLIFCIFSRDRVSPC

SEQ ID NO: 880341 - protein, 408 aa, Homo sapiens
MPVISSRQDCDSATSTVTDILCAAEVKSSKGTEDRGRILGDSNLEVSKLLSQFPLKSTETSKVPDNKNVLDKTRVTKDFLQDNLFSGPGPKEPTGLSPFLLLPPRPPPARPEKLPELPAQKRQLPVFAKICSKPKADPAVERHHLMEWSPGTKEPKKGQGSLFLSQWPQSQKDACGEEGCCDAVGTASLTLPPKKPTCPAEKNLLYEFLGATKNPSGQPRLRNKVEVDGPELKFNAPVTVADKNNPKYTGNVFTPHFPTAMTSATLNQPLWLNLNYPPPPVFTNHSTFLQYQGLYPQQAARMPYQQALHPQLGCYSQQVMPYNPQQMGQQIFRSSYTPLLSYIPFVQPNYPYPQRTPPKMSANPRDPPLMAGDGPQYLFPQGYGFGSTSGGPLMHSPYFSSSGNGINF

SEQ ID NO: 880342 - protein, 133 aa, Homo sapiens
SDSAHLHPGEINSHVAHTKPVWWSLHMDAHEIWCRDSDRGTSLGRSIPRPPALCSVRKIHLQPQVLRPTSPRNISPISNPDQKIFLFQSVSFIYDQRLNPVIKSEAPGYLYITGPMIHCFRTYLHMGWDDFLN

SEQ ID NO: 880343 - protein, 429 aa, Homo sapiens
MPLCRPEHLMPRASRVPVAASLPLSHAVIPTQLPSRSGHRPPGRPRRCPKASCLPPPVGPSSTQTAKRVTMGWPRPGRALVAVKALLVLSLLQVPAQAVVRAVLEDNSSSVDFADLPALFGVPLAPEGIRGYLMEVKPANACHPIEAPRLGNRSLGSIALIRRYDCTFDLKVLNAQRAGFEAAIVHNVHSDDLVSMTHVYEDLRGQIAIPSVFVSEAASQDLRVILGCNKSAHALLLPDDPPCHDLGCHPVLTVSWVLGCTLALVVSAFFVLNHLWLWAQACCSHRRPVKTSTCQKAQVRTFTWHNDLCAICLDEYEEGDQLKILPCSHTYHCKCIDPWFSQAPRRSCPVCKQSVAATEDSFDSTTYSFRDEDPSLPGHRPPIWAIQVQLRSRRLELLGRASPHCHCSTTSLEAEYTTVSSAPPEAPGQ

SEQ ID NO: 880344 - protein, 88 aa, Homo sapiens
PQSTFKNKEVSAHGSPSRFPSIMTAIRLREFIERRPVIPPSIFIAHQGRDVQGYYPGQLARLHFDHSAKRAPRLEPEISHSFAESSTA

SEQ ID NO: 880345 - protein, 103 aa, Homo sapiens
LLTFCSSIFIAHQGRDVQGYYPGQLARLHFDHSAKRAPRHSKPAEPWYKETTYRRDYSLPFYEIDWNQKLATVSLNPRPLNSLPELYCCEERSSFERNAFKLK

SEQ ID NO: 880346 - protein, 60 aa, Homo sapiens
MALPCGMGTAWYLDSTENALTVNVPRAQNHKASHNSMWKLGSHFYCILLVTKDPPGFTMV

SEQ ID NO: 880347 - protein, 153 aa, Homo sapiens [sequence omitted]

SEQ ID NO: 880348 - protein, 75 aa, Homo sapiens
EQEGKAEGGCMYARTCKIRRDFLRILSLTLLFLCRNFACEPLESLLMSRSQWLMPVIPALWEAEAGGSPEARNRD

SEQ ID NO: 880349 - protein, 109 aa, Homo sapiens
YVGQADLELPTSGDPPASASQSAGITGVSHCTRLSLVLRHLLDTPSLRAERSPRPVPRDKAQGRVYLGSRGGEGVEKAELESITLPTNHQTAGTLQPNAGRRTWRVSLC

SEQ ID NO: 880350 - protein, 122 aa, Homo sapiens
VLPRLVLHSWAQEILPPWSPKVLGCQVCTAILGLTLLFLSQPLCLTIPLSVPSPTQPPTLLLSLIFSFPYEAILMKSGTGRSLGTDKCQLSLAVSLPHGCSREGGQRAEVTVAKPETEAQLW

SEQ ID NO: 880351 - protein, 66 aa, Homo sapiens
PMTWCTTLDTIILEQHCTLTSQSVDILKARATFKTLDFIDALVLSKILVRVKHSMGTRAVRNILTT

SEQ ID NO: 880352 - protein, 115 aa, Homo sapiens
MSWDRKPGTLALLLLMPYTRADLGENRKYCSHNTNWFYRHCSLAFVFSFLLGTRIFEGGIISPTILHLTFPTVLSTTEASHSPREEVICFLEILTVSRFPPRGAISSHGWHFFSS

SEQ ID NO: 880353 - protein, 116 aa, Homo sapiens
FLGHRPGALWGLPYASPPSSPELVVTRAASYREHGWDADGERADREGGRHGVGKPALTATAEPGLARIHRGGRQILSREICPSHETCACFLSRSQQAADCLDGETTGESYLLLWEQ

SEQ ID NO: 880354 - protein, 116 aa, Homo sapiens; identical to SEQ ID NO: 880353

SEQ ID NO: 880355 - protein, 133 aa, Homo sapiens
TGRVLCGAYPTPLRRPPPNWWLRGPRVTVSTAGMLTGKELTEKADGMVLGSPLSQQPPNPAWPESTEEGAKSSLVRSALLTKLALASSRGNFMALLGPDIAIFPGGRCNTENLLRCCGTCARSARRPRASLVR

SEQ ID NO: 880356 - protein, 557 aa, Homo sapiens
MDSTVPSALELPQRLALNPRESPRSPEEEEPHLLSSLAAVQTLASVIRPCYGPHGRQKFLVTMKGETVCTGCATAILRALELEHPAAWLLREAGQTQAENSGDGTAFVVLLTEALLEQAEQLLKAGLPRPQLREAYATATAEVLATLPSLAIQSLGPLEDPSWALHSVMNTHTLSPMDHLTKLVAHACWAIKELDGSFKPERVGVCALPGGTLEDSCLLPGLAISGKLCGQMATVLSGARVALFACPFGPAHPNAPATARLSSPADLAQFSKGSDQLLEKQVGQLAAAGINVAVVLGEVDEETLTLADKYGIVVIQARSWMEIIYLSEVLDTPLLPRLLPPQRPGKCQRVYRQELGDGLAVVFEWECTGTPALTVVLRGATTQGLRSAEQAVYHGIDAYFQLCQDPRLIPGAGATEMALAKMLSDKGSRLEGPSGPAFLAFAWALKYLPKTLAENAGLAVSDVMAEMSGVHQGGNLLMGVGTEGIINVAQEGVWDTLIVKAQGFRAVAEVVLQLVTVDEIVVAKKSPTHQEIWNPDSKKTKKHPPPVETKKILGLNN

SEQ ID NO: 880357 - protein, 342 aa, Homo sapiens
MEEELAIQQGQLETTLKELQTLRNMQKEAIAAHKQENKLHLQQHVSMEFLKLHQFLHSKEKDILTELREEGKALNEEMELNLSQLQEQCLLAKDMLVSIQAKTEQQNSFDFLKDITTLLHSLEQGMKVLATRELISRKLNLGQYKGPIQYMVWREMQDTLCPGLSPLTLDPKTAHPNLVLSKSQTSVWHGDIKKIMPDDPERFDSSVAVLGSRGFTSGKWYWEVEVAKKTKWTVGVVRESIIRKGSCPLTPEQGFWLLRLRNQTDLKALDLPSFSLTLTNNLDKVGIYLDYEGGQLSFYNAKTMTHIYTFSNTFMEKLYPYFCPCLNDGGENKEPLHILHPQ

SEQ ID NO: 880358 - protein, 263 aa, Homo sapiens
MEEELAIQQGQLETTLKELQTLRNMQKEAIAAHKDITTLLHSLEQGMKVLATRELISRKLNLGQYKGPIQYMVWREMQDTLCPGLSPLTLDPKTAHPNLVLSKSQTSVWHGDIKKIMPDDPERFDSSVAVLGSRGFTSGKWYWEVEVAKKTKWTVGVVRESIIRKGSCPLTPEQGFWLLRLRNQTDLKALDLPSFSLTLTNNLDKVGIYLDYEGGQLSFYNAKTMTHIYTFSNTFMEKLYPYFCPCLNDGGENKEPLHILHPQ

SEQ ID NO: 880359 - protein, 239 aa, Homo sapiens
ARGLLAKDMLDITTLLHSLEQGMKVLATRELISRKLNLGQYKGPIQYMVWREMQDTLCPGLSPLTLDPKTAHPNLVLSKSQTSVWHGDIKKIMPDDPERFDSSVAVLGSRGFTSGKWYWEVEVAKKTKWTVGVVRESIIRKGSCPLTPEQGFWLLRLRNQTDLKALDLPSFSLTLTNNLDKVGIYLDYEGGQLSFYNAKTMTHIYTFSNTFMEKLYPYFCPCLNDGGENKEPLHILHPQ

SEQ ID NO: 880360 - protein, 501 aa, Homo sapiens
MEVSTNPSSNIDPGDYVEMNDSITHLPSKVVIQDITMELHCPLCNDWFRDPLMLSCGHNFCEACIQDFWRLQAKETFCPECKMLCQYNNCTFNPVLDKLVEKIKKLPLLKGHPQCPEHGENLKLFSKPDGKLICFQCKDARLSVGQSKEFLQISDAVHFFMEELAIQQGQLETTLKELQTLRNMQKEAIAAHKQENKLHLQQHVSMEFLKLHQFLHSKEKDILTELREEGKALNEEMELNLSQLQEQCLLAKDMLVSIQAKTEQQNSFDFLKDITTLLHSLEQGMKVLATRELISRKLNLGQYKGPIQYMVWREMQDTLCPGLSPLTLDPKTAHPNLVLSKSQTSVWHGDIKKIMPDDPERFDSSVAVLGSRGFTSGKWYWEVEVAKKTKWTVGVVRESIIRKGSCPLTPEQGFWLLRLRNQTDLKALDLPSFSLTLTNNLDKVGIYLDYEGGQLSFYNAKTMTHIYTFSNTFMEKLYPYFCPCLNDGGENKEPLHILHPQ

SEQ ID NO: 880361 - protein, 328 aa, Homo sapiens
MAANSTSDLHTPGTQLSVADIIVITVYFALNVAVGIWSSCRASRNTVNGYFLAGRDMTWWPIGASLFASSEGSGLFIGLAGSGAAGGLAVAGFEWNATYVLLALAWVFVPIYISSEIVTLPEYIQKRYGGQRIRMYLSVLSLLLSVFTKISLDLYAGALFVHICLGWNFYLSTILTLGITALYTIAGGLAAVIYTDALQTLIMVVGAVILTIKAFDQIGGYGQLEAAYAQAIPSRTIANTTCHLPRTDAMHMFRDPHTGDLPWTGMTFGLTIMATWYWCTDQVIVQRSLSARDLNHAKAGSILASYLKMLPMGLIIMPGMISRALFPG

SEQ ID NO: 880362 - protein, 301 aa, Homo sapiens
MAANSTSDLHTPGTQLSVADIIVITVYFALNVAVGIWSSCRASRNTVNGYFLAGRDMTWWPIGASLFASSEGSGLFIGLAGSGAAGGLAVAGFEWNATYVLLALAWVFVPIYISSEIVTLPEYIQKRYGGQRIRMYLSVLSLLLSVFTKISLDLYAGALFVHICLGWNFYLSTILTLGITALYTIAAFDQIGGYGQLEAAYAQAIPSRTIANTTCHLPRTDAMHMFRDPHTGDLPWTGMTFGLTIMATWYWCTDQVIVQRSLSARDLNHAKAGSILASYLKMLPMGLIIMPGMISRALFPG

SEQ ID NO: 880363 - protein, 130 aa, Homo sapiens
MAANSTSDLHTPGTQLSVADIIVITVYFALNVAVGIWSSCRASRNTVNGYFLAGRDMTWWPIGASLFASSEGSGLFIGLAGSGAAGGLAYCRRFAFSGSPLESGGTWPWPALKAEFRAFHSYSSFLSHIS

SEQ ID NO: 880364 - protein, 171 aa, Homo sapiens
MAANSTSDLHTPGTQLSVADIIVITVYFALNVAVGIWSSCRASRNTVNGYFLAGRDMTWWPIGASLFASSEGSGLFIGLAGSGAAGGLAVAGFEWNATYVLLALAWVFVPIYISSEQQTPYRSLRQMPLAYCRRFAFSGSPLESGGTWPWPALKAEFRAFHSYSSFLSHIS

SEQ ID NO: 880365 - protein, 146 aa, Homo sapiens
MCMERGGESTKGMVLAYRHEAPTTQGRPGGPGSSAAPHVPISHAARHQQPSPLHFSQETESCSIPQVGVQWHDLGSLQPPPPGFKWFSCLSLSSIWDYRWRKEVPSQGMQHGPLEAGMTLTSRPARNQGTQSYPSEQEIDSPLQPL

SEQ ID NO: 880366 - protein, 122 aa, Homo sapiens
LNIILDHFKYHLCTHAICAWNVEARVQKAWCLPIDMRPLQPREGPVVQDPVLLPMCPSHMLLGTSSHHHSTSLKRWRKEVPSQGMQHGPLEAGMTLTSRPARNQGTQSYPSEQEIDSPLQPL

SEQ ID NO: 880367 - protein, 84 aa, Homo sapiens
VETSGLRPSRGRLWLMNPCLQPGTLLLQPCSTDRFSSFILMFHKVFQKSSAPFHTPTAVAWSSDFKWVLTTKKRKMDKLLLASL

SEQ ID NO: 880368 - protein, 763 aa, Homo sapiens
PGRGEDGPAGQTDRGPGGRRAAQPRPPWIRRQPGPGLSTCPPGECAGQTMLDTMEAPGHSRQLLLQLNNQRTKGFLCDVIIVVQNALFRAHKNVLAASSAYLKSLVVHDNLLNLDHDMVSPAVFRLVLDFIYTGRLADGAEAAAAAAVAPGAEPSLGAVLAAASYLQIPDLVALCKKRLKRHGKYCHLRGGGGGGGGYAPYGRPGRGLRAATPVIQACYPSPVGPPPPPAAEPPSGPEAAVNTHCAELYASGPGPAAALCASERRCSPLCGLDLSKKSPPGSAAPERPLAERELPPRPDSPPSAGPAAYKEPPLALPSLPPLPFQKLEEAAPPSDPFRGGSGSPGPEPPGRPDGPSLLYRWMKHEPGLGSYGDELGRERGSPSERCEERGGDAAVSPGGPPLGLAPPPRYPGSLDGPGAGGDGDDYKSSSEETGSSEDPSPPGGHLEGYPCPHLAYGEPESFGDNLYVCIPCGKGFPSSEQLNAHVEAHVEEEEALYGRAEAAEVAAGAAGLGPPFGGGGDKVAGAPGGLGELLRPYRCASCDKSYKDPATLRQHEKTHWLTRPYPCTICGKKFTQRGTMTRHMRSHLGLKPFACDACGMRFTRQYRLTEHMRIHSGEKPYECQVCGGKFAQQRNLISHMKMHAVGGAAGAAGALAGLGGLPGVPGPDGKGKLDFPEGVFAVARLTAEQLSLKQQDKAAAAELLAQTTHFLHDPKVALESLYPLAKFTAELGLSPDKAAEVLSQGAHLAAGPDGRTIDRFSPT

SEQ ID NO: 880369 - protein, 108 aa, Homo sapiens
ARRPGRRTALTRPVCVPAGECAGQTMLDTMEAPGHSRQLLLQLNNQRTKGFLCDVIIVVQNALFRAHKNVLAASSAYLKSLVVHDNLLNLDHDMVSPAVFRLVLDFIY

SEQ ID NO: 880370 - protein, 129 aa, Homo sapiens
MIPGVGNVLVGPELSCSLCRLMLLILTRGLVLTQRSNSSLVNLIFGTIRGEDKKPGNWGDAKVITFCLLKFACSFQLDAVPSISHPTFLQSCDTVLQRRATNLHPHAGRNPEGCTLSHDSIYETRMVGF

SEQ ID NO: 880371 - protein, 569 aa, Homo sapiens
PAHLPRRPGRPPAPGSSGPPMMGSVLPAEALVLKTGLKAPGLALAEVITSDILHSFLYGRWRNVLGEQLFEDKSHHASPKTAFTAEVLAQSFSGEVQKLSSLVLPAEVIIAQSSIPGEGLGIFSKTWIKAGTEMGPFTGRVIAPEHVDICKNNNLMWEVFNEDGTVRYFIDASQEDHRSWMTYIKCARNEQEQNLEVVQIGTSIFYKAIEMIPPDQELLVWYGNSHNTFLGIPGVPGLEEDQKKNKHEDFHPADSAAGPAGRMRCVICHRGFNSRSNLRSHMRIHTLDKPFVCRFCNRRFSQSSTLRNHVRLHTGERPYKCQVCQSAYSQLAGLRAHQKSARHRPPSTALQAHSPALPAPHAHAPALAAAAAAAAAAAAHHLPAMVLLSAPAPPPGPARSWVPGTPAPQRDSPSSPNPRPGAAAEPRALGLRPGGGSQAPPPWPVSQMRTLRAASLTQATQLVRLFGRLLWEGVPLPGLAPESPCCCRAGRPGRHPPRGWQESGLRAPEGPSAEEGESPPPPPRVLCFGMKGGRPPCPGVVGRGGCGGAISSSGPWDWCPEVSGVLTQP

SEQ ID NO: 880372 - protein, 233 aa, Homo sapiens
MFPLTEENKHVAQLLLNTGTCPRCIFRFCGVDFHAPYKLPYKELLNELQKFLETEKDELILEVMNPPPKKIRLQELEDSIDNLSQNGEGRISVSHVGSTASKNSNLNVCNVCLGILQEFCEKDFIKKVCQKVEASGFEFTSLVFSVSFPPQLSVREHAAWLLVKQEMGKQSLSLGRDDIVQLKEAYKWITHPLFSEELGVPIDGKSLFEVSVGFAHPETVEDCHFLAAICPDC

SEQ ID NO: 880373 - protein, 233 aa, Homo sapiens; identical to SEQ ID NO: 880372

SEQ ID NO: 880374 - protein, 111 aa, Homo sapiens
STLAPTSDRKILTSLIRLAGSLSPHQFEGLPISIIHLEAHQLSQKAWEPFNTPIRLGLPISPIKLELHCLTHQSITPGQVQWLPPVIQALWEAEAGGSPEVRNSRQTWPTR

SEQ ID NO: 880375 - protein, 768 aa, Homo sapiens
MDVKERKPYRSLTRRRDAERRYTSSSADSEEGKAPQKSYSSSETLKAYDQDARLAYGSRVKDIVPQEAEEFCRTGANFTLRELGLEEVTPPHGTLYRTDIGLPHCGYSMGAGSDADMEADTVLSPEHPVRLWGRSTRSGRSSCLSSRANSNLTLTDTEHENTETDHPGGLQNHARLRTPPPPLSHAHTPNQHHAASINSLNRGNFTPRSNPSPAPTDHSLSGEPPAGGAQEPAHAQENWLLNSNIPLETRNLGKQPFLGTLQDNLIEMDILGASRHDGAYSDGHFLFKPGGTSPLFCTTSPGYPLTSSTVYSPPPRPLPRSTFARPAFNLKKPSKYCNWKCAALSAIVISATLVILLAYFVAMHLFGLNWHLQPMEGQMYEITEDTASSWPVPTDVSLYPSGGTGLETPDRKGKGTTEGKPSSFFPEDSFIDSGEIDVGRRASQKIPPGTFWRSQVFIDHPVHLKFNVSLGKAALVGIYGRKGLPPSHTQFDFVELLDGRRLLTQEARSLEGTPRQSRGTVPPSSHETGFIQYLDSGIWHLAFYNDGKESEVVSFLTTAIALPPRLKEMKSQESAAGSKLVLRCETSSEYSSLRFKWFKNGNELNRKNKPQNIKIQKKPGKSELRINKASLADSGEYMCKVISKLGNDSASANITIVESNEIITGMPASTEGAYVSSESPIRISVSTEGANTSSSTSTSTTGTSHLVKCAEKEKTFCVNGGECFMVKDLSNPSRYLCKCPNEFTGDRCQNYVMASFYSTSTPFLSLPE

SEQ ID NO: 880376 - protein, 299 aa, Homo sapiens
MLESHLIIYFLLAVIQFLLGIFTNGIIVVVNGIDLIKHRKMAPLDLLLSCLAVSRIFLQLFIFYVNVIVIFFIEFIMCSANCAILLFINELELWLATWLGVFYCAKVASVRHPLFIWLKMRISKLVPWMILGSLLYVSMICVFHSKYAGFMVPYFLRKFFSQNATIQKEDTLAIQIFSFVAEFSVPLLIFLFAVLLLIFSLGRHTRQMRNTVAGSRVPGRGAPISALLSILSFLILYFSHCMIKVFLSSLKFHIRRFIFLFFILVIGIYPSGHSLILILGNPKLKQNAKKFLLHSKCCQ

SEQ ID NO: 880377 - protein, 259 aa, Homo sapiens
MAPLDLLLSCLAVSRIFLQLFIFYVNVIVIFFIEFIMCSANCAILLFINELELWLATWLGVFYCAKVASVRHPLFIWLKMRISKLVPWMILGSLLYVSMICVFHSKYAGFMVPYFLRKFFSQNATIQKEDTLAIQIFSFVAEFSVPLLIFLFAVLLLIFSLGRHTRQMRNTVAGSRVPGRGAPISALLSILSFLILYFSHCMIKVFLSSLKFHIRRFIFLFFILVIGIYPSGHSLILILGNPKLKQNAKKFLLHSKCCQ

SEQ ID NO: 880378 - protein, 152 aa, Homo sapiens [sequence omitted]

SEQ ID NO: 880379 - protein, 205 aa, Homo sapiens
MPGFEGAGDGLVQTWGLLAAGAGSEEVSSQPRQGINLGHSSHSQDLPVTMAVGKFLLGSLLLLSLQLGQGWGPDARGVPVADGEFSSEQVAKAGGTWLGTHRPLARLRRALSGPCQLWSLTLSVAELGLGYASEEKVIFRYCAGSCPRGARTQHGLALARLQGQGRAHGGPCCRPTRYTDVAFLDDRHRWQRLPQLSAAACGCGG

SEQ ID NO: 880380 - protein, 226 aa, Homo sapiens
RWRRAARGHLLFFAKSEPERQAAAAAEGSATVSAGARTARAREEPPRARALRATPATSSRELCPGDRARVMTTNPKPNKALKVKKEAGENAPVLSDDELVSMSVRELNQHLRGLTKEEVTRLKQRRRTLKNRGYAASCRIKRVTQKEELERQRVELQQEVEKLARENSSMRLELDALRSKYEALQTFARTVARGPVAPSKVATTSVITIVKSTELSSTSVPFSAAS

SEQ ID NO: 880381 - protein, 226 aa, Homo sapiens; identical to SEQ ID NO: 880380

SEQ ID NO: 880382 - protein, 106 aa, Homo sapiens
MVCRQLRPSSCPVAVPVIRVCLSRGLREWARCGRSPAWGGVCVCARTPAIKAAGLRGCSLLVFTGGGPVGTHGRESVPHRESVPHRESVNSTPHQREVGILKITAA

SEQ ID NO: 880383 - protein, 202 aa, Homo sapiens
MATLIYVDKENEEPGILVATKDGLKLGSGPSIKALDGRSQVSISCFGKTFDAPTSLPKATRKALGTVNRATEKSVKTNGPLKQKQPSFSAKKMTEKTVKAKNSVPASDDGYPEIEKLFPFNPLGFESFDLPEEHQIAHLPLSEVPLMILDEERELEKLFQLGPPSPLKMPSPPWKSNLLQSPLSILLTLDVELPPVCCDIDI

SEQ ID NO: 880384 - protein, 954 aa, Homo sapiens
DLDSVSRSEIALGCKDLNHVSLSSLIPELDVTSEYINSDTLVREINKHTSPEEYNLNLFLQEKKHINLTKLGLNVQKHPGNEKEDSLQYLANKKYTQGRGSHSQEMRYNRQNRWKRQNFHEFPPLFAFPSLSQTDLEELTYFFPEDHAEDVQQEFFPSWPTPSGLTEYSTLTLCQETLANSSIGRLCLAFLGKRLDSVIEMCVKDVLLKDDLSWAEAGVALLENECEKRIVEEGKYNTEEYGTSIEDILSVLKCPNLCSGNGQCMEWGCACSPSFSSYDCSDSYDKAPEITELGNAGFCDVQKYNCMMVRVFGKGFKELPSIKCEVTKLQYNSSEWMPGEPIYTQTVFHNSRAVDCQLPTDVQQFDTMDLVGGKPTGKWQLKVSNDGYKFSNPKITVIYDGACQVCGLYKNDSCTIKENVCIIDGLCYVEGDKNPTSPCLICRPKISRFTWSFLENNQPPVIQALQDKLQTFYGENFEYQFVAFDPEGSDIHFTLDSGPEGASVSSAGLFMWKTDLLTTQQITVRLNDDCDAETRVTIEVTVKSCDCLNGGSCVSDRNFSPGSGVYLCVCLPGFHGSLCEVDISGCQSNPCGLGSYISGFHSYSCDCPPELKVETQFVNQFTTQTVVLTRSDKSVNKEEDDKNAQGRKRHVKPTSGNAFTICKYPCGKSRECVAPNICKCKPGYIGSNCQTALCDPDCKNHGKCIKPNICQCLPGHGGATCDEEHCNPPCQHGGTCLAGNLCTCPYGFVGPRCETMVCNRHCENGGQCLTPDICQCKPGWYGPTCSTALCDPVCLNGGSCNKPNTCLCPNGFFGEHCQNAFCHPPCKNGGHCMRNNVCVCREGYTGRRFQKSICDPTCMNGGKCVGPSTCSCPSGWSGKRCNTPICLQKCKNGGECIAPSICHCPSSWEGVRCQIPICNPKCLYGGRCIFPNVCSCRTEYSGVKCEKKIQIRRH

SEQ ID NO: 880385 - protein, 796 aa, Homo sapiens
MEAGGERFLRQRQVLLLFVFLGGSLAGSESRRYSVAEEKEKGFLIANLAKDLGLRVEELAARGAQVVSKGNKQHFQLSHQTGDLLLNEKLDREELCGPTEPCILHFQILLQNPLQFVTNELRIIDVNDHSPVFFENEMHLKILESTLPGTVIPLGNAEDLDVGRNSLQNYTITPNSHFHVLTRSRRDGRKYPELVLDKALDREEQPELSLTLTALDGGSPPRSGTAQINIQVLDINDNAPEFAQPLYEVAVLENTPVNSVIVTVSASDLDTGSFGTISYAFFHASEEIRKTFQLNPITGDMQLVKYLNFEAINSYEVDIEAKDGGGLSGKSTVIVQVVDVNDNPPELTLSSVNSPIPENSGETVLAVFSVSDLDSGDNGRVMCSIENNLPFFLKPSVENFYTLVSEGALDRETRSEYNITITITDLGTPRLKTKYNITVLVSDVNDNAPAFTQISYTLFVRENNSPALHIGSVSATDRDSGTNAQVTYSLLPPQDPHLPLSSLVSINADNGHLFALRSLDYEALQAFEFRVGATDRGSPALSSEALVRVLVLDANDNSPFVLYPLQNGSAPCTELVPRAAEPGYLVTKVVAVDGDSGQNAWLSYQLLKATEPGLFGVWAHNGEVRTARLLSERDAAKHRLVVLVKDNGEPPRSATATLHVLLVDGFSQPYLPLPEAAPAQAQADLLTVYLVVALASVSSLFLFSVLLFVAVRLCRRSRAASVGRCSVPEGPFPGQMVDVSGTGTLSQSYQYEVCLTGGSGTNEFKFLKPIIPNFVAQGAERVSEANPSFRKSFEFS

SEQ ID NO: 880386 - protein, 375 aa, Homo sapiens
MSLMVISMACVGFFLLQGAWTHEGGQDKPLLSAWPSAVVPRGGHVTLLCRSRLGFTIFSLYKEDGVPVPELYNKIFWKSILMGPVTPAHAGTYRCRGSHPRSPIEWSAPSNPLVIVVTGLFGKPSLSAQPGPTVRTGENVTLSCSSRSSFDMYHLSREGRAHEPRLPAVPSVNGTFQADFPLGPATHGGTYTCFGSLHDSPYEWSDPSDPLLVSVTGNSSSSSSSPTEPSSKTGIRRHLHILIGTSVAIILFIILFFFLLHCCCSNKKNAAVMDQEPAGDRTVNREDSDDQDPQEVTYAQLDHCVFTQTKITSPSQRPKTPPTDTTMYMELPNAKPRSLSPAHKHHSQALRGSSRETTALSQNRVASSHVPAAGI

SEQ ID NO: 880387 - protein, 84 aa, Homo sapiens
FLEVGINYQSPTVVPGGAVAKVQRAVCVLNNTTAITEAWARLNQKFDLMYAKRAFMHCYVDRGMEEGELSGPERTWLPWRRIMK

SEQ ID NO: 880388 - protein, 102 aa, Homo sapiens
MMFHATFYSCLHKSRKRKREHISPYLLISNSLLRGQDYLQGKKRGMPSPPSRSYVPVPEHLFPSTLKRSKCFASNSQIIYSQGEKCFKTEVLNGIKYCQQTK

SEQ ID NO: 880389 - protein, 134 aa, Homo sapiens
EHHVGAQKASDFGAFGFRIFPDLGCATWTNIWIPAVDPSMAPALAEMGKAAPWASLALRPRRVLPALLFLPGLWNSVRQGAGDLRLASPTSPGQWWTPGLCCCSALASPGGLGPTQRGPGWRPPQSTQNTQGSL

SEQ ID NO: 880390 - protein, 138 aa, Homo sapiens
SSTYAFAISLLPSVFQPKNLIVILKTCGTLPLPSNTLTVQQQVLLPTNAKYFSNLSPFVYLPCCHPSANHHCHQLCSSSLSWPPGLLQSILHAETKATKKKKSKLDYVISLSESSEWLPTAFMIKYKLLALACNTPHD

SEQ ID NO: 880391 - protein, 76 aa, Homo sapiens
CVGTFSRKYLLQIASSGDDSKGQFWSTQAIADRVTSGLYTVPGLSLPDITLGSSRLKQGAPSKGPQRKQLSLRVKK

SEQ ID NO: 880392 - protein, 103 aa, Homo sapiens
MRQSLGCKKLTRDQHLCKEAGGSTIEVEKDEEVELPCRPDRALPNQWGTRRKSCLPVSHVEPKQSCFYLSTLLSHQMQATPRRVCFSLQLRLMLRSWELEATC

SEQ ID NO: 880393 - protein, 103 aa, Homo sapiens; identical to SEQ ID NO: 880392

SEQ ID NO: 880394 - protein, 106 aa, Homo sapiens [sequence omitted]

SEQ ID NO: 880395 - protein, 67 aa, Homo sapiens
FAATMRTELPLPRTRMGETAASRHLGTPGDTWGGVRGEDWETLLHLRDTTWGRGQGPTQEGPWLRDT

SEQ ID NO: 880396 - protein, 130 aa, Homo sapiens
MFRKHHWSRSRIGAASMSSNLASLLKSSRASRAQTTARPARSGPNHRPLRDQLGRAQTTAHCGTSSVGPKPPPTAGPARSGPNHCPLRDQLGRGDPNPAALEELKKHTQKYRYLARVFCMSDTYGSNRTH

SEQ ID NO: 880397 - protein, 31 aa, Homo sapiens
MAPPGPANYSCSPTQKRFSTREDPVSHPTMA

SEQ ID NO: 880398 - protein, 291 aa, Homo sapiens
MGVAARPPALRHWFSHSIPLAIFALLLLYLSVRSLGARSGCGPRAQPCVPGETAPFQVRQESGTLEAPERKQPPCLGPRGMLGRMMRRFHASLKPEGDVGLSPYLAGWRALVEFLTPLGSVFAFATREAFTKVTDLEARVHGPDAEHYWSLAAMAAWERRAGLLEQPGAAPRDPTRSSGSRTLLLLHRALRWSQLCLHRVATGALGGPEAGVQCSDAYRAALGPHHPWLVRQTARLAFLAFPGRRRLLELACPGATEAEARAALLRAAGTLEDVYNRTQSLLAERGLLQLA

SEQ ID NO: 880399 - protein, 184 aa, Homo sapiens
MGVAARPPALRHWFSHSIPLAIFALLLLYLSVRSLGARSGCGPRAQPCVPGETAPFQVRQESGTLEAPERKQPPCLGPRGMLGRMMRRFHASLKPEGDVGLSPYLAGWRALVEFLTPLGSVFAFATAPAGLRRRLRGPAGTERTARGGAAQPGVSPAARAAAASVSRLFRDVAAARAAPGREWR

SEQ ID NO: 880400 - protein, 114 aa, Homo sapiens
RRDTDWLGAGEGAAVPAAGMGVAARPPALRHWFSHSIPLAIFALLLLYLSVRSLGELPLPSLAPGGSPESRPSRLKPLSRALTAPLLLYPGARSGCGPRAQPCVPGETAPFQVR

SEQ ID NO: 880401 - protein, 122 aa, Homo sapiens
APRDPTRSSGSRTLLLLHRALRWSQLCLHRVATGALGGPEAGVQCSDAYRAALGPHHPWLVRQTARLAFLAFPGRRRLLELACPGATEAEARAALLRAAGTLEDVYNRTQSLLAERGLLQLA

SEQ ID NO: 880402 - protein, 114 aa, Homo sapiens
WFVGRFPGFFFYYQLGCHICLYACFMINTCKRPGYAKCQLYKIMSSCFATWYCQFRLTQVVKKHPQCPKSLPTLSVTRLLNFYQSGQWIIALKSYFYCDLESNIFSVRNACTML

SEQ ID NO: 880403 - protein, 79 aa, Homo sapiens
MRVHQKMTYSSKVSAKHTSLRRQLQLEDKQEDLEARAEAEHQRAFRDYTTWKLTLTKVAGAESEVSTIQQDILRKRPFA

SEQ ID NO: 880404 - protein, 133 aa, Homo sapiens
CLLCFLPLQVSMVGVQLSPPVTFQLRAGSGPVFLSGQERYEASDLTWEEEEEEEGEEEEEEEEDDEDEDADISLEEQSPVKQVKRLVPQKQASVAKKKKLEKEEEEIRASVRDKSPVKKAKATARAKKPGFKK

SEQ ID NO: 880405 - protein, 73 aa, Homo sapiens
ASDLTWEEEEEEEGEEEEEEEEDDEDEDADISLEEQSPVKQVKRLVPQKQASVAKVGEGAWLFGRKWYPYRST

SEQ ID NO: 880406 - protein, 163 aa, Homo sapiens
VGGPENPYLIDPENQNVTLNGPGGCGTREDCVLSLGRTRTEAHTALSRLRASMWIDRSTRAVSVHFTLYNPPTQLFTSVSLRVEILPTGSLVPSSLVESFSIFRSDSALQYHLMLPQLVFLALSLIHLCVQLYRMMDKGVLSYWRKPRNWLEVASLVSFSFEK

SEQ ID NO: 880407 - protein, 277 aa, Homo sapiens
VGGPENPYLIDPENQNVTLNGPGGCGTREDCVLSLGRTRTEAHTALSRLRASMWIDRSTRAVSVHFTLYNPPTQLFTSVSLRVEILPTGSLVPSSLVESFSIFRSDSALQYHLMLPQLVFLALSLIHLCVQLYRMMDKGVLSYWRKPRNWLELSVVGVSLTYYAVSGHLVTLAGDVTNQFHRGLCRAFMDLTLMASWNQRARWLRGILLFLFTLKCVYLPGIQNTMASCSSMMRHSLPSIFVAGLVGALMLAALSHLHRFLLSMWVLPPGTFTDAFP

SEQ ID NO: 880408 - protein, 123 aa, Homo sapiens
LLLDPLHRHLDPVGSPIKAREPGKGLESPCVDYVASTNVINTKVKLFNSAMIIHRTLLELQSRPIFTIDAEGSAGSARGLRNAAPKPFCVAQALRGHALGSHILEMFVIPGRCLSEENFKQNK

SEQ ID NO: 880409 - protein, 123 aa, Homo sapiens; identical to SEQ ID NO: 880408

SEQ ID NO: 880410 - protein, 105 aa, Homo sapiens
SVHTATFTIPYPRFAETPAKTLAMQDSATTEPQSVTSRGHLDKEPQEKPKRWVKNQERRLQRKVKTRGQAPKKEMRTANFALSQPKVLQVNVRSQQMPWGADTEP

SEQ ID NO: 880411 - protein, 248 aa, Homo sapiens
MDQRQRRILGQPLSIPTSQPKQKRTSMISFFSKVSWKLRFQKREPLKNVFFILAERARDPSAKKRHMAMRNLGTMAYEAPDKVRKYKKIVLDLLVYGLYDPVNLEVIHESMKTLTVVLGKIQGKGLGSFFIDIALQTRTLLDDENDSLRYSAFVLFGQLAAFAGRKWKKFFTSQVKQTRDSLLIHLQDRNPQVAKACKTTFQACSPYLKLKEEYSFQSEEDQRNTKLYQQLSHYHPEILQFFYANKIL

SEQ ID NO: 880412 - protein, 248 aa, Homo sapiens; identical to SEQ ID NO: 880411

SEQ ID NO: 880413 - protein, 196 aa, Homo sapiens
MDQRQRRILGQPLSIPTSQPKQKRTSMISFFSKVSWKLRFQKREPLKNVFFILAERARDPSAKKRHMAMRNLGTMAYEAPDKVRKYKKIVLDLLVYGLYDPVNLEVIHESMKTLTVVLGKIQGKGLGSFFIDIALQTRTLLDDACKTTFQACSPYLKLKEEYSFQSEEDQRNTKLYQQLSHYHPEILQFFYANKIL

SEQ ID NO: 880414 - protein, 111 aa, Homo sapiens
MGKNGTLDTNSFGLVLPCGCPCSVICDTRNMFHTNRIASLPIRASAWNYIIIHLFINSFICSLPLYIGLESHYSKPSLTSGSRDTKMRLKKTHGFLHSWTPMRMATTWAET

SEQ ID NO: 880415 - protein, 364 aa, Homo sapiens
PVVVESSHPYTDDTSTSGTVKIPGAEGLRVEFDRQCSTERRHDPLTVMDGVNRIVSVRSGREWSDWSSELRIPGDELKWKFISDGSVNGWGWRFTVYPIMPAAGPKELLSDRCVLSCPSMDLVTCLLDFRLNLASNRSIVPRLVASLAACAQLSGLATSHRMWALQKLRKLLTTEFGQSININRLLGENDGEARALSFTGSALAALVKGLPEALQRQFEYEDPIVRGGKQLLHSPFFKVLVALACDLELDTLPCCAETHKWAWFRRYCMASRVAVALDKRTPLPRLFLDEVAKKIRELMADSENMDVLHESHDIFKREQDEQLVQWMNRRPDDWTLSAGGSGTIYGWGHNHRGQLGGIEGAKVK

SEQ ID NO: 880416 - protein, 323 aa, Homo sapiens
VWLSCMHGAPGLAVLELLQLTGDQSLGLSQRHMAALDALVHLLHGEPGWGWRFTVYPIMPAAGPKELLSDRCVLSCPSMDLVTCLLDFRLNLASNRSIVPRLVASLAACAQLSGLATSHRMWALQKLRKLLTTEFGQSININRLLGENDGEARALSFTGSALAALVKGLPEALQRQFEYEDPIVRGGKQLLHSPFFKVLVALACDLELDTLPCCAETHKWAWFRRYCMASRVAVALDKRTPLPRLFLDEVAKKIRELMADSENMDVLHESHDIFKREQDEQLVQWMNRRPDDWTLSAGGSGTIYGWGHNHRGQLGGIEGAKVK

SEQ ID NO: 880417 - protein, 111 aa, Homo sapiens
RNVTVDSSAWKELCHLYRRRCCALGLGVLMKDLLQELSSYNGEEEDPEDVKKSSGVIQKDTLMLASQNWKTPPLQVATSRCQQVLPLHLQKKQQKRQKWKRKCEGKWKQAE

SEQ ID NO: 880418 - protein, 122 aa, Homo sapiens
GSHPPSDSIRRCLSQGAVLQQHHVKLETKPKKFEDRVLALTSWRLHLFLLKVPAKVESSFNVLEIRAFNTLSQNQILVETERGMVSMRLPSAESVDQVTRHVSSALSKVCPGPGCLIRRGNA

SEQ ID NO: 880419 - protein, 106 aa, Homo sapiens
IPVTLQKQQLNLGKWTGTPRQTHRSEMEHKGHFWASGLHRCMVWVLFSAQCLQHCLCPLCTPAFLTFRLPCFSVTSPKNRQSLRCACTHSSLKLVSVSISRDMNKN

SEQ ID NO: 880420 - protein, 73 aa, Homo sapiens
KRCLDNWQATCRIMKLDSHLSPYTKIYSRLIKDLNLRPEIIKILEDNIGKTLLDIGLGRVHDQEPKSKCNEDK

SEQ ID NO: 880421 - protein, 90 aa, Homo sapiens
YAGVHAENAEDYEGRDVFNTKPIAQLIEEALSNNPQQVVEGCCSDMAITFNGLTPQKMEVMMYGLYRLRAFGHYFNDTLVFLPPVGSEND

SEQ ID NO: 880422 - protein, 136 aa, Homo sapiens
MGKGTVSGLVQVVDAETGKVVIISQDLVQVKVLLLGAVRIRSPIMQIRMGTQLGKNWIHLPLLEGGSTASGGIPSAGTPLVTRPDFSPPMSIYITWITNHQNPFSFGNAMPGLTFHWSVTKRDILDLQGQHHKMSH

SEQ ID NO: 880423 - protein, 105 aa, Homo sapiens
LGLLASYAVILCHVRRAASEGKNKAMSMCTTRVIIILLMFGPAIFIYMCPFRALPADKMVSLFHTVIFPLMNPMIYTLRNQEVKTSMKRLLSRHVVCQVDFIIRN

SEQ ID NO: 880424 - protein, 112 aa, Homo sapiens
AAVLLFSFSSSSPGLTSPTKYNLLELKESCIRNQDCETGCCQRAPDNCESHCAEKGSEGSLCQTQVFFGQYRACPCLRNLTCIYSKNEKWLSIAYGRCQKIGRQKLAKKMFF

SEQ ID NO: 880425 - protein, 80 aa, Homo sapiens
AAVLLFSFSSSSPGLTSPTKYNLLELKESCIRNQDCETGCCQRAPDNCESHCAEKGSEGSLCQTQLPATPCFLPSNTVRT

SEQ ID NO: 880426 - protein, 102 aa, Homo sapiens
TGMVLDREPRCPWGLTNSPWDRRGFLDGMTWSRALRKAWSSSGLGREGADGRQGLQSLATTISTFVLPGPGAGLHPQPPLVHPGLQRRHRGEPAAGHRLAPG

SEQ ID NO: 880427 - protein, 108 aa, Homo sapiens
MASLGSGQRRPQAHAGLPAGLQSLLVDERLDRATLLIFANKQDLPGALSSNAIREVLELDSIRSRPNYNSPSSTPCLLCYCSAVTGENLLPGIDWLLDDISSRIFTAD

SEQ ID NO: 880428 - protein, 115 aa, Homo sapiens
WSRGRNYDGGFECVARTACPGGPHPGPRLPRVSVGGCHPAPPQPSRAAPAFSLAYILGLRTFSKINSVEISSVWTQCDESLFLRQRFAALLVPFCPLWFSFHSVLEKISITSFCL

SEQ ID NO: 880429 - protein, 128 aa, Homo sapiens
RLWSPSSKGTQGATPPVQAKSTSPGPLGRQHLPSSRTGRTLLGQPCTSPPRQPCTSPPRQPCTSPPRQPCTSPSRQPCSQPSKSLLEGVTHLDTCTQNPIKVLVRLRKRLSPGRGQASSAHQPQERPM

SEQ ID NO: 880430 - protein, 71 aa, Homo sapiens
PLFLGIGRIQFPPEPFDRFRFYPTPIEICPWAKNFARGVQRDFGRTLSHDKGKLKCPLEFHVWALWACLIV

SEQ ID NO: 880431 - protein, 381 aa, Homo sapiens
MKQQQWCGMTAKMGTVLSGVFTIMAVDMYLIFEQKHLGNGSCTEITPKYRGASNIINNFIICWSFKIVLFLSFITILISCFLLYSVYAQIFRGLVIYIVWIFFYETANVVIQILTNNDFDIKEVRIMRWFGLVSRTVMHCFWMFFVINYAHITYKNRSQGNIISYKRRISTAEILHSRNKRLSISSGFSGSHLESQYFERQRRCSGENKYKMNVRMFSLMVGIFSVLNTTQFFIFDLNQKTHICYEAKFSIYVDSKSELVTWTLFHRANISTGLSLTTIIIGCFLLYCIHKNIYMGLLIYAMWIITYELINFSIVLLLNGIIKDHFKTLSYLHWIFQISHMLLHFFCLPFIVKHAYNLYKESQTVGRKRRHRLCSTIAVNL

SEQ ID NO: 880432 - protein, 170 aa, Homo sapiens [sequence omitted]

SEQ ID NO: 880433 - protein, 170 aa, Homo sapiens [sequence omitted]

SEQ ID NO: 880434 - protein, 88 aa, Homo sapiens
SREVAKPDGIQGKETDSASDGCNSMHIQGGKELAVVIFLDHLPQWLKLTPRKEGRVFSFFDCCSRCQTLKGELTLKTEWLFFPEEEKD

SEQ ID NO: 880435 - protein, 129 aa, Homo sapiens
VSEQWFLLNPFQDGEAPPTGLTGLGAARLFCPRASSLAASSWSSNGRYTSLRALNPSGGNPGLGLVYPAWHILADICDWKKASVLVVCCQETPSAGWHCDSTNGNHPFSFLHFAFLSFLLLPTKQNKHT

SEQ ID NO: 880436 - protein, 244 aa, Homo sapiens
GKAFTQNSQLTLHQRLHTGEKLYECKECRKVFTQLSQLILHKRIHTGEKPYECKECGKAFICGSQLSQHQKIHNGEKPYECKECGRAFIRGSLLMQHQRIHTGEKPYKCEECGKAFIRGSQLTQHQRIHTNEKPYECKECGKMFSHGSQLTQHQRIHTGEKPYQCKECGKAFNRGSLLTRHQRIHTGEKPYECKECGKTFIVAQNLLNMSEFTQLELRYSHGDFENGIWVLWIMEQKYRRSLQP

SEQ ID NO: 880437 - protein, 68 aa, Homo sapiens
MFLLLFSSSLSYFPVFLQLVVFQKCLQRDCCSSNHQAVPKMKLLYMYQTKWYSGNVFHYQLSFSLLNF

SEQ ID NO: 880438 - protein, 78 aa, Homo sapiens
CSRDCVERWKAGHREELQMVPPLTTAGSVALEEYVPFPSLGVSRIQQGAQARTFRHFYQKSSTAEEGKNTEVREHGMN

SEQ ID NO: 880439 - protein, 235 aa, Homo sapiens
MALKAEGAALDCFEVTLKCEEGEDEEEAMVVAVIPRPEPMLRVTQQEKTPPPRPSPLEAGSDGCEEPKQQVSWEQEFLVGSSPGGSGRALCMVCGAEIRAPSADTARSHILEQHPHTLDLSPSEKSNILEAWSEGVALLQDVRAEQPSPPNSDSGQDAHPDPDANPDAARMPAEIVVLLDSEDNPSLPKRSRPRGLRPLELPAVPATEPGNKKPRGQRWKEPQGKSQSERKEADL

SEQ ID NO: 880440 - protein, 164 aa, Homo sapiens
MALKAEGAALDCFEVTLKCEEGEDEEEAMVVAVIPRPEPMLRVTQQEKTPPPRPSPLEAGSDGCEEPKQQVSWEQEFLVGSSPGGSGRALCMVCGAEIRAPSADTARSHILEQHPHTLDLSPSEKRPPLPLPVPTLQRPEAGPGHPIHSRSHLHLFSCCIYHLC

SEQ ID NO: 880441 - protein, 601 aa, Homo sapiens
NSGPKVPGLAHSVTVTATMPGRTWELCLLLLLGLGLGSQEALPPPCESEIYCHGELLNQVQMAKLYQDDKQFVDMPLSIAPEQVLQTFTELSRDHNHSIPREQLQAFVHEHFQAKGQELQPWTPADWKDSPQFLQKISDAKLRAWAGQLHQLWKKLGKKMKPEVLSHPERFSLIYSEHPFIVPGGRFVEFYYWDSYWVMEGLLLSEMAETVKGMLQNFLDLVKTYGHVPNGGRVYYLQRSQPPLLTLMMDCYLTHTNDTAFLQENIETLALELDFWTKNRTVSVSLEGKNYLLNRYYVPYGGPRPESYSKDVELADTLPEGDREALWAELKAGAESGWDFSSRWLIGGPNPNSLSGIRTSKLVPVDLNAFLCQAEELMSNFYSRLGNDSQATKYRILRSQRLAALNTVLWDEQTGAWFDYDLEKKKKNREFYPSNLTPLWAGCFSDPGVADKALKYLEDNRILTYQYGIPTSLQKTGQQWDFPNAWAPLQDLVIRGLAKAPLRRAQEVAFQLAQNWIRTNFDVYSQKSAMYEKYDVSNGGQPGGGGEYEVQEGFGWTNGVVLMLLDRYGDRLTSGAKLAFLEPHCLAATLLPSLLLSLLPW

SEQ ID NO: 880442 - protein, 685 aa, Homo sapiens
NSGPKVPGLAHSVTVTATMPGRTWELCLLLLLGLGLGSQEALPPPCESEIYCHGELLNQVQMAKLYQDDKQFVDMPLSIAPGEAPRAERPLQRTFSPKKAGARPSREAPVIRELACDTLLTPPAACSPEQVLQTFTELSRDHNHSIPREQLQAFVHEHFQAKGQELQPWTPADWKDSPQFLQKISDAKLRAWAGQLHQLWKKLGKKMKPEVLSHPERFSLIYSEHPFIVPGGRFVEFYYWDSYWVMEGLLLSEMAETVKGMLQNFLDLVKTYGHVPNGGRVYYLQRSQPPLLTLMMDCYLTHTNDTAFLQWVPPSLCCSADPPIPQTSQGWEMGSTPGLRCCLLHSRENIETLALELDFWTKNRTVSVSLEGKNYLLNRYYVPYGGPRPESYSKDVELADTLPEGDREALWAELKAGAESGWDFSSRWLIGGPNPNSLSGIRTSKLVPVDLNAFLCQAEELMSNFYSRLGNDSQATKYRILRSQRLAALNTVLWDEQTGAWFDYDLEKKKKNREFYPSNLTPLWAGCFSDPGVADKALKYLEDNRILTYQYGIPTSLQKTGQQWDFPNAWAPLQDLVIRGLAKAPLRRAQEVAFQLAQNWIRTNFDVYSQKSAMYEKYDVSNGGQPGGGGEYEVQEGFGWTNGVVLMLLDRYGDRLTSGAKLAFLEPHCLAATLLPSLLLSLLPW

SEQ ID NO: 880443 - protein, 105 aa, Homo sapiens
NSGPKVPGLAHSVTVTATMPGRTWELCLLLLLGLGLGSQEALPPPCESEIYCHGELLNQVQMAKLYQDDKQFVDMPLSIAPGEAPRAERPLQRTFSPKKAGGKTK

SEQ ID NO: 880444 - protein, 671 aa, Homo sapiens
DKDNSGPTVLHLTARFGHPKVVNWLLHHGGGDPTAATDMGALPIHYAAAKGDFPSLRLLVRHYPEGVNAQTKNGATPLYLACQEGHLEVTQYLVQECGADPHARAHDGMTPLHAAAQMGHSPVIVWLVSCTDVSLSEQDKDGATATHFAASRGHSKVLSWLLLHGGEISADLWGGTALYDAAENGELECCQILVVNGAELEVRDRDGYAAADLSDFNGHSHCTHCLRTVENLSMEHCVLSRDPSVELEAKQPDSGMSSPNTTVSVQPLNFDLSSPTSTLSNYDSCSSSHSSIKGQHPPRGLSSTRAADIQSYMDMLNPELGLPWGTIGKPIPPPPPPSFPPPPPPPGTQLPPPPPSYPSPKPPVGPQAADIYMQTKNKLRHVETEALKKEPSSCDGHDGLRRQDSSRKPRAFSKQPSTGDYYRQLGRCPGETLVARPGMAHREEAELPGNHVPNGCAADPKASREQQLPPPPPPPPLPEAASSPPPVPPLPLEGAGPGCGQRRSSSPTGSTKSFNVMFPMGDNSELLAEIKAGKSLKPTPQSKGLTTVFSGSRQPAFQPDWPLPSVSPALLPVRSPTPPAAGFQPLLNGSLVPVPPTTPAPGVQLDVEALIPTHDEQGRPKPEWKRQVMVGKMQLKMEEEEEQRWKEEEEARLASMPAWRWDLLRKKLEEE

SEQ ID NO: 880445 - protein, 286 aa, Homo sapiens
DKDNSGPTVLHLTARFGHPKVVNWLLHHGGGDPTAATDMGALPIHYAAAKGDFPSLRLLVRHYPEGVNAQTKNGATPLYLACQEGHLEVTQYLVQECGADPHARAHDGMTPLHAAAQMGHSPVIVWLVSCTDVSLSEQDKDGATATHFAASRGHSKVLSWLLLHGGEISADLWGGTALYDAAENGELECCQILVVNGAELEVRDRDGYAAADLSDFNGHSHCTHCLRTVENLVRSLRCSCCILSSRPSTPVVGVVTPFTKEEAEVQRREARYPTRPVSPEPLPAGD

SEQ ID NO: 880446 - protein, 453 aa, Homo sapiens
DKDNSGPTVLHLTARFGHPKVVNWLLHHGGGDPTAATDMGALPIHYAAAKGDFPSLRLLVRHYPEGVNAQTKNGATPLYLACQEGHLEVTQYLVQECGADPHARAHDGMTPLHAAAQMGHSPVIVWLVSCTDVSLSEQDKDGATATHFAASRGHSKVLSWLLLHGGEISADLWGGTALYDAAENGELECCQILVVNGAELEVRDRDGYAAADLSDFNGHSHCTHCLRTVENLSMEHCVLSRDPSVELEAKQPDSGMSSPNTTVSVQPLNFDLSSPTSTLSNYDSCSSSHSSIKGQHPPRGLSSTRAADIQSYMDMLNPELGLPWGTIGKPIPPPPPPSFPPPPPPPGTQLPPPPPSYPSPKPPVGPQAADIYMQTKNKLRHVETEALKKEVVSPHPLPASQQGYWADGGQSGQRPGLTSGHRVGVPGSMAYSRVKAPGESHEGSGLDTGLGGE

SEQ ID NO: 880447 - protein, 79 aa, Homo sapiens
RVLRCVRVPRRGFSPPVTMGPLYRAGLVGLRLAHTHPWELLVWKAGLLLRDEPEPCQAPQGIEALAHLIRMVIGHLDLS

SEQ ID NO: 880448 - protein, 79 aa, Homo sapiens; identical to SEQ ID NO: 880447

SEQ ID NO: 880449 - protein, 68 aa, Homo sapiens
VAAVTERTSGNLSASSVKCDHKYRVPGSARDRSHYVDRAGLKLLASSSPPAATSQQHWNDRRTPLNIH

SEQ ID NO: 880450 - protein, 35 aa, Homo sapiens
MTHEPQATVLPSSQVRYQPFGLEILYPSLGLADFL

SEQ ID NO: 880451 - protein, 35 aa, Homo sapiens; identical to SEQ ID NO: 880450

SEQ ID NO: 880452 - protein, 53 aa, Homo sapiens
MTHEPQATVLPSSQVRYQPFGLEILYPSLGLADFLLQPLCLCTHIHTCTHAHA

SEQ ID NO: 880453 - protein, 1692 aa, Homo sapiens
FIRIHFGPSGKLASADIDSYLLEKSRVIFQLPGERSYHVYYQILSGRKPELQDMLLLSMNPYDYHFCSQGVITVDNMNDGEELIATDHAMDILGFSVDEKCACYKIVGALLHFGNMKFKQKQREEQAEADGTESADKAAYLMGVSSGDLLKGLLHPRVRVGNEYVTKGQSVEQVVFAVGALAKATYDRLFRWLVSRINQTLDTKLPRQFFIGVLDIAGFEIFEFNSFEQLCINFTNEKLQQFFNQHMFVLEQEEYKREGIDWVFIDFGLDLQPCIDLIEKPLGILSILEEECMFPKASDASFRAKLYDNHAGKSPNFQQPRPDKKRKYQAHFEVVHYAGVVPYSIVGWLEKNKDPLNETVVPIFQKSQNRLLATLYENYAGSCSTEPPKSGVKEKRKKAASFQTVSQLHKENLNKLMTNLRATQPHFVRCIVPNENKTPGVMDAFLVLHQLRCNGVLEGIRICRQGFPNRLLYTDFRQRYRILNPSAIPDDTFMDSRKATEKLLGSLDLDHTQYQFGHTKVFFKAGLLGVLEELRDQRLAKVLTLLQARSRGRLMRLEYQRLLGGRDALFTIQWNIRAFNAVKNWSWMKLFFKMKPLLRSAQAEEELAALRAELRGLRGALAAAEAKRQELEETHVSITQEKNDLALQLQAEQDNLADAEERCHLLIKSKVQLEGKVKELSERLEDEEEVNADLAARRRKLEDECTELKKDIDDLELTLAKAEKEKQATENKVKNLTEEMAALDESVARLTKEKKALQEAHQQALGDLQAEEDRVSALTKAKLRLEQQVEDLECSLEQEKKLRMDTERAKRKLEGDLKLTQESVADAAQDKQQLEEKLKKKDSELSQLSLRVEDEQLLGAQMQKKIKELQARAEELEEELEAERAARARVEKQRAEAARELEELSERLEEAGGASAGQREGCRKREAELGRLRRELEEAALRHEATVAALRRKQAEGAAELGEQVDSLQRVRQKLEKEKSELRMEVDDLAANVETLTRAKASAEKLCRTYEDQLSEAKIKVEELQRQLADASTQRGRLQTESGELSRLLEEKECLISQLSRGKALAAQSLEELRRQLEEESKAKSALAHAVQALRHDCDLLREQHEEEAEAQAELQRLLSKANAEVAQWRSKYEADAIQRTEELEEAKKKLALRLQEAEEGVEAANAKCSSLEKAKLRLQTESEDVTLELERATSAAAALDKKQRHLERALEERRRQEEEMQRELEAAQRESRGLGTELFRLRHGHEEALEALETLKRENKNLQEEISDLTDQVSLSGKSIQELEKTKKALEGEKSEIQAALEEAEGALELEETKTLRIQLELSQVKAEVDRKLAEKDEECANLRRNHQRAVESLQASLDAETRARNEALRLKKKMEGDLNDLELQLGHATRQATEAQAATRLMQAQLKEEQAGRDEEQRLAAELHEQAQALERRASLLAAELEELRAALEQGERSRRLAEQELLEATERLNLLHSQNTGLLNQKKKLEADLAQLSGEVEEAAQERREAEEKAKKAITDAAMMAEELKKEQDTSAHLERMKKTLEQTVRELQARLEEAEQAALRGGKKQVQKLEAKVRELEAELDAEQKKHAEALKGVRKHERRVKELAYQAEEDRKNLARMQDLVDKLQSKVKSYKRQFEEAEQQANTNLAKYRKAQHELDDAEERADMAETQANKLRARTRDALGPKHKE

SEQ ID NO: 880454 - protein, 135 aa, Homo sapiens
FFLFVFFFLRILYIVVGDSVRELEAELDAEQKKHAEALKGVRKHERRVKELAYQAEEDRKNLARMQDLVDKLQSKVKSYKRQFEEAEQQANTNLAKYRKAQHELDDAEERADMAETQANKLRARTRDALGPKHKE

SEQ ID NO: 880455 - protein, 126 aa, Homo sapiens
KKISVRELEAELDAEQKKHAEALKGVRKHERRVKELAYQAEEDRKNLARMQDLVDKLQSKVKSYKRQFEEAEQQANTNLAKYRKAQHELDDAEERADMAETQANKLRARTRDALGPKLSLSPQHKE

SEQ ID NO: 880456 - protein, 133 aa, Homo sapiens
VARAYIDRHLVATPIFLVRELEAELDAEQKKHAEALKGVRKHERRVKELAYQAEEDRKNLARMQDLVDKLQSKVKSYKRQFEEAEQQANTNLAKYRKAQHELDDAEERADMAETQANKLRARTRDALGPKHKE

SEQ ID NO: 880457 - protein, 133 aa, Homo sapiens
TPPEPVGDSHTTTHQNLVRELEAELDAEQKKHAEALKGVRKHERRVKELAYQAEEDRKNLARMQDLVDKLQSKVKSYKRQFEEAEQQANTNLAKYRKAQHELDDAEERADMAETQANKLRARTRDALGPKHKE

SEQ ID NO: 880458 - protein, 1692 aa, Homo sapiens; identical to SEQ ID NO: 880453

SEQ ID NO: 880459 - protein, 1719 aa, Homo sapiens
FIRIHFGPSGKLASADIDSYLLEKSRVIFQLPGERSYHVYYQILSGRKPELQDMLLLSMNPYDYHFCSQGVITVDNMNDGEELIATDHAMDILGFSVDEKCACYKIVGALLHFGNMKFKQKQREEQAEADGTESADKAAYLMGVSSGDLLKGLLHPRVRVGNEYVTKGQSVEQVVFAVGALAKATYDRLFRWLVSRINQTLDTKLPRQFFIGVLDIAGFEIFEFNSFEQLCINFTNEKLQQFFNQHMFVLEQEEYKREGIDWVFIDFGLDLQPCIDLIEKPLGILSILEEECMFPKASDASFRAKLYDNHAGKSPNFQQPRPDKKRKYQAHFEVVHYAGVVPYSIVGWLEKNKDPLNETVVPIFQKSQNRLLATLYENYAGSCSTEPPKSGVKEKRKKAASFQTVSQLHKENLNKLMTNLRATQPHFVRCIVPNENKTPGVMDAFLVLHQLRCNGVLEGIRICRQGFPNRLLYTDFRQRYRILNPSAIPDDTFMDSRKATEKLLGSLDLDHTQYQFGHTKVFFKAGLLGVLEELRDQRLAKVLTLLQARSRGRLMRLEYQRLLGGRDALFTIQWNIRAFNAVKNWSWMKLFFKMKPLLRSAQAEEELAALRAELRGLRGALAAAEAKRQELEETHVSITQEKNDLALQLQAEQDNLADAEERCHLLIKSKVQLEGKVKELSERLEDEEEVNADLAARRRKLEDECTELKKDIDDLELTLAKAEKEKQATENKVKNLTEEMAALDESVARLTKEKKALQEAHQQALGDLQAEEDRVSALTKAKLRLEQQVEDLECSLEQEKKLRMDTERAKRKLEGDLKLTQESVADAAQDKQQLEEKLKKKDSELSQLSLRVEDEQLLGAQMQKKIKELQARAEELEEELEAERAARARVEKQRAEAARELEELSERLEEAGGASAGQREGCRKREAELGRLRRELEEAALRHEATVAALRRKQAEGAAELGEQVDSLQRVRQKLEKEKSELRMEVDDLAANVETLTRAKASAEKLCRTYEDQLSEAKIKVEELQRQLADASTQRGRLQTESGELSRLLEEKECLISQLSRGKALAAQSLEELRRQLEEESKAKSALAHAVQALRHDCDLLREQHEEEAEAQAELQRLLSKANAEVAQWRSKYEADAIQRTEELEEAKKKLALRLQEAEEGVEAANAKCSSLEKAKLRLQTESEDVTLELERATSAAAALDKKQRHLERALEERRRQEEEMQRELEAAQRESRGLGTELFRLRHGHEEALEALETLKRENKNLQEEISDLTDQVSLSGKSIQELEKTKKALEGEKSEIQAALEEAEGALELEETKTLRIQLELSQVKAEVDRKLAEKDEECANLRRNHQRAVESLQASLDAETRARNEALRLKKKMEGDLNDLELQLGHATRQATEAQAATRLMQAQLKEEQAGRDEEQRLAAELHEQAQALERRASLLAAELEELRAALEQGERSRRLAEQELLEATERLNLLHSQNTGLLNQKKKLEADLAQLSGEVEEAAQERREAEEKAKKAITDAAMMAEELKKEQDTSAHLERMKKTLEQTVRELQARLEEAEQAALRGGKKQVQKLEAKVRELEAELDAEQKKHAEALKGVRKHERRVKELAYQVGDRVSLGSGPGAGPAQASPESPLPAQAEEDRKNLARMQDLVDKLQSKVKSYKRQFEEAEQQANTNLAKYRKAQHELDDAEERADMAETQANKLRARTRDALGPKHKE

SEQ ID NO: 880460 - protein, 194 aa, Homo sapiens
MRGLHSVAVAHLTHTALCMCPLRSGQAGSPGSFALNFPPNGLGIRLSPCLQVRELEAELDAEQKKHAEALKGVRKHERRVKELAYQVGDRVSLGSGPGAGPAQASPESPLPAQAEEDRKNLARMQDLVDKLQSKVKSYKRQFEEAEQQANTNLAKYRKAQHELDDAEERADMAETQANKLRARTRDALGPKHKE

SEQ ID NO: 880461 - protein, 1692 aa, Homo sapiens; identical to SEQ ID NO: 880453

SEQ ID NO: 880462 - protein, 1698 aa, Homo sapiens
FIRIHFGPSGKLASADIDSYLLEKSRVIFQLPGERSYHVYYQILSGRKPELQDMLLLSMNPYDYHFCSQGVITVDNMNDGEELIATDHAMDILGFSVDEKCACYKIVGALLHFGNMKFKQKQREEQAEADGTESADKAAYLMGVSSGDLLKGLLHPRVRVGNEYVTKGQSVEQVVFAVGALAKATYDRLFRWLVSRINQTLDTKLPRQFFIGVLDIAGFEIFEFNSFEQLCINFTNEKLQQFFNQHMFVLEQEEYKREGIDWVFIDFGLDLQPCIDLIEKPLGILSILEEECMFPKASDASFRAKLYDNHAGKSPNFQQPRPDKKRKYQAHFEVVHYAGVVPYSIVGWLEKNKDPLNETVVPIFQKSQNRLLATLYENYAGSCSTEPPKSGVKEKRKKAASFQTVSQLHKENLNKLMTNLRATQPHFVRCIVPNENKTPGVMDAFLVLHQLRCNGVLEGIRICRQGFPNRLLYTDFRQRYRILNPSAIPDDTFMDSRKATEKLLGSLDLDHTQYQFGHTKVFFKAGLLGVLEELRDQRLAKVLTLLQARSRGRLMRLEYQRLLGGRDALFTIQWNIRAFNAVKNWSWMKLFFKMKPLLRSAQAEEELAALRAELRGLRGALAAAEAKRQELEETHVSITQEKNDLALQLQAEQDNLADAEERCHLLIKSKVQLEGKVKELSERLEDEEEVNADLAARRRKLEDECTELKKDIDDLELTLAKAEKEKQATENKVKNLTEEMAALDESVARLTKEKKALQEAHQQALGDLQAEEDRVSALTKAKLRLEQQVEDLECSLEQEKKLRMDTERAKRKLEGDLKLTQESVADAAQDKQQLEEKLKKKDSELSQLSLRVEDEQLLGAQMQKKIKELQARAEELEEELEAERAARARVEKQRAEAARELEELSERLEEAGGASAGQREGCRKREAELGRLRRELEEAALRHEATVAALRRKQAEGAAELGEQVDSLQRVRQKLEKEKSELRMEVDDLAANVETLTRAKASAEKLCRTYEDQLSEAKIKVEELQRQLADASTQRGRLQTESGELSRLLEEKECLISQLSRGKALAAQSLEELRRQLEEESKAKSALAHAVQALRHDCDLLREQHEEEAEAQAELQRLLSKANAEVAQWRSKYEADAIQRTEELEEAKKKLALRLQEAEEGVEAANAKCSSLEKAKLRLQTESEDVTLELERATSAAAALDKKQRHLERALEERRRQEEEMQRELEAAQRESRGLGTELFRLRHGHEEALEALETLKRENKNLQEEISDLTDQVSLSGKSIQELEKTKKALEGEKSEIQAALEEAEGALELEETKTLRIQLELSQVKAEVDRKLAEKDEECANLRRNHQRAVESLQASLDAETRARNEALRLKKKMEGDLNDLELQLGHATRQATEAQAATRLMQAQLKEEQAGRDEEQRLAAELHEQAQALERRASLLAAELEELRAALEQGERSRRLAEQELLEATERLNLLHSQNTGLLNQKKKLEADLAQLSGEVEEAAQERREAEEKAKKAITDAAMMAEELKKEQDTSAHLERMKKTLEQTVRELQARLEEAEQAALRGGKKQVQKLEAKVRELEAELDAEQKKHAEALKGVRKHERRVKELAYQAEEDRKNLARMQDLVDKLQSKVKSYKRQFEEAEQQANTNLAKYRKAQHELDDAEERADMAETQANKLRARTRDALGPKLSLSPQHKE

SEQ ID NO: 880463 - protein, 1692 aa, Homo sapiens; identical to SEQ ID NO: 880453

SEQ ID NO: 880464 - protein, 1698 aa, Homo sapiens; identical to SEQ ID NO: 880462

SEQ ID NO: 880465 - protein, 1725 aa, Homo sapiens
FIRIHFGPSGKLASADIDSYLLEKSRVIFQLPGERSYHVYYQILSGRKPELQDMLLLSMNPYDYHFCSQGVITVDNMNDGEELIATDHAMDILGFSVDEKCACYKIVGALLHFGNMKFKQKQREEQAEADGTESADKAAYLMGVSSGDLLKGLLHPRVRVGNEYVTKGQSVEQVVFAVGALAKATYDRLFRWLVSRINQTLDTKLPRQFFIGVLDIAGFEIFEFNSFEQLCINFTNEKLQQFFNQHMFVLEQEEYKREGIDWVFIDFGLDLQPCIDLIEKPLGILSILEEECMFPKASDASFRAKLYDNHAGKSPNFQQPRPDKKRKYQAHFEVVHYAGVVPYSIVGWLEKNKDPLNETVVPIFQKSQNRLLATLYENYAGSCSTEPPKSGVKEKRKKAASFQTVSQLHKENLNKLMTNLRATQPHFVRCIVPNENKTPGVMDAFLVLHQLRCNGVLEGIRICRQGFPNRLLYTDFRQRYRILNPSAIPDDTFMDSRKATEKLLGSLDLDHTQYQFGHTKVFFKAGLLGVLEELRDQRLAKVLTLLQARSRGRLMRLEYQRLLGGRDALFTIQWNIRAFNAVKNWSWMKLFFKMKPLLRSAQAEEELAALRAELRGLRGALAAAEAKRQELEETHVSITQEKNDLALQLQAEQDNLADAEERCHLLIKSKVQLEGKVKELSERLEDEEEVNADLAARRRKLEDECTELKKDIDDLELTLAKAEKEKQATENKVKNLTEEMAALDESVARLTKEKKALQEAHQQALGDLQAEEDRVSALTKAKLRLEQQVEDLECSLEQEKKLRMDTERAKRKLEGDLKLTQESVADAAQDKQQLEEKLKKKDSELSQLSLRVEDEQLLGAQMQKKIKELQARAEELEEELEAERAARARVEKQRAEAARELEELSERLEEAGGASAGQREGCRKREAELGRLRRELEEAALRHEATVAALRRKQAEGAAELGEQVDSLQRVRQKLEKEKSELRMEVDDLAANVETLTRAKASAEKLCRTYEDQLSEAKIKVEELQRQLADASTQRGRLQTESGELSRLLEEKECLISQLSRGKALAAQSLEELRRQLEEESKAKSALAHAVQALRHDCDLLREQHEEEAEAQAELQRLLSKANAEVAQWRSKYEADAIQRTEELEEAKKKLALRLQEAEEGVEAANAKCSSLEKAKLRLQTESEDVTLELERATSAAAALDKKQRHLERALEERRRQEEEMQRELEAAQRESRGLGTELFRLRHGHEEALEALETLKRENKNLQEEISDLTDQVSLSGKSIQELEKTKKALEGEKSEIQAALEEAEGALELEETKTLRIQLELSQVKAEVDRKLAEKDEECANLRRNHQRAVESLQASLDAETRARNEALRLKKKMEGDLNDLELQLGHATRQATEAQAATRLMQAQLKEEQAGRDEEQRLAAELHEQAQALERRASLLAAELEELRAALEQGERSRRLAEQELLEATERLNLLHSQNTGLLNQKKKLEADLAQLSGEVEEAAQERREAEEKAKKAITDAAMMAEELKKEQDTSAHLERMKKTLEQTVRELQARLEEAEQAALRGGKKQVQKLEAKVRELEAELDAEQKKHAEALKGVRKHERRVKELAYQAEEDRKNLARMQDLVDKLQSKVKSYKRQFEEAEQQANTNLAKYRKAQHELDDAEERADMAETQANKLRARTRDALGPKVRSGRGIALCAGGLWGLTGSTAHSAIPFSSAQGVTA

SEQ ID NO: 880466 - protein, 1720 aa, Homo sapiens
FIRIHFGPSGKLASADIDSYLLEKSRVIFQLPGERSYHVYYQILSGRKPELQDMLLLSMNPYDYHFCSQGVITVDNMNDGEELIATDHAMDILGFSVDEKCACYKIVGALLHFGNMKFKQKQREEQAEADGTESADKAAYLMGVSSGDLLKGLLHPRVRVGNEYVTKGQSVEQVVFAVGALAKATYDRLFRWLVSRINQTLDTKLPRQFFIGVLDIAGFEIFEFNSFEQLCINFTNEKLQQFFNQHMFVLEQEEYKREGIDWVFIDFGLDLQPCIDLIEKPLGILSILEEECMFPKASDASFRAKLYDNHAGKSPNFQQPRPDKKRKYQAHFEVVHYAGVVPYSIVGWLEKNKDPLNETVVPIFQKSQNRLLATLYENYAGSCSTEPPKSGVKEKRKKAASFQTVSQLHKENLNKLMTNLRATQPHFVRCIVPNENKTPGVMDAFLVLHQLRCNGVLEGIRICRQGFPNRLLYTDFRQRYRILNPSAIPDDTFMDSRKATEKLLGSLDLDHTQYQFGHTKVFFKAGLLGVLEELRDQRLAKVLTLLQARSRGRLMRLEYQRLLGGRDALFTIQWNIRAFNAVKNWSWMKLFFKMKPLLRSAQAEEELAALRAELRGLRGALAAAEAKRQELEETHVSITQEKNDLALQLQAEQDNLADAEERCHLLIKSKVQLEGKVKELSERLEDEEEVNADLAARRRKLEDECTELKKDIDDLELTLAKAEKEKQATENKVKNLTEEMAALDESVARLTKEKKALQEAHQQALGDLQAEEDRVSALTKAKLRLEQQVEDLECSLEQEKKLRMDTERAKRKLEGDLKLTQESVADAAQDKQQLEEKLKKKDSELSQLSLRVEDEQLLGAQMQKKIKELQARAEELEEELEAERAARARVEKQRAEAARELEELSERLEEAGGASAGQREGCRKREAELGRLRRELEEAALRHEATVAALRRKQAEGAAELGEQVDSLQRVRQKLEKEKSELRMEVDDLAANVETLTRAKASAEKLCRTYEDQLSEAKIKVEELQRQLADASTQRGRLQTESGELSRLLEEKECLISQLSRGKALAAQSLEELRRQLEEESKAKSALAHAVQALRHDCDLLREQHEEEAEAQAELQRLLSKANAEVAQWRSKYEADAIQRTEELEEAKKKLALRLQEAEEGVEAANAKCSSLEKAKLRLQTESEDVTLELERATSAAAALDKKQRHLERALEERRRQEEEMQRELEAAQRESRGLGTELFRLRHGHEEALEALETLKRENKNLQEEISDLTDQVSLSGKSIQELEKTKKALEGEKSEIQAALEEAEGALELEETKTLRIQLELSQVKAEVDRKLAEKDEECANLRRNHQRAVESLQASLDAETRARNEALRLKKKMEGDLNDLELQLGHATRQATEAQAATRLMQAQLKEEQAGRDEEQRLAAELHEQAQALERRASLLAAELEELRAALEQGERSRRLAEQELLEATERLNLLHSQNTGLLNQKKKLEADLAQLSGEVEEAAQERREAEEKAKKAITDAAMMAEELKKEQDTSAHLERMKKTLEQTVRELQARLEEAEQAALRGGKKQVQKLEAKVRELEAELDAEQKKHAEALKGVRKHERRVKELAYQAEEDRKNLARMQDLVDKLQSKVKSYKRQFEEAVSALGPGHLDRAPQLCPRVCGQEQQANTNLAKYRKAQHELDDAEERADMAETQANKLRARTRDALGPKLSLSPQHKE

SEQ ID NO: 880467 - protein, 327 aa, Homo sapiens
FIRIHFGPSGKLASADIDSYLLEKSRVIFQLPGERSYHVYYQILSGRKPELQDMLLLSMNPYDYHFCSQGVITVDNMNDGEELIATDHAMDILGFSVDEKCACYKIVGALLHFGNMKFKQKQREEQAEADGTESADKAAYLMGVSSGDLLKGLLHPRVRVGNEYVTKGQSVEQVVFAVGALAKATYDRLFRWLVSRINQTLDTKLPRQFFIGVLDIAGFEIFEFNSFEQLCINFTNEKLQQFFNQHMFVLEQEEYKREGIDWVFIDFGLDLQPCIDLIEKPRMLKITTVFSHAQTVVLCVGCSTVLCQPTGGKARLTEGCSFRRKQH

SEQ ID NO: 880468 - protein, 154 aa, Homo sapiens [sequence omitted]

SEQ ID NO: 880469 - protein, 502 aa, Homo sapiens
PGVGWAETLSPNCQKEPEAEVEAGSLGLWVDPLKAMESSTGPRMPLLKYCSVATSLKAPGWDGAAPPWDLSFTYPFALQAPWLTGHKPLARHASSCPCLHVADPAWQGPGWLGRAGDAANTWVLARREADGFYYRAQIKATPELERQGVLLVEFEAPLVAGPKLPAQQQRVVLEEDVIPLSPSVGYSLRPGDKVLALWEPGQQQYGPGTVLLGLEMRDPQRASKEKEITVHFWNGKAAKVPLGGVQSVSLTIWKKAVERLHKSFTREHPRPLHWAPCCSLLGPITGRITNELPPDAPFLCPLCHHHACCQLLCQGCLCGCPPCGTTWWPLTRTSEVMARELPELEPTAQLLPLEGPKEEKVAMHAPLAVSSSSSSSCEQDGVENDLEMGPPQRLMVNSAVNTDPIFLEMPLRQSGLCQPEWRYWKRNGPEPCPGKPGTRYSNICKEEKDHKQQRAQTVVVGTTKELVSKATHMKPPRTPPGEAEHRKRSQSLAICQWNKNSR

SEQ ID NO: 880470 - protein, 74 aa, Homo sapiens
LWVPSLGRAFALGSPVLDPAPPRGPGLFSALSVLAAMVPSLAPPGDTRTTVHVSTPWHLPRMIGEDEGPEVQEH

SEQ ID NO: 880471 - protein, 102 aa, Homo sapiens
FLNWRSSPRRLCLHLGCEVCSGGAWLWPAFHSFMSFIYLFEMESCCVAQAGVQWHDLGSLQPPPTQIQGVYTNRGEATSHQHAEENNNNNKNRPQGIRRRTV

SEQ ID NO: 880472 - protein, 646 aa, Homo sapiens
AQRGLCCEGLCCARGGPAPGKPRGECALTEPSWQGRVSGAADPCPSGRSTAASQLGLSQHSPCWRAHPRVLSTPVLSALTCRGEPVLVPGVCVAPGCPSAPLALLWASVEPCHRGSVQGPDVALRRGQLPGLLPAQWALVSALGQARQPPMMSSAAFPRWLSMGVPRTPSRTVLFERERTGLTYRVPSLLPVPPGPTLLAFVEQRLSPDDSHAHRLVLRRGTLAGGSVRWGALHVLGTAALAEHRSMNPCPVHDAGTGTVFLFFIAVLGHTPEAVQIATGRNAARLCCVASRDAGLSWGSARDLTEEAIGGAVQDWATFAVGPGHGVQLPSGRLLVPAYTYRVDRRECFGKICRTSPHSFAFYSDDHGRTWRCGGLVPNLRSGECQLAAVDGGQAGSFLYCNARSPLGSRVQALSTDEGTSFLPAERVASLPETAWGCQGSIVGFPAPAPNRPRDDSWSVGPGSPLQPPLLGPGVHEPPEEAAVDPRGGQVPGGPFSRLQPRGDGPRQPGPRPGVSGDVGSWTLALPMPFAAPPQSPTWLLYSHPVGRRARLHMGIRLSQSPLDPRSWTEPWVIYEGPSGYSDLASIGPAPEGGLVFACLYESGARTSYDEISFCTFSLREVLENVPASPKPPNLGDKPRGCCWPS

SEQ ID NO: 880473 - protein, 611 aa, Homo sapiens
MGVPRTPSRTVLFERERTGLTYRVPSLLPVPPGPTLLAFVEQRLSPDDSHAHRLVLRRGTLAGGSVRWGALHVLGTAALAEHRSMNPCPVHDAGTGTVFLFFIAVLGHTPEAVQIATGRNAARLCCVASRDAGLSWGSARDLTEEAIGGAVQEEKAGRWGVSQLPNQQPPRPTPSSYSLLPSHPAQGLARPHPQLSLHPILCGHLTPARGSYSRECSRHMANPGTPLQGLMPPACPPLSLCGQRSPASLGAVHLGSAAKGCERLVQPGRTQGGWDESCGRAVRVRWSYPEAPAPPSPSPCAFLQPPDLRDPAAPPTSALLPADWATFAVGPGHGVQLPSGRLLVPAYTYRVDRRECFGKICRTSPHSFAFYSDDHGRTWRCGGLVPNLRSERVASLPETAWGCQGSIVGFPAPAPNRPRDDSWSVGPGSPLQPPLLGPGVHEPPEEAAVDPRGGQVPGGPFSRLQPRGDGPRQPGPRPGVSGDVGSWTLALPMPFAAPPQSPTWLLYSHPVGRRARLHMGIRLSQSPLDPRSWTEPWVIYEGPSGYSDLASIGPAPEGGLVFACLYESGARTSYDEISFCTFSLREVLENVPASPKPPNLGDKPRGCCWPS

SEQ ID NO: 880474 - protein, 210 aa, Homo sapiens
AQRGLCCEGLCCARGGPAPGKPRGECALTEPSWQGRVSGAADPCPSGRSTAASQLGLSQHSPCWRAHPRVLSTPVLSALTCRGEPVLVPGVCVAPGCPSAPLALLWASVEPCHRGSVQGPDVALRRGQLPGLLPAQWALVSALGQARQPPMMSSAAFPRWLSMGVPRTPSRTVLFERERTGLTYRVPSLLPVPLVSTMRCSWESSGMTAD

SEQ ID NO: 880475 - protein, 484 aa, Homo sapiens
MGVPRTPSRTVLFERERTGLTYRVPSLLPVPPGPTLLAFVEQRLSPDDSHAHRLVLRRGTLAGGSVRWGALHVLGTAALAEHRSMNPCPVHDAGTGTVFLFFIAVLGHTPEAVQIATGRNAARLCCVASRDAGLSWGSARDLTEEAIGGAVQDWATFAVGPGHGVQLPSGRLLVPAYTYRVDRRECFGKICRTSPHSFAFYSDDHGRTWRCGGLVPNLRSGECQLAAVDGGQAGSFLYCNARSPLGSRVQALSTDEGTSFLPAERVASLPETAWGCQGSIVGFPAPAPNRPRDDSWSVGPGSPLQPPLLGPGVHEPPEEAAVDPRGGQVPGGPFSRLQPRGDGPRQPGPRPGVSGDVGSWTLALPMPFAAPPQSPTWLLYSHPVGRRARLHMGIRLSQSPLDPRSWTEPWVIYEGPSGYSDLASIGPAPEGGLVFACLYESGARTSYDEISFCTFSLREVLENVPASPKPPNLGDKPRGCCWPS

SEQ ID NO: 880476 - protein, 561 aa, Homo sapiens
AQRGLCCEGLCCARGGPAPGKPRGECALTEPSWQGRVSGAADPCPSGRSTAASQLGLSQHSPCWRAHPRVLSTPVLSALTCRGEPVLVPGVCVAPGCPSAPLALLWASVEPCHRGSVQGPDVALRRGQLPGLLPAQWALVSALGQARQPPMMSSAAFPRWLSMGVPRTPSRTVLFERERTGLTYRVPSLLPVPPGPTLLAFVEQRLSPDDSHAHRLVLRRGTLAGGSVRTGPHSLWVPATACSCPQAACWYPPTPTAWTAESVLARSAGPALTPSPSTAMTTAAPGAVEASCPTCAQASASWRRWTVGRPAASSTAMPGAHWAAVCRRSALTRAPPSCPQERVASLPETAWGCQGSIVGFPAPAPNRPRDDSWSVGPGSPLQPPLLGPGVHEPPEEAAVDPRGGQVPGGPFSRLQPRGDGPRQPGPRPGVSGDVGSWTLALPMPFAAPPQSPTWLLYSHPVGRRARLHMGIRLSQSPLDPRSWTEPWVIYEGPSGYSDLASIGPAPEGGLVFACLYESGARTSYDEISFCTFSLREVLENVPASPKPPNLGDKPRGCCWPS

SEQ ID NO: 880477 - protein, 109 aa, Homo sapiens
AAAPNLPGAPSPLRPRFPFPTRAPLCSLALLTLSLQPPGPGRGWVAGVLLPAPWLTFPHPRTRSGEPGTKNCRPREVRLAPSTWVLKKSHRFRARRIQGGETEAEREGR

SEQ ID NO: 880478 - protein, 109 aa, Homo sapiens
AAAPNLPGAPSPLRPRFPFPTRAPLCSLALLTLSLQPPGPGRGWVAGVLLPAPWLTFPHPRTRSGEPGTKNCRPREVRLAPSTWVLKKSHRFRARRIQGGETEAEREGP

SEQ ID NO: 880479 - protein, 160 aa, Homo sapiens
QIPAEGVPAYISLHRLLRKMLRGSGLPAVSRENPVASDSYEAAVLSLATGLAHSGTDCSQLAQGLGTWTCSSSLYPSKHPITVEINGINPGNNDCWVSTGLYLLEGQNAEVSLSEAAASAGLRVQIGCHTDDLTKARKLSRAPVVTHQCWMDRTERSVSC

SEQ ID NO: 880480 - protein, 89 aa, Homo sapiens
PLGEARRGPGMERPGPLEAQWRVGLQGAQSSLVQGPESDTRGRVVGGTPQCVTTEASSPSYVSLFLSLEVQHLREDSKHRVTSSYVHFL

SEQ ID NO: 880481 - protein, 86 aa, Homo sapiens
SADLGQPVLQPKPSAETLRAALSTEGSGSSPCYLTSPGTPSSAHYRQHPSKQDPCFNGTSDLDIQVSGAPLCTAGASPTRPRFSLP

SEQ ID NO: 880482 - protein, 86 aa, Homo sapiens; identical to SEQ ID NO: 880481

SEQ ID NO: 880483 - protein, 145 aa, Homo sapiens
TKPAELLLARVPDAGVEIPEEEAVVAGLPAVERAARGAVPRGGGGGGGGGGGGGAVGRGVGARVGAVGAPALAAARLGDPLRALAPVRGEESGGGEQQRQQVQGHGQERSAAAASLHAARAAGTGLHRRGAPRAKLAAGAPRQRP

SEQ ID NO: 880484 - protein, 165 aa, Homo sapiens
ARGLVGRTGAVELGRSCGSGGGRGGRGYGGWSQKMAEAGDFAVIGLLYPCIDRHLGEPHKFKREWSSVMRCVAVFVGINHASAKVDFDNNIQLSLTLAALSIGLWWTFDRSRSGFGLGVGIAFLATVVTQLLVYNGVYHTNVKLSQKNLIRNEEGKKYLLYRKAR

SEQ ID NO: 880485 - protein, 225 aa, Homo sapiens
MAEGETESPGPKKCGPYISSVTSQSVNLMIRGVVLFFIGVFLALVLNLLQIQRNVTLFPPDVIASIFSSAWWVPPCCGTASAVIGLLYPCIDRHLGEPHKFKREWSSVMRCVAVFVGINHASAKVDFDNNIQLSLTLAALSIGLWWTFDRSRSGFGLGVGIAFLATVVTQLLVYNGVYQYTSPDFLYVRSWLPCIFFAGGITMGNIGRQLAMYECKVIAEKSHQE

SEQ ID NO: 880486 - protein, 225 aa, Homo sapiens; identical to SEQ ID NO: 880485

SEQ ID NO: 880487 - protein, 117 aa, Homo sapiens
MRCVAVFVGINHASAKVDFDNNIQLSLTLAALSIGLWWTFDRSRSGFGLGVGIAFLATVVTQLLVYNGVYQYTSPDFLYVRSWLPCIFFAGGITMGNIGRQLAMYECKVIAEKSHQE

SEQ ID NO: 880488 - protein, 225 aa, Homo sapiens; identical to SEQ ID NO: 880485

SEQ ID NO: 880489 - protein, 185 aa, Homo sapiens
ARGLVGRTGAVELGRSCGSGGGRGGRGYGGWSQKMAEAGDFAVIGLLYPCIDRHLGEPHKFKREWSSVMRCVAVFVGINHASAKVDFDNNIQLSLTLAALSIGLWWTFDRSRSGFGLGVGIAFLATVVTQLLVYNGVYQYTSPDFLYVRSWLPCIFFAGGITMGNIGRQLAMYECKVIAEKSHQE

SEQ ID NO: 880490 - protein, 117 aa, Homo sapiens; identical to SEQ ID NO: 880487

SEQ ID NO: 880491 - protein, 1591 aa, Homo sapiens
MGNAESQHVEHEFYGEKHASLGRNDTSRSLRLSHKTRRTRHASSGKVIHRNSEVSTRSSSTPSIPQSLAENGLEPFSQDGTLEDFGSPIWVDRVDMGLRPVSYTDSSVTPSVDSSIVLTAASVQSMPDTEESRLYGDDATYLAEGGRRQHSYTSNGPTFMETASFKKKRSKSADIWREDSLEFSLSDLSQEHLTSNEEILGSAEEKDCEEARGMETRASPRQLSTCQRANSLGDLYAQKNSGVTANMGPGSKFAGYCRNLVSDIPNLANHKMPPAAAEETPPYSNYNTLPCRKSHCLSEGATNPQISHSNSMQGRRAKTTQDVNAGEGSEFADSGIEGATTDTDLLSRRSNATNSSYSPTTGRAFVGSDSGSSSTGDAARQGVYENFRRELEMSTTNSESLEEAGSAHSDEQSSGTLSSPGQSDILLTAAQGTVRKAGALAVKNFLVHKKNKKVESATRRKWKHYWVSLKGCTLFFYESDGRSGIDHNSIPKHAVWVENSIVQAVPEHPKKDFVFCLSNSLGDAFLFQTTSQTELENWITAIHSACATAVARHHHKEDTLRLLKSEIKKLEQKIDMDEKMKKMGEMQLSSVTDSKKKKTILDQIFVWEQNLEQFQMDLFRFRCYLASLQGGELPNPKRLLAFASRPTKVAMGRLGIFSVSSFHALVAARTGETGVRRRTQAMSRSASKRRSRFSSLWGLDTTSKKKQGRPSINQVFGEGTEAVKKSLEGIFDDIVPDGKREKEVVLPNVHQHNPDCDIWVHEYFTPSWFCLPNNQPALTVVRPGDTARDTLELICKTHQLDHSAHYLRLKFLIENKMQLYVPQPEEDIYELLYKEIEICPKVTHSIHIEKSDTAADTYGFSLSSVEEDGIRRLYVNSVKETGLASKKGLKAGDEILEINNRAADALNSSMLKDFLSQPSLGLLVRTYPELEEGVELLESPPHRVDGPADLGESPLAFLTSNPGHSLCSEQGSSAETAPEETEGPDLESSDETDHSSKSTEQVAAFCRSLHEMNPSDQNPSPQDSTGPQLATMRQLSDADNVRKVICELLETERTYVKDLNCLMERYLKPLQKETFLTQDELDVLFGNLTEMVEFQVEFLKTLEDGVRLVPDLEKLEKVDQFKKVLFSLGGSFLYYADRFKLYSAFCASHTKVPKVLVKAKTDTAFKAFLDAQNPKQQHSSTLESYLIKPIQRILKYPLLLRELFALTDAESEEHYHLDVAIKTMNKVASHINEMQKIHEEFGAVFDQLIAEQTGEKKEVADLSMGDLLLHTTVIWLNPPASLGKWKKEPELAAFVFKTAVVLVYKDGSKQKKKLVGSHRLSIYEDWDPFRFRHMIPTEALQVRALASADAEANAVCEIVHVKSESEGRPERVFHLCCSSPESRKDFLKAVHSILRDKHRRQLLKTESLPSSQQYVPFGGKRLCALKGARPAMSRAVSAPSKSLGRRRRRLARNRFTIDSDAVSASSPEKESQQPPGGGDTDRWVEEQFDLAQYEEQDDIKETDILSDDDEFCESVKGASVDRDLQERLQATSISQRERGRKTLDSHASRMAQLKKQAALSGINGGLESASEEVIWVRREDFAPSRKLNTEI

SEQ ID NO: 880492 - protein, 1477 aa, Homo sapiens
MGNAESQHVEHEFYGEKHASLGRNDTSRSLRLSHKTRRTRHASSGKVIHRNSEVSTRSSSTPSIPQSLAENGLEPFSQDGTLEDFGSPIWVDRVDMGLRPVSYTDSSVTPSVDSSIVLTAASVQSMPDTEESRLYGDDATYLAEGGRRQHSYTSNGPTFMETASFKKKRSKSADIWREDSLEFSLSDLSQEHLTSNEEILGSAEEKDCEEARGMETRASPRQLSTCQRANSLGDLYAQKNSGVTANVGPGSKFAGYCRNLVSDIPNLANHKMPPAAAEETPPYSNYNTLPCRKSHCLSEGATNPQISHSNSMQGRRAKTTQDVNAGEGSEFADSGIEGATTDTDLLSRRSNATNSSYSPTTGRAFVGSDSGSSSTGDAARQGVYENFRRELEMSTTNSESLEEAGSAHSDEQSSGTLSSPGQSDILLTAAQGTVRKAGALAVKNFLVHKKNKKVESATRRKWKHYWVSLKGCTLFFYESDGRSGIDHNSIPKHAVWVENSIVQAVPEHPKKDFVFCLSNSLGDAFLFQTTSQTELENWITAIHSACATAVARHHHKEDTLRLLKSEIKKLEQKIDMDEKMKKMGEMQLSSVTDSKKKKTILDQIFVWEQNLEQFQMDLFRFRCYLASLQGGELPNPKRLLAFASRPTKVAMGRLGIFSVSSFHALVAARTGETGVRRRTQAMSRSASKRRSRFSSLWGLDTTSKKKQGRPSINQVFGEGTEAVKKSLEGIFDDIVPDGKREKEVVLPNVHQHNPDCDIWVHEYFTPSWFCLPNNQPALTVVRPGDTARDTLELICKTHQLDHSAHYLRLKFLIENKMQLYVPQPEEDIYELLYKEIEICPKVTHSIHIEKSDTAADTYGFSLSSVEEDGIRRLYVNSVKETGLASKKGLKAGDEILEINNRAADALNSSMLKDFLSQPSLGLLVRTYPELEEGVELLESPPHRVDGPADLGESPLAFLTSNPGHSLCSEQGSSAETAPEETEGPDLESSDETDHSSKSTEQVAAFCRSLHEMNPSDQSPSPQDSTGPQLATMRQLSDADNVRKVICELLETERTYVKDLNCLMERYLKPLQKETFLTQDELDVLFGNLTEMVEFQVEFLKTLEDGVRLVPDLEKLEKVDQFKKVLFSLGGSFLYYADRFKLYSAFCASHTKVPKVLVKAKTDTAFKAFLDAQNPKQQHSSTLESYLIKPIQRILKYPLLLRELFALTDAESEEHYHLDVAIKTMNKVASHINEMQKIHEEFGAVFDQLIAEQTGEKKEVADLSMGDLLLHTTVIWLNPPASLGKWKKEPELAAFVFKTAVVLVYKDGSKQKKKLVGSHRLSIYEDWDPFRFRHMIPTEALQVRALASADAEANAVCEIVHVKSESEGRPERVFHLCCSSPESRKDFLKAVHSILRDKHRRQLLKTESLPSSQQYVPFGGKRLCALKGARPAMSRADGKRKQRLLIVAFTGSSATHPSENTRKSGAWRGCHCLLYIRS

SEQ ID NO: 880493 - protein, 1199 aa, Homo sapiens
MGNAESQHVEHEFYGEKHASLGRNDTSRSLRLSHKTRRTRHASSGKVIHRNSEVSTRSSSTPSIPQSLAENGLEPFSQDGTLEDFGSPIWVDRVDMGLRPVSYTDSSVTPSVDSSIVLTAASVQSMPDTEESRLYGDDATYLAEGGRRQHSYTSNGPTFMETASFKKKRSKSADIWREDSLEFSLSDLSQEHLTSNEEILGSAEEKDCEEARGMETRASPRQLSTCQRANSLGDLYAQKNSGVTANMGPGSKFAGYCRNLVSDIPNLANHKMPPAAAEETPPYSNYNTLPCRKSHCLSEGATNPQISHSNSMQGRRAKTTQDVNAGEGSEFADSGIEGATTDTDLLSRRSNATNSSYSPTTGRAFVGSDSGSSSTGDAARQGVYENFRRELEMSTTNSESLEEAGSAHSDEQSSGTLSSPGQSDILLTAAQGTVRKAGALAVKNFLVHKKNKKVESATRRKWKHYWVSLKGCTLFFYESDGRSGIDHNSIPKHAVWVENSIVQAVPEHPKKDFVFCLSNSLGDAFLFQTTSQTELENWITAIHSACATAVARHHHKEDTLRLLKSEIKKLEQKIDMDEKMKKMGEMQLSSVTDSKKKKTILDQIFVWEQNLEQFQMDLFRFRCYLASLQGGELPNPKRLLAFASRPTKVAMGRLGIFSVSSFHALVAARTGETGVRRRTQAMSRSASKRRSRFSSLWGLDTTSKKKQGRPSINQVFGEGTEAVKKSLEGIFDDIVPDGKREKEVVLPNVHQHNPDCDIWVHEYFTPSWFCLPNNQPALTVVRPGDTARDTLELICKTHQLDHSAHYLRLKFLIENKMQLYVPQPEEDIYELLYKEIEICPKVTHSIHIEKSDTAADTYGFSLSSVEEDGIRRLYVNSVKETGLASKKGLKAGDEILEINNRAADALNSSMLKDFLSQPSLGLLVRTYPELEEGVELLESPPHRVDGPADLGESPLAFLTSNPGHSLCSEQGSSAETAPEETEGPDLESSDETDHSSKSTEQVAAFCRSLHEMNPSDQNPSPQDSTGPQLATMRQLSDADNVRKVICELLETERTYVKDLNCLMERYLKPLQKETFLTQDELDVLFGNLTEMVEFQVEFLKTLEDGVRLVPDLEKLEKVDQFKKVLFSLGGSFLYYADRFKLYSAFCASHTKVPKVLVKAKTDTAFKAFLDAQNPKQQHSSTLESYLIKPIQMENGSRGF

SEQ ID NO: 880494 - protein, 68 aa, Homo sapiens
MCVQDGLMTGPAFPVEISKAQGTLFSHRAVLLQIHLSPMGSFIMLLLFLILGKGEYLEDFAVDRDTEA

SEQ ID NO: 880495 - protein, 1591 aa, Homo sapiens
MGNAESQHVEHEFYGEKHASLGRNDTSRSLRLSHKTRRTRHASSGKVIHRNSEVSTRSSSTPSIPQSLAENGLEPFSQDGTLEDFGSPIWVDRVDMGLRPVSYTDSSVTPSVDSSIVLTAASVQSMPDTEESRLYGDDATYLAEGGRRQHSYTSNGPTFMETASFKKKRSKSADIWREDSLEFSLSDLSQEHLTSNEEILGSAEEKDCEEARGMETRASPRQLSTCQRANSLGDLYAQKNSGVTANMGPGSKFAGYCRNLVSDIPNLANHKMPPAAAEETPPYSNYNTLPCRKSHCLSEGATNPQISHSNSMQGRRAKTTQDVNAGEGSEFADSGIEGATTDTDLLSRRSNATNSSYSPTTGRAFVGSDSGSSSTGDAARQGVYENFRRELEMSTTNSESLEEAGSAHSDEQSSGTLSSPGQSDILLTAAQGTVRKAGALAVKNFLVHKKNKKVESATRRKWKHYWVSLKGCTLFFYESDGRSGIDHNSIPKHAVWVENSIVQAVPEHPKKDFVFCLSNSLGDAFLFQTTSQTELENWITAIHSACATAVARHHHKEDTLRLLKSEIKKLEQKIDMDEKMKKMGEMQLSSVTDSKKKKTILDQIFVWEQNLEQFQMDLFRFRCYLASLQGGELPNPKRLLAFASRPTKVAMGRLGIFSVSSFHALVAARTGETGVRRRTQAMSRSASKRRSRFSSLWGLDTTSKKKQGRPSINQVFGEGTEAVKKSLEGIFDDIVPDGKREKEVVLPNVHQHNPDCDIWVHEYFTPSWFCLPNNQPALTVVRPGDTARDTLELICKTHQLDHSAHYLRLKFLIENKMQLYVPQPEEDIYELLYKEIEICPKVTHSIHIEKSDTAADTYGFSLSSVEEDGIRRLYVNSVKETGLASKKGLKAGDEILEINNRAADALNSSMLKDFLSQPSLGLLVRTYPELEEGVELLESPPHRVDGPADLGESPLAFLTSNPGHSLCSEQGSSAETAPEETEGPDLESSDETDHSSKSTEQVAAFCRSLHEMNPSDQNPSPQDSTGPQLATMRQLSDADKLRKVICELLETERTYVKDLNCLMERYLKPLQKETFLTQDELDVLFGNLTEMVEFQVEFLKTLEDGVRLVPDLEKLEKVDQFKKVLFSLGGSFLYYADRFKLYSAFCASHTKVPKVLVKAKTDTAFKAFLDAQNPKQQHSSTLESYLIKPIQRILKYPLLLRELFALTDAESEEHYHLDVAIKTMNKVASHINEMQKIHEEFGAVFDQLIAEQTGEKKEVADLSMGDLLLHTTVIWLNPPASLGKWKKEPELAAFVFKTAVVLVYKDGSKQKKKLVGSHRLSIYEDWDPFRFRHMIPTEALQVRALASADAEANAVCEIVHVKSESEGRPERVFHLCCSSPESRKDFLKAVHSILRDKHRRQLLKTESLPSSQQYVPFGGKRLCALKGARPAMSRAVSAPSKSLGRRRRRLARNRFTIDSDAVSASSPEKESQQPPGGGDTDRWVEEQFDLAQYEEQDDIKETDILSDDDEFCESVKGASVDRDLQERLQATSISQRERGRKTLDSHASRMAQLKKQAALSGINGGLESASEEVIWVRREDFAPSRKLNTEI

SEQ ID NO: 880496 - protein, 1274 aa, Homo sapiens
MGNAESQHVEHEFYGEKHASLGRNDTSRSLRLSHKTRRTRHASSGKVIHRNSEVSTRSSSTPSIPQSLAENGLEPFSQDGTLEDFGSPIWVDRVDMGLRPVSYTDSSVTPSVDSSIVLTAASVQSMPDTEESRLYGDDATYLAEGGRRQHSYTSNGPTFMETASFKKKRSKSADIWREDSLEFSLSDLSQEHLTSNEEILGSAEEKDCEEARGMETRASPRQLSTCQRANSLGDLYAQKNSGVTANMGPGSKFAGYCRNLVSDIPNLANHKMPPAAAEETPPYSNYNTLPCRKSHCLSEGATNPQISHSNSMQGRRAKTTQDVNAGEGSEFADSGIEGATTDTDLLSRRSNATNSSYSPTTGRAFVGSDSGSSSTGDAARQGVYENFRRELEMSTTNSESLEEAGSAHSDEQSSGTLSSPGQSDILLTAAQGTVRKAGALAVKNFLVHKKNKKVESATRRKWKHYWVSLKGCTLFFYESDGRSGIDHNSIPKHAVWVENSIVQAVPEHPKKDFVFCLSNSLGDAFLFQTTSQTELENWITAIHSACATAVARHHHKEDTLRLLKSEIKKLEQKIDMDEKMKKMGEMQLSSVTDSKKKKTILDQIFVWEQNLEQFQMDLFRFRCYLASLQGGELPNPKRLLAFASRPTKVAMGRLGIFSVSSFHALVAARTGETGVRRRTQAMSRSASKRRSRFSSLWGLDTTSKKKQGRPSINQVFGEGTEAVKKSLEGIFDDIVPDGKREKEVVLPNVHQHNPDCDIWVHEYFTPSWFCLPNNQPALTVVRPGDTARDTLELICKTHQLDHSAHYLRLKFLIENKMQLYVPQPEEDIYELLYKEIEICPKVTHSIHIEKSDTAADTYGFSLSSVEEDGIRRLYVNSVKETGLASKKGLKAGDEILEINNRAADALNSSMLKDFLSQPSLGLLVRTYPELEEGVELLESPPHRVDGPADLGESPLAFLTSNPGHSLCSEQGSSAETAPEETEGPDLESSDETDHSSKSTEQVAAFCRSLHEMNPSDQNPSPQDSTGPQLATMRQLSDADNVRKVICELLETERTYVKDLNCLMERYLKPLQKETFLTQDELDVLFGNLTEMVEFQVEFLKTLEDGVRLVPDLEKLEKVDQFKKVLFSLGGSFLYYADRFKLYSAFCASHTKVPKVLVKAKTDTAFKAFLDAQNPKQQHSSTLESYLIKPIQRILKYPLLLRELFALTDAESEEHYHLDVAIKTMNKVASHINEMQKIHEEFGAVFDQLIAEQTGEKKEVADLSMGDLLLHTTEI

SEQ ID NO: 880497 - protein, 1591 aa, Homo sapiens; identical to SEQ ID NO: 880491

SEQ ID NO: 880498 - protein, 107 aa, Homo sapiens
GGSSGLEMTDLLSPLPAILGPRGQERPGIQGVPQLSFTRIYRPALPTSQHPAWQRNGTEDGAAGRYQHFRNCDRILLRCQGWSALVQSRLTANSASQVQVILLCQFL

SEQ ID NO: 880499 - protein, 77 aa, Homo sapiens
WPRARRHHHSNSAAGGRRTCPHISCVAGTASGPLGSLHVPGFVSDTSDAVLSRKRKVSVFVTFMTVRGEREREKVGE

SEQ ID NO: 880500 - protein, 107 aa, Homo sapiens
QTHRAKSASSCPNLLVPETWPHQVSASHAGRSKQPQGGILKINEEHRRGAIQDLLASPGFTFGKRVVFDSHCLKRQHTFADGLHSSCTSVPLSEIWHTLTRRENYIY

SEQ ID NO: 880501 - protein, 128 aa, Homo sapiens
QTHRAKSASSCPNLLVPETWPHQVSASHAGRSKQPQGGILKINEEHRRGAIQDLLASPGFTFGKRVVFDSHCLKRQHTFADGLHSSCTSSKLAPSATVLPSTLLNHCAGVSEPPDVFCTIIPILQLGD

SEQ ID NO: 880502 - protein, 783 aa, Homo sapiens [sequence omitted]

SEQ ID NO: 880503 - protein, 829 aa, Homo sapiens
MAKYNTGGNPTEDVSVNSRPFRVTGPNSSSGIQARKNLFNNQGNASPPAGPSNVPKFGSPKPPVAVKPSSEEKPDKEPKPPFLKPTGAGQRFGTPASLTTRDPEAKVGFLKPVGPKPINLPKEDSKPTFPWPPGNKPSLHSVNQDHDLKPLGPKSGPTPPTSENEQKQAFPKLTGVKGKFMSASQDLEPKPLFPKPAFGQKPPLSTENSHEDESPMKNVSSSKGSPAPLGVRSKSGPLKPAREDSENKDHAGEISSLPFPGVVLKPAASRGGPGLSKNGEEKKEDRKIDAAKNTFQSKINQEELASGTPPARFPKAPSKLTVGGPWGQSQEKEKGDKNSATPKQKPLPPLFTLGPPPPKPNRPPNVDLTKFHKTSSGNSTSKGQTSYSTTSLPPPPPSHPASQPPLPASHPSQPPVPSLPPRNIKPPFDLKSPVNEDNQDGVTHSDGAGNLDEEQDSEGETYEDIEASKEREKKREKEEKKRLELEKKEQKEKEKKEQEIKKKFKLTGPIQVIHLAKACCDVKGGKNELSFKQGEQIEIIRITDNPEGKWLGRTARGSYGYIKTTAVEIDYDSLKLKKDSLGAPSRPIEDDQEVYDDVAEQDDISSHSQSGSGGIFPPPPDDDIYDGIEEEDADDGSTLQVQEKSNTWSWGILKMLKGKDDRKKSIREKPKVSDSDNNEGSSFPAPPKQLDMGDEVYDDVDTSDFPVSSAEMSQGTNFGKAKTEEKDLKKLKKQEKEEKDFRKKFKYDGEIRVLYSTKVTTSITSKKWGTRDLQVKPGESLEVIQTTDDTKVLCRNEEGKYGYVLRSYLADNDGEIYDDIADGCIYDND

SEQ ID NO: 880504 - protein, 639 aa, Homo sapiens
MAKYNTGGNPTEDVSVNSRPFRVTGPNSSSGIQARKNLFNNQGNASPPAGPSNVPKFGSPKPPVAVKPSSEEKPDKEPKPPFLKPTGAGQRFGTPASLTTRDPEAKVGFLKPVGPKPINLPKEDSKPTFPWPPGNKPSLHSVNQDHDLKPLGPKSGPTPPTSENEQKQAFPKLTGVKGKFMSASQDLEPKPLFPKPAFGQKPPLSTENSHEDESPMKNVSSSKGSPAPLGVRSKSGPLKPAREDSENKDHAGEISSLPFPGVVLKPAASRGGPGLSKNGEEKKEDRKIDAAKNTFQSKINQEELASGTPPARFPKAPSKLTVGGPWGQSQEKEKGDKNSATPKQKPLPPLFTLGPPPPKPNRPPNVDLTKFHKTSSGNSTSKGQTSYSTTSLPPPPPSHPASQPPLPASHPSQPPVPSLPPRNIKPPFDLKSPVNEDNQDGVTHSDGAGNLDEEQDSEGETYEDIEASKEREKKREKEEKKRLELEKKEQKEKEKKEQEIKKKFKLTGPIQVIHLAKACCDVKGGKNELSFKQGEQIEIIRITDNPEGKWLGRTARGSYGYIKTTAVEIDYDSLKLKKDSLGAPSRPIEDDQEVYDDVAEQDDISSHSQSGSGGIFPPPPDDDIYDGLEEGTPYRLWFS

SEQ ID NO: 880505 - protein, 392 aa, Homo sapiens
MAKYNTGGNPTEDVSVNSRPFRVTGPNSSSGIQARKNLFNNQGNASPPAGPSNVPKFGSPKPPVAVKPSSEEKPDKEPKPPFLKPTGAGQRFGTPASLTTRDPEAKVGFLKPVGPKPINLPKEDSKPTFPWPPGNKPSLHSVNQDHDLKPLGPKSGPTPPTSENEQKQAFPKLTGVKGKFMSASQDLEPKPLFPKPAFGQKPPLSTENSHEDESPMKNVSSSKGSPAPLGVRSKSGPLKPAREDSENKDHAGEISSLPFPGVVLKPAASRGGPGLSKNGEEKKEDRKIDAAKNTFQSKINQEELASGTPPARFPKAPSKLTVGGPWGQSQEKEKGDKNSATPKQKPLPPLFTLGPPPPKPNRPPNVDLTKFHKTSSGNSTSKGQTSYSTPTT

SEQ ID NO: 880506 - protein, 102 aa, Homo sapiens
LTGPIQVIHLAKACCDVKGGKNELSFKQGEQIEIIRITDNPEGKWLGRTARGSCECKFLYGFEVFSLRGNIQCTYSSRTRHRHRVRSTLQSGQREENVKWQV

SEQ ID NO: 880507 - protein, 783 aa, Homo sapiens [sequence omitted]

SEQ ID NO: 880508 - protein, 829 aa, Homo sapiens; identical to SEQ ID NO: 880503

SEQ ID NO: 880509 - protein, 838 aa, Homo sapiens
MAKYNTGGNPTEDVSVNSRPFRVTGPNSSSGIQARKNLFNNQGNASPPAGPSNVPKFGSPKPPVAVKPSSEEKPDKEPKPPFLKPTGAGQRFGTPASLTTRDPEAKVGFLKPVGPKPINLPKEDSKPTFPWPPGNKPSLHSVNQDHDLKPLGPKSGPTPPTSENEQKQAFPKLTGVKGKFMSASQDLEPKPLFPKPAFGQKPPLSTENSHEDESPMKNVSSSKGSPAPLGVRSKSGPLKPAREDSENKDHAGEISSLPFPGVVLKPAASRGGPGLSKNGEEKKEDRKIDAAKNTFQSKINQEELASGTPPARFPKAPSKLTVGGPWGQSQEKEKGDKNSATPKQKPLPPLFTLGPPPPKPNRPPNVDLTKFHKTSSGNSTSKGQTSYSTTSLPPPPPSHPASQPPLPASHPSQPPVPSLPPRNIKPPFDLKSPVNEDNQDGVTHSDGAGNLDEEQDSEGETYEDIEASKEREKKREKEEKKRLELEKKEQKEKEKKEQEIKKKFKLTGPIQVIHLAKACCDVKGGKNELSFKQGEQIEIIRITDNPEGKWLGRTARGSYGYIKTTAVEIDYDSLKLKKDSLGAPSRPIEDDQEVYDDVAEQDDISSHSQSGSGGIFPPPPDDDIYDGIEEEDADDGSTLQVQEKSNTWSWGILKMLKGKDDRKKSIREKPKVSDSDNNEGSSVRVNQPNPVFPAPPKQLDMGDEVYDDVDTSDFPVSSAEMSQGTNFGKAKTEEKDLKKLKKQEKEEKDFRKKFKYDGEIRVLYSTKVTTSITSKKWGTRDLQVKPGESLEVIQTTDDTKVLCRNEEGKYGYVLRSYLADNDGEIYDDIADGCIYDND

SEQ ID NO: 880510 - protein, 463 aa, Homo sapiens
MAKYNTGGNPTEDVSVNSRPFRVTGPNSSSGIQARKNLFNNQGNASPPAGPSNVPKFGSPKPPVAVKPSSEEKPDKEPKPPFLKPTGAGQRFGTPASLTTRDPEAKVGFLKPVGPKPINLPKEDSKPTFPWPPGNKPSLHSVNQDHDLKPLGPKSGPTPPTSENEQKQAFPKLTGVKGKFMSASQDLEPKPLFPKPAFGQKPPLSTENSHEDESPMKNVSSSKGSPAPLGVRSKSGPLKPAREDSENKDHAGEISSLPFPGVVLKPAASRGGPGLSKNGEEKKEDRKIDAAKNTFQSKINQEELASGTPPARFPKAPSKLTVGGPWGQSQEKEKGDKNSATPKQKPLPPLFTLGPPPPKPNRPPNVDLTKFHKTSSGNSTSKGQTSYSTKPLATTQPAKTSTSKAKTQPTSLPKQPAPTTIGGLNKKPMSLASGLVPAAPPKRPAVASARPSILPIKRRGYRA

SEQ ID NO: 880511 - protein, 257 aa, Homo sapiens
GQCLSHSGFTMHSWERLAVLVLLGAAACAAPPRGRILGGREAEAHARPYMASVQLNGAHLCGGVLVAEQWVLSAAHCLEDAADGKVQVLLGAHSLSQPEPSKRLYDVLRAVPHPDSQPDTIDHDLLLLQLSEKATLGPAVRPLPWQRVDRDVAPGTLCDVAGWGIVNHAGRRPDSLQHVLLPVLDRATCNRRTHHDGAITERLMCAESNRRDSCKVTPGARWCAGACSRAWSPRARAFAATEEARDLHPRGSYAAWI

SEQ ID NO: 880512 - protein, 412 aa, Homo sapiens
ADPQRLHRDCAPVPLALPRCCSSRPAALRMERRARSSSRESRGRGGRTPHKENKRAKAERSGGGRGRQEAGPEPSGSGRAGTPGEPRAPAATVVDVDEVRGSGEEGTEVVALLESERPEEGTKSSGLGACEWLLVLISLLFIIMTFPFSIWFCVKVVQEYERVIIFRLGHLLPGRAKGPGLFFFLPCLDTYHKVDLRLQTLEIPFHEIVTKDMFIMEIDAICYYRMENASLLLSSLAHVSKAVQFLVQTTMKRLLAHRSLTEILLERKSIAQDAKVALDSVTCIWGIKVERIEIKDVRLPAGLQHSLAVEAEAQRQAKVRMIAAEAEKAASESLRMAAEILSGTPAAVQLRYLHTLQSLSTEKPSTVVLPLPFDLLNCLSSPSNRTQGSLPFPSPSKPVEPLNPKKKDSPML

SEQ ID NO: 880513 - protein, 188 aa, Homo sapiens
ADPQRLHRDCAPVPLALPRCCSSRPAALRMERRARSSSRESRGRGGRTPHKENKRAKAERSGGGRGRQEAGPEPSGSGRAGTPGEPRAPAATVVDVDEVRGSGEEGTEVVALLESERPEEGTKSSGLGACEWLLVLISLLFIIMTFPFSIWFCVKVVQEYERVIIFRLGHLLPGRAKGPGWPRTPDFK

SEQ ID NO: 880514 - protein, 344 aa, Homo sapiens
ADPQRLHRDCAPVPLALPRCCSSRPAALRMERRARSSSRESRGRGGRTPHKENKRAKAERSGGGRGRQEAGPEPSGSGRAGTPGEPRAPAATVVDVDEVRGSGEEGTEVVALLESERPEEGTKSSGLGACEWLLVLISLLFIIMTFPFSIWFCVKVVQEYERVIIFRLGHLLPGRAKGPGLFFFLPCLDTYHKVDLRLQTLEIPFHEVALDSVTCIWGIKVERIEIKDVRLPAGLQHSLAVEAEAQRQAKVRMIAAEAEKAASESLRMAAEILSGTPAAVQLRYLHTLQSLSTEKPSTVVLPLPFDLLNCLSSPSNRTQGSLPFPSPSKPVEPLNPKKKDSPML

SEQ ID NO: 880515 - protein, 169 aa, Homo sapiens
SLSSHPQRASVLLCPSTPGAQPPPELPDPPAARPPTRPHPAPPLPSRDCSLPGAQAGSWCAAFRGQRPCRRGGKGSGEDTLALPDAVINFKGVSLGVNENRSDAWLKASRPPPEPRALWSRPGRGGPRATFQPSPHFTIFQAPQLGMGITVSVGGTHILKGGGLTAEGN

SEQ ID NO: 880516 - protein, 436 aa, Homo sapiens
MDQPFTVNSLKKLAAMPDHTDVSLSPEERVRALSKLGCNITISEDITPRRYFRSGVEMERMASVYLEEGNLENAFVLYNKFITLFVEKLPNHRDYQQCAVPEKQDIMKKLKEIAFPRTDELKNDLLKKYNVEYQEYLQSKNKYKAEILKKLEHQRLIEAERKRIAQMRQQQLESEQFLFFEDQLKKQELARGQMRSQQTSGLSEQIDGSALSCFSTHQNNSLLNVFADQPNKSDATNYASHSPPVNRALTPAATLSAVQNLVVEGLRCVVLPEDLCHKFLQLAESNTVRGIETCGILCGKLTHNEFTITHVIVPKQSAGPDYCDMENVEELFNVQDQHDLLTLGWIHTHPTQTAFLSSVDLHTHCSYQLMLPEAIAIVCSPKHKDTGIFRLTNAGMLEVSACKKKGFHPHTKEPRLFSICKHVLVKDIKIIVLDLR

SEQ ID NO: 880517 - protein, 105 aa, Homo sapiens
MALLIHQWSFEFFSRVRRDLHHSFHALIFLCDSLCCQQYAKVRWCSFGAKHAVPEKDQSDLNCLESTLTLILLALVLSLLSLTINTKIILMPDFSEKADGKTEGK

SEQ ID NO: 880518 - protein, 390 aa, Homo sapiens
MDQPFTVNSLKKLAAMPDHTDVSLSPEERVRALSKLGCNITISEDITPRRYFRSGVEMERMASVYLEEGNLENAFVLYNKFITLFVEKLPNHRDYQQCAVPEKQDIMKKLKEIAFPRTDELKNDLLKKYNVEYQEYLQSKNKYKAEILKKLEHQRLIEAERKRIAQMRQQQLESEQFLFFEDQLKKQELARGQMRSQQTSGLSEQIDGSALSCFSTHQNNSLLNVFADQPNKSDATNYASHSPPVNRALTPAATLSAVQNLVVEGLRCVVLPEDLCHKFLQLAESNTVRGIETCGILCGKLTHPTQTAFLSSVDLHTHCSYQLMLPEAIAIVCSPKHKDTGIFRLTNAGMLEVSACKKKGFHPHTKEPRLFSICKHVLVKDIKIIVLDLR

SEQ ID NO: 880519 - protein, 112 aa, Homo sapiens
MENVEELFNVQDQHDLLTLGWIHTHPTQTAFLSSVDLHTHCSYQLMLPEAIAIVCSPKHKDTGIFRLTNAGMLEVSACKKKGFHPHTKEPRLFSICKHVLVKDIKIIVLDLR

SEQ ID NO: 880520 - protein, 461 aa, Homo sapiens
MDQPFTVNSLKKLAAMPDHTDVSLSPEERVRALSKLGCNITISEDITPRRYFRSGVEMERMASVYLEEGNLENAFVLYNKFITLFVEKLPNHRDYQQCAVPEKQDIMKKLKEIAFPRTDELKNDLLKKYNVEYQEYLQSKNKYKAEILKKLEHQRLIEAERKRIAQMRQQQLESEQFLFFEDQLKKQELARGQMRSQQTSGLSEQIDGSALSCFSTHQNNSLLNVFADQPNKSDATNYASHSPPVNRALTPAATLSAVQNLVVEGLRCVVLPEDLCHKFLQLAESNTVRGIETCGILCGKLTHNEFTITHVIVPKQSAGPDYCDMENVEELFNVQDQHDLLTLGWIHTHPTQTAFLSSVDLHTHCSYQLMLPEAIAIVCSPKHKDTGIFRLTNAGMLEVSACKKKGFHPHTKEPRLFSIQKFLSGIISGTALEMEPLKIGYGPNGFPLLGISRSSSPSEQL

SEQ ID NO: 880521 - protein, 314 aa, Homo sapiens
TRGSTHASVEYQEYLQSKNKYKAEILKKLEHQRLIEAERKRIAQMRQQQLESEQFLFFEDQLKKQELARGQMRSQQTSGLSEQIDGSALSCFSTHQNNSLLNVFADQPNKSDATNYASHSPPVNRALTPAATLSAVQNLVVEGLRCVVLPEDLCHKFLQLAESNTVRGIETCGILCGKLTHNEFTITHVIVPKQSAGPDYCDMENVEELFNVQDQHDLLTLGWIHTHPTQTAFLSSVDLHTHCSYQLMLPEAIAIVCSPKHKDTGIFRLTNAGMLEVSACKKKGFHPHTKEPRLFSICKHVLVKDIKIIVLDLR

SEQ ID NO: 880522 - protein, 497 aa, Homo sapiens
AQPTCTQVNKQPLLLTQSLFRWSSIRTRVTPRSSRRVWAAYTEGKKKPSFLGKCRKPASGRSLRSPQGGALAAQRARFPAGEPRNGGAGGGDSEDPRLGFPTWIRSAWGFDPHPGAAPRRSWAARAFGLRHRQRHLEAGASGRLCLTCLLEGNTGKPGLAVTLVTNMSQDSVTFADVAVNFTKEEWTLLDPAQRNLYRDVMLENSRNLAFIDWATPCKTKDATPQPDILPKRTFPEANRVCLTSISSQHSTLREDWRCPKTEEPHRQGVNNVKPPAVAPEKDESPVSICEDHEMRNHSKPTCRLVPSQGDSIRQCILTRDSSIFKYNPVLNDSQKTHENNEDDGVLGWNIQWVPCGRKTELKSSTWTGSQNTVHHIRDEIDTGANRHQRNPFGKAFREDGSLRAHNTHGREKMYDFTQCENTSRNNSIHAMQMQLYTAETNKKDCQTGATSANAPNSGSHKSHCTGEKTHKCPECGRAFFYQSFLMRHMKIHTGEKP

SEQ ID NO: 880523 - protein, 199 aa, Homo sapiens
AQPTCTQVNKQPLLLTQSLFRWSSIRTRVTPRSSRRVWAAYTEGKKKPSFLGKCRKPASGRSLRSPQGGALAAQRARFPAGEPRNGGAGGGDSEDPRLGFPTWIRSAWGFDPHPGAAPRRSWAARAFGLRHRQRHLEAGASGRLCLTCLLEGNTGKPGLAVTLVTNMSQDSVTFADVAVNFTKEEWTLLDPAQRNLTEM

SEQ ID NO: 880524 - protein, 543 aa, Homo sapiens
AQPTCTQVNKQPLLLTQSLFRWSSIRTRVTPRSSRRVWAAYTEGKKKPSFLGKCRKPASGRSLRSPQGGALAAQRARFPAGEPRNGGAGGGDSEDPRLGFPTWIRSAWGFDPHPGAAPRRSWAARAFGLRHRQRHLEAGASGRLCLTCLLEGNTGKPGLAVTLVTNMSQGLALLPRLDCSGRIIAYCNLHLPGSGNPPSSASRVAETTGTRPHSRDSVTFADVAVNFTKEEWTLLDPAQRNLYRDVMLENSRNLAFIDWATPCKTKDATPQPDILPKRTFPEANRVCLTSISSQHSTLREDWRCPKTEEPHRQGVNNVKPPAVAPEKDESPVSICEDHEMRNHSKPTCRLVPSQGDSIRQCILTRDSSIFKYNPVLNDSQKTHENNEDDGVLGWNIQWVPCGRKTELKSSTWTGSQNTVHHIRDEIDTGANRHQRNPFGKAFREDGSLRAHNTHGREKMYDFTQCENTSRNNSIHAMQMQLYTAETNKKDCQTGATSANAPNSGSHKSHCTGEKTHKCPECGRAFFYQSFLMRHMKIHTGEKP

SEQ ID NO: 880525 - protein, 297 aa, Homo sapiens
MLENSRNLAFIDWATPCKTKDATPQPDILPKRTFPEANRVCLTSISSQHSTLREDWRCPKTEEPHRQGVNNVKPPAVAPEKDESPVSICEDHEMRNHSKPTCRLVPSQGDSIRQCILTRDSSIFKYNPVLNDSQKTHENNEDDGVLGWNIQWVPCGRKTELKSSTWTGSQNTVHHIRDEIDTGANRHQRNPFGKAFREDGSLRAHNTHGREKMYDFTQCENTSRNNSIHAMQMQLYTAETNKKDCQTGATSANAPNSGSHKSHCTGEKTHKCPECGRAFFYQSFLMRHMKIHTGEKP

SEQ ID NO: 880526 - protein, 110 aa, Homo sapiens
PPRSKETQSPPLHRGLDITTENPTNRKTRTQQVIHAAYIAIQTSKIIDEQEAKATPISRGITWMPKESALAISDGESNRCQMSAPGFLPYRRGILDRLDRPHSVTQAGVQ

SEQ ID NO: 880527 - protein, 118 aa, Homo sapiens
ARQLHRLANIIGLLQSRPSQAKVFEGSPQRKEDPFIIWIHPWPSVMVKATDVRCQPLASCLTVEGYSTDWTDHSCWGKPGVMSWGIQVLCLKDRLADLCIRPCSEKLDPQLKTLKETS

SEQ ID NO: 880528 - protein, 79 aa, Homo sapiens
KLKEPAKTAEGEAEGCRACLVSLSNPSPQSPGSAPSAAGGSFRLAHAQCSRTRRQRPVQSGTSPRGPLPIPTGTSNIGH

SEQ ID NO: 880529 - protein, 76 aa, Homo sapiens
LYLGTTDRIMELTIFSLKVLPSPLHPGAGGLRGKGGSSSFSQASEEVNPANNCRNGLGSGSFLSPAPRQLQPCEKP

SEQ ID NO: 880530 - protein, 76 aa, Homo sapiens; identical to SEQ ID NO: 880529

SEQ ID NO: 880531 - protein, 330 aa, Homo sapiens
MAQLLEDSLFCEEFIQQCPAAVEVLNLVAQECSAGERLAVVEVQCERLRMLYRDCARPPPPPLQADRRQPKEITWSPSRVFPPVRACMFSSHLTSVTFLADPSAGGGLPRGTFIYATSPLPVQAPSFYWEIEIVSYGDTDDDTGPIVSFGFTTEAEKRDGAWTNPVGTCLFHNNGRAVHYNGSSLLQWKSVRLDVTLSPGDVAGIGWERTEGTPPPPGQPAKGRVYFTYCGQRLSPYLEDVSGGMWPVVHIQKKNTKTRANFGSRPFAYAEGQAHRNAADLCTDLAEEISANFEALPFAMASDSDNDAGTSIASDPGTHGPPCRIAAVAT

SEQ ID NO: 880532 - protein, 322 aa, Homo sapiens
DAAPKESAPTWELRELFSQIQHVPSTGERLAVVEVQCERLRMLYRDCARPPPPPLQADRRQPKEITWSPSRVFPPVRACMFSSHLTSVTFLADPSAGGGLPRGTFIYATSPLPVQAPSFYWEIEIVSYGDTDDDTGPIVSFGFTTEAEKRDGAWTNPVGTCLFHNNGRAVHYNGSSLLQWKSVRLDVTLSPGDVAGIGWERTEGTPPPPGQPAKGRVYFTYCGQRLSPYLEDVSGGMWPVVHIQKKNTKTRANFGSRPFAYAEGQAHRNAADLCTDLAEEISANFEALPFAMASDSDNDAGTSIASDPGTHGPPCRIAAVAT

SEQ ID NO: 880533 - protein, 84 aa, Homo sapiens
RSRGPSGLWKEPLEEREDATGPRRGSAPVSRMWLVSSETWLAQVEMCLSKCYHYCWDSKKSLQMPLMTSETIGSNPVNSLVKKA

SEQ ID NO: 880534 - protein, 84 aa, Homo sapiens; identical to SEQ ID NO: 880533

SEQ ID NO: 880535 - protein, 111 aa, Homo sapiens
MAGLLSLLWPFFQRFNLAETPEGNFPERPMLTKPWRGMSLNDRLPGTEKHAQNPRGYPVAFTSSSSGVTSGFVCITMNLSLEASSGLMPSLKHKSCTPQTPAEPGDLNIRQ

SEQ ID NO: 880536 - protein, 108 aa, Homo sapiens
SCHVHSAYTSDTLPPSLTFLENREHFLMNLVPSSPGVHGLTPTSTPPTDLEAPPPPTLASVAHRCLFPLNPNLSHLLAFRVWSLPTEEPGNHRTSHVFRRYFSSFSGW

SEQ ID NO: 880537 - protein, 76 aa, Homo sapiens
AALGHRTAALHRRLDALQAAAARLDHRRVKIQAVFLDNAVPDCQRCLRGKQQARGEDLGQRKKPSVLFAGLFFVSS

SEQ ID NO: 880538 - protein, 196 aa, Homo sapiens
MVVFINAKIKSLIKLFKKKTVSNLDEESRWTVHYTAPWHQQENVFLPTTRPPCVEDLHRQAKLNLKSVLRECDKLRHDGYRSSQYYSQGPTFAANASPFCDDYQDEDEETDQKCSLSSSEEERFISIRRPKTPASSDFSDLNTQTNWTKSLPLPTPEEKMRQQAQTVQADVVPINITASGTGQDDADGHSVYTPDH

SEQ ID NO: 880539 - protein, 208 aa, Homo sapiens
AALGHRTAALHRRLDALQAAAARLDHRRVKIPVSNLDEESRWTVHYTAPWHQQENVFLPTTRPPCVEDLHRQAKLNLKSVLRECDKLRHDGYRSSQYYSQGPTFAANASPFCDDYQDEDEETDQKCSLSSSEEERFISIRRPKTPASSDFSDLNTQTNWTKSLPLPTPEEKMRQQAQTVQADVVPINITASGTGQDDADGHSVYTPDH

SEQ ID NO: 880540 - protein, 114 aa, Homo sapiens
MVVFINAKIKSLIKLFKKKTVSNLDEESRWTVHYTAPWHQQENVFLPTTRPPCVEDLHRQAKLNLKSVLRECDKLRHDGYRSSQYYSQGPTFAANASPFCDDYQDEDEETDQKV

SEQ ID NO: 880541 - protein, 193 aa, Homo sapiens
QQTDVDIVTVLIYNVVSVSNLDEESRWTVHYTAPWHQQENVFLPTTRPPCVEDLHRQAKLNLKSVLRECDKLRHDGYRSSQYYSQGPTFAANASPFCDDYQDEDEETDQKCSLSSSEEERFISIRRPKTPASSDFSDLNTQTNWTKSLPLPTPEEKMRQQAQTVQADVVPINITASGTGQDDADGHSVYTPDH

SEQ ID NO: 880542 - protein, 316 aa, Homo sapiens
VNQLKTSMQSVLQEWKIYDQLYDEVNMMTIRFWYCMEHSKPVVLSLETLRCQVENLQSLQDEAESSEGSWEKLQEVIGKLKGLCPSVAEIIEEKCQNTHKRWTQVNQAIADQLQKAQSLLQLWKAYSNAHGEAAARLKQQEAKFQQLANISMSGNNLAEILPPALQDIKELQHDVQKTKEAFLQNSSVLDRLPQPAESSTHMLLPGPLHSLQRAAYLEKMLLVKANEFEFVLSQFKDFGVRLESLKGLIMHEEENLDRLHQQEKENPDSFLNHVLALTAQSPDIEHLNEVSLKLPLSDVAVKTLQNMNRQWIRATA

SEQ ID NO: 880543 - protein, 269 aa, Homo sapiens
MARNQVGNLQSLQDEAESSEGSWEKLQEVIGKLKGLCPSVAEIIEEKCQNTHKRWTQVNQAIADQLQKAQSLLQLWKAYSNAHGEAAARLKQQEAKFQQLANISMSGNNLAEILPPALQDIKELQHDVQKTKEAFLQNSSVLDRLPQPAESSTHMLLPGPLHSLQRAAYLEKMLLVKANEFEFVLSQFKDFGVRLESLKGLIMHEEENLDRLHQQEKENPDSFLNHVLALTAQSPDIEHLNEVSLKLPLSDVAVKTLQNMNRQWIRATA

SEQ ID NO: 880544 - protein, 230 aa, Homo sapiens
AAAAAGGQLLGDGGSPGRTEQPPPSPQSSSGFLYRRLKTQEKREMQKEILSVLGLPHRPRPLHGLQQPQPPALRQQEEQQQQQQLPRGEPPPGRLKSAPLFMLDLYNALSADNDEDGASEGERQQSWPHEAASSSQRRQPPPGAAHPLNRKSLLAPGSGSGGASPLTSAQDSAFLNDADMVMSFVNLVEYDKEFSPRQRHHKEFKFNLSQIPEGEVVTAAEFRIYKDCVM

SEQ ID NO: 880545 - protein, 108 aa, Homo sapiens
APVPAGVRRDRTWERGAPGSPRHRWWQALRFAESGRLDWKRRREGESGEEEEEEQEQEHGQGQSAKSSTQNLQVLDPDTDQIFWNSLSNKRLLQGQNTLPARDPSEFL

SEQ ID NO: 880546 - protein, 133 aa, Homo sapiens
NLLLVGFGITCLINNLHLQFVTFVLHTIVRGFFHSACGSLYAAVFPSNHFGTLTGLQSLISAVFALLQQPLFMAMVGPLKGEPFWVNLGLLLFSLLGFLLPSYLFYYRARLQQEYPANGMGPLKVLSGSEVTA

SEQ ID NO: 880547 - protein, 162 aa, Homo sapiens [sequence omitted]

SEQ ID NO: 880548 - protein, 112 aa, Homo sapiens
MLVVVSLTHSFISATVLSTTCTRGRGVNKIPFCLGGCPLPMGLAISRKAPQSSTLFWLCVKDVCEQAQSFAARMRGQSIPLHTHPGADRLVPPSLHACPSTGSFAAPAPPAP

SEQ ID NO: 880549 - protein, 139 aa, Homo sapiens
PHGHMRTQPYDVIYSPGSHQPRNPHMQTRVPMVNGTGLPHAAHRPRCTATQKPQSHVRCHRHRPLPEPGSRYLGRRRGCRGVAKPGCLAPWPSPTASLPQRAGWFLGRERWCHCLPGHCAIGPFRPRGCRCPVGGGGER

SEQ ID NO: 880550 - protein, 374 aa, Homo sapiens
MSSINADFAFNLYRRFTVETPDKNIFFSPVSISAALVMLSFGACCSTQTEIVETLGFNLTDTPMVEIQHGFQHLICSLNFPKKELELQIGNALFIGKHLKPLAKFLNDVKTLYETEVFSTDFSNISAAKQEINSHVEMQTKGKVVGLIQDLKPNTIMVLVNYIHFKAQWANPFDPSKTEDSSSFLIDKTTTVQVPMMHQMEQYYHLVDMELNCTVLQMDYSKNALALFVLPKEGQMESVEAAMSSKTLKKWNRLLQKGWVDLFVPKFSISATYDLGATLLKMGIQHAYSENADFSGLTEDNGLKLSNAAHKAVLHIGEKGTEAAAVPEVELSDQPENTFLHPIIQIDRSFMLLILERSTRSILFLGKVVNPTEA

SEQ ID NO: 880551 - protein, 330 aa, Homo sapiens
MSSINADFAFNLYRRFTVETPDKNIFFSPVSISAALVMLSFGACCSTQTEIVETLGFNLTDTPMVEIQHGFQHLICSLNFPKKELELQIGNALFIGKHLKPLAKFLNDVKTLYETEVFSTDFSNISAAKQEINSHVEMQTKGKVVGLIQDLKPNTIMVLVNYIHFKAQWANPFDPSKTEDSSSFLIDKTTTVQVPMMHQMEQYYHLVDMELNCTVLQMDYSKNALALFVLPKEGQMESVEAAMSSKTLKKWNRLLQKGWVDLFVPKFSISATYDLGATLLKMGIQHAYSENADFSGLTEDNGLKLSNTFPKTVPVSSETRRICSPHTGCP

SEQ ID NO: 880552 - protein, 384 aa, Homo sapiens
MSSINADFAFNLYRRFTVETPDKNIFFSPVSISAALVMLSFGACCSTQTEIVETLGFNLTDTPMVEIQHGFQHLICSLNFPKKELELQIGNALFIGKHLKPLAKFLNDVKTLYETEVFSTDFSNISAAKQEINSHVEMQTKGKVVGLIQDLKPNTIMVLVNYIHFKAQWANPFDPSKTEDSSSFLIDKTTTVQVPMMHQMEQYYHLVDMELNCTVLQMDYSKNALALFVLPKEGQMESVEAAMSSKTLKKWNRLLQKGWVDLFVPKFSISATYDLGATLLKMGIQHAYSENADFSGLTEDNGLKLSNRPAGFVLPTQAAHKAVLHIGEKGTEAAAVPEVELSDQPENTFLHPIIQIDRSFMLLILERSTRSILFLGKVVNPTEA

SEQ ID NO: 880553 - protein, 415 aa, Homo sapiens
MSPFLYLVLLVLGLHATIHCASPEGKVTACHSSQPNATLYKMSSINADFAFNLYRRFTVETPDKNIFFSPVSISAALVMLSFGACCSTQTEIVETLGFNLTDTPMVEIQHGFQHLICSLNFPKKELELQIGNALFIGKHLKPLAKFLNDVKTLYETEVFSTDFSNISAAKQEINSHVEMQTKGKVVGLIQDLKPNTIMVLVNYIHFKAQWANPFDPSKTEDSSSFLIDKTTTVQVPMMHQMEQYYHLVDMELNCTVLQMDYSKNALALFVLPKEGQMESVEAAMSSKTLKKWNRLLQKGWVDLFVPKFSISATYDLGATLLKMGIQHAYSENADFSGLTEDNGLKLSNAAHKAVLHIGEKGTEAAAVPEVELSDQPENTFLHPIIQIDRSFMLLILERSTRSILFLGKVVNPTEA

SEQ ID NO: 880554 - protein, 415 aa, Homo sapiens; identical to SEQ ID NO: 880553

SEQ ID NO: 880555 - protein, 364 aa, Homo sapiens
RLAGPLAVSRLLNDLCRLELDSSVTGVRRAAPARGKLETVLCSPHNLWVLEMEYYYCPSLLKLLRYLWDQLKQCFSRQPTEPKDTDTLVHEAGSQYGTWTEQCQSGESLATESPDSSATSTRKQPPSSRLSSLSSQTEPTSAGDQYDCSRDQRSTSVDHSSTDLESTDGMEGPPPPDACPEKRVDDFSFIDQTSVLDSSALKTRVQLSKRSRRRAPISHSLRRSRFSESESRSPLEDETDNTWMFKDSTEEKSPRKEESDEEETASKAERTPVSHPQRMPAFPGMDPAVLKAQLHKRPEVDSPGETPSWAPQPKSPKSPFQPGVLGSRVLPSSMDKDERSDEPSPQWLKELKSKKRQSLYENQV

SEQ ID NO: 880556 - protein, 364 aa, Homo sapiens; identical to SEQ ID NO: 880555

SEQ ID NO: 880557 - protein, 67 aa, Homo sapiens
RGKLETVLCSPHNLWVLEMEYYYCPSLLKLLRYLWVSGGGQCRLQDGVTSFPSPPASCQLCFLAVSG

SEQ ID NO: 880558 - protein, 107 aa, Homo sapiens
MCGVQNTGCWAVRFRFHVFVGVGRLLLFFSPRGGSFSNAPIILWVYVLQGIVVKTSRSRAFSRPKPRFSCKFGVCRGKSQNCFLFPGVSQGLGNRWQKRQNTYGAGN

SEQ ID NO: 880559 - protein, 85 aa, Homo sapiens
MEFCCVAQAGVQWRDLSSLQPPPSRFKLFSCLSLPSSQDYRRPPLRLASFCIFTRDEVLLIGQAGLELKLSTASAYQSAGITGVS

SEQ ID NO: 880560 - protein, 88 aa, Homo sapiens
SDRLDGQSMERPCQPVMAAAKDRYEVSQYVFQIHGGSTGMLGCKNKTRCILGSQEPGGRNSKPANAEGRLYVAKFCQQLKSSASRAQC

SEQ ID NO: 880561 - protein, 54 aa, Homo sapiens
MFFLWIFSVFCIFCFLFFFETGLTLSPRLQCSGMITAHCSLDLLGSSHPPTSAS

SEQ ID NO: 880562 - protein, 32 aa, Homo sapiens
EYENIQHPADKSHIIYHVIKSTRQAKEEESKT

SEQ ID NO: 880563 - protein, 90 aa, Homo sapiens
KHTGPGILSMANAGPNTNGSQFFICTAKTEWLDGKHVLFGKVKEGTNIVEAWSALGPGMARPARRSPLLTVDNSNKFDLCFILTTRPFLP

SEQ ID NO: 880564 - protein, 79 aa, Homo sapiens
MECVSASVFGLTLRFGMKRDRGATSVSEGLSDEMSPDSSYLYFLHYTVGTFLAQKACFTARWFLGAWALKAVDRASISS

SEQ ID NO: 880565 - protein, 104 aa, Homo sapiens
STKNTKIRRLRLGYCLSPGGRGCCEPRCASALNPGQQSETLSQKNQRPLWYEPWVYVSEFLSSLTTNLIKNYFWPGAVAHACNPSTLGGRGGRITRSGDRDHPG

SEQ ID NO: 880566 - protein, 80 aa, Homo sapiens
GDRLGRMKRAGVETMCPRWVSWGRRSSTLSDEPDGVLKLKTSAPAPLRSLGPRREFNFFCLDFIPIHPSLFFICLCTGLL

SEQ ID NO: 880567 - protein, 117 aa, Homo sapiens
PSEPGAGRTVVCHAQPLVRDQARVGEGGRAGLGLGLPEGVLARISFVHTLTLRPALGNAATKSILMTSTYLSGQLLPLSFLFLSLSFFLSFFLSFFLSFFLSFFLSFSFFLFLLSFF

SEQ ID NO: 880568 - protein, 137 aa, Homo sapiens
MRSTRRGFLRSSDFFWTLVLFLALFPWSRCPRRRVFHLGPLSTSHRSCAPVAARLPGTGQPPAPAAPAQASASPTSYFLGLAAAAASALGPPKWAAAPGNQNRYRFSSCASHQRHCLLPPSCQRPSSILFLTVPFLF

SEQ ID NO: 880569 - protein, 115 aa, Homo sapiens
MVTRGVAASESGPCSGGSPHCPTPSRPGSPQLRVLMCTVGAGSPVPVQMEGRGFMKQQRPTRHLGSRVGAVVGRGGAGRESEPPLHLLRTGKRVQLVGPLHAAVIKRPESSPSRA

SEQ ID NO: 880570 - protein, 275 aa, Homo sapiens
MLEGIRAHLLRSWEHPLPNNTLGMGRKERKGDARGVVDVPAKPRLLWRSFRPSLQEKAGPGCSTPRSCRLSRQVSVPSKPCATATPNTQTLGRDQTVTSPPSGLNMQIRAPGSSWDLSAEPRDSQFLSRRAGPRCRSLPGRGASGPDALQPPARGKRAGRPRHPRPRASSPSPRVQRSRPAASPYAGPAGPPRRAPHSELKSPWSSAAPKLSPRAGESSARAQGWARARGQWVQGPRLCHQPESRAQGRLGAGGIGAARGGFLAAPPLGPGGEGS

SEQ ID NO: 880571 - protein, 729 aa, Homo sapiens
MLEGIRAHLLRSWEHPLPNNTLGMGRKERKGDARGVVDVPAKPRLLWRSFRPSLQEKAGPGCSTPRSCRLSRQVSVPSKPCATATPNTQTLGRDQTVTSPPSGLNMQIRAPGSSWDLSAEPRDSQFLSRRAGPRCRSLPGRGASGPDALQPPARGKRAGRPRHPRPRASSPSPRVQRSRPAASPYAGPAGPPRRAPHSELKSPWSSAAPKLSPRAGNMGCIKSKGKDSLSDDGVDLKTQPVRNTERTIYVRDPTSNKQQRPVPESQLLPGQRFQTKDPEEQGDIVVALYPYDGIHPDDLSFKKGEKMKVLEEHGEWWKAKSLLTKKEGFIPSNYVAKLNTLETEEWFFKDITRKDAERQLLAPGNSAGAFLIRESETLKGSFSLSVRDFDPVHGDVIKHYKIRSLDNGGYYISPRITFPCISDMIKHYQKQADGLCRRLEKACISPKPQKPWDKDAWEIPRESIKLVKRLGAGQFGEVWMGYYNNSTKVAVKTLKPGTMSVQAFLEEANLMKTLQHDKLVRLYAVVTREEPIYIITEYMAKGSLLDFLKSDEGGKVLLPKLIDFSAQIAEGMAYIERKNYIHRDLRAANVLVSESLMCKIADFGLARVIEDNEYTAREGAKFPIKWTAPEAINFGCFTIKSDVWSFGILLYEIVTYGKIPYPGRTNADVMTALSQGYRMPRVENCPDELYDIMKMCWKEKAEERPTFDYLQSVLDDFYTATEGQYQQQP

SEQ ID NO: 880572 - protein, 400 aa, Homo sapiens
NRSQKSQPPVLKQTEEWFFKDITRKDAERQLLAPGNSAGAFLIRESETLKGSFSLSVRDFDPVHGDVIKHYKIRSLDNGGYYISPRITFPCISDMIKHYQKQADGLCRRLEKACISPKPQKPWDKDAWEIPRESIKLVKRLGAGQFGEVWMGYYNNSTKVAVKTLKPGTMSVQAFLEEANLMKTLQHDKLVRLYAVVTREEPIYIITEYMAKGSLLDFLKSDEGGKVLLPKLIDFSAQIAEGMAYIERKNYIHRDLRAANVLVSESLMCKIADFGLARVIEDNEYTAREGAKFPIKWTAPEAINFGCFTIKSDVWSFGILLYEIVTYGKIPYPGRTNADVMTALSQGYRMPRVENCPDELYDIMKMCWKEKAEERPTFDYLQSVLDDFYTATEGQYQQQP

SEQ ID NO: 880573 - protein, 231 aa, Homo sapiens
MSVQAFLEEANLMKTLQHDKLVRLYAVVTREEPIYIITEYMAKGSLLDFLKSDEGGKVLLPKLIDFSAQIAEGMAYIERKNYIHRDLRAANVLVSESLMCKIADFGLARVIEDNEYTAREGAKFPIKWTAPEAINFGCFTIKSDVWSFGILLYEIVTYGKIPYPGRTNADVMTALSQGYRMPRVENCPDELYDIMKMCWKEKAEERPTFDYLQSVLDDFYTATEGQYQQQP

SEQ ID NO: 880574 - protein, 198 aa, Homo sapiens
MLEGIRAHLLRSWEHPLPNNTLGMGRKERKGDARGVVDVPAKPRLLWRSFRPSLQEKAGPGCSTPRSCRLSRQVSVPSKPCATATPNTQTLGRDQTVTSPPSGLNMQIRAPGSSWDLSAEPRDSQFLSRRAGPRCRSLPGRGASGPDALQPPARGKRAGRPRHPRPRASSPSPRVQRSRPAALEHRETRPFGRGGCLI

SEQ ID NO: 880575 - protein, 312 aa, Homo sapiens
MLEGIRAHLLRSWEHPLPNNTLGMGRKERKGDARGVVDVPAKPRLLWRSFRPSLQEKAGPGCSTPRSCRLSRQVSVPSKPCATATPNTQTLGRDQTVTSPPSGLNMQIRAPGSSWDLSAEPRDSQFLSRRAGPRCRSLPGRGASGPDALQPPARGKRAGRPRHPRPRASSPSPRVQRSRPAASPYAGPAGPPRRAPHSELKSPWSSAAPKLSPRAGNMGCIKSKGKDSLSDDGVDLKTQPVRNTERTIYVRDPTSNKQQRPVPESQLLPGQRFQTKDPEEQGDIVVALYPYDGIHPDDLSFKKGEKMKVLEE

SEQ ID NO: 880576 - protein, 729 aa, Homo sapiens; identical to SEQ ID NO: 880571

SEQ ID NO: 880577 - protein, 708 aa, Homo sapiens
MLEGIRAHLLRSWEHPLPNNTLGMGRKERKGDARGVVDVPAKPRLLWRSFRPSLQEKAGPGCSTPRSCRLSRQVSVPSKPCATATPNTQTLGRDQTVTSPPSGLNMQIRAPGSSWDLSAEPRDSQFLSRRAGPRCRSLPGRGASGPDALQPPARGKRAGRPRHPRPRASSPSPRVQRSRPAASPYAGPAGPPRRAPHSELKSPWSSAAPKLSPRAGNMGCIKSKGKDSLSDDGVDLKTQPVPESQLLPGQRFQTKDPEEQGDIVVALYPYDGIHPDDLSFKKGEKMKVLEEHGEWWKAKSLLTKKEGFIPSNYVAKLNTLETEEWFFKDITRKDAERQLLAPGNSAGAFLIRESETLKGSFSLSVRDFDPVHGDVIKHYKIRSLDNGGYYISPRITFPCISDMIKHYQKQADGLCRRLEKACISPKPQKPWDKDAWEIPRESIKLVKRLGAGQFGEVWMGYYNNSTKVAVKTLKPGTMSVQAFLEEANLMKTLQHDKLVRLYAVVTREEPIYIITEYMAKGSLLDFLKSDEGGKVLLPKLIDFSAQIAEGMAYIERKNYIHRDLRAANVLVSESLMCKIADFGLARVIEDNEYTAREGAKFPIKWTAPEAINFGCFTIKSDVWSFGILLYEIVTYGKIPYPGRTNADVMTALSQGYRMPRVENCPDELYDIMKMCWKEKAEERPTFDYLQSVLDDFYTATEGQYQQQP

SEQ ID NO: 880578 - protein, 185 aa, Homo sapiens
PRVRDPRVRGKVLLPKLIDFSAQIAEGMAYIERKNYIHRDLRAANVLVSESLMCKIADFGLARVIEDNEYTAREGAKFPIKWTAPEAINFGCFTIKSDVWSFGILLYEIVTYGKIPYPGRTNADVMTALSQGYRMPRVENCPDELYDIMKMCWKEKAEERPTFDYLQSVLDDFYTATEGQYQQQP

SEQ ID NO: 880579 - protein, 421 aa, Homo sapiens
MLEGIRAHLLRSWEHPLPNNTLGMGRKERKGDARGVVDVPAKPRLLWRSFRPSLQEKAGPGCSTPRSCRLSRQVSVPSKPCATATPNTQTLGRDQTVTSPPSGLNMQIRAPGSSWDLSAEPRDSQFLSRRAGPRCRSLPGRGASGPDALQPPARGKRAGRPRHPRPRASSPSPRVQRSRPAASPYAGPAGPPRRAPHSELKSPWSSAAPKLSPRAGNMGCIKSKGKDSLSDDGVDLKTQPVRNTERTIYVRDPTSNKQQRPVPESQLLPGQRFQTKDPEEQGDIVVALYPYDGIHPDDLSFKKGEKMKVLEEHGEWWKAKSLLTKKEGFIPSNYVAKLNTLETEEWFFKDITRKDAERQLLAPGNSAGAFLIRESETLKGRKLFKASFKTLFRKLFLETILELLKGKKGHIVCSGSKSFMV

SEQ ID NO: 880580 - protein, 102 aa, Homo sapiens
MITKKEKPFFSIGYSRAWVAWQPSCSQLEDKQHTEATLDLIRSGRRSIKSSLARFQIRKESVCSQPQQRKQLSWLRIKFFIREEISALTPNSNIRFRDFIIF

SEQ ID NO: 880581 - protein, 442 aa, Homo sapiens
LTCPTAAPCLCLHPGEPRAGRGRGGGTSGELKPRLSPRWRPEAKMMSLLGGLQRYFRVILLLLLALTLLLLAGFLHSDLELDTPLFGGQAEGPPVTNIMFLKTHKTASSTVLNILYRFAETHNLSVALPAGSRVHLGYPWLFLARYVEGVGSQQRFNIMCNHLRFNLPQVQKVMPNDTFYFSILRNPVFQLESSFIYYKTYAPAFRGAPSLDAFLASPRTFYNDSRHLRNVYAKNNMWFDFGFDPNAQCEEGYVRARIAEVERRFRLVLIAEHLDESLVLLRRRLRWALDDVVAFRLNSRSARSVARLSPETRERARSWCALDWRLYEHFNRTLWAQLRAELGPRRLRGEVERLRARRRELASLCLQDGGALKNHTQIRDPRLRPYQSGKADILGYNLRPGLDNQTLGVCQRLVMPELQYMARLYALQFPEKPLKNIPFLGA

SEQ ID NO: 880582 - protein, 192 aa, Homo sapiens
VQEECRTAKGDIEISLYTVEKKKKPSYTTQRNDYEPSCGRSLRRTQRKRQHTYQTRSNIEHNSQASCQNSGVQEDSDSSSEEDETVGTSDASVEDPVVEWQSESSSSDSSSEYSDWTADAGINLQPPKRQTRQTTRKICSSSDEENLKSLEERQKKPKQTRKKKGGLVSIAGEPNEEWFAPQWILDTIPRRS

SEQ ID NO: 880583 - protein, 203 aa, Homo sapiens
PTTTKFAAASTIEQDYWQVPRKGVKAKEVFQRFLESQMVIEESILQSDKALTDREKAVAVDRAKKEAAEKEQELLKQKLQEQQQQMEAQVKSRKENIAQLKEKLQMEREHLLREQIMMLEHTQKVQNDWLHEGFKKKYEEMNAEISQFKRMIDTTKNDDTPWIARTLDNLADELTAILSAPAKLIGHGVKGVSSLFKKHKLPF

SEQ ID NO: 880584 - protein, 260 aa, Homo sapiens
DENQEFQKKFMETTMNKKGDFLLQNEESSVQYCQAKLNELSKGLMESISAGSFSVPGGHKLYMETKERIEQDYWQVPRKGVKAKEVFQRFLESQMVIEESILQSDKALTDREKAVAVDRAKKEAAEKEQELLKQKLQEQQQQMEAQVKSRKENIAQLKEKLQMEREHLLREQIMMLEHTQKVQNDWLHEGFKKKYEEMNAEISQFKRMIDTTKNDDTPWIARTLDNLADELTAILSAPAKLIGHGVKGVSSLFKKHKLPF

SEQ ID NO: 880585 - protein, 65 aa, Homo sapiens
PCLENAVITLAQRENSAAVQRAADYYSQQMAQRVKLPTDTLQELLDMHAACEREAIAIFMEHSFK

SEQ ID NO: 880586 - protein, 217 aa, Homo sapiens
EDCAFECPWQRHASAFWKPALQLRVERCLLEVVVELQIRAISCPGVFLPGKQDVYLGVYLMNQYLETNSFPSAFPIMIQESMRFEKVFESAVDPGAVVDLLEMWDELAYYEENTRDFLFPEPKLTPSHPRRCREVLMKTALGFPGIAPKIEFSTRTAIRECVFLHRNRFLGWGNKGKMLVQQEHRSLKKKLNRNGTQTSGEGLLSWMLLQEFEGRKT

SEQ ID NO: 880587 - protein, 102 aa, Homo sapiens
MGPRPLEKGCFPGCFFRNSKEERHESRRPLSTSHEPIFPLNTIKMKLKENNLNRLPKGMQARAPSQYSTRHFFQDQPAQLNLGNNFKISGGSKPPFVVRHVS

SEQ ID NO: 880588 - protein, 100 aa, Homo sapiens
AGKAHMTPGMSHRQWQTAQRVGNAQCLSVPTEKEHSSFQTTSLLTEVPELEEHQDPGKAPAQLLRSLPSASPSAPVALVWTSGTGCLRGNGYGRLSGQSR

SEQ ID NO: 880589 - protein, 112 aa, Homo sapiens
PPGEAAGAAADGIAAYSNYNNGHRKFLAAAHNPADEPGPGAPAPQELGAADKHGDLREVSLTSSAQGEAREDPLLDKPTAQPIVQDHQEHPGLGSNCCVPLFCWAWLPRRRR

SEQ ID NO: 880590 - protein, 112 aa, Homo sapiens
MRRRPDRLEGGAGMWGLGGPCARSPRGMTGMHVPWLQSEPLSPESGVAAAGKQEPGFIISRRGRGAGSSSNSVITHGKRKSKGSSKRIPPSKNASLGEGPYLTPSFWPPPLP

SEQ ID NO: 880591 - protein, 124 aa, Homo sapiens
VKYYEQDLALAKDLHDKLSQAKAYCNLGLAFKALLNFSKAEECQKYLLSLAQSLNNSQAKFRALGNLGDIFICKKDINGAIKFYEQQLGLAHQVKDRRLEASAYAALGTAYRMIQKYDKALGYH

SEQ ID NO: 880592 - protein, 90 aa, Homo sapiens
QVSAGSEGVSHASIWRTNIPVRGFSKCKIPDVGMRSVPHYLHSRTQADKAAPSGAIDGLMEETKKDHSESHSASELFCLEVTNIISITFH

SEQ ID NO: 880593 - protein, 77 aa, Homo sapiens
GRATSRQKSAQIICVLPDDFLQTQHFHVTSSQIKKQNLPGASWCPLNHYPSSQDLGTEVTLSFHLDSCLFVGRSPSS

SEQ ID NO: 880594 - protein, 101 aa, Homo sapiens
MVNSGHPGLIQDMLLPPEKAPQAASRVLVVSESSLSLRSDLGLAGLGSITGFCSPTAHQAGDSHTAYYFVCHQSIARTQHFKYADLVSHSLKTNRATEILN

SEQ ID NO: 880595 - protein, 110 aa, Homo sapiens
GLSFSSYKTTSSTSMIICQWINPFTRAEPSCSNHLLKAIPLNTATLEIKFQHKFWREYSNHRSSFLCIFMHACTHVCRDTERTREAENAYIHLYIKSIYVHIYEVVEIEP

SEQ ID NO: 880596 - protein, 126 aa, Homo sapiens
AEQVVSVWFDGGAKAFQIQNSFLFCSQQPQSRLKVSGKIQIISWEEVREWINLLSFLVENFPRYWDSEQMCHYWWGGEVKESLARLFSAATRDCGGACTHSQLLLETSARLSLGACGPCLAHCSGE

SEQ ID NO: 880597 - protein, 131 aa, Homo sapiens
RSSIHLSIYSSIIQSLTHPASTNWEPPMDEEPYQMLRGMEFRGSASSSPRLAMIWKVVATHHATGGHSSGWQSSCAPGLSSTKASLSVHGHFEDSRALSFHLLFIGSMPLSLPYIGLPLSFCFLCISSSPF

SEQ ID NO: 880598 - protein, 124 aa, Homo sapiens
MFLRLLTLWEILTYGKCQNFSKRYSGPCVIFKPLFFLLFCIHSIVQSHGLPYLCSNMQLFSPSPCLGTGETWLPSAQGTFLPHLLCLESLCSPSGPPFTQPPLGCLPACLVGQPRTSLLPSDPF

SEQ ID NO: 880599 - protein, 77 aa, Homo sapiens
LLKLMWEKAIREGPDSLVLTCMVARNYEELSALLLLPWAAMTKSCIPYMDASSVLLKGLCSVVLRQLSVGCSLGKKL

SEQ ID NO: 880600 - protein, 124 aa, Homo sapiens
MGFHRAPVPPSGALVPLLPVEDALGVPFPTVPERACPCVSLCVQERVSVHEPVYLRARMPVCMRACVSLKKHMCLCACEPVCTSVCARVCEPVSERARARVCELVSLRVCVPMCELVCPREREP

SEQ ID NO: 880601 - protein, 111 aa, Homo sapiens
MLEHCGVLLPPNHSSVLHSQDFKYRLDTDGSQIYISTYFYNQKTNGTKTGTLIYCRWACKLEMFSGKAVRQFLSKLKMHTPSSPTSRNVSKNTPAFLKNDCIQNYMLQPCL

SEQ ID NO: 880602 - protein, 72 aa, Homo sapiens
CLSSFDPLRPSWPAGLAGTMPHLTDSETEGRYVQQKGEENSHLPAVPAWKALRCWAQNVTGPSPSFSGCSFC

SEQ ID NO: 880603 - protein, 92 aa, Homo sapiens
NTKWRMTPVQRGGPEALVALGWGTAVASAEVSAVAFWGRGRGLWTGAWGLMACGARGGKAEDKEWMPVTKLGRLVKDMKIKSLEEIYLFSLP

SEQ ID NO: 880604 - protein, 39 aa, Homo sapiens
ATYLSILAVLSADLQARPTVLMYVTRGWFLITNAARCSG

SEQ ID NO: 880605 - protein, 153 aa, Homo sapiens
GGAARWLWPRRAVGPARRPLSSGSPPLEKLFARGGPLRTFLERQAGSEAHLKVRRPELLAVIKLLNEKEQELRETEHLLHDENEGLRKLAENEITLCQKEITQLKHQIILLLVPSEETDENDLILEVTAGVGGGLRHASASIGGSEAYRHMKF

SEQ ID NO: 880606 - protein, 46 aa, Homo sapiens
MTTPIILTDLWGGINVSIVNVIISIIISEAPRFPSYLPKAQACLHL

SEQ ID NO: 880607 - protein, 130 aa, Homo sapiens
GTTVAFTVVLLASFKLMTWDPAVFTADTGRKAVATGLIVTCLGVGSAEETALVTTADWRGTLAGEERVAADAGDDRRDVTEAITDTVCSEGFFPESRSTSGNTLVTVLLISPEDVLVVFMRTLGIGGVDP

SEQ ID NO: 880608 - protein, 42 aa, Homo sapiens
REGGKSQKLMLFMRGNAISGAPIIRGTSQLPKPPIMMGITMK

SEQ ID NO: 880609 - protein, 165 aa, Homo sapiens
MELFLCPHIISAIVVITNRVNSCKTSNGEVVTCVIKEEMPPTRCLRIWLERGNKVYDIVTPIQCLCELTLCVENNVNGQKFCALEDISLVQSFEHRLTHLVSSPVDSLSLENVCKENDQKKKEAKEKGTWVQLKRQPAPPREAHFVRTNGKEPELLEPIPYEFMA

SEQ ID NO: 880610 - protein, 147 aa, Homo sapiens
MFFRPFRKHGVVPLATYMRIYKKGDIVDIKGMGTVQKGMPHKCYHGKTGRVYNVTQHAVGIVVNTQVKGKILAKRINVFIEHIKHSKSRDSFLKRMKENDQKKKEAKEKGTWVQLKRQPAPPREAHFVRTNGKEPELLEPIPYEFMA

SEQ ID NO: 880611 - protein, 113 aa, Homo sapiens
MDMKGLWKVQSHLLMRGMTEPSLQSDLWTCSQFLEKCGPCSSVTENTEFQRASLGQGLCKRVVRGTSNPGNLVAGRGLGPLPHAPWDLHCDCPTPSAQLLPHQLPCIALSWDP

SEQ ID NO: 880612 - protein, 69 aa, Homo sapiens
TQTLGVKRLLGRPRTKRTGSTQRPKGEKLRVCFVAQLCQISLLPRPYPTLKSPSQNSLEDIRVVAWWFL

SEQ ID NO: 880613 - protein, 111 aa, Homo sapiens
WGAGACTLGLATSLFSSPSGFILKHLEHKSCRSTQCILYRPGLGSPALLPSLSPLFSLSLPLSLLHTLLFCQTIQMQAADSKTILPAPLSTPFPVIAMLMRVCLRGSPLVP

SEQ ID NO: 880614 - protein, 125 aa, Homo sapiens
QPPASSTIPALAHQLSHVTFVSGELQMHQTHPALGPLCQLFLLPDRFSLSSLHVLSDTQVSIPMSPSQSGRFSDHPFSNSFPGTNTSSWPFTVDLFAHLCILCLPLLKCKLFESGDLAMSIFPLL

SEQ ID NO: 880615 - protein, 111 aa, Homo sapiens
MLRLFETYLEGCPQLILQLYILLEHGQANFSQYAAIMVSCCAISWSTVDYQVALRKSLPDKKLLNGLCPKITYLFYKLFTLLSWMLSVVLLLFLNVKIALFLLLFLWLSRY

SEQ ID NO: 880616 - protein, 133 aa, Homo sapiens
MCLCSQSGAVFYVHATRCCAALGVCEPQPRAATRKILLIMKAQNHMDRLESRQSSTVFSRGCVCVCMRVCACVSVCVCVCLGLKGSGSLGTLGAPGRPVTFSSGPEWWLPRFCFIIICQALCTFYAVSLSVCA

SEQ ID NO: 880617 - protein, 82 aa, Homo sapiens
ETSGMCLTYLSCFTSHYSKSNLCSSHTDVSAVPLTDYITTYLSAFAQSVTCLTVLYLLQDATKYLSHSKKFFGPIRNNYTDP

SEQ ID NO: 880618 - protein, 347 aa, Homo sapiens
AHIQDGVPRSWERVTGGGEAAWVGPQIAGSGGISPGKPLARLQGLPPARAMAAENSKQFWKRSAKLPGSIQPVYGAQHPPLDPRLTKNFIKERSKVNTVPLKNKKASSFHEFARNTSDAWDIGDDEEEDFSSPSFQTLNSKVALATAAQVLENHSKLRVKPERSQSTTSDVPANYKVIKSSSDAQLSRNSSDTCLRNPLHKQQSLPLRPIIPLVARISDQNASGAPPMTVREKTRLEKFRQLLSSQNTDLDELRKCSWPGVPREVRPITWRLLSGYLPANTERRKLTLQRKREEYFGFIEQYYDSRNEEHHQDTYRQIHIDIPRTNPLIAVVHSNQLYRRSLKEFYY

SEQ ID NO: 880619 - protein, 136 aa, Homo sapiens
SLGDRVRLCLKQTNKKTNKNSIPCRSTGLSHLFVHLYFYSNNTCHPSTPQPTSRAPSMPHSTCPGVADLLPLLSPPRSGSSVRPDILLVLFTQVPRTVLSTKQMLPNYEYQCMLRRTNEQTNGECLLCATRHCYAL

SEQ ID NO: 880620 - protein, 165 aa, Homo sapiens
NHQSSLARHHILHTGEKPYKCEECDKVFSQKSTLERHKRIHTGEKPYKCKVCDTAFTCNSQLARHRRIHTGEKTYKCNECRKTFSRRSSLLCHRRLHSGEKPYKCNQCGNTFRHRASLVYHRRLHTLEKSYKCTVCNKVFMRNSVLAVHTRIHTAKKPYKCNECG

SEQ ID NO: 880621 - protein, 101 aa, Homo sapiens
AVMDWVWTDTTLSLSSWICVEDIYAHIFILKCWRESEKRYPQPRGQKKKKVVKYGMGGMIIVLLICIVWFPLLFMSLIKSVAGVINQPLDVSVTITLGGYQ

SEQ ID NO: 880622 - protein, 123 aa, Homo sapiens
HQFDVISPSHIWIFAHVTQGQDPWIISLSSFLKQENLPKHCSTAVSYAWMFAYTRLQLLSPQVDINSPINAKKVNTTTSSDSYIGLWRNYLILCCSAATSSSSTSAGSVRCSPPETLASTPDS

SEQ ID NO: 880623 - protein, 79 aa, Homo sapiens
RPFKPTQNPTRTRRLPLGYTRYVDIEPTLSCLTSGQVVVLLALLKPSFFLLPIKTGELLGFPVYASRKKKSIAIKKLKN

SEQ ID NO: 880624 - protein, 363 aa, Homo sapiens
MAVGCPEPLQPHPPPWLAHCPIAGCPHRPLADLTGASPGQGCQGAGHHQRPHPGPCRPLLSLREGVTVIGPPWMGRPGGQPHSWTDAATSGHTVSGRCHIWAYSVWTLPHGATVMQVISDLSAPQSHSVSGQPGHWTLLSWVTATWSLAMPVCPTDLIYVRTAWMLPRKVTAVASLAMSGCPIVTEHLDTATCSHHHVTFKNNSWPGPVLPTYPCIPSLDPGHAGLTGDRAQAAGAPTKLCPTSRTDCPGQRCSPFRASVSLSVKQSDTSKPVSIVYIADMEVLQQEVLNKHKATEGWEKQTTQTNTPHHTKQTKQKQSPGAFFAGPRTTEGYTRDHVVSTCVSLHPFLQRGENAEAPEREEV

SEQ ID NO: 880625 - protein, 141 aa, Homo sapiens
HRTVVPGPSPRQPQQAALPQKQLVAPDLTMTRCALLLLMVLMLGRVLVVPVTPIPTFQLRPQNSPQTTPRPAASESPSAAPTWPWAAQSHCSPTRHPGSRIVLSLDVPIGLLQILLEQARARAAREQATTNARILARVGHC

SEQ ID NO: 880626 - protein, 105 aa, Homo sapiens
MAPGGCTSFGHCVFISFKRQERGQLACHCCSHSVGLNEVIRHIQCQDAQEGSSCSGAAMRPLKFRCFISEEEGQQRRLCLQLDSKPGPQERGGGKQTTPLAGHPS

SEQ ID NO: 880627 - protein, 185 aa, Homo sapiens
RRTLAVITKLDLMDAGTDAMDVLMGRVIPVKLGIIGVVNRSQLDINNKKSVTDSIRDEYAFLQKKYPSLANRNGTKYLARTLNRLLMHHIRDCLPELKTRINVLAAQYQSLLNSYGEPVDDKSATLLQLITKFATEYCNTIEGTATHHIETSELCGGARIVIFCMRLWANLESVDHLVALTLLTF

SEQ ID NO: 880628 - protein, 154 aa, Homo sapiens
LWLSASQVNNNGIISFLKEVSQFTPVAFPIAKDRCVVAAFWADVDNRRAGDVYYREATDPAMLRRATEDVRHYFPELLDFNATWVFVATWYRVTFFGGSSSSPVNTFQTVLITDGKLSFTIFNYESIVWTTGTHASSGGNATGLGGIAAQVGEC

SEQ ID NO: 880629 - protein, 174 aa, Homo sapiens
MMLPYPSALGDQYWEEILLPKNGENVETMKKLTQNHKAKGLPSNDTDCPQKKEGKAQIVVPVTFRDVTVIFTEAEWKRLSPEQRNLYKEVMLENYRNLLSLDGVSLLLPRLECNRAISAHHNLCLPGSSNSPATASRVVGITAEPKPEIYTCSSCLLAFSCQQFLSQHVLQIFL

SEQ ID NO: 880630 - protein, 133 aa, Homo sapiens
MMLPYPSALGDQYWEEILLPKNGENVETMKKLTQNHKAKGLPSNDTDCPQKKEGKAQIVVPVTFRDVTVIFTEAEWKRLSPEQRNLYKEVMLENYRNLLSLAEPKPEIYTCSSCLLAFSCQQFLSQHVLQIFL

SEQ ID NO: 880631 - protein, 118 aa, Homo sapiens
MMLPYPSALGDQYWEEILLPKNGENVETMKKLTQNHKAKGLPSNDTDCPQKKEGKAQIVVPVTFRDVTVIFTEAEWKRLSPEQRNLYKEVMLENYRNLLSLGQEIETILANIVKSHLY

SEQ ID NO: 880632 - protein, 118 aa, Homo sapiens; identical to SEQ ID NO: 880631

SEQ ID NO: 880633 - protein, 113 aa, Homo sapiens
MMLPYPSALGDQYWEEILLPKNGENVETMKKLTQNHKAKGLPSNDTDCPQKKEGKAQIVVPVTFRDVTVIFTEAEWKRLSPEQRNLYKEVMLENYRNLLSLDGGQEQQDAAAY

SEQ ID NO: 880634 - protein, 86 aa, Homo sapiens
DSLNASPSSSSESYYQQIELTGKSHNPGQSEQTPKSIPGQHRSKSVASAEIISNFSMAGIQLIWDEPISNGVSADTDLGRHQVDRI

SEQ ID NO: 880635 - protein, 101 aa, Homo sapiens
ALRLQPSCQRRLPRPPPPDSAPGTCQPRAACADFPETRRGRHGDFLGSGWFVRCSPSPTPDAADRSSSAPQPRSPAAPQRRRGQCSRVASPSREQPLFDVL

SEQ ID NO: 880636 - protein, 185 aa, Homo sapiens
ALRLQPSCQRRLPRPPPPDSAPGTCQPRAACADFPETRRGRHGDFLGSGWFVRCSPSPTPDAADRSSSAPQPRSPAAPQRRRGQCSRVASPSREVSGSLDPGGFRRGGCGAVVGGERRRGGPGTFAGTAGVCDTQTGSVSQKIREKVIIGLLGCVDRESRYWLQHRQGSAEALRMAPVCCITTNS

SEQ ID NO: 880637 - protein, 138 aa, Homo sapiens
MNLKDILADLIPKEQARIKTFRQQHGKKVVGQITVDMMYGGMRGMKGLVYETSVLDPDEGIRFRGFSIPECQKLLPKAKGGEEPLPEGLYWLLVTGCIPTEEQVSWLSKEWAKRAALPSHVVTMLDNFPTNLHPMSQL

SEQ ID NO: 880638 - protein, 122 aa, Homo sapiens
GLCGCLSSVVWSGFGVAVVWVSCVLVWLGWSFVWARGAYDAGPLDRAPALGCLDAGSPPFFWGGTRAWLAEVFLGPAVAVSSLVGGAPRDGFKNFSGEAPKSFFWVFFMWGMESSCVTQARV

SEQ ID NO: 880639 - protein, 279 aa, Homo sapiens
FWASLLLRAGDKAGRAGAGMPPYHRRVGMVQELLRMVRQGRREEAGTLLQHLRQDLGMESTSLDDVLYRYASFRNLVDPITHDLIISLARYIHCPKPEGDALGAMEKLCRQLTYHLSPHSQWRRHRGLVKRKPQACLKAVLAGSPPDNTVDLSGIPLTSRDLERVTSYLQRCGEQVDSVELGFTGLTDDMVLQLLPALSTLPRLTTLALNGNGDPAVLRDLTDILKDPSKFPNVTWIDLGNNVDIFSLPQPFLLSLRKRSPKQGHLPTILELGEGPGSG

SEQ ID NO: 880640 - protein, 110 aa, Homo sapiens
MTEWPSPGKTSVVTGIKLWNIRVKARVCCELELRECLGIPPGISKGTMATASLAHVRHLLCQAFSVVEKGGRRMQLFQCCLAVPKSRDWAPHLTSNFRFTLGHSCLPLQS

SEQ ID NO: 880641 - protein, 69 aa, Homo sapiens
MRCLRLRIALQVKCRVQSQGEPRFHAAAARSAVAFAETKLPPPPSETRTRFSGPVSEDGLRHRRSASPA

SEQ ID NO: 880642 - protein, 181 aa, Homo sapiens
WYTTQAPSTTFYAFLVRSRLRPRVLALCKLFGASVCFTRFSASFELDHVPGPLCLAWRTLVDVTSAQKPRSLNKPWAAQGWALAQDLGLQSIGTGTPELPLKPQVGRAILPLHSRYENHVCGPAQQPSTQCEMNNGAHPSEDNDFYINYKDIDLASQPVYCNLQSLGQAPMDEEEYVIPGH

SEQ ID NO: 880643 - protein, 34 aa, Homo sapiens
AEHPFTKREAEPWQRKGVCSGPHTETWDPGSEST

SEQ ID NO: 880644 - protein, 174 aa, Homo sapiens
MSRRRKEAFSSQGSLQAVFLQMKTFYRYSDDWNLLSLVDMGGPRLVSQPLGGEANHPLRPELKTTVAHWCNPVSSKRPNSWQLGRTWTPNRRREGDITRGVVLRPAWCAYPSGRRCSSKKKGGRITGQQPYKHSNKKAGPKRLNLLDQIFSFSFCLLSTPSTCISGREEQRGGD

SEQ ID NO: 880645 - protein, 350 aa, Homo sapiens
VAGTRAGASGSCSLLGACAVGMEASWRQVAGGRGRSRGRATAAPSGNGVHLRGAGGGREKGSVGAVPSGTSPGGVATTAAAGSRHSPAGSQALQTTAASELMSQKKFEEIKKANQAAARKLVEEQFSSSSEEGDEDFEGKQGKILANTFITYTTQTDGDTRELERTKQYVNEAFQAGAMTCLICIASVKRNQAVWSCSGCFCIFHMPCIQKWAKDSQFLVSSVTDDDFGKKDCPWPCPKCRFEYKRSETPSRYYCYCGKVEDPPLDPWLVPHSCGQVCEREFKPPCGHKCLLLCHPGPCPPCPKMVTTTCYCKKAKPIPRRCSAKEWSCQLPCGQKLLCGQHKCENPCHA

SEQ ID NO: 880646 - protein, 190 aa, Homo sapiens
ADPGDGPLPPLRTASSPCLKSFICIASVKRNQAVWSCSGCFCIFHMPCIQKWAKDSQFLVSSVTDDDFGKKDCPWPCPKCRFEYKRSETPSRYYCYCGKVEDPPLDPWLVPHSCGQVCEREFKPPCGHKCLLLCHPGPCPPCPKMVTTTCYCKKAKPIPRRCSAKEWSCQLPCGQKLLCGQHKCENPCHA

SEQ ID NO: 880647 - protein, 84 aa, Homo sapiens [sequence omitted]

SEQ ID NO: 880648 - protein, 84 aa, Homo sapiens [sequence omitted]

SEQ ID NO: 880649 - protein, 84 aa, Homo sapiens [sequence omitted]

SEQ ID NO: 880650 - protein, 956 aa, Homo sapiens
MSSGLWSQEKVTSPYWEERIFYLLLQECSVTDKQTQKLLKVPKGSIGQYIQDRSVGHSRIPSAKGKKNQIGLKILEQPHAVLFVDEKDVVEINEKFTELLLAITNCEERFSLFKNRNRLSKGLQIDVGCPVKVQLRSGEEKFPGVVRFRGPLLAERTVSGIFFGVELLEEGRGQGFTDGVYQGKQLFQCDEDCGVFVALDKLELIEDDDTALESDYAGPGDTMQVELPPLEINSRVSLKVGETIESGTVIFCDVLPGKESLGYFVGVDMDNPIGNWDGRFDGVQLCSFACVESTILLHINDIIPALSESVTQERRPPKLAFMSRGVGDKGSSSHNKPKATGSTSDPGNRNRSELFYTLNGSSVDSQPQSKSKNTWYIDEVAEDPAKSLTEISTDFDRSSPPLQPPPVNSLTTENRFHSLPFSLTKMPNTNGSIGHSPLSLSAQSVMEELNTAPVQESPPLAMPPGNSHGLEVGSLAEVKENPPFYGVIRWIGQPPGLNEVLAGLELEDECAGCTDGTFRGTRYFTCALKKALFVKLKSCRPDSRFASLQPVSNQIERCNSLAFGGYLSEVVEENTPPKMEKEGLEIMIGKKKGIQGHYNSCYLDSTLFCLFAFSSVLDTVLLRPKEKNDVEYYSETQELLRTEIVNPLRIYGYVCATKIMKLRKILEKVEAASGFTSEEKDPEEFLNILFHHILRVEPLLKIRSAGQKVQDCYFYQIFMEKNEKVGVPTIQQLLEWSFINSNLKFAEAPSCLIIQMPRFGKDFKLFKKIFPSLELNITDLLEDTPRQCRICGGLAMYECRECYDDPDISAGKIKQFCKTCNTQVHLHPKRLNHKYNPVSLPKDLPDWDWRHGCIPCQNMELFAVLCIETSHYVAFVKYGKDDSAWLFFDSMADRDGGQNGFNIPQVTPCPEVGEYLKMSLEDLHSLDSRRIQGCARRLLCDAYMCMYQSPTMSLYK

SEQ ID NO: 880651 - protein, 956 aa, Homo sapiens; identical to SEQ ID NO: 880650

SEQ ID NO: 880652 - protein, 937 aa, Homo sapiens
MSSGLWSQEKVTSPYWEERIFYLLLQECSVTDKQTQKLLKVPKGSIGQYIQDRSVGHSRIPSAKGKKNQIGLKILEQPHAVLFVDEKDVVEINEKFTELLLAITNCEERFSLFKNRNRLSKGLQIDVGCPVKVQLRSGEEKFPGVVRFRGPLLAERTVSGIFFGVELLEEGRGQGFTDGVYQGKQLFQCDEDCGVFVALDKLELIEDDDTALESDYAGPGDTMQVELPPLEINSRVSLKVGETIESGTVIFCDVLPGKESLGYFVGVDMDNPIGNWDGRFDGVQLCSFACVESTILLHINDIIPESVTQERRPPKLAFMSRGVGDKGSSSHNKPKATGSTSDPGNRNRSELFYTLNGSSVDSQPQSKSKNTWYIDEVAEDPAKSLTEISTDFDRSSPPLQPPPVNSLTTENRFHSLPFSLTKMPNTNGSIGHSPLSLSAQSVMEELNTAPVQESPPLAMPPGNSHGLEVGSLAEVKENPPFYGVIRWIGQPPGLNEVLAGLELEDECAGCTDGTFRGTRYFTCALKKALFVKLKSCRPDSRFASLQPVSNQIERCNSLAFGGYLSEVVEENTPPKMEKEGLEIMIGKKKGIQGHYNSCYLDSTLFCLFAFSSVLDTVLLRPKEKNDVEYYSETQELLRTEIVNPLRIYGYVCATKIMKLRKILEKVEAASGFTSEEKDPEEFLNILFHHILRVEPLLKIRSAGQKVQDCYFYQIFMEKNEKVGVPTIQQLLEWSFINSNLKFAEAPSCLIIQMPRFGKDFKLFKKIFPSLELNITDLLEDTPRQCRICGGLAMYECRECYDDPDISAGKIKQFCKTCNTQVHLHPKRLNHKYNPVSLPKDLPDWDWRHGCIPCQNMELFAVLCIETSHYVAFVKYGKDDSAWLFFDSMADRDGGQNGFNIPQVTPCPEVGEYLKMSLEDLHSLDSRRIPRLCTKTAL

SEQ ID NO: 880653 - protein, 937 aa, Homo sapiens; identical to SEQ ID NO: 880652

SEQ ID NO: 880654 - protein, 698 aa, Homo sapiens [sequence omitted]

SEQ ID NO: 880655 - protein, 515 aa, Homo sapiens
MPNTNGSIGHSPLSLSAQSVMEELNTAPVQESPPLAMPPGNSHGLEVGSLAEVKENPPFYGVIRWIGQPPGLNEVLAGLELEDECAGCTDGTFRGTRYFTCALKKALFVKLKSCRPDSRFASLQPVSNQIERCNSLAFGGYLSEVVEENTPPKMEKEGLEIMIGKKKGIQGHYNSCYLDSTLFCLFAFSSVLDTVLLRPKEKNDVEYYSETQELLRTEIVNPLRIYGYVCATKIMKLRKILEKVEAASGFTSEEKDPEEFLNILFHHILRVEPLLKIRSAGQKVQDCYFYQIFMEKNEKVGVPTIQQLLEWSFINSNLKFAEAPSCLIIQMPRFGKDFKLFKKIFPSLELIYQIYLKTLPDSAGYVEGLQCMSVENATTIRTFSAGKIKQFCKTCNTQVHLHPKRLNHKYNPVSLPKDLPDWDWRHGCIPCQNMELFAVLCIETSHYVAFVKYGKDDSAWLFFDSMADRDGGQNGFNIPQVTPCPEVGEYLKMSLEDLHSLDSRRIPRLCTKTAL

SEQ ID NO: 880656 - protein, 956 aa, Homo sapiens; identical to SEQ ID NO: 880650

SEQ ID NO: 880657 - protein, 956 aa, Homo sapiens; identical to SEQ ID NO: 880650

SEQ ID NO: 880658 - protein, 131 aa, Homo sapiens
MRLFLHDGQGGRSQQSVCILLCSGIIAPFILTLLWWLCSWLQPLSLPLSHLSPYITQSPSLPSHPLQGIPQDLPLVDGKVVATHSIDSQVPADVCWRDLMEQSGSGHSPQQLGSHVEGGSENGDVAAHQAG

SEQ ID NO: 880659 - protein, 728 aa, Homo sapiens
MATPGSEPQPFVPALSVATLHPLHHPHHHHHHHQHHGGTGAPGGAGGGGGGSGGFNLPLNRGLERALEEAANSGGLNLSARKLKEFPRTAAPGHDLSDTVQADLSKNRLVEVPMELCHFVSLEILNLYHNCIRVIPEAIVNLQMLTYLNLSRNQLSALPACLCGLPLKVLIASNNKLGSLPEEIGQLKQLMELDVSCNEITALPQQIGQLKSLRELNVRRNYLKVLPQELVDLPLVKFDFSCNKVLVIPICFREMKQLQVLLLENNPLQSPPAQICTKGKVHIFKYLSIQACQIKTADSLYLHTMERPHLHQHVEDGKKDSDSGVGSDNGDKRLSATEPSDEDTVSLNVPMSNIMEEEQIIKEDSCHRLSPVKGEFHQEFQPEPSLLGDSTNSGEERDQFTDRADGLHSEFMNYKARAEDCEELLRIEEDVHWQTEGIISSSKDQDMDIAMIEQLREAVDLLQDPNGLSTDITERSVLNLYPMGSAEALELQDSALNGQIQLETSPVCEVQSDLTLQSNGSQYSPNEIRENSPAVSPTTNSTAPFGLKPRSVFLRPQRNLESIDPQFTIRRKMEQMREEKELVEQLRESIEMRLKVSLHEDLGAALMDGVVLCHLVNHIRPRSVASIHVPSPAVPKLSMAKCRRNVENFLEACRKLGVPEADLCSPCDILQLDFRHIRKTVDTLLALGEKAPPPTSALRSRDLIGFCLVHILFIVLVYITYHWNALSA

SEQ ID NO: 880660 - protein, 68 aa, Homo sapiens
RLSTAVPKLSMAKCRRNVENFLEACRKLGVPEEKLCLPHHILEEKGLVKVGITIQALLDITVTKALFT

SEQ ID NO: 880661 - protein, 203 aa, Homo sapiens
HEGNDKVEQVTSAVCEVQSDLTLQMNGGKYSPLEMMENSCAISPTTESTRPFGLKSRSVFLRPQRNLESIDPQFTIRRKMEQMREEKELVEQLRESIEMRLKVSLHEDLGAALMDGVVLCHLVNHIRPRSVASIHVPSPAVPKLSMAKCRRNVENFLEACRKLGVPEEKLCLPHHILEEKGLVKVGITIQALLDITVTKALFT

SEQ ID NO: 880662 - protein, 696 aa, Homo sapiens
MATPGSEPQPFVPALSVATLHPLHHPHHHHHHHQHHGGTGAPGGAGGGGGGSGGFNLPLNRGLERALEEAANSGGLNLSARKLKEFPRTAAPGHDLSDTVQADLSKNRLVEVPMELCHFVSLEILNLYHNCIRVIPEAIVNLQMLTYLNLSRNQLSALPACLCGLPLKVLIASNNKLGSLPEEIGQLKQLMELDVSCNEITALPQQIGQLKSLRELNVRRNYLKVLPQELVDLPLVKFDFSCNKVLVIPICFREMKQLQVLLLENNPLQSPPAQICTKGKVHIFKYLSIQACQIKTADSLYLHTMERPHLHQHVEDGKKDSDSGVGSDNGDKRLSATEPSDEDTVSLNVPMSNIMEEEQIIKEDSCHRLSPVKGEFHQEFQPEPSLLGDSTNSGEERDQFTDRADGLHSEFMNYKARAEDCEELLRIEEDVHWQTEGIISSSKDQDMDIAMIEQLREAVDLLQDPNGLSTDITERSVLNLYPMGSAEALELQDSALNGQIQLETSPVCEVQSDLTLQSNGSQYSPNEIRENSPAVSPTTNSTAPFGLKPRSVFLRPQRNLESIDPQFTIRRKMEQMREEKELVEQLRESIEMRLKVSLHEDLGAALMDGVVLCHLVNHIRPRSVASIHVPSPAVPKLSMAKCRRNVENFLEACRKLGVPEEKLCLPHHILEEKGLVKVGITIQALLDITVTKALFT

SEQ ID NO: 880663 - protein, 696 aa, Homo sapiens; identical to SEQ ID NO: 880662

SEQ ID NO: 880664 - protein, 92 aa, Homo sapiens
AVLSFPGTGNLQDRAATAASPPAPHSTRLPTPSSPPSSAFRWSTAALSPSCRFPLAGNAVTPPQERRGGVGGPGRRWRRREANPNLSSRPFR

SEQ ID NO: 880665 - protein, 696 aa, Homo sapiens; identical to SEQ ID NO: 880662

SEQ ID NO: 880666 - protein, 277 aa, Homo sapiens
SLLVPCLYCRRLRFLLAPRHRCRRLRSLLTLWHRCRPLRPWASPCHCGQPGRASSGQRSRPLWSLLAQCQRYQPPRPLLTLRPRRRPASFLPGQCCCPRRAFLAPCQYGQPRRSLLGQPSRPRRSLLRPRQPQRLVEAPEQPGPLTPSLLGPGRPRQQKQPLMGPEQPCPPKRPLMGPEQPCQPLRPLMGPNKPCKPQPLLPIPDRPSLLGQPGPPCRPLLGLLCQPRRSLLDLVPARQPRLSLLALGHPCRPLRSRWTRSCAPGMARQAPSVSPGA

SEQ ID NO: 880667 - protein, 256 aa, Homo sapiens
PLLGQRSWPQRSLLGLKQPCQPRRSLLGPGQPCRPQRLLPSPDQLCQPQRSRPAQPCRPHWALPGPRQCCRRLRSLLTPCHHCRRLRSLLAPRSLLVPCLYCRRLRFLLAPRHRCRRLRSLLTLWHRCRPLRPWASPCHCGQPGRASSGQRSRPLWSLLAQCQRYQPPRPLLTLRPRRRPASFLPGQCCCPRRAFLAPCQYGQPRRSLLGQPSRPRRSLLRPRQPQRLVEAPEQPGPLTPSLLGPGRPRQQKQPLM

SEQ ID NO: 880668 - protein, 277 aa, Homo sapiens; identical to SEQ ID NO: 880666

SEQ ID NO: 880669 - protein, 115 aa, Homo sapiens
VCAVPLVFRLGPSWGAPSWRSQASGRGHLPTPWKGPGSDLDPRRENSYVEHVVFWPFLGRHLQRPLGPAGSEATNLPRPLFSLFLKFFCCGPAPALAPARHLLIGKPRTELDWPS

SEQ ID NO: 880670 - protein, 135 aa, Homo sapiens
MFLSFPTTKTYFPHFDLSHGSAQVKGHGKKVADALTNAVANVDDMPNALSALSDLHAHKLRVDPVNFKLLSHCLLVTLGRPPPRRVHPCGARLPGTSSWASVSTVLDLPNYRLSWEPSVSRASCPLGLPPAPPPL

SEQ ID NO: 880671 - protein, 135 aa, Homo sapiens; identical to SEQ ID NO: 880670

SEQ ID NO: 880672 - protein, 135 aa, Homo sapiens; identical to SEQ ID NO: 880670

SEQ ID NO: 880673 - protein, 64 aa, Homo sapiens
MFLSFPTTKTYFPHFDLSHGSAQVKGHGKKVADALTNAVANVDDMPRFKGHGKKVADALTNAVA

SEQ ID NO: 880674 - protein, 140 aa, Homo sapiens
MFLSFPTTKTYFPHFDLSHGSAQVKGHGKKVADALTNAVANVDDMPNALSALSDLHAHKLRVDPVNFKLLSHCLLVTLGRPPPRRVHPCGARLPGTSSWASVSTVLDLPNYRLSWEPSVSLSSCRLASNGPLPLDRPSWF

SEQ ID NO: 880675 - protein, 135 aa, Homo sapiens; identical to SEQ ID NO: 880670

SEQ ID NO: 880676 - protein, 104 aa, Homo sapiens
MMVVSVTMYHHEGGASMNFRWVTEDKSLRVVGLLPKGWDYGLEPQCPTHLTFLMPISSSEKQASHVIVPNEIAIFVGQKQLNIDSFIRYQPNNGTYLVGLLGGL

SEQ ID NO: 880677 - protein, 198 aa, Homo sapiens
MECVGTRINDISLGEPDLLATGVEREQSERFNVYLMPSPNLDVHGECALQITYEYICLWDVQNPRVKLISWPLSALRRYGRDTTWFTFEAGRMCETGEGLFIFQTRDGEAIYQKVHSAALAIAEQHERLLQSVKNSMLQMKMSERAASLSTMVPLPRSAYWQHITRQHSTGQLYRLQDVSSPLKLHRTETFPAYRSEH

SEQ ID NO: 880678 - protein, 304 aa, Homo sapiens
EIMNIENANFIEKKENLNEYIYQRCWLVFKKASSKGPKRLEKFSDERAAYFRCYHKVTELNNVKNVARLPKSTKKHAIGIYFNDDTSKTFACESDLEADEWCKVLQMECVGTRINDISLGEPDLLATGVEREQSERFNVYLMPSPNLDVHGECALQITYEYICLWDVQNPRVKLISWPLSALRRYGRDTTWFTFEAGRMCETGEGLFIFQTRDGEAIYQKVHSAALAIAEQHERLLQSVKNSMLQMKMSERAASLSTMVPLPRSAYWQHITRQHSTGQLYRLQDVSSPLKLHRTETFPAYRSEH

SEQ ID NO: 880679 - protein, 106 aa, Homo sapiens [sequence omitted]

SEQ ID NO: 880680 - protein, 306 aa, Homo sapiens [sequence omitted]

SEQ ID NO: 880681 - protein, 306 aa, Homo sapiens [sequence omitted]

SEQ ID NO: 880682 - protein, 308 aa, Homo sapiens
MIYQRCWLVFKKASSKGPKRLEKFSDERAAYFRCYHKVTELNNVKNVARLPKSTKKHAIGIYFNDDTSKTFACESDLEADEWCKVLQMECVGTRINDISLGEPDLLATGVEREQSERFNVYLMPSPNLDVHGECALQITYEYICLWDVQNPRVKLISWPLSALRRYGRDTTWFTFEAGRMCETGEGLFIFQTRDGEAIYQKVHSAALAIAEQHERLLQSVKNSMLQMHDELNGPPSAEPHWVALTSKSLLGQDITQDRHRPGHSLPGLAQGFQTLLKASFRAKKEFSTRDKYWTLEKADERLATTHVT

SEQ ID NO: 880683 - protein, 198 aa, Homo sapiens; identical to SEQ ID NO: 880677

SEQ ID NO: 880684 - protein, 118 aa, Homo sapiens
GRRQGWIPQPPPLLLLAGRPRSQLTPALQPRLPAPRSALPESGCKPAAHCQGWGDRESDVRLLKPRPAPPKQLHLSNFLPPTACLDPALHPPQSHFGCALLGKGGVTGCLGWLPILMT

SEQ ID NO: 880685 - protein, 1174 aa, Homo sapiens
MGNQLAGIAPSQILSVESYFSDIHDFEYDKSLGSTRFFKVARAKHREGLVVVKVFAIQDPTLPLTSYKQELEELKIRLNSAQNCLPFQKASEKASEKAAMLFRQYVRDNLYDRISTRPFLNNIEKRWIAFQILTAVDQAHKSGVRHGDIKTENVMVTSWNWVLLTDFASFKPTYLPEDNPADFNYFFDTSRRRTCYIAPERFVDGGMFATELEYMRDPSTPLVDLNSNQRTRGELKRAMDIFSAGCVIAELFTEGVPLFDLSQLLAYRNGHFFPEQVLNKIEDHSIRELVTQMIHREPDKRLEAEDYLKQQRGNAFPEIFYTFLQPYMAQFAKETFLSADERILVIRKDLGNIIHNLCGHDLPEKAEGEPKENGLVILVSVITSCLQTLKYCDSKLAALELILHLAPRLSVEILLDRITPYLLHFSNDSVPRVRAEALRTLTKVLALVKEVPRNDINIYPEYILPGIAHLAQDDATIVRLAYAENIALLAETALRFLELVQLKNLNMENDPNNEEIDEVTHPNGNYDTELQALHEMVQQKVVTLLSDPENIVKQTLMENGITRLCVFFGRQKANDVLLSHMITFLNDKNDWHLRGAFFDSIVGVAAYVGWQSSSILKPLLQQGLSDAEEFVIVKALYALTCMCQLGLLQKPHVYEFASDIAPFLCHPNLWIRYGAVGFITVVARQISTADVYCKLMPYLDPYITQPIIQIERKLVLLSVLKEPVSRSIFDYALRSKDITSLFRHLHMRQKKRNGSLPDCPPPEDPAIAQLLKKLLSQGMTEEEEDKLLALKDFMMKSNKAKANIVDQSHLHDSSQKGVIDLAALGITGRQVDLVKTKQEPDDKRARKHVKQDSNVNEEWKSMFGSLDPPNMPQALPKGSDQEVIQTGKPPRSESSAGICVPLSTSSQVPEVTTVQNKKPVIPVLSSTILPSTYQIRITTCKTELQQLIQQKREQCNAERIAKQMMENAEWESKPPPPGWRPKGLLVAHLHEHKSAVNRIRVSDEHSLFATCSNDGTVKIWNSQKMEGKTTTTRSILTYSRIGGRVKTLTFCQGSHYLAIASDNGAVQLLGIEASKLPKSPKIHPLQSRILDQKEDGCVVDMHHFNSGAQSVLAYATVNGSLVGWDLRSSSNAWTLKHDLKSGLITSFAVDIHQCWLCIGLESDASQCTLCISPG

SEQ ID NO: 880686 - protein, 717 aa, Homo sapiens
MCQLGLLQKPHVYEFASDIAPFLCHPNLWIRYGAVGFITVVARQISTADVYCKLMPYLDPYITQPIIQIERKLVLLSVLKEPVSRSIFDYALRSKDITSLFRHLHMRQKKRNGSLPDCPPPEDPAIAQLLKKLLSQGMTEEEEDKLLALKDFMMKSNKAKANIVDQSHLHDSSQKGVIDLAALGITGRQVDLVKTKQEPDDKRARKHVKQDSNVNEEWKSMFGSLDPPNMPQALPKGSDQEVIQTGKPPRSESSAGICVPLSTSSQVPEVTTVQNKKPVIPVLSSTILPSTYQIRITTCKTELQQLIQQKREQCNAERIAKQMMENAEWESKPPPPGWRPKGLLVAHLHEHKSAVNRIRVSDEHSLFATCSNDGTVKIWNSQKMEGKTTTTRSILTYSRIGGRVKTLTFCQGSHYLAIASDNGAVQLLGIEASKLPKSPKIHPLQSRILDQKEDGCVVDMHHFNSGAQSVLAYATVNGSLVGWDLRSSSNAWTLKHDLKSGLITSFAVDIHQCWLCIGTSSGTMACWDMRFQLPISSHCHPSRARIRRLSMHPLYQSWVIAAVQGNNEVSMWDMETGDRRFTLWASSAPPLSELQPSPHSVHGIYCSPADGNPILLTAGSDMKIRFWDLAYPERSYVVAGSTSSPSVSYYRKIIEGTEVVQEIQNKQKVGPSDDTPRRGPESLPVGHHDIITDVATFQTTQGFIVTASRDGIVKVWK

SEQ ID NO: 880687 - protein, 1304 aa, Homo sapiens
MGNQLAGIAPSQILSVESYFSDIHDFEYDKSLGSTRFFKVARAKHREGLVVVKVFAIQDPTLPLTSYKQELEELKIRLNSAQNCLPFQKASEKASEKAAMLFRQYVRDNLYDRISTRPFLNNIEKRWIAFQILTAVDQAHKSGVRHGDIKTENVMVTSWNWVLLTDFASFKPTYLPEDNPADFNYFFDTSRRRTCYIAPERFVDGGMFATELEYMRDPSTPLVDLNSNQRTRGELKRAMDIFSAGCVIAELFTEGVPLFDLSQLLAYRNGHFFPEQVLNKIEDHSIRELVTQMIHREPDKRLEAEDYLKQQRGNAFPEIFYTFLQPYMAQFAKETFLSADERILVIRKDLGNIIHNLCGHDLPEKAEGEPKENGLVILVSVITSCLQTLKYCDSKLAALELILHLAPRLSVEILLDRITPYLLHFSNDSVPRVRAEALRTLTKVLALVKEVPRNDINIYPEYILPGIAHLAQDDATIVRLAYAENIALLAETALRFLELVQLKNLNMENDPNNEEIDEVTHPNGNYDTELQALHEMVQQKVVTLLSDPENIVKQTLMENGITRLCVFFGRQKANDVLLSHMITFLNDKNDWHLRGAFFDSIVGVAAYVGWQSSSILKPLLQQGLSDAEEFVIVKALYALTCMCQLGLLQKPHVYEFASDIAPFLCHPNLWIRYGAVGFITVVARQISTADVYCKLMPYLDPYITQPIIQIERKLVLLSVLKEPVSRSIFDYALRSKDITSLFRHLHMRQKKRNGSLPDCPPPEDPAIAQLLKKLLSQGMTEEEEDKLLALKDFMMKSNKAKANIVDQSHLHDSSQKGVIDLAALGITGRQVDLVKTKQEPDDKRARKHVKQDSNVNEEWKSMFGSLDPPNMPQALPKGSDQEVIQTGKPPRSESSAGICVPLSTSSQVPEVTTVQNKKPVIPVLSSTILPSTYQIRITTCKTELQQLIQQKREQCNAERIAKQMMENAEWESKPPPPGWRPKGLLVAHLHEHKSAVNRIRVSDEHSLFATCSNDGTVKIWNSQKMEGKTTTTRSILTYSRIGGRVKTLTFCQGSHYLAIASDNGAVQLLGIEASKLPKSPKIHPLQSRILDQKEDGCVVDMHHFNSGAQSVLAYATVNGSLVGWDLRSSSNAWTLKHDLKSGLITSFAVDIHQCWLCIGTSSGTMACWDMRFQLPISSHCHPSRARIRRLSMHPLYQSWVIAAVQGNNEVSMWDMETGDRRFTLWASSAPPLSELQPSPHSVHGIYCSPADGNPILLTAGSDMKIRFWDLAYPERSYVVAGSTSSPSVSYYRKIIEGTEVVQVL

SEQ ID NO: 880688 - protein, 1358 aa, Homo sapiens
MGNQLAGIAPSQILSVESYFSDIHDFEYDKSLGSTRFFKVARAKHREGLVVVKVFAIQDPTLPLTSYKQELEELKIRLNSAQNCLPFQKASEKASEKAAMLFRQYVRDNLYDRISTRPFLNNIEKRWIAFQILTAVDQAHKSGVRHGDIKTENVMVTSWNWVLLTDFASFKPTYLPEDNPADFNYFFDTSRRRTCYIAPERFVDGGMFATELEYMRDPSTPLVDLNSNQRTRGELKRAMDIFSAGCVIAELFTEGVPLFDLSQLLAYRNGHFFPEQVLNKIEDHSIRELVTQMIHREPDKRLEAEDYLKQQRGNAFPEIFYTFLQPYMAQFAKETFLSADERILVIRKDLGNIIHNLCGHDLPEKAEGEPKENGLVILVSVITSCLQTLKYCDSKLAALELILHLAPRLSVEILLDRITPYLLHFSNDSVPRVRAEALRTLTKVLALVKEVPRNDINIYPEYILPGIAHLAQDDATIVRLAYAENIALLAETALRFLELVQLKNLNMENDPNNEEIDEVTHPNGNYDTELQALHEMVQQKVVTLLSDPENIVKQTLMENGITRLCVFFGRQKANDVLLSHMITFLNDKNDWHLRGAFFDSIVGVAAYVGWQSSSILKPLLQQGLSDAEEFVIVKALYALTCMCQLGLLQKPHVYEFASDIAPFLCHPNLWIRYGAVGFITVVARQISTADVYCKLMPYLDPYITQPIIQIERKLVLLSVLKEPVSRSIFDYALRSKDITSLFRHLHMRQKKRNGSLPDCPPPEDPAIAQLLKKLLSQGMTEEEEDKLLALKDFMMKSNKAKANIVDQSHLHDSSQKGVIDLAALGITGRQVDLVKTKQEPDDKRARKHVKQDSNVNEEWKSMFGSLDPPNMPQALPKGSDQEVIQTGKPPRSESSAGICVPLSTSSQVPEVTTVQNKKPVIPVLSSTILPSTYQIRITTCKTELQQLIQQKREQCNAERIAKQMMENAEWESKPPPPGWRPKGLLVAHLHEHKSAVNRIRVSDEHSLFATCSNDGTVKIWNSQKMEGKTTTTRSILTYSRIGGRVKTLTFCQGSHYLAIASDNGAVQLLGIEASKLPKSPKIHPLQSRILDQKEDGCVVDMHHFNSGAQSVLAYATVNGSLVGWDLRSSSNAWTLKHDLKSGLITSFAVDIHQCWLCIGTSSGTMACWDMRFQLPISSHCHPSRARIRRLSMHPLYQSWVIAAVQGNNEVSMWDMETGDRRFTLWASSAPPLSELQPSPHSVHGIYCSPADGNPILLTAGSDMKIRFWDLAYPERSYVVAGSTSSPSVSYYRKIIEGTEVVQEIQNKQKVGPSDDTPRRGPESLPVGHHDIITDVATFQTTQGFIVTASRDGIVKVWK

SEQ ID NO: 880689 - protein, 1358 aa, Homo sapiens; identical to SEQ ID NO: 880688

SEQ ID NO: 880690 - protein, 181 aa, Homo sapiens
QRGNAFPEIFYTFLQPYMAQFAKETFLSADERILVIRKDLGNIIHNLCGHDLPEKAEGEPKENGLVILVSVITSCLQTLKYCDSKLAALELILHLAPRLSVEILLDRITPYLLHFSNDSVPRVRAEALRTLTKVLALVKEVPRNDINIYPEYILPGIAHLAQDDATIVRLAYAGKSLLSKY

SEQ ID NO: 880691 - protein, 110 aa, Homo sapiens
ASECCAQQSDIKSSTLYNNTRYQNLTFVFMAKEAVLYPTVVQRAKDECQPGWRLTGFQEPESPLGLLACFWLQNHHLHLEISTGTFWRQTNPALILGTMPVEMHSSTIQK

SEQ ID NO: 880692 - protein, 122 aa, Homo sapiens
PCCNDSLNIHRYNNLTFVFMAKEAVLYPTVVQRAKDECQPGWRLTGFQEPESPLGLLACFWLQNHHLHLEISTGTFWRQTNPALILGTMPVEMHSSTIQNDYLKIPPKKDKTFLQPRGHLLI

SEQ ID NO: 880693 - protein, 125 aa, Homo sapiens
MSKQRLCKIECGPRSLRQTVVGVLEMEGIMNPYTALPTPQQLLAIEQSVYSSDPFRQGLTPPQMPGDHMHPYGAEPLFHDLDSDDTSLSNLGDCFLATSEAGPLQSRVGNPIDHLYSMQNSYFTS

SEQ ID NO: 880694 - protein, 71 aa, Homo sapiens
TLRIPWSLHPPHQSSRRLYYPFCQWDSKKLSDLVWLPHLVREQRVSLTCLTPGTVLSDEGCFGKSEASKAQ

SEQ ID NO: 880695 - protein, 90 aa, Homo sapiens
QVTPPIFLSPTLPQYPQVTPPLFLSPTLPQYPQVTPPLFMSPMLPHYPQGTQIAHLGNADMIQPGLIPGQPNLDFVISQAWSQSTFSTST

SEQ ID NO: 880696 - protein, 82 aa, Homo sapiens
GCARGMVQERQWSSLHLQSLQLLSGEELGEGIWEEGGQVFGVCGRVQMRDDDDGLDKGGGCRDGKRGVNSGAGQSCRSLYRV

SEQ ID NO: 880697 - protein, 49 aa, Homo sapiens
GLGKLSLDKSVDPVDHLILIWANILVIIWHLPHPYSLQGAIVVLGSLNT

SEQ ID NO: 880698 - protein, 143 aa, Homo sapiens
LCVANGSGLMVPQGGQGTINMAELHLGTNLNICSRDEAHYHVTDSPHWGQLLQATQPATAFSQQDLLVGAVFYGHNGSLSSRNTLAFSMDVGPVHTDATLQVTIALEGPVAPLKLAQHKEIYIFQGEAAEIRRDQLEVRSWRW

SEQ ID NO: 880699 - protein, 81 aa, Homo sapiens
GYCEDFYVHKLENLEEIDKFRKIYSTPRLNQEEMETLNRPITSSKIEMVIKKKLPTKKVQAQTDSRLNSIRHSKKNWYQSY

SEQ ID NO: 880700 - protein, 51 aa, Homo sapiens
MIRGRCKIWKKEFSPCTYPTVRGEFPPGRTEAVRGLQSISTFNGGPGEAPI

SEQ ID NO: 880701 - protein, 228 aa, Homo sapiens
STHPCLFSHSHTYTHTCTLNTPMPILSHTCTHDTHTHAYSHTHLYTHAHTRHTPMLILTHTPLYTHMHILNTHTHAYSLTHLYTHMHMTHTPMPILTHSHTYTHTCTYSTHSHAYSLTHTLTHLYTHAHTQHTCSSSHTFTHMHTFGYTHTRYLHTHMHTLNTHIPMHIHTYTWTHSDTHTYIPSHTHVHTRYTHAYAYLCTHTHIHTHPVPSHTCTQYTHTRAHPHT

SEQ ID NO: 880702 - protein, 81 aa, Homo sapiens
YCNRLHRLEYLNNRNTFLTVLEAVKSKIKMWADLVSGEGWLPGLQMAVSSLHPHMVKREKHHLCCVSFEKATNLIHKAPSS

SEQ ID NO: 880703 - protein, 114 aa, Homo sapiens
VTLRIFAECMAGSKTTKSASWSFLLLSAGGNPKSAQAPGIPWKMCVFIVHGKAPTAVLNRMLTHICRDTLTAQRKWISFVFDEGLGRVGVDLENKGKLSRSSPYLDYGEDHDLT

SEQ ID NO: 880704 - protein, 120 aa, Homo sapiens
WLSVVGHLSPVAIRGRPHLPSLTTVRIFLGIRPDSSTCPEPLAPPLQRLLASVVHIHREQVGHGSGSGAPAFGPWGRHCLLTHGCCLIGIIQQLPNWSPCLQLDWGTNPSLTYKPWFKAP

SEQ ID NO: 880705 - protein, 270 aa, Homo sapiens
MKQPQNKRRDRREQQTQSTQARSKREKTDSRKKREERGKKRKQRRRKQGAQEKEKKEKKKRDSKQKRKEEREGRKKREQKEEEDKDTKEEAEQQDKRKEQRSEARERKANRDRTKENRKRKRRQRETKRRKKNKEQKRKNMKTELDLKNESRTRKTGGAERSEREEKRTREKHDERQDGKKKETRQNREPEKKKTKKKGGKRRQRRKKKKRGRDRETRERKREEKRKKKKTEERAREQEEKEEHKEKREKKENKREERKKKGGKDRKEQK

SEQ ID NO: 880706 - protein, 120 aa, Homo sapiens
ATTGPAAWSSPPPASANQCGEISTVRWLIFPAWQPQSREKSLDTRATSGTLELGLQYLIQTGSVLCGGYGGEGLRVRYILARLNSKHSLSLSMYVQIITWPICLSLAKINLSFKKCQLGH

SEQ ID NO: 880707 - protein, 76 aa, Homo sapiens
ATAPYACSHLVLDSPRGRASAISQVCAMDRRATPLPEATLTPLSRWLPALLLPWPGTALQAAHLYHGSPHLTQPSR

SEQ ID NO: 880708 - protein, 80 aa, Homo sapiens
KASGQILMGRGGRHVWAWGFPTQKWEPGQLSSRLPFLRPQMNGVCIFVEDINTPPPALPTRHTPTLRTVPDKPKFRLSGC

SEQ ID NO: 880709 - protein, 74 aa, Homo sapiens
VSGNTWSVIKPPPRIIAMDNQPLVSQGQNLSLKAAKGSFRERAFQLKGSRTNMAKKESPMAEGNVVRTSKNMFL

SEQ ID NO: 880710 - protein, 137 aa, Homo sapiens
IVIPKYHPVNGHNCEVGKTLSKQEMAGASSSQRGQSGSGNFSGGCASGSGGNDNFDHGRNISSCSDFDGSHSGGGYGSSEYGCYGFGNDGINFGSCVICNDFGNYNSQSSHFGPMKGGHFGGISCAPVTVEANTLLL

SEQ ID NO: 880711 - protein, 37 aa, Homo sapiens
SQPSYPAGSSPTARVSLCPLASRLLPQNAGFLMEIFL

SEQ ID NO: 880712 - protein, 33 aa, Homo sapiens
MFNFLTFAKNLFTNPLINGGHSLAGIRGSGEEW

SEQ ID NO: 880713 - protein, 39 aa, Homo sapiens
FVLNRGFSVGFCFSSPFPFRDGCSMWPGILTGDGPVFIS

SEQ ID NO: 880714 - protein, 124 aa, Homo sapiens
KRHPFPTSLKINITILDIGESGHSQPGLGSTGSVWCGSSGQVPTVPHGDPLGRRVHLPVSLTKSAHQASLPPLDVGGNILDQPQSSGGMEGLTEADAGPGIVQDPKTSIPTCLRGELHGWINSF

SEQ ID NO: 880715 - protein, 79 aa, Homo sapiens
RGLITHHWEPGQGQFVSTWPAGHYVTSGRGVVCGASLPPSAGKVSRGTLEGGWKEKVRRCVESNTAWQTYNFTNDLCST

SEQ ID NO: 880716 - protein, 217 aa, Homo sapiens
MAHLRSPSGFGDPGEEGPEGVRGGVRGGGGGGRGFPKIFQTFRKDMSEMSIDRNIHRNLSPGIPVSVQTEESWLQDLSDKVQSRKKASKEKAEPECLASKLREKWVINPEESKLNILYELEFKEDFITLFEPSLRTLPSIGPPSILAYKEESSNLGINFKDEEEETSPKCEFCGSDLRAFFSNVDVSSEPKGHASCCIAFQNLIDYIYEEQIKTKPP

SEQ ID NO: 880717 - protein, 339 aa, Homo sapiens
SGRADRGRGQRAGCNPASRQPWPTCARLAASETRGKKDQKESEEELEEEEEEEEVAEEAPQAAEAAPQVAEEEEEVVEEELVGEEQELEAPETFSEEYLWKVTDIGDYDDDFPDVRPRLASIVSPSLTSTFVPSQSATSTETPSASPPSSTSSHKSFPKIFQTFRKDMSEMSIDRNIHRNLSPGIPVSVQTEESWLQDLSDKVQSRKKASKEKAEPECLASKLREKWVINPEESKLNILYELEFKEDFITLFEPSLRTLPSIGPPSILAYKEESSNLGINFKDEEEETSPKCEFCGSDLRAFFSNVDVSSEPKGHASCCIAFQNLIDYIYEEQIKTKPP

SEQ ID NO: 880718 - protein, 71 aa, Homo sapiens
GALLALLREGEGEEDAVPGKRLLRRAGISAKRPLPPLPFPLTSSVPTSPGEETKDVGGQQHAGGLPLTPRS

SEQ ID NO: 880719 - protein, 75 aa, Homo sapiens
MPIRMHLLLKDTPTSTMTVYRCHGNVWRLPYKVSKGRGGDLSSSSSLYFPDKLALTLLCELAPNSFSHEIKETSL

SEQ ID NO: 880720 - protein, 109 aa, Homo sapiens
MQGTRRLLKPRDQETSCMSQGLLAQAPPLEFPVQSHQPGDHVFIKGWKEGRLEPAWEGSYLMLLTIETAVRTAEKGWTHHTRVKKASTPSESWIVVPEPSPTKLKLRRT

SEQ ID NO: 880721 - protein, 104 aa, Homo sapiens
MQNTQIENPINTKCKFGFQKPKESARKTSAKKMFSSRIPAVGSGKGSAAEITGKDVEEGMFAHRPKDHATENSLIAKGKHVPRVIWGHQLICMIKLSIPNCGTT

SEQ ID NO: 880722 - protein, 128 aa, Homo sapiens
NIFPVTLFSELLIPCWLSVFYTTPPGPMSALNPGDGRTKSLYTLSQQGARATEEESPLNSQNPKASMVLEIRSPRMKVPSVALVPPGGSKGNSVSCASPASRGDLHSPAPCPLFHPQSHSLASSSLCL

SEQ ID NO: 880723 - protein, 1073 aa, Homo sapiens
MTDQENNNNISSNPFAALFGSLADAKQFAAIQKEQLKQQSDELPASPDDSDNSVSESLDEFDYSVAEISRSFRSQQEICEQLNINHMIQRIFLITLDNSDPSLKSGNGIPSRCVYLEEMAVELEDQDWLDMSNVEQALFARLLLQDPGNHLINMTSSTTLNLSADRDAGERHIFCYLYSCFQRAKEEITKVPENLLPFAVQCRNLTVSNTRTVLLTPEIYVDQNIHEQLVDLMLEAIQGAREYMNKIYFEDVTEFLEEVIEALILDEEVRTFPEVMIPVFDILLGRIKDLELCQILLYAYLDILLYFTRQKDMAKVFVEYIQPKDPTNGQMYQKTLLGVILSISCLLKTPGVVENHGYFLNPSRSSPQEIKVQEANIHQFMAQFHEKIYQMLKNLLQLSPETKHCILSWLGNCLHANAGRTKIWANQMPEIFFQMYASDAFFLNLGAALLKLCQPFCKPRSSRLLTFNPTYCALKELNDEERKIKNVHMRGLDKETCLIPAVQEPKFPQNYNLVTENLALTEYTLYLGFHRLHDQMVKINQNLHRLQVAWRDAQQSSSPAADNLREQFERLMTIYLSTKTAMTEPQMLQNCLNLQVSMAVLLVQLAIGNEGSQPIELTFPLPDGYSSLAYVPEFFADNLGDFLIFLRRFADDILETSADSLEHVLHFITIFTGSIERMKNPHLRAKLAEVLEAVMPHLDQTPNPLVSSVFHRKRVFCNFQYAPQLAEALIKVFVDIEFTGDPHQFEQKFNYRRPMYPILRYMWGTDTYRESIKDLADYASKNLEAMNPPLFLRFLNLLMNDAIFLLDEAIQYLSKIKIQQIEKDRGEWDSLTPEARREKEAGLQMFGQLARFHNIMSNETIGTLAFLTSEIKSLFVHPFLAERIISMLNYFLQHLVGPKMGALKVKDFSEFDFKPQQLVSDICTIYLNLGDEENFCATVPKDGRSYSPTLFAQTVRVLKKINKPGNMIMAFSNLAERIKSLADLQQQEEETYADACDEFLDPIMSTLMCDPVVLPSSRVTVDRSTIARHLLSDQTDPFNRSPLTMDQIRPNTELKEKIQRWLAERKQQKEQLE

SEQ ID NO: 880724 - protein, 1066 aa, Homo sapiens
MTDQENNNNISSNPFAALFGSLADAKQFAAIQKEQLKQQSDELPASPDDSDNSVSESLDEFDYSVAEISRSFRSQQEICEQLNINHMIQRIFLITLDNSDPSLKSGNGIPSRCVYLEEMAVELEDQDWLDMSNVEQALFARLLLQDPGNHLINMTSSTTLNLSADRDAGERHIFCYLYSCFQRAKEEITKVPENLLPFAVQCRNLTVSNTRTVLLTPEIYVDQNIHEQLVDLMLEAIQGAHFEDVTEFLEEVIEALILDEEVRTFPEVMIPVFDILLGRIKDLELCQILLYAYLDILLYFTRQKDMAKVFVEYIQPKDPTNGQMYQKTLLGVILSISCLLKTPGVVENHGYFLNPSRSSPQEIKVQEANIHQFMAQFHEKIYQMLKNLLQLSPETKHCILSWLGNCLHANAGRTKIWANQMPEIFFQMYASDAFFLNLGAALLKLCQPFCKPRSSRLLTFNPTYCALKELNDEERKIKNVHMRGLDKETCLIPAVQEPKFPQNYNLVTENLALTEYTLYLGFHRLHDQMVKINQNLHRLQVAWRDAQQSSSPAADNLREQFERLMTIYLSTKTAMTEPQMLQNCLNLQVSMAVLLVQLAIGNEGSQPIELTFPLPDGYSSLAYVPEFFADNLGDFLIFLRRFADDILETSADSLEHVLHFITIFTGSIERMKNPHLRAKLAEVLEAVMPHLDQTPNPLVSSVFHRKRVFCNFQYAPQLAEALIKVFVDIEFTGDPHQFEQKFNYRRPMYPILRYMWGTDTYRESIKDLADYASKNLEAMNPPLFLRFLNLLMNDAIFLLDEAIQYLSKIKIQQIEKDRGEWDSLTPEARREKEAGLQMFGQLARFHNIMSNETIGTLAFLTSEIKSLFVHPFLAERIISMLNYFLQHLVGPKMGALKVKDFSEFDFKPQQLVSDICTIYLNLGDEENFCATVPKDGRSYSPTLFAQTVRVLKKINKPGNMIMAFSNLAERIKSLADLQQQEEETYADACDEFLDPIMSTLMCDPVVLPSSRVTVDRSTIARHLLSDQTDPFNRSPLTMDQIRPNTELKEKIQRWLAERKQQKEQLE

SEQ ID NO: 880725 - protein, 97 aa, Homo sapiens
VQRTPSAHFSREKKDYADACDEFLDPIMSTLMCDPVVLPSSRVTVDRSTIARHLLSDQTDPFNRSPLTMDQIRPNTELKEKIQRWLAERKQQKEQLE

SEQ ID NO: 880726 - protein, 1066 aa, Homo sapiens; identical to SEQ ID NO: 880724

SEQ ID NO: 880727 - protein, 1066 aa, Homo sapiens; identical to SEQ ID NO: 880724

SEQ ID NO: 880728 - protein, 75 aa, Homo sapiens
NGQMYQKTLLGVILSISCLLKTPGVVENHGYFLNPSRSSPQEIKVQEANIHQVELFTRVSQPPDLKRVFSESRYR

SEQ ID NO: 880729 - protein, 262 aa, Homo sapiens
MTDQENNNNISSNPFAALFGSLADAKQFAAIQKEQLKQQSDELPASPDDSDNSVSESLDEFDYSVAEISRSFRSQQEICEQLNINHMIQRIFLITLDNSDPSLKSGNGIPSRCVYLEEMAVELEDQDWLDMSNVEQALFARLLLQDPGNHLINMTSSTTLNLSADRDAGERHIFCYLYSCFQRAKEEITKVPENLLPFAVQCRNLTVSNTRTVLLTPEIYVDQNIHEQLVDLMLEAIQGAHFEDVTEFLEEVIEALILDEES

SEQ ID NO: 880730 - protein, 1100 aa, Homo sapiens
MTDQENNNNISSNPFAALFGSLADAKQFAAIQKEQLKQQSEKSCSVTEAGVQCNLCLPGLSNSPASASRVAGTTDELPASPDDSDNSVSESLDEFDYSVAEISRSFRSQQEICEQLNINHMIQRIFLITLDNSDPSLKSGNGIPSRCVYLEEMAVELEDQDWLDMSNVEQALFARLLLQDPGNHLINMTSSTTLNLSADRDAGERHIFCYLYSCFQRAKEEITKVPENLLPFAVQCRNLTVSNTRTVLLTPEIYVDQNIHEQLVDLMLEAIQGAHFEDVTEFLEEVIEALILDEEVRTFPEVMIPVFDILLGRIKDLELCQILLYAYLDILLYFTRQKDMAKVFVEYIQPKDPTNGQMYQKTLLGVILSISCLLKTPGVVENHGYFLNPSRSSPQEIKVQEANIHQFMAQFHEKIYQMLKNLLQLSPETKHCILSWLGNCLHANAGRTKIWANQMPEIFFQMYASDAFFLNLGAALLKLCQPFCKPRSSRLLTFNPTYCALKELNDEERKIKNVHMRGLDKETCLIPAVQEPKFPQNYNLVTENLALTEYTLYLGFHRLHDQMVKINQNLHRLQVAWRDAQQSSSPAADNLREQFERLMTIYLSTKTAMTEPQMLQNCLNLQVSMAVLLVQLAIGNEGSQPIELTFPLPDGYSSLAYVPEFFADNLGDFLIFLRRFADDILETSADSLEHVLHFITIFTGSIERMKNPHLRAKLAEVLEAVMPHLDQTPNPLVSSVFHRKRVFCNFQYAPQLAEALIKVFVDIEFTGDPHQFEQKFNYRRPMYPILRYMWGTDTYRESIKDLADYASKNLEAMNPPLFLRFLNLLMNDAIFLLDEAIQYLSKIKIQQIEKDRGEWDSLTPEARREKEAGLQMFGQLARFHNIMSNETIGTLAFLTSEIKSLFVHPFLAERIISMLNYFLQHLVGPKMGALKVKDFSEFDFKPQQLVSDICTIYLNLGDEENFCATVPKDGRSYSPTLFAQTVRVLKKINKPGNMIMAFSNLAERIKSLADLQQQEEETYADACDEFLDPIMSTLMCDPVVLPSSRVTVDRSTIARHLLSDQTDPFNRSPLTMDQIRPNTELKEKIQRWLAERKQQKEQLE

SEQ ID NO: 880731 - protein, 242 aa, Homo sapiens
MTDQENNNNISSNPFAALFGSLADAKQFAAIQKEQLKQQSDELPASPDDSDNSVSESLDEFDYSVAEISRSFRSQQEICEQLNINHMIQRIFLITLDNSDPSLKSGNGIPSRCVYLEEMAVELEDQDWLDMSNVEQALFARLLLQDPGNHLINMTSSTTLNLSADRDAGERHIFCYLYSCFQRAKEEITKVPENLLPFAVQCRNLTVSNTRTVLLTPEIYVDQNIHEQNLVHSHFKYPLSPV

SEQ ID NO: 880732 - protein, 257 aa, Homo sapiens
MTDQENNNNISSNPFAALFGSLADAKQFAAIQKEQLKQQSDELPASPDDSDNSVSESLDEFDYSVAEISRSFRSQQEICEQLNINHMIQRIFLITLDNSDPSLKSGNGIPSRCVYLEEMAVELEDQDWLDMSNVEQALFARLLLQDPGNHLINMTSSTTLNLSADRDAGERHIFCYLYSCFQRAKEEITKVPENLLPFAVQCRNLTVSNTRTVLLTPEIYVDQNIHEQLVDLMLEAIQGAREYMNKICKLLHFDFQI

SEQ ID NO: 880733 - protein, 116 aa, Homo sapiens
REWRDWERVLPGFDPLPPTAHAAAAGTPGLGLGAGKERPGVGRAPMDSRNPRPGVAGRPEGDLAPGGRRALLEGGELAGRGRGRAHRIQTQKPLPPGIPARNGLRRRRPPLSLPRS

SEQ ID NO: 880734 - protein, 200 aa, Homo sapiens
FPAQGPAARHSRLRAFVIIHRSHFHFSAAQELHSTIKMRWDCLARPLLRVQTQVGRGPCAAPSGLRLRGRALAPCWTHGALQAAQRALPAMRVRKSRDRPISSEMATVPGEKAGGREEAGVQAPVQSHLVLCGPFLFLGCWQGALPQLRGTQDPDGCRQEGQLGRGGGGPGPRPEPGQPPGVVGPWTLPTADPVGPTPLQ

SEQ ID NO: 880735 - protein, 116 aa, Homo sapiens
MRVTPEVTTTAPPSPIQLKPPSLWLPTPSLPSSHSLHGLLIAWPLLSLSPASLASCWLPRKSCQDLPETPVYWVGKERGSTDLFMKLHSDTQNRPSTQRPSMAGRPGKGARKRAKS

SEQ ID NO: 880736 - protein, 82 aa, Homo sapiens
LKAQASIIQGDFQSPGWGGLHRTLEEGRSGSAHEVAEEQDMAHSFACPSTWPTSAGLPRALKACTFTILMDRSGYRLRGQRY

SEQ ID NO: 880737 - protein, 94 aa, Homo sapiens
TLALLATVGRAVECEVPCLLAARGDESGPHGSPDSSLGASLLTESRSVTQARVQWTVSAHCKLRLPGSCHSPASVSRVAGSTGRMSILRFSVTT

SEQ ID NO: 880738 - protein, 280 aa, Homo sapiens
LVLVGILGHRHTPSHPPPALWSLPRAREQLGLILLTPQGRTGQGGSRRPPMLGTQWTLARCLLPSHPDPGLAGSLRGDSSEDGRRGQLLPQSPAPCSPVWSPGTPVGGPHPAGDGPATAPGPPEGPELAFPQDLSPAWPQKGAGTHPANAGPGPLSRRSSQLRTPLEAGRKWGWKMTRWRLRRDQAPGEGTQAKLLGEALSTAGRGHAGPPEGWAGEGGVSPGLTPLLGTGQGKELDLDLREKFIRFDQILGISLDHIPFLPQTGPGRPWGCGVGKQRPH

SEQ ID NO: 880739 - protein, 131 aa, Homo sapiens
MCSTGGETQTHQQAPRVSTVGQMLAGQGRRSGAHSNLCFFMRKGPIKRGAKQGFEGRGVGALFPPRRSFNGGPPFPEKPKKKREKGPKSRPHTQHAPRSNNVLKTDRRDPFKTVFGAPLGSPQGDTQGGEK

SEQ ID NO: 880740 - protein, 224 aa, Homo sapiens
FFLNLFSFRWASPPPPVSTSSRGVTIALVCWVGSFGFASKALRDSVCRFYIGLCSLTWRSSHSDMATSSLHFASCDTQQAPRQRGASTVSSSSSTKVDLKSGLEECAVALNLFLSNKFTDALELLRPWAKESMYHALGYSTIVVLQAVLTFEQQDIQNGISAMKDALQTCQKYRKKYTVVESFSSLLSRGSLEQLSEEEMHAEICYAECLLQKAALTFVQVMNI

SEQ ID NO: 880741 - protein, 70 aa, Homo sapiens
LGLSGARPDKETAPSRALGRGPGHRADRCAHTHSAGTPLASKVHWNTGTEGLPPGSSHLRTFTDHCREPR

SEQ ID NO: 880742 - protein, 168 aa, Homo sapiens
HRHHVSSQASAVISASGMKTSEQWNLFLFLAPVSEPTDFGFTVVSTYPHIKRMGFPSLSYPLFPLSLACSAGTFPKAWDPGEPKSSLEGEFTGFRVRLVEGTSWWYAWGLHGEEDKGDFQELQRQPTLRASSACAPRGARGNCGPTSPVSLVDFASSDEAGAGLFRGM

SEQ ID NO: 880743 - protein, 162 aa, Homo sapiens
MAAGPAALSRLIARPGGLPVSSGHPHPKHWLAVRWESCRPCHLIPPRGFGSFSTKFSSGILFHPAPQNSDLTSEITVERIEKRCLELFGRDYCFSVIPNTNGDICGHYPRHIVFLEYESSEKEKDTFESTVQVSKLQDLIHRSKMARCRGRFVCPVILFKGK

SEQ ID NO: 880744 - protein, 129 aa, Homo sapiens
MCHFLCACRRQRKSQIQLFRCNVFCDSGPWTLGPVPTLHFKAPPAPYYGLGLVPGMMKPTRICHCGLNPASLPRPYRAPYPTCHEGSVLPSAMTQPCWLPCVPLECPVSQGSCSGFVSDSWVQSAASAC

SEQ ID NO: 880745 - protein, 151 aa, Homo sapiens
MAVAPGWPKSPVQLRLPDSRRHHQPGSARLGSGTPEPLACGPAALPLYAQAPPSPRCAFRRPPRASRCRRRPDHARDSPGARGLHPLPGLWTLQAATLSLRLQAFPRLLSSRASNTWGPLRTGCAPRRQGPGPAVLGSPPVLRLAAEKLFW

SEQ ID NO: 880746 - protein, 152 aa, Homo sapiens
MVSVTTAPHPGSPSDQRQRSPTTPAREAQSQQNPERAHHMCLPVTACDRAPARANELEGPKELGCSAGVTGQPHGVLPSLDQTRGGEAQTRRGADLGWGDCWGKLGPLARDRACVQAQRCPRLKWAPRGHYQSPNSWPWGKPCPANLALGTM

SEQ ID NO: 880747 - protein, 104 aa, Homo sapiens
MEHSVSGTGGFLVSLTSRMKLRTLGKLLEGRGMPAIFIIALPSPNTIREPALIISLQLYPAAPERQRPARRGHDDGGGFFKTKRGICRETEREIRLLQTLTVST

SEQ ID NO: 880748 - protein, 126 aa, Homo sapiens
MNIDWCRTYLLQTKPLRIQEVEATHSLLAAKLRKSGAHELDTPAAIKEILPRNTSKMGSDPAHGPPLNQVHLHQTGYSPYEILFGRPLPIIGQIKGDLCELGELSLRRQMQALGKAMQEVHGWVWE

SEQ ID NO: 880749 - protein, 209 aa, Homo sapiens
VRSGTRQEAARREDRGGVRVAPSPGPHPRWTVGETECLSLGPHRTMKVLLLTGLGALFFAYYWDDNFDPGEHLGLREGETGPAVLSSAQSDHPGYGQPASRERELLLTGANAGVGEELAYHYARLGSHLVLTAHTEALLQKVVGNCRKLGAPKVFYIAADMASPEAPESVVQFALDKLGGLDYLVLNHIGGAPAGTRAPSPQATRWLMQ

SEQ ID NO: 880750 - protein, 292 aa, Homo sapiens
KPSPGAYHADPGLGTLSLLTGPCVATAPPPTEIQSIAAPFLQKDCSPETLACGSKNALTPATPRTAREPWLWGSSLVPGRVLSVLSEVRAQPLPLLPQSRGSFSPAQIWECGEGQAPCAGLPAGKEWLSRQCEVLQSPVGLPGDGQRALGLGPAHPLVAPPQTHSHLGLWRRKEREIPALNSPSLCFFEEPEMNLKAKTEWRRSGERAGASTGPALGTGLCHSLLLLSSFCHLALPPVVLPCTLPSGASLSSESFPFPNPNCRSTGPSPQVWYILGSSGGSGVGQDGATDSY

SEQ ID NO: 880751 - protein, 238 aa, Homo sapiens
SVHRLLPTSARPASDPFSGDGRSWSPGPGRQVGSWEGDEADEETEVPKSQVADTNTPVATFFHLFFRVSAIVTYVSCDWFSKSFVGCFVMVLLLLSLDFWSVKNVTGRLLVGLRWWNQIDEDGKSHWIFEARKVSPNSIAATEAEARIFWLGLIICPMIWIVFFFSTLFSLKLKWLALVVAGISLQAANLYGYILCKMGGNSDIGKVTASFLSQTVFQTACPGDFQKPGLEGLEIHQH

SEQ ID NO: 880752 - protein, 294 aa, Homo sapiens
MSRSRHLGKIRKRLEDVKSQWVRPARADFSDNESARLATDALLDGGSEAYWRVLSQEGEVDFLSSVEAQYIQAQAREPPCPPDTLGGAEAGPKGLDSSSLQSGTYFPVASEGSEPALLHSWASAEKPYLKEKSSATVYFQTVKHNNIRDLVRRCITRTSQNISIRSVEGEIYCAKSGRKFAGQIREKFIISDWRFVLSGSYSFTWLCGHVHRNILSKFTGQAVELFDEEFRHLYASSKPVMGLKSPRLVAPVPPGAAPANGRLSSSSGSASDRTSSNPFSGRSAGSHPGTRTDG

SEQ ID NO: 880753 - protein, 434 aa, Homo sapiens
MSRSRHLGKIRKRLEDVKSQWVRPARADFSDNESARLATDALLDGGSEAYWRVLSQEGEVDFLSSVEAQYIQAQAREPPCPPDTLGGAEAGPKGLDSSSLQSGTYFPVASEGSEPALLHSWASAEKPYLKEKSSATVYFQTVKHNNIRDLVRRCITRTSQVLVILMDVFTDVEIFCDILEAANKRGVFVCVLLDQGGVKLFQEMCDKVQISDSHLKNISIRSVEGEIYCAKSGRKFAGQIREKFIISDWRFVLSGSYSFTWLCGHVHRNILSKFTGQAVELFDEEFRHLYASSKPVMGLKSPRLVAPVPPGAAPANGRLSSSSGSASDRTSSNPFSGRSAGSHPGTRSVSASSGPCSPAAPHPPPPPRFQPHQGPWGAPSPQAHLSPRPHDGPPAAVYSNLGAYRPTRLQLEQLGLVPRLTPTWRPFLQASPHF

SEQ ID NO: 880754 - protein, 269 aa, Homo sapiens
MSRSRHLGKIRKRLEDVKSQWVRPARADFSDNESARLATDALLDGGSEAYWRVLSQEGEVDFLSSVEAQYIQAQAREPPCPPDTLGGAEAGPKGLDSSSLQSGTYFPVASEGSEPALLHSWASAEKPYLKEKSSATVYFQTVKHNNIRDLVRRCITRTSQVLVILMDVFTDVEIFCDILEAANKRGVFVCVLLDQGGVKLFQEMCDKVQISDSHLKNISIRSVEGEIYCAKSGRKFAGQIREKFIISDWRFVLSGSYRWQLPDHCLRDL

SEQ ID NO: 880755 - protein, 66 aa, Homo sapiens
MIELHNGEYSQGKHGFTMAMNAFGDMTNEEFRQMMGCFRNQKFRKGKGPGQDRGKKVYQDSGAPGE

SEQ ID NO: 880756 - protein, 334 aa, Homo sapiens
MNLSLVLAAFCLGIASAVPKFDQNLDTKWYQWKATHRRLYGANEEGWRRAVWEKNMKMIELHNGEYSQGKHGFTMAMNAFGDMTNEEFRQMMGCFRNQKFRKGKVFREPLFLDLPKSVDWRKKGYVTPVKNQKQCGSCWAFSATGALEGQMFRKTGKLVSLSEQNLVDCSRPQGNQGCNGGFMARAFQYVKENGGLDSEESYPYVAVDEICKYRPENSVANDTGFTVVAPGKEKALMKAVATVGPISVAMDAGHSSFQFYKSGIYFEPDCSSKNLDHGVLVVGYGFEGANSNNSKYWLVKNSWGPEWGSNGYVKIAKDKNNHCGIATAASYPNV

SEQ ID NO: 880757 - protein, 334 aa, Homo sapiens; identical to SEQ ID NO: 880756

SEQ ID NO: 880758 - protein, 128 aa, Homo sapiens
MDEICKYRPENSVANDTGFTVVAPGKEKALMKAVATVGPISVAMDAGHSSFQFYKSGIYFEPDCSSKNLDHGVLVVGYGFEGANSNNSKYWLVKNSWGPEWGSNGYVKIAKDKNNHCGIATAASYPNV

SEQ ID NO: 880759 - protein, 67 aa, Homo sapiens
GIKMAAWDRSQPLRPLPEEPRPVCYTQLIGSSITERRGNMRMTSDTNMAFWTGSIVCLASTQGMLMV

SEQ ID NO: 880760 - protein, 67 aa, Homo sapiens; identical to SEQ ID NO: 880759

SEQ ID NO: 880761 - protein, 67 aa, Homo sapiens; identical to SEQ ID NO: 880759

SEQ ID NO: 880762 - protein, 67 aa, Homo sapiens; identical to SEQ ID NO: 880759

SEQ ID NO: 880763 - protein, 67 aa, Homo sapiens; identical to SEQ ID NO: 880759

SEQ ID NO: 880764 - protein, 67 aa, Homo sapiens; identical to SEQ ID NO: 880759

SEQ ID NO: 880765 - protein, 121 aa, Homo sapiens
RTQGTQGGWLFSRNVSFWAGLRCLQSLVPPLALHSSSAGGRYKFQLLSALLCFSKAFQQQHEVGSLPPPVILIIFSLEVQELQAAGDRLLGTCVELCTGDWDCNPGDHCVSNGCGHECVAG

SEQ ID NO: 880766 - protein, 74 aa, Homo sapiens
PPTTTKFAAASTQHEVGSLPPPVILIIFSLEVQELQAAGDRLLGTCVELCTGDWDCNPGDHCVSNGCGHECVAG

SEQ ID NO: 880767 - protein, 261 aa, Homo sapiens [sequence omitted]

SEQ ID NO: 880768 - protein, 247 aa, Homo sapiens
LRLGTRPGVVFRRPGNAAAGSGLRFAQLEAAQQQRMSGTLEKVLCLRNNTIFKQAFSLLRFRTSGEKPIYSVGGILLSISRPYKTKPTHGIGKYKHLIKAEEPKKKKGKVEVRAINLGTDYEYGVLNIHLTAYDMTLAESYAQYVHNLCNSLSIKVEESYAMPTKTIEVLQLQDQGSKMLLDSVLTTHERVVQISGLSATFAEIFLEIIQSSLPEGVRLSVKEHTEEDFKGRFKARPELEELLAKLK

SEQ ID NO: 880769 - protein, 194 aa, Homo sapiens
MGLSSCRKTSSGLPLILHYGGILLSISRPYKTKPTHGIGKYKHLIKAEEPKKKKGKVEVRAINLGTDYEYGVLNIHLTAYDMTLAESYAQYVHNLCNSLSIKVEESYAMPTKTIEVLQLQDQGSKMLLDSVLTTHERVVQISGLSATFAEIFLEIIQSSLPEGVRLSVKEHTEEDFKGRFKARPELEELLAKLK

SEQ ID NO: 880770 - protein, 113 aa, Homo sapiens
MTLAESYAQYVHNLCNSLSIKVEESYAMPTKTIEVLQLQDQGSKMLLDSVLTTHERVVQISGLSATFAEIFLEIIQSSLPEGVRLSVKEHTEEDFKGRFKARPELEELLAKLK

SEQ ID NO: 880771 - protein, 261 aa, Homo sapiens [sequence omitted]

SEQ ID NO: 880772 - protein, 261 aa, Homo sapiens [sequence omitted]

SEQ ID NO: 880773 - protein, 247 aa, Homo sapiens; identical to SEQ ID NO: 880768

SEQ ID NO: 880774 - protein, 303 aa, Homo sapiens
MMWKLSESRWDIAAAPGQGRSVSVFRRPGNAAAGSGLRFAQLEAAQQQRMSGTLEKVLCLRNNTIFKQAFSLLRFRTSGEKPIYSVERDVSCLWPRLEYSGMIIAPCSLELLGSSNPPASASGVAGITGGILLSISRPYKTKPTHGIGKYKHLIKAEEPKKKKGKVEVRAINLGTDYEYGVLNIHLTAYDMTLAESYAQYVHNLCNSLSIKVEESYAMPTKTIEVLQLQDQGSKMLLDSVLTTHERVVQISGLSATFAEIFLEIIQSSLPEGVRLSVKEHTEEDFKGRFKARPELEELLAKLK

SEQ ID NO: 880775 - protein, 113 aa, Homo sapiens; identical to SEQ ID NO: 880770

SEQ ID NO: 880776 - protein, 128 aa, Homo sapiens
SRPFLQCFQTPWERGCRVRSSVCTARGRAAAKDERNLGKVLCLRNNTIFKQAFSLLRFRTSGEKPIYSVGGILLSISRPYKTKPTHGIGKYKHLIKAEELCNANQNHRSVAVAGPRQQNAPGLSAYHP

SEQ ID NO: 880777 - protein, 186 aa, Homo sapiens
MMWKLSESRWDIAAAPGQGRSVSVFRRPGNAAAGSGLRFAQLEAAQQQRMSGTLEKVLCLRNNTIFKQAFSLLRFRTSGEKPIYSVGGILLSISRPYKTKPTHGIGKYKHLIKAEEPKKKKGKVEVRAINLGTDYEYGVLNIHLTAYDMTLAESYAQYVHNLCNSLSIKVEERYEGCFCMGCSWCG

SEQ ID NO: 880778 - protein, 125 aa, Homo sapiens
LSGSGSCRELEPAEFETMLLFCPGCGNGLIVEEGQRCHRFACNTCPYVHNITRKVTNRKYPKLKEVDDVLGGAAAWENVDSTAESCPKCEHPRAYFMQLQTRSADEPMTTFYKCCNAQCGHRWRD

SEQ ID NO: 880779 - protein, 722 aa, Homo sapiens
TAPFPVQSWANQGFRFTMDADKEKDLQKFLKNVDEISNLIQEMNSDDPVVQQKAVLETEKRLLLMEEDQEEDECRTTLNKTMISPPQTAMKSAEEINSEAFLASVEKDAKERAKRRRENKVLADALKEKGNEAFAEGNYETAILRYSEGLEKLKDMKVLYTNRAQAYMKLEDYEKALVDCEWALKCDEKCTKAYFHMGKANLALKNYSVSRECYKKILEINPKLQTQVKGYLNQVDLQEKADLQEKEAHELLDSGKNTAVTTKNLLETLSKPDQIPLFYAGGIEILTEMINECTEQTLFRMHNGFSIISDNEVIRRCFSTAGNDAVEEMVCVSVLKLWQAVCSRNEENQRVLVIHHDRARLLAALLSSKVLAIRQQSFALLLHLAQTESGRSLIINHLDLTRLLEALVSFLDFSDKEANTAMGLFTDLALEERFQVWFQANLPGVLPALTGVLKTDPKVSSSSALCQCIAIMGNLSAEPTTRRHMAACEEFGDGCLSLLARCEEDVDLFREVIYTLLGLMMNLCLQAPFVSEVWAVEVSRRCLSLLNSQDGGILTRAAGVLSRTLSSSLKIVEEALRAGVVKKMMKFLKTGGETASRYAIKILAICTNSYHEAREEVIRLDKKLSVMMKLLSSEDEVLVGNAALCLGNCMEVPNVASSLLKTDLLQVLLKLAGSDTQKTAVQVNAGIALGKLCTAEPRFAAQLRKLHGLEILNSTMKYISDS

SEQ ID NO: 880780 - protein, 263 aa, Homo sapiens
TAPFPVQSWANQGFRFTMDADKEKDLQKFLKNVDEISNLIQEMNSDDPVVQQKAVLETEKRLLLMEEDQEEDECRTTLNKTMISPPQTAMKSAEEINSEAFLASVEKDAKERAKRRRENKVLADALKEKGNEAFAEGNYETAILRYSEGLEKLKDMKVLYTNRAQAYMKLEDYEKALVDCEWALKCDEKCTKAYFHMGKANLALKNYSVSRECYKKILEINPKLQTQVKGYLNQVDLQEKADLQEKEAHELLDSGKNTADPRL

SEQ ID NO: 880781 - protein, 705 aa, Homo sapiens
MDADKEKDLQKFLKNVDEISNLIQEMNSDDPVVQQKAVLETEKRLLLMEEDQEEDECRTTLNKTMISPPQTAMKSAEEINSEAFLASVEKDAKERAKRRRENKVLADALKEKGNEAFAEGNYETAILRYSEGLEKLKDMKVLYTNRAQAYMKLEDYEKALVDCEWALKCDEKCTKAYFHMGKANLALKNYSVSRECYKKILEINPKLQTQVKGYLNQVDLQEKADLQEKEAHELLDSGKNTAVTTKNLLETLSKPDQIPLFYAGGIEILTEMINECTEQTLFRMHNGFSIISDNEVIRRCFSTAGNDAVEEMVCVSVLKLWQAVCSRNEENQRVLVIHHDRARLLAALLSSKVLAIRQQSFALLLHLAQTESGRSLIINHLDLTRLLEALVSFLDFSDKEANTAMGLFTDLALEERFQVWFQANLPGVLPALTGVLKTDPKVSSSSALCQCIAIMGNLSAEPTTRRHMAACEEFGDGCLSLLARCEEDVDLFREVIYTLLGLMMNLCLQAPFVSEVWAVEVSRRCLSLLNSQDGGILTRAAGVLSRTLSSSLKIVEEALRAGVVKKMMKFLKTGGETASRYAIKILAICTNSYHEAREEVIRLDKKLSVMMKLLSSEDEVLVGNAALCLGNCMEVPNVASSLLKTDLLQVLLKLAGSDTQKTAVQVNAGIALGKLCTAEPRFAAQLRKLHGLEILNSTMKYISDS

SEQ ID NO: 880782 - protein, 705 aa, Homo sapiens; identical to SEQ ID NO: 880781

SEQ ID NO: 880783 - protein, 705 aa, Homo sapiens; identical to SEQ ID NO: 880781

SEQ ID NO: 880784 - protein, 394 aa, Homo sapiens
MVCVSVLKLWQAVCSRNEENQRVLVIHHDRARLLAALLSSKVLAIRQQSFALLLHLAQTESGRSLIINHLDLTRLLEALVSFLDFSDKEANTAMGLFTDLALEERFQVWFQANLPGVLPALTGVLKTDPKVSSSSALCQCIAIMGNLSAEPTTRRHMAACEEFGDGCLSLLARCEEDVDLFREVIYTLLGLMMNLCLQAPFVSEVWAVEVSRRCLSLLNSQDGGILTRAAGVLSRTLSSSLKIVEEALRAGVVKKMMKFLKTGGETASRYAIKILAICTNSYHEAREEVIRLDKKLSVMMKLLSSEDEVLVGNAALCLGNCMEVPNVASSLLKTDLLQVLLKLAGSDTQKTAVQVNAGIALGKLCTAEPRFAAQLRKLHGLEILNSTMKYISDS

SEQ ID NO: 880785 - protein, 555 aa, Homo sapiens
MKLEDYEKALVDCEWALKCDEKCTKAYFHMGKANLALKNYSVSRECYKKILEINPKLQTQVKGYLNQVDLQEKADLQEKEAHELLDSGKNTAVTTKNLLETLSKPDQIPLFYAGGIEILTEMINECTEQTLFRMHNGFSIISDNEVIRRCFSTAGNDAVEEMVCVSVLKLWQAVCSRNEENQRVLVIHHDRARLLAALLSSKVLAIRQQSFALLLHLAQTESGRSLIINHLDLTRLLEALVSFLDFSDKEANTAMGLFTDLALEERFQVWFQANLPGVLPALTGVLKTDPKVSSSSALCQCIAIMGNLSAEPTTRRHMAACEEFGDGCLSLLARCEEDVDLFREVIYTLLGLMMNLCLQAPFVSEVWAVEVSRRCLSLLNSQDGGILTRAAGVLSRTLSSSLKIVEEALRAGVVKKMMKFLKTGGETASRYAIKILAICTNSYHEAREEVIRLDKKLSVMMKLLSSEDEVLVGNAALCLGNCMEVPNVASSLLKTDLLQVLLKLAGSDTQKTAVQVNAGIALGKLCTAEPRFAAQLRKLHGLEILNSTMKYISDS

SEQ ID NO: 880786 - protein, 284 aa, Homo sapiens [sequence omitted]

SEQ ID NO: 880787 - protein, 705 aa, Homo sapiens; identical to SEQ ID NO: 880781

SEQ ID NO: 880788 - protein, 705 aa, Homo sapiens; identical to SEQ ID NO: 880781

SEQ ID NO: 880789 - protein, 711 aa, Homo sapiens
MDADKEKDLQKFLKNVDEISNLIQEMNSDDPVVQQKAVLETEKRLLLMEEDQEEDECRTTLNKTMISPPQTAMKSAEEINSEAFLASVEKDAKERAKRRRENKVLADALKEKGNEAFAEGNYETAILRYSEGLEKLKDMKVLYTNRAQAYMKLEDYEKALVDCEWALKSFSFMQCDEKCTKAYFHMGKANLALKNYSVSRECYKKILEINPKLQTQVKGYLNQVDLQEKADLQEKEAHELLDSGKNTAVTTKNLLETLSKPDQIPLFYAGGIEILTEMINECTEQTLFRMHNGFSIISDNEVIRRCFSTAGNDAVEEMVCVSVLKLWQAVCSRNEENQRVLVIHHDRARLLAALLSSKVLAIRQQSFALLLHLAQTESGRSLIINHLDLTRLLEALVSFLDFSDKEANTAMGLFTDLALEERFQVWFQANLPGVLPALTGVLKTDPKVSSSSALCQCIAIMGNLSAEPTTRRHMAACEEFGDGCLSLLARCEEDVDLFREVIYTLLGLMMNLCLQAPFVSEVWAVEVSRRCLSLLNSQDGGILTRAAGVLSRTLSSSLKIVEEALRAGVVKKMMKFLKTGGETASRYAIKILAICTNSYHEAREEVIRLDKKLSVMMKLLSSEDEVLVGNAALCLGNCMEVPNVASSLLKTDLLQVLLKLAGSDTQKTAVQVNAGIALGKLCTAEPRFAAQLRKLHGLEILNSTMKYISDS

SEQ ID NO: 880790 - protein, 671 aa, Homo sapiens
MDADKEKDLQKFLKNVDEISNLIQEMNSDDPVVQQKAVLETEKRLLLMEEDQEEDECRTTLNKTMISPPQTAMKSAEEINSEAFLASVEKDAKERAKRRRENKVLADALKEKGNEAFAEGNYETAILRYSEGLEKLKDMKVLYTNRAQAYMKLEDYEKALVDCEWALKCDEKCTKAYFHMGKANLALKNYSVSRECYKKILEINPKLQTQVKGYLNQVDLQEKADLQEKEAHELLDSGKNTAVTTKNLLETLSKPDQIPLFYAGGIEILTEMINECTEQTLFRMHNGFSIISDNEVIRRCFSTAGNDAVEEMVCVSVLKLWQAVCSRNEENQRVLVIHHDRARLLAALLSSKVLAIRQQSFALLLHLAQTESGRSLIINHLDLTRLLEALVSFLDFSDKEANTAMGLFTDLALEERFQVWFQANLPGVLPALTGVLKTDPKVSSSSALCQCIAIMGNLSAEPTTRRHMAACEEFGDGCLSLLARCEEDVDLFREVIYTLLGLMMNLCLQAPFVSEVWAVEVSRRCLSLLNSQDGGILTRAAGVLSRTLSSSLKIVEEALRAGVVKKMMKFLKTGGETASRYAIKILAICTNSYHEAREEVIRLDKKLSVMMKLLSSEDEVLVGNAALCLGNCMEVPNVASSLLKTDLLQVLLKLAGSDTQKTAHPLPPLLI

SEQ ID NO: 880791 - protein, 422 aa, Homo sapiens
MHNGFSIISDNEVIRRCFSTAGNDAVEEMVCVSVLKLWQAVCSRNEENQRVLVIHHDRARLLAALLSSKVLAIRQQSFALLLHLAQTESGRSLIINHLDLTRLLEALVSFLDFSDKEANTAMGLFTDLALEERFQVWFQANLPGVLPALTGVLKTDPKVSSSSALCQCIAIMGNLSAEPTTRRHMAACEEFGDGCLSLLARCEEDVDLFREVIYTLLGLMMNLCLQAPFVSEVWAVEVSRRCLSLLNSQDGGILTRAAGVLSRTLSSSLKIVEEALRAGVVKKMMKFLKTGGETASRYAIKILAICTNSYHEAREEVIRLDKKLSVMMKLLSSEDEVLVGNAALCLGNCMEVPNVASSLLKTDLLQVLLKLAGSDTQKTAVQVNAGIALGKLCTAEPRFAAQLRKLHGLEILNSTMKYISDS

SEQ ID NO: 880792 - protein, 258 aa, Homo sapiens
MKTPNAQEAEGQQTRAAAGRATGSANMTKKKVSQKKQRGRPSSQPRRNIVGCRISHGWKEGDEPITQWKGTVLDQVPINPSLYLVKYDGIDCVYGLELHRDERVLSLKILSDRVASSHISDANLANTIIGKAVEHMFEGEHGSKDEWRGMVLAQAPIMKAWFYITYEKDPVLYMYQLLDDYKEGDLRIMPESSESPPTEREPGGVVDGLIGKHVEYTKEDGSKRIGMVIHQVEAKPSVYFIKFDDDFHIYVYDLVKKS

SEQ ID NO: 880793 - protein, 151 aa, Homo sapiens
MKTPNAQEAEGQQTRAAAGRATGSANMTKKKVSQKKQRGRPSSQPRRNIVGCRISHGWKEGDEPITQWKGTVLDQVPINPSLYLVKYDGIDCVYGLELHRDERVLSLKILSDRVASSHISDANLANTIIGKAVEHMFEGEHGSKDEWRGMG

SEQ ID NO: 880794 - protein, 258 aa, Homo sapiens; identical to SEQ ID NO: 880792

SEQ ID NO: 880795 - protein, 258 aa, Homo sapiens; identical to SEQ ID NO: 880792

SEQ ID NO: 880796 - protein, 165 aa, Homo sapiens
PAVDARQGMKTPNAQEAEGQQTRAAAGRATGSANMTKKKVSQKKQRGRPSSQPRRNIVGCRISHGWKEGDEPITQWKGTVLDQLLDDYKEGDLRIMPESSESPPTEREPGGVVDGLIGKHVEYTKEDGSKRIGMVIHQVEAKPSVYFIKFDDDFHIYVYDLVKKS

SEQ ID NO: 880797 - protein, 93 aa, Homo sapiens
PAVDARQGMKTPNAQEAEGQQTRAAAGRATGSANMTKKKVSQKKQRGRPSSQPRRNIVGCRISHGWKEGDEPITQWKGTVLDQLPETTGGSDK

SEQ ID NO: 880798 - protein, 33 aa, Homo sapiens
MTKKKVSQKKQRGRPSSQPRRNIVGCRISHGWK

SEQ ID NO: 880799 - protein, 428 aa, Homo sapiens
MDVVDSLLVNGSNITPPCELGLENETLFCLDQPRPSKEWQPAVQILLYSLIFLLSVLGNTLVITVLIRNKRMRTVTNIFLLSLAVSDLMLCLFCMPFNLIPNLLKDFIFGSAVCKTTTYFMGTSVSVSTFNLVAISLERYGAICKPLQSRVWQTKSHALKVIAATWCLSFTIMTPYPIYSNLVPFTKNNNQTANMCRFLLPNDVMQQSWHTFLLLILFLIPGIVMMVAYGLISLELYQGIKFEASQKKSAKERKPSTTSSGKYEDSDGCYLQKTRPPRKLELRQLSTGSSSRANRIRSNSSAANLMAKKRVIRMLIVIVVLFFLCWMPIFSANAWRAYDTASAERRLSGTPISFILLLSYTSSCVNPIIYCFMNKRFRLGFMATFPCCPNPGPPGARGEVGEEEEGGTTGASLSRFSYSHMSASVPPQ

SEQ ID NO: 880800 - protein, 175 aa, Homo sapiens
APPQTSVSGADGGSAACSWKFRLGCLLGAMESDFYLRYYVGHKGKFGHEFLEFEFRPDGKLRYANNSNYKNDVMIRKEAYVHKSVMEELKRIIDDSEITKEDDALWPPPDRVGRQELEIVIGDEHISFTTSKIGSLIDVNQSKDPEGLRVFYYLVQDLKCLVFSLIGLHFKIKPI

SEQ ID NO: 880801 - protein, 175 aa, Homo sapiens; identical to SEQ ID NO: 880800

SEQ ID NO: 880802 - protein, 161 aa, Homo sapiens
APPQTSVSGADGGSAACSWKFRLGCLLGAMESDFYLRYYVGHKGKFGHEFLEFEFRPDGKLRYANNSNYKNDVMIRKEAYVHKSVMEELKRIIDDSEITKEDDALWPPPDRVGRQELEIVIGDEHISFTTSKGSRRLTSILLSCPGPEVFGLQSYWITLQD

SEQ ID NO: 880803 - protein, 161 aa, Homo sapiens; identical to SEQ ID NO: 880802

SEQ ID NO: 880804 - protein, 161 aa, Homo sapiens; identical to SEQ ID NO: 880802

SEQ ID NO: 880805 - protein, 129 aa, Homo sapiens
APPQTSVSGADGGSAACSWKFRLGCLLGAMESDFYLRYYVGHKGKFGHEFLEFEFRPDGKLRYANNSNYKNDVMIRKEAYVHKSVMEELKRIIDDSEITKEDDALWPPPDRVGRQVCFIDYPVVQKSYK

SEQ ID NO: 880806 - protein, 136 aa, Homo sapiens
RRRKRQCRAQTAAVRLALGSSGSVVFWEPWRVTFICVTTWGTRASSATSSLECSGIISAHCNLCLLGSSDSPASASRIAGITGVLHHAQLIFVFVVEMAFHHVGQASLKLLTSGDPPALPSQSAVVTGVSRRILLV

SEQ ID NO: 880807 - protein, 138 aa, Homo sapiens
APPQTSVSGADGGSAACSWKFRLGCLLGAMESDFYLRYYVGHKGKFGHEFLEFEFRPDGKLRYANNSNYKNDVMIRKEELEIVIGDEHISFTTSKIGSLIDVNQSKDPEGLRVFYYLVQDLKCLVFSLIGLHFKIKPI

SEQ ID NO: 880808 - protein, 143 aa, Homo sapiens
APPQTSVSGADGGSAACSWKFRLGCLLGAMESDFYLRYYVGHKGKFGHEFLEFEFRPDGKLRYANNSNYKNDVMIRKEAYVHKSVMEELKRIIDDSEITKEDDALWPPPDRVGRQELEIVIGDEHISFTTSKIGSLIDVNQSK

SEQ ID NO: 880809 - protein, 143 aa, Homo sapiens; identical to SEQ ID NO: 880808

SEQ ID NO: 880810 - protein, 172 aa, Homo sapiens
APPQTSVSGADGGSAACSWKFRLGCLLGAMESDFYLRYYVGHKGKFGHEFLEFEFRPDGKLRYANNSNYKNDVMIRKEAYVHKSVMEELKRIIDDSEITKEDDALWPPPDRVGRQELEIVIGDEHISFTTSKGSRRLTSILLSCPGPEVFGLQSYWITLRLNIGVDMGGGWE

SEQ ID NO: 880811 - protein, 396 aa, Homo sapiens
MEFLKTCVLRRNACTAVCFWRSKVVQKPSVRRISTTSPRSTVMPAWVIDKYGKNEVLRFTQNMMMPIIHYPNEVIVKVHAASVNPIDVNMRSGYGATALNMKRDPLHVKIKGEEFPLTLGRDVSGVVMECGLDVKYFKPGDEVWAAVPPWKQGTLSEFVVVSGNEVSHKPKSLTHTQAASLPYVALTAWSAINKVGGLNDKNCTGKRVLILGASGGVGTFAIQVMKAWDAHVTAVCSQDASELVRKLGADDVIDYKSGSVEEQLKSLKPFDFILDNVGGSTETWAPDFLKKWSGATYVTLVTPFLLNMDRLGIADGMLQTGVTVGSKALKHFWKGVHYRWAFFMASGPCLDDIAELVDAGKIRPVIEQTFPFSKVPEAFLKVERGHARGKTVINVV

SEQ ID NO: 880812 - protein, 396 aa, Homo sapiens; identical to SEQ ID NO: 880811

SEQ ID NO: 880813 - protein, 172 aa, Homo sapiens [sequence omitted]

SEQ ID NO: 880814 - protein, 330 aa, Homo sapiens
RVTAPGGGGEMRLLALAAAALLARAPAPEVCAALNVTVSPGPVVDYLEGENATLLCHVSQKRRKDSLLAVRWFFAHSSDSQEALMVKMTKLRVVQYYGNFSRSAKRRRLRLLEEQRGALYRLSVLTLQPSDQGHYVCRVQEISRHRNKWTAWSNGSSATEMRVISLKASEESSFEKTKETWAFFEDLYVYAVLVCCVGILSILLFMLVIVWQSVFNKRKSRVRHYLVKCPQNSSGETVTSVTSLAPLQPKKGKRQKEKPDIPPPVPAKAPIAPTFHKPKLLKPQRKVTLPKIAEENLTYAELELIKPHRAAKGAPTSTVYAQILFEENKL

SEQ ID NO: 880815 - protein, 330 aa, Homo sapiens; identical to SEQ ID NO: 880814

SEQ ID NO: 880816 - protein, 345 aa, Homo sapiens
SGLGPGERGYDAACVARSRERGPGCRLRSSVMCARVRRRQVSLVSTRGAPWSQLQRGGVRTKMRTSSLVAGPPRKDRRKDSLLAVRWFFAHSSDSQEALMVKMTKLRVVQYYGNFSRSAKRRRLRLLEEQRGALYRLSVLTLQPSDQGHYVCRVQEISRHRNKWTAWSNGSSATEMRVISLKASEESSFEKTKETWAFFEDLYVYAVLVCCVGILSILLFMLVIVWQSVFNKRKSRVRHYLVKCPQNSSGETVTSVTSLAPLQPKKGKRQKEKPDIPPPVPAKAPIAPTFHKPKLLKPQRKVTLPKIAEENLTYAELELIKPHRAAKGAPTSTVYAQILFEENKL

SEQ ID NO: 880817 - protein, 233 aa, Homo sapiens
RVTAPGGGGEMRLLALAAAALLARAPAPEVCAALNVTVSPGPVVDYLEGENATLLCHVSQKRRKDSLLAVRWFFAHSSDSQEALMVKMTKLRVVQYYGNFSRSAKRRRLRLLEEQRGALYRLSVLTLQPSDQGHYVCRVQEISRHRNKWTAWSNGSSATEMRVISLKASEESSFEKTKETWAFFEDLYVYAVLVCCVGILSILLFMLVIVWQSVFNKRKSRVRHYLVKCPQNR

SEQ ID NO: 880818 - protein, 797 aa, Homo sapiens
MGNYKSRPTQTCTDEWKKKVSESYVITIERLEDDLQIKEKELTELRNIFGSDEAFSKVNLNYRTENGLSLLHLCCICGGKKSHIRTLMLKGLRPSRLTRNGFTALHLAVYKDNAELITSLLHSGADIQQVGYGGLTALHIATIAGHLEAADVLLQHGANVNIQDAVFFTPLHIAAYYGHEQVTRLLLKFGADVNVSGEVGDRPLHLASAKGFLNIAKLLMEEGSKADVNAQDNEDHVPLHFCSRFGHHDIVKYLLQSDLEVQPHVVNIYGDTPLHLACYNGKFEVAKEIIQISGTESLTKENIFSETAFHSACTYGKSIDLVKFLLDQNVININHQGRDGHTGLHSACYHGHIRLVQFLLDNGADMNLVACDPSRSSGEKDEQTCLMWAYEKGHDAIVTLLKHYKRPQDELPCNEYSQPGGDGSYVSVPSPLGKIKSMTKEKADILLLRAGLPSHFHLQLSEIEFHEIIGSGSFGKVYKGRCRNKIVAIKRYRANTYCSKSDVDMFCREVSILCQLNHPCVIQFVGACLNDPSQFAIVTQYISGGSLFSLLHEQKRILDLQSKLIIAVDVAKGMEYLHNLTQPIIHRDLNSHNILLYEDGHAVVADFGESRFLQSLDEDNMTKQPGNLRWMAPEVFTQCTRYTIKADVFSYALCLWEILTGEIPFAHLKPAAAAADMAYHHIRPPIGYSIPKPISSLLIRGWNACPEGRPEFSEVVMKLEECLCNIELMSPASSNSSGSLSPSSSSDCLVNRGGPGRSHVAALRSRFELEYALNARSYAALSQSAGQYSSQVCLWRR

SEQ ID NO: 880819 - protein, 298 aa, Homo sapiens
PSPCGLHFLIPWLTQDNAELITSLLHSGADIQQVGYGGLTALHIATIAGHLEAADVLLQHGANVNIQDAVFFTPLHIAAYYGHEQVTRLLLKFGADVNVSGEVGDRPLHLASAKGFLNIAKLLMEEGSKADVNAQDNEDHVPLHFCSRFGHHDIVKYLLQSDLEVQPHVVNIYGDTPLHLACYNGKFEVAKEIIQISGTESLTKENIFSETAFHSACTYGKSIDLVKFLLDQNVININHQGRDGHTGLHSACYHGHIRLVQFLLDNGADMNLVACDQRFCENVELAGFNAVLSSGFRQ

SEQ ID NO: 880820 - protein, 263 aa, Homo sapiens
MRAVRRGLREGGAMAAARDPPEVSLREATQRKLRRFSELRGKLVARGEFWDIVAITAADEKQELAYNQQLSEKLKRKELPLGVQYHVFVDPAGAKIGNGGSTLCALQCLEKLYGDKWNSFTILLIHSDEWKKKVSESYVITIERLEDDLQIKEKELTELRNIFGSDEAFSKVNLNYRTENGLSLLHLCCICGGKKSHIRTLMLKGLRPSRLTRNGFTALHLAVYKDNAELITSLLHSGADIQQVGYGGLTALHIATIAGHLEL

SEQ ID NO: 880821 - protein, 911 aa, Homo sapiens
MRAVRRGLREGGAMAAARDPPEVSLREATQRKLRRFSELRGKLVARGEFWDIVAITAADEKQELAYNQQLSEKLKRKELPLGVQYHVFVDPAGAKIGNGGSTLCALQCLEKLYGDKWNSFTILLIHSDEWKKKVSESYVITIERLEDDLQIKEKELTELRNIFGSDEAFSKVNLNYRTENGLSLLHLCCICGGKKSHIRTLMLKGLRPSRLTRNGFTALHLAVYKDNAELITSLLHSGADIQQVGYGGLTALHIATIAGHLEAADVLLQHGANVNIQDAVFFTPLHIAAYYGHEQVTRLLLKFGADVNVSGEVGDRPLHLASAKGFLNIAKLLMEEGSKADVNAQDNEDHVPLHFCSRFGHHDIVKYLLQSDLEVQPHVVNIYGDTPLHLACYNGKFEVAKEIIQISGTESLTKENIFSETAFHSACTYGKSIDLVKFLLDQNVININHQGRDGHTGLHSACYHGHIRLVQFLLDNGADMNLVACDPSRSSGEKDEQTCLMWAYEKGHDAIVTLLKHYKRPQDELPCNEYSQPGGDGSYVSVPSPLGKIKSMTKEKADILLLRAGLPSHFHLQLSEIEFHEIIGSGSFGKVYKGRCRNKIVAIKRYRANTYCSKSDVDMFCREVSILCQLNHPCVIQFVGACLNDPSQFAIVTQYISGGSLFSLLHEQKRILDLQSKLIIAVDVAKGMEYLHNLTQPIIHRDLNSHNILLYEDGHAVVADFGESRFLQSLDEDNMTKQPGNLRWMAPEVFTQCTRYTIKADVFSYALCLWEILTGEIPFAHLKPAAAAADMAYHHIRPPIGYSIPKPISSLLIRGWNACPEGRPEFSEVVMKLEECLCNIELMSPASSNSSGSLSPSSSSDCLVNRGGPGRSHVAALRSRFELEYALNARSYAALSQSAGQYSSQVCLWRR

SEQ ID NO: 880822 - protein, 911 aa, Homo sapiens; identical to SEQ ID NO: 880821

SEQ ID NO: 880823 - protein, 911 aa, Homo sapiens; identical to SEQ ID NO: 880821

SEQ ID NO: 880824 - protein, 911 aa, Homo sapiens; identical to SEQ ID NO: 880821

SEQ ID NO: 880825 - protein, 707 aa, Homo sapiens
MRAVRRGLREGGAMAAARDPPEVSLREATQRKLRRFSELRGKLVARGEFWDIVAITAADEKQELAYNQQLSEKLKRKELPLGVQYHVFVDPAGAKIGNGGSTLCALQCLEKLYGDKWNSFTILLIHSDEWKKKVSESYVITIERLEDDLQIKEKELTELRNIFGSDEAFSKVNLNYRTENGLSLLHLCCICGGKKSHIRTLMLKGLRPSRLTRNGFTALHLAVYKDNAELITSLLHSGADIQQVGYGGLTALHIATIAGHLEAADVLLQHGANVNIQDAVFFTPLHIAAYYGHEQVTRLLLKFGADVNVSGEVGDRPLHLASAKGFLNIAKLLMEEGSKADVNAQDNEDHVPLHFCSRFGHHDIVKYLLQSDLEVQPHVVNIYGDTPLHLACYNGKFEVAKEIIQISGTESLTKENIFSETAFHSACTYGKSIDLVKFLLDQNVININHQGRDGHTGLHSACYHGHIRLVQFLLDNGADMNLVACDPSRSSGEKDEQTCLMWAYEKGHDAIVTLLKHYKRPQDELPCNEYSQPGGDGSYVSVPSPLGKIKSMTKEKADILLLRAGLPSHFHLQLSEIEFHEIIGSGSFGKVYKGRCRNKIVAIKRYRANTYCSKSDVDMFCREVSILCQLNHPCVIQFVGACLNDPSQFAIVTQYISGGSLFSLLHEQKRILDLQSKLIIAVDVAKGMEYLHNLTQPIIHRDLNRAS

SEQ ID NO: 880826 - protein, 856 aa, Homo sapiens
MRAVRRGLREGGAMAAARDPPEVSLREATQRKLRRFSELRGKLVARGEFWDIVAITAADEKQELAYNQQLSEKLKRKELPLGVQYHVFVDPAGAKIGNGGSTLCALQCLEKLYGDKWNSFTILLIHSDEWKKKVSESYVITIERLEDDLQIKEKELTELRNIFGSDEAFSKVNLNYRTENGLSLLHLCCICGGKKSHIRTLMLKGLRPSRLTRNGFTALHLAVYKDNAELITSLLHSGADIQQVGYGGLTALHIATIAGHLEAADVLLQHGANVNIQDAVFFTPLHIAAYYGHEQVTRLLLKFGADVNVSGEVGDRPLHLASAKGFLNIAKLLMEEGSKADVNAQDNEDHVPLHFCSRFGHHDIVKYLLQSDLEVQPHVVNIYGDTPLHLACYNGKFEVAKEIIQISGTESLTKENIFSETAFHSACTYGKSIDLVKFLLDQNVININHQGRDGHTGLHSACYHGHIRLVQFLLDNGADMNLVACDPSRSSGEKDEQTCLMWAYEKGHDAIVTLLKHYKRPQDELPCNEYSQPGGDGSYVSVPSPLGKIKSMTKEKADILLLRAGLPSHFHLQLSEIEFHEIIGSGSFGKVYKGRCRNKIVAIKRYRANTYCSKSDVDMFCREVSILCQLNHPCVIQFVGACLNDPSQFAIVTQYISGGSLFSLLHEQKRILDLQSKLIIAVDVAKGMEYLHNLTQPIIHRDLNSHNILLYEDGHAVVADFGESRFLQSLDEDNMTKQPGNLRWMAPEVFTQCTRYTIKADVFSYALCLWEILTGEIPFAHLKPAAAAADMAYHHIRPPIGYSIPKPISSLLIRGWNACPEAKSRPSHYPVSSVYTETLKKKNEDRFGMWIEYLRR

SEQ ID NO: 880827 - protein, 508 aa, Homo sapiens
MRAVRRGLREGGAMAAARDPPEVSLREATQRKLRRFSELRGKLVARGEFWDIVAITAADEKQELAYNQQLSEKLKRKELPLGVQYHVFVDPAGAKIGNGGSTLCALQCLEKLYGDKWNSFTILLIHSDEWKKKVSESYVITIERLEDDLQIKEKELTELRNIFGSDEAFSKVNLNYRTENGLSLLHLCCICGGKKSHIRTLMLKGLRPSRLTRNGFTALHLAVYKDNAELITSLLHSGADIQQVGYGGLTALHIATIAGHLEAADVLLQHGANVNIQDAVFFTPLHIAAYYGHEQVTRLLLKFGADVNVSGEVGDRPLHLASAKGFLNIAKLLMEEGSKADVNAQDNEDHVPLHFCSRFGHHDIVKYLLQSDLEVQPHVVNIYGDTPLHLACYNGKFEVAKEIIQISGTESLTKENIFSETAFHSACTYGKSIDLVKFLLDQNVININHQGRDGHTGLHSACYHGHIRLVQFLLDNGADMNLVACDQRFCENVELAGFNAVLSSGFRQ

SEQ ID NO: 880828 - protein, 717 aa, Homo sapiens
MRAVRRGLREGGAMAAARDPPEVSLREATQRKLRRFSELRGKLVARGEFWDIVAITAADEKQELAYNQQLSEKLKRKELPLGVQYHVFVDPAGAKIGNGGSTLCALQCLEKLYGDKWNSFTILLIHSDEWKKKVSESYVITIERLEDDLQIKEKELTELRNIFGSDEAFSKVNLNYRTENGLSLLHLCCICGGKKSHIRTLMLKGLRPSRLTRNGFTALHLAVYKDNAELITSLLHSGADIQQVGYGGLTALHIATIAGHLEAADVLLQHGANVNIQDAVFFTPLHIAAYYGHEQVTRLLLKFGADVNVSGEVGDRPLHLASAKGFLNIAKLLMEEGSKADVNAQDNEDHVPLHFCSRFGHHDIVKYLLQSDLEVQPHVVNIYGDTPLHLACYNGKFEVAKEIIQISGTESLTKENIFSETAFHSACTYGKSIDLVKFLLDQNVININHQGRDGHTGLHSACYHGHIRLVQFLLDNGADMNLVACDPSRSSGEKDEQTCLMWAYEKGHDAIVTLLKHYKRPQDELPCNEYSQPGGDGSYVSVPSPLGKIKSMTKEKADILLLRAGLPSHFHLQLSEIEFHEIIGSGSFGKVYKGRCRNKIVAIKRYRANTYCSKSDVDMFCREVSILCQLNHPCVIQFVGACLNDPSQFAIVTQYISGGSLFSLLHEQKRILDLQSKLIIAVDVAKGMEYLHNLTQPIIHRDLNRCCTGWLSCYHPD

SEQ ID NO: 880829 - protein, 704 aa, Homo sapiens
MRAVRRGLREGGAMAAARDPPEVSLREATQRKLRRFSELRGKLVARGEFWDIVAITAADEKQELAYNQQLSEKLKRKELPLGVQYHVFVDPAGAKIGNGGSTLCALQCLEKLYGDKWNSFTILLIHSDEWKKKVSESYVITIERLEDDLQIKEKELTELRNIFGSDEAFSKVNLNYRTENGLSLLHLCCICGGKKSHIRTLMLKGLRPSRLTRNGFTALHLAVYKDNAELITSLLHSGADIQQVGYGGLTALHIATIAGHLEAADVLLQHGANVNIQDAVFFTPLHIAAYYGHEQVTRLLLKFGADVNVSGEVGDRPLHLASAKGFLNIAKLLMEEGSKADVNAQDNEDHVPLHFCSRFGHHDIVKYLLQSDLEVQPHVVNIYGDTPLHLACYNGKFEVAKEIIQISGTESLTKENIFSETAFHSACTYGKSIDLVKFLLDQNVININHQGRDGHTGLHSACYHGHIRLVQFLLDNGADMNLVACDPSRSSGEKDEQTCLMWAYEKGHDAIVTLLKHYKRPQDELPCNEYSQPGGDGSYVSVPSPLGKIKSMTKEKADILLLRAGLPSHFHLQLSEIEFHEIIGSGSFGKVYKGRCRNKIVAIKRYRANTYCSKSDVDMFCREVSILCQLNHPCVIQFVGACLNDPSQFAIVTQYISGGSLFSLLHEQKRYGSFVLIYPWTFRRNYSCNTSEGFPLDEPSPFEI

SEQ ID NO: 880830 - protein, 513 aa, Homo sapiens
MQRTFAWLLDRVQHLGAPVTLRASYLEIYNEQVRDLLSLGSPRPLPVRWNKTRGFYVEQLRVVEFGSLEALMELLQTGLSRRRNSAHTLNQASSRSHALLTLYISRQTAQQMPSVDPGEPPVGGKLCFVDLAGSEKVAATGSRGELMLEANSINRSLLALGHCISLLLDPQRKQSHIPFRDSKLTKLLADSLGGRGVTLMVACVSPSAQCLPETLSTLRYASRAQRVTTRPQAPKSPVAKQPQRLETEMLQLQEENRRLQFQLDQMDCKASGLSGARVAWAQRNLYGMLQEFMLENERLRKEKSQLQNSRDLAQNEQRILAQQVHALERRLLSACYHHQQGPGLTPPCPCLMAPAPPCHALPPLYSCPCCHICPLCRVPLAHWACLPGEHHLPQVLDPEASGGRPPSARPPPWAPPCSPGSAKCPRERSHSDWTQTRVLAEMLTEEEVVPSAPPLPVRPPKTSPGLRGGAGVPNLAQRLEALRDQIGSSLRRGRSQPPCSEGARSPGQVLPPH

SEQ ID NO: 880831 - protein, 402 aa, Homo sapiens [sequence omitted]

SEQ ID NO: 880832 - protein, 402 aa, Homo sapiens [sequence omitted]

SEQ ID NO: 880833 - protein, 293 aa, Homo sapiens [sequence omitted]

SEQ ID NO: 880834 - protein, 318 aa, Homo sapiens
MRGIERQPMRKRSASFQGAWIKGQKRRWGLLSVRSGDGWTQKDPLPSPSSLPSQVRDLLSLGSPRPLPVRWNKTRGFYVEQLRVVEFGSLEALMELLQTGLSRRRNSAHTLNQASSRSHALLTLYISRQTAQQMPSVDPGEPPVGGKLCFVDLAGSEKVAATGSRGELMLEANSINRSLLALGHCISLLLDPQRKQSHIPFRDSKLTKLLADSLGGRGVTLMVACVSPSAQCLPETLSTLRYASRAQRVTTRPQAPKSPVAKQPQRLETEMLQLQEENRRLQFQLDQMDCKGKKRASCRIAETWPRMSSASWPSRSMH

SEQ ID NO: 880835 - protein, 385 aa, Homo sapiens
MPSVDPGEPPVGGKLCFVDLAGSEKVAATGSRGELMLEANSINRSLLALGHCISLLLDPQRKQSHIPFRDSKLTKLLADSLGGRGVTLMVACVSPSAQCLPETLSTLRYASRAQRVTTRPQAPKSPVAKQPQRLETEMLQLQEENRRLQFQLDQMDCKASGLSGARVAWAQRNLYGMLQEFMLENERLRKEKSQLQNSRDLAQNEQRILAQQVHALERRLLSACYHHQQGPGLTPPCPCLMAPAPPCHALPPLYSCPCCHICPLCRVPLAHWACLPGEHHLPQVLDPEASGGRPPSARPPPWAPPCSPGSAKCPRERSHSDWTQTRVLAEMLTEEEVVPSAPPLPVRPPKTSPGLRGEEGREGGAPNVLCDLGVEPTLSRPQSYL

SEQ ID NO: 880836 - protein, 323 aa, Homo sapiens
MPSVDPGEPPVGGKLCFVDLAGSEKVAATGSRGELMLEANSINRSLLALGHCISLLLDPQRKQSHIPFRDSKLTKLLADSLGGRGVTLMVACVSPSAQCLPETLSTLRYASRAQRVTTRPQAPKSPVAKQPQRLETEMLQLQEENRRLQFQLDQMDCKASGLSGARVAWAQRNLYGMLQEFMLENERLRKEKSQLQNSRDLAQNEQRILAQQVHALERRLLSACYHHQQGPGLTPPCPCLMAPAPPCHVSLTAQPGGVTSRDVMEPLTHLFAGTATPLLLPLLPHLPTVSSAPGPLGLPARGAPPAPDKSGCSLGILQGAGKE

SEQ ID NO: 880837 - protein, 115 aa, Homo sapiens
VDTLRTLAAAGPCTREASPLCLLPSPAGSWPDPTVSLLDGPSSPLPCTATPLLLPLLPHLPTVSSAPGPLGLPARGAPPAPGRKGHGGSEGRLGELETLIQESSIQSPRDSRAAG

SEQ ID NO: 880838 - protein, 535 aa, Homo sapiens
MRGIERQPMRKRSASFQGAWIKGQKRRWGLLSVRSGDGWTQKDPLPSPSSLPSQVRDLLSLGSPRPLPVRWNKTRGFYVEQLRVVEFGSLEALMELLQTGLSRRRNSAHTLNQASSRSHALLTLYISRQTAQQMPSVDPGEPPVGGKLCFVDLAGSEKVAATGSRGELMLEANSINRSLLALGHCISLLLDPQRKQSHIPFRDSKLTKLLADSLGGRGVTLMVACVSPSAQCLPETLSTLRYASRAQRVTTRPQAPKSPVAKQPQRLETEMLQLQEENRRLQFQLDQMDCKASGLSGARVAWAQRNLYGMLQEFMLENERLRKEKSQLQNSRDLAQNEQRILAQQVHALERRLLSACYHHQQGPGLTPPCPCLMAPAPPCHALPPLYSCPCCHICPLCRVPLAHWACLPGEHHLPQVLDPEASGGRPPSARPPPWAPPCSPGSAKCPRERSHSDWTQTRVLAEMLTEEEVVPSAPPLPVRPPKTSPGLRGGAGVPNLAQRLEALRDQIGSSLRRGRSQPPCSEGARSPGQVLPPH

SEQ ID NO: 880839 - protein, 385 aa, Homo sapiens; identical to SEQ ID NO: 880835

SEQ ID NO: 880840 - protein, 318 aa, Homo sapiens; identical to SEQ ID NO: 880834

SEQ ID NO: 880841 - protein, 169 aa, Homo sapiens
MSRSQPSKELSPHPEPGLQPKPCPAHPLHQPSNCHCISLLLDPQRKQSHIPFRDSKLTKLLADSLGGRGVTLMVACVSPSAQCLPETLSTLRYASRAQRVTTRPQAPKSPVAKQPQRLETEMLQLQEENRRLQFQLDQMDCKGKKRASCRIAETWPRMSSASWPSRSMH

SEQ ID NO: 880842 - protein, 103 aa, Homo sapiens
VDTLRTLAAAGPCTREASPLCLLPSPAGSWPDPTVSLLDGPSSPLPCTATPLLLPLLPHLPTVSSAPGPLGLPARGAPPAPASLLGSEESEIDQTWFLLSGGF

SEQ ID NO: 880843 - protein, 137 aa, Homo sapiens
QRAGAAREATMRGAGAILRPAARGARDLNPRRDISSWLAQWFPRTPARSVVALKTPIKVELVAGKTYRWCVCGRSKKQPFCDGSHFFQRTGLSPLKFKAQETRMVALCTCKATQRPPYCDGTHRSERVQKAEVGSPL

SEQ ID NO: 880844 - protein, 137 aa, Homo sapiens; identical to SEQ ID NO: 880843

SEQ ID NO: 880845 - protein, 122 aa, Homo sapiens
QRAGAAREATMRGAGAILRPAARGARVSTPALHQPPSRTPAGPLPAPTPAPARPSIPELPARPAGVWLASAHRLFPSASPCQDLRSQHLLLRPFSYPLIPPSPLQPCHLLLPRWPPVSFPFH

SEQ ID NO: 880846 - protein, 170 aa, Homo sapiens
PECLHGFEISLSKAHGPMVSWGTVLLGGIRSASCRGNLPHTQASGKLGRVAGRTVLPGLELTLSPSSSLAQAQWFPRTPARSVVALKTPIKVELVAGKTYRWCVCGRSKKQPFCDGSHFFQRTGLSPLKFKAQETRMVALCTCKATQRPPYCDGTHRSERVQKAEVGSPL

SEQ ID NO: 880847 - protein, 137 aa, Homo sapiens; identical to SEQ ID NO: 880843

SEQ ID NO: 880848 - protein, 116 aa, Homo sapiens
MYGDMIPVEIKEAGGTTTSNNPEEATLQNLLAQESCCKFPSSQELEDASCCSLKKDSNPMVICQLKGGTQMLCIDNSRTRELKALHLVPQYQDQNNYLQSGTKLINKKNYVIYVSW

SEQ ID NO: 880849 - protein, 560 aa, Homo sapiens
SGFLSLTLPPSPTANGRLRLGPAHAPSRSLHAAAAPAAPGARPRHPAPPPCAMEEGPLPGGLPSPEDAMVTELLSPEGPFASENIGLKAPVKYEEDEFHVFKEAYLGPADPKEPVLHAFNPALGADCKGQVKAKLAGGDSDGGELLGEYPGIPELSALEDVALLQAPQPPACNVHFLSSLLPAHRSPAVLPLGAWVLEGASHPGVRMIPVEIKEAGGTTTSNNPEEATLQNLLAQESCCKFPSSQELEDASCCSLKKDSNPMVICQLKGGTQMLCIDNSRTRELKALHLVPQYQDQNNYLQSDVPKPMTALVGRFLPASTKLNLITQQLEGALPSVVNGSAFPSGSTLPGPPKITLAGYCDCFASGDFCNNCNCNNCCNNLHHDIERFKAIKACLGRNPEAFQPKIGKGQLGNVKPQHNKGCNCRRSGCLKNYCECYEAQIMCSSICKCIGCKNYEESPERKTLMSMPNYMQTGGLEGSHYLPPTKFSGLPRFSHDRRPSSCISWEVVEATCACLLAQGEEAEKEHCSKCLAEQMILEEFGRCLSQILHTEFKSKGLKME

SEQ ID NO: 880850 - protein, 563 aa, Homo sapiens
SGFLSLTLPPSPTANGRLRLGPAHAPSRSLHAAAAPAAPGARPRHPAPPPCAMEEGPLPGGLPSPEDAMVTELLSPEGPFASENIGLKAPVKYEEDEFHVFKEAYLGPADPKEPVLHAFNPALGADCKGQVKAKLAGGDSDGGELLGEYPGIPELSALEDVALLQAPQPPACNVHFLSSLLPAHRSPAVLPLGAWVLEGASHPGVRMIPVEIKEAGGTTTSNNPEEATLQNLLAQESCCKFPSSQELEDASCCSLKKDSNPMVICQLKGGTQMLCIDNSRTRELKALHLVPQYQDQNNYLQSDVPKPMTALVGRFLPASTKLNLITQQLEGALPSVVNGSAFPSGSTLPGPPKITLAGYCDCFASGDFCNNCNCNNCCNNLHHDIERFKAIKACLGRNPEAFQPKIGKGQLGNVKPQHNKGCNCRRSGCLKNYCECYEAQIMCSSICKCIGCKNYEESPERKTLMSMPNYMQTGGLEGSHYLPPTKFSGLPRFSHDRRPSSCISWEVVEATCACLLAQGEEAEKEHCSKCLAEQMILEEFGRNKFSGWAVVIPLKISRELLNT

SEQ ID NO: 880851 - protein, 207 aa, Homo sapiens
RVPVPHPSPFSNRQRPPAPEARPTPHPARSTLRQPRRPQVRGPRHPAPPPCAMEEGPLPGGLPSPEDAMVTELLSPEGPFASENIGLKAPVKYEEDEFHVFKEAYLGPADPKEPVLHAFNPALGADCKGQVKAKLAGGDSDGGELLGEYPGIPELSALEDVALLQAPQPPACNVHFLSSLLPAHRSPRGVAPGAPGSWKEPPTRASA

SEQ ID NO: 880852 - protein, 560 aa, Homo sapiens; identical to SEQ ID NO: 880849

SEQ ID NO: 880853 - protein, 207 aa, Homo sapiens; identical to SEQ ID NO: 880851

SEQ ID NO: 880854 - protein, 223 aa, Homo sapiens [sequence omitted]

SEQ ID NO: 880855 - protein, 174 aa, Homo sapiens [sequence omitted]

SEQ ID NO: 880856 - protein, 496 aa, Homo sapiens
MWQIVFFTLSCDLVLAAAYNNFRKSMDSIGKKQYQVQHGSCSYTFLLPEMDNCRSSSSPYVSNAVQRDAPLEYDDSVQRLQVLENIMENNTQWLMKLENYIQDNMKKEMVEIQQNAVQNQTAVMIEIGTNLLNQTAEQTRKLTDVEAQVLNQTTRLELQLLEHSLSTNKLEKQILDQTSEINKLQDKNSFLEKKVLAMEDKHIIQLQSIKEEKDQLQVLVSKQNSIIEELEKKIVTATVNNSVLQKQQHDLMETVNNLLTMMSTSNSAKDPTVAKEEQISFRDCAEVFKSGHTTNGIYTLTFPNSTEEIKAYCDMEAGGGGWTIIQRREDGSVDFQRTWKEYKVGFGNPSGEYWLGNEFVSQLTNQQRYVLKIHLKDWEGNEAYSLYEHFYLSSEELNYRIHLKGLTGTAGKISSISQPGNDFSTKDGDNDKCICKCSQMLTGGWWFDACGPSNLNGMYYPQRQNTNKFNGIKWYYWKGSGYSLKATTMMIRPADF

SEQ ID NO: 880857 - protein, 496 aa, Homo sapiens; identical to SEQ ID NO: 880856

SEQ ID NO: 880858 - protein, 444 aa, Homo sapiens
MWQIVFFTLSCDLVLAAAYNNFRKSMDSIGKKQYQVQHGSCSYTFLLPEMDNCRSSSSPYVSNAVQRDAPLEYDDSVQRLQVLENIMENNTQWLMKVLNQTTRLELQLLEHSLSTNKLEKQILDQTSEINKLQDKNSFLEKKVLAMEDKHIIQLQSIKEEKDQLQVLVSKQNSIIEELEKKIVTATVNNSVLQKQQHDLMETVNNLLTMMSTSNSAKDPTVAKEEQISFRDCAEVFKSGHTTNGIYTLTFPNSTEEIKAYCDMEAGGGGWTIIQRREDGSVDFQRTWKEYKVGFGNPSGEYWLGNEFVSQLTNQQRYVLKIHLKDWEGNEAYSLYEHFYLSSEELNYRIHLKGLTGTAGKISSISQPGNDFSTKDGDNDKCICKCSQMLTGGWWFDACGPSNLNGMYYPQRQNTNKFNGIKWYYWKGSGYSLKATTMMIRPADF

SEQ ID NO: 880859 - protein, 392 aa, Homo sapiens
MKKEMVEIQQNAVQNQTAVMIEIGTNLLNQTAEQTRKLTDVEAQVLNQTTRLELQLLEHSLSTNKLEKQILDQTSEINKLQDKNSFLEKKVLAMEDKHIIQLQSIKEEKDQLQVLVSKQNSIIEELEKKIVTATVNNSVLQKQQHDLMETVNNLLTMMSTSNSAKDPTVAKEEQISFRDCAEVFKSGHTTNGIYTLTFPNSTEEIKAYCDMEAGGGGWTIIQRREDGSVDFQRTWKEYKVGFGNPSGEYWLGNEFVSQLTNQQRYVLKIHLKDWEGNEAYSLYEHFYLSSEELNYRIHLKGLTGTAGKISSISQPGNDFSTKDGDNDKCICKCSQMLTGGWWFDACGPSNLNGMYYPQRQNTNKFNGIKWYYWKGSGYSLKATTMMIRPADF

SEQ ID NO: 880860 - protein, 153 aa, Homo sapiens
MWQIVFFTLSCDLVLAAAYNNFRKSMDSIGKKQYQVQHGSCSYTFLLPEMDNCRSSSSPYVSNAVQRDAPLEYDDSVQRLQVLENIMENNTQWLMKLENYIQDNMKKEMVEIQQNAVQNQTAVMIEIGTNLLNQTAEQTRKLTDVEAQVSNAT

SEQ ID NO: 880861 - protein, 123 aa, Homo sapiens
MWQIVFFTLSCDLVLAAAYNNFRKSMDSIGKKQYQVQHGSCSYTFLLPEMDNCRSSSSPYVSNAVQRDAPLEYDDSVQRLQVLENIMENNTQWLMKGKKSICLCEHAIKISLAAAQVLTTKKK

SEQ ID NO: 880862 - protein, 130 aa, Homo sapiens
MWQIVFFTLSCDLVLAAAYNNFRKSMDSIGKKQYQVQHGSCSYTFLLPEMDNCRSSSSPYVSNAVQRDAPLEYDDSVQRLQVLENIMENNTQWLMKQRESKLLNATVFKTGGRRIRRKLESRIKTSDTFS

SEQ ID NO: 880863 - protein, 336 aa, Homo sapiens
MLQRGLWPWRTRLLPTPGTWRPARPWPLPPPPQVLRVKLCGNVKYYQSHHYSTVVPPDEITVIYRHGLPLVTLTLPSRKERCQFVVKPMLSTVGSFLQDLQNEDKGIKTAAIFTADGNMISASTLMDILLMNDFKLVINKIAYDVQCPKREKPSNEHTAEMEHMKSLVHRLFTILHLEESQKKREHHLLEKIDHLKEQLQPLEQVKAGIEAHSEAKTSGLLWAGLALLSIQGGALAWLTWWVYSWDIMEPVTYFITFANSMVFFAYFIVTRQDYTYSAVKSRQFLQFFHKKSKQQHFDVQQYNKLKEDLAKAKESLKQARHSLCLQMQVEELNEKN

SEQ ID NO: 880864 - protein, 201 aa, Homo sapiens
VTRQDYTYSAVKSRQKKPSNEHTAEMEHMKSLVHRLFTILHLEESQKKREHHLLEKIDHLKEQLQPLEQVKAGIEAHSEAKTSGLLWAGLALLSIQGGALAWLTWWVYSWDIMEPVTYFITFANSMVFFAYFIVTRQDYTYSAVKSRQFLQFFHKKSKQQHFDVQQYNKLKEDLAKAKESLKQARHSLCLQMQVEELNEKN

SEQ ID NO: 880865 - protein, 105 aa, Homo sapiens
NISLIHLPSFALVLLSQVSFLQRHYVHSKHVVFFSLSFFFKDYTYSAVKSRQFLQFFHKKSKQQHFDVQQYNKLKEDLAKAKESLKQARHSLCLQMQVEELNEKN

SEQ ID NO: 880866 - protein, 129 aa, Homo sapiens
PKLEPRRAERAGGAGAPTARSHQALTRSPAEGGCAADACGSRAPGAGGCSRGASGRGARGCCRPLAPGAQRARGRCRLRPSLCLPLSAVSLCYRGWTVLTRSRLTATSLPDSPASACRVPGIAGARRHA

SEQ ID NO: 880867 - protein, 136 aa, Homo sapiens
ADMLQPLEQVKAGIEAHSEAKTSGLLWAGLALLSIQGGALAWLTWWVYSWDIMEPVTYFITFANSMVFFAYFIVTRQDYTYSAVKSRQFLQFFHKKSKQQHFDVQQYNKLKEDLAKHKESLKQAVCFTVYRAIGSR

SEQ ID NO: 880868 - protein, 336 aa, Homo sapiens; identical to SEQ ID NO: 880863

SEQ ID NO: 880869 - protein, 354 aa, Homo sapiens
GEAQRMLHRGLWPWCTRLLPTWDHGWPSGRPCVCGLLDLLNTQGFSACRTHAVGRIVIHTYQFIDAILVPSCATVSQITVIYRHGLPLVTLTLPSRKERCQFVVKPMLSTVGSFLQDLQNEDKGIKTAAIFTADGNMISASTLMDILLMNDFKLVINKIAYDVQCPKREKPSNEHTAEMEHMKSLVHRLFTILHLEESQKKREHHLLEKIDHLKEQLQPLEQVKAGIEAHSEAKTSGLLWAGLALLSIQGGALAWLTWWVYSWDIMEPVTYFITFANSMVFFAYFIVTRQDYTYSAVKSRQFLQFFHKKSKQQHFDVQQYNKLKEDLAKAKESLKQARHSLCLQMQVEELNEKN

SEQ ID NO: 880870 - protein, 272 aa, Homo sapiens
MLQRGLWPWRTRLLPTPGTWRPARPWPLPPPPQVLRVKLCGNVKYYQSHHYSTVVPPDEITVIYRHGLPLVTLTLPSRKERCQFVVKPMLSTVGSFLQDLQNEDKGIKTAAIFTADGNMISASTLMDILLMNDFKLVINKIAYDVQCPKREKPSNEHTAEMEHMKSLVHRLFTILHLEESQKKREHHLLEKIDHLKEQLQPLEQVKAGIEAHSEAKTSGLLWAGLALLSIQGGALAWLTWIILTQLLRVGNFFSSSTRNQSNSTLMCSNTTS

SEQ ID NO: 880871 - protein, 104 aa, Homo sapiens [sequence omitted]

SEQ ID NO: 880872 - protein, 175 aa, Homo sapiens
MLPPMALPSVSWMLLSCLILLCQVQGEETQKELPSPRISCPKGSKAYGSPCYALFLSPKSWMDADLACQKRPSGKLVSVLSGAEGSFVSSLVRSISNSYSYIWIGLHDPTQGSEPDGDGWEWSSTDVMNYFAWEKNPSTILNPGHCGSLSRSTGFLKWKDYNCDAKLPYVCKFKD

SEQ ID NO: 880873 - protein, 129 aa, Homo sapiens
MLPPMALPSVSWMLLSCLILLCQVQGEETQKELPSPRISCPKGSKAYGSPCYALFLSPKSWMDADGSEPDGDGWEWSSTDVMNYFAWEKNPSTILNPGHCGSLSRSTGFLKWKDYNCDAKLPYVCKFKD

SEQ ID NO: 880874 - protein, 100 aa, Homo sapiens
MKLLAATVLLLTICSLEGALVRRQAKEPCVESLVSQYFQTVTDYGKDLMEKVKSPELQAEAKSYFEKSKEQLTPLIKKAGTELVNFLSYFVELGTQPATQ

SEQ ID NO: 880875 - protein, 100 aa, Homo sapiens; identical to SEQ ID NO: 880874

SEQ ID NO: 880876 - protein, 114 aa, Homo sapiens
PLAKGDFSKPLFGYARFPSSHVFNAASECNSPPKAEWVRGPPKVDGSIAGYQFRHRETLARAALPTVTNMKAARSNLCLLPSPICKPLKELWFGRQAKEPMCGEPLVSSVLPRP

SEQ ID NO: 880877 - protein, 93 aa, Homo sapiens
KKIHQGQETLARGRPPHCYQHESCSQQPVPTPLTHLQALEGALVRKTGKGAHVWRAPGFLSTSQTVTDYGKDLMEKVKSPELFRPRPSLTVLL

SEQ ID NO: 880878 - protein, 100 aa, Homo sapiens; identical to SEQ ID NO: 880874

SEQ ID NO: 880879 - protein, 92 aa, Homo sapiens
AQTPRTETLARGRPPHCYQHESCSQQPVPTPLTHLQALEGALVRKTGKGAHVWRAPGFLSTSQTVTDYGKDLMEKVKSPELFRPRPSLTVLL

SEQ ID NO: 880880 - protein, 92 aa, Homo sapiens; identical to SEQ ID NO: 880879

SEQ ID NO: 880881 - protein, 92 aa, Homo sapiens; identical to SEQ ID NO: 880879

SEQ ID NO: 880882 - protein, 92 aa, Homo sapiens; identical to SEQ ID NO: 880879

SEQ ID NO: 880883 - protein, 93 aa, Homo sapiens; identical to SEQ ID NO: 880877

SEQ ID NO: 880884 - protein, 100 aa, Homo sapiens; identical to SEQ ID NO: 880874

SEQ ID NO: 880885 - protein, 100 aa, Homo sapiens; identical to SEQ ID NO: 880874

SEQ ID NO: 880886 - protein, 100 aa, Homo sapiens; identical to SEQ ID NO: 880874

SEQ ID NO: 880887 - protein, 100 aa, Homo sapiens; identical to SEQ ID NO: 880874

SEQ ID NO: 880888 - protein, 100 aa, Homo sapiens; identical to SEQ ID NO: 880874

SEQ ID NO: 880889 - protein, 100 aa, Homo sapiens; identical to SEQ ID NO: 880874

SEQ ID NO: 880890 - protein, 100 aa, Homo sapiens; identical to SEQ ID NO: 880874

SEQ ID NO: 880891 - protein, 100 aa, Homo sapiens; identical to SEQ ID NO: 880874

SEQ ID NO: 880892 - protein, 100 aa, Homo sapiens; identical to SEQ ID NO: 880874

SEQ ID NO: 880893 - protein, 100 aa, Homo sapiens; identical to SEQ ID NO: 880874

SEQ ID NO: 880894 - protein, 72 aa, Homo sapiens
NSAIMAGEAQTPRTETLARAALPTVTNMKAARSNLCLLPSPICKPLKELWFGRQAKEPMCGEPLVSSVLPRP

SEQ ID NO: 880895 - protein, 143 aa, Homo sapiens
MKAARSNLCLLPSPICKPLKVGVIWRGGQKGECAGGYSYLSACALISRSGNQRAQKEDHSLSKAQKAHPKIWLDTFLGRGQRAGVGTGRGMAGGQDSLLWTQLKRGVCVCVCVCVCGQELWFGRQAKEPMCGEPLVSSVLPRP

SEQ ID NO: 880896 - protein, 149 aa, Homo sapiens
MKAARSNLCLLPSPICKPLKVGVIWRGGQKGECAGGYSYLSACALISRSGNQRAQKEDHSLSKAQKAHPKIWLDTFLGRGQRAGVGTGRGMAGGQDSLLWTQLKRGAHVWRAPGFLSTSQTVTDYGKDLMEKVKSPELFRPRPSLTVLL

SEQ ID NO: 880897 - protein, 143 aa, Homo sapiens; identical to SEQ ID NO: 880895

SEQ ID NO: 880898 - protein, 40 aa, Homo sapiens
MTNPSEGTVSRTGTEIKRRFLWLHGSVEKPGSHQVPCKAW

SEQ ID NO: 880899 - protein, 347 aa, Homo sapiens
MGARGAPSRRRQAGRRLRYLPTGSFPFLLLLLLLCIQLGGGQKKKENLLAEKVEQLMEWSSRRSIFRMNGDKFRKFIKAPPRNYSMIVMFTALQPQRQCSVCRQANEEYQILANSWRYSSAFCNKLFFSMVDYDEGTDVFQQLNMNSAPTFMHFPPKGRPKRADTFDLQRIGFAAEQLAKWIADRTDVHIRVFRPPNYSGTIALALLVSLVGGLLYLRRNNLEFIYNKTGWAMVSLCIVFAMTSGQMWNHIRGPPYAHKNPHNGQVSYIHGSSQAQFVAESHIILVLNAAITMGMVLLNEAATSKGDVGKRRIICLVGLGLVVFFFSFLLSIFRSKYHGYPYSFLIK

SEQ ID NO: 880900 - protein, 347 aa, Homo sapiens; identical to SEQ ID NO: 880899

SEQ ID NO: 880901 - protein, 347 aa, Homo sapiens; identical to SEQ ID NO: 880899

SEQ ID NO: 880902 - protein, 348 aa, Homo sapiens
MGARGAPSRRRQAGRRLRYLPTGSFPFLLLLLLLCIQLGGGQKKKENLLAEKVEQLMEWSSRRSIFRMNGDKFRKFIKAPPRNYSMIVMFTALQPQRQCSVCRQANEEYQILANSWRYSSAFCNKLFFSMVDYDEGTDVFQQLNMNSAPTFMHFPPKGRPKRADTFDLQRIGFAAEQLAKWIADRTDVHIRVFRPPNYSGTIALALLVSLVGGLLYLRRNNLEFIYNKTGWAMVSLCIVFAMTSGQMWNHIRGPPYAHKNPHNGQVSYIHGSSQAQFVAESHIILVLNAAITMGMVLLNEAATSKGDVGKRRIICLVGLGLVVFFFSFLLSIFRSKYHGYPYSDLDFE

SEQ ID NO: 880903 - protein, 348 aa, Homo sapiens; identical to SEQ ID NO: 880902

SEQ ID NO: 880904 - protein, 348 aa, Homo sapiens; identical to SEQ ID NO: 880902

SEQ ID NO: 880905 - protein, 348 aa, Homo sapiens; identical to SEQ ID NO: 880902

SEQ ID NO: 880906 - protein, 347 aa, Homo sapiens; identical to SEQ ID NO: 880899

SEQ ID NO: 880907 - protein, 348 aa, Homo sapiens; identical to SEQ ID NO: 880902

SEQ ID NO: 880908 - protein, 359 aa, Homo sapiens
MGARGAPSRRRQAGRRLRYLPTGSFPFLLLLLLLCIQLGGGQKKKENLLAEKVEQLMEWSSRRSIFRMNGDKFRKFIKAPPRNYSMIVMFTALQPQRQCSVCRQANEEYQILANSWRYSSAFCNKLFFSMVDYDEGTDVFQQLNMNSAPTFMHFPPKGRPKRADTFDLQRIGFAAEQLAKWIADRTDVHIRVFRPPNYSGTIALALLVSLVGGLLYLRRNNLEFIYNKTGWAMVSLCIVFAMTSGQMWNHIRGPPYAHKNPHNGQVSYIHGSSQAQFVAESHIILVLNAAITMGMVLLNEAATSKGDVGKRRIICLVGLGLVVFFFSFLLSIFRSKYHGYPYREKSSDKNVYQKTDTWS

SEQ ID NO: 880909 - protein, 276 aa, Homo sapiens
MGARGAPSRRRQAGRRLRYLPTGSFPFLLLLLLLCIQLGGGQKKKENLLAEKVEQLMEWSSRRSIFRMNGDKFRKFIKAPPRNYSMIVMFTALQPQRQCSVCRQANEEYQILANSWRYSSAFCNKLFFSMVDYDEGTDVFQQLNMNSAPTFMHFPPKGRPKRADTFDLQRIGFAAEQLAKWIADRTDVHIRVFRPPNYSGTIALALLVSLVGGLLYLRRNNLEFIYNKTGWAMVSLCIVFAMTSGQMWNHIRGPPYAHKNPHNGQVMPLSPWGWFF

SEQ ID NO: 880910 - protein, 269 aa, Homo sapiens
MGARGAPSRRRQAGRRLRYLPTGSFPFLLLLLLLCIQLGGGQKKKENLLAEKVEQLMEWSSRRSIFRMNGDKFRKFIKAPPRNYSMIVMFTALQPQRQCSVCRQANEEYQILANSWRYSSAFCNKLFFSMVDYDEGTDVFQQLNMNSAPTFMHFPPKGRPKRADTFDLQRIGFAAEQLAKWIADRTDVHIRVFRPPNYSGTIALALLVSLVGGLLYLRRNNLEFIYNKTGWAMVSLCIVFAMTSGQMWNHIRGPPYAHKNPHNGQVLFN

SEQ ID NO: 880911 - protein, 291 aa, Homo sapiens
MEWSSRRSIFRMNGDKFRKFIKAPPRNYSMIVMFTALQPQRQCSVCRQANEEYQILANSWRYSSAFCNKLFFSMVDYDEGTDVFQQLNMNSAPTFMHFPPKGRPKRADTFDLQRIGFAAEQLAKWIADRTDVHIRVFRPPNYSGTIALALLVSLVGGLLYLRRNNLEFIYNKTGWAMVSLCIVFAMTSGQMWNHIRGPPYAHKNPHNGQVSYIHGSSQAQFVAESHIILVLNAAITMGMVLLNEAATSKGDVGKRRIICLVGLGLVVFFFSFLLSIFRSKYHGYPYSFLIK

SEQ ID NO: 880912 - protein, 269 aa, Homo sapiens; identical to SEQ ID NO: 880910

SEQ ID NO: 880913 - protein, 308 aa, Homo sapiens
MGARGAPSRRRQAGRRLRYLPTGSFPFLLLLLLLCIQLGGGQKKKENLLAEKVEQLMEWSSRRSIFRMNGDKFRKFIKAPPRNYSMIVMFTALQPQRQCSVCRQANEEYQILANSWRYSSAFCNKLFFSMVDYDEGTDVFQQLNMNSAPTFMHFPPKGRPKRADTFDLQRIGFAAEQLAKWIADRTDVHIRVFRPPNYSGTIALALLVSLVGGLLYLRRNNLEFIYNKTGWAMVSLCIVFAMTSGQMWNHIRGPPYAHKNPHNGQVFNHSGTLCSEPEKLIDFIHIYVYGFLDNYCRCRYHHGDGSSK

SEQ ID NO: 880914 - protein, 284 aa, Homo sapiens
MGARGAPSRRRQAGRRLRYLPTGSFPFLLLLLLLCIQLGGGQKKKENLLAEKVEQLMEWSSRRSIFRMNGDKFRKFIKAPPRNYSMIVMFTALQPQRQCSVCRQANEEYQILANSWRYSSAFCNKLFFSMVDYDEGTDVFQQLNMNSAPTFMHFPPKGRPKRADTFDLQRIGFAAEQLAKWIADRTDVHIRVFRPPNYSGTIALALLVSLVGGLLYLRRNNLEFIYNKTGWAMVSLCIVFAMTSGQMWNHIRGPPYAHKNPHNGQVGLLLWPRLEFSGVITAYF

SEQ ID NO: 880915 - protein, 230 aa, Homo sapiens
MGARGAPSRRRQAGRRLRYLPTGSFPFLLLLLLLCIQLGGGQKKKENLLAEKVEQLMEWSSRRSIFRMNGDKFRKFIKAPPRNYSMIVMFTALQPQRQCSVCRQANEEYQILANSWRYSSAFCNKLFFSMVDYDEGTDVFQQLNMNSAPTFMHFPPKGRPKRADTFDLQRIGFAAEQLAKWIADRTDVHIRVFRPPNYSGTIALALLVSLVGGLLYLRRNNLEFIYNSPP

SEQ ID NO: 880916 - protein, 203 aa, Homo sapiens
MNSAPTFMHFPPKGRPKRADTFDLQRIGFAAEQLAKWIADRTDVHIRVFRPPNYSGTIALALLVSLVGGLLYLRRNNLEFIYNKTGWAMVSLCIVFAMTSGQMWNHIRGPPYAHKNPHNGQVSYIHGSSQAQFVAESHIILVLNAAITMGMVLLNEAATSKGDVGKRRIICLVGLGLVVFFFSFLLSIFRSKYHGYPYSFLIK

SEQ ID NO: 880917 - protein, 348 aa, Homo sapiens; identical to SEQ ID NO: 880902

SEQ ID NO: 880918 - protein, 347 aa, Homo sapiens; identical to SEQ ID NO: 880899

SEQ ID NO: 880919 - protein, 347 aa, Homo sapiens; identical to SEQ ID NO: 880899

SEQ ID NO: 880920 - protein, 330 aa, Homo sapiens
MGARGAPSRRRQAGRRLRYLPTGSFPFLLLLLLLCIQLGGGQKKKENLLAEKVEQLMEWSSRRSIFRMNGDKFRKFIKAPPRNYSMIVMFTALQPQRQCSVCRQANEEYQILANSWRYSSAFCNKLFFSMVDYDEGTDVFQQLNMNSAPTFMHFPPKGRPKRADTFDLQRIGFAAEQLAKWIADRTDVHIRVFRPPNYSGTIALALLVSLVGGLLYLRRNNLEFIYNKTGWAMVSLCIVFAMTSGQMWNHIRGPPYAHKNPHNGQVSYIHGSSQAQFVAESHIILVLNAAITMGMVLLNEAATSKGDVGKRRIFYFQYFVPSTTAILIAF

SEQ ID NO: 880921 - protein, 314 aa, Homo sapiens
MGARGAPSRRRQAGRRLRYLPTGSFPFLLLLLLLCIQLGGGQKKKENLLAEKVEQLMEWSSRRSIFRMNGDKFRKFIKAPPRNYSMIVMFTALQPQRQCSVCRQANEEYQILANSWRYSSAFCNKLFFSMVDYDEGTDVFQQLNMNSAPTFMHFPPKGRPKRADTFDLQRIGFAAEQLAKWIADRTDVHIRVFRPPNYSGTIALALLVSLVGGLLYLRRNNLEFIYNKTGWAMVSLCIVFAMTSGQMWNHIRGPPYAHKNPHNGQVSYIHGSSQAQFVAESHIILVLNAAITMGMVLLNEAATSKGDVGKRRTF

SEQ ID NO: 880922 - protein, 347 aa, Homo sapiens; identical to SEQ ID NO: 880899

SEQ ID NO: 880923 - protein, 343 aa, Homo sapiens
MGARGAPSRRRQAGRRLRYLPTGSFPFLLLLLLLCIQLGGGQKKKENLLAEKVEQLMEWSSRRSIFRMNGDKFRKFIKAPPRNYSMIVMFTALQPQRQCSVCRQANEEYQILANSWRYSSAFCNKLFFSMVDYDEGTDVFQQLNMNSAPTFMHFPPKGRPKRADTFDLQRIGFAAEQLAKWIADRTDVHIRVFRPPNYSGTIALALLVSLVGGLLYLRRNNLEFIYNKTGWAMVSLCIVFAMTSGQMWNHIRGPPYAHKNPHNGQVSYIHGSSQAQFVAESHIILVLNAAITMGMVLLNEAATSKGDVGKRRIICLVGLGLVVFFFSFLLSIFRSKYHGYPYR

SEQ ID NO: 880924 - protein, 314 aa, Homo sapiens; identical to SEQ ID NO: 880921

SEQ ID NO: 880925 - protein, 308 aa, Homo sapiens; identical to SEQ ID NO: 880913

SEQ ID NO: 880926 - protein, 318 aa, Homo sapiens
QGQHPSRLPIDKKNQTSNLLAEKVEQLMEWSSRRSIFRMNGDKFRKFIKAPPRNYSMIVMFTALQPQRQCSVCRQANEEYQILANSWRYSSAFCNKLFFSMVDYDEGTDVFQQLNMNSAPTFMHFPPKGRPKRADTFDLQRIGFAAEQLAKWIADRTDVHIRVFRPPNYSGTIALALLVSLVGGLLYLRRNNLEFIYNKTGWAMVSLCIVFAMTSGQMWNHIRGPPYAHKNPHNGQVSYIHGSSQAQFVAESHIILVLNAAITMGMVLLNEAATSKGDVGKRRIICLVGLGLVVFFFSFLLSIFRSKYHGYPYSFLIK

SEQ ID NO: 880927 - protein, 269 aa, Homo sapiens; identical to SEQ ID NO: 880910

SEQ ID NO: 880928 - protein, 241 aa, Homo sapiens
MGARGAPSRRRQAGRRLRYLPTGSFPFLLLLLLLCIQLGGGQKKKENLLAEKVEQLMEWSSRRSIFRMNGDKFRKFIKAPPRNYSMIVMFTALQPQRQCSVCRQANEEYQILANSWRYSSAFCNKLFFSMVDYDEGTDVFQQLNMNSAPTFMHFPPKGRPKRADTFDLQRIGFAAEQLAKWIADRTDVHIRVFRPPNYSGTIALALLVSLVGGLLYLRRNNLEFIYNTLGAPWARRLYDSI

SEQ ID NO: 880929 - protein, 251 aa, Homo sapiens
WPIILIRQANEEYQILANSWRYSSAFCNKLFFSMVDYDEGTDVFQQLNMNSAPTFMHFPPKGRPKRADTFDLQRIGFAAEQLAKWIADRTDVHIRVFRPPNYSGTIALALLVSLVGGLLYLRRNNLEFIYNKTGWAMVSLCIVFAMTSGQMWNHIRGPPYAHKNPHNGQVSYIHGSSQAQFVAESHIILVLNAAITMGMVLLNEAATSKGDVGKRRIICLVGLGLVVFFFSFLLSIFRSKYHGYPYSFLIK

SEQ ID NO: 880930 - protein, 118 aa, Homo sapiens
TLHPVFQCIVFAMTSGQMWNHIRGPPYAHKNPHNGQVSYIHGSSQAQFVAESHIILVLNAAITMGMVLLNEAATSKGDVGKRRIICLVGLGLVVFFFSFLLSIFRSKYHGYPYSFLIK

SEQ ID NO: 880931 - protein, 918 aa, Homo sapiens
RIRGFGPVSVTPGAESILLLLPRRCRGRSTGSFLSVSGVQSQAVGVEKRRQRSWARRGREPQGCSDFWRADPEASDREVPARRGGFIRGFGPRMPAPIRLRELIRTIRTARTQAEEREMIQKECAAIRSSFREEDNTYRCRNVAKLLYMHMLGYPAHFGQLECLKLIASQKFTDKRIGYLGAMLLLDERQDVHLLMTNCIKNDLNHSTQFVQGLALCTLGCMGSSEMCRDLAGEVEKLLKTSNSYLRKKAALCAVHVIRKVPELMEMFLPATKNLLNEKNHGVLHTSVVLLTEMCERSPDMLAHFRKNEKLVPQLVRILKNLIMSGYSPEHDVSGISDPFLQVRILRLLRILGRNDDDSSEAMNDILAQVATNTETSKNVGNAILYETVLTIMDIKSESGLRVLAINILGRFLLNNDKNIRYVALTSLLKTVQTDHNAVQRHRSTIVDCLKDLDVSIKRRAMELSFALVNGNNIRGMMKELLYFLDSCEPEFKADCASGIFLAAEKYAPSKRWHIDTIMRVLTTAGSYVRDDAVPNLIQLITNSVEMHAYTVQRLYKAILGDYSQQPLVQVAAWCIGEYGDLLVSGQCEEEEPIQVTEDEVLDILESVLISNMSTSVTRGYALTAIMKLSTRFTCTVNRIKKVVSIYGSSIDVELQQRAVEYNALFKKYDHMRSALLERMPVMEKVTTNGPTEIVQTNGETEPAPLETKPPPSGPQPTSQANDLLDLLGGNDITPVIPTAPTSKPSSAGGELLDLLGDINLTGAPAAAPAPASVPQISQPPFLLDGLSSQPLFNDIAAGIPSITAYSKNGLKIEFTFERSNTNPSVTVITIQASNSTELDMTDFVFQAAVPKTFQLQLLSPSSSIVPAFNTGTITQVIKVLNPQKQQLRMRIKLTYNHKGSAMQDLAEVNNFPPQSWQ

SEQ ID NO: 880932 - protein, 114 aa, Homo sapiens
IASPVSSLASVLASPVSSLASVTVITIQASNSTELDMTDFVFQAAVPKTFQLQLLSPSSSIVPAFNTGTITQVIKVLNPQKQQLRMRIKLTYNHKGSAMQDLAEVNNFPPQSWQ

SEQ ID NO: 880933 - protein, 918 aa, Homo sapiens; identical to SEQ ID NO: 880931

SEQ ID NO: 880934 - protein, 748 aa, Homo sapiens
RIRGFGPVSVTPGAESILLLLPRRCRGRSTGSFLSVSGVQSQAVGVEKRRQRSWARRGREPQGCSDFWRADPEASDREVPARRGGFIRGFGPRMPAPIRLRELIRTIRTARTQAEEREMIQKECAAIRSSFREEDNTYRCRNVAKLLYMHMLGYPAHFGQLECLKLIASQKFTDKRIGYLGAMLLLDERQDVHLLMTNCIKNDLNHSTQFVQGLALCTLGCMGSSEMCRDLAGEVEKLLKTSNSYLRKKAALCAVHVIRKVPELMEMFLPATKNLLNEKNHGVLHTSVVLLTEMCERSPDMLAHFRKNEKLVPQLVRILKNLIMSGYSPEHDVSGISDPFLQVRILRLLRILGRNDDDSSEAMNDILAQVATNTETSKNVGNAILYETVLTIMDIKSESGLRVLAINILGRFLLNNDKNIRYVALTSLLKTVQTDHNAVQRHRSTIVDCLKDLDVSIKRRAMELSFALVNGNNIRGMMKELLYFLDSCEPEFKADCASGIFLAAEKYAPSKRWHIDTIMRVLTTAGSYVRDDAVPNLIQLITNSVEMHAYTVQRLYKAILGDYSQQPLVQVAAWCIGEYGDLLVSGQCEEEEPIQVTEDEVLDILESVLISNMSTSVTRGYALTAIMKLSTRFTCTVNRIKKVVSIYGSSIDVELQQRAVEYNALFKKYDHMRSALLERMPVMEKVTTNGPTEIVQTNGETEPAPLETKPPPSGPQPTSQANDLLDLLGGNDITPVIPTAPTRIISPA

SEQ ID NO: 880935 - protein, 894 aa, Homo sapiens
RIRGFGPVSVTPGAESILLLLPRRCRGRSTGSFLSVSGVQSQAVGVEKRRQRSWARRGREPQGCSDFWRADPEASDREVPARRGGFIRGFGPRMPAPIRLRELIRTIRTARTQAEEREMIQKECAAIRSSFREEDNTYRCRNVAKLLYMHMLGYPAHFGQLECLKLIASQKFTDKRIGYLGAMLLLDERQDVHLLMTNCIKNDLNHSTQFVQGLALCTLGCMGSSEMCRDLAGEVEKLLKTSNSYLRKKAALCAVHVIRKVPELMEMFLPATKNLLNEKNHGVLHTSVVLLTEMCERSPDMLAHFRKNEKLVPQLVRILKNLIMSGYSPEHDVSGISDPFLQVRILRLLRILGRNDDDSSEAMNDILAQVATNTETSKNVGNAILYETVLTIMDIKSESGLRVLAINILGRFLLNNDKNIRYVALTSLLKTVQTDHNAVQRHRSTIVDCLKDLDVSIKRRAMELSFALVNGNNIRGMMKELLYFLDSCEPEFKADCASGIFLAAEKYAPSKRWHIDTIMRVLTTAGSYVRDDAVPNLIQLITNSVEMHAYTVQRLYKAILGDYSQQPLVQVAAWCIGEYGDLLVSGQCEEEEPIQVTEDEVLDILESVLISNMSTSVTRGYALTAIMKLSTRFTCTVNRIKKVVSIYGSSIDVELQQRAVEYNALFKKYDHMRSALLERMPVMEKVTTNGPTEIVQTNGETEPAPLETKPPPSGPQPTSQANDLLDLLGGNDITPVIPTAPTSKPSSAGGELLDLLGDINLTGAPAAAPAPASVPQISQPPFLLDGLSSQPLFNDIAAGIPSITAYSKNGLKIEFTFERSNTNPSVTVITIQASNSTELDMTDFVFQAAVPKTFQLQLLSPSSSIVPAFNTGTITQVIKVLNPQKVSSTFVANI

SEQ ID NO: 880936 - protein, 918 aa, Homo sapiens; identical to SEQ ID NO: 880931

SEQ ID NO: 880937 - protein, 230 aa, Homo sapiens
RIRGFGPVSVTPGAESILLLLPRRCRGRSTGSFLSVSGVQSQAVGVEKRRQRSWARRGREPQGCSDFWRADPEASDREVPARRGGFIRGFGPRMPAPIRLRELIRTIRTARTQAEEREMIQKECAAIRSSFREEDNTYRCRNVAKLLYMHMLGYPAHFGQLECLKLIASQKFTDKRIVPAFNTGTITQVIKVLNPQKQQLRMRIKLTYNHKGSAMQDLAEVNNFPPQSWQ

SEQ ID NO: 880938 - protein, 918 aa, Homo sapiens; identical to SEQ ID NO: 880931

SEQ ID NO: 880939 - protein, 117 aa, Homo sapiens
GLSTSVRLFYVWPKTVLLLPVWPREAKRLDTRGLCICMYTHTYTHTQRHTLVLFLQRTLTNTGDPGSQQWCLPSHCCHWVWVSEAPTRHNSEGSSSGPWHMLGALQNQQKRTLTKGQ

SEQ ID NO: 880940 - protein, 1585 aa, Homo sapiens
MENTGWMGKGHRMTPACPLLLSVILSLRLATAFDPAPSACSALASGVLYGAFSLQDLFPTIASGCSWTLENPDPTKYSLYLRFNRQEQVCAHFAPRLLPLDHYLVNFTCLRPSPEEAVAQAESEVGRPEEEEAEAAAGLELCSGSGPFTFLHFDKNFVQLCLSAEPSEAPRLLAPAALAFRFVEVLLINNNNSSQFTCGVLCRWSEECGRAAGRACGFAQPGCSCPGEAGAGSTTTTSPGPPAAHTLSNALVPGGPAPPAEADLHSGSSNDLFTTEMRYGEEPEEEPKVKTQWPRSADEPGLYMAQTGDPAAEEWSPWSVCSLTCGQGLQVRTRSCVSSPYGTLCSGPLRETRPCNNSATCPVHGVWEEWGSWSLCSRSCGRGSRSRMRTCVPPQHGGKACEGPELQTKLCSMAACPVEGQWLEWGPWGPCSTSCANGTQQRSRKCSVAGPAWATCTGALTDTRECSNLECPATDSKWGPWNAWSLCSKTCDTGWQRRFRMCQATGTQGYPCEGTGEEVKPCSEKRCPAFHEMCRDEYVMLMTWKKAAAGEIIYNKCPPNASGSASRRCLLSAQGVAYWGLPSFARCISHEYRYLYLSLREHLAKGQRMLAGEGMSQVVRSLQELLARRTYYSGDLLFSVDILRNVTDTFKRATYVPSADDVQRFFQVVSFMVDAENKEKWDDAQQVSPGSVHLLRVVEDFIHLVGDALKAFQSSLIVTDNLVISIQREPVSAVSSDITFPMRGRRGMKDWVRHSEDRLFLPKEVLSLSSPGKPATSGAAGSPGRGRGPGTVPPGPGHSHQRLLPADPDESSYFVIGAVLYRTLGLILPPPRPPLAVTSRVMTVTVRPPTQPPAEPLITVELSYIINGTTDPHCASWDYSRADASSGDWDTENCQTLETQAAHTRCQCQHLSTFAVLAQPPKDLTLELAGSPSVPLVIGCAVSCMALLTLLAIYAAFWRFIKSERSIILLNFCLSILASNILILVGQSRVLSKGVCTMTAAFLHFFFLSSFCWVLTEAWQSYLAVIGRMRTRLVRKRFLCLGWGLPALVVAVSVGFTRTKGYGTSSYCWLSLEGGLLYAFVGPAAVIVLVNMLIGIIVFNKLMARDGISDKSKKQRAGSERCPWASLLLPCSACGAVPSPLLSSASARNAMASLWSSCVVLPLLALTWMSAVLAMTDRRSVLFQALFAVFNSAQGFVITAVHCFLRREVQDVVKCQMGVCRADESEDSPDSCKNGQLQILSDFEKDVDLACQTVLFKEVNTCNPSTITGTLSRLSLDEDEEPKSCLVGPEGSLSFSPLPGNILVPMAASPGLGEPPPPQEANPVYMCGEGGLRQLDLTWLRPTEPGSEGDYMVLPRRTLSLQPGGGGGGGEDAPRARPEGTPRRAAKTVAHTEGYPSFLSVDHSGLGLGPAYGSLQNPYGMTFQPPPPTPSARQVPEPGERSRTMPRTVPGSTMKMGSLERKKLRYSDLDFEKVMHTRKRHSELYHELNQKFHTFDRYRSQSTAKREKRWSVSSGGAAERSVCTDKPSPGERPSLSQHRRHQSWSTFKSMTLGSLPPKPRERLTLHRAAAWEPTEPPDGDFQTEV

SEQ ID NO: 880941 - protein, 896 aa, Homo sapiens
HSLLSPQRFFQVVSFMVDAENKEKWDDAQQVSPGSVHLLRVVEDFIHLVGDALKAFQSSLIVTDNLVISIQREPVSAVSSDITFPMRGRRGMKDWVRHSEDRLFLPKEVLSLSSPGKPATSGAAGSPGRGRGPGTVPPGPGHSHQRLLPADPDESSYFVIGAVLYRTLGLILPPPRPPLAVTSRVMTVTVRPPTQPPAEPLITVELSYIINGTTDPHCASWDYSRADASSGDWDTENCQTLETQAAHTRCQCQHLSTFAVLAQPPKDLTLELAGSPSVPLVIGCAVSCMALLTLLAIYAAFWRFIKSERSIILLNFCLSILASNILILVGQSRVLSKGVCTMTAAFLHFFFLSSFCWVLTEAWQSYLAVIGRMRTRLVRKRFLCLGWGLPALVVAVSVGFTRTKGYGTSSYCWLSLEGGLLYAFVGPAAVIVLVNMLIGIIVFNKLMARDGISDKSKKQRAGASLWSSCVVLPLLALTWMSAVLAMTDRRSVLFQALFAVFNSAQGFVITAVHCFLRREVQDVVKCQMGVCRADESEDSPDSCKNGQLQILSDFEKDVDLACQTVLFKEVNTCNPSTITGTLSRLSLDEDEEPKSCLVGPEGSLSFSPLPGNILVPMAASPGLGEPPPPQEANPVYMCGEGGLRQLDLTWLRPTEPGSEGDYMVLPRRTLSLQPGGGGGGGEDAPRARPEGTPRRAAKTVAHTEGYPSFLSVDHSGLGLGPAYGSLQNPYGMTFQPPPPTPSARQVPEPGERSRTMPRTVPGSTMKMGSLERKKLRYSDLDFEKVMHTRKRHSELYHELNQKFHTFDRYRSQSTAKREKRWSVSSGGAAERSVCTDKPSPGERPSLSQHRRHQSWSTFKSMTLGSLPPKPRERLTLHRAAAWEPTEPPDGDFQTEV

SEQ ID NO: 880942 - protein, 1478 aa, Homo sapiens
MENTGWMGKGHRMTPACPLLLSVILSLRLATAFDPAPSACSALASGVLYGAFSLQDLFPTIASGCSWTLENPDPTKYSLYLRFNRQEQVCAHFAPRLLPLDHYLVNFTCLRPSPEEAVAQAESEVGRPEEEEAEAAAGLELCSGSGPFTFLHFDKNFVQLCLSAEPSEAPRLLAPAALAFRFVEVLLINNNNSSQFTCGVLCRWSEECGRAAGRACGFAQPGCSCPGEAGAGSTTTTSPGPPAAHTLSNALVPGGPAPPAEADLHSGSSNDLFTTEMRYGEEPEEEPKVKTQWPRSADEPGLYMAQTVHGVWEEWGSWSLCSRSCGRGSRSRMRTCVPPQHGGKACEGPELQTKLCSMAACPVEGQWLEWGPWGPCSTSCANGTQQRSRKCSVAGPAWATCTGALTDTRECSNLECPATDSKWGPWNAWSLCSKTCDTGWQRRFRMCQATGTQGYPCEGTGEEVKPCSEKRCPAFHEMCRDEYVMLMTWKKAAAGEIIYNKCPPNASGSASRRCLLSAQGVAYWGLPSFARCISHEYRYLYLSLREHLAKGQRMLAGEGMSQVVRSLQELLARRTYYSGDLLFSVDILRNVTDTFKRATYVPSADDVQRFFQVVSFMVDAENKEKWDDAQQVSPGSVHLLRVVEDFIHLVGDALKAFQSSLIVTDNLVISIQREPVSAVSSDITFPMRGRRGMKDWVRHSEDRLFLPKEVLSLSSPGKPATSGAAGSPGRGRGPGTVPPGPGHSHQRLLPADPDESSYFVIGAVLYRTLGLILPPPRPPLAVTSRVMTVTVRPPTQPPAEPLITVELSYIINGTTDPHCASWDYSRADASSGDWDTENCQTLETQAAHTRCQCQHLSTFAVLAQPPKDLTLELAGSPSVPLVIGCAVSCMALLTLLAIYAAFWRFIKSERSIILLNFCLSILASNILILVGQSRVLSKGVCTMTAAFLHFFFLSSFCWVLTEAWQSYLAVIGRMRTRLVRKRFLCLGWGLPALVVAVSVGFTRTKGYGTSSYCWLSLEGGLLYAFVGPAAVIVLVNMLIGIIVFNKLMARDGISDKSKKQRAGASLWSSCVVLPLLALTWMSAVLAMTDRRSVLFQALFAVFNSAQGFVITAVHCFLRREVQDVVKCQMGVCRADESEDSPDSCKNGQLQILSDFEKDVDLACQTVLFKEVNTCNPSTITGTLSRLSLDEDEEPKSCLVGPEGSLSFSPLPGNILVPMAASPGLGEPPPPQEANPVYMCGEGGLRQLDLTWLRPTEPGSEGDYMVLPRRTLSLQPGGGGGGGEDAPRARPEGTPRRAAKTVAHTEGYPSFLSVDHSGLGLGPAYGSLQNPYGMTFQPPPPTPSARQVPEPGERSRTMPRTVPGSTMKMGSLERKKLRYSDLDFEKVMHTRKRHSELYHELNQKFHTFDRYRSQSTAKDKPSPGERPSLSQHRRHQSWSTFKSMTLGSLPPKPRERLTLHRAAAWEPTEPPDGDFQTEV

SEQ ID NO: 880943 - protein, 1497 aa, Homo sapiens
MENTGWMGKGHRMTPACPLLLSVILSLRLATAFDPAPSACSALASGVLYGAFSLQDLFPTIASGCSWTLENPDPTKYSLYLRFNRQEQVCAHFAPRLLPLDHYLVNFTCLRPSPEEAVAQAESEVGRPEEEEAEAAAGLELCSGSGPFTFLHFDKNFVQLCLSAEPSEAPRLLAPAALAFRFVEVLLINNNNSSQFTCGVLCRWSEECGRAAGRACGFAQPGCSCPGEAGAGSTTTTSPGPPAAHTLSNALVPGGPAPPAEADLHSGSSNDLFTTEMRYGEEPEEEPKVKTQWPRSADEPGLYMAQTVHGVWEEWGSWSLCSRSCGRGSRSRMRTCVPPQHGGKACEGPELQTKLCSMAACPVEGQWLEWGPWGPCSTSCANGTQQRSRKCSVAGPAWATCTGALTDTRECSNLECPATDSKWGPWNAWSLCSKTCDTGWQRRFRMCQATGTQGYPCEGTGEEVKPCSEKRCPAFHEMCRDEYVMLMTWKKAAAGEIIYNKCPPNASGSASRRCLLSAQGVAYWGLPSFARCISHEYRYLYLSLREHLAKGQRMLAGEGMSQVVRSLQELLARRTYYSGDLLFSVDILRNVTDTFKRATYVPSADDVQRFFQVVSFMVDAENKEKWDDAQQVSPGSVHLLRVVEDFIHLVGDALKAFQSSLIVTDNLVISIQREPVSAVSSDITFPMRGRRGMKDWVRHSEDRLFLPKEVLSLSSPGKPATSGAAGSPGRGRGPGTVPPGPGHSHQRLLPADPDESSYFVIGAVLYRTLGLILPPPRPPLAVTSRVMTVTVRPPTQPPAEPLITVELSYIINGTTDPHCASWDYSRADASSGDWDTENCQTLETQAAHTRCQCQHLSTFAVLAQPPKDLTLELAGSPSVPLVIGCAVSCMALLTLLAIYAAFWRFIKSERSIILLNFCLSILASNILILVGQSRVLSKGVCTMTAAFLHFFFLSSFCWVLTEAWQSYLAVIGRMRTRLVRKRFLCLGWGLPALVVAVSVGFTRTKGYGTSSYCWLSLEGGLLYAFVGPAAVIVLVNMLIGIIVFNKLMARDGISDKSKKQRAGASLWSSCVVLPLLALTWMSAVLAMTDRRSVLFQALFAVFNSAQGFVITAVHCFLRREVQDVVKCQMGVCRADESEDSPDSCKNGQLQILSDFEKDVDLACQTVLFKEVNTCNPSTITGTLSRLSLDEDEEPKSCLVGPEGSLSFSPLPGNILVPMAASPGLGEPPPPQEANPVYMCGEGGLRQLDLTWLRPTEPGSEGDYMVLPRRTLSLQPGGGGGGGEDAPRARPEGTPRRAAKTVAHTEGYPSFLSVDHSGLGLGPAYGSLQNPYGMTFQPPPPTPSARQVPEPGERSRTMPRTVPGSTMKMGSLERKKLRYSDLDFEKVMHTRKRHSELYHELNQKFHTFDRYRSQSTAKREKRWSVSSGGAAERSVCTDKPSPGERPSLSQHRRHQSWSTFKSMTLGSLPPKPRERLTLHRAAAWEPTEPPDGDFQTEV

SEQ ID NO: 880944 - protein, 1422 aa, Homo sapiens
MENTGWMGKGHRMTPACPLLLSVILSLRLATAFDPAPSACSALASGVLYGAFSLQDLFPTIASGCSWTLENPDPTKYSLYLRFNRQEQVCAHFAPRLLPLDHYLVNFTCLRPSPEEAVAQAESEVGRPEEEEAEAAAGLELCSGSGPFTFLHFDKNFVQLCLSAEPSEAPRLLAPAALAFRFVEVLLINNNNSSQFTCGVLCRWSEECGRAAGRACGFAQPGCSCPGEAGAGSTTTTSPGPPAAHTLSNALVPGGPAPPAEADLHSGSSNDLFTTEMRYGEEPEEEPKVKTQWPRSADEPGLYMAQTVHGVWEEWGSWSLCSRSCGRGSRSRMRTCVPPQHGGKACEGPELQTKLCSMAACPVEGQWLEWGPWGPCSTSCANGTQQRSRKCSVAGPAWATCTGALTDTRECSNLECPATDSKWGPWNAWSLCSKTCDTGWQRRFRMCQATGTQGYPCEGTGEEVKPCSEKRCPAFHEMCRDEYVMLMTWKKAAAGEIIYNKCPPNASGSASRRCLLSAQGVAYWGLPSFARCISHEYRYLYLSLREHLAKGQRMLAGEGMSQVVRSLQELLARRTYYSGDLLFSVDILRNVTDTFKRATYVPSADDVQRFFQVVSFMVDAENKEKWDDAQQVSPGSVHLLRVVEDFIHLVGDALKAFQSSLIVTDNLVISIQREPVSAVSSDITFPMRGRRGMKDWVRHSEDRLFLPKEVLSLSSPGKPATSGAAGSPGRGRGPGTVPPGPGHSHQRLLPADPDESSYFVIGAVLYRTLGLILPPPRPPLAVTSRVMTVTVRPPTQPPAEPLITVELSYIINGTTDPHCASWDYSRADASSGDWDTENCQTLETQAAHTRCQCQHLSTFAVLAQPPKDLTLELAGSPSVPLVIGCAVSCMALLTLLAIYAAFWRFIKSERSIILLNFCLSILASNILILVGQSRVLSKGVCTMTAAFLHFFFLSSFCWVLTEAWQSYLAVIGRMRTRLVRKRFLCLGWGLPALVVAVSVGFTRTKGYGTSSYCWLSLEGGLLYAFVGPAAVIVLVNMLIGIIVFNKLMARDGISDKSKKQRAGASLWSSCVVLPLLALTWMSAVLAMTDRRSVLFQALFAVFNSAQGFVITAVHCFLRREVQDVVKCQMGVCRADESEDSPDSCKNGQLQILSDFEKDVDLACQTVLFKEVNTCNPSTITGTLSRLSLDEDEEPKSCLVGPEGSLSFSPLPGNILVPMAASPGLGEPPPPQEANPVYMCGEGGLRQLDLTWLRPTEPGSEGDYMVLPRRTLSLQPGGGGGGGEDAPRARPEGTPRRAAKTVAHTEGYPSFLSVDHSGLGLGPAYGSLQNPYGMTFQPPPPTPSARQVPEPGERSRTMPRTVPGSTMKMGSLERKKLRYSDLDFEKVMHTRKRHSELYHELNQKFHTFDRYRSQSTAKRTTGW

SEQ ID NO: 880945 - protein, 170 aa, Homo sapiens
MHEFGDIEFLAGPMAQSVTLLYHFQILTRIFPFLSPGELMHREVGRQSPLTAVGLWGQSRDLHQDTGSWALPLFLALSQCGDFGAVVFLTPLICERLPTTQPSLQDPVSFPVQAQKLGTSPAWAMASGGSFSSGLTPSLPLLPPVLFKEVNTCNPSTITGTLSRLSLDED

SEQ ID NO: 880946 - protein, 1497 aa, Homo sapiens; identical to SEQ ID NO: 880943

SEQ ID NO: 880947 - protein, 486 aa, Homo sapiens
SPGFPCVSPPSPMSVPPPRSERCPWASLLLPCSACGAVPSPLLSSASARNAMASLWSSCVVLPLLALTWMSAVLAMTDRRSVLFQALFAVFNSAQGFVITAVHCFLRREVQDVVKCQMGVCRADESEDSPDSCKNGQLQILSDFEKDVDLACQTVLFKEVNTCNPSTITGTLSRLSLDEDEEPKSCLVGPEGSLSFSPLPGNILVPMAASPGLGEPPPPQEANPVYMCGEGGLRQLDLTWLRPTEPGSEGDYMVLPRRTLSLQPGGGGGGGEDAPRARPEGTPRRAAKTVAHTEGYPSFLSVDHSGLGLGPAYGSLQNPYGMTFQPPPPTPSARQVPEPGERSRTMPRTVPGSTMKMGSLERKKLRYSDLDFEKVMHTRKRHSELYHELNQKFHTFDRYRSQSTAKREKRWSVSSGGAAERSVCTDKPSPGERPSLSQHRRHQSWSTFKSMTLGSLPPKPRERLTLHRAAAWEPTEPPDGDFQTEV

SEQ ID NO: 880948 - protein, 1497 aa, Homo sapiens; identical to SEQ ID NO: 880943

SEQ ID NO: 880949 - protein, 1255 aa, Homo sapiens
MENTGWMGKGHRMTPACPLLLSVILSLRLATAFDPAPSACSALASGVLYGAFSLQDLFPTIASGCSWTLENPDPTKYSLYLRFNRQEQVCAHFAPRLLPLDHYLVNFTCLRPSPEEAVAQAESEVGRPEEEEAEAAAGLELCSGSGPFTFLHFDKNFVQLCLSAEPSEAPRLLAPAALAFRFVEVLLINNNNSSQFTCGVLCRWSEECGRAAGRACGFAQPGCSCPGEAGAGSTTTTSPGPPAAHTLSNALVPGGPAPPAEADLHSGSSNDLFTTEMRYGEEPEEEPKVKTQWPRSADEPGLYMAQTVHGVWEEWGSWSLCSRSCGRGSRSRMRTCVPPQHGGKACEGPELQTKLCSMAACPVEGQWLEWGPWGPCSTSCANGTQQRSRKCSVAGPAWATCTGALTDTRECSNLECPATDSKWGPWNAWSLCSKTCDTGWQRRFRMCQATGTQGYPCEGTGEEVKPCSEKRCPAFHEMCRDEYVMLMTWKKAAAGEIIYNKCPPNASGSASRRCLLSAQGVAYWGLPSFARCISHEYRYLYLSLREHLAKGQRMLAGEGMSQVVRSLQELLARRTYYSGDLLFSVDILRNVTDTFKRATYVPSADDVQRFFQVVSFMVDAENKEKWDDAQQVSPGSVHLLRVVEDFIHLVGDALKAFQSSLIVTDNLVISIQREPVSAVSSDITFPMRGRRGMKDWVRHSEDRLFLPKEVLSLSSPGKPATSGAAGSPGRGRGPGTVPPGPGHSHQRLLPADPDESSYFVIGAVLYRTLGLILPPPRPPLAVTSRVMTVTVRPPTQPPAEPLITVELSYIINGTTDPHCASWDYSRADASSGDWDTENCQTLETQAAHTRCQCQHLSTFAVLAQPPKDLTLELAGSPSVPLVIGCAVSCMALLTLLAIYAAFWRFIKSERSIILLNFCLSILASNILILVGQSRVLSKGVCTMTAAFLHFFFLSSFCWVLTEAWQSYLAVIGRMRTRLVRKRFLCLGWGLPALVVAVSVGFTRTKGYGTSSYCWLSLEGGLLYAFVGPAAVIVLVNMLIGIIVFNKLMARDGISDKSKKQRAGASLWSSCVVLPLLALTWMSAVLAMTDRRSVLFQALFAVFNSAQGFVITAVHCFLRREVQDVVKCQMGVCRADESEDSPDSCKNGQLQILSDFEKDVDLACQTVLFKEVNTCNPSTITGTLSRLSLDEDEEPKSCLVGPEGSLSFSPLPGNILVPMAASPGLGEPPPPQEANPVYMCGEGGLRQLAPELAARP

SEQ ID NO: 880950 - protein, 730 aa, Homo sapiens
CCVRRGAASTGKAPPSLPEWNMATCAEILRSEFPEIDGQVFDYVTGVLHSGSADFESVDDLVEAVGELLQEVSGDSKDDAGIRAVCQRMYNTLRLAEPQSQGNSQVLLDAPIQLSKITENYDCGTKLPGLLKREQSSTVNAKKLEKAEARLKAKQEKRSEKDTLKTSNPLVLEEASASQAGSRKESRLESSGKNKSYDVRIENFDVSFGDRVLLAGADVNLAWGRRYGLVGRNGLGKTTLLKMLATRSLRVPAHISLLHVEQEVAGDDTPALQSVLESDSVREDLLRRERELTAQIAAGRAEGSEAAELAEIYAKLEEIEADKAPARASVILAGLGFTPKMQQQPTREFSGGWRMRLALARALFARPDLLLLDEPTNMLDVRAILWLENYLQTWPSTILVVSHDRNFLNAIATDIIHLHSQRLDGYRGDFETFIKSKQERLLNQQREYEAQQQYRQHIQVFIDRFRYNANRASQVQSKLKMLEKLPELKPVDKESEVVMKFPDGFEKFSPPILQLDEVDFYYDPKHVIFSRLSVSADLESRICVVGENGAGKSTMLKLLLGDLAPVRGIRHAHRNLKIGYFSQHHVEQLDLNVSAVELLARKFPGRPEEEYRHQLGRYGISGELAMRPLASLSGGQKSRVAFAQMTMPCPNFYILDEPTNHLDMETIEALGRALNNFRGGVILVSHDERFIRLVCRELWVCEGGGVTRVEGGFDQYRALLQEQFRREGFL

SEQ ID NO: 880951 - protein, 709 aa, Homo sapiens
MATCAEILRSEFPEIDGQVFDYVTGVLHSGSADFESVDDLVEAVGELLQEVSGDSKDDAGIRAVCQRMYNTLRLAEPQSQGNSQVLLDAPIQLSKITENYDCGTKLPGLLKREQSSTVNAKKLEKAEARLKAKQEKRSEKDTLKTSNPLVLEEASASQAGSRKESRLESSGKNKSYDVRIENFDVSFGDRVLLAGADVNLAWGRRYGLVGRNGLGKTTLLKMLATRSLRVPAHISLLHVEQEVAGDDTPALQSVLESDSVREDLLRRERELTAQIAAGRAEGSEAAELAEIYAKLEEIEADKAPARASVILAGLGFTPKMQQQPTREFSGGWRMRLALARALFARPDLLLLDEPTNMLDVRAILWLENYLQTWPSTILVVSHDRNFLNAIATDIIHLHSQRLDGYRGDFETFIKSKQERLLNQQREYEAQQQYRQHIQVFIDRFRYNANRASQVQSKLKMLEKLPELKPVDKESEVVMKFPDGFEKFSPPILQLDEVDFYYDPKHVIFSRLSVSADLESRICVVGENGAGKSTMLKLLLGDLAPVRGIRHAHRNLKIGYFSQHHVEQLDLNVSAVELLARKFPGRPEEEYRHQLGRYGISGELAMRPLASLSGGQKSRVAFAQMTMPCPNFYILDEPTNHLDMETIEALGRALNNFRGGVILVSHDERFIRLVCRELWVCEGGGVTRVEGGFDQYRALLQEQFRREGFL

SEQ ID NO: 880952 - protein, 707 aa, Homo sapiens
MATCAEILRSEFPEIDGQVFDYVTGVLHSGSADFESVDDLVEAVGELLQEVSGDSKDDAGIRAVCQRMYNTLRLAEPQSQGNSQVLLDAPIQLSKITENYDCGTKLPGLLKREQSSTVNAKKLEKAEARLKAKQEKRSEKDTLKTSNPLVLEEASASQAGSRKESRLESSGKNKSYDVRIENFDVSFGDRVLLAGADVNLAWGRRYGLVGRNGLGKTTLLKMLATRSLRVPAHISLLHVEQEVAGDDTPALQSVLESDSVREDLLRRERELTAQIAAGRAEGSEAAELAEIYAKLEEIEADKAPARASVILAGLGFTPKMQQQPTREFSGGWRMRLALARALFARESPGPEPTNMLDVRAILWLENYLQTWPSTILVVSHDRNFLNAIATDIIHLHSQRLDGYRGDFETFIKSKQERLLNQQREYEAQQQYRQHIQVFIDRFRYNANRASQVQSKLKMLEKLPELKPVDKESEVVMKFPDGFEKFSPPILQLDEVDFYYDPKHVIFSRLSVSADLESRICVVGENGAGKSTMLKLLLGDLAPVRGIRHAHRNLKIGYFSQHHVEQLDLNVSAVELLARKFPGRPEEEYRHQLGRYGISGELAMRPLASLSGGQKSRVAFAQMTMPCPNFYILDEPTNHLDMETIEALGRALNNFRGGVILVSHDERFIRLVCRELWVCEGGGVTRVEGGFDQYRALLQEQFRREGFL

SEQ ID NO: 880953 - protein, 642 aa, Homo sapiens
MYNTLRLAEPQSQGNSQVLLDAPIQLSKITENYDCGTKLPGLLKREQSSTVNAKKLEKAEARLKAKQEKRSEKDTLKTSNPLVLEEASASQAGSRKESRLESSGKNKSYDVRIENFDVSFGDRVLLAGADVNLAWGRRYGLVGRNGLGKTTLLKMLATRSLRVPAHISLLHVEQEVAGDDTPALQSVLESDSVREDLLRRERELTAQIAAGRAEGSEAAELAEIYAKLEEIEADKAPARASVILAGLGFTPKMQQQPTREFSGGWRMRLALARALFARPDLLLLDEPTNMLDVRAILWLENYLQTWPSTILVVSHDRNFLNAIATDIIHLHSQRLDGYRGDFETFIKSKQERLLNQQREYEAQQQYRQHIQVFIDRFRYNANRASQVQSKLKMLEKLPELKPVDKESEVVMKFPDGFEKFSPPILQLDEVDFYYDPKHVIFSRLSVSADLESRICVVGENGAGKSTMLKLLLGDLAPVRGIRHAHRNLKIGYFSQHHVEQLDLNVSAVELLARKFPGRPEEEYRHQLGRYGISGELAMRPLASLSGGQKSRVAFAQMTMPCPNFYILDEPTNHLDMETIEALGRALNNFRGGVILVSHDERFIRLVCRELWVCEGGGVTRVEGGFDQYRALLQEQFRREGFL

SEQ ID NO: 880954 - protein, 628 aa, Homo sapiens
MATCAEILRSEFPEIDGQVFDYVTGVLHSGSADFESVDDLVEAVGELLQEVSGDSKDDAGIRAVCQRMYNTLRLAEPQSQGNSQVLLDAPIQLSKITENYDCGTKLPGLLKREQSSTVNAKKLEKAEARLKAKQEKRSEKDTLKTSNPLVLEEASASQAGSRKESRLESSGKNKSYDVRIENFDVSFGDRVLLAGADVNLAWGRRYGLVGRNGLGKTTLLKMLATRSLRVPAHISLLHVEQEVAGDDTPALQSVLESDSVREDLLRRERELTAQIAAGRAEGSEAAELAEIYAKLEEIEADKAPARASVILAGLGFTPKMQQQPTREFSGGWRMRLALARALFARPDLLLLDEPTNMLDVRAILWLENYLQTWPSTILVVSHDRNFLNAIATDIIHLHSQRLDGYRGDFETFIKSKQERLLNQQREYEAQQQYRQHIQVFIDRFRYNANRASQVQSKLKMLEKLPELKPVDKESEVVMKFPDGFEKFSPPILQLDEVDFYYDPKHVIFSRLSVSADLESRICVVGENGAGKSTMLKLLLGDLAPVRGIRHAHRNLKIGYFSQHHVEQLDLNVSAVELLARKFPGRPEEEYRHQLGRYGISGELAMRPLASLSGGQKSRVAFAQMTMPW

SEQ ID NO: 880955 - protein, 488 aa, Homo sapiens
MLATRSLRVPAHISLLHVEQEVAGDDTPALQSVLESDSVREDLLRRERELTAQIAAGRAEGSEAAELAEIYAKLEEIEADKAPARASVILAGLGFTPKMQQQPTREFSGGWRMRLALARALFARPDLLLLDEPTNMLDVRAILWLENYLQTWPSTILVVSHDRNFLNAIATDIIHLHSQRLDGYRGDFETFIKSKQERLLNQQREYEAQQQYRQHIQVFIDRFRYNANRASQVQSKLKMLEKLPELKPVDKESEVVMKFPDGFEKFSPPILQLDEVDFYYDPKHVIFSRLSVSADLESRICVVGENGAGKSTMLKLLLGDLAPVRGIRHAHRNLKIGYFSQHHVEQLDLNVSAVELLARKFPGRPEEEYRHQLGRYGISGELAMRPLASLSGGQKSRVAFAQMTMPCPNFYILDEPTNHLDMETIEALGRALNNFRGGVILVSHDERFIRLVCRELWVCEGGGVTRVEGGFDQYRALLQEQFRREGFL

SEQ ID NO: 880956 - protein, 500 aa, Homo sapiens
MATCAEILRSEFPEIDGQVFDYVTGVLHSGSADFESVDDLVEAVGELLQEVSGDSKDDAGIRAVCQRMYNTLRLAEPQSQGNSQVLLDAPIQLSKITENYDCGTKLPGLLKREQSSTVNAKKLEKAEARLKAKQEKRSEKDTLKTSNPLVLEEASASQAGSRKESRLESSGKNKSYDVRIENFDVSFGDRVLLAGADVNLAWGRRYGLVGRNGLGKTTLLKMLATRSLRVPAHISLLHVEQEVAGDDTPALQSVLESDSVREDLLRRERELTAQIAAGRAEGSEAAELAEIYAKLEEIEADKAPARASVILAGLGFTPKMQQQPTREFSGGWRMRLALARALFARPDLLLLDEPTNMLDVRAILWLENYLQTWPSTILVVSHDRNFLNAIATDIIHLHSQRLDGYRGDFETFIKSKQERLLNQQREYEAQQQYRQHIQVFIDRFRYNANRASQVQSKLKMLEKLPELKPVDKESEVVMKFPDGFEKFSPPILQLDEVDCG

SEQ ID NO: 880957 - protein, 108 aa, Homo sapiens
MATCAEILRSEFPEIDGQVFDYVTGVLHSGSADFESVDDLVEAVGELLQEVSGDSKDDAGIRAVCQRMYNTLRLAEPQSQGNSQVLLDAPIQLSKITENYGESEGRLN

SEQ ID NO: 880958 - protein, 709 aa, Homo sapiens; identical to SEQ ID NO: 880951

SEQ ID NO: 880959 - protein, 746 aa, Homo sapiens
MATCAEILRSEFPEIDGQVFDYVTGVLHSGSADFESVDDLVEAVGELLQEVSGDSKDDAGIRAVCQRMYNTLRLAEPQSQGNSQVLLDAPIQLSKITENYDCGTKLPGLLKREQSSTVNAKKLEKAEARLKAKQEKRSEKDTLKTSNPLVLEEASASQAGSRKESRLESSGKNKSYDVRIENFDVSFGDRVLLAGADVNLAWGRRYGLVGRNGLGKTTLLKMLATRSLRVPAHISLLHVEQEVAGDDTPALQSVLESDSVREDLLRRERELTAQIAAGRAEGSEAAELAEIYAKLEEIEADKAPARASVILAGLGFTPKMQQQPTREFSGGWRMRLALARALFARPDLLLLDGEFEMGHPDFRMGRGGSIQVPSSPALQSQVLCSPASPEPTNMLDVRAILWLENYLQTWPSTILVVSHDRNFLNAIATDIIHLHSQRLDGYRGDFETFIKSKQERLLNQQREYEAQQQYRQHIQVFIDRFRYNANRASQVQSKLKMLEKLPELKPVDKESEVVMKFPDGFEKFSPPILQLDEVDFYYDPKHVIFSRLSVSADLESRICVVGENGAGKSTMLKLLLGDLAPVRGIRHAHRNLKIGYFSQHHVEQLDLNVSAVELLARKFPGRPEEEYRHQLGRYGISGELAMRPLASLSGGQKSRVAFAQMTMPCPNFYILDEPTNHLDMETIEALGRALNNFRGGVILVSHDERFIRLVCRELWVCEGGGVTRVEGGFDQYRALLQEQFRREGFL

SEQ ID NO: 880960 - protein, 709 aa, Homo sapiens; identical to SEQ ID NO: 880951

SEQ ID NO: 880961 - protein, 599 aa, Homo sapiens
MCLDPETVNAKKLEKAEARLKAKQEKRSEKDTLKTSNPLVLEEASASQAGSRKESRLESSGKNKSYDVRIENFDVSFGDRVLLAGADVNLAWGRRYGLVGRNGLGKTTLLKMLATRSLRVPAHISLLHVEQEVAGDDTPALQSVLESDSVREDLLRRERELTAQIAAGRAEGSEAAELAEIYAKLEEIEADKAPARASVILAGLGFTPKMQQQPTREFSGGWRMRLALARALFARPDLLLLDEPTNMLDVRAILWLENYLQTWPSTILVVSHDRNFLNAIATDIIHLHSQRLDGYRGDFETFIKSKQERLLNQQREYEAQQQYRQHIQVFIDRFRYNANRASQVQSKLKMLEKLPELKPVDKESEVVMKFPDGFEKFSPPILQLDEVDFYYDPKHVIFSRLSVSADLESRICVVGENGAGKSTMLKLLLGDLAPVRGIRHAHRNLKIGYFSQHHVEQLDLNVSAVELLARKFPGRPEEEYRHQLGRYGISGELAMRPLASLSGGQKSRVAFAQMTMPCPNFYILDEPTNHLDMETIEALGRALNNFRGGVILVSHDERFIRLVCRELWVCEGGGVTRVEGGFDQYRALLQEQFRREGFL

SEQ ID NO: 880962 - protein, 709 aa, Homo sapiens; identical to SEQ ID NO: 880951

SEQ ID NO: 880963 - protein, 488 aa, Homo sapiens; identical to SEQ ID NO: 880955

SEQ ID NO: 880964 - protein, 232 aa, Homo sapiens [sequence omitted]

SEQ ID NO: 880965 - protein, 507 aa, Homo sapiens
FRDIVDPGATGLQSVLESDSVREDLLRRERELTAQIAAGRAEGSEAAELAEIYAKLEEIEADKAPARASVILAGLGFTPKMQQQPTREFSGGWRMRLALARALFASVSLLGQCMKPYGRLVLALGRWHELLTKNLRPCILFHRPDLLLLDEPTNMLDVRAILWLENYLQTWPSTILVVSHDRNFLNAIATDIIHLHSQRLDGYRGDFETFIKSKQERLLNQQREYEAQQQYRQHIQVFIDRFRYNANRASQVQSKLKMLEKLPELKPVDKESEVVMKFPDGFEKFSPPILQLDEVDFYYDPKHVIFSRLSVSADLESRICVVGENGAGKSTMLKLLLGDLAPVRGIRHAHRNLKIGYFSQHHVEQLDLNVSAVELLARKFPGRPEEEYRHQLGRYGISGELAMRPLASLSGGQKSRVAFAQMTMPCPNFYILDEPTNHLDMETIEALGRALNNFRGGVILVSHDERFIRLVCRELWVCEGGGVTRVEGGFDQYRALLQEQFRREGFL

SEQ ID NO: 880966 - protein, 175 aa, Homo sapiens
MATCAEILRSEFPEIDGQVFDYVTGVLHSGSADFESVDDLVEAVGELLQEVSGDSKDDAGIRAVCQRMYNTLRLAEPQSQGNSQVLLDAPIQLSKITENYDCGTKLPGLLKREQSSTVNAKKLEKAEARLKAKQEKRSEKDTLKTSNPLVLEEASASQAGSRKESRLESSGKNKS

SEQ ID NO: 880967 - protein, 120 aa, Homo sapiens
MATCAEILRSEFPEIDGQVFDYVTGVLHSGSADFESVDDLVEAVGELLQEVSGDSKDDAGIRAVCQRMYNTLRLYVPGSEGLMGAKGRRTVRRQEVGEEDLMAIELFPQLLTLRFLSLPT

SEQ ID NO: 880968 - protein, 539 aa, Homo sapiens
MERPAPLAVLPFSDPAHALSLLRGLSQLRAERKFLDVTLEAAGGRDFPAHRAVLAAASPYFRAMFAGQLRESRAERVRLHGVPPDMLQLLLDFSYTGRVAVSGDNAEPLLRAADLLQFPAVKEACGAFLQQQLDLANCLDMQDFAEAFSCSGLASAAQRFILRHVGELGAEQLERLPLARLLRYLRDDGLCVPKEEAAYQLALRWVRADPPRRAAHWPQLLEAVRLPFVRRFYLLAHVEAEPLVARCPPCLRLLREARDFQAARYDRHDRGPCPRMRPRPSTGLAEILVLVGGCDQDCDELVTVDCYNPQTGQWRYLAEFPDHLGGGYSIVALGNDIYVTGGSDGSRLYDCVWRYNSSVNEWAEVAPMLKAREYHSSSVLDGLLYVVAADSTERYDHTTDSWEALQPMTYPMDNCSTTACRGRLYAIGSLAGKETMVMQCYDPDTDLWSLVDCGQLPPWSFAPKTATLNGLMYFVRDDSAEVDVYNPTRNEWDKIPSMNQVNFQAGQHWKHRLVLILQPKCHRDECLGSTAMMDGSHLN

SEQ ID NO: 880969 - protein, 597 aa, Homo sapiens
MERPAPLAVLPFSDPAHALSLLRGLSQLRAERKFLDVTLEAAGGRDFPAHRAVLAAASPYFRAMFAGQLRESRAERVRLHGVPPDMLQLLLDFSYTGRVAVSGDNAEPLLRAADLLQFPAVKEACGAFLQQQLDLANCLDMQDFAEAFSCSGLASAAQRFILRHVGELGAEQLERLPLARLLRYLRDDGLCVPKEEAAYQLALRWVRADPPRRAAHWPQLLEAVRLPFVRRFYLLAHVEAEPLVARCPPCLRLLREARDFQAARYDRHDRGPCPRMRPRPSTGLAEILVLVGGCDQDCDELVTVDCYNPQTGQWRYLAEFPDHLGGGYSIVALGNDIYVTGGSDGSRLYDCVWRYNSSVNEWAEVAPMLKAREYHSSSVLDGLLYVVAADSTERYDHTTDSWEALQPMTYPMDNCSTTACRGRLYAIGSLAGKETMVMQCYDPDTDLWSLVDCGQLPPWSFAPKTATLNGLMYFVRDDSAEVDVYNPTRNEWDKIPSMNQVHVGGSLAVLGGKLYVSGGYDNTFELSDVVEAYDPETRAWSVVGRLPEPTFWHGSVSIFRQFMPQTFSGGRGFELDSGSDDMDPGRPRPPRDPDELH

SEQ ID NO: 880970 - protein, 279 aa, Homo sapiens
LLTSSVAPQENCPKAQGSGLLRCGSDGSRLYDCVWRYNSSVNEWAEVAPMLKAREYHSSSVLDGLLYVVAADSTERYDHTTDSWEALQPMTYPMDNCSTTACRGRLYAIGSLAGKETMVMQCYDPDTDLWSLVDCGQLPPWSFAPKTATLNGLMYFVRDDSAEVDVYNPTRNEWDKIPSMNQVHVGGSLAVLGGKLYVSGGYDNTFELSDVVEAYDPETRAWSVVGRLPEPTFWHGSVSIFRQFMPQTFSGGRGFELDSGSDDMDPGRPRPPRDPDELH

SEQ ID NO: 880971 - protein, 133 aa, Homo sapiens
MLKAREYHSSSVLDGLLYVVAADSTERYDHTTDSWEALQPMTYPMDNCSTTACRGRLYAIGSLAGKETMVMQCYDPDTDLWSLVDCGQLPPWSFAPKTATLNGLMYFVRDDSAEVDVYNPTRNEWDKIPSMNQ

SEQ ID NO: 880972 - protein, 597 aa, Homo sapiens; identical to SEQ ID NO: 880969

SEQ ID NO: 880973 - protein, 103 aa, Homo sapiens
MAWLVALICPRTPDRAAWPLPRAPQEPSPYTVDVIAVGLGSLVLERPGWYDHSSWRLFSLGSWSSSSTCCAGKAEDGGPALSRPAGAWLGVLWAAWNMQLGFL

SEQ ID NO: 880974 - protein, 597 aa, Homo sapiens; identical to SEQ ID NO: 880969

SEQ ID NO: 880975 - protein, 79 aa, Homo sapiens
LHDIKCKVKQQDDDLEAAAGYPEDLPKTIHESGYSKQLIFNVDLKAFYWKKKAPFRSFLARDQKSIPGFRASEDRQPLL

SEQ ID NO: 880976 - protein, 94 aa, Homo sapiens
SVTQGRTLLQPCMCALPPRSEQLSSCCPLHRDDSAEVDVYNPTRNEWDKIPSMNQVNFQAGQHWKHRLVLILQPKCHRDECLGSTAMMGGSHLN

SEQ ID NO: 880977 - protein, 134 aa, Homo sapiens
MSWHLRDPAFCFPRSKLHIVIANLGKMEGIIQPRGSEPSSATVSHASLSFPICNMGRTALLSPEGHCRDSERERRKRCSARPAHGEAWRCSGHPHHHREGPAASGEARSPRQGVGKGLASLLLSGRAKATPLGY

SEQ ID NO: 880978 - protein, 597 aa, Homo sapiens; identical to SEQ ID NO: 880969

SEQ ID NO: 880979 - protein, 516 aa, Homo sapiens
VSLYVLTAVISRNQEGPGEMGKAVLIPKDDQEKMKELFKINQFNLMASDLIALNRSLPDVRLEGCKTKVYPDELPNTSVVIVFHNEAWSTLLRTVYSVINRSPHYLLSEVILVDDASERDFLKLTLENYVKNLEVPVKIIRMEERSGLIRARLRGAAASKGQVITFLDAHCECTLGWLEPLLARIKEDRKTVVCPIIDVISDDTFEYMAGSDMTYGGFNWKLNFRWYPVPQREMDRRKGDRTLPVRTPTMAGGLFSIDRNYFEEIGTYDAGMDIWGGENLEMSFRIWQCGGSLEIVTCSHVGHVFRKATPYTFPGGTGHVINKNNRRLAEVWMDEFKDFFYIISPGVVKVDYGDVSVRKTLRENLKCKPFSWYLENIYPDSQIPRRYYSLGEIRNVETNQCLDNMGRKENEKVGIFNCHGMGGNQVFSYTADKEIRTDDLCLDVSRLNGPVIMLKCHHMRGNQLWEYDAERLTLRHVNSNQCLDEPSEEDKMVPTMQDCSGSRSQQWLLRNMTLGT

SEQ ID NO: 880980 - protein, 516 aa, Homo sapiens; identical to SEQ ID NO: 880979

SEQ ID NO: 880981 - protein, 531 aa, Homo sapiens
VSLYVLTAVISRNQEGPGEMGKAVLIPKDDQEKMKELFKINQFNLMASDLIALNRSLPDVRLEGCKTKVYPDELPNTSVVIVFHNEAWSTLLRTVYSVINRSPHYLLSEVILVDDASERDFLKLTLENYVKNLEVPVKIIRMEERSGLIRARLRGAAASKGQVITFLDAHCECTLGWLEPLLARIKEDRKTVVCPIIDVISDDTFEYMAGSDMTYGGFNWKLNFRWYPVPQREMDRRKGDRTLPVRTPTMAGGLFSIDRNYFEEIGTYDAGMDIWGGENLEMSFRIWQCGGSLEIVTCSHVGHVFRKATPYTFPGGTGHVINKNNRRLAEVWMDEFKDFFYIISPGVVKVDYGDVSVRKTLRENLKCKPFSWYLENIYPDSQIPRRYYSLGEIRNVETNQCLDNMGRKENEKVGIFNCHGMGGNQVFSYTADKEIRTDDLCLDVSRLNGPVIMLKCHHMRGNQLWEYDAETHTLLHIITQSCLSVNKVADGSQHPTVETCNDSTLQKWLLRNYTRMEIFRNIFGNSTDYIL

SEQ ID NO: 880982 - protein, 293 aa, Homo sapiens
VSLYVLTAVISRNQEGPGEMGKAVLIPKDDQEKMKELFKINQFNLMASDLIALNRSLPDVRLEGCKTKVYPDELPNTSVVIVFHNEAWSTLLRTVYSVINRSPHYLLSEVILVDDASERDFLKLTLENYVKNLEVPVKIIRMEERSGLIRARLRGAAASKGQVITFLDAHCECTLGWLEPLLARIKEDRKTVVCPIIDVISDDTFEYMAGSDMTYGGFNWKLNFRWYPVPQREMDRRKGDRTLPVRTPTMAGGLFSIDRNYFEEIGTYDAGMDIWGGENLEMSFRVIAFYFIF

SEQ ID NO: 880983 - protein, 104 aa, Homo sapiens
LAGDDSLNFPPLQVFSYTADKEIRTDDLCLDVSRLNGPVIMLKCHHMRGNQLWEYDAERLTLRHVNSNQCLDEPSEEDKMVPTMQDCSGSRSQQWLLRNMTLGT

SEQ ID NO: 880984 - protein, 516 aa, Homo sapiens; identical to SEQ ID NO: 880979

SEQ ID NO: 880985 - protein, 97 aa, Homo sapiens
AEVPSAGAKWGLRRNVSFNLETDSYLPSPLYPLTRSSRPLLEVDEGLQPTQPGRTGDRNAAEPSWPERGDCLFSDVRNISGNQGDLAASSPWMQGLK

SEQ ID NO: 880986 - protein, 137 aa, Homo sapiens
MPERPTMEHTPRRCFGLASPDPPPQATSSHWDARSEEAALTLLWPSQALPQPLSHLGGMGLFPGVPHYHLPVSETPAQKARAPACFLQHPRGICEGPSGRRCEVRTPCPKGVHAFPSHSSQQHRRPIPQTPKCLQMN

SEQ ID NO: 880987 - protein, 130 aa, Homo sapiens
ANASPVLCMAPKKEKGGTVNTSSKIWEPSLIAAQFNQNDWQASIAFVVGNQIEDDLLIQALTVAVQVPQRKLFSMVSWQDILQQINEINTLVGSASSKKAKKPVGGNAPLYYEVSESVYRRYFCVFRKKN

SEQ ID NO: 880988 - protein, 319 aa, Homo sapiens
RRSPGWEERSADSQGTYSFLLHSIAGAGAESEMSSSGTPDLPVLLTDLKIQYTKIFINNEWHDSVSGKKFPVFNPATEEELCQVEEGDKEDVDKAVKAARQAFQIGSPWRTMDASERGRLLYKLADLIERDRLLLATMESMNGGKLYSNAYLNDLAGCIKTLRYCAGWADKIQGRTIPIDGNFFTYTRHEPIGVCGQIIPWNFPLVMLIWKIGPALSCGNTVVVKPAEQTPLTALHVASLIKEAGFPPGVVNIVPGYGPTAGAAISSPWFCSTVPSPDSPLALSRVPGKHWRARLWNSCYARRAVFSRGSPRVFPVALY

SEQ ID NO: 880989 - protein, 533 aa, Homo sapiens
RRSPGWEERSADSQGTYSFLLHSIAGAGAESEMSSSGTPDLPVLLTDLKIQYTKIFINNEWHDSVSGKKFPVFNPATEEELCQVEEGDKEDVDKAVKAARQAFQIGSPWRTMDASERGRLLYKLADLIERDRLLLATMESMNGGKLYSNAYLNDLAGCIKTLRYCAGWADKIQGRTIPIDGNFFTYTRHEPIGVCGQIIPWNFPLVMLIWKIGPALSCGNTVVVKPAEQTPLTALHVASLIKEAGFPPGVVNIVPGYGPTAGAAISSHMDIDKVAFTGSTEVGKLIKEAAGKSNLKRVTLELGGKSPCIVLADADLDNAVEFAHHGVFYHQGQCCIAASRIFVEESIYDEFVRRSVERAKKYILGNPLTPGVTQGPQIDKEQYDKILDLIESGKKEGAKLECGGGPWGNKGYFVQPTVFSNVTDEMRIAKEEIFGPVQQIMKFKSLDDVIKRANNTFYGLSAGVFTKDIDKAITISSALQAGTVWVNCYGVVSAQCPFGGFKMSGNGRELGEYGFHEYTEVKTVTVKISQKNS

SEQ ID NO: 880990 - protein, 533 aa, Homo sapiens; identical to SEQ ID NO: 880989

SEQ ID NO: 880991 - protein, 533 aa, Homo sapiens; identical to SEQ ID NO: 880989

SEQ ID NO: 880992 - protein, 503 aa, Homo sapiens
MISVSGSSTKKDNAHGGDRDVLIAMCHGWQLLRSYLAPVSNMAVHCELVWPCDRPDADKEDVDKAVKAARQAFQIGSPWRTMDASERGRLLYKLADLIERDRLLLATMESMNGGKLYSNAYLNDLAGCIKTLRYCAGWADKIQGRTIPIDGNFFTYTRHEPIGVCGQIIPWNFPLVMLIWKIGPALSCGNTVVVKPAEQTPLTALHVASLIKEAGFPPGVVNIVPGYGPTAGAAISSHMDIDKVAFTGSTEVGKLIKEAAGKSNLKRVTLELGGKSPCIVLADADLDNAVEFAHHGVFYHQGQCCIAASRIFVEESIYDEFVRRSVERAKKYILGNPLTPGVTQGPQIDKEQYDKILDLIESGKKEGAKLECGGGPWGNKGYFVQPTVFSNVTDEMRIAKEEIFGPVQQIMKFKSLDDVIKRANNTFYGLSAGVFTKDIDKAITISSALQAGTVWVNCYGVVSAQCPFGGFKMSGNGRELGEYGFHEYTEVKTVTVKISQKNS

SEQ ID NO: 880993 - protein, 533 aa, Homo sapiens; identical to SEQ ID NO: 880989

SEQ ID NO: 880994 - protein, 327 aa, Homo sapiens [sequence omitted]

SEQ ID NO: 880995 - protein, 533 aa, Homo sapiens; identical to SEQ ID NO: 880989

SEQ ID NO: 880996 - protein, 533 aa, Homo sapiens; identical to SEQ ID NO: 880989

SEQ ID NO: 880997 - protein, 518 aa, Homo sapiens
RRSPGWEERSADSQGTYSFLLHSIAGAGAESEMSSSGTPDLPVLLTDLKIQYTKIFINNEWHDSVSGKKFPVFNPATEEELCQVEEGDKEDVDKAVKAARQAFQIGSPWRTMDASERGRLLYKLADLIERDRLLLATMESMNGGKLYSNAYLNDLAGCIKTLRYCAGWADKIQGRTIPIDGNFFTYTRHEPIGVCGQIIPWNFPLVMLIWKIGPALSCGNTVVVKPAEQTPLTALHVASLIKEPTAGAAISSHMDIDKVAFTGSTEVGKLIKEAAGKSNLKRVTLELGGKSPCIVLADADLDNAVEFAHHGVFYHQGQCCIAASRIFVEESIYDEFVRRSVERAKKYILGNPLTPGVTQGPQIDKEQYDKILDLIESGKKEGAKLECGGGPWGNKGYFVQPTVFSNVTDEMRIAKEEIFGPVQQIMKFKSLDDVIKRANNTFYGLSAGVFTKDIDKAITISSALQAGTVWVNCYGVVSAQCPFGGFKMSGNGRELGEYGFHEYTEVKTVTVKISQKNS

SEQ ID NO: 880998 - protein, 549 aa, Homo sapiens
RRSPGWEERSADSQGTYSFLLHSIAGAGAESEMSSSGTPDLPVLLTDLKIQYTKIFINNEWHDSVSGKKFPVFNPATEEELCQVEEGDKEDVDKAVKAARQAFQIGSPWRTMDASERGRLLYKLADLIERDRLLLATMESMNGGKLYSNAYLNDLAGCIKTLRYCAGWADKIQGRTIPIDGNFFTYTRHEPIGVCGQIIPWNFPLVMLIWKIGPALSCGNTVVVKPAEQTPLTALHVASLIKEAGFPPGVVNIVPGYGPTAGAAISSHMDIDKVAFTGSTEVGKLIKEAAGKSNLKRVTLELGGKSPCIVLADADLDNAVEFAHHGVFYHQGQCCIAASRIFVEESIYDEFVRRSVERAKKYILGNPLTPGVTQGPQYVFLVNLRALSDSWGQIDKEQYDKILDLIESGKKEGAKLECGGGPWGNKGYFVQPTVFSNVTDEMRIAKEEIFGPVQQIMKFKSLDDVIKRANNTFYGLSAGVFTKDIDKAITISSALQAGTVWVNCYGVVSAQCPFGGFKMSGNGRELGEYGFHEYTEVKTVTVKISQKNS

SEQ ID NO: 880999 - protein, 514 aa, Homo sapiens
RRSPGWEERSADSQGTYSFLLHSIAGAGAESEMSSSGTPDLPVLLTDLKIQYTKIFINNEWHDSVSGKKFPVFNPATEEELCQVEEGDKEDVDKAVKAARQAFQIGSPWRTMDASERGRLLYKLADLIERDRLLLATMESMNGGKLYSNAYLNDLAGCIKTLRYCAGWADKIQGRTIPIDGNFFTYTRHEPIGVCGQIIPWNFPLVMLIWKIGPALSCGNTVVVKPAEQTPLTALHVASLIKEAGFPPGVVNIVPGYGPTAGAAISSHMDIDKVAFTGSTEGKLIKEAVGVLADADLDNAVEFAHHGVFYHQGQCCIAASRIFVEESIYDEFVRRSVERAKKYILGNPLTPGVTQGPQIDKEQYDKILDLIESGKKEGAKLECGGGPWGNKGYFVQPTVFSNVTDEMRIAKEEIFGPVQQIMKFKSLDDVIKRANNTFYGLSAGVFTKDIDKAITISSALQAGTVWVNCYGVVSAQCPFGGFKMSGNGRELGEYGFHEYTEVKTVTVKISQKNS

SEQ ID NO: 881000 - protein, 515 aa, Homo sapiens
RRSPGWEERSADSQGTYSFLLHSIAGAGAESEMSSSGTPDLPVLLTDLKIQYTKIFINNEWHDSVSGKKFPVFNPATEEELCQVEEGDKEDVDKAVKAARQAFQIGSPWRTMDASERGRLLYKLADLIERDRLLLATMESMNGGKLYSNAYLNDLAGCIKTLRYCAGWADKIQGRTIPIDGNFFTYTRHEPIGVCGQIIPWNFPLVMLIWKIGPALSCGNTVVVKPAEQTPLTALHVASLIKEAGFPPGVVNIVPGYGPTAGAAISSHMDIDKVAFTGSTEVGKLIKEAAGKSNLKRVTLELGGKSPCIVLADADLDNAVEFAHHGVFYHQGQCCIAASRIFVEESIYDEFVRRSVERAKKYILGNPLTPGVTQGPQEGAKLECGGGPWGNKGYFVQPTVFSNVTDEMRIAKEEIFGPVQQIMKFKSLDDVIKRANNTFYGLSAGVFTKDIDKAITISSALQAGTVWVNCYGVVSAQCPFGGFKMSGNGRELGEYGFHEYTEVKTVTVKISQKNS

SEQ ID NO: 881001 - protein, 533 aa, Homo sapiens; identical to SEQ ID NO: 880989

SEQ ID NO: 881002 - protein, 508 aa, Homo sapiens
RRSPGWEERSADSQGTYSFLLHSIAGAGAESEMSSSGTPDLPVLLTDLKIQYTKIFINNEWHDSVSGKKFPVFNPATEEELCQVEEGDKEDVDKAVKAARQAFQIGSPWRTMDASERGRLLYKLADLIERDRLLLATMESMNGGKLYSNAYLNDLAGCIKTLRYCAGWADKIQGRTIPIDGNFFTYTRHEPIGVCGQIIPWNFPLVMLIWKIGPALSCGNTVVVKPAEQTPLTALHVASLIKEAGFPPGVVNIVPGYGPTAGAAISSHMDIDKVAFTGSTEVGKLIKEAAGKSNLKRVTLELGGKSPCIVLADADLDNAVEFAHHGVFYHQGQCCIAASRIFVEESIYDEFVRRSVERAKKYILGNPLTPGVTQGPQIDKEQYDKILDLIESGKKEGAKLECGGGPWGNKGYFVQPTVFSNVTDEMRIAKEEIFGPVQQIMKFKSLDDVIKRANNTFYGLSAGVFTKDIDKAITISSALQAGTVWGEYGFHEYTEVKTVTVKISQKNS

SEQ ID NO: 881003 - protein, 454 aa, Homo sapiens
RRSPGWEERSADSQGTYSFLLHSIAGAGAESEMSSSGTPDLPVLLTDLKIQYTKIFINNEWHDSVSGKKFPVFNPATEEELCQVEEGDKEDVDKAVKAARQAFQIGSPWRTMDASERGRLLYKLADLIERDRLLLATMESMNGGKLYSNAYLNDLAGCIKTLRYCAGWADKIQGRTIPIDGNFFTYTRHEPIGVCGQIIPWNFPLVMLIWKIGPALSCGNTVVVKPAEQTPLTALHVASLIKEAGFPPGVVNIVPGYGPTAGAAISSHMDIDKVAFTGSTEVGKLIKEAAGKSNLKRVTLELGGKSPCIVLADADLDNAVEFAHHGVFYHQGQCCIAASRIFVEESIYDEFVRRSVERAKKYILGNPLTPGVTQGPQIDKEQYDKILDLIESGKKEGAKLECGGGPWGNKGYFVQPTVFSNVTDEMRIAKEEIFGPVQQIMKFKSLDDVILIKP

SEQ ID NO: 881004 - protein, 145 aa, Homo sapiens
PGCRIRHEGAKLECGGGPWGNKGYFVQPTVFSNVTDEMRIAKEEIFGPVQQIMKFKSLDDVIKRANNTFYGLSAGVFTKDIDKAITISSALQAGTVWVNCYGVVSAQCPFGGFKMSGNGRELGEYGFHEYTEVKTVTVKISQKNS

SEQ ID NO: 881005 - protein, 295 aa, Homo sapiens
MLLVLLVLSWLPHGGALSLAEASRASFPGPSELHSEDSRFRELRKRYEDLLTRLRANQSWEDSNTDLVPAPAVRILTPEVRLGIRRPPCTCVSLGPPFPRGFPEASRLHRALFRLSPTASRSWDVTRPLRRQLSLARPQAPALQPATVAAAVAVGPTAGRIFVRTAPAGVALAAASRQGAPQSACAQIRGPLSARARALLPSAHGPRVAGRPGLGRLGAVATGGASDHVHRRVPEPVPGGKTCTRKIKTSLHRLKSPNTVPQAPPWPACPPQLTIPMVPHSKKDPTPGCRLSQTL

SEQ ID NO: 881006 - protein, 295 aa, Homo sapiens; identical to SEQ ID NO: 881005

SEQ ID NO: 881007 - protein, 330 aa, Homo sapiens
DWPRAKIGTSLVNGPEATRCTAMPGQELRTVNGSQMLLVLLVLSWLPHGGALSLAEASRASFPGPSELHSEDSRFRELRKRYEDLLTRLRANQSWEDSNTDLVPAPAVRILTPEVRLGIRRPPCTCVSLGPPFPRGFPEASRLHRALFRLSPTASRSWDVTRPLRRQLSLARPQAPALQPATVAAAVAVGPTAGRIFVRTAPAGVALAAASRQGAPQSACAQIRGPLSARARALLPSAHGPRVAGRPGLGRLGAVATGGASDHVHRRVPEPVPGGKTCTRKIKTSLHRLKSPNTVPQAPPWPACPPQLTIPMVPHSKKDPTPGCRLSQTL

SEQ ID NO: 881008 - protein, 295 aa, Homo sapiens; identical to SEQ ID NO: 881005

SEQ ID NO: 881009 - protein, 241 aa, Homo sapiens
MLLVLLVLSWLPHGGALSLAEASRASFPGPSELHSEDSRFRELRKRYEDLLTRLRANQSWEDSNTDLVPAPAVRILTPEVRLGIRRPPCTCVSLGPPFPRGFPEASRLHRALFRLSPTASRSWDVTRPLRRQLSLARPQAPALQLLAESSSARPQLELHLRPQAARGRRRARARKTGDHCPLGPGRCCRLHTVRASLEDLGWADWVLSPREVQVTMCIGACPSQFRAAKHARARSRRACTA

SEQ ID NO: 881010 - protein, 241 aa, Homo sapiens
MLLVLLVLSWLPHGGALSLAEASRASFPGPSELHSEDSRFRELRKRYEDLLTRLRANQSWEDSNTDLVPAPAVRILTPEVRLGIRRPPCTSATVAAAVAVGPTAGRIFVRTAPAGVALAAASRQGAPQSACAQIRGPLSARARALLPSAHGPRVAGRPGLGRLGAVATGGASDHVHRRVPEPVPGGKTCTRKIKTSLHRLKSPNTVPQAPPWPACPPQLTIPMVPHSKKDPTPGCRLSQTL

SEQ ID NO: 881011 - protein, 273 aa, Homo sapiens
MLLVLLVLSWLPHGGALSLAEASRASFPGPSELHSEDSRFRELRKRYEDLLTRLRANQSWEDSNTDLVPAPAVRILTPEVRLGIRRPPCTCVSLGPPFPRGFPEASRLHRALFRLSPTASRSWDVTRPLRRQLSLARPQAPALQPATVAAAVAVGPTAGRIFVRTAPAGVALAAASRQGAPQSACAQIRGPLSARARALLPSAHGPRVAGRPGLGRLGAVATRKIKTSLHRLKSPNTVPQAPPWPACPPQLTIPMVPHSKKDPTPGCRLSQTL

SEQ ID NO: 881012 - protein, 223 aa, Homo sapiens
MLLVLLVLSWLPHGGALSLAEASRASFPGPSELHSEDSRFRELRKRYEDLLTRLRANQSWEDSNTDLVPAPAVRILTPEVRLGIRRPPCTCVSLGPPFPRGFPEASRLHRALFRLSPTASRSWDVTRPLRRQLSLARPQAPALQPATVAAAVAVGPTAGRIFVRTAPAGVALAAASRQGAPQSACAQIRGPLSARARALLPSAHGPRVAGRPGLGRLGAVATA

SEQ ID NO: 881013 - protein, 254 aa, Homo sapiens
MLLVLLVLSWLPHGGALSLAEASRASFPGPSELHSEDSRFRELRKRYEDLLTRLRANQSWEDSNTDLVPAPAVRILTPEVRLGIRRPPCTCVSLGPPFPRGFPEASRLHRALFRLSPTASRSWDVTRPLRRQLSLARPQAPALQPATVAAAVAVGPTAGRIFVRTAPAGVALAAASRQGAPQSACAQIRGPLSARARALLPSAHGPRVAGRPGLGRLGAVATPPWPACPPQLTIPMVPHSKKDPTPGCRLSQTL

SEQ ID NO: 881014 - protein, 122 aa, Homo sapiens
MLLVLLVLSWLPHGGALSLAEASRASFPGPSELHSEDSRFRELRKRYEDLLTRLRANQSWEDSNTDLVPAPAVRILTPEVRLGIRRPPCTWEVQVTMCIGACPSQFRAAKHARARSRRACTA

SEQ ID NO: 881015 - protein, 103 aa, Homo sapiens
MLLVLLVLSWLPHGGALSLAEASRASFPGPSELHSEDSRFRELRKRYEDLLTRLRANQSWEDSNTDLVPAPAVRILTPEGKGNLRDPLPPPKQPPYLIRDSSS

SEQ ID NO: 881016 - protein, 261 aa, Homo sapiens
MTCWLRGVTATFGRPAEWPGYLSHLCGRSAAMDLGPMRKSYRGDREAFEETHLTSLDPVKQFAAWFEEAVQCPDIGEANAMCLATCTRDGKPSARMLLLKGFGKDGFRFFTNFESRKGKELDSNPFASLVFYWEPLNRQVRVEGPVKKLPEEEAECYFHSRPKSSQIGAVVSHQSSVIPDREYLRKKNEELEQLYQDQEVPKPKSWGGYVLYPQVMEFWQGQTNRLHDRIVFRRGLPTGDSPLGPMTHRGEEDWLYERLAP

SEQ ID NO: 881017 - protein, 166 aa, Homo sapiens
MLLLKGFGKDGFRFFTNFESRKGKELDSNPFASLVFYWEPLNRQVRVEGPVKKLPEEEAECYFHSRPKSSQIGAVVSHQSSVIPDREYLRKKNEELEQLYQDQEVPKPKSWGGYVLYPQVMEFWQGQTNRLHDRIVFRRGLPTGDSPLGPMTHRGEEDWLYERLAP

SEQ ID NO: 881018 - protein, 261 aa, Homo sapiens; identical to SEQ ID NO: 881016

SEQ ID NO: 881019 - protein, 117 aa, Homo sapiens
GRVGRPTRPGTHRITGKLQGSRFHLNIGRDFKQSHLPEKEWAVTRNFYSQSVRNFVEGLHVLVPIGQEDFNQLYYLCFFMETVCMYTYIFQKEKLNDYRDYVFQTTHVSAFLTPHLC

SEQ ID NO: 881020 - protein, 261 aa, Homo sapiens; identical to SEQ ID NO: 881016

SEQ ID NO: 881021 - protein, 261 aa, Homo sapiens; identical to SEQ ID NO: 881016

SEQ ID NO: 881022 - protein, 261 aa, Homo sapiens; identical to SEQ ID NO: 881016

SEQ ID NO: 881023 - protein, 120 aa, Homo sapiens
MPAKHAFLKTHKSVGERNHPVSLWSPTGLNLAPPLPAGTWARDLACLCVCDNRPTFEGLNELLRWVHLLWACALQLSCLFPACRRPPLPVLMAGCGFSFTSRTLIPLLPLSSTGSHLTVR

SEQ ID NO: 881024 - protein, 195 aa, Homo sapiens
MTCWLRGVTATFGRPAEWPGYLSHLCGRSAAMDLGPMRKSYRGDREHLGELIVTVACGPRAAKTEVFGLGPLGFFLNGRGLGSSGSLNTRGTPNAMCLATCTRDGKPSARMLLLKGFGKDGFRFFTNFESRKGKELDSNPFASLVFYWEPLNRQVSEFSQDSLGWAGLAGPEFMATSSEGPQTGQTSQLGTLPLK

SEQ ID NO: 881025 - protein, 261 aa, Homo sapiens; identical to SEQ ID NO: 881016

SEQ ID NO: 881026 - protein, 426 aa, Homo sapiens
RRPAKEGRGWCLWGAAPGLGGLLAGCWAGAKGCSVSFSGALGSAMALQGISVMELSGLAPGPFCAMVLADFGARVVRVDRPGSRYDVSRLGRGKRSLVLDLKQPRGAAVLRRLCKRSDVLLEPFRRGVMEKLQLGPEILQRENPRLIYARLSGFGQSGSFCRLAGHDINYLALSGVLSKIGRSGENPYAPLNLLADFAGGGLMCALGIIMALFDRTRTDKGQVIDANMVEGTAYLSSFLWKTQKSSLWEAPRGQNMLDGGAPFYTTYRTADGEFMAVGAIEPQFYELLIKGLGLKSDELPNQMSMDDWPEMKKKFADVFAEKTKAEWCQIFDGTDACVTPVLTFEEVVHHDHNKERGSFITSEEQDVSPRPAPLLLNTPAIPSFKRDPFIGEHTEEILEEFGFSREEIYQLNSDKIIESNKVKASL

SEQ ID NO: 881027 - protein, 426 aa, Homo sapiens; identical to SEQ ID NO: 881026

SEQ ID NO: 881028 - protein, 426 aa, Homo sapiens; identical to SEQ ID NO: 881026

SEQ ID NO: 881029 - protein, 298 aa, Homo sapiens
MEKLQLGPEILQRENPRLIYARLSGFGQSGSFCRLAGHDINYLALSGVLSKIGRSGENPYAPLNLLADFAGGGLMCALGIIMALFDRTRTDKGQVIDANMVEGTAYLSSFLWKTQKSSLWEAPRGQNMLDGGAPFYTTYRTADGEFMAVGAIEPQFYELLIKGLGLKSDELPNQMSMDDWPEMKKKFADVFAEKTKAEWCQIFDGTDACVTPVLTFEEVVHHDHNKERGSFITSEEQDVSPRPAPLLLNTPAIPSFKRDPFIGEHTEEILEEFGFSREEIYQLNSDKIIESNKVKASL

SEQ ID NO: 881030 - protein, 426 aa, Homo sapiens
RRPAKEGRGWCLWGAAPGLGGLLAGCWAGAKGCSVSFSGALGSAMALQGISVMELSGLAPGPFCAMVLADFGARVVRVDRPGSRYDVSRLGRGKRSLVLDLKQPRGAAVLRRLCKRSDVLLEPFRRGVMEKLQLGPEILQRENPRLIYARLSGFGQSGSFCRLAGHDINYLALSGVLSKIGRSGENPYAPLNLLADFAGGGLMCALGIIMALFDRTRTDKGQVIDANMVEGTAYLSSFLWKTQKSSLWEAPRGQNMLDGGAPFYTTYRTADGEFMAVGAIEPQFYELLIKGLGLKSDELPNQMSMDDWPEMKKKFADVFAEKTKAEWCQIFDGTDACVTPVLTFEEVVHHDHNKERGSFITSEEQDVSPRPAPLLLNTPAIPSFKRDPFIGEHTEEILEEFGFSREEIYQLNSDKIIESNKIYSVE

SEQ ID NO: 881031 - protein, 332 aa, Homo sapiens
RRPAKEGRGWCLWGAAPGLGGLLAGCWAGAKGCSVSFSGALGSAMALQGISVMELSGLAPGPFCAMVLADFGARVVRVDRPGSRYDVSRLGRGKRSLVLDLKQPRGAAVLRRLCKRSDVLLEPFRRGVMEKLQLGPEILQRENPRLIYARLSGFGQSGSFCRLAGHDINYLALSGVLSKIGRSGENPYAPLNLLADFAGGGLMCALGIIMALFDRTRTDKGQVIDANMVEGTAYLSSFLWKTQKSSLWEAPRGQNMLDGGAPFYTTYRTADGEFMAVGAIEPQFYELLIKGLGELILLKIQQEAVSCQARQTLVSVKQWPSLQPKSWGFVWQ

SEQ ID NO: 881032 - protein, 426 aa, Homo sapiens; identical to SEQ ID NO: 881026

SEQ ID NO: 881033 - protein, 242 aa, Homo sapiens
RRPAKEGRGWCLWGAAPGLGGLLAGCWAGAKGCSVSFSGALGSAMALQGISVMELSGLAPGPFCAMVLADFGARVVRVDRPGSRYDVSRLGRGKRSLVLDLKQPRGAAVLRRLCKRSDVLLEPFRRGVMEKLQLGPEILQRENPRLIYARLSGFGQSGSFCRLAGHDINYLALSGGRNSIFKFFSVENSEIESVGSTSRTEHVGWWSTFLYDLQDSRWGIHGCWSNRTPVLRAADQRTWTKV

SEQ ID NO: 881034 - protein, 152 aa, Homo sapiens
MVPDMQRTQFYELLIKGLGLKSDELPNQMSMDDWPEMKKKFADVFAEKTKAEWCQIFDGTDACVTPVLTFEEVVHHDHNKERGSFITSEEQDVSPRPAPLLLNTPAIPSFKRDPFIGEHTEEILEEFGFSREEIYQLNSDKIIESNKVKASL

SEQ ID NO: 881035 - protein, 438 aa, Homo sapiens
RRPAKEGRGWCLWGAAPGLGGLLAGCWAGAKGCSVSFSGALGSAMALQGISVMELSGLAPGPFCAMVLADFGARVVRVDRPGSRYDVSRLGRGKRSLVLDLKQPRGAAVLRRLCKRSDVLLEPFRRGVMEKLQLGPEILQRENPRLIYARLSGFGQSGSFCRLAGHDINYLALSGVLSKIGRSGENPYAPLNLLADFAGGGLMCALGIIMALFDRTRTDKGQVIDANMVEGTAYLSSFLWKTQKSSLWEAPRGQNMLDGGAPFYTTYRTADGEFMAVGAIEPQFYELLIKGLGLKSDELPNQMSMDDWPEMKKKFADVFAEKTKAEWCQIFDGTDACVTPVLTFEEVVHHDHNKERGSFITSEEQDVSPRPAPLLLNTPAIPSFKRDPFIGEHTEEILEEFGFSREEIYQLNSDKIIESNKAGSKFWILYPTHSNIQK

SEQ ID NO: 881036 - protein, 328 aa, Homo sapiens
MVSIPEYYEGKNVLLTGATGFLGKVLLEKLLRSCPKVNSVYVLVRQKAGQTPQERVEEVLSGKLFDRLRDENPDFREKIIAINSELTQPKLALSEEDKEVIIDSTNIIFHCAATVRFNENLRDAVQLNVIATRQLILLAQQMKNLEVFMHVSTAYAYCNRKHIDEVVYPPPVDPKKLIDSLEWMDDGLVNDITPKLIGDRPNTYIYTKALAEYVVQQEGAKLNVAIVRPSIVGASWKEPFPGWIDNFNGPSGLFIAAGKGILRTIRASNNALADLVPVDVVVNMSLAAAWYSGVNRPRNIMVYNCTTGSTNPFHWGEVGMILPVFLNV

SEQ ID NO: 881037 - protein, 515 aa, Homo sapiens
MVSIPEYYEGKNVLLTGATGFLGKVLLEKLLRSCPKVNSVYVLVRQKAGQTPQERVEEVLSGKLFDRLRDENPDFREKIIAINSELTQPKLALSEEDKEVIIDSTNIIFHCAATVRFNENLRDAVQLNVIATRQLILLAQQMKNLEVFMHVSTAYAYCNRKHIDEVVYPPPVDPKKLIDSLEWMDDGLVNDITPKLIGDRPNTYIYTKALAEYVVQQEGAKLNVAIVRPSIVGASWKEPFPGWIDNFNGPSGLFIAAGKGILRTIRASNNALADLVPVDVVVNMSLAAAWYSGVNRPRNIMVYNCTTGSTNPFHWGEVEYHVISTFKRNPLEQAFRRPNVNLTSNHLLYHYWIAVSHKAPAFLYDIYLRMTGRSPRMMKTITRLHKAMVFLEYFTSNSWVWNTENVNMLMNQLNPEDKKTFNIDVRQLHWAEYIENYCLGTKKYVLNEEMSGLPAARKHLNKLRNIRYGFNTILVILIWRIFIARSQMARNIWYFVVSLCYKFLSYFRASSTMRY

SEQ ID NO: 881038 - protein, 515 aa, Homo sapiens; identical to SEQ ID NO: 881037

SEQ ID NO: 881039 - protein, 80 aa, Homo sapiens
MFPLVKSALNRLQVRSIQQTMARQSHQKRTPDFHDKYGNAVLASGATFCIVTWTYVATQVGIEWNLSPVGRVTPKEWRNQ

SEQ ID NO: 881040 - protein, 80 aa, Homo sapiens; identical to SEQ ID NO: 881039

SEQ ID NO: 881041 - protein, 85 aa, Homo sapiens
RRLQRNFSSGKSALNRLQVRSIQQTMARQSHQKRTPDFHDKYGNAVLASGATFCIVTWTYVATQVGIEWNLSPVGRVTPKEWRNQ

SEQ ID NO: 881042 - protein, 80 aa, Homo sapiens; identical to SEQ ID NO: 881039

SEQ ID NO: 881043 - protein, 80 aa, Homo sapiens; identical to SEQ ID NO: 881039

SEQ ID NO: 881044 - protein, 80 aa, Homo sapiens; identical to SEQ ID NO: 881039

SEQ ID NO: 881045 - protein, 116 aa, Homo sapiens
MLKKKKKKKTSCRIRHESELAPKQQLYCRSSSFTFTMFPLVKSALNRLQVRSIQQTMARQSHQKRTPDFHDKYGNAVLASGATFCIVTWTYVATQVGIEWNLSPVGRVTPKEWRNQ

SEQ ID NO: 881046 - protein, 159 aa, Homo sapiens
MKTNRKRNTITGGTHPTGGKRHHKGELYNPPRTNQIKATAGHKRGQHSRAYRRPTQVAQQRKSEEPSTGATTRHQSYDKTHARRRNRTAEHQQTNAGQRRQQQENNERQTTPKQTDPQAQTGRRTRQPHRHQSDQSTRRQEKEEKDANTRQRHTHKTDW

SEQ ID NO: 881047 - protein, 80 aa, Homo sapiens; identical to SEQ ID NO: 881039

SEQ ID NO: 881048 - protein, 80 aa, Homo sapiens; identical to SEQ ID NO: 881039

SEQ ID NO: 881049 - protein, 80 aa, Homo sapiens; identical to SEQ ID NO: 881039

SEQ ID NO: 881050 - protein, 156 aa, Homo sapiens
MASRVLSAYVSRLPAAFAPLPRVRMLAVARPLSTALCSAGTQTRLGTLQPALVLAQVPGRVTQLCRQYSDMPPLTLEGIQDRVLYVLKLYDKIDPEKLSVNSHFMKDLGLDSLDQVEIIMAMEDEFGFEIPDIDAEKLMCPQEIVDYIADKKDVYE

SEQ ID NO: 881051 - protein, 180 aa, Homo sapiens
CAPPERNPGPECGGLCILAWVGVAMASRVLSAYVSRLPAAFAPLPRVRMLAVARPLSTALCSAGTQTRLGTLQPALVLAQVPGRVTQLCRQYSDMPPLTLEGIQDRVLYVLKLYDKIDPEKLSVNSHFMKDLGLDSLDQVEIIMAMEDEFGFEIPDIDAEKLMCPQEIVDYIADKKDVYE

SEQ ID NO: 881052 - protein, 180 aa, Homo sapiens; identical to SEQ ID NO: 881051

SEQ ID NO: 881053 - protein, 156 aa, Homo sapiens; identical to SEQ ID NO: 881050

SEQ ID NO: 881054 - protein, 156 aa, Homo sapiens; identical to SEQ ID NO: 881050

SEQ ID NO: 881055 - protein, 180 aa, Homo sapiens; identical to SEQ ID NO: 881051

SEQ ID NO: 881056 - protein, 82 aa, Homo sapiens
RAAGKEPWSGVRRAVHPGLGWRSHGVSCPFSLCQPPARGLCAAAPGPDAGRGPASQHRSLLRGDPDEARDFAAGLSARAGSW

SEQ ID NO: 881057 - protein, 103 aa, Homo sapiens [sequence omitted]

SEQ ID NO: 881058 - protein, 180 aa, Homo sapiens; identical to SEQ ID NO: 881051

SEQ ID NO: 881059 - protein, 156 aa, Homo sapiens; identical to SEQ ID NO: 881050

SEQ ID NO: 881060 - protein, 156 aa, Homo sapiens; identical to SEQ ID NO: 881050

SEQ ID NO: 881061 - protein, 180 aa, Homo sapiens; identical to SEQ ID NO: 881051

SEQ ID NO: 881062 - protein, 115 aa, Homo sapiens [sequence omitted]

SEQ ID NO: 881063 - protein, 115 aa, Homo sapiens [sequence omitted]

SEQ ID NO: 881064 - protein, 67 aa, Homo sapiens
AGQAHARSWSRRGGAGGRGCALSYSSPRERGEPVAAAASVAAVGGRYGFSMGRVGSGLLPHVHVSLF

SEQ ID NO: 881065 - protein, 112 aa, Homo sapiens
MDSPWDELALAFSRTSMFPFFDIAHYLVSVMAVKRQPGAAALAWKNPISSWFTAMLHCFGGGILSCRRRRRRSLNLDNALLSLFKDTFNSPIFNHKEYIVLICLALSIGDPL

SEQ ID NO: 881066 - protein, 291 aa, Homo sapiens
MDSPWDELALAFSRTSMFPFFDIAHYLVSVMAVKRQPGAAALAWKNPISSWFTAMLHCFGGGILSCLLLAEPPLKFLANHTNILLASSIWYITFFCPHDLVSQGYSYLPVQLLASGMKEVTRTWKIVGGVTHANSYYKNGWIVMIAIGWARGAGGTIITNFERLVKGDWKPEGDEWLKMSYPAKVTLLGSVIFTFQHTQHLAISKHNLMFLYTIFIVATKITMMTTQTSTMTFAPFEDTLSWMLFGWQQPFSSCEKKSEAKSPSNGVGSLASKPVDVASDNVKKKHTKKNE

SEQ ID NO: 881067 - protein, 338 aa, Homo sapiens
MDSPWDELALAFSRTSMFPFFDIAHYLVSVMAVKRQPGAAALAWKNPISSWFTAMLHCFGGGILSCLLLAEPPLKFLANHTNILLASSIWTRAWSRVPPATKVSAQKSDIPKIPKYKSDTSCLSSIWKPAIQFILERYITFFCPHDLVSQGYSYLPVQLLASGMKEVTRTWKIVGGVTHANSYYKNGWIVMIAIGWARGAGGTIITNFERLVKGDWKPEGDEWLKMSYPAKVTLLGSVIFTFQHTQHLAISKHNLMFLYTIFIVATKITMMTTQTSTMTFAPFEDTLSWMLFGWQQPFSSCEKKSEAKSPSNGVGSLASKPVDVASDNVKKKHTKKNE

SEQ ID NO: 881068 - protein, 237 aa, Homo sapiens
MLHCFGGGILSCLLLAEPPLKFLANHTNILLASSIWYITFFCPHDLVSQGYSYLPVQLLASGMKEVTRTWKIVGGVTHANSYYKNGWIVMIAIGWARGAGGTIITNFERLVKGDWKPEGDEWLKMSYPAKVTLLGSVIFTFQHTQHLAISKHNLMFLYTIFIVATKITMMTTQTSTMTFAPFEDTLSWMLFGWQQPFSSCEKKSEAKSPSNGVGSLASKPVDVASDNVKKKHTKKNE

SEQ ID NO: 881069 - protein, 127 aa, Homo sapiens
DSCSLRCASGWRSHLASPAKVTLLGSVIFTFQHTQHLAISKHNLMFLYTIFIVATKITMMTTQTSTMTFAPFEDTLSWMLFGWQQPFSSCEKKSEAKSPSNGVGSLASKPVDVASDNVKKKHTKKNE

SEQ ID NO: 881070 - protein, 222 aa, Homo sapiens
MDSPWDELALAFSRTSMFPFFDIAHYLVSVMAVKRQPGAAALAWKNPISSWFTAMLHCFGGGILSCLLLAEPPLKFLANHTNILLASSIWYITFFCPHDLVSQGYSYLPVQLLASGMKEVTRTWKIVGGVTHANSYYKNGWIVMIAIGWARGAGGTIITNFERLVKGDWKPEGDEWLKMSYPAKVTLLGSVIFTFQHTQHLAISKHNLMFLYTIFIVATKSL

SEQ ID NO: 881071 - protein, 67 aa, Homo sapiens; identical to SEQ ID NO: 881064

SEQ ID NO: 881072 - protein, 130 aa, Homo sapiens
EQLDTREFCNKRQRNLTGHSPAKVTLLGSVIFTFQHTQHLAISKHNLMFLYTIFIVATKITMMTTQTSTMTFAPFEDTLSWMLFGWQQPFSSCEKKSEAKSPSNGVGSLASKPVDVASDNVKKKHTKKNE

SEQ ID NO: 881073 - protein, 291 aa, Homo sapiens; identical to SEQ ID NO: 881066

SEQ ID NO: 881074 - protein, 180 aa, Homo sapiens
MDSPWDELALAFSRTSMFPFFDIAHYLVSVMAVKRQPGAAALAWKNPISSWFTAMLHCFGGGILSCLLLAEPPLKFLANHTNILLASSIWYITFFCPHDLVSQGYSYLPVQLLASGMKEVTRTWKIVGGVTHANSYYKNGWIVMIAIGWARGAGGTIITNFERLVKGDWKPEGDEWLKMS

SEQ ID NO: 881075 - protein, 260 aa, Homo sapiens
SDTLLYSRKLTEHCKPTIMEKIIEKYVICRYSGILFSHKKNEVMPLANHTNILLASSIWYITFFCPHDLVSQGYSYLPVQLLASGMKEVTRTWKIVGGVTHANSYYKNGWIVMIAIGWARGAGGTIITNFERLVKGDWKPEGDEWLKMSYPAKVTLLGSVIFTFQHTQHLAISKHNLMFLYTIFIVATKITMMTTQTSTMTFAPFEDTLSWMLFGWQQPFSSCEKKSEAKSPSNGVGSLASKPVDVASDNVKKKHTKKNE

SEQ ID NO: 881076 - protein, 291 aa, Homo sapiens; identical to SEQ ID NO: 881066

SEQ ID NO: 881077 - protein, 222 aa, Homo sapiens; identical to SEQ ID NO: 881070

SEQ ID NO: 881078 - protein, 533 aa, Homo sapiens
GAAQRHPWERPPGGVGAGEGGAMGQGDESERIVINVGGTRHQTYRSTLRTLPGTRLAWLAEPDAHSHFDYDPRADEFFFDRHPGVFAHILNYYRTGKLHCPADVCGPLYEEELAFWGIDETDVEPCCWMTYRQHRDAEEALDSFGGAPLDNSADDADADGPGDSGDGEDELEMTKRLALSDSPDGRPGGFWRRWQPRIWALFEDPYSSRYARYVAFASLFFILVSITTFCLETHERFNPIVNKTEIENVRNGTQVRYYREAETEAFLTYIEGVCVVWFTFEFLMRVIFCPNKVEFIKNSLNIIDFVAILPFYLEVGLSGLSSKAAKDVLGFLRVVRFVRILRIFKLTRHFVGLRVLGHTLRASTNEFLLLIIFLALGVLIFATMIYYAERIGAQPNDPSASEHTHFKNIPIGFWWAVVTMTTLGYGDMYPQTWSGMLVGALCALAGVLTIAMPVPVIVNNFGMYYSLAMAKQKLPKKKKKHIPRPPQLGSPNYCKSVVNSPHHSTQSDTCPLAQEEILEINRAGRKPLRGMSI

SEQ ID NO: 881079 - protein, 607 aa, Homo sapiens
GAAQRHPWERPPGGVGAGEGGAMGQGDESERIVINVGGTRHQTYRSTLRTLPGTRLAWLAEPDAHSHFDYDPRADEFFFDRHPGVFAHILNYYRTGKLHCPADVCGPLYEEELAFWGIDETDVEPCCWMTYRQHRDAEEALDSFGGAPLDNSADDADADGPGDSGDGEDELEMTKRLALSDSPDGRPGGFWRRWQPRIWALFEDPYSSRYARYVAFASLFFILVSITTFCLETHERFNPIVNKTEIENVRNGTQVRYYREAETEAFLTYIEGVCVVWFTFEFLMRVIFCPNKVEFIKNSLNIIDFVAILPFYLEVGLSGLSSKAAKDVLGFLRVVRFVRILRIFKLTRHFVGLRVLGHTLRASTNEFLLLIIFLALGVLIFATMIYYAERIGAQPNDPSASEHTHFKNIPIGFWWAVVTMTTLGYGDMYPQTWSGMLVGALCALAGVLTIAMPVPVIVNNFGMYYSLAMAKQKLPKKKKKHIPRPPQLGSPNYCKSVVNSPHHSTQSDTCPLAQEEILEINRADSKLNGEVAKAALANEDCPHIDQALTPDEGLPFTRSGTRERYGPCFLLSTGEYACPPGGGMRKDLCKESPVIAKYMPTEAVRVT

SEQ ID NO: 881080 - protein, 168 aa, Homo sapiens
MGQGDESERIVINVGGTRHQTYRSTLRTLPGTRLAWLAEPDAHSHFDYDPRADEFFFDRHPGVFAHILNYYRTGKLHCPADVCGPLYEEELAFWGIDETDVEPCCWMTYRQHRDAEEALDSFGGAPLDNSADDADADGPGDSGDGEDELEMTKRLALSDSPDGRPGGF

SEQ ID NO: 881081 - protein, 107 aa, Homo sapiens
LPCFYSSFRAQFKCHLSLIFIFPHLSDRCFFYELPEKPLLILTLQPLYLINKLTKQANIEYLLGTQVLGSAMWKRIMRHDYQFQLCKRTQCIREFKHSLRSSFLNCV

SEQ ID NO: 881082 - protein, 504 aa, Homo sapiens
MMTTSLIWGIAIAACCCLWLILGIRRRQTGEPPLENGLIPYLGCALQFGANPLEFLRANQRKHGHVFTCKLMGKYVHFITNPLSYHKVLCHGKYFDWKKFHFATSAKAFGHRSIDPMDGNTTENINDTFIKTLQGHALNSLTESMMENLQRIMRPPVSSNSKTAAWVTEGMYSFCYRVMFEAGYLTIFGRDLTRRDTQKAHILNNLDNFKQFDKVFPALVAGLPIHMFRTAHNAREKLAESLRHENLQKRESISELISLRMFLNDTLSTFDDLEKAKTHLVVLWASQANTIPATFWSLFQMIRNPEAMKAATEEVKRTLENAGQKVSLEGNPICLSQAELNDLPVLDSIIKESLRLSSASLNIRTAKEDFTLHLEDGSYNIRKDDIIALYPQLMHLDPEIYPDPLTFKYDRYLDENGKTKTTFYCNGLKLKYYYMPFGSGATICPGRLFAIHEIKQFLILMLSYFELELIEGQAKCPPLDQSRAGLGILPPLNDIEFKYKFKHL

SEQ ID NO: 881083 - protein, 260 aa, Homo sapiens
MFRTAHNAREKLAESLRHENLQKRESISELISLRMFLNDTLSTFDDLEKAKTHLVVLWASQANTIPATFWSLFQMIRNPEAMKAATEEVKRTLENAGQKVSLEGNPICLSQAELNDLPVLDSIIKESLRLSSASLNIRTAKEDFTLHLEDGSYNIRKDDIIALYPQLMHLDPEIYPDPLTFKYDRYLDEYMPFGSGATICPGRLFAIHEIKQFLILMLSYFELELIEGQAKCPPLDQSRAGLGILPPLNDIEFKYKFKHL

SEQ ID NO: 881084 - protein, 334 aa, Homo sapiens
MRPPVSSNSKTAAWVTEGMYSFCYRVMFEAGYLTIFGRDLTRRDTQKAHILNNLDNFKQFDKVFPALVAGLPIHMFRTAHNAREKLAESLRHENLQKRESISELISLRMFLNDTLSTFDDLEKAKTHLVVLWASQANTIPATFWSLFQMIRNPEAMKAATEEVKRTLENAGQKVSLEGNPICLSQAELNDLPVLDSIIKESLRLSSASLNIRTAKEDFTLHLEDGSYNIRKDDIIALYPQLMHLDPEIYPDPLTFKYDRYLDEYMPFGSGATICPGRLFAIHEIKQFLILMLSYFELELIEGQAKCPPLDQSRAGLGILPPLNDIEFKYKFKHL

SEQ ID NO: 881085 - protein, 261 aa, Homo sapiens
MVVVAAAPNPADGTPKVLLLSGQPASAAGAPAGQALPLMVPAQRGASPEAASGGLPQARKRQRLTHLSPEEKALRRKLKNRVAAQTARDRKKARMSELEQQVVDLEEENQKLLLENQLLREKTHGLVVENQELRQRLGMDALVAEEEAEAKGNEVRPVAGSAESAALRLRAPLQQVQAQLSPLQNISPWILAVLTLQIQSLISCWAFWTTWTQSCSSNALPQSLPAWRSSQRSTQKDPVPYQPPFLCQWGRHQPSWKPLMN

SEQ ID NO: 881086 - protein, 261 aa, Homo sapiens; identical to SEQ ID NO: 881085

SEQ ID NO: 881087 - protein, 117 aa, Homo sapiens
MVVVAAAPNPADGTPKVLLLSGQPASAAGAPAGQALPLMVPAQRGASPEAASGGLPQARKRQRLTHLSPEEKALRRKLKNRVAAQTARDRKKARMSELEQQVVDLEEENPFASQLLR

SEQ ID NO: 881088 - protein, 111 aa, Homo sapiens
MYPRFVLVYHMVASPCNTRNSRILLECQERAVCPLRVLSQERSRGGAGDTQRERIRSEEGENSSDGSERERHLSICFHSGERGEIPNNDVGHKETWPHLWEEEIFPKEGTR

SEQ ID NO: 881089 - protein, 275 aa, Homo sapiens
MQHTENHMQDEPSVNGRGAAAPNPADGTPKVLLLSGQPASAAGAPAGQALPLMVPAQRGASPEAASGGLPQARKRQRLTHLSPEEKALRRKLKNRVAAQTARDRKKARMSELEQQVVDLEEENQKLLLENQLLREKTHGLVVENQELRQRLGMDALVAEEEAEAKGNEVRPVAGSAESAALRLRAPLQQVQAQLSPLQNISPWILAVLTLQIQSLISCWAFWTTWTQSCSSNALPQSLPAWRSSQRSTQKDPVPYQPPFLCQWGRHQPSWKPLMN

SEQ ID NO: 881090 - protein, 206 aa, Homo sapiens
MVVVARQRLTHLSPEEKALRRKLKNRVAAQTARDRKKARMSELEQQVVDLEEENQKLLLENQLLREKTHGLVVENQELRQRLGMDALVAEEEAEAKGNEVRPVAGSAESAALRLRAPLQQVQAQLSPLQNISPWILAVLTLQIQSLISCWAFWTTWTQSCSSNALPQSLPAWRSSQRSTQKDPVPYQPPFLCQWGRHQPSWKPLMN

SEQ ID NO: 881091 - protein, 197 aa, Homo sapiens [sequence omitted]

SEQ ID NO: 881092 - protein, 197 aa, Homo sapiens [sequence omitted]

SEQ ID NO: 881093 - protein, 197 aa, Homo sapiens [sequence omitted]

SEQ ID NO: 881094 - protein, 243 aa, Homo sapiens
MVVVAAAPNPADGTPKVLLLSGQPASAAGAPAGQALPLMVPAQRGASPEAASGGLPQARKRQRLTHLSPEEKALRRKLKNRVAAQTARDRKKARMSELEQQVVDLEEENQKLLLENQLLREDALVAEEEAEAKGNEVRPVAGSAESAALRLRAPLQQVQAQLSPLQNISPWILAVLTLQIQSLISCWAFWTTWTQSCSSNALPQSLPAWRSSQRSTQKDPVPYQPPFLCQWGRHQPSWKPLMN

SEQ ID NO: 881095 - protein, 261 aa, Homo sapiens; identical to SEQ ID NO: 881085

SEQ ID NO: 881096 - protein, 167 aa, Homo sapiens
MVVVAAAPNPADGTPKVLLLSGQPASAAGAPAGQALPLMVPAQRGASPEAASGGLPQARKRQRLTHLSPEEKALRRKLKNRVAAQTARDRKKARMSELEQQVVDLEEENQKLLLENQLLREKTHGLVVENQELRQRLGMDALVAEEEAEAKVNHLLYLVPHVSTGSK

SEQ ID NO: 881097 - protein, 197 aa, Homo sapiens [sequence omitted]

SEQ ID NO: 881098 - protein, 197 aa, Homo sapiens [sequence omitted]

SEQ ID NO: 881099 - protein, 252 aa, Homo sapiens
MVVVAAAPNPADGTPKVLLLSGQPASAAGAPAGQALPLMVPAQRGASPEAASGGLPQARKRQRLTHLSPEEKALRRKLKNRVAAQTARDRKKARMSELEQQVVDLEEENQKLLLENQLLREKTHGLVVENQELRQRLGMDALVAEEEAEAKGNEVRPVAGSAESAAVQAQLSPLQNISPWILAVLTLQIQSLISCWAFWTTWTQSCSSNALPQSLPAWRSSQRSTQKDPVPYQPPFLCQWGRHQPSWKPLMN

SEQ ID NO: 881100 - protein, 200 aa, Homo sapiens
MVVVAAAPNPADGTPKVLLLSGQPASAAGAPAGQALPLMVPAQRGASPEAASGGLPQARKRQRLTHLSPEEKALRRKLKNRVAAQTARDRKKARMSELEQQVVDLEEENQKLLLENQLLREKTHGLVVENQELRQRLGMDALVAEEEAEAKGNEVRPVAGSAESAALRLRAPLQQVQAQLSPLQNISPWILAVLTLQIQR

SEQ ID NO: 881101 - protein, 167 aa, Homo sapiens; identical to SEQ ID NO: 881096

SEQ ID NO: 881102 - protein, 261 aa, Homo sapiens; identical to SEQ ID NO: 881085

SEQ ID NO: 881103 - protein, 261 aa, Homo sapiens; identical to SEQ ID NO: 881085

SEQ ID NO: 881104 - protein, 261 aa, Homo sapiens; identical to SEQ ID NO: 881085

SEQ ID NO: 881105 - protein, 261 aa, Homo sapiens; identical to SEQ ID NO: 881085

SEQ ID NO: 881106 - protein, 261 aa, Homo sapiens; identical to SEQ ID NO: 881085

SEQ ID NO: 881107 - protein, 261 aa, Homo sapiens; identical to SEQ ID NO: 881085

SEQ ID NO: 881108 - protein, 291 aa, Homo sapiens
MVVVAAAPNPADGTPKVLLLSGQPASAAGAPAGQALPLMVPAQRGASPEAASGGLPQARKRQRLTHLSPEEKALRRKLKNRVAAQTARDRKKARMSELEQQVVDLEEENQKLLLENQLLREKTHGLVVENQELRQRLGMDALVAEEEAEAKGNEVRPVAGSAESAALRLRAPLQQVQAQLSPLQNISPWILAVLTLQIQSLISCWAFWTTWTQSCSSNALPQSLPAWRSSQRSTQKGGGGKNAPPKGVAYQPSLSLSGEPGPISQAGKGAPKFQLNLIRYRNQSQIIKPKA

SEQ ID NO: 881109 - protein, 167 aa, Homo sapiens; identical to SEQ ID NO: 881096

SEQ ID NO: 881110 - protein, 418 aa, Homo sapiens [sequence omitted]

SEQ ID NO: 881111 - protein, 175 aa, Homo sapiens
MAIYLKQVTATVLINGTNFPFGIPQVYHGQIHQPLPHSAQLISTNALGLLELYRTFETTQVGASQYLFPIEEAQGQFLFIVGEGDKTINSKAHAEQAIGQLKRHGKNNWTLLSYPGAGHLIEPPYSPLCCASTTHDLRLHWGGEVIPHAAAQEHAWKEIQRFLRKHLIPDVTSQL

SEQ ID NO: 881112 - protein, 400 aa, Homo sapiens
MIQLTATPVSALVDEPVHIQATGLIPFQMVSFQASLEDEVDLNHASSLGGDYMGVHPMGLFWSLKPEKLLTRLLKRDVMNRPFQVQVKLYDLELIVNNKVASAPKASLTLERWYVAPGVTRIKVREGRLRGALFLPPGEGLFPGVIDLFGGLGGLLEFRASLLASRGFASLALAYHNYEDLPRKPEVTDLEYFEEAANFLLRHPKVFGSGVGVVSVCQGVQIGLSMAIYLKQVTATVLINGTNFPFGIPQVYHGQIHQPLPHSAQLISTNALGLLELYRTFETTQVGASQYLFPIEEAQGQFLFIVGEGDKTINSKAHAEQAIGQLKRHGKNNWTLLSYPGAGHLIEPPYSPLCCASTTHDLRLHWGGEVIPHAAAQEHAWKEIQRFLRKHLIPDVTSQL

SEQ ID NO: 881113 - protein, 175 aa, Homo sapiens; identical to SEQ ID NO: 881111

SEQ ID NO: 881114 - protein, 85 aa, Homo sapiens [sequence omitted]

SEQ ID NO: 881115 - protein, 118 aa, Homo sapiens
DYRVPDTVLGIEDTFKLNVSDVISRDGIHWLALYFGTIVIVPNGSQMSKTLRNNSESLAGKPHLNAAHTFMIHYKGFKVMRCLCPKKKKSTPACPASLTTSHFFPPGTIYCQEENQTP

SEQ ID NO: 881116 - protein, 125 aa, Homo sapiens
SELVSGFNIEYAALRPILHSQKYTNIIIIEPRRKLSRKLQLNLSQLRDPQHDLDRVKKPEWVILIGVCTHLGCVPIANAGDFGGYYCPCHGSHYDASGRIRLGPAPLNLEVPTYEFTSDDMVIVG

SEQ ID NO: 881117 - protein, 239 aa, Homo sapiens
CRISFPAARCRHASRASSRLRRGWKVVPVTGLAVGAAVAMLSVAARSGPFAPVLSATSRGVAGALRPLVQATVPATPEQPVLDLKRPFLSRESLSGQAVRRPLVASVGLNVPASVCYSHTDIKVPDFSEYRRLEVLDSTKSSRESSEARKGFSYLVTGVTTVGVAYAAKNAVTQFVSSMSASADVLALAKIEIKLSDIPEGKNMAFKWRGKPLFVRHRTQKEIEQEAAVEFITVEGPTA

SEQ ID NO: 881118 - protein, 220 aa, Homo sapiens
CRISFPAARCRHASRASSRLRRGWKVVPVTGLAVGAAVAMLSVAARSGPFAPVLSATPEQPVLDLKRPFLSRESLSGQAVRRPLVASVGLNVPASVCYSHTDIKVPDFSEYRRLEVLDSTKSSRESSEARKGFSYLVTGVTTVGVAYAAKNAVTQFVSSMSASADVLALAKIEIKLSDIPEGKNMAFKWRGKPLFVRHRTQKEIEQEAAVEFITVEGPTA

SEQ ID NO: 881119 - protein, 173 aa, Homo sapiens
MLSPNTSITAFSSFQNSLFLVPFFDDYKTLASTLEDNCYRCLYVNGAVSSNWHAEEELIHGVYVLGDKLSPNTDIKVPDFSEYRRLEVLDSTKSSRESSEARKGFSYLVTGVTTVGVAYAAKNAVTQFVSSMSASADVLGSVGGGFIPNTNTFEDLKSFKIVVFILQFTVLGD

SEQ ID NO: 881120 - protein, 239 aa, Homo sapiens; identical to SEQ ID NO: 881117

SEQ ID NO: 881121 - protein, 239 aa, Homo sapiens; identical to SEQ ID NO: 881117

SEQ ID NO: 881122 - protein, 239 aa, Homo sapiens; identical to SEQ ID NO: 881117

SEQ ID NO: 881123 - protein, 220 aa, Homo sapiens; identical to SEQ ID NO: 881118

SEQ ID NO: 881124 - protein, 185 aa, Homo sapiens
AKEVARLGNRPRAVRARSCSATPEQPVLDLKRPFLSRESLSGQAVRRPLVASVGLNVPASVCYSHTDIKVPDFSEYRRLEVLDSTKSSRESSEARKGFSYLVTGVTTVGVAYAAKNAVTQFVSSMSASADVLALAKIEIKLSDIPEGKNMAFKWRGKPLFVRHRTQKEIEQEAAVEFITVEGPTA

SEQ ID NO: 881125 - protein, 183 aa, Homo sapiens
TRLGRRLGVDRPRVAPSVATPEQPVLDLKRPFLSRESLSGQAVRRPLVASVGLNVPASVCYSHTDIKVPDFSEYRRLEVLDSTKSSRESSEARKGFSYLVTGVTTVGVAYAAKNAVTQFVSSMSASADVLALAKIEIKLSDIPEGKNMAFKWRGKPLFVRHRTQKEIEQEAAVEFITVEGPTA

SEQ ID NO: 881126 - protein, 130 aa, Homo sapiens
MCWPWRKSKSSYPIFQKARTWLSNGEANPCLCVIEPRRKLSRKLQLNLSQLRDPQHDLDRVKKPEWVILIGVCTHLGCVPIANAGDFGGYYCPCHGSHYDASGRIRLGPAPLNLEVPTYEFTSDDMVIVG

SEQ ID NO: 881127 - protein, 239 aa, Homo sapiens; identical to SEQ ID NO: 881117

SEQ ID NO: 881128 - protein, 130 aa, Homo sapiens; identical to SEQ ID NO: 881126

SEQ ID NO: 881129 - protein, 196 aa, Homo sapiens
CRISFPAARCRHASRASSRLRRGWKVVPVTGLAVGAAVAMLSVAARSGPFAPVLSATSRGVAGALRPLVQATVPATPEQPVLDLKRPFLSRESLSGQAVRRPLVASVGLNVPASVCYSHTDIKVPDFSEYRRLEVLDSTKSSRESSEARKGFSYLVTGVTTVGVAYAAKNAVTQFVSSMSASADVLVERQTPVCAS

SEQ ID NO: 881130 - protein, 125 aa, Homo sapiens; identical to SEQ ID NO: 881116

SEQ ID NO: 881131 - protein, 187 aa, Homo sapiens
CRISFPAARCRHASRASSRLRRGWKVVPVTGLAVGAAVAMLSVAARSGPFAPVLSATSRGVAGALRPLVQATVPATPEQPVLDLKRPFLSRESLSGQAVRRPLVASVGLNVPASVCYSHTDIKVPDFSEYRRLEVLDSTKSSRESSEARKGFSYLVTGVTTVGVAYAAKNAVTQFVSSMSASADVLG

SEQ ID NO: 881132 - protein, 193 aa, Homo sapiens
CRISFPAARCRHASRASSRLRRGWKVVPVTGLAVGAAVAMLSVAARSGPFAPVLSATSRGVAGALRPLVQATVPATPEQPVLDLKRPFLSRESLSGQAVRRPLVASVGLNVPASVCYSHTDIKVPDFSEYRRLEVLDSTKSSRESSEARKGFSYLVTGVTTVGVAYAAKNAVTQFVSSMSASADVLGSVGENQ

SEQ ID NO: 881133 - protein, 1068 aa, Homo sapiens
YLEGRCLNCSSGSKRGRWAARTFSNKTLVLDETTTSTGSAGMWLVLRRGVLRDGEGYTFTLTVLGRSGEEEGCASIPLSPNRPPLGGSCRLFPLGAVHALTTKVHFECTGWHDAEDAGAPLVYALLLQRCRQGHCEEFCVYKGSLSGYGAVLPPGFRPHFEVGLAVVVQDQLGAAVVALNRSLAITLPEPNGSAMGLTVWLHGLTASVLPGLLRQADPQHVIEYSLALVTVLNEPPPRRAHVLTLFCPRRNSSVLRVNAHITQHLARNCTPGVVGILLASCRSPALLTACCAACLPQYERALDVAAEPKHERQRRAQIRKNITETLVSLRVHTVDDIQQIAAALAQCMGPSRELVCRSCLKQTLHKLEAMMRILQAETTAGTVTPTAIGDSILNITGDLIHLASSDVRAPQRSELGAESPSRMVASQAYNLTSALMRILTRSRVLNEEPLTLAGEEIVAQGKRSDPRSLLCYGGAPGPGCHFSIPKAFSRAPANLSDVVQLIFLVDSNPFPFGYISNYTVSTKVASMAFQTQAGAQIPIERLASERAITVKVPNNSDWAARGHRSSANSVVVQPQASVGAVVTLDSSNPAAVLHLQLNYTLLDGRYLSEEPEPYLAVYLHSEPRPNEHNCSASRRIRPESLQGADHRPYTFFISPGTRDPVGSYRLNLSSHFRLSALEVSVGLYTSLCQYFSEEDVVWRTEGLLPLEETSPRQAVCLTRHLTAFGASLFVPPSHVRFVFPEPTADVNYIVMLTCAVCLVTYMVMAAILHKLDQLDASRGRAIPFCGQRGRFKYEILVKTGWGRGSGTTAHVGIMLYGVDSRSGHRHLDGDRAFHRNSLDIFRIATPHSLGSVWKIRVWHDKGLSPAWFLQHVIIRDLQTAHSTFFLVNDWLSVETEANGGLVEKEVLAASHAALLRFRRLLVAELQCGFFDKHIWLSIWDRPPRSCFTRIQRATCCVLLICLFLGANAVWYGAVGDSAYSTGHVSRLSPLSVDTVAVGLVSSVVVYPVYLAILFLFWMSRSKVGWGWGPGSTGNGAWASAPCPEPPLSSAAARGKGVHQRLLGKGQHT

SEQ ID NO: 881134 - protein, 1068 aa, Homo sapiens; identical to SEQ ID NO: 881133

SEQ ID NO: 881135 - protein, 1052 aa, Homo sapiens
YLEGRCLNCSSGSKRGRWAARTFSNKTLVLDETTTSTGSAGMWLVLRRGVLRDGEGYTFTLTVLGRSGEEEGCASIPLSPNRPPLGGSCRLFPLGAVHALTTKVHFECTGWHDAEDAGAPLVYALLLQRCRQGHCEEFCVYKGSLSGYGAVLPPGFRPHFEVGLAVVVQDQLGAAVVALNRSLAITLPEPNGSAMGLTVWLHGLTASVLPGLLRQADPQHVIEYSLALVTVLNEPPPRRAHVLTLFCPRRNSSVLRVNAHITQHLARNCTPGVVGILLASCRSPALLTACCAACLPQYERALDVAAEPKHERQRRAQIRKNITETLVSLRVHTVDDIQQIAAALAQCMGPSRELVCRSCLKQTLHKLEAMMRILQAETTAGTVTPTAIGDSILNITGDLIHLASSDVRAPQRSELGAESPSRMVASQAYNLTSALMRILTRSRVLNEEPLTLAGEEIVAQGKRSDPRSLLCYGGAPGPGCHFSIPKAFSRAPANLSDVVQLIFLVDSNPFPFGYISNYTVSTKVASMAFQTQAGAQIPIERLASERAITVKVPNNSDWAARGHRSSANSVVVQPQASVGAVVTLDSSNPAAVLHLQLNYTLLDGRYLSEEPEPYLAVYLHSEPRPNEHNCSASRRIRPESLQGADHRPYTFFISPGTRDPVGSYRLNLSSHFRLSALEVSVGLYTSLCQYFSEEDVVWRTEGLLPLEETSPRQAVCLTRHLTAFGASLFVPPSHVRFVFPEPTADVNYIVMLTCAVCLVTYMVMAAILHKLDQLDASRGRAIPFCGQRGRFKYEILVKTGWGRGSGTTAHVGIMLYGVDSRSGHRHLDGDRAFHRNSLDIFRIATPHSLGSVWKIRVWHDKGLSPAWFLQHVIIRDLQTAHSTFFLVNDWLSVETEANGGLVEKEVLAASHAALLRFRRLLVAELQCGFFDKHIWLSIWDRPPRSCFTRIQRATCCVLLICLFLGANAVWYGAVGDSAYSTGHVSRLSPLSVDTVAVGLVSSVVVYPVYLAILFLFWMSRSKLHQSAVKCSVAHVARGCHHGRCRCPIYPAF

SEQ ID NO: 881136 - protein, 1062 aa, Homo sapiens
YLEGRCLNCSSGSKRGRWAARTFSNKTLVLDETTTSTGSAGMWLVLRRGVLRDGEGYTFTLTVLGRSGEEEGCASIPLSPNRPPLGGSCRLFPLGAVHALTTKVHFECTGWHDAEDAGAPLVYALLLQRCRQGHCEEFCVYKGSLSGYGAVLPPGFRPHFEVGLAVVVQDQLGAAVVALNRSLAITLPEPNGSAMGLTVWLHGLTASVLPGLLRQADPQHVIEYSLALVTVLNEPPPRRAHVLTLFCPRRNSSVLRVNAHITQHLARNCTPGVVGILLASCRSPALLTACCAACLPQYERALDVAAEPKHERQRRAQIRKNITETLVSLRVHTVDDIQQIAAALAQCMGPSRELVCRSCLKQTLHKLEAMMRILQAETTAGTVTPTAIGDSILNITGDLIHLASSDVRAPQRSELGAESPSRMVASQAYNLTSALMRILTRSRVLNEEPLTLAGEEIVAQGKRSDPRSLLCYGGAPGPGCHFSIPKAFSRAPANLSDVVQLIFLVDSNPFPFGYISNYTVSTKVASMAFQTQAGAQIPIERLASERAITVKVPNNSDWAARGHRSSANSVVVQPQASVGAVVTLDSSNPAAVLHLQLNYTLLDGRYLSEEPEPYLAVYLHSEPRPNEHNCSASRRIRPESLQGADHRPYTFFISPGTRDPVGSYRLNLSSHFRLSALEVSVGLYTSLCQYFSEEDVVWRTEGLLPLEETSPRQAVCLTRHLTAFGASLFVPPSHEPTADVNYIVMLTCAVCLVTYMVMAAILHKLDQLDASRGRAIPFCGQRGRFKYEILVKTGWGRGSGTTAHVGIMLYGVDSRSGHRHLDGDRAFHRNSLDIFRIATPHSLGSVWKIRVWHDKGLSPAWFLQHVIIRDLQTAHSTFFLVNDWLSVETEANGGLVEKEVLAASHAALLRFRRLLVAELQCGFFDKHIWLSIWDRPPRSCFTRIQRATCCVLLICLFLGANAVWYGAVGDSAYSTGHVSRLSPLSVDTVAVGLVSSVVVYPVYLAILFLFWMSRSKVGWGWGPGSTGNGAWASAPCPEPPLSSAAARGKGVHQRLLGKGQHT

SEQ ID NO: 881137 - protein, 66 aa, Homo sapiens
RVLAGPGHRPERGECSLAGDLTSAACVLGTKTCTPAWSFAEGLSRAPEINPSDPEAAPRRSAPSSH

SEQ ID NO: 881138 - protein, 1027 aa, Homo sapiens
YLEGRCLNCSSGSKRGRWAARTFSNKTLVLDETTTSTGSAGMWLVLRRGVLRDGEGYTFTLTVLGRSGEEEGCASIPLSPNRPPLGGSCRLFPLGAVHALTTKVHFECTGWHDAEDAGAPLVYALLLQRCRQGHCEEFCVYKGSLSGYGAVLPPGFRPHFEVGLAVVVQDQLGAAVVALNRSLAITLPEPNGSAMGLTVWLHGLTASVLPGLLRQADPQHVIEYSLALVTVLNEPPPRRAHVLTLFCPRRNSSVLRVNAHITQHLARNCTPGVVGILLASCRSPALLTACCAACLPQYERALDVAAEPKHERQRRAQIRKNITETLVSLRVHTVDDIQQIAAALAQCMGPSRELVCRSCLKQTLHKLEAMMRILQAETTAGTVTPTAIGDSILNITGDLIHLASSDVRAPQRSELGAESPSRMVASQAYNLTSALMRILTRSRVLNEEPLTLAGEEIVAQGKRSDPRSLLCYGGAPGPGCHFSIPKAFSRAPANLSDVVQLIFLVDSNPFPFGYISNYTVFHRSSANSVVVQPQASVGAVVTLDSSNPAAVLHLQLNYTLLDGRYLSEEPEPYLAVYLHSEPRPNEHNCSASRRIRPESLQGADHRPYTFFISPGTRDPVGSYRLNLSSHFRLSALEVSVGLYTSLCQYFSEEDVVWRTEGLLPLEETSPRQAVCLTRHLTAFGASLFVPPSHVRFVFPEPTADVNYIVMLTCAVCLVTYMVMAAILHKLDQLDASRGRAIPFCGQRGRFKYEILVKTGWGRGSGTTAHVGIMLYGVDSRSGHRHLDGDRAFHRNSLDIFRIATPHSLGSVWKIRVWHDKGLSPAWFLQHVIIRDLQTAHSTFFLVNDWLSVETEANGGLVEKEVLAASHAALLRFRRLLVAELQCGFFDKHIWLSIWDRPPRSCFTRIQRATCCVLLICLFLGANAVWYGAVGDSAYSTGHVSRLSPLSVDTVAVGLVSSVVVYPVYLAILFLFWMSRSKVGWGWGPGSTGNGAWASAPCPEPPLSSAAARGKGVHQRLLGKGQHT

SEQ ID NO: 881139 - protein, 1160 aa, Homo sapiens
YLEGRCLNCSSGSKRGRWAARTFSNKTLVLDETTTSTGSAGMWLVLRRGVLRDGEGYTFTLTVLGRSGEEEGCASIPLSPNRPPLGGSCRLFPLGAVHALTTKVHFECTGWHDAEDAGAPLVYALLLQRCRQGHCEEFCVYKGSLSGYGAVLPPGFRPHFEVGLAVVVQDQLGAAVVALNRSLAITLPEPNGSAMGLTVWLHGLTASVLPGLLRQADPQHVIEYSLALVTVLNEPPPRRAHVLTLFCPRRNSSVLRVNAHITQHLARNCTPGVVGILLASCRSPALLTACCAACLPQYERALDVAAEPKHERQRRAQIRKNITETLVSLRVHTVDDIQQIAAALAQCMGPSRELVCRSCLKQTLHKLEAMMRILQAETTAGTVTPTAIGDSILNITGDLIHLASSDVRAPQRSELGAESPSRMVASQAYNLTSALMRILTRSRVLNEEPLTLAGEEIVAQGKRSDPRSLLCYGGAPGPGCHFSIPKAFSRAPANLSDVVQLIFLVDSNPFPFGYISNYTVSTKVASMAFQTQAGAQIPIERLASERAITVKVPNNSDWAARGHRSSANSVVVQPQASVGAVVTLDSSNPAAVLHLQLNYTLLDGRYLSEEPEPYLAVYLHSEPRPNEHNCSASRRIRPESLQGADHRPYTFFISPGTRDPVGSYRLNLSSHFRLSALEVSVGLYTSLCQYFSEEDVVWRTEGLLPLEETSPRQAVCLTRHLTAFGASLFVPPSHVRFVFPEPTADVNYIVMLTCAVCLVTYMVMAAILHKLDQLDASRGRAIPFCGQRGRFKYEILVKTGWGRGSGTTAHVGIMLYGVDSRSGHRHLDGDRAFHRNSLDIFRIATPHSLGSVWKIRVWHDKGLSPAWFLQHVIIRDLQTAHSTFFLVNDWLSVETEANGGLVEKEVLAASHAALLRFRRLLVAELQCGFFDKHIWLSIWDRPPRSCFTRIQRATCCVLLICLFLGANAVWYGAVGDSAYSTGHVSRLSPLSVDTVAVGLVSSVVVYPVYLAILFLFWMSRSKVAGSPSPTPAGQQVLDIDSCLDSSVLDSSFLTFSGLHAEVINTLADHRHRGTDFGGSPWLLIITVFLRSYKFAISLCTLTFGLSILWLTIVTRGTDFGGSPWLLIITVFLRSYKFAISLCITNLRVSFLKTIFPSRSV

SEQ ID NO: 881140 - protein, 397 aa, Homo sapiens
RLGARPGVNRPRVTSLCQYFSEEDVVWRTEGLLPLEETSPRQAVCLTRHLTAFGASLFVPPSHVRFVFPEPTADVNYIVMLTCAVCLVTYMVMAAILHKLDQLDASRGRAIPFCGQRGRFKYEILVKTGWGRGSGTTAHVGIMLYGVDSRSGHRHLDGDRAFHRNSLDIFRIATPHSLGSVWKIRVWHDKGLSPAWFLQHVIIRDLQTAHSTFFLVNDWLSVETEANGGLVEKEVLAASHAALLRFRRLLVAELQCGFFDKHIWLSIWDRPPRSCFTRIQRATCCVLLICLFLGANAVWYGAVGDSAYSTGHVSRLSPLSVDTVAVGLVSSVVVYPVYLAILFLFWMSRSKVGWGWGPGSTGNGAWASAPCPEPPLSSAAARGKGVHQRLLGKGQHT

SEQ ID NO: 881141 - protein, 254 aa, Homo sapiens
MNSRQAWRLLLSQGRGDRWVSRPRGHFSPALRREFFTTTTKEGYDRRPVDITPLEQRKLTFDTHALVQDLETHGFDKTQAETIVSALTALSNVSLDTIYKEMVTQAQQEITVQQLMAHLDAIRKDMVILEKSEFANLRAENEKMKIELDQVKQQLMHETSRIRADNKLDINLERSRVTDMFTDQEKQLMETTTEFTKKDTQTKSIISETSNKIDAEIASLKTLMESNKLETIRYLAASVFTCLAIALGFYRFWK

SEQ ID NO: 881142 - protein, 254 aa, Homo sapiens; identical to SEQ ID NO: 881141

SEQ ID NO: 881143 - protein, 254 aa, Homo sapiens; identical to SEQ ID NO: 881141

SEQ ID NO: 881144 - protein, 254 aa, Homo sapiens; identical to SEQ ID NO: 881141

SEQ ID NO: 881145 - protein, 153 aa, Homo sapiens
MVTQAQQEITVQQLMAHLDAIRKDMVILEKSEFANLRAENEKMKIELDQVKQQLMHETSRIRADNKLDINLERSRVTDMFTDQEKQLMETTTEFTKKDTQTKSIISETSNKIDAEIASLKTLMESNKLETIRYLAASVFTCLAIALGFYRFWK

SEQ ID NO: 881146 - protein, 280 aa, Homo sapiens
MNSRQAWRLLLSQGRGDRWVSRPRGHFSPALRREFFTTTTKEGYDRRPVDITPLEQRKLTFDTHALVQDLETHGFDKTQAETIVSALTALSNVSLDTIYKEMVTQAQQEITVQQLMAHLDAIRKDMVILEKSEFANLRAENEKMKIELDQVKQQLMHETSRIRADNKLDINLERSRVTDMFTDQEKQLMETTTEFTKKDTQTKSIISETSNKIDAEIASLKTLMESNKLETIRYLAGKTVRERNCCHLIFLLVLPIKVTEQAQEKKEELDNKAPLLLGPL

SEQ ID NO: 881147 - protein, 153 aa, Homo sapiens; identical to SEQ ID NO: 881145

SEQ ID NO: 881148 - protein, 111 aa, Homo sapiens
MKIELDQVKQQLMHETSRIRADNKLDINLERSRVTDMFTDQEKQLMETTTEFTKKDTQTKSIISETSNKIDAEIASLKTLMESNKLETIRYLAASVFTCLAIALGFYRFWK

SEQ ID NO: 881149 - protein, 156 aa, Homo sapiens
MHWFRTWKLMEITVQQLMAHLDAIRKDMVILEKSEFANLRAENEKMKIELDQVKQQLMHETSRIRADNKLDINLERSRVTDMFTDQEKQLMETTTEFTKKDTQTKSIISETSNKIDAEIASLKTLMESNKLETIRYLAASVFTCLAIALGFYRFWK

SEQ ID NO: 881150 - protein, 156 aa, Homo sapiens; identical to SEQ ID NO: 881149

SEQ ID NO: 881151 - protein, 153 aa, Homo sapiens; identical to SEQ ID NO: 881145

SEQ ID NO: 881152 - protein, 245 aa, Homo sapiens
MLANCGSVCEETQFRGTTVAPALGEFFTTTTKEGYDRRPVDITPLEQRKLTFDTHALVQDLETHGFDKTQAETIVSALTALSNVSLDTIYKEMVTQAQQEITVQQLMAHLDAIRKDMVILEKSEFANLRAENEKMKIELDQVKQQLMHETSRIRADNKLDINLERSRVTDMFTDQEKQLMETTTEFTKKDTQTKSIISETSNKIDAEIASLKTLMESNKLETIRYLAASVFTCLAIALGFYRFWK

SEQ ID NO: 881153 - protein, 208 aa, Homo sapiens [sequence omitted]

SEQ ID NO: 881154 - protein, 262 aa, Homo sapiens
MNSRQAWRLLLSQGRGDRWVSRPRGHFSPALRREFFTTTTKEGYDRRPVDITPLEQRKLTFDTHALVQDLETHGFDKTQAETIVSALTALSNVSLDTIYKEMVTQAQQVIFILFSEEITVQQLMAHLDAIRKDMVILEKSEFANLRAENEKMKIELDQVKQQLMHETSRIRADNKLDINLERSRVTDMFTDQEKQLMETTTEFTKKDTQTKSIISETSNKIDAEIASLKTLMESNKLETIRYLAASVFTCLAIALGFYRFWK

SEQ ID NO: 881155 - protein, 139 aa, Homo sapiens
MAHLDAIRKDMVILEKSEFANLRAENEKMKIELDQVKQQLMHETSRIRADNKLDINLERSRVTDMFTDQEKQLMETTTEFTKKDTQTKSIISETSNKIDAEIASLKTLMESNKLETIRYLAASVFTCLAIALGFYRFWK

SEQ ID NO: 881156 - protein, 156 aa, Homo sapiens; identical to SEQ ID NO: 881149

SEQ ID NO: 881157 - protein, 86 aa, Homo sapiens
SPLKGFRGSDKVGGGNWGTGNPIFHRKRTRLITHLFTAIASKYRNSTIREKAGNASPGSRVRNFPGVDYFLINSAARVRLKNIDGI

SEQ ID NO: 881158 - protein, 200 aa, Homo sapiens
MNSRQAWRLLLSQGRGDRWVSRPRGHFSPALRREFFTTTTKEGYDRRPVDITPLEQRKLTFDTHALVQDLETHGFDKTQAETIVSALTALSNVSLDTIYKEMVTQAQQEITVQQLMAHLDAIRKDMVILEKSEFANLRAENEKMKIELDQVKQQLMHETSRIRADNKLDINLERSRVTDMFTDQEKQLMETTTEFTKKVK

SEQ ID NO: 881159 - protein, 156 aa, Homo sapiens; identical to SEQ ID NO: 881149

SEQ ID NO: 881160 - protein, 156 aa, Homo sapiens; identical to SEQ ID NO: 881149

SEQ ID NO: 881161 - protein, 237 aa, Homo sapiens
MNSRQAWRLLLSQGRGDRWVSRPRGHFSPALRREFFTTTTKEGYDRRPVDITPLEQRKLTFDTHALVQDLETHGFDKTQAETIVSALTALSNVSLDTIYKEMVTQAQQEITVQQLMAHLDAIRKDMVILEKSEFANLRAENEKMKIELDQVKQQLMHETSRIRADNKLDINLERSRVTDMFTDQKATYGNTTDFQKDLNQSIFETRINGLNGLKLWALHWDIVLRRFGGTGLTGIRP

SEQ ID NO: 881162 - protein, 117 aa, Homo sapiens
MVTQAQQEITVQQLMAHLDAIRKDMVILEKSEFANLRAENEKMKIELDQVKQQLMHETSRIRADNKLDINLERSRVTDMFTDQKSNLWKHYGFPNRVLKPKFISRPDNGRNGLNRWF

SEQ ID NO: 881163 - protein, 78 aa, Homo sapiens
GVAPARANGKRRCHALLPDSRLVLGDAAACCPDLPSSPQGARTEESTAFLFLKRTFEGLGFAPGFFLSRCFRFLVTRG

SEQ ID NO: 881164 - protein, 366 aa, Homo sapiens
EATGSSNRGSGAAARVPGLLNLGSYSRVAAEDELQLPRLPELFETGRQLLDEVEVATEPAGSRIVQEKVFKGLDLLEKAAEMLSQLDLFSRNEDLEEIASTDLKYLLVPAFQGALTMKQVNPSKRLDHLQRAREHFINYLTQCHCYHVAEFELPKTMNNSAENHTANSSMAYPSLVAMASQRQAKIQRYKQKKELEHRLSAMKSAVESGQADDERVREYYLLHLQRWIDISLEEIESIDQEIKILRERDSSREASTSNSSRQERPPVKPFILTRNMAQAKVFGAGYPSLPTMTVSDWYEQHRKYGALPDQGIAKAAPEEFRKAAQQQEEQEEKEEEDDEQTLHRAREWDDWKDTHPRGYGNRQNMG

SEQ ID NO: 881165 - protein, 285 aa, Homo sapiens [sequence omitted]

SEQ ID NO: 881166 - protein, 149 aa, Homo sapiens
GRVGRPTRPWIDISLEEIESIDQEIKILRERDSSREASTSNSSRQERPPVKPFILTRNMAQAKVFGAGYPSLPTMTVSDWYEQHRKYGALPDQGIAKAAPEEFRKAAQQQEEQEEKEEEDDEQTLHRAREWDDWKDTHPRGYGNRQNMG

SEQ ID NO: 881167 - protein, 285 aa, Homo sapiens [sequence omitted]

SEQ ID NO: 881168 - protein, 347 aa, Homo sapiens
DAWVDPRVLAAEDELQLPRLPELFETGRQLLDEVEVATEPAGSRIVQEKVFKGLDLLEKAAEMLSQLDLFSRNEDLEEIASTDLKYLLVPAFQGALTMKQVNPSKRLDHLQRAREHFINYLTQCHCYHVAEFELPKTMNNSAENHTANSSMAYPSLVAMASQRQAKIQRYKQKKELEHRLSAMKSAVESGQADDERVREYYLLHLQRWIDISLEEIESIDQEIKILRERDSSREASTSNSSRQERPPVKPFILTRNMAQAKVFGAGYPSLPTMTVSDWYEQHRKYGALPDQGIAKAAPEEFRKAAQQQEEQEEKEEEDDEQTLHRAREWDDWKDTHPRGYGNRQNMG

SEQ ID NO: 881169 - protein, 253 aa, Homo sapiens
MLSQLDLFSRNEDLEEIASTDLKYLLVPAFQGALTMKQVNPSKRLDHLQRAREHFINYLTQCHCYHVAEFELPKTMNNSAENHTANSSMAYPSLVAMASQRQAKIQRYKQKKELEHRLSAMKSAVESGQADDERVREYYLLHLQRWIDISLEEIESIDQEIKILRERDSSREASTSNSSRQERPPVKPFILTRNMAQAKVFGAGYPSLPTMTVSDWYEQHRKYGALPDQGIAKAAPGHQNEGKSEKELHPRGD

SEQ ID NO: 881170 - protein, 120 aa, Homo sapiens
MLSQLDLFSRNEDLEEIASTDLKYLLVPAFQGALTMKQVNPSKRLDHLQRAREHFINYLTQCHCYHVAEFELPKTMNNSAENHTANSSMAYPSLVAMASQRQAKIQRHQLLTHLARRGLQ

SEQ ID NO: 881171 - protein, 285 aa, Homo sapiens [sequence omitted]

SEQ ID NO: 881172 - protein, 366 aa, Homo sapiens; identical to SEQ ID NO: 881164

SEQ ID NO: 881173 - protein, 285 aa, Homo sapiens [sequence omitted]

SEQ ID NO: 881174 - protein, 218 aa, Homo sapiens
MLSQLDLFSRNEDLEEIASTDLKYLLVPAFQGALTMKQVNPSKRLDHLQRAREHFINYLTQCHCYHVAEFELPKTMNNSAENHTANSSMAYPSLVAMASQRQAKIQRYKQKKELEHRLSAMKSAVESGQADDERVREYYLLHLQRWIDISLEEIESIDQEIKILRERDSSREASTSNSSRQERPPVKPFILTRNMAQAKGIQKSSSATGRTRRKGGRG

SEQ ID NO: 881175 - protein, 178 aa, Homo sapiens [sequence omitted]

SEQ ID NO: 881176 - protein, 36 aa, Homo sapiens
MGSMERYDSICNVWESMASMPVGVLHPAVAVKDQRL

SEQ ID NO: 881177 - protein, 458 aa, Homo sapiens
GLRAGAARRPARPFRRCRRRRACRSAEGTGLRSLLLPPRLQLPAGPFSRCRWDPVSSPRPSTMPPKKGGDGIKPPPIIGRFGTSLKIGIVGLPNVGKSTFFNVLTNSQASAENFPFCTIDPNESRVPVPDERFDFLCQYHKPASKIPAFLNVVDIAGLVKGAHNGQGLGNAFLSHISACDGIFHLTRAFEDDDITHVEGSVDPIRDIEIIHEELQLKDEEMIGPIIDKLEKVAVRGGDKKLKPEYDIMCKVKSWVIDQKKPVRFYHDWNDKEIEVLNKHLFLTSKPMVYLVNLSEKDYIRKKNKWLIKIKEWVDKYDPGALVIPFSGALELKLQELSAEERQKYLEANMTQSALPKIIKAGFAALQLEYFFTAGPDEVRAWTIRKGTKAPQAAGKIHTDFEKGFIMAEVMKYEDFKEEGSENAVKAAGKYRQQGRNYIVEDGDIIFFKFNTPQQPKKK

SEQ ID NO: 881178 - protein, 458 aa, Homo sapiens; identical to SEQ ID NO: 881177

SEQ ID NO: 881179 - protein, 424 aa, Homo sapiens
VCAQVPLGARPARSAAVAAVVRAARRRGRACVLSSFLPASSCRQDLSLAAAGTPCHRPGRARKSTFFNVLTNSQASAENFPFCTIDPNESRVPVPDERFDFLCQYHKPASKIPAFLNVVDIAGLVKGAHNGQGLGNAFLSHISACDGIFHLTRAFEDDDITHVEGSVDPIRDIEIIHEELQLKDEEMIGPIIDKLEKVAVRGGDKKLKPEYDIMCKVKSWVIDQKKPVRFYHDWNDKEIEVLNKHLFLTSKPMVYLVNLSEKDYIRKKNKWLIKIKEWVDKYDPGALVIPFSGALELKLQELSAEERQKYLEANMTQSALPKIIKAGFAALQLEYFFTAGPDEVRAWTIRKGTKAPQAAGKIHTDFEKGFIMAEVMKYEDFKEEGSENAVKAAGKYRQQGRNYIVEDGDIIFFKFNTPQQPKKK

SEQ ID NO: 881180 - protein, 396 aa, Homo sapiens
MPPKKGGDGIKPPPIIGRFGTSLKIGIVGLPNVGKSTFFNVLTNSQASAENFPFCTIDPNESRVPVPDERFDFLCQYHKPASKIPAFLNVVDIAGLVKGAHNGQGLGNAFLSHISACDGIFHLTRAFEDDDITHVEGSVDPIRDIEIIHEELQLKDEEMIGPIIDKLEKVAVRGGDKKLKPEYDIMCKVKSWVIDQKKPVRFYHDWNDKEIEVLNKHLFLTSKPMVYLVNLSEKDYIRKKNKWLIKIKEWVDKYDPGALVIPFSGALELKLQELSAEERQKYLEANMTQSALPKIIKAGFAALQLEYFFTAGPDEVRAWTIRKGTKAPQAAGKIHTDFEKGFIMAEVMKYEDFKEEGSENAVKAAGKYRQQGRNYIVEDGDIIFFKFNTPQQPKKK

SEQ ID NO: 881181 - protein, 382 aa, Homo sapiens
GLRAGAARRPARPFRRCRRRRACRSAEGTGLRSLLLPPRLQLPAGPFSRCRWDPVSSPRPSTMPPKKGGDGIKPPPIIGRFGTSLKIGIVGLPNVGKSTFFNVLTNSQASAENFPFCTIDPNESRVPVPDERFDFLCQYHKPASKIPAFLNVVDIAGLVKGAHNGQGLGNAFLSHISACDGIFHLTRAFEDDDITHVEGSVDPIRDIEIIHEELQLKDEEMIGPIIDKLEKVAVRGGDKKLKPEYDIMCKVKSWVIDQKKPVRFYHDWNDKEIEVLNKHLFLTSKPMVYLVNLSEKDYIRKKNKWLIKIKEWVDKYDPGALVIPFSGALELKLQELSAEERQKYLEANMTQSALPKIIKAGFAALQLEYFFRSACMDHQERD

SEQ ID NO: 881182 - protein, 438 aa, Homo sapiens
GLRAGAARRPARPFRRCRRRRACRSAEGTGLRSLLLPPRLQLPAGPFSRCRWDPVSSPRPSTMPPKKGGDGIKPPPIIGRFGTSLKIGIVGLPNVGKSTFFNVLTNSQASAENFPFCTIDPNESRVPVPDERFDFLCQYHKPASKIPAFLNVVDIAGLVKGAHNGQGLGNAFLSHISACDGIFHLTRAFEDDDITHVEGSVDPIRDIEIIHEELQLKDEEMIGPIIDKLEKVAVRGGDKKLKPEYDIMCKVKSWVIDQKKPVRFYHDWNDKEIEVLNKHLFLTSKPMVYLVNLSEKDYIRKKNKWLIKIKEWVDKYDPGALVIPFSGALELNALPKIIKAGFAALQLEYFFTAGPDEVRAWTIRKGTKAPQAAGKIHTDFEKGFIMAEVMKYEDFKEEGSENAVKAAGKYRQQGRNYIVEDGDIIFFKFNTPQQPKKK

SEQ ID NO: 881183 - protein, 458 aa, Homo sapiens; identical to SEQ ID NO: 881177

SEQ ID NO: 881184 - protein, 238 aa, Homo sapiens
MIGPIIDKLEKVAVRGGDKKLKPEYDIMCKVKSWVIDQKKPVRFYHDWNDKEIEVLNKHLFLTSKPMVYLVNLSEKDYIRKKNKWLIKIKEWVDKYDPGALVIPFSGALELKLQELSAEERQKYLEANMTQSALPKIIKAGFAALQLEYFFTAGPDEVRAWTIRKGTKAPQAAGKIHTDFEKGFIMAEVMKYEDFKEEGSENAVKAAGKYRQQGRNYIVEDGDIIFFKFNTPQQPKKK

SEQ ID NO: 881185 - protein, 452 aa, Homo sapiens
VCAQVPLGARPARSAAVAAVVRAARRRGRACVLSSFLPASSCRQDLSLAAAGTPCHRPGRARKSTFFNVLTNSQASAENFPFCTIDPNESRVPVPDERFDFLCQYHKPASKIPAFLNVVDIAGLVKGAHNGQGLGNAFLSHISACDGIFHLTRWSCNGTISAHHNLHLLGSSDSSASASCSAFEDDDITHVEGSVDPIRDIEIIHEELQLKDEEMIGPIIDKLEKVAVRGGDKKLKPEYDIMCKVKSWVIDQKKPVRFYHDWNDKEIEVLNKHLFLTSKPMVYLVNLSEKDYIRKKNKWLIKIKEWVDKYDPGALVIPFSGALELKLQELSAEERQKYLEANMTQSALPKIIKAGFAALQLEYFFTAGPDEVRAWTIRKGTKAPQAAGKIHTDFEKGFIMAEVMKYEDFKEEGSENAVKAAGKYRQQGRNYIVEDGDIIFFKFNTPQQPKKK

SEQ ID NO: 881186 - protein, 510 aa, Homo sapiens
GLRAGAARRPARPFRRCRRRRACRSAEGTGLRSLLLPPRLQLPAGPFSRCRWDPVSSPRPSTMPPKKGGDGIKPPPIIGRFGTSLKIGIVGLPNVGKSTFFNVLTNSQASAENFPFCTIDPNESRVPVPDERFDFLCQYHKPASKIPAFLNVVDIAGLVKGAHNGQGLGNAFLSHISACDGIFHLTRAFEDDDITHVEGSVDPIRDIEIIHEELQLKDEEMIGPIIDKLEKVAVRGGDKKLKPEYDIMCKVKSWVIDQKKPVRFYHDWNDKEIEVLNKHLFLTSKPMVYLVNLSEKDYIRKKNKWLIKIKEWVDKYDPGALVIPFSGALELKLQELSAEERQKYLEANMTQSALPKIIKAGFAALQLEYFFTAGPDEVRAWTIRKGTKAPQAAGKIHTDFEKGFIMAEVMKYEDFKEEGSENAVKAAGKYRQQGRNYIVEDGDIIFFKFNTPQQPKKKNKNIKKNFWARLPSKIFSTPRVAPAPGMEHAKRLPQDTGPQRVGSPKPGPRF

SEQ ID NO: 881187 - protein, 533 aa, Homo sapiens
GLRAGAARRPARPFRRCRRRRACRSAEGTGLRSLLLPPRLQLPAGPFSRCRWDPVSSPRPSTMPPKKGGDGIKPPPIIGRFGTSLKIGIVGLPNVGKSTFFNVLTNSQASAENFPFCTIDPNESRVPVPDERFDFLCQYHKPASKIPAFLNVVDIAGLVKGAHNGQGLGNAFLSHISACDGIFHLTRAFEDDDITHVEGSVDPIRDIEIIHEELQLKDEEMIGPIIDKLEKVAVRGGDKKLKPEYDIMCKVKSWVIDQKKPVRFYHDWNDKEIEVLNKHLFLTSKPMVYLVNLSEKDYIRKKNKWLIKIKEWVDKYDPGALVIPFSGALELKLQELSAEERQKYLEANMTQSALPKIIKAGFAALQLEYFFTAGPDEVRAWTIRKGTKAPQAAGKIHTDFEKGFIMAEVMKYEDFKEEGSENAVKAAGKYRQQGRNYIVEDGDIIFFKFNTPQQPSNPSGVAWLGGVLPLFATIKYPQKFEARITITTDESTRTNYMELRGLTSEDTAVYFCARVDLSPHYEGYYFDPWGQVT

SEQ ID NO: 881188 - protein, 110 aa, Homo sapiens
MTQSALPKIIKAGFAALQLEYFFTAGPDEVRAWTIRKGTKAPQAAGKIHTDFEKGFIMAEVMKYEDFKEEGSENAVKAAGKYRQQGRNYIVEDGDIIFFKFNTPQQPKKK

SEQ ID NO: 881189 - protein, 340 aa, Homo sapiens
GLRAGAARRPARPFRRCRRRRACRSAEGTGLRSLLLPPRLQLPAGPFSRCRWDPVSSPRPSTMPPKKGGDGIKPPPIIGRFGTSLKIGIVGLPNVGKSTFFNVLTNSQASAENFPFCTIDPNESRVPVPDERFDFLCQYHKPASKIPAFLNVVDIAGLVKGAHNGQGLGNAFLSHISACDGIFHLTRAFEDDDITHVEGSVDPIRDIEIIHEELQLKDEEMIGPIIDKLEKVAVRGGDKKLKPEYDIMCKVKSWVIDQKKPVRFYHDWNDKEIEVLNKHLFLTSKPMVYLVNLSEKDYIRKKNKWLLESTDNKAEIILLKMEILSSSNLTHLNNRRRNKI

SEQ ID NO: 881190 - protein, 119 aa, Homo sapiens
LAGTTLLILHRYNALPKIIKAGFAALQLEYFFTAGPDEVRAWTIRKGTKAPQAAGKIHTDFEKGFIMAEVMKYEDFKEEGSENAVKAAGKYRQQGRNYIVEDGDIIFFKFNTPQQPKKK

SEQ ID NO: 881191 - protein, 98 aa, Homo sapiens
ACWNDSLNPPPLQRPDEVRAWTIRKGTKAPQAAGKIHTDFEKGFIMAEVMKYEDFKEEGSENAVKAAGKYRQQGRNYIVEDGDIIFFKFNTPQQPKKK

SEQ ID NO: 881192 - protein, 144 aa, Homo sapiens
SPRPSTMPPKKGGDGIKPPPIIGRFGTSLKIGIVGLPNVGKSTFFNVLTNSQASAENFPFCTIDPNESRVPVPDERFDFLCQYHKPASKIPAFLNVVDIAGLVKGAHNGQGLGNAFLSHISACDGIFHLTRCWKVQTTRQKLYC

SEQ ID NO: 881193 - protein, 213 aa, Homo sapiens
GLRAGAARRPARPFRRCRRRRACRSAEGTGLRSLLLPPRLQLPAGPFSRCRWDPVSSPRPSTMPPKKGGDGIKPPPIIGRFGTSLKIGIVGLPNVGKSTFFNVLTNSQASAENFPFCTIDPNESRVPVPDERFDFLCQYHKPASKIPAFLNVVDIAGLVKGAHNGQGLGNAFLSHISACDGIFHLTRWSCNGTISAHHNLHLLGSSDSSASAS

SEQ ID NO: 881194 - protein, 458 aa, Homo sapiens; identical to SEQ ID NO: 881177

SEQ ID NO: 881195 - protein, 458 aa, Homo sapiens; identical to SEQ ID NO: 881177

SEQ ID NO: 881196 - protein, 458 aa, Homo sapiens; identical to SEQ ID NO: 881177

SEQ ID NO: 881197 - protein, 238 aa, Homo sapiens; identical to SEQ ID NO: 881184

SEQ ID NO: 881198 - protein, 304 aa, Homo sapiens
GLRAGAARRPARPFRRCRRRRACRSAEGTGLRSLLLPPRLQLPAGPFSRCRWDPVSSPRPSTMPPKKGGDGIKPPPIIGRFGTSLKIGIVGLPNVGKSTFFNVLTNSQASAENFPFCTIDPNESRVPVPDERFDFLCQYHKPASKIPAFLNVVDIAGLVKGAHNGQGLGNAFLSHISACDGIFHLTRAFEDDDITHVEGSVDPIRDIEIIHEELQLKDEEMIGPIIDKLEKVAVRGGDKKLKPEYDIMCKVKSWVIDQKKPVRFYHDWNDKEIEVLNKHLFLTSKPMVYLVNLSEKDYIRKKNK

SEQ ID NO: 881199 - protein, 448 aa, Homo sapiens
GLRAGAARRPARPFRRCRRRRACRSAEGTGLRSLLLPPRLQLPAGPFSRCRWDPVSSPRPSTMPPKKGGDGIKPPPIIGRFGTSLKIGIVGLPNVGKSTFFNVLTNSQASAENFPFCTIDPNESRVPVPDERFDFLCQYHKPASKIPAFLNVVDIAGLVKGAHNGQGLGNAFLSHISACDGIFHLTRAFEDDDITHVEGSVDPIRDIEIIHEELQLKDEEMIGPIIDKLEKVAVRGGDKKLKPEYDIMCKVKSWVIDQKKPVRFYHDWNDKEIEVLNKHLFLTSKPMVYLVNLSEKDYIRKKNKWLIKIKEWVDKYDPGALVIPFSGALELKLQELSAEERQKYLEANMTQSALPKIIKAGFAALQLEYFFTAGPDEVRAWTIRKGTKAPQAAGKIHTDFEKGFIMAEVMKYEDFKEEGSENAVKLLKMEILSSSNLTHLNNRRRNKI

SEQ ID NO: 881200 - protein, 278 aa, Homo sapiens
MQVIYQRAFEDDDITHVEGSVDPIRDIEIIHEELQLKDEEMIGPIIDKLEKVAVRGGDKKLKPEYDIMCKVKSWVIDQKKPVRFYHDWNDKEIEVLNKHLFLTSKPMVYLVNLSEKDYIRKKNKWLIKIKEWVDKYDPGALVIPFSGALELKLQELSAEERQKYLEANMTQSALPKIIKAGFAALQLEYFFTAGPDEVRAWTIRKGTKAPQAAGKIHTDFEKGFIMAEVMKYEDFKEEGSENAVKAAGKYRQQGRNYIVEDGDIIFFKFNTPQQPKKK

SEQ ID NO: 881201 - protein, 340 aa, Homo sapiens; identical to SEQ ID NO: 881189

SEQ ID NO: 881202 - protein, 172 aa, Homo sapiens
MVYLVNLSEKDYIRKKNKWLIKIKEWVDKYDPGALVIPFSGALELKLQELSAEERQKYLEANMTQSALPKIIKAGFAALQLEYFFTAGPDEVRAWTIRKGTKAPQAAGKIHTDFEKGFIMAEVMKYEDFKEEGSENAVKAAGKYRQQGRNYIVEDGDIIFFKFNTPQQPKKK

SEQ ID NO: 881203 - protein, 170 aa, Homo sapiens
YFFTPSLIITIFTTSSVLIKIKEWVDKYDPGALVIPFSGALELKLQELSAEERQKYLEANMTQSALPKIIKAGFAALQLEYFFTAGPDEVRAWTIRKGTKAPQAAGKIHTDFEKGFIMAEVMKYEDFKEEGSENAVKAAGKYRQQGRNYIVEDGDIIFFKFNTPQQPKKK

SEQ ID NO: 881204 - protein, 360 aa, Homo sapiens
GLRAGAARRPARPFRRCRRRRACRSAEGTGLRSLLLPPRLQLPAGPFSRCRWDPVSSPRPSTMPPKKGGDGIKPPPIIGRFGTSLKIGIVGLPNVGKSTFFNVLTNSQASAENFPFCTIDPNESRVPVPDERFDFLCQYHKPASKIPAFLNVVDIAGLVKGAHNGQGLGNAFLSHISACDGIFHLTRAFEDDDITHVEGSVDPIRDIEIIHEELQLKDEEMIGPIIDKLEKVAVRGGDKKLKPEYDIMCKVKSWVIDQKKPVRFYHDWNDKEIEVLNKHLFLTSKPMVYLVNLSEKDYIRKKNKWLIKIKEWVDKYDPGALVIPFSGALELKLQELSAEERQKYLEANMTQSALPKIIAG

SEQ ID NO: 881205 - protein, 107 aa, Homo sapiens
LAGTTLLILHRYKLIKIKEWVDKYDPGALVIPFSGALELKLQELSAEERQKYLEANMTQSALPKIIKAGFAALQLEYFFTAGPDEVRAWTIRERFTQILKRDSLWLK

SEQ ID NO: 881206 - protein, 106 aa, Homo sapiens
MSEDNVACSFLNLQIMHVLQYSRCLHSIKHLTKPALVCLGMSVLTDCGVLNAIRHLVVADYRILRRVYDTVTGSVGQLQLYLKSESFMGIRRIVYQGFVSKKLINL

SEQ ID NO: 881207 - protein, 418 aa, Homo sapiens
MIHSLFLINSSGDIFLEKHWKSVVSRSVCDYFFEAQERATEAENVPPVIPTPHHYLLSVYRHKIFFVAVIQTEVPPLFVIEFLHRVVDTFQDYFGVCSEPVIKDNVVVVYEVLEEMLDNGFPLATESNILKELIKPPTILRTVVNTITGSTNVGDQLPTGQLSVVPWRRTGVKYTNNEAYFDVIEEIDAIIDKSGSTITAEIQGVIDACVKLTGMPDLTLSFMNPRLLDDVSFHPCVRFKRWESERILSFIPPDGNFRLLSYHVSAQNLVAIPVYVKHNISFRDSSSLGRFEITVGPKQTMGKTIEGVTVTSQMPKGVLNMSLTPSQGTHTFDPVTKMLSWDVGKINPQKLPSLKGTMSLQAGASKPDENPTINLQFKIQQLAISGLKVNRLDMYGEKYKPFKGIKYMTKAGKFQVRT

SEQ ID NO: 881208 - protein, 268 aa, Homo sapiens
MIHSLFLINSSGDIFLEKHWKSVVSRSVCDYFFEAQERATEAENVPPVIPTPHHYLLSVYRHKIFFVAVIQTEVPPLFVIEFLHRVVDTFQDYFGVCSEPVIKDNVVVVYEVLEEMLDNGFPLATESNILKELIKPPTILRTVVNTITGSTNVGDQLPTGQLSVVPWRRTGVKYTNNEAYFDVIEEIDAIIDKSGSTITAEIQGVIDACVKLTGMPDLTLSFMNPRLLDDVSFHPCVRFKRWESERILSFIPPDGNFRLLSYHVSAQK

SEQ ID NO: 881209 - protein, 77 aa, Homo sapiens
TLRLGTRLGVASLKGTMSLQAGASKPDENPTINLQFKIQQLAISGLKVNRLDMYGEKYKPFKGIKYMTKAGKFQVRT

SEQ ID NO: 881210 - protein, 160 aa, Homo sapiens
LSSVEPAAVLSVPDLVASRSTLTPPDHYSLGRFEITVGPKQTMGKTIEGVTVTSQMPKGVLNMSLTPSQGTHTFDPVTKMLSWDVGKINPQKLPSLKGTMSLQAGASKPDENPTINLQFKIQQLAISGLKVNRLDMYGEKYKPFKGIKYMTKAGKFQVRT

SEQ ID NO: 881211 - protein, 418 aa, Homo sapiens; identical to SEQ ID NO: 881207

SEQ ID NO: 881212 - protein, 418 aa, Homo sapiens; identical to SEQ ID NO: 881207

SEQ ID NO: 881213 - protein, 230 aa, Homo sapiens [sequence omitted]

SEQ ID NO: 881214 - protein, 222 aa, Homo sapiens
MIHSLFLINSSGDIFLEKHWKSVVSRSVCDYFFEAQERATEAENVPPVIPTPHHYLLSVYRHKIFFVAVIQTEVPPLFVIEFLHRVVDTFQDYFGVCSEPVIKDNVVVVYEVLEEMLDNGFPLATESNILKELIKPPTILRTVVNTITGSTITAEIQGVIDACVKLTGMPDLTLSFMNPRLLDDVSFHPCVRFKRWESERILSFIPPDGNFRLLSYHVSAQK

SEQ ID NO: 881215 - protein, 118 aa, Homo sapiens [sequence omitted]

SEQ ID NO: 881216 - protein, 418 aa, Homo sapiens; identical to SEQ ID NO: 881207

SEQ ID NO: 881217 - protein, 230 aa, Homo sapiens [sequence omitted]

SEQ ID NO: 881218 - protein, 384 aa, Homo sapiens
IKTGRAPKGADAYYRSTRHQRPVPGSPLRLFGASSSNRIQIFGSEGRRTLRKLRRLSSPGAMDSDASLVSSRPSSPEPDDLFLPARSKGSSGSAFTGGTVSSSTPSDCPPELSAELRGAMGSAGAHPGDKLGGSGFKSSSSSTSSSTSSAAASSTKKDKKQMTEPELQQLRLKINSRERKRMHDLNIAMDGLREVMPYAHGPSVRKLSKIATLLLARNYILMLTNSLEEMKRLVSEIYGGHHAGFHPSACGGLAHSAPLPAATAHPAAAAHAAHHPAVHHPILPPAAAAAAAAAAAAAVSSASLPGSGLPSVGSIRPPHGLLKSPSAAAAAPLGGGGGGSGASGGFQHWGGMPCPCSMCQVPPPHHHVSAMGAGSLPRLTSDAK

SEQ ID NO: 881219 - protein, 47 aa, Homo sapiens
MYCVEEHYVLNFSQNRAEAVPTRQNRSSYKEMPRDSKAKPECSLEPR

SEQ ID NO: 881220 - protein, 47 aa, Homo sapiens; identical to SEQ ID NO: 881219

SEQ ID NO: 881221 - protein, 47 aa, Homo sapiens; identical to SEQ ID NO: 881219

SEQ ID NO: 881222 - protein, 93 aa, Homo sapiens
PPSPQPTEEDPEHRVRVRVTKLRLGGPNQDLTVLEIKRENPQLKQPPPQDIEDLDHYEMKAEPISGKKLEDEGIEKENLAILEKLGRLKDKSI

SEQ ID NO: 881223 - protein, 80 aa, Homo sapiens
MEMLARTIKYLEPNPASQAKLTMLNTVWKIQGQVKNPGYPQSEGLLSECLIRHQKELGNESNFSDALLDAGESMKHLAEV

SEQ ID NO: 881224 - protein, 191 aa, Homo sapiens
RPNESAGRCRWDHGGQSGRMASGFKKPSAASTGQKRKVAPKPELTEDQKQEVREAFDLFDVDGSGTIDAKELKVAMRALGFEPRKEEMKKMISEVDREGTGKISFNDFLAVMTQKMSEKDTKEEILKAFRLFDDDETGKISFKNLKRVANELGENLTDEELQEMIDEADRDGDGEVNEEEFLRIMKKTSLY

SEQ ID NO: 881225 - protein, 272 aa, Homo sapiens
MSKAGAGRGPLQEAQSQKMRYKTSLVMRKRLRLYRNTLKESSSSSGHHGPQLTAASSPSVFPGLHEEPPQASPSRPLNGLLRLGLPGDMYARPEPFPPGPAARSDALAAAAALHGYGGMNLTVNLAAPHGPGAFFRYMRQPIKQELICKWLAADGTATPSLCSKTFSTMHELVTHVTVEHVGGPEQANHICFWEECPRQGKPFKAKYKLVNHIRVHTGEKPFPCPFPGCGKVFARSENLKIHKRTHTGEKPFRCEFEGCERRFANSSDRKKH

SEQ ID NO: 881226 - protein, 186 aa, Homo sapiens
MYARPEPFPPGPAARSDALAAAAALHGYGGMNLTVNLAAPHGPGAFFRYMRQPIKQELICKWLAADGTATPSLCSKTFSTMHELVTHVTVEHVGGPEQANHICFWEECPRQGKPFKAKYKLVNHIRVHTGEKPFPCPFPGCGKVFARSENLKIHKRTHTGQYSALSVACGPSGEAGPRVWISSSPN

SEQ ID NO: 881227 - protein, 111 aa, Homo sapiens [sequence omitted]

SEQ ID NO: 881228 - protein, 398 aa, Homo sapiens
MLRLYVLVMGVSAFTLQPAAHTGAARSCRFRGRHYKREFRLEGEPVALRCPQVPYWLWASVSPRINLTWHKNDSARTVPGEEETRMWAQDGALWLLPALQEDSGTYVCTTRNASYCDKMSIELRVFENTDAFLPFISYPQILTLSTSGVLVCPDLSEFTRDKTDVKIQWYKDSLLLDKDNEKFLSVRGTTHLLVHDVALEDAGYYRCVLTFAHEGQQYNITRSIELRIKKKKEETIPVIISPLKTISASLGSRLTIPCKVFLGTGTPLTTMLWWTANDTHIESAYPGGRVTEGPRQEYSENNENYIEVPLIFDPVTREDLHMDFKCVVHNTLSFQTLRTTVKEASSTFSWGIVLAPLSLAFLVLGGIWMHRRCKHRTGKADGLTVLWPHHQDFQSYPK

SEQ ID NO: 881229 - protein, 296 aa, Homo sapiens
MLRLYVLVMGVSAFTLQPAAHTGAARSCRFRGRHYKREFRLEGEPVALRCPQVPYWLWASVSPRINLTWHKNDSARTVPGEEETRMWAQDGALWLLPALQEDSGTYVCTTRNASYCDKMSIELRVFENTDAFLPFISYPQILTLSTSGVLVCPDLSEFTRDKTDVKIQWYKDSLLLDKDNEKFLSVRGTTHLLVHDVALEDAGYYRCVLTFAHEGQQYNITRSIELRIKKKKEETIPVIISPLKTISASLGSRLTIPCKVFLGTGTPLTTMLWWTANDTHIESAYPGGRVTEGPRQ

SEQ ID NO: 881230 - protein, 398 aa, Homo sapiens; identical to SEQ ID NO: 881228

SEQ ID NO: 881231 - protein, 73 aa, Homo sapiens
GLTVACGLTVACGLTVACGLTVAVWVDRWLHLHGWCLCRVPGRLSIARIVNQCPTCGLPSKVVSGQLDCLRGG

SEQ ID NO: 881232 - protein, 417 aa, Homo sapiens
AGGESLAWQPSPGEQQQGHVLLGLSPPLPVSSGSCQEQCCAWAARSCRFRGRHYKREFRLEGEPVALRCPQVPYWLWASVSPRINLTWHKNDSARTVPGEEETRMWAQDGALWLLPALQEDSGTYVCTTRNASYCDKMSIELRVFENTDAFLPFISYPQILTLSTSGVLVCPDLSEFTRDKTDVKIQWYKDSLLLDKDNEKFLSVRGTTHLLVHDVALEDAGYYRCVLTFAHEGQQYNITRSIELRIKKKKEETIPVIISPLKTISASLGSRLTIPCKVFLGTGTPLTTMLWWTANDTHIESAYPGGRVTEGPRQEYSENNENYIEVPLIFDPVTREDLHMDFKCVVHNTLSFQTLRTTVKEASSTFSWGIVLAPLSLAFLVLGGIWMHRRCKHRTGKADGLTVLWPHHQDFQSYPK

SEQ ID NO: 881233 - protein, 188 aa, Homo sapiens
MALTFALLVALLVLSCKSSCSVGCDLPQTHSLGSRRTLMLLAQMRRISLFSCLKDRHDFGFPQEEFGNQFQKAETIPVLHEMIQQIFNLFSTKDSSAAWDETLLDKFYTELYQQLNDLEACVIQGVGVTETPLMKEDSILAVRKYFQRITLYLKEKKYSPCAWEVVRAEIMRSFSLSTNLQESLRSKE

SEQ ID NO: 881234 - protein, 153 aa, Homo sapiens [sequence omitted]

SEQ ID NO: 881235 - protein, 137 aa, Homo sapiens
MGLTSQLLPPLFFLLACAGNFVHGHKCDITLQEIIKTLNSLTEQKNTTEKETFCRAATVLRQFYSHHEKDTRCLGATAQQFHRHKQLIRFLKRLDRNLWGLAGLNSCPVKEANQSTLENFLERLKTIMREKYSKCSS

SEQ ID NO: 881236 - protein, 133 aa, Homo sapiens
MTSIKQLSSEELEQFQKTGTIVVEGHELHDEDIRLMYTFDQATGGTAQFEAHSDAQALVLLDVTPDQSMVDEGMAREVINRIQKLRKKCNLVPTDEITVYYKAKSEGGRNEFLYNENTRESPNITDPVDPLYA

SEQ ID NO: 881237 - protein, 1262 aa, Homo sapiens
MLQQVPENINFPAEEEKILEFWTEFNCFQECLKQSKHKPKFTFYDGPPFATGLPHYGHILAGTIKDIVTRYAHQSGFHVDRRFGWDCHGLPVEYEIDKTLGIRGPEDVAKMGITEYNNQCRAIVMRYSAEWKSTVSRLGRWIDFDNDYKTLYPQFMESVWWVFKQLYDKGLVYRGVKVMPFSTACNTPLSNFESHQNYKDVQDPSVFVTFPLEEDETVSLVAWTTTPWTLPSNLAVCVNPEMQYVKIKDVARGRLLILMEARLSALYKLESDYEILERFPGAYLKGKKYRPLFDYFLKCKENGAFTVLVDNYVKEEEGTGVVHQAPYFGAEDYRVCMDFNIIRKDSLPVCPVDASGCFTTEVTDFAGQYVKDADKSIIRTLKEQGRLLVATTFTHSYPFCWRSDTPLIYKAVPSWFVRVENMVDQLLRNNDLCYWVPELVREKRFGNWLKDARDWTISRNRYWGTPIPLWVSDDFEEVVCIGSVAELEELSGAKISDLHRESVDHLTIPSRCGKGSLHRISEVFDCWFESGSMPYAQVHYPFENKREFEDAFPADFIAEGIDQTRGWFYTLLVLATALFGQPPFKNVIVNGLVLASDGQKMSKRKKNYPDPVSIIQKYGADALRLYLINSPVVRAENLRFKEEGVRDVLKDVLLPWYNAYRFLIQNVLRLQKEEEIEFLYNENTVRESPNITDRWILSFMQSLIGFFETEMAAYRLYTVVPRLVKFVDILTNWYVRMNRRRLKGENGMEDCVMALETLFSVLLSLCRLMAPYTPFLTELMYQNLKVLIDPVSVQDKDTLSIHYLMLPRVREELIDKKTESAVSQMQSVIELGRVIRDRKTIPIKYPLKEIVVIHQDPEALKDIKSLEKYIIEELNVRKVTLSTDKNKYGIRLRAEPDHMVLGKRLKGAFKAVMTSIKQLSSEELEQFQKTGTIVVEGHELHDEDIRLMYTFDQATGGTAQFEAHSDAQALVLLDVTPDQSMVDEGMAREVINRIQKLRKKCNLVPTDEITVYYKAKSEGTYLNSVIESHTEFIFTTIKAPLKPYPVSPSDKVLIQEKTQLKGSELEITLTRGSSLPGPACAYVNLNICANGSEQGGVLLLENPKGDNRLDLLKLKSVVTSIFGVKNTELAVFHDETEIQNQTDLLSLSGKTLCVTAGSAPSLINSSSTLLCQYINLQLLNAKPQECLMGTVGTLLLENPLGQNGLTHQGLLYEAAKVFGLRSRKLKLFLNETQTQEITEDIPVKTLNMKTVYVSVLPTTADF

SEQ ID NO: 881238 - protein, 1152 aa, Homo sapiens
MGITEYNNQCRAIVMRYSAEWKSTVSRLGRWIDFDNDYKTLYPQFMESVWWVFKQLYDKGLVYRGVKVMPFSTACNTPLSNFESHQNYKDVQDPSVFVTFPLEEDETVSLVAWTTTPWTLPSNLAVCVNPEMQYVKIKDVARGRLLILMEARLSALYKLESDYEILERFPGAYLKGKKYRPLFDYFLKCKENGAFTVLVDNYVKEEEGTGVVHQAPYFGAEDYRVCMDFNIIRKDSLPVCPVDASGCFTTEVTDFAGQYVKDADKSIIRTLKEQGRLLVATTFTHSYPFCWRSDTPLIYKAVPSWFVRVENMVDQLLRNNDLCYWVPELVREKRFGNWLKDARDWTISRNRYWGTPIPLWVSDDFEEVVCIGSVAELEELSGAKISDLHRESVDHLTIPSRCGKGSLHRISEVFDCWFESGSMPYAQVHYPFENKREFEDAFPADFIAEGIDQTRGWFYTLLVLATALFGQPPFKNVIVNGLVLASDGQKMSKRKKNYPDPVSIIQKYGADALRLYLINSPVVRAENLRFKEEGVRDVLKDVLLPWYNAYRFLIQNVLRLQKEEEIEFLYNENTVRESPNITDRWILSFMQSLIGFFETEMAAYRLYTVVPRLVKFVDILTNWYVRMNRRRLKGENGMEDCVMALETLFSVLLSLCRLMAPYTPFLTELMYQNLKVLIDPVSVQDKDTLSIHYLMLPRVREELIDKKTESAVSQMQSVIELGRVIRDRKTIPIKYPLKEIVVIHQDPEALKDIKSLEKYIIEELNVRKVTLSTDKNKYGIRLRAEPDHMVLGKRLKGAFKAVMTSIKQLSSEELEQFQKTGTIVVEGHELHDEDIRLMYTFDQATGGTAQFEAHSDAQALVLLDVTPDQSMVDEGMAREVINRIQKLRKKCNLVPTDEITVYYKAKSEGTYLNSVIESHTEFIFTTIKAPLKPYPVSPSDKVLIQEKTQLKGSELEITLTRGSSLPGPACAYVNLNICANGSEQGGVLLLENPKGDNRLDLLKLKSVVTSIFGVKNTELAVFHDETEIQNQTDLLSLSGKTLCVTAGSAPSLINSSSTLLCQYINLQLLNAKPQECLMGTVGTLLLENPLGQNGLTHQGLLYEAAKVFGLRSRKLKLFLNETQTQEITEDIPVKTLNMKTVYVSVLPTTADF

SEQ ID NO: 881239 - protein, 563 aa, Homo sapiens
MQSLIGFFETEMAAYRLYTVVPRLVKFVDILTNWYVRMNRRRLKGENGMEDCVMALETLFSVLLSLCRLMAPYTPFLTELMYQNLKVLIDPVSVQDKDTLSIHYLMLPRVREELIDKKTESAVSQMQSVIELGRVIRDRKTIPIKYPLKEIVVIHQDPEALKDIKSLEKYIIEELNVRKVTLSTDKNKYGIRLRAEPDHMVLGKRLKGAFKAVMTSIKQLSSEELEQFQKTGTIVVEGHELHDEDIRLMYTFDQATGGTAQFEAHSDAQALVLLDVTPDQSMVDEGMAREVINRIQKLRKKCNLVPTDEITVYYKAKSEGTYLNSVIESHTEFIFTTIKAPLKPYPVSPSDKVLIQEKTQLKGSELEITLTRGSSLPGPACAYVNLNICANGSEQGGVLLLENPKGDNRLDLLKLKSVVTSIFGVKNTELAVFHDETEIQNQTDLLSLSGKTLCVTAGSAPSLINSSSTLLCQYINLQLLNAKPQECLMGTVGTLLLENPLGQNGLTHQGLLYEAAKVFGLRSRKLKLFLNETQTQEITEDIPVKTLNMKTVYVSVLPTTADF

SEQ ID NO: 881240 - protein, 483 aa, Homo sapiens [sequence omitted]

SEQ ID NO: 881241 - protein, 1262 aa, Homo sapiens; identical to SEQ ID NO: 881237

SEQ ID NO: 881242 - protein, 1262 aa, Homo sapiens; identical to SEQ ID NO: 881237

SEQ ID NO: 881243 - protein, 315 aa, Homo sapiens
MYTFDQATGGTAQFEAHSDAQALVLLDVTPDQSMVDEGMAREVINRIQKLRKKCNLVPTDEITVYYKAKSEGTYLNSVIESHTEFIFTTIKAPLKPYPVSPSDKVLIQEKTQLKGSELEITLTRGSSLPGPACAYVNLNICANGSEQGGVLLLENPKGDNRLDLLKLKSVVTSIFGVKNTELAVFHDETEIQNQTDLLSLSGKTLCVTAGSAPSLINSSSTLLCQYINLQLLNAKPQECLMGTVGTLLLENPLGQNGLTHQGLLYEAAKVFGLRSRKLKLFLNETQTQEITEDIPVKTLNMKTVYVSVLPTTADF

SEQ ID NO: 881244 - protein, 174 aa, Homo sapiens
MYTFDQATGGTAQFEAHSDAQALVLLDVTPDQSMVDEGMAREVINRIQKLRKKCNLVPTDEITVYYKAKSEGTYLNSVIESHTEFIFTTIKAPLKPYPVSPSDKVLIQEKTQLKGSELEITLTRGSSLPGPACAYVNLNICANGSEQGEMQWIIPEIYHFWKPRWSIAPGKSKR

SEQ ID NO: 881245 - protein, 1201 aa, Homo sapiens
MLQQVPENINFPAEEEKILEFWTEFNCFQECLKQSKHKPKFTFYDGPPFATGLPHYGHILAGTIKDIVTRYAHQSGFHVDRRFGWDCHGLPVEYEIDKTLGIRGPEDVAKMGITEYNNQCRAIVMRYSAEWKSTVSRLGRWIDFDNDYKTLYPQFMESVWWVFKQLYDKGLVYRGVKVMPFSTACNTPLSNFESHQNYKDVQDPSVFVTFPLEEDETVSLVAWTTTPWTLPSNLAVCVNPEMQYVKIKDVARGRLLILMEARLSALYKLESDYEILERFPGAYLKGKKYRPLFDYFLKCKENGAFTVLVDNYVKEEEGTGVVHQAPYFGAEDYRVCMDFNIIRKDSLPVCPVDASGCFTTEVTDFAGQYVKDADKSIIRTLKEQGRLLVATTFTHSYPFCWRSDTPLIYKAVPSWFVRVENMVDQLLRNNDLCYWVPELVREKRFGNWLKDARDWTISRNRYWGTPIPLWVSDDFEEVVCIGSVAELEELSGAKISDLHRESVDHLTIPSRCGKGSLHRISEVFDCWFESGSMPYAQVHYPFENKREFEDAFPADFIAEGIDQTRGWFYTLLVLATALFGQPPFKNVIVNGLVLASDGQKMSKRKKNYPDPVSIIQKYGADALRLYLINSPVVRAENLRFKEEGVRDVLKDVLLPWYNAYRFLIQNVLRLQKEEEIEFLYNENTVRESPNITDRWILSFMQSLIGFFETEMAAYRLYTVVPRLVKFVDILTNWYVRMNRRRLKGENGMEDCVMALETLFSVLLSLCRLMAPYTPFLTELMYQNLKVLIDPVSVQDKDTLSIHYLMLPRVREELIDKKTESAVSQMQSVIELGRVIRDRKTIPIKYPLKEIVVIHQDPEALKDIKSLEKYIIEELNVRKVTLSTDKNKYGIRLRAEPDHMVLGKRLKGAFKAVMTSIKQLSSEELEQFQKTGTIVVEGHELHDEDIRLMYTFDQATGGTAQFEAHSDAQALVLLDVTPDQSMVDEGMAREVINRIQKLRKKCNLVPTDEITVYYKAKSEGTYLNSVIESHTEFIFTTIKAPLKPYPVSPSDKVLIQEKTQLKGSELEITLTRGSSLPGPACAYVNLNICANGSEQGGVLLLENPKGDNRLDLLKLKSVVTSIFGVKNTELAVFHDETEIQNQTDLLSLSGKTLCVTAGSAPSLINSSSTLLCQYINPTRFPGMPKSPKWFQLVDRGPPFSLH

SEQ ID NO: 881246 - protein, 139 aa, Homo sapiens
MLQQVPENINFPAEEEKILEFWTEFNCFQECLKQSKHKPKFTFYDGPPFATGLPHYGHILAGTIKDIVTRYAHQSGFHVDRRFGWDCHGLPVEYEIDKTLGIRGPEDVAKMGITEYNNQCRAIVMRYSAEWKKLQKTSP

SEQ ID NO: 881247 - protein, 735 aa, Homo sapiens
MLQQVPENINFPAEEEKILEFWTEFNCFQECLKQSKHKPKFTFYDGPPFATGLPHYGHILAGTIKDIVTRYAHQSGFHVDRRFGWDCHGLPVEYEIDKTLGIRGPEDVAKMGITEYNNQCRAIVMRYSAEWKSTVSRLGRWIDFDNDYKTLYPQFMESVWWVFKQLYDKGLVYRGVKVMPFSTACNTPLSNFESHQNYKDVQDPSVFVTFPLEEDETVSLVAWTTTPWTLPSNLAVCVNPEMQYVKIKDVARGRLLILMEARLSALYKLESDYEILERFPGAYLKGKKYRPLFDYFLKCKENGAFTVLVDNYVKEEEGTGVVHQAPYFGAEDYRVCMDFNIIRKDSLPVCPVDASGCFTTEVTDFAGQYVKDADKSIIRTLKEQGRLLVATTFTHSYPFCWRSDTPLIYKAVPSWFVRVENMVDQLLRNNDLCYWVPELVREKRFGNWLKDARDWTISRNRYWGTPIPLWVSDDFEEVVCIGSVAELEELSGAKISDLHRESVDHLTIPSRCGKGSLHRISEVFDCWFESGSMPYAQVHYPFENKREFEDAFPADFIAEGIDQTRGWFYTLLVLATALFGQPPFKNVIVNGLVLASDGQKMSKRKKNYPDPVSIIQKYGADALRLYLINSPVVRAENLRFKEEGVRDVLKDVLLPWYNAYRFLIQNVLRLQKEEEIEFLYNENTVRESPNITDRWILSFMQSLIGFFETEMAGESLLVCPPRNKDYSLCNCPFDI

SEQ ID NO: 881248 - protein, 702 aa, Homo sapiens [sequence omitted]

SEQ ID NO: 881249 - protein, 702 aa, Homo sapiens [sequence omitted]

SEQ ID NO: 881250 - protein, 147 aa, Homo sapiens
MLQQVPENINFPAEEEKILEFWTEFNCFQECLKQSKHKPKFTFYDGPPFATGLPHYGHILAGTIKDIVTRYAHQSGFHVDRRFGWDCHGLPVEYEIDKTLGIRGPEDVAKMGITEYNNQCRAIVMRYSAEWKVCWVFFSRMNSKCSY

SEQ ID NO: 881251 - protein, 419 aa, Homo sapiens
MYPLKEIVVIHQDPEALKDIKSLEKYIIEELNVRKVTLSTDKNKYGIRLRAEPDHMVLGKRLKGAFKAVMTSIKQLSSEELEQFQKTGTIVVEGHELHDEDIRLMYTFDQATGGTAQFEAHSDAQALVLLDVTPDQSMVDEGMAREVINRIQKLRKKCNLVPTDEITVYYKAKSEGTYLNSVIESHTEFIFTTIKAPLKPYPVSPSDKVLIQEKTQLKGSELEITLTRGSSLPGPACAYVNLNICANGSEQGGVLLLENPKGDNRLDLLKLKSVVTSIFGVKNTELAVFHDETEIQNQTDLLSLSGKTLCVTAGSAPSLINSSSTLLCQYINLQLLNAKPQECLMGTVGTLLLENPLGQNGLTHQGLLYEAAKVFGLRSRKLKLFLNETQTQEITEDIPVKTLNMKTVYVSVLPTTADF

SEQ ID NO: 881252 - protein, 1262 aa, Homo sapiens; identical to SEQ ID NO: 881237

SEQ ID NO: 881253 - protein, 823 aa, Homo sapiens
MLQQVPENINFPAEEEKILEFWTEFNCFQECLKQSKHKPKFTFYDGPPFATGLPHYGHILAGTIKDIVTRYAHQSGFHVDRRFGWDCHGLPVEYEIDKTLGIRGPEDVAKMGITEYNNQCRAIVMRYSAEWKSTVSRLGRWIDFDNDYKTLYPQFMESVWWVFKQLYDKGLVYRGVKVMPFSTACNTPLSNFESHQNYKDVQDPSVFVTFPLEEDETVSLVAWTTTPWTLPSNLAVCVNPEMQYVKIKDVARGRLLILMEARLSALYKLESDYEILERFPGAYLKGKKYRPLFDYFLKCKENGAFTVLVDNYVKEEEGTGVVHQAPYFGAAPYTPFLTELMYQNLKVLIDPVSVQDKDTLSIHYLMLPRVREELIDKKTESAVSQMQSVIELGRVIRDRKTIPIKYPLKEIVVIHQDPEALKDIKSLEKYIIEELNVRKVTLSTDKNKYGIRLRAEPDHMVLGKRLKGAFKAVMTSIKQLSSEELEQFQKTGTIVVEGHELHDEDIRLMYTFDQATGGTAQFEAHSDAQALVLLDVTPDQSMVDEGMAREVINRIQKLRKKCNLVPTDEITVYYKAKSEGTYLNSVIESHTEFIFTTIKAPLKPYPVSPSDKVLIQEKTQLKGSELEITLTRGSSLPGPACAYVNLNICANGSEQGGVLLLENPKGDNRLDLLKLKSVVTSIFGVKNTELAVFHDETEIQNQTDLLSLSGKTLCVTAGSAPSLINSSSTLLCQYINLQLLNAKPQECLMGTVGTLLLENPLGQNGLTHQGLLYEAAKVFGLRSRKLKLFLNETQTQEITEDIPVKTLNMKTVYVSVLPTTADF

SEQ ID NO: 881254 - protein, 526 aa, Homo sapiens
MNRRRLKGENGMEDCVMALETLFSVLLSLCRLMAPYTPFLTELMYQNLKVLIDPVSVQDKDTLSIHYLMLPRVREELIDKKTESAVSQMQSVIELGRVIRDRKTIPIKYPLKEIVVIHQDPEALKDIKSLEKYIIEELNVRKVTLSTDKNKYGIRLRAEPDHMVLGKRLKGAFKAVMTSIKQLSSEELEQFQKTGTIVVEGHELHDEDIRLMYTFDQATGGTAQFEAHSDAQALVLLDVTPDQSMVDEGMAREVINRIQKLRKKCNLVPTDEITVYYKAKSEGTYLNSVIESHTEFIFTTIKAPLKPYPVSPSDKVLIQEKTQLKGSELEITLTRGSSLPGPACAYVNLNICANGSEQGGVLLLENPKGDNRLDLLKLKSVVTSIFGVKNTELAVFHDETEIQNQTDLLSLSGKTLCVTAGSAPSLINSSSTLLCQYINLQLLNAKPQECLMGTVGTLLLENPLGQNGLTHQGLLYEAAKVFGLRSRKLKLFLNETQTQEITEDIPVKTLNMKTVYVSVLPTTADF

SEQ ID NO: 881255 - protein, 1241 aa, Homo sapiens
MLQQVPENINFPAEEEKILEFWTEFNCFQECLKQSKHKPKFTFYDGPPFATGLPHYGHILAGTIKDIVTRYAHQSGFHVDRRFGWDCHGLPVEYEIDKTLGIRGPEDVAKMGITEYNNQCRAIVMRYSAEWKSTVSRLGRWIDFDNDYKTLYPQFMESVWWVFKQLYDKGLVYRGVKVMPFSTACNTPLSNFESHQNYKDVQDPSVFVTFPLEEDETVSLVAWTTTPWTLPSNLAVCVNPEMQYVKIKDVARGRLLILMEARLSALYKLESDYEILERFPGAYLKGKKYRPLFDYFLKCKENGAFTVLVDNYVKEEEGTGVVHQAPYFGAEDYRVCMDFNIIRKDSLPVCPVDASGCFTTEVTDFAGQYVKDADKSIIRTLKEQGRLLVATTFTHSYPFCWRSDTPLIYKAVPSWFVRVENMVDQLLRNNDLCYWVPELVREKRFGNWLKDARDWTISRNRYWGTPIPLWVSDDFEEVVCIGSVAELEELSGAKISDLHRESVDHLTIPSRCGKGSLHRISEVFDCWFESGSMPYAQVHYPFENKREFEDAFPADFIAEGIDQTRGWFYTLLVLATALFGQPPFKNVIVNGLVLASDGQKMSKRKKNYPDPVSIIQKYGADALRLYLINSPVVRAENLRFKEEGVRDVLKDVLLPWYNAYRFLIQNVLRLQKEEEIEFLYNENTVRESPNITDRWILSFMQSLIGFFETEMAAYRLYTVVPRLVKFVDILTNWYVRMNRRRLKGENGMEDCVMALETLFSVLLSLCRLMAPYTPFLTELMYQNLKVLIDPVSVQDKDTLSIHYLMLPRVREELIDKKTESAVSQMQSVIELGRVIRDRKTIPIKYPLKEIVVIHQDPEALKDIKSLEKYIIEELNVRKVTLSTDKNKYGIRLRAEPDHMVLGKRLKGAFKAVMTSIKQLSSEELEQFQKTGTIVVEGHELHDEDIRLMYTFDQATGGTAQFEAHSDAQALVLLDVTPDQSMVDEGMAREVINRIQKLRKKCNLVPTDEITVYYKAKSEGTYLNSVIESHTEFIFTTIKAPLKPYPVSPSDKVLIQEKTQLKGSELEITLTRGSSLPGPACAYVNLNICANGSEQGGVLLLENPKGDNRLDLLKLKSVVTSIFGVKNTELAVFHDETAAPSLINSSSTLLCQYINLQLLNAKPQECLMGTVGTLLLENPLGQNGLTHQGLLYEAAKVFGLRSRKLKLFLNETQTQEITEDIPVKTLNMKTVYVSVLPTTADF

SEQ ID NO: 881256 - protein, 313 aa, Homo sapiens
ARCITSVRPVAAWTPDELLLGLLARGAVQAREAPQAPYTPFLTELMYQNLKVLIDPVSVQDKDTLSIHYLMLPRVREELIDKKTESAVSQMQSVIELGRVIRDRKTIPIKLKGSELEITLTRGSSLPGPACAYVNLNICANGSEQGGVLLLENPKGDNRLDLLKLKSVVTSIFGVKNTELAVFHDETEIQNQTDLLSLSGKTLCVTAGSAPSLINSSSTLLCQYINLQLLNAKPQECLMGTVGTLLLENPLGQNGLTHQGLLYEAAKVFGLRSRKLKLFLNETQTQEITEDIPVKTLNMKTVYVSVLPTTADF

SEQ ID NO: 881257 - protein, 139 aa, Homo sapiens; identical to SEQ ID NO: 881246

SEQ ID NO: 881258 - protein, 720 aa, Homo sapiens
MLQQVPENINFPAEEEKILEFWTEFNCFQECLKQSKHKPKFTFYDGPPFATGLPHYGHILAGTIKDIVTRYAHQSGFHVDRRFGWDCHGLPVEYEIDKTLGIRGPEDVAKMGITEYNNQCRAIVMRYSAEWKSTVSRLGRWIDFDNDYKTLYPQFMESVWWVFKQLYDKGLVYRGVKVMPFSTACNTPLSNFESHQNYKDVQDPSVFVTFPLEEDETVSLVAWTTTPWTLPSNLAVCVNPEMQYVKIKDVARGRLLILMEARLSALYKLESDYEILERFPGAYLKGKKYRPLFDYFLKCKENGAFTVLVDNYVKEEEGTGVVHQAPYFGAEDYRVCMDFNIIRKDSLPVCPVDASGCFTTEVTDFAGQYVKDADKSIIRTLKEQGRLLVATTFTHSYPFCWRSDTPLIYKAVPSWFVRVENMVDQLLRNNDLCYWVPELVREKRFGNWLKDARDWTISRNRYWGTPIPLWVSDDFEEVVCIGSVAELEELSGAKISDLHRESVDHLTIPSRCGKGSLHRISEVFDCWFESGSMPYAQVHYPFENKREFEDAFPADFIAEGIDQTRGWFYTLLVLATALFGQPPFKNVIVNGLVLASDGQKMSKRKKNYPDPVSIIQKYGADALRLYLINSPVVRAENLRFKEEGVRDVLKDVLLPWYNAYRFLIQNVLRLQKEEEIEFLYNENTVRESPNITDRWILSFMQSLIGFFETEMADFLVLPSS

SEQ ID NO: 881259 - protein, 752 aa, Homo sapiens
MLQQVPENINFPAEEEKILEFWTEFNCFQECLKQSKHKPKFTFYDGPPFATGLPHYGHILAGTIKDIVTRYAHQSGFHVDRRFGWDCHGLPVEYEIDKTLGIRGPEDVAKMGITEYNNQCRAIVMRYSAEWKSTVSRLGRWIDFDNDYKTLYPQFMESVWWVFKQLYDKGLVYRGVKVMPFSTACNTPLSNFESHQNYKDVQDPSVFVTFPLEEDETVSLVAWTTTPWTLPSNLAVCVNPEMQYVKIKDVARGRLLILMEARLSALYKLESDYEILERFPGAYLKGKKYRPLFDYFLKCKENGAFTVLVDNYVKEEEGTGVVHQAPYFGAEDYRVCMDFNIIRKDSLPVCPVDASGCFTTEVTDFAGQYVKDADKSIIRTLKEQGRLLVATTFTHSYPFCWRSDTPLIYKAVPSWFVRVENMVDQLLRNNDLCYWVPELVREKRFGNWLKDARDWTISRNRYWGTPIPLWVSDDFEEVVCIGSVAELEELSGAKISDLHRESVDHLTIPSRCGKGSLHRISEVFDCWFESGSMPYAQVHYPFENKREFEDAFPADFIAEGIDQTRGWFYTLLVLATALFGQPPFKNVIVNGLVLASDGQKMSKRKKNYPDPVSIIQKYGADALRLYLINSPVVRAENLRFKEEGVRDVLKDVLLPWYNAYRFLIQNVLRLQKEEEIEFLYNENTVRESPNITDRWILSFMQSLIGFFETEMAAYRLYTVVLAKSELEIGSQPKSKGAAMMLAVATVDFSQEH

SEQ ID NO: 881260 - protein, 720 aa, Homo sapiens
MLQQVPENINFPAEEEKILEFWTEFNCFQECLKQSKHKPKFTFYDGPPFATGLPHYGHILAGTIKDIVTRYAHQSGFHVDRRFGWDCHGLPVEYEIDKTLGIRGPEDVAKMGITEYNNQCRAIVMRYSAEWKSTVSRLGRWIDFDNDYKTLYPQFMESVWWVFKQLYDKGLVYRGVKVMPFSTACNTPLSNFESHQNYKDVQDPSVFVTFPLEEDETVSLVAWTTTPWTLPSNLAVCVNPEMQYVKIKDVARGRLLILMEARLSALYKLESDYEILERFPGAYLKGKKYRPLFDYFLKCKENGAFTVLVDNYVKEEEGTGVVHQAPYFGAEDYRVCMDFNIIRKDSLPVCPVDASGCFTTEVTDFAGQYVKDADKSIIRTLKEQGRLLVATTFTHSYPFCWRSDTPLIYKAVPSWFVRVENMVDQLLRNNDLCYWVPELVREKRFGNWLKDARDWTISRNRYWGTPIPLWVSDDFEEVVCIGSVAELEELSGAKISDLHRESVDHLTIPSRCGKGSLHRISEVFDCWFESGSMPYAQVHYPFENKREFEDAFPADFIAEGIDQTRGWFYTLLVLATALFGQPPFKNVIVNGLVLASDGQKMSKRKKNYPDPVSIIQKYGADALSIDTLINSPVAEQHAKPPPFTRTQRAVRATLLYAHCSCLPLATNCPTRLPLPPEPLPEASRTGRARHLALFSTLSTPGSPDSPIPPRRVAPVLPAAP

SEQ ID NO: 881261 - protein, 771 aa, Homo sapiens
AHSLLPARSLFLCSPEARECSRRPKLGPQEAMAESRGRLYLWMCLAAALASFLMGFMVGWFIKPLKETTTSVRYHQSIRWKLVSEMKAENIKSFLRSFTKLPHLAGTEQNFLLAKKIQTQWKKFGLDSAKLVHYDVLLSYPNETNANYISIVDEHETEIFKTSYLEPPPDGYENVTNIVPPYNAFSAQGMPEGDLVYVNYARTEDFFKLEREMGINCTGKIVIARYGKIFRGNKVKNAMLAGAIGIILYSDPADYFAPEVQPYPKGWNLPGTAAQRGNVLNLNGAGDPLTPGYPAKEYTFRLDVEEGVGIPRIPVHPIGYNDAEILLRYLGGIAPPDKSWKGALNVSYSIGPGFTGSDSFRKVRMHVYNINKITRIYNVVGTIRGSVEPDRYVILGGHRDSWVFGAIDPTSGVAVLQEIARSFGKLMSKGWRPRRTIIFASWDAEEFGLLGSTEWAEENVKILQERSIAYINSDSSIEGNYTLRVDCTPLLYQLVYKLTKEIPSPDDGFESKSLYESWLEKDPSPENKNLPRINKLGSGSDFEAYFQRLGIASGRARYTKNKKTDKYSSYPVYHTIYETFELVEKFYDPTFKKQLSVAQLRGALVYELVDSKIIPFNIQDYAEALKNYAASIYNLSKKHDQQLTDHGVSFDSLFSAVKNFSEAASDFHKRLIQVDLNNPIAVRMMNDQLMLLERAFIDPLGLPGKLFYRHIIFAPSSHNKYAGESFPGIYDAIFDIENKANSRLAWKEVKKHISIAAFTIQAAAGTLKEVL

SEQ ID NO: 881262 - protein, 348 aa, Homo sapiens
AHSLLPARSLFLCSPEARECSRRPKLGPQEAMAESRGRLYLWMCLAAALASFLMGFMVGWFIKPLKETTTSVRYHQSIRWKLVSEMKAENIKSFLRSFTKLPHLAGTEQNFLLAKKIQTQWKKFGLDSAKLVHYDVLLSYPNETNANYISIVDEHETEIFKTSYLEPPPDGYENVTNIVPPYNAFSAQGMPEGDLVYVNYARTEDFFKLEREMGINCTGKIVIARYGKIFRGNKVKNAMLAGAIGIILYSDPADYFAPEVQPYPKGWNLPGTAAQRGNVLNLNGAGDPLTPGYPAKEYTFRLDVEEGVGIPRIPVHPIGYNDAEILLRYSFLVGYEIKIFCTSCLFSH

SEQ ID NO: 881263 - protein, 771 aa, Homo sapiens; identical to SEQ ID NO: 881261

SEQ ID NO: 881264 - protein, 686 aa, Homo sapiens
MKAENIKSFLRSFTKLPHLAGTEQNFLLAKKIQTQWKKFGLDSAKLVHYDVLLSYPNETNANYISIVDEHETEIFKTSYLEPPPDGYENVTNIVPPYNAFSAQGMPEGDLVYVNYARTEDFFKLEREMGINCTGKIVIARYGKIFRGNKVKNAMLAGAIGIILYSDPADYFAPEVQPYPKGWNLPGTAAQRGNVLNLNGAGDPLTPGYPAKEYTFRLDVEEGVGIPRIPVHPIGYNDAEILLRYLGGIAPPDKSWKGALNVSYSIGPGFTGSDSFRKVRMHVYNINKITRIYNVVGTIRGSVEPDRYVILGGHRDSWVFGAIDPTSGVAVLQEIARSFGKLMSKGWRPRRTIIFASWDAEEFGLLGSTEWAEENVKILQERSIAYINSDSSIEGNYTLRVDCTPLLYQLVYKLTKEIPSPDDGFESKSLYESWLEKDPSPENKNLPRINKLGSGSDFEAYFQRLGIASGRARYTKNKKTDKYSSYPVYHTIYETFELVEKFYDPTFKKQLSVAQLRGALVYELVDSKIIPFNIQDYAEALKNYAASIYNLSKKHDQQLTDHGVSFDSLFSAVKNFSEAASDFHKRLIQVDLNNPIAVRMMNDQLMLLERAFIDPLGLPGKLFYRHIIFAPSSHNKYAGESFPGIYDAIFDIENKANSRLAWKEVKKHISIAAFTIQAAAGTLKEVL

SEQ ID NO: 881265 - protein, 501 aa, Homo sapiens
AHSLLPARSLFLCSPEARECSRRPKLGPQEAMAESRGRLYLWMCLAAALASFLMGFMVGWFIKPLKETTTSVRYHQSIRWKLVSEMKAENIKSFLRSFTKLPHLAGTEQNFLLAKKIQTQWKKFGLDSAKLVHYDVLLSYPNETNANYISIVDEHETEIFKTSYLEPPPDGYENVTNIVPPYNAFSAQGMPEGDLVYVNYARTEDFFKLEREMGINCTGKIVIARYGKIFRGNKVKNAMLAGAIGIILYSDPADYFAPEVQPYPKGWNLPGTAAQRGNVLNLNGAGDPLTPGYPAKEYTFRLDVEEGVGIPRIPVHPIGYNDAEILLRYLGGIAPPDKSWKGALNVSYSIGPGFTGSDSFRKVRMHVYNINKITRIYNVVGTIRGSVEPDRYVILGGHRDSWVFGAIDPTSGVAVLQEIARSFGKLMSKADEYSGLEDFLWALGAHMWLGSPEGGVDRAVLFGAGPFVPGQIFSQGVSATPQSSSRRHSRRSRLPVFPFLC

SEQ ID NO: 881266 - protein, 491 aa, Homo sapiens
RRFPPAGAVAVIERGVRGGSQRCRTMADQLYLENIDEFVTDQNKIVTYKWLSYTLGVHVNQAKQMLYDYVERKRKENSGAQLHVTYLVSGSLIQNGHSCHKVAVVREDKLEAVKSKLAVTASIHVYSIQKAMLKDSGPLFNTDYDILKSNLQNCSKFSAIQCAAAVPRAPAESSSSSKKFEQSHLHMSSETQANNELTTNGHGPPASKQVSQQPKGIMGMFASKAAAKTQETNKETKTEAKEVTNASAAGNKAPGKGNMMSNFFGKAAMNKFKVNLDSEQAVKEEKIVEQPTVSVTEPKLATPAGLKKSSKKAEPVKVLQKEKKRGKRVALSDDETKETENMRKKRRRIKLPESDSSEDEVFPDSPGAYEAESPSPPPPPSPPLEPVPKTEPEPPSVKSSSGENKRKRKRVLKSKTYLDGEGCIVTEKVYESESCTDSEEELNMKTSSVHRPPAMTVKKEPREERKGPKKGTAALGKANRQVSITGFFQRK

SEQ ID NO: 881267 - protein, 150 aa, Homo sapiens
MRKKRRRIKLPESDSSEDEVFPDSPGAYEAESPSPPPPPSPPLEPVPKTEPEPPSVKSSSGENKRKRKRVLKSKTYLDGEGCIVTEKVYESESCTDSEEELNMKTSSVHRPPAMTVKKEPREERKGPKKGTAALGKANRQVSITGFFQRK

SEQ ID NO: 881268 - protein, 491 aa, Homo sapiens; identical to SEQ ID NO: 881266

SEQ ID NO: 881269 - protein, 110 aa, Homo sapiens
MRAKWRKKRMRRLKRKRRKMRQSPSKPLACCTVEATGAETWNARRWGCWYKLWDCMLLSRACLNGSRTSSPSDRRSPLRPTLLINKMPMLVLCPGPVTFWTISVFICGRV

SEQ ID NO: 881270 - protein, 327 aa, Homo sapiens
AHAHTVHTSVRRLPVPRLTQVLPRARNTPAGSCVCCRGSGARKKMAVPPTYADLGKSARDVFTKGYGFGLIKLDLKTKSENGLEFTSSGSANTETTKVTGSLETKYRWTEYGLTFTEKWNTDNTLGTEITVEDQLARGLKLTFDSSFSPNTGKKNAKIKTGYKREHINLGCDMDFDIAGPSIRGALVLGYEGWLAGYQMNFETAKSRVTQSNFAVGYKTDEFQLHTNVNDGTEFGGSIYQKVNKKLETAVNLAWTAGNSNTRFGIAAKYQIDPDACFSAKVNNSSLIGLGYTQTLKPGIKLTLSALLDGKNVNAGGHKLGLGLEFQA

SEQ ID NO: 881271 - protein, 317 aa, Homo sapiens
AARSAPLPGSAPCLRVAAPAVAASEPAATSSEQKMAVPPTYADLGKSARDVFTKGYGFGLIKLDLKTKSENGLEFTSSGSANTETTKVTGSLETKYRWTEYGLTFTEKWNTDNTLGTEITVEDQLARGLKLTFDSSFSPNTGKKNAKIKTGYKREHINLGCDMDFDIAGPSIRGALVLGYEGWLAGYQMNFETAKSRVTQSNFAVGYKTDEFQLHTNVNDGTEFGGSIYQKVNKKLETAVNLAWTAGNSNTRFGIAAKYQIDPDACFSAKVNNSSLIGLGYTQTLKPGIKLTLSALLDGKNVNAGGHKLGLGLEFQA

SEQ ID NO: 881272 - protein, 317 aa, Homo sapiens; identical to SEQ ID NO: 881271

SEQ ID NO: 881273 - protein, 317 aa, Homo sapiens; identical to SEQ ID NO: 881271

SEQ ID NO: 881274 - protein, 317 aa, Homo sapiens; identical to SEQ ID NO: 881271

SEQ ID NO: 881275 - protein, 317 aa, Homo sapiens; identical to SEQ ID NO: 881271

SEQ ID NO: 881276 - protein, 364 aa, Homo sapiens
MNRAPLKRSRILHMALTGASDPSAEAEANGEKPFLLRALQIALVVSLYWVTSISMVFLNKYLLDSPSLRLDTPIFVTFYQCLVTTLLCKGLSALAACCPGAVDFPSLRLDLRVARSVLPLSVVFIGMITFNNLCLKYVGVAFYNVGRSLTTVFNVLLSYLLLKQTTSFYALLTCGIIIGGFWLGVDQEGAEGTLSWLGTVFGVLASLCVSLNAIYTTKVLPAVDGSIWRLTFYNNVNACILFLPLLLLLGELQALRDFAQLGSAHFWGMMTLGGLFGFAIGYVTGLQIKFTSPLTHNVSGTAKACAQTVLAVLYYEETKSFLWWTSNMMVLGGSSAYTWVRGWEMKKTPEEPSPKDSEKSAMGV

SEQ ID NO: 881277 - protein, 364 aa, Homo sapiens; identical to SEQ ID NO: 881276

SEQ ID NO: 881278 - protein, 507 aa, Homo sapiens
HFWKCKPVARRARDTAKSRDVPAAVTEAGSRAGGGTRDRSSLGKRRGPPPTTVRITASPPAPPGPMPRTGRRGWQGARARGGKQEVDPAGAAQGAALQMQHGVAGRAPSAPEEVSARSPSRPGDTGRDAGADAAGPGRGNSIFWKGAPLKRSRILHMALTGASDPSAEAEANGEKPFLLRALQIALVVSLYWVTSISMVFLNKYLLDSPSLRLDTPIFVTFYQCLVTTLLCKGLSALAACCPGAVDFPSLRLDLRVARSVLPLSVVFIGMITFNNLCLKYVGVAFYNVGRSLTTVFNVLLSYLLLKQTTSFYALLTCGIIIGGFWLGVDQEGAEGTLSWLGTVFGVLASLCVSLNAIYTTKVLPAVDGSIWRLTFYNNVNACILFLPLLLLLGELQALRDFAQLGSAHFWGMMTLGGLFGFAIGYVTGLQIKFTSPLTHNVSGTAKACAQTVLAVLYYEETKSFLWWTSNMMVLGGSSAYTWVRGWEMKKTPEEPSPKDSEKSAMGV

SEQ ID NO: 881279 - protein, 435 aa, Homo sapiens
HFWKCKPVARRARDTAKSRDVPAAVTEAGSRAGGGTRDRSSLGKRRGPPPTTVRITASPPAPPGPMPRTGRRGWQGARARGGKQEVDPAGAAQGAALQMQHGVAGRAPSAPEEVSARSPSRPGDTGRDAGADAAGPGRGNSIFWKGAPLKRSRILHMALTGASDPSAEAEANGEKPFLLRALQIALVVSLYWVTSISMVFLNKYLLDSPSLRLDTPIFVTFYQCLVTTLLCKGLSALAACCPGAVDFPSLRLDLRVARSVLPLSVVFIGMITFNNLCLKYVGVAFYNVGRSLTTVFNVLLSYLLLKQTTSFYALLTCGIIIGGFWLGVDQEGAEGTLSWLGTVFGVLASLCVSLNAIYTTKVLPAVDGSIWRLTFYNNVNACILFLPLLLLLGELQALRDFAQLGSAHFWGMMTLGGLFGFAIGYVTGLQIKFTS

SEQ ID NO: 881280 - protein, 246 aa, Homo sapiens
MNRAPLKRSRILHMALTGASDPSAEAEANGEKPFLLRALQIALVVSLYWVTSISMVFLNKYLLDSPSLRLDTPIFVTFYQCLVTTLLCKGLSALAACCPGAVDFPSLRLDLRVARSVLPLSVVFIGMITFNNLCLKYVGVAFYNVGRSLTTVFNVLLSYLLLKQTTSFYALLTCGIIIGGFWLGVDQEGAEGTLSWLGTVFGVLASLCVSLNAIYTTKVLPAVDGSIWRLTFYNNVNACILFLPLL

SEQ ID NO: 881281 - protein, 364 aa, Homo sapiens; identical to SEQ ID NO: 881276

SEQ ID NO: 881282 - protein, 339 aa, Homo sapiens
HFWKCKPVARRARDTAKSRDVPAAVTEAGSRAGGGTRDRSSLGKRRGPPPTTVRITASPPAPPGPMPRTGRRGWQGARARGGKQEVDPAGAAQGAALQMQHGVAGRAPSAPEEVSARSPSRPGDTGRDAGADAAGPGRGNSIFWKGAPLKRSRILHMALTGASDPSAEAEANGEKPFLLRALQIALVVSLYWVTSISMVFLNKYLLDSPSLRLDTPIFVTFYQCLVTTLLCKGLSALAACCPGAVDFPSLRLDLRVARSVLPLSVVFIGMITFNNLCLKYVGVAFYNVGRSLTTVFNVLLSYLLLKQTTSFYALLTCGIIIGEWQLGPRGIEWSWGLKQ

SEQ ID NO: 881283 - protein, 78 aa, Homo sapiens
LAPDGTGRWQSACREMRPQDSTGVAELQEPGLPLTDDAPPGATEEPAAAEAAGAPDRGRCWLCLSSPCCSRTEPATLL

SEQ ID NO: 881284 - protein, 78 aa, Homo sapiens; identical to SEQ ID NO: 881283

SEQ ID NO: 881285 - protein, 615 aa, Homo sapiens
MESMFEDDISILTQEALGPSEVWLDSPGDPSLGGDMCSASHFALITAYGDIKERLGGLERENATLRRRLKVYEIKYPLISDFGEEHGFSLYEIKDGSLLEVEKVSLQQRLNQFQHELQKNKEQEEQLGEMIQAYEKLCVEKSDLETELREMRALVETHLRQICGLEQQLRQQQGLQDAAFSNLSPPPAPAPPCTDLDLHYLALRGGSGLSHAGWPGSTPSVSDLERRRLEEALEAAQGEARGAQLREEQLQAECERLQGELKQLQETRAQDLASNQSERDMAWVKRVGDDQVNLALAYTELTEELGRLRELSSLQGRILRTLLQEQARSGGQRHSPLSQRHSPAPQCPSPSPPARAAPPCPPCQSPVPQRRSPVPPCPSPQQRRSPASPSCPSPVPQRRSPVPPSCQSPSPQRRSPVPPSCPAPQPRPPPPPPPGERTLAERAYAKPPSHHVKAGFQGRRSYSELAEGAAYAGASPPWLQAEAATLPKPRAYGSELYGPGRPLSPRRAFEGIRLRFEKQPSEEDEWAVPTSPPSPEVGTIRCASFCAGFPIPESPAATAYAHAEHAQSWPSINLLMETVGSDIRSCPLCQLGFPVGYPDDALIKHIDSHLENSKI

SEQ ID NO: 881286 - protein, 118 aa, Homo sapiens
GPQEGPGPTEALTPSPAAFHCAHPGAGPREECGGRRHLWRPRVGRGPALTMESMFEDDISILTQEALGPSEVWLDSPGDPSLGGDMCSASHFALITAYGDIKERLGGLERGGRGPCAL

SEQ ID NO: 881287 - protein, 149 aa, Homo sapiens
PPHAPPQSVWPVISALGSVLNQGWIQEGVQCLGLGWGEGVRGLQELLHPSPNVHLSQTGLCLGSTHRLPLGSQSLLCALTPVPPSCGQPRAHGMGPHWGREASCFLWFPAGQSCPPFPVLPTLGNREGRRGEEREDPGGLGRSSLKRLL

SEQ ID NO: 881288 - protein, 65 aa, Homo sapiens
AARDYVLEDDRRAPHNESTLLHCAPLPGLSSGWGAVAATDSACPALIQLFQAPPPCTPPLYRAGE

SEQ ID NO: 881289 - protein, 725 aa, Homo sapiens
RAHAQGGAPPLPRGEGVYGEAAAAAAEAEAEAVAMAPFPEEVDVFTAPHWRMKQLVGLYCDKLSKTNFSNNNDFRALLQSLYATFKEFKMHEQIENEYIIGLLQQRSQTIYNVHSDNKLSEMLSLFEKGLKNVKNEYEQLNYAKQLKERLEAFTRDFLPHMKEEEEVFQPMLMEYFTYEELKDIKKKVIAQHCSQKDTAELLRGLSLWNHAEERQKFFKYSVDEKSDKEAEVSEHSTGITHLPPEVMLSIFSYLNPQELCRCSQVSMKWSQLTKTGSLWKHLYPVHWARGDWYSGPATELDTEPDDEWVKNRKDESRAFHEWDEDADIDESEESAEESIAISIAQMEKRLLHGLIHNVLPYVGTSVKTLVLAYSSAVSSKMVRQILELCPNLEHLDLTQTDISDSAFDSWSWLGCCQSLRHLDLSGCEKITDVALEKISRALGILTSHQSGFLKTSTSKITSTAWKNKDITMQSTKQYACLHDLTNKGIGEEIDNEHPWTKPVSSENFTSPYVWMLDAEDLADIEDTVEWRHRNVESLCVMETASNFSCSTSGCFSKDIVGLRTSVCWQQHCASPAFAYCGHSFCCTGTALRTMSSLPESSAMCRKAARTRLPRGKDLIYFGSEKSDQETGRVLLFLSLSGCYQITDHGLRVLTLGGGLPYLEHLNLSGCLTITGAGLQDLVSACPSLNDEYFYYCDNINGPHADTASGCQNLQCGFRACCRSGE

SEQ ID NO: 881290 - protein, 45 aa, Homo sapiens
DRQNLHLTVGLGLVAARVFGILICLVVRKSQMWPNTVRWPNTAAL

SEQ ID NO: 881291 - protein, 653 aa, Homo sapiens
RAHAQGGAPPLPRGEGVYGEAAAAAAEAEAEAVAMAPFPEEVDVFTAPHWRMKQLVGLYCDKNEYEQLNYAKQLKERLEAFTRDFLPHMKEEEEVFQPMLMEYFTYEELKDIKKKVIAQHCSQKDTAELLRGLSLWNHAEERQKFFKYSVDEKSDKEAEVSEHSTGITHLPPEVMLSIFSYLNPQELCRCSQVSMKWSQLTKTGSLWKHLYPVHWARGDWYSGPATELDTEPDDEWVKNRKDESRAFHEWDEDADIDESEESAEESIAISIAQMEKRLLHGLIHNVLPYVGTSVKTLVLAYSSAVSSKMVRQILELCPNLEHLDLTQTDISDSAFDSWSWLGCCQSLRHLDLSGCEKITDVALEKISRALGILTSHQSGFLKTSTSKITSTAWKNKDITMQSTKQYACLHDLTNKGIGEEIDNEHPWTKPVSSENFTSPYVWMLDAEDLADIEDTVEWRHRNVESLCVMETASNFSCSTSGCFSKDIVGLRTSVCWQQHCASPAFAYCGHSFCCTGTALRTMSSLPESSAMCRKAARTRLPRGKDLIYFGSEKSDQETGRVLLFLSLSGCYQITDHGLRVLTLGGGLPYLEHLNLSGCLTITGAGLQDLVSACPSLNDEYFYYCDNINGPHADTASGCQNLQCGFRACCRSGE

SEQ ID NO: 881292 - protein, 531 aa, Homo sapiens
GDGSDIKRSRPPYRSISRRGPSRYPSRYPSRYRSESYTISILVSKAIITSSRWVVIKAVCSRTSPPVCICFVRIPISITAKRTIIPVFYPVHWARGDWYSGPATELDTEPDDEWVKNRKDESRAFHEWDEDADIDESEESAEESIAISIAQMEKRLLHGLIHNVLPYVGTSVKTLVLAYSSAVSSKMVRQILELCPNLEHLDLTQTDISDSAFDSWSWLGCCQSLRHLDLSGCEKITDVALEKISRALGILTSHQSGFLKTSTSKITSTAWKNKDITMQSTKQYACLHDLTNKGIGEEIDNEHPWTKPVSSENFTSPYVWMLDAEDLADIEDTVEWRHRNVESLCVMETASNFSCSTSGCFSKDIVGLRTSVCWQQHCASPAFAYCGHSFCCTGTALRTMSSLPESSAMCRKAARTRLPRGKDLIYFGSEKSDQETGRVLLFLSLSGCYQITDHGLRVLTLGGGLPYLEHLNLSGCLTITGAGLQDLVSACPSLNDEYFYYCDNINGPHADTASGCQNLQCGFRACCRSGE

SEQ ID NO: 881293 - protein, 633 aa, Homo sapiens
RAHAQGGAPPLPRGEGVYGEAAAAAAEAEAEAVAMAPFPEEVDVFTAPHWRMKQLVGLYCDKLSKTNFSNNNDFRALLQSLYATFKEFKMHEQIENEYIIGLLQQRSQTIYNVHSDNKLSEMLSLFEKGLKNVKNEYEQLNYAKQLKERLEAFTRDFLPHMKEEEEVFQPMLMEYFTYEELKDIKKKVIAQHCSQKDTAELLRGLSLWNHAEERQKFFKYSVDEKSDKEAEVSEHSTGITHLPPEVMLSIFSYLNPQELCRCSQVSMKWSQLTKTGSLWKHLYPVHWARGDWYSGPATELDTEPDDEWVKNRKDESRAFHEWDEDADIDESEESAEESIAISIAQMEKRLLHGLIHNVLPYVGTSVKTLVLAYSSAVSSKMVRQILELCPNLEHLDLTQTDISDSAFDSWSWLGCCQSLRHLDLSGCEKITDVALEKISRALGILTSHQSGFLKTSTSKITSTAWKNKDITMQSTKQYACLHDLTNKGIGEEIDNEHPWTKPVSSENFTSPYVWMLDAEDLADIEDTVEWRHRNVESLCVMETASNFSCSTSGCFSKDIVGLRTSVCWQQHCASPAFAYCGHSFCCTGTALRTMSSLPESSAMCRKAARTRLPRGKDLIYFGIIRSQTMVSGF

SEQ ID NO: 881294 - protein, 291 aa, Homo sapiens
RAHAQGGAPPLPRGEGVYGEAAAAAAEAEAEAVAMAPFPEEVDVFTAPHWRMKQLVGLYCDKLSKTNFSNNNDFRALLQSLYATFKEFKMHEQIENEYIIGLLQQRSQTIYNVHSDNKLSEMLSLFEKGLKNVKNEYEQLNYAKQLKERLEAFTRDFLPHMKEEEEVFQPMLMEYFTYEELKDIKKKVIAQHCSQKDTAELLRGLSLWNHAEERQKFFKYSVDEKSDKEAEVSEHSTGITHLPPEVMLSIFSYLNPQELCRCSQVSMKWSQLTKTGSLWKHLYPVHWARGR

SEQ ID NO: 881295 - protein, 355 aa, Homo sapiens
RAHAQGGAPPLPRGEGVYGEAAAAAAEAEAEAVAMAPFPEEVDVFTAPHWRMKQLVGLYCDKLSKTNFSNNNDFRALLQSLYATFKEFKMHEQIENEYIIGLLQQRSQTIYNVHSDNKLSEMLSLFEKGLKNVKNEYEQLNYAKQLKERLEAFTRDFLPHMKEEEEVFQPMLMEYFTYEELKDIKKKVIAQHCSQKDTAELLRGLSLWNHAEERQKFFKYSVDEKSDKESSAMCRKAARTRLPRGKDLIYFGSEKSDQETGRVLLFLSLSGCYQITDHGLRVLTLGGGLPYLEHLNLSGCLTITGAGLQDLVSACPSLNDEYFYYCDNINGPHADTASGCQNLQCGFRACCRSGE

SEQ ID NO: 881296 - protein, 281 aa, Homo sapiens
RAHAQGGAPPLPRGEGVYGEAAAAAAEAEAEAVAMAPFPEEVDVFTAPHWRMKQLVGLYCDKLSKTNFSNNNDFRALLQSLYATFKEFKMHEQIENEYIIGLLQQRSQTIYNVHSDNKLSEMLSLFEKGLKNVKNEYEQLNYAKQLKERLEAFTRDFLPHMKEEEEVFQPMLMEYFTYEELKDIKKKVIAQHCSQKDTAELLRGLSLWNHAEERQKFFKYSVDEKSDKESSAMCRKAARTRLPRGKDLIYFGSEKSDQETGRVLLFLSLSGCYQITDHGLR

SEQ ID NO: 881297 - protein, 725 aa, Homo sapiens; identical to SEQ ID NO: 881289

SEQ ID NO: 881298 - protein, 760 aa, Homo sapiens
RAHAQGGAPPLPRGEGVYGEAAAAAAEAEAEAVAMAPFPEEVDVFTAPHWRMKQLVGLYCDKLSKTNFSNNNDFRALLQSLYATFKEFKMHEQIENEYIIGLLQQRSQTIYNVHSDNKLSEMLSLFEKGLKNVKPTTVDWKPYQITENNRITIISCIICKIYILDSYSKNEYEQLNYAKQLKERLEAFTRDFLPHMKEEEEVFQPMLMEYFTYEELKDIKKKVIAQHCSQKDTAELLRGLSLWNHAEERQKFFKYSVDEKSDKEAEVSEHSTGITHLPPEVMLSIFSYLNPQELCRCSQVSMKWSQLTKTGSLWKHLYPVHWARGDWYSGPATELDTEPDDEWVKNRKDESRAFHEWDEDADIDESEESAEESIAISIAQMEKRLLHGLIHNVLPYVGTSVKTLVLAYSSAVSSKMVRQILELCPNLEHLDLTQTDISDSAFDSWSWLGCCQSLRHLDLSGCEKITDVALEKISRALGILTSHQSGFLKTSTSKITSTAWKNKDITMQSTKQYACLHDLTNKGIGEEIDNEHPWTKPVSSENFTSPYVWMLDAEDLADIEDTVEWRHRNVESLCVMETASNFSCSTSGCFSKDIVGLRTSVCWQQHCASPAFAYCGHSFCCTGTALRTMSSLPESSAMCRKAARTRLPRGKDLIYFGSEKSDQETGRVLLFLSLSGCYQITDHGLRVLTLGGGLPYLEHLNLSGCLTITGAGLQDLVSACPSLNDEYFYYCDNINGPHADTASGCQNLQCGFRACCRSGE

SEQ ID NO: 881299 - protein, 708 aa, Homo sapiens
RAHAQGGAPPLPRGEGVYGEAAAAAAEAEAEAVAMAPFPEEVDVFTAPHWRMKQLVGLYCDKSLYATFKEFKMHEQIENEYIIGLLQQRSQTIYNVHSDNKLSEMLSLFEKGLKNVKNEYEQLNYAKQLKERLEAFTRDFLPHMKEEEEVFQPMLMEYFTYEELKDIKKKVIAQHCSQKDTAELLRGLSLWNHAEERQKFFKYSVDEKSDKEAEVSEHSTGITHLPPEVMLSIFSYLNPQELCRCSQVSMKWSQLTKTGSLWKHLYPVHWARGDWYSGPATELDTEPDDEWVKNRKDESRAFHEWDEDADIDESEESAEESIAISIAQMEKRLLHGLIHNVLPYVGTSVKTLVLAYSSAVSSKMVRQILELCPNLEHLDLTQTDISDSAFDSWSWLGCCQSLRHLDLSGCEKITDVALEKISRALGILTSHQSGFLKTSTSKITSTAWKNKDITMQSTKQYACLHDLTNKGIGEEIDNEHPWTKPVSSENFTSPYVWMLDAEDLADIEDTVEWRHRNVESLCVMETASNFSCSTSGCFSKDIVGLRTSVCWQQHCASPAFAYCGHSFCCTGTALRTMSSLPESSAMCRKAARTRLPRGKDLIYFGSEKSDQETGRVLLFLSLSGCYQITDHGLRVLTLGGGLPYLEHLNLSGCLTITGAGLQDLVSACPSLNDEYFYYCDNINGPHADTASGCQNLQCGFRACCRSGE

SEQ ID NO: 881300 - protein, 641 aa, Homo sapiens
RAHAQGGAPPLPRGEGVYGEAAAAAAEAEAEAVAMAPFPEEVDVFTAPHWRMKQLVGLYCDKLSKTNFSNNNDFRALLQSLYATFKEFKMHEQIENEYIIGLLQQRSQTIYNVHSDNKLSEMLSLFEKGLKNVKNEYEQLNYAKQLKERLEAFTRDFLPHMKEEEEVFQPMLMEYFTYEELKDIKKKVIAQHCSQKDTAELLRGLSLWNHAEERQKFFKYSVDEKSDKEAEVSEHSTGITHLPPEVMLSIFSYLNPQELCRCSQVSMKWSQLTKTGSLWKHLYPVHWARGDWYSGPATELDTEPDDEWVKNRKDESRAFHEWDEDADIDESEESAEESIAISIAQMEKRLLHGLIHNVLPYVGTSVKTLVLAYSSAVSSKMVRQILELCPNLEHLDLTQTDISDSAFDSWSWLGCCQSLRHLDLSGCEKITDVALEKISRALGILTSHQSGFLKTSTSKITSTAWKNKDITMQSTKQYACLHDLTNKGIGEEIDNEHPWTKPVSSENFTSPYVWMLDAEDLADIEDTVEWRHRNVESLCVMETASNFSCSTSGCFSKDIVGLRTSVCWQQHCASPAFAYCGHSFCCTGTALRTMSSLPESSAMCRKAARTRLPRGKDLIYFGIGKWKKNFDSKKNLGPRDP

SEQ ID NO: 881301 - protein, 620 aa, Homo sapiens
RAHAQGGAPPLPRGEGVYGEAAAAAAEAEAEAVAMAPFPEEVDVFTAPHWRMKQLVGLYCDKLSKTNFSNNNDFRALLQSLYATFKEFKMHEQIENEYIIGLLQQRSQTIYNVHSDNKLSEMLSLFEKGLKNVKNEYEQLNYAKQLKERLEAFTRDFLPHMKEEEEVFQPMLMEYFTYEELKDIKKKVIAQHCSQKDTAELLRGLSLWNHAEERQKFFKYSVDEKSDKEAEVSEHSTGITHLPPEVMLSIFSYLNPQELCRCSQVSMKWSQLTKTGSLWKHLYPVHWARGDWYSGPATELDTEPDDEWVKNRKDESRAFHEWDEDADIDESEESAEESIAISIAQMEKRLLHGLIHNVLPYVGTSVKTLVLAYSSAVSSKMVRQILELCPNLEHLDLTQTDISDSAFDSWSWLGCCQSLRHLDLSGCEKITDVALEKISRALGILTSHQSGFLKTSTSKITSTAWKNKDITMQSTKQYACLHDLTNKGIGEEIDNEHPWTKPVSSENFTSPYVWMLDAEDLADIEDTVEWRHRNVESLCVMETASNFSCSTSGCFSKDIVGLRTSVCWQQHCASPAFAYCGHSFCCTGTALRTMSSLPESSAMCRKFWEVDTSRIPDRTG

SEQ ID NO: 881302 - protein, 136 aa, Homo sapiens
RAHAQGGAPPLPRGEGVYGEAAAAAAEAEAEAVAMAPFPEEVDVFTAPHWRMKQLVGLYCDKLSKTNFSNNNDFRALLQSLYATFKEFKMHEQIENEYIIGLLQQRSQTIYNVHSDNKLSEMLSLFEKGLKNVKKG

SEQ ID NO: 881303 - protein, 653 aa, Homo sapiens
MEVAMVSAESSGCNSHMPYGYAAQARARERERLAHSRAAAAAAVAAATAAVEGSGGSGGGSHHHHQSRGACTSHDPQSSRGSRRRRRQRSEKKKAHYRQSSFPHCSDLMPSGSEEKILRELSEEEEDEEEEEEEEEEGRFYYSEDDHGDECSYTDLLPQDEGGGGYSSVRYSDCCERVVINVSGLRFETQMKTLAQFPETLLGDPEKRTQYFDPLRNEYFFDRNRPSFDAILYYYQSGGRLKRPVNVPFDIFTEEVKFYQLGEEALLKFREDEGFVREEEDRALPENEFKKQIWLLFEYPESSSPARGIAIVSVLVILISIVIFCLETLPEFRDDRDLVMALSAGGHGGLLNDTSAPHLENSGHTIFNDPFFIVETVCIVWFSFEFVVRCFACPSQALFFKNIMNIIDIVSILPYFITLGTDLAQQQGGGNGQQQQAMSFAILRIIRLVRVFRIFKLSRHSKGLQILGHTLRASMRELGLLIFFLFIGVILFSSAVYFAEADEPTTHFQSIPDAFWWAVVTMTTVGYGDMKPITVGGKIVGSLCAIAGVLTIALPVPVIVSNFNYFYHRETENEEQTQLTQNAVSCPYLPSNLLKKFRSSTSSSLGDKSEYLEMEEGVKESLCAKEEKCQGKGDDSETDKNNCSNAKAVETDV

SEQ ID NO: 881304 - protein, 205 aa, Homo sapiens
MLQQDSNDDTEDVSLFDAEEETTNRPRKAKIRHPVASFFHLFFRVSAIIVYLLCELLSSSFITCMVTIILLLSCDFWAVKNVTGRLMVGLRWWNHIDEDGKSHWVFESRKESSQENKTVSEAESRIFWLGLIACPVLWVIFAFSALFSFRVKWLAVVIMGVVLQGANLYGYIRCKVRSRKHLTSMATSYFGKQFLRQNTGDDQTS

SEQ ID NO: 881305 - protein, 205 aa, Homo sapiens; identical to SEQ ID NO: 881304

SEQ ID NO: 881306 - protein, 119 aa, Homo sapiens
MVGLRWWNHIDEDGKSHWVFESRKESSQENKTVSEAESRIFWLGLIACPVLWVIFAFSALFSFRVKWLAVVIMGVVLQGANLYGYIRCKVRSRKHLTSMATSYFGKQFLRQNTGDDQTS

SEQ ID NO: 881307 - protein, 205 aa, Homo sapiens; identical to SEQ ID NO: 881304

SEQ ID NO: 881308 - protein, 205 aa, Homo sapiens; identical to SEQ ID NO: 881304

SEQ ID NO: 881309 - protein, 138 aa, Homo sapiens
PRHRAFWGRSSTKSKMAASRRLMKELEEIRKCGMKNFRNIQVDEANLLTWQGLIVPDNPPYDKGAFRIEINFPAEYPFKPPKITFKTKIYHPNIDEKGQVCLPVISAENWKPATKTDQVIQSLIALVNDPQPEHPLRA

SEQ ID NO: 881310 - protein, 105 aa, Homo sapiens
MKNFRNIQVDEANLLTWQGLIVPDNPPYDKGAFRIEINFPAEYPFKPPKITFKTKIYHPNIDEKGQVCLPVISAENWKPATKTDQVIQSLIALVNDPQPEHPLRA

SEQ ID NO: 881311 - protein, 138 aa, Homo sapiens; identical to SEQ ID NO: 881309

SEQ ID NO: 881312 - protein, 138 aa, Homo sapiens; identical to SEQ ID NO: 881309

SEQ ID NO: 881313 - protein, 138 aa, Homo sapiens; identical to SEQ ID NO: 881309

SEQ ID NO: 881314 - protein, 105 aa, Homo sapiens; identical to SEQ ID NO: 881310

SEQ ID NO: 881315 - protein, 105 aa, Homo sapiens; identical to SEQ ID NO: 881310

SEQ ID NO: 881316 - protein, 100 aa, Homo sapiens
CRLLLLNSRPLDQGLIVPDNPPYDKGAFRIEINFPAEYPFKPPKITFKTKIYHPNIDEKGQVCLPVISAENWKPATKTDQVIQSLIALVNDPQPEHPLRA

SEQ ID NO: 881317 - protein, 138 aa, Homo sapiens; identical to SEQ ID NO: 881309

SEQ ID NO: 881318 - protein, 108 aa, Homo sapiens
FGTVGAASSEADEELEEIRKCGMKNFRNIQVDEANLLTWQGLIVPDNPPYDKGAFRIEINFPAEYPFKPPKITFKTKIYHPNIDEKGQVCLPVISAENWKPATKTDQA

SEQ ID NO: 881319 - protein, 136 aa, Homo sapiens
PRHRAFWGRSSTKSKMAASRRLMKELEEIRKCGMKNFRNIQVDEANLLTWQGLIVPDNPPYDKGAFRIEINFPAEYPFKPPKITFKTKIYHPNIDEKGQVCLPVISAENWKPATKTDQETSAFPIMASLRSSLEVL

SEQ ID NO: 881320 - protein, 138 aa, Homo sapiens; identical to SEQ ID NO: 881309

SEQ ID NO: 881321 - protein, 138 aa, Homo sapiens; identical to SEQ ID NO: 881309

SEQ ID NO: 881322 - protein, 138 aa, Homo sapiens; identical to SEQ ID NO: 881309

SEQ ID NO: 881323 - protein, 138 aa, Homo sapiens; identical to SEQ ID NO: 881309

SEQ ID NO: 881324 - protein, 105 aa, Homo sapiens; identical to SEQ ID NO: 881310

SEQ ID NO: 881325 - protein, 106 aa, Homo sapiens
PRHRAFWGRSSTKSKMAASRRLMKDNPPYDKGAFRIEINFPAEYPFKPPKITFKTKIYHPNIDEKGQVCLPVISAENWKPATKTDQVIQSLIALVNDPQPEHPLRA

SEQ ID NO: 881326 - protein, 136 aa, Homo sapiens; identical to SEQ ID NO: 881319

SEQ ID NO: 881327 - protein, 105 aa, Homo sapiens; identical to SEQ ID NO: 881310

SEQ ID NO: 881328 - protein, 138 aa, Homo sapiens; identical to SEQ ID NO: 881309

SEQ ID NO: 881329 - protein, 196 aa, Homo sapiens
RRQYPGVIGSEAGVARLLRRQPAAPWLTSAPASARGVAAGPGDGGRKRERRRAGKTPRGTARPPHPKQRSKQKARRRTRSSSSSSSSSSSSSSSSSSSSSSSSSDGRKKRGKYKDKRRKKKKKRKKLKKKGKEKAEAQQVEALPGPSLDQWHRSAGEEEDGPVLTDEQKSRIQAMKPMTKEEWDARQKHHPQGGGP

SEQ ID NO: 881330 - protein, 249 aa, Homo sapiens
MPRCTYQLEQNPGFLPDGPGVHARAHCQDLSGPYGHEFATSESLGGRVGKTRAPQSGARSRMERAGPAGEEGGAREGRLLPRAPGAWVLRACAERAALEVGAASADTGVRGCGARGPAPLLASAGGGRARDGTWGVRTKGSGAALPSRPASRAAPRPEASSPPLPLEKARGGLSGPQGGRARGAMAHVGSRKRSRSRSRSRGRGSEKRKKKSRKDTSRNCSASTSQAEKQAEGPEENKIQLLLLFFQFF

SEQ ID NO: 881331 - protein, 260 aa, Homo sapiens
MPRCTYQLEQNPGFLPDGPGVHARAHCQDLSGPYGHEFATSESLGGRVGKTRAPQSGARSRMERAGPAGEEGGAREGRLLPRAPGAWVLRACAERAALEVGAASADTGVRGCGARGPAPLLASAGGGRARDGTWGVRTKGSGAALPSRPASRAAPRPEASSPPLPLEKARGGLSGPQGGRARGAMAHVGSRKRSRSRSRSRGRGSEKRKKKSRKDTSRNCSASTSQGRKASTAPGAEAEKQAEGPEENKIQLLLLFFQFF

SEQ ID NO: 881332 - protein, 216 aa, Homo sapiens
RLGRRRVLNLAEGFLSRRRGAGCPARRAVEPAAPWLTSAPASARGVAAGPGDGGRKRERRRAGKTPRGTARPPHPKVARPARPLGRRQRSKQKARRRTRSSSSSSSSSSSSSSSSSSSSSSSSSDGRKKRGKYKDKRRKKKKKRKKLKKKGKEKAEAQQVEALPGPSLDQWHRSAGEEEDGPVLTDEQKSRIQAMKPMTKEEWDARQKHHPQGGGP

SEQ ID NO: 881333 - protein, 196 aa, Homo sapiens; identical to SEQ ID NO: 881329

SEQ ID NO: 881334 - protein, 403 aa, Homo sapiens
MPRCTYQLEQNPGFLPDGPGVHARAHCQDLSGPYGHEFATSESLGGRVGKTRAPQSGARSRMERAGPAGEEGGAREGRLLPRAPGAWVLRACAERAALEVGAASADTGVRGCGARGPAPLLASAGGGRARDGTWGVRTKGSGAALPSRPASRAAPRPEASSPPLPLEKARGGLSGPQGGRGGNGAAPGAPLRRRGREGRGAGGVGERGKAPQTPLAADGGQFPGVWSRPAAPWLTSAPASARGVAAGPGDGGRKRERRRAGKTPRGTARPPHPKQRSKQKARRRTRSSSSSSSSSSSSSSSSSSSSSSSSSDGRKKRGKYKDKRRKKKKKRKKLKKKGKEKAEAQQVEALPGPSLDQWHRSAGEEEDGPVLTDEQKSRIQAMKPMTKEEWDARQKHHPQGGGP

SEQ ID NO: 881335 - protein, 219 aa, Homo sapiens
MGLGSMPALTAKIFLAPTDTSLRPLSHWVGASERPGRLSLELAVPAAPWLTSAPASARGVAAGPGDGGRKRERRRAGKTPRGTARPPHPKQRSKQKARRRTRSSSSSSSSSSSSSSSSSSSSSSSSSDGRKKRGKYKDKRRKKKKKRKKLKKKGKEKAEAQQVEALPGPSLDQWHRSAGEEEDGPVLTDEQKSRIQAMKPMTKEEWDARQKHHPQGGGP

SEQ ID NO: 881336 - protein, 447 aa, Homo sapiens
MPRCTYQLEQNPGFLPDGPGVHARAHCQDLSGPYGHEFATSESLGGRVGKTRAPQSGARSRMERAGPAGEEGGAREGRLLPRAPGAWVLRACAERAALEVGAASADTGVRGCGARGPAPLLASAGGGRARDGTWGVRTKGSGAALPSRPASRAAPRPEASSPPLPLEKARGGLSGPQGGRGGNGAAPGAPLRRRGREGRGAGGYESAGKRPRRHSRRTAASSQGFGAGCAGVGPPGTGRALNRHRCGDWSRRRKPGSPALGPAAPWLTSAPASARGVAAGPGDGGRKRERRRAGKTPRGTARPPHPKVARPARPLGRRQRSKQKARRRTRSSSSSSSSSSSSSSSSSSSSSSSSSDGRKKRGKYKDKRRKKKKKRKKLKKKGKEKAEAQQVEALPGPSLDQWHRSAGEEEDGPVLTDEQKSRIQAMKPMTKEEWDARQKHHPQGGGP

SEQ ID NO: 881337 - protein, 216 aa, Homo sapiens; identical to SEQ ID NO: 881332

SEQ ID NO: 881338 - protein, 230 aa, Homo sapiens
MGLGSMPALTAKIFLAPTDTSLRPLSHWVGASERPGRLSLELAVPAAPWLTSAPASARGVAAGPGDGGRKRERRRAGKTPRGTARPPHPKVARPARPLGRRQRSKQKARRRTRSSSSSSSSSSSSSSSSSSSSSSSSSDGRKKRGKYKDKRRKKKKKRKKLKKKGKEKAEAQQVEALPGPSLDQWHRSAGEEEDGPVLTDEQKSRIQAMKPMTKEEWDARQKHHPQGGGP

SEQ ID NO: 881339 - protein, 274 aa, Homo sapiens [sequence omitted]

SEQ ID NO: 881340 - protein, 216 aa, Homo sapiens; identical to SEQ ID NO: 881332

SEQ ID NO: 881341 - protein, 216 aa, Homo sapiens; identical to SEQ ID NO: 881332

SEQ ID NO: 881342 - protein, 216 aa, Homo sapiens; identical to SEQ ID NO: 881332

SEQ ID NO: 881343 - protein, 127 aa, Homo sapiens
ELGTLAYGKAKHPSGVEETRKMNHVTEIEKATYGVVPWPCHMQLHMARRKKKKKRKKLKKKGKEKAEAQQVEALPGPSLDQWHRSAGEEEDGPVLTDEQKSRIQAMKPMTKEEWDARQKHHPQGGGP

SEQ ID NO: 881344 - protein, 276 aa, Homo sapiens
MPRCTYQLEQNPGFLPDGPGVHARAHCQDLSGPYGHEFATSESLGGRVGKTRAPQSGARSRMERAGPAGEEGGAREGRLLPRAPGAWVLRACAERAALEVGAASADTGVRGCGARGPAPLLASAGGGRARDGTWGVRTKGSGAALPSRPASRAAPRPEASSPPLPLEKARGGLSGPQGGRARGAMAHVGSRKRSRSRSRSRGRGSEKRKKKSRKDTSRNCSASTSQGRKASTAPGAEVLLAPLLPPRPPPLPPVMAGRSGGSTRTRGGRRRRRGRS

SEQ ID NO: 881345 - protein, 438 aa, Homo sapiens
MPRCTYQLEQNPGFLPDGPGVHARAHCQDLSGPYGHEFATSESLGGRVGKTRAPQSGARSRMERAGPAGEEGGAREGRLLPRAPGAWVLRACAERAALEVGAASADTGVRGCGARGPAPLLASAGGGRARDGTWGVRTKGSGAALPSRPASRAAPRPEASSPPLPLEKARGGLSGPQGGRGGNGAAPGAPLRRRGREGRGAGGYESAGKRPRRHSRRTAASSQGFGAGCAGVGPPGTGRALNRHRCGDWSRRRKPGSPALGPAAPWLTSAPASARGVAAGPGDGGRKRERRRAGKTPRGTARPPHPKVARPARPLGRRVRTTGIGERRRSYYPGKSGEQWSGTLSHASVQPGLRCEGQAPQEPGRGSSGKLHLCSGKPLRKRSPCSRSVPAPGQSRGRRFTSSPPGFPASPSPCITEKQAEGPEENKIQLLLLFFQFF

SEQ ID NO: 881346 - protein, 260 aa, Homo sapiens; identical to SEQ ID NO: 881331

SEQ ID NO: 881347 - protein, 260 aa, Homo sapiens; identical to SEQ ID NO: 881331

SEQ ID NO: 881348 - protein, 249 aa, Homo sapiens; identical to SEQ ID NO: 881330

SEQ ID NO: 881349 - protein, 249 aa, Homo sapiens; identical to SEQ ID NO: 881330

SEQ ID NO: 881350 - protein, 308 aa, Homo sapiens
MPRCTYQLEQNPGFLPDGPGVHARAHCQDLSGPYGHEFATSESLGGRVGKTRAPQSGARSRMERAGPAGEEGGAREGRLLPRAPGAWVLRACAERAALEVGAASADTGVRGCGARGPAPLLASAGGGRARDGTWGVRTKGSGAALPSRPASRAAPRPEASSPPLPLEKARGGLSGPQGGRGGNGAAPGAPLRRRGREGRGAGGPRRHGSRRLPQALEESQPVPGTGVGKEKEEEQERHLEELLGLHIPSREASRRPGGEQDPAPPPLLPVLLAPLLPPRPPPLPPVMAGRSGGSTRTRGGRRRRRGRS

SEQ ID NO: 881351 - protein, 249 aa, Homo sapiens; identical to SEQ ID NO: 881330

SEQ ID NO: 881352 - protein, 189 aa, Homo sapiens
MSAVVIGRGRRAVEPAAPWLTSAPASARGVAAGPGDGGRKRERRRAGKTPRGTARPPHPKQRSKQKARRRTRSSSSSSSSSSSSSSSSSSSSSSSSSDGRKKRGKYKDKRRKKKKKRKKLKKKGKEKAEAQQVEALPGPSLDQWHRSAGEEEDGPVLTDEQKSRIQAMKPMTKEEWDARQKHHPQGGGP

SEQ ID NO: 881353 - protein, 216 aa, Homo sapiens; identical to SEQ ID NO: 881332

SEQ ID NO: 881354 - protein, 308 aa, Homo sapiens; identical to SEQ ID NO: 881350

SEQ ID NO: 881355 - protein, 372 aa, Homo sapiens
MGLGSMPALTAKIFLAPTDTSLRPLSHWVGASERPGASVWSSQSYGEGRTSRGGGRRARGSPSSQGTGGVGAAGVRREGSLGSGRSFGRHRREGLRSSRAGAPACLCGRWARPGRNLGRQNERQRRRASQPASLPRSAPAGSLLAAASSREGAGRAVRPAGRSRWERSSPGGPLEAARPRRARGWRPAAPWLTSAPASARGVAAGPGDGGRKRERRRAGKTPRGTARPPHPKVARPARPLGRRQRSKQKARRRTRSSSSSSSSSSSSSSSSSSSSSSSSSDGRKKRGKYKDKRRKKKKKRKKLKKKGKEKAEAQQVEALPGPSLDQWHRSAGEEEDGPVLTDEQKSRIQAMKPMTKEEWDARQKHHPQGGGP

SEQ ID NO: 881356 - protein, 190 aa, Homo sapiens
ARYEAWVVPARSAVEPAAPWLTSAPASARGVAAGPGDGGRKRERRRAGKTPRGTARPPHPKQRSKQKARRRTRSSSSSSSSSSSSSSSSSSSSSSSSSDGRKKRGKYKDKRRKKKKKRKKLKKKGKEKAEAQQVEALPGPSLDQWHRSAGEEEDGPVLTDEQKSRIQAMKPMTKEEWDARQKHHPQGGGP

SEQ ID NO: 881357 - protein, 213 aa, Homo sapiens
MSTTQWERSSPGGPLEAARPRRARGWRPAAPWLTSAPASARGVAAGPGDGGRKRERRRAGKTPRGTARPPHPKVARPARPLGRRQRSKQKARRRTRSSSSSSSSSSSSSSSSSSSSSSSSSDGRKKRGKYKDKRRKKKKKRKKLKKKGKEKAEAQQVEALPGPSLDQWHRSAGEEEDGPVLTDEQKSRIQAMKPMTKEEWDARQKHHPQGGGP

SEQ ID NO: 881358 - protein, 260 aa, Homo sapiens
MPRCTYQLEQNPGFLPDGPGVHARAHCQDLSGPYGHEFATSESLGGRVGKTRAPQSGARSRMERAGPAGEEGGAREGRLLPRAPGAWVLRACAERAALEVGAASADTGVRGCGARGPAPLLASAGGGRARDGTWGVRTKGSGAALPSRPASRAAPRPEASSPPLPLEKARGGLSGPQGGRGGNGAAPGAPLRRRGREGRGAGGPRRHGSRRLPQALEESQPVPGTGVGKEKEEEQERHLEELLGLHIPRSQGQHGPWGGG

SEQ ID NO: 881359 - protein, 485 aa, Homo sapiens
MPRCTYQLEQNPGFLPDGPGVHARAHCQDLSGPYGHEFATSESLGGRVGKTRAPQSGARSRMERAGPAGEEGGAREGRLLPRAPGAWVLRACAERAALEVGAASADTGVRGCGARGPAPLLASAGGGRARDGTWGVRTKGSGAALPSRPASRAAPRPEASSPPLPLEKARGGLSGPQGGRGGNGAAPGAPLRRRGREGRGAGGYESAGKRPRRHSRRTAASSQGFGAGCAGVGPPGTGRALNRHRCGDWSRRRKPGSPALGVGEGRSFSRDGDGYWASPGPGPARATLGARPRPALGASAQARLLRRQPAAPWLTSAPASARGVAAGPGDGGRKRERRRAGKTPRGTARPPHPKVARPARPLGRRVRTTGIGERRRSYYPGKSGEQWSGTLSHASVQPGLRCEGQAPQEPGRGSSGKLHLCSGKPLRKRSPCSRSVPAPGQSRGRRFTSSPPGFPASPSPCITEKQAEGPEENKIQLLLLFFQFF

SEQ ID NO: 881360 - protein, 150 aa, Homo sapiens
MAHVGSRKRSRSRSRSRGRGSQRSKQKARRRTRSSSSSSSSSSSSSSSSSSSSSSSSSDGRKKRGKYKDKRRKKKKKRKKLKKKGKEKAEAQQVEALPGPSLDQWHRSAGEEEDGPVLTDEQKSRIQAMKPMTKEEWDARQKHHPQGGGP

SEQ ID NO: 881361 - protein, 197 aa, Homo sapiens
MGAGGLSPVDWSLAQPSLFSGAGGGGWGHRPAWHPHLKEQHFSAIKGPLDRPPGNFSQKKGGAQKTPRGAPSMQYNAFWCKRGPQESALKQNRTRVLTTRSDNVTSVIVSKTAQHPVLRETGQYATNIASQEQETNTQWRHTTELVGDTYLDDYDTSLKRQSRVERLPEHSRKRSDCSKDASTGSTDDSTSSHRRKG

SEQ ID NO: 881362 - protein, 216 aa, Homo sapiens; identical to SEQ ID NO: 881332

SEQ ID NO: 881363 - protein, 308 aa, Homo sapiens; identical to SEQ ID NO: 881350

SEQ ID NO: 881364 - protein, 249 aa, Homo sapiens; identical to SEQ ID NO: 881330

SEQ ID NO: 881365 - protein, 372 aa, Homo sapiens; identical to SEQ ID NO: 881355

SEQ ID NO: 881366 - protein, 267 aa, Homo sapiens
MPRCTYQLEQNPGFLPDGPGVHARAHCQDLSGPYGHEFATSESLGGRVGKTRAPQSGARSRMERAGPAGEEGGAREGRLLPRAPGAWVLRACAERAALEVGAASADTGVRGCGARGPAPLLASAGGGRARDGTWGVRTKGSGAALPSRPASRAAPRPEASSPPLPLEKARGGLSGPQGGRARGAMAHVGSRKRSRSRSRSRGRGSEKRKKKSIIRKVVDPETGRTRLIKGDGEVLEEIVTKERHREINKQATRGDCLAFQMRAGLLP

SEQ ID NO: 881367 - protein, 68 aa, Homo sapiens
SVPTLSLWGRAGFLVPEKGQMWAKIRSLGVSSCRGWKGLEEALERAVVGRAEAGKAEPSSTAFIRESG

SEQ ID NO: 881368 - protein, 119 aa, Homo sapiens
MCCTLAWGPTGCGLDAFPLGGSFLPRSPPLWRGPRRPPVGPPLQTALSLLGCLQPGPAHACPPEKYVAFQKEVGDHGQALWTLTSAPPPVPQGPRPGGPRPAFLGLQVAQWCRGIQTFC

SEQ ID NO: 881369 - protein, 133 aa, Homo sapiens
MCARVCLCVCTRVHVTTGAFRVWYKMVLKWQRFFVFVCFVSLEKEKERKIMQNRKHSDWTTGSYSDQSLPLLASYTIVIFMSKEAKTCNTIFSRQKKELSIKCINIFDLNIWMALGASRASILRMECLEKRDF

SEQ ID NO: 881370 - protein, 224 aa, Homo sapiens
MGRARAPARVEARTAAPPPGVEGVGACWVGVVVRVCVCARLCVCVRVCACVCLCVCASCVCVCVRVCVRVCVYVCTRVCVCTCVSLHACLCMCARVCLCVCTRVHVTTGAFRVWYKMVLKWQRFFVFVCFVSLEKEKERKIMQNRKHSDWTTGSYSDQSLPLLASYTIVIFMSKEAKTCNTIFSRQKKELSIKCINIFDLNIWMALGASRASILRMECLEKRDF

SEQ ID NO: 881371 - protein, 119 aa, Homo sapiens; identical to SEQ ID NO: 881368

SEQ ID NO: 881372 - protein, 133 aa, Homo sapiens; identical to SEQ ID NO: 881369

SEQ ID NO: 881373 - protein, 83 aa, Homo sapiens
LLQFGLTGSRAQPTETPLCTPHKSNEKMGRKRVLRLLLLGRRVGGQGHSRARLVEAQVRAHTAVWGTLQPLRRRPRAPSLGLS

SEQ ID NO: 881374 - protein, 187 aa, Homo sapiens
MGIQSRGVHSRGQATSTMGQCVTKCKNPSSTLGSKNGDREPSNKSHSRRGAGHREEQVPPCGKPGGDILVNGTKKAEAATEACQLPTSSGDAGRESKSNAEESSLQRLEELFRRYKDEREDAILEEGMERFCNDLCVDPTEFRVLLLAWKFQAATMCKFTRLVTNTLCHQVSSGGKGTALGSGAQLG

SEQ ID NO: 881375 - protein, 321 aa, Homo sapiens
MGIQSRGVHSRGQATSTMGQCVTKCKNPSSTLGSKNGDREPSNKSHSRRGAGHREEQVPPCGKPGGDILVNGTKKAEAATEACQLPTSSGDAGRESKSNAEESSLQRLEELFRRYKDEREDAILEEGMERFCNDLCVDPTEFRVLLLAWKFQAATMCKFTRKEFFDGCKAISADSIDGICARFPSLLTEAKQEDKFKDLYRFTFQFGLDSEEGQRSLHREIAIALWKLVFTQNNPPVLDQWLNFLTENPSGIKGISRDTWNMFLNFTQVIGPDLSNYSEDEAWPSLFDTFVEWEMERRKREGEGRGALSSGPEGLCPEEQT

SEQ ID NO: 881376 - protein, 1657 aa, Homo sapiens
MGVGWDSFSSPWRRRRTAWACGETSSSEAEKAQGAAVARTTRTCCCSSRVCTGLGPSGARSLGPGAHLRLALAQPAVMEAATTLHPGPRPALPLGGPGPLGEFLPPPECPVFEPSWEEFADPFAFIHKIRPIAEQTGICKVRPPPDWQPPFACDVDKLHFTPRIQRLNELEAQTRVKLNFLDQIAKYWELQGSTLKIPHVERKILDLFQLNKLVAEEGGFAVVCKDRKWTKIATKMGFAPGKAVGSHIRGHYERILNPYNLFLSGDSLRCLQKPNLTTDTKDKEYKPHDIPQRQSVQPSETCPPARRAKRMRAERQSLAVLPRLECSGAILAHCNLRLLDSSNSSASASQAMNIKIEPEETTEARTHNLRRRMGCPTPKCENEKEMKSSIKQEPIERKDYIVENEKEKPKSRSKKATNAVDLYVCLLCGSGNDEDRLLLCDGCDDSYHTFCLIPPLHDVPKGDWRCPKCLAQECSKPQEAFGFEQAARDYTLRTFGEMADAFKSDYFNMPVHMVPTELVEKEFWRLVSTIEEDVTVEYGADIASKEFGSGFPVRDGKIKLSPEEEEYLDSGWNLNNMPVMEQSVLAHITADICGMKLPWLYVGMCFSSFCWHIEDHWSYSINYLHWGEPKTWYGVPGYAAEQLENVMKKLAPELFVSQPDLLHQLVTIMNPNTLMTHEVPVYRTNQCAGEFVITFPRAYHSGFNQGFNFAEAVNFCTVDWLPLGRQCVEHYRLLHRYCVFSHDEMICKMASKADVLDVVVASTVQKDMAIMIEDEKALRETVRKLGVIDSERMDFELLPDDERQCVKCKTTCFMSAISCSCKPGLLVCLHHVKELCSCPPYKYKLRYRYTLDDLYPMMNALKLRAESYNEWALNVNEALEAKINKKKSLVSFKALIEESEMKKFPDNDLLRHLRLVTQDAEKCASVAQQLLNGKRQTRYRSGGGKSQNQLTVNELRQFVTQLYALPCVLSQTPLLKDLLNRVEDFQQHSQKLLSEETPSAAELQDLLDVSFEFDVELPQLAEMRIRLEQARWLEEVQQACLDPSSLTLDDMRRLIDLGVGLAPYSAVEKAMARLQELLTVSEHWDDKAKSLLKARPRHSLNSLATAVKEIEEIPAYLPNGAALKDSVQRARDWLQDVEGLQAGGRVPVLDTLIELVTRGRSIPVHLNSLPRLETLVAEVQAWKECAVNTFLTENSPYSLLEVLCPRCDIGLLGLKRKQRKLKEPLPNGKKKSTKLESLSDLERALTESKETASAMATLGEARLREMEALQSLRLANEGKLLSPLQDVDIKICLCQKAPAAPMIQCELCRDAFHTSCVAVPSISQGLRIWLCPHCRRSEKPPLEKILPLLASLQRIRVRLPEGDALRYMIERTVNWQHRAQQLLSSGNLKFVQDRVGSGLLYSRWQASAGQVSDTNKVSQPPGTTSFSLPDDWDNRTSYLHSPFSTGRSCIPLHGVSPEVNELLMEAQLLQVSLPEIQELYQTLLAKPSPAQQTDRSSPVRPSSEKNDCCRGKRDGINSLERKLKRRLEREGLSSERWERVKKMRTPKKKKIKLSHPKDMNNFKLERERSYELVRSAETHSLPSDTSYSEQEDSEDEDAICPAVSCLQPEGDEVDWVQCDGSCNQWFHQVCVGVSPEMAEKEDYICVRCTVKDAPSRK

SEQ ID NO: 881377 - protein, 1657 aa, Homo sapiens; identical to SEQ ID NO: 881376

SEQ ID NO: 881378 - protein, 1583 aa, Homo sapiens
MGVGWDSFSSPWRRRRTAWACGETSSSEAEKAQGAAVARTTRTCCCSSRVCTGLGPSGARSLGPGAHLRLALAQPAVMEAATTLHPGPRPALPLGGPGPLGEFLPPPECPVFEPSWEEFADPFAFIHKIRPIAEQTGICKVRPPPDWQPPFACDVDKLHFTPRIQRLNELEAQTRVKLNFLDQIAKYWELQGSTLKIPHVERKILDLFQLNKLVAEEGGFAVVCKDRKWTKIATKMGFAPGKAVGSHIRGHYERILNPYNLFLSGDSLRCLQKPNLTTDTKDKEYKPHDIPQRQSVQPSETCPPARRAKRMRAEAMNIKIEPEETTEARTHNLRRRMGCPTPKCENEKEMKSSIKQEPIERKDYIVENEKEKPKSRSKKATNAVDLYVCLLCGSGNDEDRLLLCDGCDDSYHTFCLIPPLHDVPKGDWRCPKCLAQECSKPQEAFGFEQAARDYTLRTFGEMADAFKSDYFNMPVHMVPTELVEKEFWRLVSTIEEDVTVEYGADIASKEFGSGFPVRDGKIKLSPEEEEYLDSGWNLNNMPVMEQSVLAHITADICGMKLPWLYVGMCFSSFCWHIEDHWSYSINYLHWGEPKTWYGVPGYAAEQLENVMKKLAPELFVSQPDLLHQLVTIMNPNTLMTHEVPVYRTNQCAGEFVITFPRAYHSGFNQGFNFAEAVNFCTVDWLPLGRQCVEHYRLLHRYCVFSHDEMICKMASKADVLDVVVASTVQKDMAIMIEDEKALRETVRKLGVIDSERMDFELLPDDERQCVKCKTTCFMSAISCSCKPGLLVCLHHVKELCSCPPYKYKLRYRYTLDDLYPMMNALKLRAESYNEWALNVNEALEAKINKKKSLVSFKALIEESEMKKFPDNDLLRHLRLVTQDAEKCASVAQQLLNGKRQTRYRSGGGKSQNQLTVNELRQFVTQLYALPCVLSQTPLLKDLLNRVEDFQQHSQKLLSEETPSAAELQDLLDVSFEFDVELPQLAEMRIRLEQARWLEEVQQACLDPSSLTLDDMRRLIDLGVGLAPYSAVEKAMARLQELLTVSEHWDDKAKSLLKARPRHSLNSLATAVKEIEEIPAYLPNGAALKDSVQRARDWLQDVEGLQAGGRVPVLDTLIELVTRGRSIPVHLNSLPRLETLVAEVQAWKECAVNTFLTENSPYSLLEVLCPRCDIGLLGLKRKQRKLKEPLPNGKKKSTKLESLSDLERALTESKETASAMATLGEARLREMEALQSLRLANEGKLLSPLQDVDIKICLCQKAPAAPMIQCELCRDAFHTSCVAVPSISQGLRIWLCPHCRRSEKPPLEKILPLLASLQRIRVRLPEGDALRYMIERTVNWQHRAQQLLSSGNLKFVQDRVGSGLLYSRWQASAGQVSDTNKVSQPPGTTSFSLPDDWDNRTSYLHSPFSTGRSCIPLHGVSPEVNELLMEAQLLQVSLPEIQELYQTLLAKPSPAQQTDRSSPVRPSSEKNDCCRGKRDGINSLERKLKRRLEREGLSSERWERVKKMRTPKKKKIKLSHPKDMNNFKLDETHSLPSDTSYSEQEDSEDEDAICPAVSCLQPEGDEVSEVWAIEDVLSLNSETL

SEQ ID NO: 881379 - protein, 1621 aa, Homo sapiens
MGVGWDSFSSPWRRRRTAWACGETSSSEAEKAQGAAVARTTRTCCCSSRVCTGLGPSGARSLGPGAHLRLALAQPAVMEAATTLHPGPRPALPLGGPGPLGEFLPPPECPVFEPSWEEFADPFAFIHKIRPIAEQTGICKVRPPPDWQPPFACDVDKLHFTPRIQRLNELEAQTRVKLNFLDQIAKYWELQGSTLKIPHVERKILDLFQLNKLVAEEGGFAVVCKDRKWTKIATKMGFAPGKAVGSHIRGHYERILNPYNLFLSGDSLRCLQKPNLTTDTKDKEYKPHDIPQRQSVQPSETCPPARRAKRMRAEAMNIKIEPEETTEARTHNLRRRMGCPTPKCENEKEMKSSIKQEPIERKDYIVENEKEKPKSRSKKATNAVDLYVCLLCGSGNDEDRLLLCDGCDDSYHTFCLIPPLHDVPKGDWRCPKCLAQECSKPQEAFGFEQAARDYTLRTFGEMADAFKSDYFNMPVHMVPTELVEKEFWRLVSTIEEDVTVEYGADIASKEFGSGFPVRDGKIKLSPEEEEYLDSGWNLNNMPVMEQSVLAHITADICGMKLPWLYVGMCFSSFCWHIEDHWSYSINYLHWGEPKTWYGVPGYAAEQLENVMKKLAPELFVSQPDLLHQLVTIMNPNTLMTHEVPVYRTNQCAGEFVITFPRAYHSGFNQGFNFAEAVNFCTVDWLPLGRQCVEHYRLLHRYCVFSHDEMICKMASKADVLDVVVASTVQKDMAIMIEDEKALRETVRKLGVIDSERMDFELLPDDERQCVKCKTTCFMSAISCSCKPGLLVCLHHVKELCSCPPYKYKLRYRYTLDDLYPMMNALKLRAESYNEWALNVNEALEAKINKKKSLVSFKALIEESEMKKFPDNDLLRHLRLVTQDAEKCASVAQQLLNGKRQTRYRSGGGKSQNQLTVNELRQFVTQLYALPCVLSQTPLLKDLLNRVEDFQQHSQKLLSEETPSAAELQDLLDVSFEFDVELPQLAEMRIRLEQARWLEEVQQACLDPSSLTLDDMRRLIDLGVGLAPYSAVEKAMARLQELLTVSEHWDDKAKSLLKARPRHSLNSLATAVKEIEEIPAYLPNGAALKDSVQRARDWLQDVEGLQAGGRVPVLDTLIELVTRGRSIPVHLNSLPRLETLVAEVQAWKECAVNTFLTENSPYSLLEVLCPRCDIGLLGLKRKQRKLKEPLPNGKKKSTKLESLSDLERALTESKETASAMATLGEARLREMEALQSLRLANEGKLLSPLQDVDIKICLCQKAPAAPMIQCELCRDAFHTSCVAVPSISQGLRIWLCPHCRRSEKPPLEKILPLLASLQRIRVRLPEGDALRYMIERTVNWQHRAQQLLSSGNLKFVQDRVGSGLLYSRWQASAGQVSDTNKVSQPPGTTSFSLPDDWDNRTSYLHSPFSTGRSCIPLHGVSPEVNELLMEAQLLQVSLPEIQELYQTLLAKPSPAQQTDRSSPVRPSSEKNDCCRGKRDGINSLERKLKRRLEREGLSSERWERVKKMRTPKKKKIKLSHPKDMNNFKLERERSYELVRSAETHSLPSDTSYSEQEDSEDEDAICPAVSCLQPEGDEVDWVQCDGSCNQWFHQVCVGVSPEMAEKEDYICVRCTVKDAPSRK

SEQ ID NO: 881380 - protein, 1582 aa, Homo sapiens
MGVGWDSFSSPWRRRRTAWACGETSSSEAEKAQGAAVARTTRTCCCSSRVCTGLGPSGARSLGPGAHLRLALAQPAVMEAATTLHPGPRPALPLGGPGPLGEFLPPPECPVFEPSWEEFADPFAFIHKIRPIAEQTGICKVRPPPDWQPPFACDVDKLHFTPRIQRLNELEAQTRVKLNFLDQIAKYWELQGSTLKIPHVERKILDLFQLNKLVAEEGGFAVVCKDRKWTKIATKMGFAPGKAVGSHIRGHYERILNPYNLFLSGDSLRCLQKPNLTTDTKDKEYKPHDIPQRQSVQPSETCPPARRAKRMRAEAMNIKIEPEETTEARTHNLRRRMGCPTPKCENEKEMKSSIKQEPIERKDYIVENEKEKPKSRSKKATNAVDLYVCLLCGSGNDEDRLLLCDGCDDSYHTFCLIPPLHDVPKGDWRCPKCLAQECSKPQEAFGFEQAARDYTLRTFGEMADAFKSDYFNMPVHMVPTELVEKEFWRLVSTIEEDVTVEYGADIASKEFGSGFPVRDGKIKLSPEEEEYLDSGWNLNNMPVMEQSVLAHITADICGMKLPWLYVGMCFSSFCWHIEDHWSYSINYLHWGEPKTWYGVPGYAAEQLENVMKKLAPELFVSQPDLLHQLVTIMNPNTLMTHEVPVYRTNQCAGEFVITFPRAYHSGFNQGFNFAEAVNFCTVDWLPLGRQCVEHYRLLHRYCVFSHDEMICKMASKADVLDVVVASTVQKDMAIMIEDEKALRETVRKLGVIDSERMDFELLPDDERQCVKCKTTCFMSAISCSCKPGLLVCLHHVKELCSCPPYKYKLRYRYTLDDLYPMMNALKLRAESYNEWALNVNEALEAKINKKKSLVSFKALIEESEMKKFPDNDLLRHLRLVTQDAEKCASVAQQLLNGKRQTRYRSGGGKSQNQLTVNELRQFVTQLYALPCVLSQTPLLKDLLNRVEDFQQHSQKLLSEETPSAAELQDLLDVSFEFDVELPQLAEMRIRLEQARWLEEVQQACLDPSSLTLDDMRRLIDLGVGLAPYSAVEKAMARLQELLTVSEHWDDKAKSLLKARPRHSLNSLATAVKEIEEIPAYLPNGAALKDSVQRARDWLQDVEGLQAGGRVPVLDTLIELVTRGRSIPVHLNSLPRLETLVAEVQAWKECAVNTFLTENSPYSLLEVLCPRCDIGLLGLKRKQRKLKEPLPNGKKKSTKLESLSDLERALTESKETASAMATLGEARLREMEALQSLRLANEGKLLSPLQDVDIKICLCQKAPAAPMIQCELCRDAFHTSCVAVPSISQGLRIWLCPHCRRSEKPPLEKILPLLASLQRIRVRLPEGDALRYMIERTVNWQHRAQQLLSSGNLKFVQDRVGSGLLYSRWQASAGQVSDTNKVSQPPGTTSFSLPDDWDNRTSYLHSPFSTGRSCIPLHGVSPEVNELLMEAQLLQVSLPEIQELYQTLLAKPSPAQQTDRSSPVRPSSEKNDCCRGKRDGINSLERKLKRRLEREGLSSERWERVKKMRTPKKKKIKLSHPKDMNNFKLERERSYELVRSAETHSLPSDTSYSEQEDSEDEDAICPAVSCLQPEGDELSPSRR

SEQ ID NO: 881381 - protein, 757 aa, Homo sapiens
MKKFPDNDLLRHLRLVTQDAEKCASVAQQLLNGKRQTRYRSGGGKSQNQLTVNELRQFVTQLYALPCVLSQTPLLKDLLNRVEDFQQHSQKLLSEETPSAAELQDLLDVSFEFDVELPQLAEMRIRLEQARWLEEVQQACLDPSSLTLDDMRRLIDLGVGLAPYSAVEKAMARLQELLTVSEHWDDKAKSLLKARPRHSLNSLATAVKEIEEIPAYLPNGAALKDSVQRARDWLQDVEGLQAGGRVPVLDTLIELVTRGRSIPVHLNSLPRLETLVAEVQAWKECAVNTFLTENSPYSLLEVLCPRCDIGLLGLKRKQRKLKEPLPNGKKKSTKLESLSDLERALTESKETASAMATLGEARLREMEALQSLRLANEGKLLSPLQDVDIKICLCQKAPAAPMIQCELCRDAFHTSCVAVPSISQGLRIWLCPHCRRSEKPPLEKILPLLASLQRIRVRLPEGDALRYMIERTVNWQHRAQQLLSSGNLKFVQDRVGSGLLYSRWQASAGQVSDTNKVSQPPGTTSFSLPDDWDNRTSYLHSPFSTGRSCIPLHGVSPEVNELLMEAQLLQVSLPEIQELYQTLLAKPSPAQQTDRSSPVRPSSEKNDCCRGKRDGINSLERKLKRRLEREGLSSERWERVKKMRTPKKKKIKLSHPKDMNNFKLERERSYELVRSAETHSLPSDTSYSEQEDSEDEDAICPAVSCLQPEGDEVDWVQCDGSCNQWFHQVCVGVSPEMAEKEDYICVRCTVKDAPSRK

SEQ ID NO: 881382 - protein, 757 aa, Homo sapiens; identical to SEQ ID NO: 881381

SEQ ID NO: 881383 - protein, 1583 aa, Homo sapiens; identical to SEQ ID NO: 881378

SEQ ID NO: 881384 - protein, 115 aa, Homo sapiens [sequence omitted]

SEQ ID NO: 881385 - protein, 104 aa, Homo sapiens
SSCHSVCPWGGSRERSYELVRSAETHSLPSDTSYSEQEDSEDEDAICPAVSCLQPEGDEVDWVQCDGSCNQWFHQVCVGVSPEMAEKEDYICVRCTVKDAPSRK

SEQ ID NO: 881386 - protein, 883 aa, Homo sapiens
MGVGWDSFSSPWRRRRTAWACGETSSSEAEKAQGAAVARTTRTCCCSSRVCTGLGPSGARSLGPGAHLRLALAQPAVMEAATTLHPGPRPALPLGGPGPLGEFLPPPECPVFEPSWEEFADPFAFIHKIRPIAEQTGICKVRPPPDWQPPFACDVDKLHFTPRIQRLNELEAQTRVKLNFLDQIAKYWELQGSTLKIPHVERKILDLFQLNKLVAEEGGFAVVCKDRKWTKIATKMGFAPGKAVGSHIRGHYERILNPYNLFLSGDSLRCLQKPNLTTDTKDKEYKPHDIPQRQSVQPSETCPPARRAKRMRAEAMNIKIEPEETTEARTHNLRRRMGCPTPKCENEKEMKSSIKQEPIERKDYIVENEKEKPKSRSKKATNAVDLYVCLLCGSGNDEDRLLLCDGCDDSYHTFCLIPPLHDVPKGDWRCPKCLAQECSKPQEAFGFEQAARDYTLRTFGEMADAFKSDYFNMPVHMVPTELVEKEFWRLVSTIEEDVTVEYGADIASKEFGSGFPVRDGKIKLSPEEEEYLDSGWNLNNMPVMEQSVLAHITADICGMKLPWLYVGMCFSSFCWHIEDHWSYSINYLHWGEPKTWYGVPGYAAEQLENVMKKLAPELFVSQPDLLHQLVTIMNPNTLMTHEVPVYRTNQCAGEFVITFPRAYHSGFNQGFNFAEAVNFCTVDWLPLGRQCVEHYRLLHRYCVFSHDEMICKMASKADVLDVVVASTVQKDMAIMIEDEKALRETVRKLGVIDSERMDFELLPDDERQCVKCKTTCFMSAISCSCKPGLLVCLHHVKELCSCPPYKYKLRYRYTLDDLYPMMNALKLRAESYNEWALNVNEALEAKINKKKSTFHIYKAQGKATLADDDIDQVNIVHGADKLL

SEQ ID NO: 881387 - protein, 483 aa, Homo sapiens
MGVGWDSFSSPWRRRRTAWACGETSSSEAEKAQGAAVARTTRTCCCSSRVCTGLGPSGARSLGPGAHLRLALAQPAVMEAATTLHPGPRPALPLGGPGPLGEFLPPPECPVFEPSWEEFADPFAFIHKIRPIAEQTGICKVRPPPDWQPPFACDVDKLHFTPRIQRLNELEAQTRVKLNFLDQIAKYWELQGSTLKIPHVERKILDLFQLNKLVAEEGGFAVVCKDRKWTKIATKMGFAPGKAVGSHIRGHYERILNPYNLFLSGDSLRCLQKPNLTTDTKDKEYKPHDIPQRQSVQPSETCPPARRAKRMRAEAMNIKIEPEETTEARTHNLRRRMGCPTPKCENEKEMKSSIKQEPIERKDYIVENEKEKPKSRSKKATNAVDLYVCLLCGSGNDEDRLLLCDGCDDSYHTFCLIPPLHDVPKGDWRCPKCLAQECSKPQEAFGFEQAARDYTLRTFGEMADAFKSDYFNMPVHVCTYILL

SEQ ID NO: 881388 - protein, 1621 aa, Homo sapiens; identical to SEQ ID NO: 881379

SEQ ID NO: 881389 - protein, 1029 aa, Homo sapiens
QDVDVKYFARCAEQLENVMKKLAPELFVSQPDLLHQLVTIMNPNTLMTHEVPVYRTNQCAGEFVITFPRAYHSGFNQGFNFAEAVNFCTVDWLPLGRQCVEHYRLLHRYCVFSHDEMICKMASKADVLDVVVASTVQKDMAIMIEDEKALRETVRKLGVIDSERMDFELLPDDERQCVKCKTTCFMSAISCSCKPGLLVCLHHVKELCSCPPYKYKLRYRYTLDDLYPMMNALKLRAESYNEWALNVNEALEAKINKKKSLVSFKALIEESEMKKFPDNDLLRHLRLVTQDAEKCASVAQQLLNGKRQTRYRSGGGKSQNQLTVNELRQFVTQLYALPCVLSQTPLLKDLLNRVEDFQQHSQKLLSEETPSAAELQDLLDVSFEFDVELPQLAEMRIRLEQARWLEEVQQACLDPSSLTLDDMRRLIDLGVGLAPYSAVEKAMARLQELLTVSEHWDDKAKSLLKARPRHSLNSLATAVKEIEEIPAYLPNGAALKDSVQRARDWLQDVEGLQAGGRVPVLDTLIELVTRGRSIPVHLNSLPRLETLVAEVQAWKECAVNTFLTENSPYSLLEVLCPRCDIGLLGLKRKQRKLKEPLPNGKKKSTKLESLSDLERALTESKETASAMATLGEARLREMEALQSLRLANEGKLLSPLQDVDIKICLCQKAPAAPMIQCELCRDAFHTSCVAVPSISQGLRIWLCPHCRRSEKPPLEKILPLLASLQRIRVRLPEGDALRYMIERTVNWQHRAQQLLSSGNLKFVQDRVGSGLLYSRWQASAGQVSDTNKVSQPPGTTSFSLPDDWDNRTSYLHSPFSTGRSCIPLHGVSPEVNELLMEAQLLQVSLPEIQELYQTLLAKPSPAQQTDRSSPVRPSSEKNDCCRGKRDGINSLERKLKRRLEREGLSSERWERVKKMRTPKKKKIKLSHPKDMNNFKLERERSYELVRSAETHSLPSDTSYSEQEDSEDEDAICPAVSCLQPEGDEVDWVQCDGSCNQWFHQVCVGVSPEMAEKEDYICVRCTVKDAPSRK

SEQ ID NO: 881390 - protein, 1621 aa, Homo sapiens; identical to SEQ ID NO: 881379

SEQ ID NO: 881391 - protein, 800 aa, Homo sapiens
LLPHDLLPQSYNEWALNVNEALEAKINKKKSLVSFKALIEESEMKKFPDNDLLRHLRLVTQDAEKCASVAQQLLNGKRQTRYRSGGGKSQNQLTVNELRQFVTQLYALPCVLSQTPLLKDLLNRVEDFQQHSQKLLSEETPSAAELQDLLDVSFEFDVELPQLAEMRIRLEQARWLEEVQQACLDPSSLTLDDMRRLIDLGVGLAPYSAVEKAMARLQELLTVSEHWDDKAKSLLKARPRHSLNSLATAVKEIEEIPAYLPNGAALKDSVQRARDWLQDVEGLQAGGRVPVLDTLIELVTRGRSIPVHLNSLPRLETLVAEVQAWKECAVNTFLTENSPYSLLEVLCPRCDIGLLGLKRKQRKLKEPLPNGKKKSTKLESLSDLERALTESKETASAMATLGEARLREMEALQSLRLANEGKLLSPLQDVDIKICLCQKAPAAPMIQCELCRDAFHTSCVAVPSISQGLRIWLCPHCRRSEKPPLEKILPLLASLQRIRVRLPEGDALRYMIERTVNWQHRAQQLLSSGNLKFVQDRVGSGLLYSRWQASAGQVSDTNKVSQPPGTTSFSLPDDWDNRTSYLHSPFSTGRSCIPLHGVSPEVNELLMEAQLLQVSLPEIQELYQTLLAKPSPAQQTDRSSPVRPSSEKNDCCRGKRDGINSLERKLKRRLEREGLSSERWERVKKMRTPKKKKIKLSHPKDMNNFKLERERSYELVRSAETHSLPSDTSYSEQEDSEDEDAICPAVSCLQPEGDEVDWVQCDGSCNQWFHQVCVGVSPEMAEKEDYICVRCTVKDAPSRK

SEQ ID NO: 881392 - protein, 1538 aa, Homo sapiens
MGVGWDSFSSPWRRRRTAWACGETSSSEAEKAQGAAVARTTRTCCCSSRVCTGLGPSGARSLGPGAHLRLALAQPAVMEAATTLHPGPRPALPLGGPGPLGEFLPPPECPVFEPSWEEFADPFAFIHKIRPIAEQTGICKVRPPPDWQPPFACDVDKLHFTPRIQRLNELEAQTRVKLNFLDQIAKYWELQGSTLKIPHVERKILDLFQLNKLVAEEGGFAVVCKDRKWTKIATKMGFAPGKAVGSHIRGHYERILNPYNLFLSGDSLRCLQKPNLTTDTKDKEYKPHDIPQRQSVQPSETCPPARRAKRMRAEAMNIKIEPEETTEARTHNLRRRMGCPTPKCENEKEMKSSIKQEPIERKDYIVENEKEKPKSRSKKATNAVDLYVCLLCGSGNDEDRLLLCDGCDDSYHTFCLIPPLHDVPKGDWRCPKCLAQECSKPQEAFGFEQAARDYTLRTFGEMADAFKSDYFNMPVHMVPTELVEKEFWRLVSTIEEDVTVEYGADIASKEFGSGFPVRDGKIKLSPEEEEYLDSGWNLNNMPVMEQSVLAHITADICGMKLPWLYVGMCFSSFCWHIEDHWSYSINYLHWGEPKTWYGVPGYAAEQLENVMKKLAPELFVSQPDLLHQLVTIMNPNTLMTHEVPVYRTNQCAGEFVITFPRAYHSGFNQGFNFAEAVNFCTVDWLPLGRQCVEHYRLLHRYCVFSHDEMICKMASKADVLDVVVASTVQKDMAIMIEDEKALRETVRKLGVIDSERMDFELLPDDERQCVKCKTTCFMSAISCSCKPGLLVCLHHVKELCSCPPYKYKLRYRYTLDDLYPMMNALKLRAESYNEWALNVNEALEAKINKKKSLVSFKALIEESEMKKFPDNDLLRHLRLVTQDAEKCASVAQQLLNGKRQTRYRSGGGKSQNQLTVNELRQFVTQLYALPCVLSQTPLLKDLLNRVEDFQQHSQKLLSEETPSAAELQDLLDVSFEFDVELPQLAEMRIRLEQARWLEEVQQACLDPSSLTLDDMRRLIDLGVGLAPYSAVEKAMARLQELLTVSEHWDDKAKSLLKARPRHSLNSLATAVKEIEEIPAYLPNGAALKDSVQRARDWLQDVEGLQAGGRVPVLDTLIELVTRGRSIPVHLNSLPRLETLVAEVQAWKECAVNTFLTENSPYSLLEVLCPRCDIGLLGLKRKQRKLKEPLPNGKKKSTKLESLSDLERALTESKETASAMATLGEARLREMEALQSLRLANEGKLLSPLQDVDIKICLCQKAPAAPMIQCELCRDAFHTSCVAVPSISQGLRIWLCPHCRRSEKPPLEKILPLLASLQRIRVRLPEGDALRYMIERTVNWQHRAQQLLSSGNLKFVQDRVGSGLLYSRWQASAGQVSDTNKVSQPPGTTSFSLPDDWDNRTSYLHSPFSTGRSCIPLHGVSPEVNELLMEAQLLQVSLPEIQELYQTLLAKPSPAQQTDRSSPVRPSSEKNDCCRGKRDGINSLERKLKRRLEREGLSSERWERVKKMRTPKKKKIKLSHPKDMNNFKLEGDPEIDHSS

SEQ ID NO: 881393 - protein, 194 aa, Homo sapiens [sequence omitted]

SEQ ID NO: 881394 - protein, 1047 aa, Homo sapiens
MGVGWDSFSSPWRRRRTAWACGETSSSEAEKAQGAAVARTTRTCCCSSRVCTGLGPSGARSLGPGAHLRLALAQPAVMEAATTLHPGPRPALPLGGPGPLGEFLPPPECPVFEPSWEEFADPFAFIHKIRPIAEQTGICKVRPPPDWQPPFACDVDKLHFTPRIQRLNELEAQTRVKLNFLDQIAKYWELQGSTLKIPHVERKILDLFQLNKLVAEEGGFAVVCKDRKWTKIATKMGFAPGKAVGSHIRGHYERILNPYNLFLSGDSLRCLQKPNLTTDTKDKEYKPHDIPQRQSVQPSETCPPARRAKRMRAEAMNIKIEPEETTEARTHNLRRRMGCPTPKCENEKEMKSSIKQEPIERKDYIVENEKEKPKSRSKKATNAVDLYVCLLCGSGNDEDRLLLCDGCDDSYHTFCLIPPLHDVPKGDWRCPKCLAQECSKPQEAFGFEQAARDYTLRTFGEMADAFKSDYFNMPVHMVPTELVEKEFWRLVSTIEEDVTVEYGADIASKEFGSGFPVRDGKIKLSPEEEEYLDSGWNLNNMPVMEQSVLAHITADICGMKLPWLYVGMCFSSFCWHIEDHWSYSINYLHWGEPKTWYGVPGYAAEQLENVMKKLAPELFVSQPDLLHQLVTIMNPNTLMTHEVPVYRTNQCAGEFVITFPRAYHSGFNQGFNFAEAVNFCTVDWLPLGRQCVEHYRLLHRYCVFSHDEMICKMASKADVLDVVVASTVQKDMAIMIEDEKALRETVRKLGVIDSERMDFELLPDDERQCVKCKTTCFMSAISCSCKPGLLVCLHHVKELCSCPPYKYKLRYRYTLDDLYPMMNALKLRAESYNEWALNVNEALEAKINKKKSLVSFKALIEESEMKKFPDNDLLRHLRLVTQDAEKCASVAQQLLNGKRQTRYRSGGGKSQNQLTVNELRQFVTQLYALPCVLSQTPLLKDLLNRVEDFQQHSQKLLSEETPSAAELQDLLDVSFEFDVELPQLAEMRIRLEQARWLEEVQQACLDPSSLTLDDMRRLIDLGVGLAPYSAVEKAMAQGEGWSSVSEH

SEQ ID NO: 881395 - protein, 107 aa, Homo sapiens
RRRRGGWAGGGGGTRRALGVPVARRRRMWRAEGKWLPKTSRKSVSQSVFCGTSTYCVLNTVPPIEDDHGNSNSSHVKIFLPKKLLECLPKCSSLPKERHRWNTNERS

SEQ ID NO: 881396 - protein, 84 aa, Homo sapiens
AAAAGWLGRRRRRYEARARGPGREEEEDVARGGEMAAENKPEDDHGNSNSSHVKIFLPKKLLECLPKCSSLPKERHRWNTNERS

SEQ ID NO: 881397 - protein, 107 aa, Homo sapiens; identical to SEQ ID NO: 881395

SEQ ID NO: 881398 - protein, 181 aa, Homo sapiens
AAAAGWLGRRRRRYEARARGPGREEEEDVARGGEMAAENKPEDDHGNSNSSHVKIFLPKKLLECLPKCSSLPKERHRWNTNELTYRPSKQYNERSGSLLAAAYQDQLDQPVIPHPFRVGDAVWVRRHQTKNLEPRWKGPYTVLLTTPTALKVDGISAWIHAAHVKAATTPPAGATWKVQRS

SEQ ID NO: 881399 - protein, 462 aa, Homo sapiens
MSIAGVAAQEIRVPLKTGFLHNGRAMGNMRKTYWSSRSEFKNNFLNIDPITMAYSLNSSAQERLIPLGHASKSAPMNGHCFAENGPSQKSSLPPLLIPPSENLGPHEEDQVVCGFKKLTVNGVCASTPPLTPIKNSPSLFPCAPLCERGSRPLPPLPISEALSLDDTDCEVEFLTSSDTDFLLEDSTLSDFKYDVPGRRSFRGCGQINYAYFDTPAVSAADLSYVSDQNGGVPDPNPPPPQTHRRLRRSHSGPAGSFNKPAIRISNCCIHRASPNSDEDKPEVPPRVPIPPRPVKPDYRRWSAEVTSSTYSDEDRPPKVPPREPLSPSNSRTPSPKSLPSYLNGVMPPTQSFAPDPKYVSSKALQRQNSEGSASKVPCILPIIENGKKVSSTHYYLLPERPPYLDKYEKFFREAEETNGGAQIQPLPADCGISSATEKPDSKTKMDLGGHVKRKHLSYVVSP

SEQ ID NO: 881400 - protein, 444 aa, Homo sapiens
MSIAGVAAQEIRVPLKTGFLHNGRAMGNMRKTYWSSRSEFKNNFLNIDPITMAYSLNSSAQERLIPLGHASKSAPMNGHCFAENGPSQKSSLPPLLIPPSENLGPHEEDQVVCGFKKLTVNGVCASTPPLTPITLPPLPISEALSLDDTDCEVEFLTSSDTDFLLEDSTLSDFKYDVPGRRSFRGCGQINYAYFDTPAVSAADLSYVSDQNGGVPDPNPPPPQTHRRLRRSHSGPAGSFNKPAIRISNCCIHRASPNSDEDKPEVPPRVPIPPRPVKPDYRRWSAEVTSSTYSDEDRPPKVPPREPLSPSNSRTPSPKSLPSYLNGVMPPTQSFAPDPKYVSSKALQRQNSEGSASKVPCILPIIENGKKVSSTHYYLLPERPPYLDKYEKFFREAEETNGGAQIQPLPADCGISSATEKPDSKTKMDLGGHVKRKHLSYVVSP

SEQ ID NO: 881401 - protein, 412 aa, Homo sapiens
MSIAGVAAQEIRVPLKTGFLHNGRAMGNMRKTYWSSRSEFKNNFLNIDPITMAYSLNSSAQERLIPLGHASKSAPMNGHCFAENGPSQKSSLPPLLIPPSENLGPHEEDQVVCGFKKLTVNGVCASTPPLTPIKNSPSLFPCAPLCERGSRPLPPLPISEALSLDDTDCEVEFLTSSDTDFLLEDSTLSDFKYDVPGRRSFRGCGQINYAYFDTPAVSAADLSYVSDQNGGVPDPNPPPPQTHRRLRRSHSGPAGSFNKPAIRISNCCIHRASPNSDEDKPEVPPRVPIPPRPVKPDYRRWSAEVTSSTYSDEDRPPKVPPREPLSPSNSRTPSPKSLPSYLNGVMPPTQSFAPDPKYVSSKALQRQNSEGSASKVPCILPIIENGKKVSSTHYYLLPERPPYLDKYEKFFC

SEQ ID NO: 881402 - protein, 462 aa, Homo sapiens; identical to SEQ ID NO: 881399

SEQ ID NO: 881403 - protein, 444 aa, Homo sapiens
MSIAGVAAQEIRVPLKTGFLHNGRAMGNMRKTYWSSRSEFKNNFLNIDPITMAYSLNSSAQERLIPLGHASKSAPMNGHCFAENGPSQKSSLPPLLIPPSENLGPHEEDQVVCGFKKLTVNGVCASTPPLTPIKNSPSLFPCAPLCERGSRPLPPLPISEALSLDDTDCEVEFLTSSDTDFLLEDSTLSDFKYDVPGRRSFRGCGQINYAYFDTPAVSAADLSYVSDQNGGVPDPNPPPPQTHRRLRRSHSGPAGSFNKPAIRISNCCIHRASPNSDEDKPEVPPRVPIPPRPVKPDYRRWSAEVTSSTYSDEDRPPKVPPREPLSPSNSRTPSPKSLPSYLNGVMPPTQSFAPDPKYVSSKALQRQNSEGSASKVPCILPIIENGKKVSSTHYYLLPERPPYLDKYEKFFREAEETNGGAQIQPLPADCGISSATEKPDSNSP

SEQ ID NO: 881404 - protein, 422 aa, Homo sapiens
MSIAGVAAQEIRVPLKTGFLHNGRAMGNMRKTYWSSRSEFKNNFLNIDPITMAYSLNSSAQERLIPLGHASKSAPMNGHCFAENGPSQKSSLPPLLIPPSENLGPHEEDQVVCGFKKLTVNGVCASTPPLTPIKNSPSLFPCAPLCERGSRPLPPLPISEALSLDDTDCEVEFLTSSDTDFLLEDSTLSDFKYDVPGRRSFRGCGQINYAYFDTPAVSAADLSYVSDQNGGVPDPNPPPPQTHRRLRRSHSGPAGSFNKPAIRISNCCIHRASPNSDEDKPEVPPRVPIPPRPVKPDYRRWSAEVTSSTYSDEDRPPKVPPREPLSPSNSRTPSPKSLPSYLNGVMPPTQSFAPDPKYVSSKALQRQNSEGSASKVPCILPIIENGKKVSSTHYYLLPERPPYLDKYEKFFFLYMHTLHTYI

SEQ ID NO: 881405 - protein, 1700 aa, Homo sapiens
RRRRGGWAGGGGGTRRALGVPVARRRRMWRAEGKWLPKTSRKSVSQSVFCGTSTYCVLNTVPPIEDDHGNSNSSHVKIFLPKKLLECLPKCSSLPKERHRWNTNEEIAAYLITFEKHEEWLTTSPKTRPQNGSMILYNRKKVKYRKDGYCWKKRKDGKTTREDHMKLKVQGVECLYGCYVHSSIIPTFHRRCYWLLQNPDIVLVHYLNVPAIEDCGKPCGPILCSINTDKKEWAKWTKEELIGQLKPMFHGIKWTCSNGNSSSGFSVEQLVQQILDSHQTKPQPRTHNCLCTGSLGAGGSVHHKCNSAKHRIISPKVEPRTGGYGSHSEVQHNDVSEGKHEHSHSKGSSREKRNGKVAKPVLLHQSSTEVSSTNQVEVPDTTQSSPVSISSGLNSDPDMVDSPVVTGVSGMAVASVMGSLSQSATVFMSEVTNEAVYTMSPTAGPNHHLLSPDASQGLVLAVSSDGHKFAFPTTGSSESLSMLPTNVSEELVLSTTLDGGRKIPETTMNFDPDCFLNNPKQGQTYGGGGLKAEMVSSNIRHSPPGERSFSFTTVLTKEIKTEDTSFEQQMAKEAYSSSAAAVAASSLTLTAGSSLLPSGGGLSPSTTLEQMDFSAIDSNKDYTSSFSQTGHSPHIHQTPSPSFFLQDASKPLPVEQNTHSSLSDSGGTFVMPTVKTEASSQTSSCSGHVETRIESTSSLHLMQFQANFQAMTAEGEVTMETSQAAEGSEVLLKSGELQACSSEHYLQPETNGVIRSAGGVPILPGNVVQGLYPVAQPSLGNASNMELSLDHFDISFSNQFSDLINDFISVEGGSSTIYGHQLVSGDSTALSQSEDGARAPFTQAEMCLPCCSPQQGSLQLSSSEGGASTMAYMHVAEVVSAASAQGTLGMLQQSGRVFMVTDYSPEWSYPEGGVKVLITGPWQEASNNYSCLFDQISVPASLIQPGVLRCYCPAHDTGLVTLQVAFNNQIISNSVVFEYKARALPTLPSSQHDWLSLDDNQFRMSILERLEQMERRMAEMTGSQQHKQASGGGSSGGGSGSGNGGSQAQCASGTGALGSCFESRVVVVCEKMMSRACWAKSKHLIHSKTFRGMTLLHLAAAQGYATLIQTLIKWRTKHADSIDLELEVDPLNVDHFSCTPLMWACALGHLEAAVVLYKWDRRAISIPDSLGRLPLGIARSRGHVKLAECLEHLQRDEQAQLGQNPRIHCPASEEPSTESWMAQWHSEAISSPEIPKGVTVIASTNPELRRPRSEPSNYYSSESHKDYPAPKKHKLNPEYFQTRQEKLLPTALSLEEPNIRKQSPSSKQSVPETLSPSEGVRDFSRELSPPTPETAAFQASGSQPVGKWNSKDLYIGVSTVQVTGNPKGTSVGKEAAPSQVRPREPMSVLMMANREVVNTELGSYRDSAENEECGQPMDDIQVNMMTLAEHIIEATPDRIKQENFVPMESSGLERTDPATISSTMSWLASYLADADCLPSAAQIRSAYNEPLTPSSNTSLSPVGSPVSEIAFEKPNLPSAADWSEFLSASTSEKVENEFAQLTLSDHEQRELYEAARLVQTAFRKYKGRPLREQQEVAAAVIQRCYRKYKQYALYKKMTQAAILIQSKFRSYYEQKKFQQSRRAAVLIQKYYRSYKKCGKRRQARRTAVIVQQKLRSSLLTKKQDQAARKIMRFLRRCRHSPLVDHRLYKRSERIEKGQGT

SEQ ID NO: 881406 - protein, 1700 aa, Homo sapiens; identical to SEQ ID NO: 881405

SEQ ID NO: 881407 - protein, 107 aa, Homo sapiens; identical to SEQ ID NO: 881395

SEQ ID NO: 881408 - protein, 1705 aa, Homo sapiens
TSADDDMASLVFHSTSMCSDHRFGDLEMMSSQNSESEKEKSVSQSVFCGTSTYCVLNTVPPIEDDHGNSNSSHVKIFLPKKLLECLPKCSSLPKERHRWNTNEEIAAYLITFEKHEEWLTTSPKTRPQNGSMILYNRKKVKYRKDGYCWKKRKDGKTTREDHMKLKVQGVECLYGCYVHSSIIPTFHRRCYWLLQNPDIVLVHYLNVPAIEDCGKPCGPILCSINTDKKEWAKWTKEELIGQLKPMFHGIKWTCSNGNSSSGFSVEQLVQQILDSHQTKPQPRTHNCLCTGSLGAGGSVHHKCNSAKHRIISPKVEPRTGGYGSHSEVQHNDVSEGKHEHSHSKGSSREKRNGKVAKPVLLHQSSTEVSSTNQVEVPDTTQSSPVSISSGLNSDPDMVDSPVVTGVSGMAVASVMGSLSQSATVFMSEVTNEAVYTMSPTAGPNHHLLSPDASQGLVLAVSSDGHKFAFPTTGSSESLSMLPTNVSEELVLSTTLDGGRKIPETTMNFDPDCFLNNPKQGQTYGGGGLKAEMVSSNIRHSPPGERSFSFTTVLTKEIKTEDTSFEQQMAKEAYSSSAAAVAASSLTLTAGSSLLPSGGGLSPSTTLEQMDFSAIDSNKDYTSSFSQTGHSPHIHQTPSPSFFLQDASKPLPVEQNTHSSLSDSGGTFVMPTVKTEASSQTSSCSGHVETRIESTSSLHLMQFQANFQAMTAEGEVTMETSQAAEGSEVLLKSGELQACSSEHYLQPETNGVIRSAGGVPILPGNVVQGLYPVAQPSLGNASNMELSLDHFDISFSNQFSDLINDFISVEGGSSTIYGHQLVSGDSTALSQSEDGARAPFTQAEMCLPCCSPQQGSLQLSSSEGGASTMAYMHVAEVVSAASAQGTLGMLQQSGRVFMVTDYSPEWSYPEGGVKVLITGPWQEASNNYSCLFDQISVPASLIQPGVLRCYCPAHDTGLVTLQVAFNNQIISNSVVFEYKARALPTLPSSQHDWLSLDDNQFRMSILERLEQMERRMAEMTGSQQHKQASGGGSSGGGSGSGNGGSQAQCASGTGALGSCFESRVVVVCEKMMSRACWAKSKHLIHSKTFRGMTLLHLAAAQGYATLIQTLIKWRTKHADSIDLELEVDPLNVDHFSCTPLMWACALGHLEAAVVLYKWDRRAISIPDSLGRLPLGIARSRGHVKLAECLEHLQRDEQAQLGQNPRIHCPASEEPSTESWMAQWHSEAISSPEIPKGVTVIASTNPELRRPRSEPSNYYSSESHKDYPAPKKHKLNPEYFQTRQEKLLPTALSLEEPNIRKQSPSSKQSVPETLSPSEGVRDFSRELSPPTPETAAFQASGSQPVGKWNSKDLYIGVSTVQVTGNPKGTSVGKEAAPSQVRPREPMSVLMMANREVVNTELGSYRDSAENEECGQPMDDIQVNMMTLAEHIIEATPDRIKQENFVPMESSGLERTDPATISSTMSWLASYLADADCLPSAAQIRSAYNEPLTPSSNTSLSPVGSPVSEIAFEKPNLPSAADWSEFLSASTSEKVENEFAQLTLSDHEQRELYEAARLVQTAFRKYKGRPLREQQEVAAAVIQRCYRKYKQLTWLALKYALYKKMTQAAILIQSKFRSYYEQKKFQQSRRAAVLIQKYYRSYKKCGKRRQARRTAVIVQQKLRSSLLTKKQDQAARKIMRFLRRCRHRVKELKKAKELEDIQQHPLAM

SEQ ID NO: 881409 - protein, 107 aa, Homo sapiens; identical to SEQ ID NO: 881395

SEQ ID NO: 881410 - protein, 84 aa, Homo sapiens; identical to SEQ ID NO: 881396

SEQ ID NO: 881411 - protein, 1668 aa, Homo sapiens
TSADDDMASLVFHSTSMCSDHRFGDLEMMSSQNSESEKEKSVSQSVFCGTSTYCVLNTVPPIEDDHGNSNSSHVKIFLPKKLLECLPKCSSLPKERHRWNTNEEIAAYLITFEKHEEWLTTSPKTRPQNGSMILYNRKKVKYRKDGYCWKKRKDGKTTREDHMKLKVQGVECLYGCYVHSSIIPTFHRRCYWLLQNPDIVLVHYLNVPAIEDCGKPCGPILCSINTDKKEWAKWTKEELIGQLKPMFHGIKWTCSNGNSSSGFSVEQLVQQILDSHQTKPQPRTHNCLCTGSLGAGGSVHHKCNSAKHRIISPKVEPRTGGYGSHSEVQHNDVSEGKHEHSHSKGSSREKRNGKVAKPVLLHQSSTEVSSTNQVEVPDTTQSSPVSISSGLNSDPDMVDSPVVTGVSGMAVASVMGSLSQSATVFMSEVTNEAVYTMSPTAGPNHHLLSPDASQGLVLAVSSDGHKFAFPTTGSSESLSMLPTNVSEELVLSTTLDGGRKIPETTMNFDPDCFLNNPKQGQTYGGGGLKAEMVSSNIRHSPPGERSFSFTTVLTKEIKTEDTSFEQQMAKEAYSSSAAAVAASSLTLTAGSSLLPSGGGLSPSTTLEQMDFSAIDSNKDYTSSFSQTGHSPHIHQTPSPSFFLQDASKPLPVEQNTHSSLSDSGGTFVMPTVKTEASSQTSSCSGHVETRIESTSSLHLMQFQANFQAMTAEGEVTMETSQAAEGSEVLLKSGELQACSSEHYLQPETNGVIRSAGGVPILPGNVVQGLYPVAQPSLGNASNMELSLDHFDISFSNQFSDLINDFISVEGGSSTIYGHQLVSGDSTALSQSEDGARAPFTQAEMCLPCCSPQQGSLQLSSSEGGASTMAYMHVAEVVSAASAQGTLGMLQQSGRVFMVTDYSPEWSYPEGGVKVLITGPWQEASNNYSCLFDQISVPASLIQPGVLRCYCPAHDTGLVTLQVAFNNQIISNSVVFEYKARALPTLPSSQHDWLSLDDNQFRMSILERLEQMERRMAEMTGSQQHKQASGGGSSGGGSGSGNGGSQAQCASGTGALGSCFESRVVVVCEKMMSRACWAKSKHLIHSKTFRGMTLLHLAAAQGYATLIQTLIKWRTKHADSIDLELEVDPLNVDHFSCTPLMWACALGHLEAAVVLYKWDRRAISIPDSLGRLPLGIARSRGHVKLAECLEHLQRDEQAQLGQNPRIHCPASEEPSTESWMAQWHSEAISSPEIPKGVTVIASTNPELRRPRSEPSNYYSSESHKDYPAPKKHKLNPEYFQTRQEKLLPTALSLEEPNIRKQSPSSKQSVPETLSPSEGVRDFSRELSPPTPETAAFQASGSQPVGKWNSKDLYIGVSTVQVTGNPKGTSVGKEAAPSQVRPREPMSVLMMANREVVNTELGSYRDSAENEECGQPMDDIQVNMMTLAEHIIEATPDRIKQENFVPMESSGLERTDPATISSTMSWLASYLADADCLPSAAQIRSAYNEPLTPSSNTSLSPVGSPVSEIAFEKPNLPSAADWSEFLSASTSEKVENEFAQLTLSDHEQRELYEAARLVQTAFRKYKGRPLREQQEVAAAVIQRCYRKYKQLTWLALKYALYKKMTQAAILIQSKFRSYYEQKKFQQSRRAAVLIQKYYRSYKKCGKRRQARRTAVIVQQKLRWVEKSSWR

SEQ ID NO: 881412 - protein, 223 aa, Homo sapiens
TSADDDMASLVFHSTSMCSDHRFGDLEMMSSQNSESEKEKSVSQSVFCGTSTYCVLNTVPPIEDDHGNSNSSHVKIFLPKKLLECLPKCSSLPKERHRWNTNEEIAAYLITFEKHEEWLTTSPKTRPQNGSMILYNRKKVKYRKDGYCWKKRKDGKTTREDHMKLKVQGVETDSSNHSHIPQPLQHPASSPRGQQGLVHPTTAAMSSPLATAATLFDLMYMKK

SEQ ID NO: 881413 - protein, 107 aa, Homo sapiens; identical to SEQ ID NO: 881395

SEQ ID NO: 881414 - protein, 84 aa, Homo sapiens; identical to SEQ ID NO: 881396

SEQ ID NO: 881415 - protein, 193 aa, Homo sapiens
MSIAGVAAQEIRVPLKTGFLHNGRAMGNMRKTYWSSRSEFKNNFLNIDPITMAYSLNSSAQERLIPLGHASKSAPMNGHCFAENGPSQKSSLPPLLIPPSENLGPHEEDQVVCGFKKLTVNGVCASTPPLTPITLPPLPISEALSLDDTDCEVEFLTSSDTDFLLEDSTLSDFKYDVPGRRSFRGCGQINYAY

SEQ ID NO: 881416 - protein, 462 aa, Homo sapiens; identical to SEQ ID NO: 881399

SEQ ID NO: 881417 - protein, 462 aa, Homo sapiens; identical to SEQ ID NO: 881399

SEQ ID NO: 881418 - protein, 387 aa, Homo sapiens
MNGHCFAENGPSQKSSLPPLLIPPSENLGPHEEDQVVCGFKKLTVNGVCASTPPLTPIKNSPSLFPCAPLCERGSRPLPPLPISEALSLDDTDCEVEFLTSSDTDFLLEDSTLSDFKYDVPGRRSFRGCGQINYAYFDTPAVSAADLSYVSDQNGGVPDPNPPPPQTHRRLRRSHSGPAGSFNKPAIRISNCCIHRASPNSDEDKPEVPPRVPIPPRPVKPDYRRWSAEVTSSTYSDEDRPPKVPPREPLSPSNSRTPSPKSLPSYLNGVMPPTQSFAPDPKYVSSKALQRQNSEGSASKVPCILPIIENGKKVSSTHYYLLPERPPYLDKYEKFFREAEETNGGAQIQPLPADCGISSATEKPDSKTKMDLGGHVKRKHLSYVVSP

SEQ ID NO: 881419 - protein, 387 aa, Homo sapiens; identical to SEQ ID NO: 881418

SEQ ID NO: 881420 - protein, 444 aa, Homo sapiens
MSIAGVAAQEIRVPLKTGFLHNGRAMGNMRKTYWSSRSEFKNNFLNIDPITMAYSLNSSAQERLIPLGHASKSAPMNGHCFAENGPSQKSSLPPLLIPPSENLGPHEEDQVVCGFKKLTVNGVCASTPPLTPIKNSPSLFPCAPLCERGSRPLPPLPISEALSLDDTDCEVEFLTSSDTDFLLEDSTLSDFKYDVPGRRSFRGCGQINYAYFDTPAVSAADLSYVSDLRRSHSGPAGSFNKPAIRISNCCIHRASPNSDEDKPEVPPRVPIPPRPVKPDYRRWSAEVTSSTYSDEDRPPKVPPREPLSPSNSRTPSPKSLPSYLNGVMPPTQSFAPDPKYVSSKALQRQNSEGSASKVPCILPIIENGKKVSSTHYYLLPERPPYLDKYEKFFREAEETNGGAQIQPLPADCGISSATEKPDSKTKMDLGGHVKRKHLSYVVSP

SEQ ID NO: 881421 - protein, 444 aa, Homo sapiens
MSIAGVAAQEIRVPLKTGFLHNGRAMGNMRKTYWSSRSEFKNNFLNIDPITMAYSLNSSAQERLIPLGHASKSAPMNGHCFAENGPSQKSSLPPLLIPPSENLGPHEEDQVVCGFKKLTVNGVCASTPPLTPIKNSPSLFPCAPLCERGSRPLPPLPISEALSLDDTDCEVEFLTSSDTDFLLEDSTLSDFKYDVPGRRSFRGCGQINYAYFDTPAVSAADLSYVSDQNGGVPDPNPPPPQTHRRLRRSHSGPAGSFNKPAIRISNCCIHRASPNSDEDKPEVPPRVPIPPRPVKPDYRRWSAEVTSSTYSDEDRPPKVPPREPLSPSNSRTPSPPDPKYVSSKALQRQNSEGSASKVPCILPIIENGKKVSSTHYYLLPERPPYLDKYEKFFREAEETNGGAQIQPLPADCGISSATEKPDSKTKMDLGGHVKRKHLSYVVSP

SEQ ID NO: 881422 - protein, 462 aa, Homo sapiens; identical to SEQ ID NO: 881399

SEQ ID NO: 881423 - protein, 462 aa, Homo sapiens; identical to SEQ ID NO: 881399

SEQ ID NO: 881424 - protein, 1700 aa, Homo sapiens; identical to SEQ ID NO: 881405

SEQ ID NO: 881425 - protein, 1698 aa, Homo sapiens
TSADDDMASLVFHSTSMCSDHRFGDLEMMSSQNSESEKEKSVSQSVFCGTSTYCVLNTVPPIEDDHGNSNSSHVKIFLPKKLLECLPKCSSLPKERHRWNTNEEIAAYLITFEKHEEWLTTSPKTRPQNGSMILYNRKKVKYRKDGYCWKKRKDGKTTREDHMKLKVQGVECLYGCYVHSSIIPTFHRRCYWLLQNPDIVLVHYLNVPAIEDCGKPCGPILCSINTDKKEWAKWTKEELIGQLKPMFHGIKWTCSNGNSSSGFSVEQLVQQILDSHQTKPQPRTHNCLCTGSLGAGGSVHHKCNSAKHRIISPKVEPRTGGYGSHSEVQHNDVSEGKHEHSHSKGSSREKRNGKVAKPVLLHQSSTEVSSTNQVEVPDTTQSSPVSISSGLNSDPDMVDSPVVTGVSGMAVASVMGSLSQSATVFMSEVTNEAVYTMSPTAGPNHHLLSPDASQGLVLAVSSDGHKFAFPTTGSSESLSMLPTNVSEELVLSTTLDGGRKIPETTMNFDPDCFLNNPKQGQTYGGGGLKAEMVSSNIRHSPPGERSFSFTTVLTKEIKTEDTSFEQQMAKEAYSSSAAAVAASSLTLTAGSSLLPSGGGLSPSTTLEQMDFSAIDSNKDYTSSFSQTGHSPHIHQTPSPSFFLQDASKPLPVEQNTHSSLSDSGGTFVMPTVKTEASSQTSSCSGHVETRIESTSSLHLMQFQANFQAMTAEGEVTMETSQAAEGSEVLLKSGELQACSSEHYLQPETNGVIRSAGGVPILPGNVVQGLYPVAQPSLGNASNMELSLDHFDISFSNQFSDLINDFISVEGGSSTIYGHQLVSGDSTALSQSEDGARAPFTQAEMCLPCCSPQQGSLQLSSSEGGASTMAYMHVAEVVSAASAQGTLGMLQQSGRVFMVTDYSPEWSYPEGGVKVLITGPWQEASNNYSCLFDQISVPASLIQPGVLRCYCPAHDTGLVTLQVAFNNQIISNSVVFEYKARALPTLPSSQHDWLSLDDNQFRMSILERLEQMERRMAEMTGSQQHKQASGGGSSGGGSGSGNGGSQAQCASGTGALGSCFESRVVVVCEKMMSRACWAKSKHLIHSKTFRGMTLLHLAAAQGYATLIQTLIKWRTKHADSIDLELEVDPLNVDHFSCTPLMWACALGHLEAAVVLYKWDRRAISIPDSLGRLPLGIARSRGHVKLAECLEHLQRDEQAQLGQNPRIHCPASEEPSTESWMAQWHSEAISSPEIPKGVTVIASTNPELRRPRSEPSNYYSSESHKDYPAPKKHKLNPEYFQTRQEKLLPTALSLEEPNIRKQSPSSKQSVPETLSPSEGVRDFSRELSPPTPETAAFQASGSQPVGKWNSKDLYIGVSTVQVTGNPKGTSVGKEAAPSQVRPREPMSVLMMANREVVNTELGSYRDSAENEECGQPMDDIQVNMMTLAEHIIEATPDRIKQENFVPMESSGLERTDPATISSTMSWLASYLADADCLPSAAQIRSAYNEPLTPSSNTSLSPVGSPVSEIAFEKPNLPSAADWSEFLSASTSEKVENEFAQLTLSDHEQRELYEAARLVQTAFRKYKGRPLREQQEVAAAVIQRCYRKYKQYALYKKMTQAAILIQSKFRSYYEQKKFQQSRRAAVLIQKYYRSYKKCGKRRQARRTAVIVQQKLRSSLLTKKQDQAARKIMRFLRRCRHRVKELKKAKELEDIQQHPLAM

SEQ ID NO: 881426 - protein, 317 aa, Homo sapiens
MNGHCFAENGPSQKSSLPPLLIPPSENLGPHEEDQVVCGFKKLTVNGVCASTPPLTPIKNSPSLFPCAPLCERGSRPLPPLPISEALSLDDTDCEVEFLTSSDTDFLLEDSTLSDFKYDVPGRRSFRGCGQINYAYFDTPAVSAADLSYVSDQNGGVPDPNPPPPQTHRRLRRSHSGPAGSFNKPAIRISNCCIHRASPNSDEDKPEVPPRVPIPPRPVKPDYRRWSAEVTSSTYSDEDRPPKVPPREPLSPSNSRTPSPKSLPSYLNGVMPPTQSFAPDPKYVSSKALQRQNSEGSASKVPCILPIIENGKKVSSF

SEQ ID NO: 881427 - protein, 107 aa, Homo sapiens; identical to SEQ ID NO: 881395

SEQ ID NO: 881428 - protein, 208 aa, Homo sapiens
QPPSASSVAGDLGRGTRTEVEARAARPGAESAPAAAMPDSWDKDVYPEPPRRTPVQPNPIVYMMKAFDLIVDRPVTLVREFIERQHAKNRYYYYHRQYRRVPDITECKEEDIMCMYEAEMQWKRDYKVDQEIINIMQDRLKACQQREGQNYQQNCIKEVEQFTQVAKAYQDRYQDLGAYSSARKCLAKQRQRMLQERKAAKEAAAATS

SEQ ID NO: 881429 - protein, 208 aa, Homo sapiens; identical to SEQ ID NO: 881428

SEQ ID NO: 881430 - protein, 197 aa, Homo sapiens
QPPSASSVAGDLGRGTRTEVEARAARPGAESAPAAAMPDSWDKDVYPEPPRRTPVQPNPIVYMMKAFDLIVDRPVTLVREFIERQHAKNRYYYYHRQYRRVPDITECKEEDIMCIKVDQEIINIMQDRLKACQQREGQNYQQNCIKEVEQFTQVAKAYQDRYQDLGAYSSARKCLAKQRQRMLQERKAAKEAAAATS

SEQ ID NO: 881431 - protein, 286 aa, Homo sapiens
FMDVYQRSYCHPIETLVDIFQEYPDEIEYIFKPSCVPLMRCGGCCNDEGLECVPTEESNITMQIMRIKPHQGQHIGEMSFLQHNKCECRPKKDRARQENPCGPCSEAESAPAAAMPDSWDKDVYPEPPRRTPVQPNPIVYMMKAFDLIVDRPVTLVREFIERQHAKNRYYYYHRQYRRVPDITECKEEDIMCMYEAEMQWKRDYKVDQEIINIMQDRLKACQQREGQNYQQNCIKEVEQFTQVAKAYQDRYQDLGAYSSARKCLAKQRQRMLQERKAAKEAAAATS

SEQ ID NO: 881432 - protein, 208 aa, Homo sapiens; identical to SEQ ID NO: 881428

SEQ ID NO: 881433 - protein, 259 aa, Homo sapiens
QPPSASSVAGDLGRGTRTEVEARAARPGAESAPAAAMPDSWDKDVYPEPPRRTPVQPNPIVYMMKAFDLIVDRPVTLVREFIERQHAKNRYYYYHRQYRRVPDITECKEEDIMCMYEAEMQWKRDYKVDQEIINIMQDRLKACQQREGRPPGPDSGPGRPCHLGELLHFLDTVLLVVLSFPLLTGFEPILHNVDNFLVDFVVPLPLHFGFIHAHDVLLLALSDVWHAAVLPVVVVIPVLCVLPLYKFSHEVDAAANLVV

SEQ ID NO: 881434 - protein, 204 aa, Homo sapiens
QPPSASSVAGDLGRGTRTEVEARAARPGAESAPAAAMPDSWDKDVYPEPPRRTPVQPNPIVYMMKAFDLIVDRPVTLVREFIERQHAKNRYYYYHRQYRRVPDITECKEEDIMCMYEAEMQWKRDYKVDQEIINIMQDRLKACQQREGQNYQQNCIKEVEQFTQVAKAYQDRCACPTHPQPPTILLRPGGQNHCKSSLPSLVLT

SEQ ID NO: 881435 - protein, 94 aa, Homo sapiens
QPPSASSVAGDLGRGTRTEVEARAARPGAESAPAAAMPDSWDKDVYPEPPRRTPVQPNPIVYMMKAFDLIVDRPVTLVRGTKPQPGAPSPASGD

SEQ ID NO: 881436 - protein, 208 aa, Homo sapiens; identical to SEQ ID NO: 881428

SEQ ID NO: 881437 - protein, 303 aa, Homo sapiens
QPPSASSVAGDLGRGTRTEVEARAARPGAESAPAAAMPDSWDKDVYPEPPRRTPVQPNPIVYMMKAFDLIVDRPVTLVREFIERQHAKNRYYYYHRQYRRVPDITECKEEDIMCMYEAEMQWKRDYKVDQEIINIMQDRLKACQQREDSHQSHTAGAPTAASGGGSGGLFCSFSLLQHPLPLFGQALPGRTVGPQVLIAVLVGLGHLGELLHFLDTVLLVVLSFPLLTGFEPILHNVDNFLVDFVVPLPLHFGFIHAHDVLLLALSDVWHAAVLPVVVVIPVLCVLPLYKFSHEVDAAANLVV

SEQ ID NO: 881438 - protein, 125 aa, Homo sapiens
QPPSASSVAGDLGRGTRTEVEARAARPGAESAPAAAMPDSWDKDVYPEPPRRTPVQPNPIVYMMKAFDLIVDRPVTLVREFIERQHAKNRYYYYHRQYRRVPDITECKPGGQNHCKSSLPSLVLT

SEQ ID NO: 881439 - protein, 701 aa, Homo sapiens
KASAIQRKGRAGRCRPGICFRLFSRLRFQNMLEFQTPELLRMPLQELCLHTKLLAPVNCPIADFLMKAPEPPPALIVRNAVQMLKTIDAMDTWEDLTELGYHLADLPVEPHLGKMVLCAVVLKCLDPILTVACTLAYRDPFVLPTQASQKRAAMLCRKRFTAGAFSDHMALLRAFQAWQKARSDGWERAFCEKNFLSQATMEIIIGMRTQLLGQLRASGFVRARGGGDIRDVNTNSENWAVVKAALVAGMYPNLVHVDRENLVLTGPKEKKVRFHPASVLSQPQYKKIPPANGQAAAIKALPTDWLIYDEMTRAHRIANIRCCSAVTPVTILVFCGPARLASNALQEPSSFRVDGIPNDSSDSEMEDKTTANLAALKLDEWLHFTLEPEAASLLLQLRQKWHSLFLRRMRAPSKPWSQVDEATIRAIIAVLSTEEQSAGLQQPSGIGQRPRPMSSEELPLASSWRSNNSRKSSADTEFSDECTTAERVLMKSPSPALHPPQKYKDRGILHPKRGTEDRSDQSSLKSTDSSSYPSPCASPSPPSSGKGSKSPSPRPNMPVRYFIMKSSNLRNLEISQQKGIWSTTPSNERKLNRAFWESSIVYLVFSVQGSGHFQGFSRMSSEIGREKSQDWGSAGLGGVFKVEWIRKESLPFQFAHHLLNPWNDNKKVQISRDGQELEPQVGEQLLQLWERLPLGEKNTTD

SEQ ID NO: 881440 - protein, 227 aa, Homo sapiens
LSGTDSLLYHRYRVLMKSPSPALHPPQKYKDRGILHPKRGTEDRSDQSSLKSTDSSSYPSPCASPSPPSSGKGSKSPSPRPNMPVRYFIMKSSNLRNLEISQQKGIWSTTPSNERKLNRAFWESSIVYLVFSVQGSGHFQGFSRMSSEIGREKSQDWGSAGLGGVFKVEWIRKESLPFQFAHHLLNPWNDNKKVQISRDGQELEPQVGEQLLQLWERLPLGEKNTTD

SEQ ID NO: 881441 - protein, 443 aa, Homo sapiens
MEIIIGMRTQLLGQLRASGFVRARGGGDIRDVNTNSENWAVVKAALVAGMYPNLVHVDRENLVLTGPKEKKVRFHPASVLSQPQYKKIPPANGQAAAIKALPTDWLIYDEMTRAHRIANIRCCSAVTPVTILVFCGPARLASNALQEPSSFRVDGIPNDSSDSEMEDKTTANLAALKLDEWLHFTLEPEAASLLLQLRQKWHSLFLRRMRAPSKPWSQVDEATIRAIIAVLSTEEQSAGLQQPSGIGQRPRPMSSEELPLASSWRSNNSRKSSADTEFSDECTTAERVLMKSPSPALHPPQKYKDRGILHPKRGTEDRSDQSSLKSTDSSSYPSPCASPSPPSSGKGSKSPSPRPNMPVRYFIMKSSNLRNLEISQQKGIWSTTPSNERKLNRAFWESSIVYLVFSVQGSGHFQGFSRMSSEIGREKSQDWGSAGLGGVFKVE

SEQ ID NO: 881442 - protein, 501 aa, Homo sapiens [sequence omitted]

SEQ ID NO: 881443 - protein, 501 aa, Homo sapiens [sequence omitted]

SEQ ID NO: 881444 - protein, 501 aa, Homo sapiens [sequence omitted]

SEQ ID NO: 881445 - protein, 501 aa, Homo sapiens [sequence omitted]

SEQ ID NO: 881446 - protein, 501 aa, Homo sapiens [sequence omitted]

SEQ ID NO: 881447 - protein, 212 aa, Homo sapiens [sequence omitted]

SEQ ID NO: 881448 - protein, 500 aa, Homo sapiens
MEIIIGMRTQLLGQLRASGFVRARGGGDIRDVNTNSENWAVVKAALVAGMYPNLVHVDRENLVLTGPKEKKVRFHPASVLSQPQYKKIPPANGQAAAIKALPTDWLIYDEMTRAHRIANIRCCSAVTPVTILVFCGPARLASNALQEPSSFRVDGIPNDSSDSEMEDKTTANLAALKLDEWLHFTLEPEAASLLLQLRQKWHSLFLRRMRAPSKPWSQVDEATIRAIIAVLSTEEQSAGLQQPSGIGQRPRPMSSEELPLASSWRSNNSRKSSADTEFSDECTTAERVLMKSPSPALHPPQKYKDRGILHPKRGTEDRSDQSSLKSTDSSSYPSPCASPSPPSSGKGSKSPSPRPNMPVRYFIMKSSNLRNLEISQQKGIWSTTPSNERKLNRAFWESSIVYLVFSVQGSGHFQGFSRMSSEIGREKSQDWGSAGLGGVFKVEWIRKESLPFQFAHHLLNPWNDNKKVQISRDGQELEPQVGEQLLQLWERLPLGDICDH

SEQ ID NO: 881449 - protein, 212 aa, Homo sapiens [sequence omitted]

SEQ ID NO: 881450 - protein, 501 aa, Homo sapiens [sequence omitted]

SEQ ID NO: 881451 - protein, 498 aa, Homo sapiens
MEIIIGMRTQLLGQLRASGFVRARGGGDIRDVNTNSENWAVVKAALVAGMYPNLVHVDRENLVLTGPKEKKVRFHPASVLSQPQYKKIPPANGQAAAIKALPTDWLIYDEMTRAHRIANIRCCSAVTPVTILVFCGPARLASNALQEPSSFRVDGIPNDSSDSEMEDKTTANLAALKLDEWLHFTLEPEAASLLLQLRQKWHSLFLRRMRAPSKPWSQVDEATIRAIIAVLSTEEQSAGLQQPSGIGQRPRPMSSEELPLASSWRSNNSRKSSADTEFSDECTTAERVLMKSPSPALHPPQKYKDRGILHPKRGTEDRSDQSSLKSTDSSSYPSPCASPSPPSSGKGSKSPSPRPNMPVRYFIMKSSNLRNLEISQQKGIWSTTPSNERKLNRAFWESSIVYLVFSVQGSGHFQGFSRMSSEIGREKSQDWGSAGLGGVFKVEWIRKESLPFQFAHHLLNPWNDNKKVQISRDGQVYNGIFFFIYFCFCLFSVIQCFN

SEQ ID NO: 881452 - protein, 110 aa, Homo sapiens
MPEKLQTLRPRSLSGAEVAHCQPQVKCQGGDGAGSTRRRGQAPPEGGARPQGKVEMSLWHPQEVYQICPRASDPLDLSGLHSSGSHCFFLEGGRKCSHQSLPTGHLGGFS

SEQ ID NO: 881453 - protein, 847 aa, Homo sapiens
MAKPLTDQEKRRQISIRGIVGVENVAELKKSFNRHLHFTLVKDRNVATTRDYYFALAHTVRDHLVGRWIRTQQHYYDKCPKRVYYLSLEFYMGRTLQNTMINLGLQNACDEAIYQLGLDIEELEEIEEDAGLGNGGLGRLAACFLDSMATLGLAAYGYGIRYEYGIFNQKIRDGWQVEEADDWLRYGNPWEKSRPEFMLPVHFYGKVEHTNTGTKWIDTQVVLALPYDTPVPGYMNNTVNTMRLWSARAPNDFNLRDFNVGDYIQAVLDRNLAENISRVLYPNDNFFEGKELRLKQEYFVVAATLQDIIRRFKASKFGSTRGAGTVFDAFPDQVAIQLNDTHPALAIPELMRIFVDIEKLPWSKAWELTQKTFAYTNHTVLPEALERWPVDLVEKLLPRHLEIIYEINQKHLDRIVALFPKDVDRLRRMSLIEEEGSKRINMAHLCIVGSHAVNGVAKIHSDIVKTKVFKDFSELEPDKFQNKTNGITPRRWLLLCNPGLAELIAEKIGEDYVKDLSQLTKLHSFLGDDVFLRELAKVKQENKLKFSQFLETEYKVKINPSSMFDVQVKRIHEYKRQLLNCLHVITMYNRIKKDPKKLFVPRTVIIGGKAAPGYHMAKMIIKLITSVADVVNNDPMVGSKLKVIFLENYRVSLAEKVIPATDLSEQISTAGTEASGTGNMKFMLNGALTIGTMDGANVEMAEEAGEENLFIFGMRIDDVAALDKKGYEAKEYYEALPELKLVIDQIDNGFFSPKQPDLFKDIINMLFYHDRFKVFADYEAYVKCQDKVSQLYMNPKAWNTMVLKNIAASGKFSSDRTIKEYAQNIWNVEPSDLKISLSNESNKVNGN

SEQ ID NO: 881454 - protein, 756 aa, Homo sapiens
MGRTLQNTMINLGLQNACDEAIYQLGLDIEELEEIEEDAGLGNGGLGRLAACFLDSMATLGLAAYGYGIRYEYGIFNQKIRDGWQVEEADDWLRYGNPWEKSRPEFMLPVHFYGKVEHTNTGTKWIDTQVVLALPYDTPVPGYMNNTVNTMRLWSARAPNDFNLRDFNVGDYIQAVLDRNLAENISRVLYPNDNFFEGKELRLKQEYFVVAATLQDIIRRFKASKFGSTRGAGTVFDAFPDQVAIQLNDTHPALAIPELMRIFVDIEKLPWSKAWELTQKTFAYTNHTVLPEALERWPVDLVEKLLPRHLEIIYEINQKHLDRIVALFPKDVDRLRRMSLIEEEGSKRINMAHLCIVGSHAVNGVAKIHSDIVKTKVFKDFSELEPDKFQNKTNGITPRRWLLLCNPGLAELIAEKIGEDYVKDLSQLTKLHSFLGDDVFLRELAKVKQENKLKFSQFLETEYKVKINPSSMFDVQVKRIHEYKRQLLNCLHVITMYNRIKKDPKKLFVPRTVIIGGKAAPGYHMAKMIIKLITSVADVVNNDPMVGSKLKVIFLENYRVSLAEKVIPATDLSEQISTAGTEASGTGNMKFMLNGALTIGTMDGANVEMAEEAGEENLFIFGMRIDDVAALDKKGYEAKEYYEALPELKLVIDQIDNGFFSPKQPDLFKDIINMLFYHDRFKVFADYEAYVKCQDKVSQLYMNPKAWNTMVLKNIAASGKFSSDRTIKEYAQNIWNVEPSDLKISLSNESNKVNGN

SEQ ID NO: 881455 - protein, 813 aa, Homo sapiens
MAKPLTDQEKRRQISIRGIVGVENVAELKKSFNRHLHFTLVKDRNVATTRDYYFALAHTVRDHLVGRWIRTQQHYYDKCPKLGLDIEELEEIEEDAGLGNGGLGRLAACFLDSMATLGLAAYGYGIRYEYGIFNQKIRDGWQVEEADDWLRYGNPWEKSRPEFMLPVHFYGKVEHTNTGTKWIDTQVVLALPYDTPVPGYMNNTVNTMRLWSARAPNDFNLRDFNVGDYIQAVLDRNLAENISRVLYPNDNFFEGKELRLKQEYFVVAATLQDIIRRFKASKFGSTRGAGTVFDAFPDQVAIQLNDTHPALAIPELMRIFVDIEKLPWSKAWELTQKTFAYTNHTVLPEALERWPVDLVEKLLPRHLEIIYEINQKHLDRIVALFPKDVDRLRRMSLIEEEGSKRINMAHLCIVGSHAVNGVAKIHSDIVKTKVFKDFSELEPDKFQNKTNGITPRRWLLLCNPGLAELIAEKIGEDYVKDLSQLTKLHSFLGDDVFLRELAKVKQENKLKFSQFLETEYKVKINPSSMFDVQVKRIHEYKRQLLNCLHVITMYNRIKKDPKKLFVPRTVIIGGKAAPGYHMAKMIIKLITSVADVVNNDPMVGSKLKVIFLENYRVSLAEKVIPATDLSEQISTAGTEASGTGNMKFMLNGALTIGTMDGANVEMAEEAGEENLFIFGMRIDDVAALDKKGYEAKEYYEALPELKLVIDQIDNGFFSPKQPDLFKDIINMLFYHDRFKVFADYEAYVKCQDKVSQLYMNPKAWNTMVLKNIAASGKFSSDRTIKEYAQNIWNVEPSDLKISLSNESNKVNGN

SEQ ID NO: 881456 - protein, 519 aa, Homo sapiens
MAKPLTDQEKRRQISIRGIVGVENVAELKKSFNRHLHFTLVKDRNVATTRDYYFALAHTVRDHLVGRWIRTQQHYYDKCPKRVYYLSLEFYMGRTLQNTMINLGLQNACDEAIYQLGLDIEELEEIEEDAGLGNGGLGRLAACFLDSMATLGLAAYGYGIRYEYGIFNQKIRDGWQVEEADDWLRYGNPWEKSRPEFMLPVHFYGKVEHTNTGTKWIDTQVVLALPYDTPVPGYMNNTVNTMRLWSARAPNDFNLRDFNVGDYIQAVLDRNLAENISRVLYPNDNFFEGKELRLKQEYFVVAATLQDIIRRFKASKFGSTRGAGTVFDAFPDQVAIQLNDTHPALAIPELMRIFVDIEKLPWSKAWELTQKTFAYTNHTVLPEALERWPVDLVEKLLPRHLEIIYEINQKHLDRIVALFPKDVDRLRRMSLIEEEGSKRINMAHLCIVGSHAVNGVAKIHSDIVKTKVFKDFSELEPDKFQNKTNGITPRRWLLLCNPGLAELIAESWVMMSSSGNSPR

SEQ ID NO: 881457 - protein, 719 aa, Homo sapiens
QAGLATWIRRKASNTVPVPGVEPNLEALKRADDIVARLRPPQSIPASIFRLLPFKKIVIGIEDPGRCSRAGFGPAQTECMVSNTGTKWIDTQVVLALPYDTPVPGYMNNTVNTMRLWSARAPNDFNLRDFNVGDYIQAVLDRNLAENISRVLYPNDNFFEGKELRLKQEYFVVAATLQDIIRRFKASKFGSTRGAGTVFDAFPDQVAIQLNDTHPALAIPELMRIFVDIEKLPWSKAWELTQKTFAYTNHTVLPEALERWPVDLVEKLLPRHLEIIYEINQKHLDRIVALFPKDVDRLRRMSLIEEEGSKRINMAHLCIVGSHAVNGVAKIHSDIVKTKVFKDFSELEPDKFQNKTNGITPRRWLLLCNPGLAELIAEKIGEDYVKDLSQLTKLHSFLGDDVFLRELAKVKQENKLKFSQFLETEYKVKINPSSMFDVQVKRIHEYKRQLLNCLHVITMYNRIKKDPKKLFVPRTVIIGGKAAPGYHMAKMIIKLITSVADVVNNDPMVGSKLKVIFLENYRVSLAEKVIPATDLSEQISTAGTEASGTGNMKFMLNGALTIGTMDGANVEMAEEAGEENLFIFGMRIDDVAALDKKGYEAKEYYEALPELKLVIDQIDNGFFSPKQPDLFKDIINMLFYHDRFKVFADYEAYVKCQDKVSQLYMNPKAWNTMVLKNIAASGKFSSDRTIKEYAQNIWNVEPSDLKISLSNESNKVNGN

SEQ ID NO: 881458 - protein, 468 aa, Homo sapiens
MAKPLTDQEKRRQISIRGIVGVENVAELKKSFNRHLHFTLVKDRNVATTRDYYFALAHTVRDHLVGRWIRTQQHYYDKCPKRVYYLSLEFYMGRTLQNTMINLGLQNACDEAIYQLGLDIEELEEIEEDAGLGNGGLGRLAACFLDSMATLGLAAYGYGIRYEYGIFNQKIRDGWQVEEADDWLRYGNPWEKSRPEFMLPVHFYGKVEHTNTGTKWIDTQVVLALPYDTPVPGYMNNTVNTMRLWSARAPNDFNLRDFNVGDYIQAVLDRNLAENISRVLYPNDNFFEGKELRLKQEYFVVAATLQDIIRRFKASKFGSTRGAGTVFDAFPDQVAIQLNDTHPALAIPELMRIFVDIEKLPWSKAWELTQKTFAYTNHTVLPEALERWPVDLVEKLLPRHLEIIYEINQKHLDRIVALFPKDVDRLRRMSLIEEEGSKRINMAHLCIVGSHAVNGVAKIHSDIVKTKV

SEQ ID NO: 881459 - protein, 225 aa, Homo sapiens
MAKPLTDQEKRRQISIRGIVGVENVAELKKSFNRHLHFTLVKDRNVATTRDYYFALAHTVRDHLVGRWIRTQQHYYDKCPKRVYYLSLEFYMGRTLQNTMINLGLQNACDEAIYQLGLDIEELEEIEEDAGLGNGGLGRLAACFLDSMATLGLAAYGYGIRYEYGIFNQKIRDGWQVEEADDWLRYGNPWEKSRPEFMLPVHFYGKVEHTNTGTKWIDTQFRVLV

SEQ ID NO: 881460 - protein, 847 aa, Homo sapiens; identical to SEQ ID NO: 881453

SEQ ID NO: 881461 - protein, 847 aa, Homo sapiens; identical to SEQ ID NO: 881453

SEQ ID NO: 881462 - protein, 613 aa, Homo sapiens [sequence omitted]

SEQ ID NO: 881463 - protein, 807 aa, Homo sapiens
MAKPLTDQEKRRQISIRGIVGVENVAELKKSFNRHLHFTLVKDRNVATTRDYYFALAHTVRDHLVGRWIRTQQHYYDKCPKRVYYLSLEFYMGRTLQNTMINLGLQNACDEAIYQLGLDIEELEEIEEDAGLGNGGLGRLAACFLDSMATLGLAAYGYGIRYEYGIFNQKIRDGWQVEEADDWLRYGNPWEKSRPEFMLPVHFYGKVEHTNTGTKWIDTQVVLALPYDTPVPGYMNNTVNTMRLWSARAPNDFNLRDFNVGDYIQAVLDRNLAENISRVLYPNDNFFEGKELRLKQEYFVVAATLQDIIRRFKASKFGSTRGAGTVFDAFPDQVAIQLNDTHPALAIPELMRIFVDIEKLPWSKAWELTQKTFAYTNHTVLPEALERWPVDLVEKLLPRHLEIIYEINQKHLDRIVALFPKDVDRLRRMSLIEEEGSKRINMAHLCIVGSHAVNGVAKIHSDIVKTKVFKDFSELEPDKFQNKTNGITPRRWLLLCNPGLAELIAEKIGEDYVKDLSQLTKLHSFLGDDVFLRELAKVKQENKLKFSQFLETEYKVKINPSSMFDVQVKRIHEYKRQLLNCLHVITMYNRIKKDPKKLFVPRTVIIGGKAAPGYHMAKMIIKLITSVADVVNNDPMVGSKLKVIFLENYRVSLAEKVIPATDLSEQISTAGTEASGTGNMKFMLNGALTIGTMDGANVEMAEEAGEENLFIFGMRIDDVAALDKKGYEAKEYYEALPELKLVIDQIDNGFFSPKQPDLFKDIINMLFYHDRFKVFADYEAYVKCQDKVSQLYMVSKLPRFIKKTSLL

SEQ ID NO: 881464 - protein, 752 aa, Homo sapiens
MAKPLTDQEKRRQISIRGIVGVENVAELKKSFNRHLHFTLVKDRNVATTRDYYFALAHTVRDHLVGRWIRTQQHYYDKCPKRVYYLSLEFYMGRTLQNTMINLGLQNACDEAIYQLGLDIEELEEIEEDAGLGNGGLGRLAACFLDSMATLGLAAYGYGIRYEYGIFNQKIRDGWQVEEADDWLRYGNPWEKSRPEFMLPVHFYGKVEHTNTGTKWIDTQVVLALPYDTPVPGYMNNTVNTMRLWSARAPNDFNLRDFNVGDYIQAVLDRNLAENISRVLYPNDNFFEGKELRLKQEYFVVAATLQDIIRRFKASKFGSTRGAGTVFDAFPDQVAIQLNDTHPALAIPELMRIFVDIEKLPWSKAWELTQKTFAYTNHTVLPEALERWPVDLVEKLLPRHLEIIYEINQKHLDRIVALFPKDVDRLRRMSLIEEEGSKRINMAHLCIVGSHAVNGVAKIHSDIVKTKVFKDFSELEPDKFQNKTNGITPRRWLLLCNPGLAELIAEKIGEDYVKDLSQLTKLHSFLGDDVFLRELAKVKQENKLKFSQFLETEYKVKINPSSMFDVQVKRIHEYKRQLLNCLHVITMYNRIKKDPKKLFVPRTVIIGGKAAPGYHMAKMIIKLITSVADVVNNDPMVGSKLKVIFLENYRVSLAEKVIPATDLSEQISTAGTEASGTGNMKFMLNGALTIGTMDGANVEMAEEAGEENLFIFGMRIDDVAALDKKGYEANTTYYEATSRAPVDAAANLVVVG

SEQ ID NO: 881465 - protein, 437 aa, Homo sapiens
MNFYLNDSHSYCQPVPPPLFNLSKPALGFLNITPNFVQCAGPFAVSAKFSDVVSSISRFKDFSELEPDKFQNKTNGITPRRWLLLCNPGLAELIAEKIGEDYVKDLSQLTKLHSFLGDDVFLRELAKVKQENKLKFSQFLETEYKVKINPSSMFDVQVKRIHEYKRQLLNCLHVITMYNRIKKDPKKLFVPRTVIIGGKAAPGYHMAKMIIKLITSVADVVNNDPMVGSKLKVIFLENYRVSLAEKVIPATDLSEQISTAGTEASGTGNMKFMLNGALTIGTMDGANVEMAEEAGEENLFIFGMRIDDVAALDKKGYEAKEYYEALPELKLVIDQIDNGFFSPKQPDLFKDIINMLFYHDRFKVFADYEAYVKCQDKVSQLYMNPKAWNTMVLKNIAASGKFSSDRTIKEYAQNIWNVEPSDLKISLSNESNKVNGN

SEQ ID NO: 881466 - protein, 354 aa, Homo sapiens
SKKRKTRPPNSSRPQFLETEYKVKINPSSMFDVQVKRIHEYKRQLLNCLHVITMYNREISPVANKPPCRWKQQTQHRSHCPDRQLSSISSTSPSFSGIKKDPKKLFVPRTVIIGGKAAPGYHMAKMIIKLITSVADVVNNDPMVGSKLKVIFLENYRVSLAEKVIPATDLSEQISTAGTEASGTGNMKFMLNGALTIGTMDGANVEMAEEAGEENLFIFGMRIDDVAALDKKGYEAKEYYEALPELKLVIDQIDNGFFSPKQPDLFKDIINMLFYHDRFKVFADYEAYVKCQDKVSQLYMNPKAWNTMVLKNIAASGKFSSDRTIKEYAQNIWNVEPSDLKISLSNESNKVNGN

SEQ ID NO: 881467 - protein, 1212 aa, Homo sapiens
LPNPPPEEISTGTQSTFSTMGTVSRRRICRTNTMARAKILQDIDRELDLVERESAKLRKKQAELDEEEKEIDAKLRYLEMGINRRKEALLKEREKRERAYLQGVAEDRDYMSDSEVSSTRPTRIESQHGIERPRTAPQTEFSQFIPPQTQTESQLVPPTSPYTQYQYSSPALPTQAPTSYTQQSHFEQQTLYHQQVSPYQTQPTFQAVATMSFTPQVQPTPTPQPSYQLPSQMMVIQQKPRQTTLYLEPKITSNYEVIRNQPLMIAPVSTDNTFAVSHLGSKYNSLDLRIGLEERSSMASSPISSISADSFYADIDHHTPRNYVLIDDIGEITKGTAALSTAFSLHEKDLSKTDRLLRTTETRRSQEVTDFLAPLQSSSRLHSYVKAEEDPMEDPYELKLLKHQIKQEFRRGTESLDHLAGLSHYYHADTSYRHFPKSEKYSISRLTLEKQAAKQLPAAILYQKQSKHKKSLIDPKMSKFSPIQESRDLEPDYSSYMTSSTSSIGGISSRARLLQDDITFGLRKNITDQQKFMGSSLGTGLGTLGNTIRSALQDEADKPYSSGSRSRPSSRPSSVYGLDLSIKRDSSSSSLRLKAQEAEALDVSFSHASSSARTKPTSLPISQSRGRIPIVAQNSEEESPLSPVGQPMGMARAAAGPLPPISADTRDQFGSSHSLPEVQQHMREESRTRGYDRDIAFIMDDFQHAMSDSEAYHLRREETDWFDKPRESRLENGHGLDRKLPERLVHSRPLSQHQEQIIQMNGKTMHYIFPHARIKITRDSKDHTVSGNGLGIRIVGGKEIPGHSGEIGAYIAKILPGGSAEQTGKLMEGMQVLEWNGIPLTSKTYEEVQSIISQQSGEAEICVRLDLNMLSDSENSQHLELHEPPKAVDKAKSPGVDPKQLAAELQKVSLQQSPLVLSSVVEKGSHVHSGPTSAGSSSVPSPGQPGSPSVSKKKHGSSKPTDGTKVVSHPITGEIQLQINYDLGNLIIHILQARNLVPRDNNGYSDPFVKVYLLPGRGQVMVVQNASAEYKRRTKHVQKSLNPEWNQTVIYKSISMEQLKKKTLEVTVWDYDRFSSNDFLGEVLIDLSSTSHLDNTPRWYPLKEQTESIDHGKSHSSQSSQQSPKPSVIKSRSHGIFPDPSKDMQVPTIEKSHSSPGSSKSSSEGHLRSHGPSRSQSKTSVTQTHLEDAGAAIAAAEAAVQQLRIQPSKRRK

SEQ ID NO: 881468 - protein, 565 aa, Homo sapiens
MGMARAAAGPLPPISADTRDQFGSSHSLPEVQQHMREESRTRGYDRDIAFIMDDFQHAMSDSEAYHLRREETDWFDKPRESRLENGHGLDRKLPERLVHSRPLSQHQEQIIQMNGKTMHYIFPHARIKITRDSKDHTVSGNGLGIRIVGGKEIPGHSGEIGAYIAKILPGGSAEQTGKLMEGMQVLEWNGIPLTSKTYEEVQSIISQQSGEAEICVRLDLNMLSDSENSQHLELHEPPKAVDKAKSPGVDPKQLAAELQKVSLQQSPLVLSSVVEKGSHVHSGPTSAGSSSVPSPGQPGSPSVSKKKHGSSKPTDGTKVVSHPITGEIQLQINYDLGNLIIHILQARNLVPRDNNGYSDPFVKVYLLPGRGQVMVVQNASAEYKRRTKHVQKSLNPEWNQTVIYKSISMEQLKKKTLEVTVWDYDRFSSNDFLGEVLIDLSSTSHLDNTPRWYPLKEQTESIDHGKSHSSQSSQQSPKPSVIKSRSHGIFPDPSKDMQVPTIEKSHSSPGSSKSSSEGHLRSHGPSRSQSKTSVTQTHLEDAGAAIAAAEAAVQQLRIQPSKRRK

SEQ ID NO: 881469 - protein, 436 aa, Homo sapiens
LRCDFAFCHDCEAFPATWNCNGLGIRIVGGKEIPGHSGEIGAYIAKILPGGSAEQTGKLMEGMQVLEWNGIPLTSKTYEEVQSIISQQSGEAEICVRLDLNMLSDSENSQHLELHEPPKAVDKAKSPGVDPKQLAAELQKVSLQQSPLVLSSVVEKGSHVHSGPTSAGSSSVPSPGQPGSPSVSKKKHGSSKPTDGTKVVSHPITGEIQLQINYDLGNLIIHILQARNLVPRDNNGYSDPFVKVYLLPGRGAEYKRRTKHVQKSLNPEWNQTVIYKSISMEQLKKKTLEVTVWDYDRFSSNDFLGEVLIDLSSTSHLDNTPRWYPLKEQTESIDHGKSHSSQSSQQSPKPSVIKSRSHGIFPDPSKDMQVPTIEKSHSSPGSSKSSSEGHLRSHGPSRSQSKTSVTQTHLEDAGAAIAAAEAAVQQLRIQPSKRRK

SEQ ID NO: 881470 - protein, 357 aa, Homo sapiens
MEVLRPQLIRIDGRNYRKNPVQEQTYQHEEDEEDFYQGSMECADEPCDAYEVEQTPQGFRSTLRAPSLLYKHIVGKRGDTRKKIEMETKTSISIPKPGQDGEIVITGQHRNGVISARTRIDVLLDTFRRKQPFTHFLAFFLNEVEVQEGFLRFQEEVLAKCSMDHGVDSSIFQNPKKLHLTIGMLVLLSEEEIQQTCEMLQQCKEEFINDISGGKPLEVEMAGIEYMNDDPGMVDVLYAKVHMKDGSNRLQELVDRVLERFQASGLIVKEWNSVKLHATVMNTLFRKDPNAEGRYNLYTAEGKYIFKERESFDGRNILKLFENFYFGSLKLNSIHISQRFTVDSFGNYASCGQIDFS

SEQ ID NO: 881471 - protein, 357 aa, Homo sapiens; identical to SEQ ID NO: 881470

SEQ ID NO: 881472 - protein, 357 aa, Homo sapiens; identical to SEQ ID NO: 881470

SEQ ID NO: 881473 - protein, 357 aa, Homo sapiens; identical to SEQ ID NO: 881470

SEQ ID NO: 881474 - protein, 317 aa, Homo sapiens
MEVLRPQLIRIDGRNYRKNPVQEQTYQHEEDEEDFYQGSMECADEPCDAYEVEQTPQGFRSTLRAPSLLYKHIVGKRGDTRKKIEMETKTSISIPKPGQDGEIVITGQHRNGVISARTRIDVLLDTFRRKQPFTHFLAFFLNEVEVQEGFLRFQEEVLAKCSMDHGVDSSIFQNPKKLHLTIGMLVLLSEEEIQQTCEMLQQCKEEFIKLQELVDRVLERFQASGLIVKEWNSVKLHATVMNTLFRKDPNAEGRYNLYTAEGKYIFKERESFDGRNILKLFENFYFGSLKLNSIHISQRFTVDSFGNYASCGQIDFS

SEQ ID NO: 881475 - protein, 357 aa, Homo sapiens; identical to SEQ ID NO: 881470

SEQ ID NO: 881476 - protein, 334 aa, Homo sapiens [sequence omitted]

SEQ ID NO: 881477 - protein, 408 aa, Homo sapiens
RTRSRRGIPGPPPRPTLVYLQPPSPLLLLFDDSGPRLPSRGIIGISFGESVMEVLRPQLIRIDGRNYRKNPVQEQTYQHEEDEEDFYQGSMECADEPCDAYEVEQTPQGFRSTLRAPSLLYKHIVGKRGDTRKKIEMETKTSISIPKPGQDGEIVITGQHRNGVISARTRIDVLLDTFRRKQPFTHFLAFFLNEVEVQEGFLRFQEEVLAKCSMDHGVDSSIFQNPKKLHLTIGMLVLLSEEEIQQTCEMLQQCKEEFINDISGGKPLEVEMAGIEYMNDDPGMVDVLYAKVHMKDGSNRLQELVDRVLERFQASGLIVKEWNSVKLHATVMNTLFRKDPNAEGRYNLYTAEGKYIFKERESFDGRNILKLFENFYFGSLKLNSIHISQRFTVDSFGNYASCGQIDFS

SEQ ID NO: 881478 - protein, 372 aa, Homo sapiens
MEVLRPQLIRIDGRNYRKNPVQEQTYQHEEDEEDFYQGSMECADEPCDAYEVEQTPQGFRSTLRAPSLLYKHIVGKRGDTRKKIEMETKTSISIPKPGQDGEIVITGQHRNGVISARTRIDVLLDTFRRKQPFTHFLAFFLNEVEVQEGFLRFQEEVLAKCSMDHGVDSSIFQNPKKLHLTIGMLVLLSEEEIQQTCEMLQQCKEEFINDISGGKPLEVEMAGIEYMNDDPGMVDVLYAKVHMKDGSNRLQELVDRVLERFQASGLIVKEWNSVKLHATVMNTLFRKDPNAEGRYNLYTAEGKYIFKERESFDGRNILKSFALLPRLEYNDAISAHCNLCLPGSSDSPASASQVAGITGVSDAYSQSLPGKS

SEQ ID NO: 881479 - protein, 292 aa, Homo sapiens
MEVLRPQLIRIDGRNYRKNPVQEQTYQHEEDEEDFYQGSMECADEPCDAYEVEQTPQGFRSTLRAPSLLYKHIVGKRGDTRKKIEMETKTSISIPKPGQDGEIVITGQHRNGVISARTRIDVLLDTFRRKQPFTHFLAFFLNEVEVQEGFLRFQEEVLAKCSMDHGVDSSIFQNPKKLHLTIGMLVLLSEEEIQQTCEMLQQCKEEFINDISGGKPLEVEMAGIEYMNDDPGMVDVLYAKVHMKDGSNRLQELVDRVLERFQASGLIVKEWNSVKLHATVMNTLFRKDPNVV

SEQ ID NO: 881480 - protein, 372 aa, Homo sapiens; identical to SEQ ID NO: 881478

SEQ ID NO: 881481 - protein, 1015 aa, Homo sapiens
MRGSGPRGAGHRRPPSGGGDTPITPASLAGCYSAPRRAPLWTCLLLCAALRTLLASPSNEVNLLDSRTVMGDLGWIAFPKNGWEEIGEVDENYAPIHTYQVCKVMEQNQNNWLLTSWISNEGASRIFIELKFTLRDCNSLPGGLGTCKETFNMYYFESDDQNGRNIKENQYIKIDTIAADESFTELDLGDRVMKLNTEVRDVGPLSKKGFYLAFQDVGACIALVSVRVYYKKCPSVVRHLAVFPDTITGADSSQLLEVSGSCVNHSVTDEPPKMHCSAEGEWLVPIGKCMCKAGYEEKNGTCQVCRPGFFKASPHIQSCGKCPPHSYTHEEASTSCVCEKDYFRRESDPPTMACTRPPSAPRNAISNVNETSVFLEWIPPADTGGRKDVSYYIACKKCNSHAGVCEECGGHVRYLPRQSGLKNTSVMMVDLLAHTNYTFEIEAVNGVSDLSPGARQYVSVNVTTNQAAPSPVTNVKKGKIAKNSISLSWQEPDRPNGIILEYEIKHFEKDQETSYTIIKSKETTITAEGLKPASVYVFQIRARTAAGYGVFSRRFEFETTPVFAASSDQSQIPVIAVSVTVGVILLAVVIGVLLSGRRCGYSKAKQDPEEEKMHFHNGHIKLPGVRTYIDPHTYEDPNQAVHEFAKEIEASCITIERVIGAGEFGEVCSGRLKLPGKRELPVAIKTLKVGYTEKQRRDFLGEASIMGQFDHPNIIHLEGVVTKSKPVMIVTEYMENGSLDTFLKKNDGQFTVIQLVGMLRGISAGMKYLSDMGYVHRDLAARNILINSNLVCKVSDFGLSRVLEDDPEAAYTTRGGKIPIRWTAPEAIAFRKFTSASDVWSYGIVMWEVVSYGERPYWEMTNQDVIKAVEEGYRLPSPMDCPAALYQLMLDCWQKERNSRPKFDEIVNMLDKLIRNPSSLKTLVNASCRVSNLLAEHSPLGSGAYRSVGEWLEAIKMGRYTEIFMENGYSSMDAVAQVTLEDLRRLGVTLVGHQKKIMNSLQEMKVQLVNGMVPL

SEQ ID NO: 881482 - protein, 1037 aa, Homo sapiens
MRGSGPRGAGHRRPPSGGGDTPITPASLAGCYSAPRRAPLWTCLLLCAALRTLLASPSNEVNLLDSRTVMGDLGWIAFPKNGWEEIGEVDENYAPIHTYQVCKVMEQNQNNWLLTSWISNEGASRIFIELKFTLRDCNSLPGGLGTCKETFNMYYFESDDQNGRNIKENQYIKIDTIAADESFTELDLGDRVMKLNTEVRDVGPLSKKGFYLAFQDVGACIALVSVRVYYKKCPSVVRHLAVFPDTITGADSSQLLEVSGSCVNHSVTDEPPKMHCSAEGEWLVPIGKCMCKAGYEEKNGTCQVCRPGFFKASPHIQSCGKCPPHSYTHEEASTSCVCEKDYFRRESDPPTMACTRPPSAPRNAISNVNETSVFLEWIPPADTGGRKDVSYYIACKKCNSHAGVCEECGGHVRYLPRQSGLKNTSVMMVDLLAHTNYTFEIEAVNGVSDLSPGARQYVSVNVTTNQAAPSPVTNVKKGKIAKNSISLSWQEPDRPNGIILEYEIKHFEKDQETSYTIIKSKETTITAEGLKPASVYVFQIRARTAAGYGVFSRRFEFETTPVFAASSDQSQIPVIAVSVTVGVILLAVVIGVLLSGSCCECGCGRASSLCAVAHPSLIWRCGYSKAKQDPEEEKMHFHNGHIKLPGVRTYIDPHTYEDPNQAVHEFAKEIEASCITIERVIGAGEFGEVCSGRLKLPGKRELPVAIKTLKVGYTEKQRRDFLGEASIMGQFDHPNIIHLEGVVTKSKPVMIVTEYMENGSLDTFLKKNDGQFTVIQLVGMLRGISAGMKYLSDMGYVHRDLAARNILINSNLVCKVSDFGLSRVLEDDPEAAYTTRGGKIPIRWTAPEAIAFRKFTSASDVWSYGIVMWEVVSYGERPYWEMTNQDVIKAVEEGYRLPSPMDCPAALYQLMLDCWQKERNSRPKFDEIVNMLDKLIRNPSSLKTLVNASCRVSNLLAEHSPLGSGAYRSVGEWLEAIKMGRYTEIFMENGYSSMDAVAQVTLEDLRRLGVTLVGHQKKIMNSLQEMKVQLVNGMVPL

SEQ ID NO: 881483 - protein, 694 aa, Homo sapiens
LLEGIKDQLLQAEQLPGCREKTRHWAVMRVLLHLPALLASLILLQAAASTTRAQTTRTSAISDTVSQAKVQVNKAFLDSRTRLKTAMSSETPTSRQLSEYLKHAKGRTRTAIRNGQVWEESLKRLRQKASLTNVTDPSLDLTSLSLEVGCGAPAPVVRCDPCSPYRTITGDCNNRRKPALGAANRALARWLPAEYEDGLSLPFGWTPGKTRNGFPLPLAREVSNKIVGYLNEEGVLDQNRSLLFMQWGQIVDHDLDFAPDTELGSSEYSKAQCDEYCIQGDNCFPIMFPPNDPKAGTQGKCMPFFRAGFVCPTPPYKSLAREQINALTSFLDASFVYSSEPSLASRLRNLSSPLGLMAVNQEVSDHGLPYLPYDSKKPSPCEFINTTARVPCFLAGDSRASEHILLATSHTLFLREHNRLARELKRLNPQWDGEKLYQEARKILGAFVQIITFRDYLPILLGDHMQKWIPPYQGYSESVDPRISNVFTFAFRFGHLEVPSSMFRLDENYQPWGPEPELPLHTLFFNTWRMVKDGGIDPLVRGLLAKKSKLMKQNKMMTGELRNKLFQPTHRIHGFDLAAINTQRCRDHGQPGYNSWRAFCDLSQPQTLEELNTVLKSKMLAKKLLGLYGTPDNIDIWIGAIAEPLVERGRVGPLLACLLGKQFQQIRDGDRQVRPQPGREGQGPSPRGVSQGPA

SEQ ID NO: 881484 - protein, 739 aa, Homo sapiens
LLEGIKDQLLQAEQLPGCREKTRHWAVMRVLLHLPALLASLILLQAAASTTRAQTTRTSAISDTVSQAKVQVNKAFLDSRTRLKTAMSSETPTSRQLSEYLKHAKGRTRTAIRNGQVWEESLKRLRQKASLTNVTDPSLDLTSLSLEVGCGAPAPVVRCDPCSPYRTITGDCNNRRKPALGAANRALARWLPAEYEDGLSLPFGWTPGKTRNGFPLPLAREVSNKIVGYLNEEGVLDQNRSLLFMQWGQIVDHDLDFAPDTELGSSEYSKAQCDEYCIQGDNCFPIMFPPNDPKAGTQGKCMPFFRAGFVCPTPPYKSLAREQINALTSFLDASFVYSSEPSLASRLRNLSSPLGLMAVNQEVSDHGLPYLPYDSKKPSPCEFINTTARVPCFLAGDSRASEHILLATSHTLFLREHNRLARELKRLNPQWDGEKLYQEARKILGAFVQIITFRDYLPILLGDHMQKWIPPYQGYSESVDPRISNVFTFAFRFGHLEVPSSMFRLDENYQPWGPEPELPLHTLFFNTWRMVKDGGIDPLVRGLLAKKSKLMKQNKMMTGELRNKLFQPTHRIHGFDLAAINTQRCRDHGQPGYNSWRAFCDLSQPQTLEELNTVLKSKMLAKKLLGLYGTPDNIDIWIGAIAEPLVERGRVGPLLACLLGKQFQQIRDGDRFWWENPGVFTNEQKDSLQKMSFSRLVCDNTRITKVPRDPFWANSYPYDFVDCSAIDKLDLSPWASVKN

SEQ ID NO: 881485 - protein, 366 aa, Homo sapiens
IWGRSQVLVPSPASFKISAVHEILCKLSLEGEHSTLPSAFGSVKAYTKFDAEQDALNIEMAIKTKGVDEITTVNILTNHSNAQRQDIAFTYQRRTKKELVSALKSALSGHLDSGFGPIKDTCSDDASELKSSMKGLGTNKDSLIEIICSRTNQELQEINRVYKEMYKTDLEKDIISDTSGDFCKLMVALAKGRRAEDGSVIDYELIDQDARDLYDAGVKRKGTEVPKWISVMTERSMSHFQKVFDRYKSYSPYDMLESIKKEVKGDLENSFLNLVQCIQNKPLYFADRLYDSIMGMGTQDKVLIRIMVSHNEVDMLKIRSEFKRKYSKSLYYYIQQDTKGAVPVWWRWLKSDTARASRNGAPHASS

SEQ ID NO: 881486 - protein, 748 aa, Homo sapiens
TNCWARSRKRPGFGKDPRVRRPGGRAGLFLSCSAGSPEPWRKASSAPHRRRRLGRTHSASWRAEADDEFRSACQACCVTRPARRAPSQPPFRTGSRALPVSGRPLPAGSSPAAARRSPSRPCGLVSHSAWAPGARQTLAMTSGATRYRLSCSLRGHELDVRGLVCCAYPPGAFVSVSRDRTTRLWAPDSPNRSFTEMHCMSGHSNFVSCVCIIPSSDIYPHGLIATGGNDHNICIFSLDSPMPLYILKGHKNTVCSLSSGKFGTLLSGSWDTTAKVWLNDKCMMTLQGHTAAVWAVKILPEQGLMLTGSADKTVKLWKAGRCERTFSGHEDCVRGLAILSETEFLSCANDASIRRWQITGECLEVYYGHTNYIYSISVFPNCRDFVTTAEDRSLRIWKHGECAQTIRLPAQSIWCCCVLDNGDIVVGASDGIIRVFTESEDRTASAEEIKAFEKELSHATIDSKTGDLGDINAEQLPGREHLNEPGTREGQTRLIRDGEKVEAYQWSVSEGRWIKIGDVVGSSGANQQTSGKVLYEGKEFDYVFSIDVNEGGPSYKLPYNTSDDPWLTAYNFLQKNDLNPMFLDQVAKFIIDNTKGQMLGLGNPSFSDPFTGGGRYVPGSSGSSNTLPTADPFTGAGRYVPGSASMGTTMAGVDPFTGNSAYRSAASKTMNIYFPKKEAVTFDQANPTQILGKLKELNGTAPEEKKLTEDDLILLEKILSLICNSSSEKPTVQQLQILWKAINCPEGK

SEQ ID NO: 881487 - protein, 916 aa, Homo sapiens
TNCWARSRKRPGFGKDPRVRRPGGRAGLFLSCSAGSPEPWRKASSAPHRRRRLGRTHSASWRAEADDEFRSACQACCVTRPARRAPSQPPFRTGSRALPVSGRPLPAGSSPAAARRSPSRPCGLVSHSAWAPGARQTLAMTSGATRYRLSCSLRGHELDVRGLVCCAYPPGAFVSVSRDRTTRLWAPDSPNRSFTEMHCMSGHSNFVSCVCIIPSSDIYPHGLIATGGNDHNICIFSLDSPMPLYILKGHKNTVCSLSSGKFGTLLSGSWDTTAKVWLNDKCMMTLQGHTAAVWAVKILPEQGLMLTGSADKTVKLWKAGRCERTFSGHEDCVRGLAILSETEFLSCANDASIRRWQITGECLEVYYGHTNYIYSISVFPNCRDFVTTAEDRSLRIWKHGECAQTIRLPAQSIWCCCVLDNGDIVVGASDGIIRVFTESEDRTASAEEIKAFEKELSHATIDSKTGDLGDINAEQLPGREHLNEPGTREGQTRLIRDGEKVEAYQWSVSEGRWIKIGDVVGSSGANQQTSGKVLYEGKEFDYVFSIDVNEGGPSYKLPYNTSDDPWLTAYNFLQKNDLNPMFLDQVAKFIIDNTKGQMLGLGNPSFSDPFTGGGRYVPGSSGSSNTLPTADPFTGAGRYVPGSASMGTTMAGVDPFTGNSAYRSAASKTMNIYFPKKEAVTFDQANPTQILGKLKELNGTAPEEKKLTEDDLILLEKILSLICNSSSEKPTVQQLQILWKAINCPEDIVFPALDILRLSIKHPSVNENFCNEKEGAQFSSHLINLLNPKGKPANQLLALRTFCNCFVGQAGQSGSNKNIHIALATLALNYSVCFHKDHNIEGKAQCLSLISTILEVVQDLEATFRLLVALGTLISDDSNAVQLAKSLGVDSQIKKYSSVSEPAKVSECCRFILNLL

SEQ ID NO: 881488 - protein, 630 aa, Homo sapiens
MLTGSADKTVKLWKAGRCERTFSGHEDCVRGLAILSETEFLSCANDASIRRWQITGECLEVYYGHTNYIYSISVFPNCRDFVTTAEDRSLRIWKHGECAQTIRLPAQSIWCCCVLDNGDIVVGASDGIIRVFTESEDRTASAEEIKAFEKELSHATIDSKTGDLGDINAEQLPGREHLNEPGTREGQTRLIRDGEKVEAYQWSVSEGRWIKIGDVVGSSGANQQTSGKVLYEGKEFDYVFSIDVNEGGPSYKLPYNTSDDPWLTAYNFLQKNDLNPMFLDQVAKFIIDNTKGQMLGLGNPSFSDPFTGGGRYVPGSSGSSNTLPTADPFTGAGRYVPGSASMGTTMAGVDPFTGNSAYRSAASKTMNIYFPKKEAVTFDQANPTQILGKLKELNGTAPEEKKLTEDDLILLEKILSLICNSSSEKPTVQQLQILWKAINCPEDIVFPALDILRLSIKHPSVNENFCNEKEGAQFSSHLINLLNPKGKPANQLLALRTFCNCFVGQAGQKLMMSQRESLMSHAIELKSGSNKNIHIALATLALNYSVCFHKDHNIEGKAQCLSLISTILEVVQDLEATFRLLVALGTLISDDSNAVQLAKSLGVDSQIKKYSSVSEPAKVSECCRFILNLL

SEQ ID NO: 881489 - protein, 289 aa, Homo sapiens
TNCWARSRKRPGFGKDPRVRRPGGRAGLFLSCSAGSPEPWRKASSAPHRRRRLGRTHSASWRAEADDEFRSACQACCVTRPARRAPSQPPFRTGSRALPVSGRPLPAGSSPAAARRSPSRPCGLVSHSAWAPGARQTLAMTSGATRYRLSCSLRGHELDVRGLVCCAYPPGAFVSVSRDRTTRLWAPDSPNRSFTEMHCMSGHSNFVSCVCIIPSSDIYPHGLIATGGNDHNICIFSLDSPMPLYILKGHKNTVCSLSSGKFGTLLSGSWDTTAKVWLNDKCMMTLQVQ

SEQ ID NO: 881490 - protein, 934 aa, Homo sapiens
TNCWARSRKRPGFGKDPRVRRPGGRAGLFLSCSAGSPEPWRKASSAPHRRRRLGRTHSASWRAEADDEFRSACQACCVTRPARRAPSQPPFRTGSRALPVSGRPLPAGSSPAAARRSPSRPCGLVSHSAWAPGARQTLAMTSGATRYRLSCSLRGHELDVRGLVCCAYPPGAFVSVSRDRTTRLWAPDSPNRSFTEMHCMSGHSNFVSCVCIIPSSDIYPHGLIATGGNDHNICIFSLDSPMPLYILKGHKNTVCSLSSGKFGTLLSGSWDTTAKVWLNDKCMMTLQGHTAAVWAVKILPEQGLMLTGSADKTVKLWKAGRCERTFSGHEDCVRGLAILSETEFLSCANDASIRRWQITGECLEVYYGHTNYIYSISVFPNCRDFVTTAEDRSLRIWKHGECAQTIRLPAQSIWCCCVLDNGDIVVGASDGIIRVFTESEDRTASAEEIKAFEKELSHATIDSKTGDLGDINAEQLPGREHLNEPGTREGQTRLIRDGEKVEAYQWSVSEGRWIKIGDVVGSSGANQQTSGKVLYEGKEFDYVFSIDVNEGGPSYKLPYNTSDDPWLTAYNFLQKNDLNPMFLDQVAKFIIDNTKGQMLGLGNPSFSDPFTGGGRYVPGSSGSSNTLPTADPFTGAGRYVPGSASMGTTMAGVDPFTGNSAYRSAASKTMNIYFPKKEAVTFDQANPTQILGKLKELNGTAPEEKKLTEDDLILLEKILSLICNSSSEKPTVQQLQILWKAINCPEDIVFPALDILRLSIKHPSVNENFCNEKEGAQFSSHLINLLNPKGKPANQLLALRTFCNCFVGQAGQKLMMSQRESLMSHAIELKSGSNKNIHIALATLALNYSVCFHKDHNIEGKAQCLSLISTILEVVQDLEATFRLLVALGTLISDDSNAVQLAKSLGVDSQIKKYSSVSEPAKVSECCRFILNLL

SEQ ID NO: 881491 - protein, 934 aa, Homo sapiens; identical to SEQ ID NO: 881490

SEQ ID NO: 881492 - protein, 621 aa, Homo sapiens
TNCWARSRKRPGFGKDPRVRRPGGRAGLFLSCSAGSPEPWRKASSAPHRRRRLGRTHSASWRAEADDEFRSACQACCVTRPARRAPSQPPFRTGSRALPVSGRPLPAGSSPAAARRSPSRPCGLVSHSAWAPGARQTLAMTSGATRYRLSCSLRGHELDVRGLVCCAYPPGAFVSVSRDRTTRLWAPDSPNRSFTEMHCMSGHSNFVSCVCIIPSSDIYPHGLIATGGNDHNICIFSLDSPMPLYILKGHKNTVCSLSSGKFGTLLSGSWDTTAKVWLNDKCMMTLQGHTAAVWAVKILPEQGLMLTGSADKTVKLWKAGRCERTFSGHEDCVRGLAILSETEFLSCANDASIRRWQITGECLEVYYGHTNYIYSISVFPNCRDFVTTAEDRSLRIWKHGECAQTIRLPAQSIWCCCVLDNGDIVVGASDGIIRVFTESEDRTASAEEIKAFEKELSHATIDSKTGDLGDINAEQLPGREHLNEPGTREGQTRLIRDGEKVEAYQWSVSEGRWIKIGDVVGSSGANQQTSGKVLYEGKEFDYVFSIDVNEGGPSYKLPYNTSDDPWLTAYNFLQKNDLNPMFLDQVAKFIIDNTKGQMLGLGNPSFSDPFTGKLVFILSLM

SEQ ID NO: 881493 - protein, 459 aa, Homo sapiens [sequence omitted]

SEQ ID NO: 881494 - protein, 459 aa, Homo sapiens [sequence omitted]

SEQ ID NO: 881495 - protein, 459 aa, Homo sapiens [sequence omitted]

SEQ ID NO: 881496 - protein, 459 aa, Homo sapiens [sequence omitted]

SEQ ID NO: 881497 - protein, 262 aa, Homo sapiens
MTILGTTFGMVFSLLQVVSGESGYAQNGDLEDAELDDYSFSCYSQLEVNGSQHSLTCAFEDPDVNTTNLEFEICGALVEVKCLNFRKLQEIYFIETKKFLLIGKSNICVKVGEKSLTCKKIDLTTIVKPEAPFDLSVIYREGANDFVVTFNTSHLQKKYVKVLMHDVAYRQEKDENKWTHVNLSSTKLTLLQRKLQPAAMYEIKVRSIPDHYFKGFWSEWSPSYYFRTPEINNSSGLSLSYGPVSPIIRRLWNIFVRNQEKI

SEQ ID NO: 881498 - protein, 171 aa, Homo sapiens
EILDVIDEGKSNRHVAVTNMNEHSSRSHSIFLINIKQENMETEQKLSGKLYLVDLAGSEKVSKTGAEGAVLDEAKNINKSLSALGNVISALAEGTKSYVPYRDSKMTRILQDSLGGNCRTTMFICCSPSSYNDAETKSTLMFGQRAKTIKNTASVNLELTAEQWKKKYEKE

SEQ ID NO: 881499 - protein, 286 aa, Homo sapiens
EILDVIDEGKSNRHVAVTNMNEHSSRSHSIFLINIKQENMETEQKLSGKLYLVDLAGSEKVSKTGAEGAVLDEAKNINKSLSALGNVISALAEGTKSYVPYRDSKMTRILQDSLGGNCRTTMFICCSPSSYNDAETKSTLMFGQRAKTIKNTASVNLELTAEQWKKKYEKEKEKTKAQKETIAKLEAELSRWRNGENVPETERLAGEEAALGAELCEETPVNDNSSIVVRIAPEERQKYEEEIRRLYKQLDDKDDEINQQSQLIEKLKQQMLDQEELLVTRGDNEK

SEQ ID NO: 881500 - protein, 266 aa, Homo sapiens
MWDSAKTWAALTPTSSAKSEGASLGGDPAPNHSPGPHRESVDALSVGGAVLDEAKNINKSLSALGNVISALAEGTKSYVPYRDSKMTRILQDSLGGNCRTTMFICCSPSSYNDAETKSTLMFGQRAKTIKNTASVNLELTAEQWKKKYEKEKEKTKAQKETIAKLEAELSRWRNGENVPETERLAGEEAALGAELCEETPVNDNSSIVVRIAPEERQKYEEEIRRLYKQLDDKDDEINQQSQLIEKLKQQMLDQEELLVTRGDNEK

SEQ ID NO: 881501 - protein, 1480 aa, Homo sapiens
NSGRQSRSAPRRSAPARAPARLGLGSGSGGGVPAPGPGTGGDAPTMARAQALVLALTFQLCAPETETPAAGCTFEEASDPAVPCEYSQAQYDDFQWEQVRIHPGTRAPADLPHGSYLMVNTSQHAPGQRAHVIFQSLSENDTHCVQFSYFLYSRDGHSPGTLGVYVRVNGGPLGSAVWNMTGSHGRQWHQAELAVSTFWPNEYQVLFEALISPDRRGYMGLDDILLLSYPCAKAPHFSRLGDVEVNAGQNASFQCMAAGRARGRTLPLATAERGAGAGGGRAAHQPPRFLATFPLAAVSRAEQDLYRCVSQAPRGAGVSNFAELIVKEPPTPIAPPQLLRAGPTYLIIQLNTNSIIGDGPIVRKEIEYRMARGPWAEVHAVSLQTYKLWHLDPDTEYEISVLLTRPGDGGTGRPGPPLISRTKCAEPMRAPKGLAFAEIQARQLTLQWEPLGYNVTRCHTYTVSLCYHYTLGSSHNQTIRECVKTEQGVSRYTIKNLLPYRNVHVRLVLTNPEGRKEGKEVTFQTDEDVPSGIAAESLTFTPLEDMIFLKWEEPQEPNGLITQYEISYQSIESSDPAVNVPGPRRTISKLRNETYHVFSNLHPGTTYLFSVRARTGKGFGQAALTEITTNISAPSFDYADMPSPLGESENTITVLLRPAQGRGAPISVYQVIVEEERARRLRREPGGQDCFPVPLTFEAALARGLVHYFGAELAASSLPEAMPFTVGDNQTYRGFWNPPLEPRKAYLIYFQAASHLKGETRLNCIRIARKAACKESKRPLEVSQRSEEMGLILGICAGGLAVLILLLGAIIVIIRKGKPVNMTKATVNYRQEKTHMMSAVDRSFTDQSTLQEDERLGLSFMDTHGYSTRGDQRSGGVTEASSLLGGSPRRPCGRKGSPYHTGQLHPAVRVADLLQHINQMKTAEGYGFKQEYESFFEGWDATKKKDKVKGSRQEPMPAYDRHRVKLHPMLGDPNADYINANYIDGYHRSNHFIATQGPKPEMVYDFWRMVWQEHCSSIVMITKLVEVGRVKCSRYWPEDSDTYGDIKIMLVKTETLAEYVVRTFALERRGYSARHEVRQFHFTAWPEHGVPYHATGLLAFIRRVKASTPPDAGPIVIHCSAGTGRTGCYIVLDVMLDMAECEGVVDIYNCVKTLCSRRVNMIQTEEQYIFIHDAILEACLCGETTIPVSEFKATYKEMIRIDPQSNSSQLREEFQTLNSVTPPLDVEECSIALLPRNRDKNRSMDVLPPDRCLPFLISTDGDSNNYINAALTDSYTRSAAFIVTLHPLQSTTPDFWRLVYDYGCTSIVMLNQLNQSNSAWPCLQYWPEPGRQQYGLMEVEFMSGTADEDLVARVFRVQNISRLQEGHLLVRHFQFLRWSAYRDTPDSKKAFLHLLAEVDKWQAESGDGRTIVHCLNGGGRSGTFCACATVLEMIRCHNLVDVFFAAKTLRNYKPNMVETMDQYHFCYDVALEYLEGLESR

SEQ ID NO: 881502 - protein, 1486 aa, Homo sapiens
NSGRQSRSAPRRSAPARAPARLGLGSGSGGGVPAPGPGTGGDAPTMARAQALVLALTFQLCAPETETPAAGCTFEEASDPAVPCEYSQAQYDDFQWEQVRIHPGTRAPADLPHGSYLMVNTSQHAPGQRAHVIFQSLSENDTHCVQFSYFLYSRDGHSPGTLGVYVRVNGGPLGSAVWNMTGSHGRQWHQAELAVSTFWPNEYQVLFEALISPDRRGYMGLDDILLLSYPCAKAPHFSRLGDVEVNAGQNASFQCMAAGRARGRTLPLATAERGAGAGGGRAAHQPPRFLATFPLAAVSRAEQDLYRCVSQAPRGAGVSNFAELIVKEPPTPIAPPQLLRAGPTYLIIQLNTNSIIGDGPIVRKEIEYRMARGPWAEVHAVSLQTYKLWHLDPDTEYEISVLLTRPGDGGTGRPGPPLISRTKCAEPMRAPKGLAFAEIQARQLTLQWEPLGYNVTRCHTYTVSLCYHYTLGSSHNQTIRECVKTEQGVSRYTIKNLLPYRNVHVRLVLTNPEGRKEGKEVTFQTDEDVPSGIAAESLTFTPLEDMIFLKWEEPQEPNGLITQYEISYQSIESSDPAVNVPGPRRTISKLRNETYHVFSNLHPGTTYLFSVRARTGKGFGQAALTEITTNISAPSFDYADMPSPLGESENTITVLLRPAQGRGAPISVYQVIVEEERARRLRREPGGQDCFPVPLTFEAALARGLVHYFGAELAASSLPEAMPFTVGDNQTYRGFWNPPLEPRKAYLIYFQAASHLKGETRLNCIRIARKAACKESKRPLEVSQRSEEMGLILGICAGGLAVLILLLGAIIVIIRKGKPVNMTKATVNYRQEKTHMMSAVDRSFTDQSTLQEDERLGLSFMDTHGYSTRGDQRSGGVTEASSLLGGSPRRPCGRKGSPYHTGQLHPAVRVADLLQHINQMKTAEGYGFKQEYESFFEGWDATKKKDKVKGSRQEPMPAYDRHRVKLHPMLGDPNADYINANYIDIRINREGYHRSNHFIATQGPKPEMVYDFWRMVWQEHCSSIVMITKLVEVGRVKCSRYWPEDSDTYGDIKIMLVKTETLAEYVVRTFALERRGYSARHEVRQFHFTAWPEHGVPYHATGLLAFIRRVKASTPPDAGPIVIHCSAGTGRTGCYIVLDVMLDMAECEGVVDIYNCVKTLCSRRVNMIQTEEQYIFIHDAILEACLCGETTIPVSEFKATYKEMIRIDPQSNSSQLREEFQTLNSVTPPLDVEECSIALLPRNRDKNRSMDVLPPDRCLPFLISTDGDSNNYINAALTDSYTRSAAFIVTLHPLQSTTPDFWRLVYDYGCTSIVMLNQLNQSNSAWPCLQYWPEPGRQQYGLMEVEFMSGTADEDLVARVFRVQNISRLQEGHLLVRHFQFLRWSAYRDTPDSKKAFLHLLAEVDKWQAESGDGRTIVHCLNGGGRSGTFCACATVLEMIRCHNLVDVFFAAKTLRNYKPNMVETMDQYHFCYDVALEYLEGLESR

SEQ ID NO: 881503 - protein, 213 aa, Homo sapiens
MAMDRGPWVNRTGLIVILHPLQSTTPDFWRLVYDYGCTSIVMLNQLNQSNSAWPCLQYWPEPGRQQYGLMEVEFMSGTADEDLVARVFRVQNISRLQEGHLLVRHFQFLRWSAYRDTPDSKKAFLHLLAEVDKWQAESGDGRTIVHCLNGGGRSGTFCACATVLEMIRCHNLVDVFFAAKTLRNYKPNMVETMDQYHFCYDVALEYLEGLESR

SEQ ID NO: 881504 - protein, 1258 aa, Homo sapiens
NSGRQSRSAPRRSAPARAPARLGLGSGSGGGVPAPGPGTGGDAPTMARAQALVLALTFQLCAPETETPAAGCTFEEASDPAVPCEYSQAQYDDFQWEQVRIHPGTRAPADLPHGSYLMVNTSQHAPGQRAHVIFQSLSENDTHCVQFSYFLYSRDGHSPGTLGVYVRVNGGPLGSAVWNMTGSHGRQWHQAELAVSTFWPNEYQVLFEALISPDRRGYMGLDDILLLSYPCAKAPHFSRLGDVEVNAGQNASFQCMAAGRARGRTLPLATAERGAGAGGGRAAHQPPRFLATFPLAAVSRAEQDLYRCVSQAPRGAGVSNFAELIVKEPPTPIAPPQLLRAGPTYLIIQLNTNSIIGDGPIVRKEIEYRMARGPWAEVHAVSLQTYKLWHLDPDTEYEISVLLTRPGDGGTGRPGPPLISRTKCAEPMRAPKGLAFAEIQARQLTLQWEPLGYNVTRCHTYTVSLCYHYTLGSSHNQTIRECVKTEQGVSRYTIKNLLPYRNVHVRLVLTNPEGRKEGKEVTFQTDEDVPSGIAAESLTFTPLEDMIFLKWEEPQEPNGLITQYEISYQSIESSDPAVNVPGPRRTISKLRNETYHVFSNLHPGTTYLFSVRARTGKGFGQAALTEITTNISAPSFDYADMPSPLGESENTITVLLRPAQGRGAPISVYQVIVEEERARRLRREPGGQDCFPVPLTFEAALARGLVHYFGAELAASSLPEAMPFTVGDNQTYRGFWNPPLEPRKAYLIYFQAASHLKGETRLNCIRIARKAACKESKRPLEVSQRSEEMGLILGICAGGLAVLILLLGAIIVIIRKGRDHYAYSYYPKPVNMTKATVNYRQEKTHMMSAVDRSFTDQSTLQEDERLGLSFMDTHGYSTRGDQRSGGVTEASSLLGGSPRRPCGRKGSPYHTGQLHPAVRVADLLQHINQMKTAEGYGFKQEYESFFEGWDATKKKDKVKGSRQEPMPAYDRHRVKLHPMLGDPNADYINANYIDGYHRSNHFIATQGPKPEMVYDFWRMVWQEHCSSIVMITKLVEVGRVKCSRYWPEDSDTYGDIKIMLVKTETLAEYVVRTFALERRGYSARHEVRQFHFTAWPEHGVPYHATGLLAFIRRVKASTPPDAGPIVIHCSAGTGRTGCYIVLDVMLDMAECEGVVDIYNCVKTLCSRRVNMIQTEEQYIFIHDAILEACLCGETTIPVSEFKATYKEMIRIDPQSNSSQLREEFQTLNSVTPPLDVEECSIALLPRTCKVTCKPGTCK

SEQ ID NO: 881505 - protein, 1482 aa, Homo sapiens
NSGRQSRSAPRRSAPARAPARLGLGSGSGGGVPAPGPGTGGDAPTMARAQALVLALTFQLCAPETETPAAGCTFEEASDPAVPCEYSQAQYDDFQWDRAPADLPHGSYLMVNTSQHAPGQRAHVIFQSLSENDTHCVQFSYFLYSRDGHSPGTLGVYVRVNGGPLGSAVWNMTGSHGRQWHQAELAVSTFWPNEYQVLFEALISPDRRGYMGLDDILLLSYPCAKAPHFSRLGDVEVNAGQNASFQCMAAGRARGRTLPLATAERGAGAGGGRAAHQPPRFLATFPLAAVSRAEQDLYRCVSQAPRGAGVSNFAELIVKEPPTPIAPPQLLRAGPTYLIIQLNTNSIIGDGPIVRKEIEYRMARGPWAEVHAVSLQTYKLWHLDPDTEYEISVLLTRPGDGGTGRPGPPLISRTKCAEPMRAPKGLAFAEIQARQLTLQWEPLGYNVTRCHTYTVSLCYHYTLGSSHNQTIRECVKTEQGVSRYTIKNLLPYRNVHVRLVLTNPEGRKEGKEVTFQTDEDVPSGIAAESLTFTPLEDMIFLKWEEPQEPNGLITQYEISYQSIESSDPAVNVPGPRRTISKLRNETYHVFSNLHPGTTYLFSVRARTGKGFGQAALTEITTNISAPSFDYADMPSPLGESENTITVLLRPAQGRGAPISVYQVIVEEERARRLRREPGGQDCFPVPLTFEAALARGLVHYFGAELAASSLPEAMPFTVGDNQTYRGFWNPPLEPRKAYLIYFQAASHLKGETRLNCIRIARKAACKESKRPLEVSQRSEEMGLILGICAGGLAVLILLLGAIIVIIRKGRDHYAYSYYPKPVNMTKATVNYRQEKTHMMSAVDRSFTDQSTLQEDERLGLSFMDTHGYSTRGDQRSGGVTEASSLLGGSPRRPCGRKGSPYHTGQLHPAVRVADLLQHINQMKTAEGYGFKQEYESFFEGWDATKKKDKVKGSRQEPMPAYDRHRVKLHPMLGDPNADYINANYIDGYHRSNHFIATQGPKPEMVYDFWRMVWQEHCSSIVMITKLVEVGRVKCSRYWPEDSDTYGDIKIMLVKTETLAEYVVRTFALERRGYSARHEVRQFHFTAWPEHGVPYHATGLLAFIRRVKASTPPDAGPIVIHCSAGTGRTGCYIVLDVMLDMAECEGVVDIYNCVKTLCSRRVNMIQTEEQYIFIHDAILEACLCGETTIPVSEFKATYKEMIRIDPQSNSSQLREEFQTLNSVTPPLDVEECSIALLPRNRDKNRSMDVLPPDRCLPFLISTDGDSNNYINAALTDSYTRSAAFIVTLHPLQSTTPDFWRLVYDYGCTSIVMLNQLNQSNSAWPCLQYWPEPGRQQYGLMEVEFMSGTADEDLVARVFRVQNISRLQEGHLLVRHFQFLRWSAYRDTPDSKKAFLHLLAEVDKWQAESGDGRTIVHCLNGGGRSGTFCACATVLEMIRCHNLVDVFFAAKTLRNYKPNMVETMDQYHFCYDVALEYLEGLESR

SEQ ID NO: 881506 - protein, 1430 aa, Homo sapiens
NSGRQSRSAPRRSAPARAPARLGLGSGSGGGVPAPGPGTGGDAPTMARAQALVLALTFQLCAPETETPAAGCTFEEASDPAVPCEYSQAQYDDFQWEQVRIHPGTRAPADLPHGSYLMVNTSQHAPGQRAHVIFQSLSENDTHCVQFSYFLYSRDGHSPGTLGVYVRVNGGPLGSAVWNMTGSHGRQWHQAELAVSTFWPNEYQVLFEALISPDRRGYMGLDDILLLSYPCAKAPHFSRLGDVEVNAGQNASFQCMAAGRARGRTLPLATAERGAGAGGGRAAHQPPRFLATFPLAAVSRAEQDLYRCVSQAPRGAGVSNFAELIVKEPPTPIAPPQLLRAGPTYLIIQLNTNSIIGDGPIVRKEIEYRMARGPWAEVHAVSLQTYKLWHLDPDTEYEISVLLTRPGDGGTGRPGPPLISRTKCAEPMRAPKGLAFAEIQARQLTLQWEPLGYNVTRCHTYTVSLCYHYTLGSSHNQTIRECVKTEQGVSRYTIKNLLPYRNVHVRLVLTNPEGRKEGKEVTFQTDEDVPSGIAAESLTFTPLEDMIFLKWEEPQEPNGLITQYEISYQSIESSDPAVNVPGPRRTISKLRNETYHVFSNLHPGTTYLFSVRARTGKGFGQAALTEITTNISAPSFDYADMPSPLGESENTITVLLRPAQGRGAPISVYQVIVEEERARRLRREPGGQDCFPVPLTFEAALARGLVHYFGAELAASSLPEAMPFTVGDNQTYRGFWNPPLEPRKAYLIYFQAASHLKGETRLNCIRIARKAACKESKRPLEVSQRSEEMGLILGICAGGLAVLILLLGAIIVIIRKGRDHYAYSYYPKPVNMTKATVNYRQEKTHMMSAVDRSFTDQSTLQEDERLGLSFMDTHGYSTRGDQRSGGVTEASSLLGGSPRRPCGRKGSPYHTGQLHPAVRVADLLQHINQMKTAEGYGFKQEYESFFEGWDATKKKDKVKGSRQEPMPAYDRHRVKLHPMLGDPNADYINANYIDGYHRSNHFIATQGPKPEMVYDFWRMVWQEHCSSIVMITKLVEVGRVKCSRYWPEDSDTYGDIKIMLVKTETLAEYVVRTFALERRGYSARHEVRQFHFTAWPEHGVPYHATGLLAFIRRVKASTPPDAGPIVIHCSAGTGRTGCYIVLDVMLDMAECEGVVDIYNCVKTLCSRRVNMIQTEEQYIFIHDAILEACLCGETTIPVSEFKATYKEMIRIDPQSNSSQLREEFQTLNSVTPPLDVEECSIALLPRNRDKNRSMDVLPPDRCLPFLISTDGDSNNYINAALTDSYTRSAAFIVTLHPLQSTTPDFWRLVYDYGCTSIVMLNQLNQSNSAWPCLQYWPEPGRQQYGLMEVEFMSGTADEDLVARVFRVQNISRLQEGHLLVRHFQFLRWSAYRDTPDSKKAFLHLLAEVDKWQAESGDGRTIVHCLPSACG

SEQ ID NO: 881507 - protein, 57 aa, Homo sapiens
DNQTYRGFWNPPLEPRKAYLIYFQAASHLKGVRDRPGSWWAWLGVGGWQTGDTLEQA

SEQ ID NO: 881508 - protein, 1657 aa, Homo sapiens
WLSQQLQQLREWPGGRRVPAAMEAVPRMPMIWLDLKEAGDFHFQPAVKKFVLKNYGENPEAYNEELKKLELLRQNAVRVPRDFEGCSVLRKYLGQLHYLQSRVPMGSGQEAAVPVTWTEIFSGKSVAHEDIKYEQACILYNLGALHSMLGAMDKRVSEEGMKVSCTHFQCAAGAFAYLREHFPQAYSVDMSRQILTLNVNLMLGQAQECLLEKSMLDNRKSFLVARISAQVVDYYKEACRALENPDTASLLGRIQKDWKKLVQMKIYYFAAVAHLHMGKQAEEQQKFGERVAYFQSALDKLNEAIKLAKGQPDTVQDALRFTMDVIGGKYNSAKKDNDFIYHEAVPALDTLQPVKGAPLVKPLPVNPTDPAVTGPDIFAKLVPMAAHEASSLYSEEKAKLLREMMAKIEDKNEVLDQFMDSMQLDPETVDNLDAYSHIPPQLMEKCAALSVRPDTVRNLVQSMQVLSGVFTDVEASLKDIRDLLEEDELLEQKFQEAVGQAGAISITSKAELAEVRREWAKYMEVHEKASFTNSELHRAMNLHVGNLRLLSGPLDQVRAALPTPALSPEDKAVLQNLKRILAKVQEMRDQRVSLEQQLRELIQKDDITASLVTTDHSEMKKLFEEQLKKYDQLKVYLEQNLAAQDRVLCALTEANVQYAAVRRVLSDLDQKWNSTLQTLVASYEAYEDLMKKSQEGRDFYADLESKVAALLERTQSTCQAREAARQQLLDRELKKKPPPRPTAPKPLLPRREESEAVEAGDPPEELRSLPPDMVAGPRLPDTFLGSATPLHFPPSPFPSSTGPGPHYLSGPLPPGTYSGPTQLIQPRAPGPHAMPVAPGPALYPAPAYTPELGLVPRSSPQHGVVSSPYVGVGPAPPVAGLPSAPPPQFSGPELAMAVRPATTTVDSIQAPIPSHTAPRPNPTPAPPPPCFPVPPPQPLPTPYTYPAGAKQPIPAQHHFSSGIPAGFPAPRIGPQPQPHPQPHPSQAFGPQPPQQPLPLQHPHLFPPQAPGLLPPQSPYPYAPQPGVLGQPPPPLHTQLYPGPAQDPLPAHSGALPFPSPGPPQPPHPPLAYGPAPSTRPMGPQAAPLTIRGPSSAGQSTPSPHLVPSPAPSPGPGPVPPRPPAAEPPPCLRRGAAAADLLSSSPESQHGGTQSPGGGQPLLQPTKVDAAEGRRPQALRLIERDPYEHPERLRQLQQELEAFRGQLGDVGALDTVWRELQDAQEHDARGRSIAIARCYSLKNRHQDVMPYDSNRVVLRSGKDDYINASCVEGLSPYCPPLVATQAPLPGTAADFWLMVHEQKVSVIVMLVSEAEMEKQKVARYFPTERGQPMVHGALSLALSSVRSTETHVERVLSLQFRDQSLKRSLVHLHFPTWPELGLPDSPSNLLRFIQEVHAHYLHQRPLHTPIIVHCSSGVGRTGAFALLYAAVQEVEAGNGIPELPQLVRRMRQQRKHMLQEKLHLRFCYEAVVRHVEQVLQRHGVPPPCKPLASASISQKNHLPQDSQDLVLGGDVPISSIQATIAKLSIRPPGGLESPVASLPGPAEPPGLPPASLPESTPIPSSSPPPLSSPLPEAPQPKEEPPVPEAPSSGPPSSSLELLASLTPEAFSLDSSLRGKQRMSKHNFLQAHNGQGLRATRPSDDPLSLLDPLWTLNKT

SEQ ID NO: 881509 - protein, 1657 aa, Homo sapiens; identical to SEQ ID NO: 881508

SEQ ID NO: 881510 - protein, 92 aa, Homo sapiens
MGRSSAQVVDYYKEACRALENPDTASLLGRIQKDWKKLVQMKIYYFAAVAHLHMGKQAEEQQKFGERVAYFQSALDKLNEAIKLAKVKLRKA

SEQ ID NO: 881511 - protein, 1683 aa, Homo sapiens
MGSGQEAAVPVTWTEIFSGKSVAHEDIKYEQACILYNLGALHSMLGAMDKRVSEEGMKVSCTHFQCAAGAFAYLREHFPQAYSVDMSRQILTLNVNLMLGQAQECLLEKSMLDNRKSFLVARISAQVVDYYKEACRALENPDTASLLGRIQKDWKKLVQMKIYYFAAVAHLHMGKQAEEQQKFGERVAYFQSALDKLNEAIKLAKGQPDTVQDALRFTMDVIGGKYNSAKKDNDFIYHEAVPALDTLQPVKGAPLVKPLPVNPTDPAVTGPDIFAKLVPMAAHEASSLYSEEKAKLLREMMAKIEDKNEVLELSVGLGQGGGGRQHFPGLWGPQGCLCWERNEMSIPNRFPNAAFPPGVVGLVCKAGVMSVGGGGAFCSTVSSSALGMFCETRPDLVVGVRGHNLLSAETSDGVVRLALAAPLTWSELDQHPAPTWPVAPHSQFMDSMQLDPETVDNLDAYSHIPPQLMEKCAALSVRPDTVRNLVQSMQVLSGVFTDVEASLKDIRDLLEEDELLEQKFQEAVGQAGAISITSKAELAEVRREWAKYMEVHEKASFTNSELHRAMNLHVGNLRLLSGPLDQVRAALPTPALSPEDKAVLQNLKRILAKVQEMRDQRVSLEQQLRELIQKDDITASLVTTDHSEMKKLFEEQLKKYDQLKVYLEQNLAAQDRVLCALTEANVQYAAVRRVLSDLDQKWNSTLQTLVASYEAYEDLMKKSQEGRDFYADLESKVAALLERTQSTCQAREAARQQLLDRELKKKPPPRPTAPKPLLPRREESEAVEAGDPPEELRSLPPDMVAGPRLPDTFLGSATPLHFPPSPFPSSTGPGPHYLSGPLPPGTYSGPTQLIQPRAPGPHAMPVAPGPALYPAPAYTPELGLVPRSSPQHGVVSSPYVGVGPAPPVAGLPSAPPPQFSGPELAMAVRPATTTVDSIQAPIPSHTAPRPNPTPAPPPPCFPVPPPQPLPTPYTYPAGAKQPIPAQHHFSSGIPAGFPAPRIGPQPQPHPQPHPSQAFGPQPPQQPLPLQHPHLFPPQAPGLLPPQSPYPYAPQPGVLGQPPPPLHTQLYPGPAQDPLPAHSGALPFPSPGPPQPPHPPLAYGPAPSTRPMGPQAAPLTIRGPSSAGQSTPSPHLVPSPAPSPGPGPVPPRPPAAEPPPCLRRGAAAADLLSSSPESQHGGTQSPGGGQPLLQPTKVDAAEGRRPQALRLIERDPYEHPERLRQLQQELEAFRGQLGDVGALDTVWRELQDAQEHDARGRSIAIARCYSLKNRHQDVMPYDSNRVVLRSGKDDYINASCVEGLSPYCPPLVATQAPLPGTAADFWLMVHEQKVSVIVMLVSEAEMEKQKVARYFPTERGQPMVHGALSLALSSVRSTETHVERVLSLQFRDQSLKRSLVHLHFPTWPELGLPDSPSNLLRFIQEVHAHYLHQRPLHTPIIVHCSSGVGRTGAFALLYAAVQEVEAGNGIPELPQLVRRMRQQRKHMLQEKLHLRFCYEAVVRHVEQVLQRHGVPPPCKPLASASISQKNHLPQDSQDLVLGGDVPISSIQATIAKLSIRPPGGLESPVASLPGPAEPPGLPPASLPESTPIPSSSPPPLSSPLPEAPQPKEEPPVPEAPSSGPPSSSLELLASLTPEAFSLDSSLRGKQRMSKHNFLQAHNGQGLRATRPSDDPLSLLDPLWTLNKT

SEQ ID NO: 881512 - protein, 1711 aa, Homo sapiens
SRGSPCSRSWSVLRKYLGQLHYLQSRVPMGSGQEAAVPVTWTEIFSGKSVAHEDIKYEQACILYNLGALHSMLGAMDKRVSEEGMKVSCTHFQCAAGAFAYLREHFPQAYSVDMSRQILTLNVNLMLGQAQECLLEKSMLDNRKSFLVARISAQVVDYYKEACRALENPDTASLLGRIQKDWKKLVQMKIYYFAAVAHLHMGKQAEEQQKFGERVAYFQSALDKLNEAIKLAKGQPDTVQDALRFTMDVIGGKYNSAKKDNDFIYHEAVPALDTLQPVKGAPLVKPLPVNPTDPAVTGPDIFAKLVPMAAHEASSLYSEEKAKLLREMMAKIEDKNEVLELSVGLGQGGGGRQHFPGLWGPQGCLCWERNEMSIPNRFPNAAFPPGVVGLVCKAGVMSVGGGGAFCSTVSSSALGMFCETRPDLVVGVRGHNLLSAETSDGVVRLALAAPLTWSELDQHPAPTWPVAPHSQFMDSMQLDPETVDNLDAYSHIPPQLMEKCAALSVRPDTVRNLVQSMQVLSGVFTDVEASLKDIRDLLEEDELLEQKFQEAVGQAGAISITSKAELAEVRREWAKYMEVHEKASFTNSELHRAMNLHVGNLRLLSGPLDQVRAALPTPALSPEDKAVLQNLKRILAKVQEMRDQRVSLEQQLRELIQKDDITASLVTTDHSEMKKLFEEQLKKYDQLKVYLEQNLAAQDRVLCALTEANVQYAAVRRVLSDLDQKWNSTLQTLVASYEAYEDLMKKSQEGRDFYADLESKVAALLERTQSTCQAREAARQQLLDRELKKKPPPRPTAPKPLLPRREESEAVEAGDPPEELRSLPPDMVAGPRLPDTFLGSATPLHFPPSPFPSSTGPGPHYLSGPLPPGTYSGPTQLIQPRAPGPHAMPVAPGPALYPAPAYTPELGLVPRSSPQHGVVSSPYVGVGPAPPVAGLPSAPPPQFSGPELAMAVRPATTTVDSIQAPIPSHTAPRPNPTPAPPPPCFPVPPPQPLPTPYTYPAGAKQPIPAQHHFSSGIPAGFPAPRIGPQPQPHPQPHPSQAFGPQPPQQPLPLQHPHLFPPQAPGLLPPQSPYPYAPQPGVLGQPPPPLHTQLYPGPAQDPLPAHSGALPFPSPGPPQPPHPPLAYGPAPSTRPMGPQAAPLTIRGPSSAGQSTPSPHLVPSPAPSPGPGPVPPRPPAAEPPPCLRRGAAAADLLSSSPESQHGGTQSPGGGQPLLQPTKVDAAEGRRPQALRLIERDPYEHPERLRQLQQELEAFRGQLGDVGALDTVWRELQDAQEHDARGRSIAIARCYSLKNRHQDVMPYDSNRVVLRSGKDDYINASCVEGLSPYCPPLVATQAPLPGTAADFWLMVHEQKVSVIVMLVSEAEMEKQKVARYFPTERGQPMVHGALSLALSSVRSTETHVERVLSLQFRDQSLKRSLVHLHFPTWPELGLPDSPSNLLRFIQEVHAHYLHQRPLHTPIIVHCSSGVGRTGAFALLYAAVQEVEAGNGIPELPQLVRRMRQQRKHMLQEKLHLRFCYEAVVRHVEQVLQRHGVPPPCKPLASASISQKNHLPQDSQDLVLGGDVPISSIQATIAKLSIRPPGGLESPVASLPGPAEPPGLPPASLPESTPIPSSSPPPLSSPLPEAPQPKEEPPVPEAPSSGPPSSSLELLASLTPEAFSLDSSLRGKQRMSKHNFLQAHNGQGLRATRPSDDPLSLLDPLWTLNKT

SEQ ID NO: 881513 - protein, 1671 aa, Homo sapiens
MGSGQEAAVPVTWTEIFSGKSVAHEDIKYEQACILYNLGALHSMLGAMDKRVSEEGMKVSCTHFQCAAGAFAYLREHFPQAYSVDMSRQILTLNVNLMLGQAQECLLEKSMLDNRKSFLVARISAQVVDYYKEACRALENPDTASLLGRIQKDWKKLVQMKIYYFAAVAHLHMGKQAEEQQKFGERVAYFQSALDKLNEAIKLAKGQPDTVQDALRFTMDVIGGKYNSAKKDNDFIYHEAVPALDTLQPVKGAPLVKPLPVNPTDPAVTGPDIFAKLVPMAAHEASSLYSEEKAKLLREMMAKIEDKNEVLELSVGLGQGGGGRQHFPGLWGPQGCLCWERNEMSIPNRFPNAAFPPGVVGLVCKAGVMSVGGGGAFCSTVSSSALGMFCETRPDLVVGVRGHNLLSAETSDGVVRLALAAPLTWSELDQHPAPTWPVAPHSQFMDSMQLDPETVDNLDAYSHIPPQLMEKCAALSVRPDTVRNLVQSMQVLSGVFTDVEASLKDIRDLLEEDELLEQKFQEAVGQAGAISITSKAELAEVRREWAKYMEVHEKASFTNSELHRAMNLHVGNLRLLSGPLDQEDKAVLQNLKRILAKVQEMRDQRVSLEQQLRELIQKDDITASLVTTDHSEMKKLFEEQLKKYDQLKVYLEQNLAAQDRVLCALTEANVQYAAVRRVLSDLDQKWNSTLQTLVASYEAYEDLMKKSQEGRDFYADLESKVAALLERTQSTCQAREAARQQLLDRELKKKPPPRPTAPKPLLPRREESEAVEAGDPPEELRSLPPDMVAGPRLPDTFLGSATPLHFPPSPFPSSTGPGPHYLSGPLPPGTYSGPTQLIQPRAPGPHAMPVAPGPALYPAPAYTPELGLVPRSSPQHGVVSSPYVGVGPAPPVAGLPSAPPPQFSGPELAMAVRPATTTVDSIQAPIPSHTAPRPNPTPAPPPPCFPVPPPQPLPTPYTYPAGAKQPIPAQHHFSSGIPAGFPAPRIGPQPQPHPQPHPSQAFGPQPPQQPLPLQHPHLFPPQAPGLLPPQSPYPYAPQPGVLGQPPPPLHTQLYPGPAQDPLPAHSGALPFPSPGPPQPPHPPLAYGPAPSTRPMGPQAAPLTIRGPSSAGQSTPSPHLVPSPAPSPGPGPVPPRPPAAEPPPCLRRGAAAADLLSSSPESQHGGTQSPGGGQPLLQPTKVDAAEGRRPQALRLIERDPYEHPERLRQLQQELEAFRGQLGDVGALDTVWRELQDAQEHDARGRSIAIARCYSLKNRHQDVMPYDSNRVVLRSGKDDYINASCVEGLSPYCPPLVATQAPLPGTAADFWLMVHEQKVSVIVMLVSEAEMEKQKVARYFPTERGQPMVHGALSLALSSVRSTETHVERVLSLQFRDQSLKRSLVHLHFPTWPELGLPDSPSNLLRFIQEVHAHYLHQRPLHTPIIVHCSSGVGRTGAFALLYAAVQEVEAGNGIPELPQLVRRMRQQRKHMLQEKLHLRFCYEAVVRHVEQVLQRHGVPPPCKPLASASISQKNHLPQDSQDLVLGGDVPISSIQATIAKLSIRPPGGLESPVASLPGPAEPPGLPPASLPESTPIPSSSPPPLSSPLPEAPQPKEEPPVPEAPSSGPPSSSLELLASLTPEAFSLDSSLRGKQRMSKHNFLQAHNGQGLRATRPSDDPLSLLDPLWTLNKT

SEQ ID NO: 881514 - protein, 1745 aa, Homo sapiens
MGSGQEAAVPVTWTEIFSGKSVAHEDIKYEQACILYNLGALHSMLGAMDKRVSEEGMKVSCTHFQCAAGAFAYLREHFPQAYSVDMSRQILTLNVNLMLGQAQECLLEKSMLDNRKSFLVARISAQVVDYYKEACRALENPDTASLLGRIQKDWKKLVQMKIYYFAAVAHLHMGKQAEEQQKFGERVAYFQSALDKLNEAIKLAKGQPDTVQDALRFTMDVIGGKYNSAKKDNDFIYHEAVPALDTLQPVKGAPLVKPLPVNPTDPAVTGPDIFAKLVPMAAHEASSLYSEEKAKLLREMMAKIEDKNEVLELSVGLGQGGGGRQHFPGLWGPQGCLCWERNEMSIPNRFPNAAFPPGVVGLVCKAGVMSVGGGGAFCSTVSSSALGMFCETRPDLVVGVRGHNLLSAETSDGVVRLALAAPLTWSELDQHPAPTWPVAPHSQFMDSMQLDPETVDNLDAYSHIPPQLMEKCAALSVRPDTVRNLVQSMQVLSGVFTDVEASLKDIRDLLEEDELLEQKFQEAVGQAGAISITSKAELAEVRREWAKYMEVHEKASFTNSELHRAMNLHVGNLRLLSGPLDQVRAALPTPALSPEDKAVLQNLKRILAKVQEMRDQRVSLEQQLRELIQKDDITASLVTTDHSEMKVGWVSRVEGLWLRAPPLGVEALSVRPWPPPLPQKLFEEQLKKYDQLKVYLEQNLAAQDRVLCALTEANVQYAAVRRVLSDLDQKSVPSPLLFSRSHLEPSPMVHLELALLPTRWNSTLQTLVASYEAYEDLMKKSQEGRDFYADLESKVAALLERTQSTCQAREAARQQLLDRELKKKPPPRPTAPKPLLPRREESEAVEAGDPPEELRSLPPDMVAGPRLPDTFLGSATPLHFPPSPFPSSTGPGPHYLSGPLPPGTYSGPTQLIQPRAPGPHAMPVAPGPALYPAPAYTPELGLVPRSSPQHGVVSSPYVGVGPAPPVAGLPSAPPPQFSGPELAMAVRPATTTVDSIQAPIPSHTAPRPNPTPAPPPPCFPVPPPQPLPTPYTYPAGAKQPIPAQHHFSSGIPAGFPAPRIGPQPQPHPQPHPSQAFGPQPPQQPLPLQHPHLFPPQAPGLLPPQSPYPYAPQPGVLGQPPPPLHTQLYPGPAQDPLPAHSGALPFPSPGPPQPPHPPLAYGPAPSTRPMGPQAAPLTIRGPSSAGQSTPSPHLVPSPAPSPGPGPVPPRPPAAEPPPCLRRGAAAADLLSSSPESQHGGTQSPGGGQPLLQPTKVDAAEGRRPQALRLIERDPYEHPERLRQLQQELEAFRGQLGDVGALDTVWRELQDAQEHDARGRSIAIARCYSLKNRHQDVMPYDSNRVVLRSGKDDYINASCVEGLSPYCPPLVATQAPLPGTAADFWLMVHEQKVSVIVMLVSEAEMEKQKVARYFPTERGQPMVHGALSLALSSVRSTETHVERVLSLQFRDQSLKRSLVHLHFPTWPELGLPDSPSNLLRFIQEVHAHYLHQRPLHTPIIVHCSSGVGRTGAFALLYAAVQEVEAGNGIPELPQLVRRMRQQRKHMLQEKLHLRFCYEAVVRHVEQVLQRHGVPPPCKPLASASISQKNHLPQDSQDLVLGGDVPISSIQATIAKLSIRPPGGLESPVASLPGPAEPPGLPPASLPESTPIPSSSPPPLSSPLPEAPQPKEEPPVPEAPSSGPPSSSLELLASLTPEAFSLDSSLRGKQRMSKHNFLQAHNGQGLRATRPSDDPLSLLDPLWTLNKT

SEQ ID NO: 881515 - protein, 869 aa, Homo sapiens
HKRLGLIHTAVPSTPGPHYLSGPLPPGTYSGPTQLIQPRAPGPHAMPVAPGPALYPAPAYTPELGLVPRSSPQHGVVSSPYVGVGPAPPVAGLPSAPPPQFSGPELAMAVRPATTTVDSIQAPIPSHTAPRPNPTPAPPPPCFPVPPPQPLPTPYTYPAGAKQPIPAQHHFSSGIPAGFPAPRIGPQPQPHPQPHPSQAFGPQPPQQPLPLQHPHLFPPQAPGLLPPQSPYPYAPQPGVLGQPPPPLHTQLYPGPAQDPLPAHSGALPFPSPGPPQPPHPPLAYGPAPSTRPMGPQAAPLTIRGPSSAGQSTPSPHLVPSPAPSPGPGPVPPRPPAAEPPPCLRRGAAAADLLSSSPESQHGGTQSPGGGQPLLQPTKVDAAEGRRPQALRLIERDPYEHPERLRQLQQELEAFRGQLGDVGALDTVWRELQDAQEHDARGRSIAIARCYSLKNRHQDVMPYDSNRVVLRSGKDDYINASCVEGLSPYCPPLVATQAPLPGTAADFWLMVHEQKVSVIVMLVSEAEMEKQKVARYFPTERGQPMVHGALSLALSSVRSTETHVERVLSLQFRDQSLKRSLVHLHFPTWPELGLPDSPSNLLRFIQEVHAHYLHQRPLHTPIIVHCSSGVGRTGAFALLYAAVQEVEAGNGIPELPQLVRRMRQQRKHMLQEKLHLRFCYEAVVRHVEQVLQRHGVPPPCKPLASASISQKNHLPQDSQDLVLGGDVPISSIQATIAKLSIRPPGGLESPVASLPGPAEPPGLPPASLPESTPIPSSSPPPLSSPLPEAPQPKEEPPVPEAPSSGPPSSSLELLASLTPEAFSLDSSLRGKQRMSKHNFLQAHNGQGLRATRPSDDPLSLLDPLWTLNKT

SEQ ID NO: 881516 - protein, 1174 aa, Homo sapiens
MGSGQEAAVPVTWTEIFSGKSVAHEDIKYEQACILYNLGALHSMLGAMDKRVSEEGMKVSCTHFQCAAGAFAYLREHFPQAYSVDMSRQILTLNVNLMLGQAQECLLEKSMLDNRKSFLVARISAQVVDYYKEACRALENPDTASLLGRIQKDWKKLVQMKIYYFAAVAHLHMGKQAEEQQKFGERVAYFQSALDKLNEAIKLAKGQPDTVQDALRFTMDVIGGKYNSAKKDNDFIYHEAVPALDTLQPVKGAPLVKPLPVNPTDPAVTGPDIFAKLVPMAAHEASSLYSEEKAKLLREMMAKIEDKNEVLELSVGLGQGGGGRQHFPGLWGPQGCLCWERNEMSIPNRFPNAAFPPGVVGLVCKAGVMSVGGGGAFCSTVSSSALGMFCETRPDLVVGVRGHNLLSAETSDGVVRLALAAPLTWSELDQHPAPTWPVAPHSQFMDSMQLDPETVDNLDAYSHIPPQLMEKCAALSVRPDTVRNLVQSMQVLSGVFTDVEASLKDIRDLLEEDELLEQKFQEAVGQAGAISITSKAELAEVRREWAKYMEVHEKASFTNSELHRAMNLHVGNLRLLSGPLDQVRAALPTPALSPEDKAVLQNLKRILAKVQEMRDQRVSLEQQLRELIQKDDITASLVTTDHSEMKKLFEEQLKKYDQLKVYLEQNLAAQDRVLCALTEANVQYAAVRRVLSDLDQKWNSTLQTLVASYEAYEDLMKKSQEGRDFYADLESKVAALLERTQSTCQAREAARQQLLDRELKKKPPPRPTAPKPLLPRREESEAVEAGDPPEELRSLPPDMVAGPRLPDTFLGSATPLHFPPSPFPSSTGPGPHYLSGPLPPGTYSGPTQLIQPRAPGPHAMPVAPGPALYPAPAYTPELGLVPRSSPQHGVVSSPYVGVGPAPPVAGLPSAPPPQFSGPELAMAVRPATTTVDSIQAPIPSHTAPRPNPTPAPPPPCFPVPPPQPLPTPYTYPAGAKQPIPAQHHFSSGIPAGFPAPRIGPQPQPHPQPHPSQAFGPQPPQQPLPLQHPHLFPPQAPGLLPPQSPYPYAPQPGVLGQPPPPLHTQLYPGPAQDPLPAHSGALPFPSPGPPQPPHPPLAYGPAPSTRPMGPQAAPLTIRGPSSAGQSTPSPHLVPSPAPSPGPGPVPPRPPAAEPPPCCSPPRWMQLRVVGRRPCG

SEQ ID NO: 881517 - protein, 147 aa, Homo sapiens
MGKQAEEQQKFGERVSYSEEGTGDQWQPSVRCRCAPAPYTPGGGLLCLTLAITLLEAWCLKCCPICAALVPRGLRRWGRLPTEQVAGAGCGATLLLLAGVVPGCLLSCLSSDGQAGPGGRQEEKGSKQRRTEQAFLPPSTGCILPER

SEQ ID NO: 881518 - protein, 88 aa, Homo sapiens
MAAHEASSLYSEEKAKLLREMMAKIEDKNEVLDQFMDSMQLDPETVDNLDAYSHIPPQLMEKCAALSVRPDTVRNLVQSMQVHREKLE

SEQ ID NO: 881519 - protein, 49 aa, Homo sapiens
PNAPVQLHLRFCYEAVVRHVEQVLQRHGVPPPCKPLASPGLQPPSQSTG

SEQ ID NO: 881520 - protein, 1636 aa, Homo sapiens
WGCTPARGGMKVSCTHFQCAAGAFAYLREHFPQAYSVDMSRQILTLNVNLMLGQAQECLLEKSMLDNRKSFLVARISAQVVDYYKEACRALENPDTASLLGRIQKDWKKLVQMKIYYFAAVAHLHMGKQAEEQQKFGERVAYFQSALDKLNEAIKLAKGQPDTVQDALRFTMDVIGGKYNSAKKDNDFIYHEAVPALDTLQPVKGAPLVKPLPVNPTDPAVTGPDIFAKLVPMAAHEASSLYSEEKAKLLREMMAKIEDKNEVLELSVGLGQGGGGRQHFPGLWGPQGCLCWERNEMSIPNRFPNAAFPPGVVGLVCKAGVMSVGGGGAFCSTVSSSALGMFCETRPDLVVGVRGHNLLSAETSDGVVRLALAAPLTWSELDQHPAPTWPVAPHSQFMDSMQLDPETVDNLDAYSHIPPQLMEKCAALSVRPDTVRNLVQSMQVLSGVFTDVEASLKDIRDLLEEDELLEQKFQEAVGQAGAISITSKAELAEVRREWAKYMEVHEKASFTNSELHRAMNLHVGNLRLLSGPLDQVRAALPTPALSPEDKAVLQNLKRILAKVQEMRDQRVSLEQQLRELIQKDDITASLVTTDHSEMKKLFEEQLKKYDQLKVYLEQNLAAQDRVLCALTEANVQYAAVRRVLSDLDQKWNSTLQTLVASYEAYEDLMKKSQEGRDFYADLESKVAALLERTQSTCQAREAARQQLLDRELKKKPPPRPTAPKPLLPRREESEAVEAGDPPEELRSLPPDMVAGPRLPDTFLGSATPLHFPPSPFPSSTGPGPHYLSGPLPPGTYSGPTQLIQPRAPGPHAMPVAPGPALYPAPAYTPELGLVPRSSPQHGVVSSPYVGVGPAPPVAGLPSAPPPQFSGPELAMAVRPATTTVDSIQAPIPSHTAPRPNPTPAPPPPCFPVPPPQPLPTPYTYPAGAKQPIPAQHHFSSGIPAGFPAPRIGPQPQPHPQPHPSQAFGPQPPQQPLPLQHPHLFPPQAPGLLPPQSPYPYAPQPGVLGQPPPPLHTQLYPGPAQDPLPAHSGALPFPSPGPPQPPHPPLAYGPAPSTRPMGPQAAPLTIRGPSSAGQSTPSPHLVPSPAPSPGPGPVPPRPPAAEPPPCLRRGAAAADLLSSSPESQHGGTQSPGGGQPLLQPTKVDAAEGRRPQALRLIERDPYEHPERLRQLQQELEAFRGQLGDVGALDTVWRELQDAQEHDARGRSIAIARCYSLKNRHQDVMPYDSNRVVLRSGKDDYINASCVEGLSPYCPPLVATQAPLPGTAADFWLMVHEQKVSVIVMLVSEAEMEKQKVARYFPTERGQPMVHGALSLALSSVRSTETHVERVLSLQFRDQSLKRSLVHLHFPTWPELGLPDSPSNLLRFIQEVHAHYLHQRPLHTPIIVHCSSGVGRTGAFALLYAAVQEVEAGNGIPELPQLVRRMRQQRKHMLQEKLHLRFCYEAVVRHVEQVLQRHGVPPPCKPLASASISQKNHLPQDSQDLVLGGDVPISSIQATIAKLSIRPPGGLESPVASLPGPAEPPGLPPASLPESTPIPSSSPPPLSSPLPEAPQPKEEPPVPEAPSSGPPSSSLELLASLTPEAFSLDSSLRGKQRMSKHNFLQAHNGQGLRATRPSDDPLSLLDPLWTLNKT

SEQ ID NO: 881521 - protein, 1683 aa, Homo sapiens
WLSQQLQQLREWPGGRRVPAAMEAVPRMPMIWLDLKEAGDFHFQPAVKKFVLKNYGENPEAYNEELKKLELLRQNAVRVPRDFEGCSVLRKYLGQLHYLQSRVPMGSGQEAAVPVTWTEIFSGKSVAHEDIKYEQACILYNLGALHSMLGAMDKRVSEEGMKVSCTHFQCAAGAFAYLREHFPQAYSVDMSRQILTLNVNLMLGQAQECLLEKSMLDNRKSFLVARISAQVVDYYKEACRALENPDTASLLGRIQKDWKKLVQMKIYYFAAVAHLHMGKQAEEQQKFGERVAYFQSALDKLNEAIKLAKGQPDTVQDALRFTMDVIGGKYNSAKKDNDFIYHEAVPALDTLQPVKGAPLVKPLPVNPTDPAVTGPDIFAKLVPMAAHEASSLYSEEKAKLLREMMAKIEDKNEVLDQFMDSMQLDPETVDNLDAYSHIPPQLMEKCAALSVRPDTVRNLVQSMQVLSGVFTDVEASLKDIRDLLEEDELLEQKFQEAVGQAGAISITSKAELAEVRREWAKYMEVHEKASFTNSELHRAMNLHVGNLRLLSGPLDQVRAALPTPALSPEDKAVLQNLKRILAKVQEMRDQRVSLEQQLRELIQKDDITASLVTTDHSEMKKLFEEQLKKYDQLKVYLEQNLAAQDRVLCALTEANVQYAAVRRVLSDLDQKWNSTLQTLVASYEAYEDLMKKSQEGRDFYADLESKVAALLERTQSTCQAREAARQQLLDRELKKKPPPRPTAPKPLLPRREESEAVEAGDPPEELRSLPPDMVAGPRLPDTFLGSATPLHFPPSPFPSSTGPGPHYLSGPLPPGTYSGPTQLIQPRAPGPHAMPVAPGPALYPAPAYTPELGLVPRSSPQHGVVSSPYVGVGPAPPVAGLPSAPPPQFSGPELAMAVRPATTTVDSIQAPIPSHTAPRPNPTPAPPPPCFPVPPPQPLPTPYTYPAGAKQPIPAQHHFSSGIPAGFPAPRIGPQPQPHPQPHPSQAFGPQPPQQPLPLQHPHLFPPQAPGLLPPQSPYPYAPQPGVLGQPPPPLHTQLYPGPAQDPLPAHSGALPFPSPGPPQPPHPPLAYGPAPSTRPMGPQAAPLTIRGPSSAGQSTPSPHLVPSPAPSPGPGPVPPRPPAAEPPPCLRRGAAAADLLSSSPESQHGGTQSPGGGQPLLQPTKVDAAEGRRPQALRLIERDPYEHPERLRQLQQELEAFRGQLGDVGALDTVWRELQDAQEHDARGRSIAIARCYSLKNRHQDVMPYDSNRVVLRSGKDDYINASCVEGLSPYCPPLVATQAPLPGTAADFWLMVHEQKVSVIVMLVSEAEMEKQKVARYFPTERGQPMVHGALSLALSSVRSTETHVERVLSLQFRDQSLKRSLVHLHFPTWPELGLPDSPSNLLRFIQEVHAHYLHQRPLHTPIIVHCSSGVGRTGAFALLYAAVQEVEAGNGIPELPQLVRRMRQQRKHMLQEKLHLRFCYEAVVRHVEQVLQRHGVPPPCKPLASASISQKVRKVPWKLLGEPQPWDSLSSLTLSSQNHLPQDSQDLVLGGDVPISSIQATIAKLSIRPPGGLESPVASLPGPAEPPGLPPASLPESTPIPSSSPPPLSSPLPEAPQPKEEPPVPEAPSSGPPSSSLELLASLTPEAFSLDSSLRGKQRMSKHNFLQAHNGQGLRATRPSDDPLSLLDPLWTLNKT

SEQ ID NO: 881522 - protein, 856 aa, Homo sapiens
MLGAMDKRVSEEGMKVSCTHFQCAAGAFAYLREHFPQAYSVDMSRQILTLNVNLMLGQAQECLLEKSMLDNRKSFLVARISAQVVDYYKEACRALENPDTASLLGRIQKDWKKLVQMKIYYFAAVAHPGFPVPPPQPLPTPYTYPAGAKQPIPAQHHFSSGIPAGFPAPRIGPQPQPHPQPHPSQAFGPQPPQQPLPLQHPHLFPPQAPGLLPPQSPYPYAPQPGVLGQPPPPLHTQLYPGPAQDPLPAHSGALPFPSPGPPQPPHPPLAYGPAPSTRPMGPQAAPLTIRGPSSAGQSTPSPHLVPSPAPSPGPGPVPPRPPAAEPPPCLRRGAAAADLLSSSPESQHGGTQSPGGGQPLLQPTKVDAAEGRRPQALRLIERDPYEHPERLRQLQQELEAFRGQLGDVGALDTVWRELQDAQEHDARGRSIAIARCYSLKNRHQDVMPYDSNRVVLRSGKDDYINASCVEGLSPYCPPLVATQAPLPGTAADFWLMVHEQKVSVIVMLVSEAEMEKQKVARYFPTERGQPMVHGALSLALSSVRSTETHVERVLSLQFRDQSLKRSLVHLHFPTWPELGLPDSPSNLLRFIQEVHAHYLHQRPLHTPIIVHCSSGVGRTGAFALLYAAVQEVEAGNGIPELPQLVRRMRQQRKHMLQEKLHLRFCYEAVVRHVEQVLQRHGVPPPCKPLASASISQKNHLPQDSQDLVLGGDVPISSIQATIAKLSIRPPGGLESPVASLPGPAEPPGLPPASLPESTPIPSSSPPPLSSPLPEAPQPKEEPPVPEAPSSGPPSSSLELLASLTPEAFSLDSSLRGKQRMSKHNFLQAHNGQGLRATRPSDDPLSLLDPLWTLNKT

SEQ ID NO: 881523 - protein, 823 aa, Homo sapiens
DAWVDPRVRPAPVCRQGLGLVPRSSPQHGVVSSPYVGVGPAPPVAGLPSAPPPQFSGPELAMAVRPATTTVDSIQAPIPSHTAPRPNPTPAPPPPCFPVPPPQPLPTPYTYPAGAKQPIPAQHHFSSGIPAGFPAPRIGPQPQPHPQPHPSQAFGPQPPQQPLPLQHPHLFPPQAPGLLPPQSPYPYAPQPGVLGQPPPPLHTQLYPGPAQDPLPAHSGALPFPSPGPPQPPHPPLAYGPAPSTRPMGPQAAPLTIRGPSSAGQSTPSPHLVPSPAPSPGPGPVPPRPPAAEPPPCLRRGAAAADLLSSSPESQHGGTQSPGGGQPLLQPTKVDAAEGRRPQALRLIERDPYEHPERLRQLQQELEAFRGQLGDVGALDTVWRELQDAQEHDARGRSIAIARCYSLKNRHQDVMPYDSNRVVLRSGKDDYINASCVEGLSPYCPPLVATQAPLPGTAADFWLMVHEQKVSVIVMLVSEAEMEKQKVARYFPTERGQPMVHGALSLALSSVRSTETHVERVLSLQFRDQSLKRSLVHLHFPTWPELGLPDSPSNLLRFIQEVHAHYLHQRPLHTPIIVHCSSGVGRTGAFALLYAAVQEVEAGNGIPELPQLVRRMRQQRKHMLQEKLHLRFCYEAVVRHVEQVLQRHGVPPPCKPLASASISQKNHLPQDSQDLVLGGDVPISSIQATIAKLSIRPPGGLESPVASLPGPAEPPGLPPASLPESTPIPSSSPPPLSSPLPEAPQPKEEPPVPEAPSSGPPSSSLELLASLTPEAFSLDSSLRGKQRMSKHNFLQAHNGQGLRATRPSDDPLSLLDPLWTLNKT

SEQ ID NO: 881524 - protein, 70 aa, Homo sapiens
CLGLSVPQQKVARYFPTERGQPMVHGALSLALSSVRSTETHVERVLSLQFRDQSLKRSLVHLHFPTWPEL

SEQ ID NO: 881525 - protein, 114 aa, Homo sapiens
ICFPLHYPIRISKRVCVMMITGSWMISSINSCAHTVYALCIPYCKSRAINHFFCDVPAMLTLACTDTWVYESTVFLSSTIFLVLPFTGIACSYGRVLLAVYRMHSAEGRKKAYS

SEQ ID NO: 881526 - protein, 1624 aa, Homo sapiens
RGPGGGGLTAGPGGGAARDRGAAGARSQRSQLSPSPARARAAMPLAFCGSENHSAAYRVDQGVLNNGCFVDALNVVPHVFLLFITFPILFIGWGSQSSKVHIHHSTWLHFPGHNLRWILTFMLLFVLVCEIAEGILSDGVTESHHLHLYMPAGMAFMAAVTSVVYYHNIETSNFPKLLIALLVYWTLAFITKTIKFVKFLDHAIGFSQLRFCLTGLLVILYGMLLLVEVNVIRVRRYIFFKTPREVKPPEDLQDLGVRFLQPFVNLLSKGTYWWMNAFIKTAHKKPIDLRAIGKLPIAMRALTNYQRLCEAFDAQVRKDIQGTQGARAIWQALSHAFGRRLVLSSTFRILADLLGFAGPLCIFGIVDHLGKENDVFQPKTQFLGVYFVSSQEFLANAYVLAVLLFLALLLQRTFLQASYYVAIETGINLRGAIQTKIYNKIMHLSTSNLSMGEMTAGQICNLVAIDTNQLMWFFFLCPNLWAMPVQIIVGVILLYYILGVSALIGAAVIILLAPVQYFVATKLSQAQRSTLEYSNERLKQTNEMLRGIKLLKLYAWENIFRTRVETTRRKEMTSLRAFAIYTSISIFMNTAIPIAAVLITFVGHVSFFKEADFSPSVAFASLSLFHILVTPLFLLSSVVRSTVKALVSVQKLSEFLSSAEIREEQCAPHEPTPQGPASKYQAVPLRVVNRKRPAREDCRGLTGPLQSLVPSADGDADNCCVQIMGGYFTWTPDGIPTLSNITIRIPRGQLTMIVGQVGCGKSSLLLAALGEMQKVSGAVFWSSLPDSEIGEDPSPERETATDLDIRKRGPVAYASQKPWLLNATVEENIIFESPFNKQRYKMVIEACSLQPDIDILPHGDQTQIGERGINLSGGQRQRISVARALYQHANVVFLDDPFSALDIHLSDHLMQAGILELLRDDKRTVVLVTHKLQYLPHADWIIAMKDGTIQREGTLKDFQRSECQLFEHWKTLMNRQDQELEKETVTERKATEPPQGLSRAMSSRDGLLQDEEEEEEEAAESEEDDNLSSMLHQRAEIPWRACAKYLSSAGILLLSLLVFSQLLKHMVLVAIDYWLAKWTDSALTLTPAARNCSLSQECTLDQTVYAMVFTVLCSLGIVLCLVTSVTVEWTGLKVAKRLHRSLLNRIILAPMRFFETTPLGSILNRFSSDCNTIDQHIPSTLECLSRSTLLCVSALAVISYVTPVFLVALLPLAIVCYFIQKYFRVASRDLQQLDDTTQLPLLSHFAETVEGLTTIRAFRYEARFQQKLLEYTDSNNIASLFLTAANRWLEVRMEYIGACVVLIAAVTSISNSLHRELSAGLVGLGLTYALMVSNYLNWMVRNLADMELQLGAVKRIHGLLKTEAESYEGLLGAPSLIPKNWPDQGKIQIQNLSVRYDSSLKPVLKHVNALISPGQKIGICGRTGSGKSSFSLAFFRMVDTFEGHIIIDGIDIAKLPLHTLRSRLSIILQDPVLFSGTIRFNLDPERKCSDSTLWEALEIAQLKLVVKALPGGLDAIITEGGENFSQGQRQLFCLARAFVRKTSIFIMDEATASIDMATENILQKVVMTAFADRTVVTIAHRVHTILSADLVIVLKRGAILEFDKPEKLLSRKDSVFASFVRADK

SEQ ID NO: 881527 - protein, 1037 aa, Homo sapiens
MNTAIPIAAVLITFVGHVSFFKEADFSPSVAFASLSLFHILVTPLFLLSSVVRSTVKALVSVQKLSEFLSSAEIREEQCAPHEPTPQGPASKYQAVPLRVVNRKRPAREDCRGLTGPLQSLVPSADGDADNCCVQIMGGYFTWTPDGIPTLSNITIRIPRGQLTMIVGQVGCGKSSLLLAALGEMQKVSGAVFWSSLPDSEIGEDPSPERETATDLDIRKRGPVAYASQKPWLLNATVEENIIFESPFNKQRYKMVIEACSLQPDIDILPHGDQTQIGERGINLSGGQRQRISVARALYQHANVVFLDDPFSALDIHLSDHLMQAGILELLRDDKRTVVLVTHKLQYLPHADWIIAMKDGTIQREGTLKDFQRSECQLFEHWKTLMNRQDQELEKETVTERKATEPPQGLSRAMSSRDGLLQDEEEEEEEAAESEEDDNLSSMLHQRAEIPWRACAKYLSSAGILLLSLLVFSQLLKHMVLVAIDYWLAKWTDSALTLTPAARNCSLSQECTLDQTVYAMVFTVLCSLGIVLCLVTSVTVEWTGLKVAKRLHRSLLNRIILAPMRFFETTPLGSILNRFSSDCNTIDQHIPSTLECLSRSTLLCVSALAVISYVTPVFLVALLPLAIVCYFIQKYFRVASRDLQQLDDTTQLPLLSHFAETVEGLTTIRAFRYEARFQQKLLEYTDSNNIASLFLTAANRWLEVRMEYIGACVVLIAAVTSISNSLHRELSAGLVGLGLTYALMVSNYLNWMVRNLADMELQLGAVKRIHGLLKTEAESYEGLLGAPSLIPKNWPDQGKIQIQNLSVRYDSSLKPVLKHVNALISPGQKIGICGRTGSGKSSFSLAFFRMVDTFEGHIIIDGIDIAKLPLHTLRSRLSIILQDPVLFSGTIRFNLDPERKCSDSTLWEALEIAQLKLVVKALPGGLDAIITEGGENFSQGQRQLFCLARAFVRKTSIFIMDEATASIDMATENILQKVVMTAFADRTVVTIAHRVHTILSADLVIVLKRGAILEFDKPEKLLSRKDSVFASFVRADK

SEQ ID NO: 881528 - protein, 783 aa, Homo sapiens
MVIEACSLQPDIDILPHGDQTQIGERGINLSGGQRQRISVARALYQHANVVFLDDPFSALDIHLSDHLMQAGILELLRDDKRTVVLVTHKLQYLPHADWIIAMKDGTIQREGTLKDFQRSECQLFEHWKTLMNRQDQELEKETVTERKATEPPQGLSRAMSSRDGLLQDEEEEEEEAAESEEDDNLSSMLHQRAEIPWRACAKYLSSAGILLLSLLVFSQLLKHMVLVAIDYWLAKWTDSALTLTPAARNCSLSQECTLDQTVYAMVFTVLCSLGIVLCLVTSVTVEWTGLKVAKRLHRSLLNRIILAPMRFFETTPLGSILNRFSSDCNTIDQHIPSTLECLSRSTLLCVSALAVISYVTPVFLVALLPLAIVCYFIQKYFRVASRDLQQLDDTTQLPLLSHFAETVEGLTTIRAFRYEARFQQKLLEYTDSNNIASLFLTAANRWLEVRMEYIGACVVLIAAVTSISNSLHRELSAGLVGLGLTYALMVSNYLNWMVRNLADMELQLGAVKRIHGLLKTEAESYEGLLGAPSLIPKNWPDQGKIQIQNLSVRYDSSLKPVLKHVNALISPGQKIGICGRTGSGKSSFSLAFFRMVDTFEGHIIIDGIDIAKLPLHTLRSRLSIILQDPVLFSGTIRFNLDPERKCSDSTLWEALEIAQLKLVVKALPGGLDAIITEGGENFSQGQRQLFCLARAFVRKTSIFIMDEATASIDMATENILQKVVMTAFADRTVVTIAHRVHTILSADLVIVLKRGAILEFDKPEKLLSRKDSVFASFVRADK

SEQ ID NO: 881529 - protein, 402 aa, Homo sapiens
MLLARADLQQLDDTTQLPLLSHFAETVEGLTTIRAFRYEARFQQKLLEYTDSNNIASLFLTAANRWLEVRMEYIGACVVLIAAVTSISNSLHRELSAGLVGLGLTYALMVSNYLNWMVRNLADMELQLGAVKRIHGLLKTEAESYEGLLGAPSLIPKNWPDQGKIQIQNLSVRYDSSLKPVLKHVNALISPGQKIGICGRTGSGKSSFSLAFFRMVDTFEGHIIIDGIDIAKLPLHTLRSRLSIILQDPVLFSGTIRFNLDPERKCSDSTLWEALEIAQLKLVVKALPGGLDAIITEGGENFSQGQRQLFCLARAFVRKTSIFIMDEATASIDMATENILQKVVMTAFADRTVVTIAHRVHTILSADLVIVLKRGAILEFDKPEKLLSRKDSVFASFVRADK

SEQ ID NO: 881530 - protein, 1208 aa, Homo sapiens
MNTAIPIAAVLITFVGHVSFFKEADFSPSVAFASLSLFHILVTPLFLLSSVVRSTVKALVSVQKLSEFLSSAEIREEQCAPHEPTPQGPASKYQAVPLRVVNRKRPAREDCRGLTGPLQSLVPSADGDADNCCVQIMGGYFTWTPDGIPTLSNITIRIPRGQLTMIVGQVGCGKSSLLLAALGEMQKVSGAVFWSSLPDSEIGEDPSPERETATDLDIRKRGPVAYASQKPWLLNATVEENIIFESPFNKQRYKMVIEACSLQPDIDILPHGDQTQIGERGINLSGGQRQRISVARALYQHANVVFLDDPFSALDIHLSDHLMQAGILELLRDDKRTVVLVTHKLQYLPHADWIIAMKDGTIQREGTLKDFQRSECQLFEHWKTLMNRQDQELEKETVTERKATEPPQGLSRAMSSRDGLLQDEEEEEEEAAESEEDDNLSSMLHQRAEIPWRACAKYLSSAGILLLSLLVFSQLLKHMVLVAIDYWLAKWTDSALTLTPAARNCSLSQECTLDQTVYAMVFTVLCSLGIVLCLVTSVTVEWTGLKVAKRLHRSLLNRIILAPMRFFETTPLGSILNRFSSDCNTIDQHIPSTLECLSRSTLLCVSALAVISYVTPVFLVALLPLAIVCYFIQKYFRVASRDLQQLDDTTQLPLLSHFAETVEGLTTIRAFRYEARFQQKLLEYTDSNNIASLFLTAANRWLEVRMEYIGACVVLIAAVTSISNSLHRELSAGLVGLGLTYALMVSGSGLGQRRGQTPALPEHLRHWRHETLPGLTPISFASDARGTVRAGRLTSRPQGPGPRQVEVGEPHELTLPVPPGRAALSRQWMAAKGIWGPGPSPALRRAILVAEDRTKLTMECAPLACSPQVSNYLNWMVRNLADMELQLGAVKRIHGLLKTEAESYEGLLGEAQGEGWGRVQGGVCLGWGPQGSLGMGWHFRILAVAHAWWLSPARPPAPSLIPKNWPDQGKIQIQNLSVRYDSSLKPVLKHVNALISPGQKIGICGRTGSGKSSFSLAFFRMVDTFEGHIIIDGIDIAKLPLHTLRSRLSIILQDPVLFSGTIRFNLDPERKCSDSTLWEALEIAQLKLVVKALPGGLDAIITEGGENFSQGQRQLFCLARAFVRKTSIFIMDEATASIDMATENILQKVVMTAFADRTVVTIAHRVHTILSADLVIVLKRGAILEFDKPEKLLSRKDSVFASFVRADK

SEQ ID NO: 881531 - protein, 1011 aa, Homo sapiens
MNTAIPIAAVLITFVGHVSFFKEADFSPSVAFASLSLFHILVTPLFLLSSVVRSTVKALVSVQKLSEFLSSAEIREEQCAPHEPTPQGPASKYQAVPLRVVNRKRPAREDCRGLTGPLQSLVPSADGDADNCCVQIMGGYFTWTPDGIPTLSNITIRIPRGQLTMIVGQVGCGKSSLLLAALGEMQKVSGAVFWSSLPDSEIGEDPSPERETATDLDIRKRGPVAYASQKPWLLNATVEENIIFESPFNKQRYKMVIEACSLQPDIDILPHGDQTQIGERGINLSGGQRQRISVARALYQHANVVFLDDPFSALDIHLSDHLMQAGILELLRDDKRTVVLVTHKLQYLPHADWIIAMKDGTIQREGTLKDFQRSECQLFEHWKTLMNRQDQELEKETVTERKATEPPQGLSRAMSSRDGLLQDEEEEEEEAAESEEDDNLSSMLHQRAEIPWRACAKYLSSAGILLLSLLVFSQLLKHMVLVAIDYWLAKWTDSALTLTPAARNCSLSQECTLDQTVYAMVFTVLCSLGIVLCLVTSVTVEWTGLKVAKRLHRSLLNRIILAPMRFFETTPLGSILNRFSSDCNTIDQHIPSTLECLSRSTLLCVSALAVISYVTPVFLVALLPLAIVCYFIQKYFRVASRDLQQLDDTTQLPLLSHFAETVEGLTTIRAFRYEARFQQKLLEYTDSNNIASLFLTAANRWLEVRMEYIGACVVLIAAVTSISNSLHRELSAGLVGLGLTYALMVSNYLNWMVRNLADMELQLGAVKRIHGLLKTEAESYEGLLVSTIADPKELARPREDPDPEPERALRQLPEAGAEARQCPHLPWTEDRDAAAAPAVGSPPSLLPSSAWWTRSKDPVLFSGTIRFNLDPERKCSDSTLWEALEIAQLKLVVKALPGGLDAIITEGGENFSQGQRQLFCLARAFVRKTSIFIMDEATASIDMATENILQKVVMTAFADRTVVTIAHRVHTILSADLVIVLKRGAILEFDKPEKLLSRKDSVFASFVRADK

SEQ ID NO: 881532 - protein, 966 aa, Homo sapiens
MNTAIPIAAVLITFVGHVSFFKEADFSPSVAFASLSLFHILVTPLFLLSSVVRSTVKALVSVQKLSEFLSSAEIREEQCAPHEPTPQGPASKYQAVPLRVVNRKRPAREDCRGLTGPLQSLVPSADGDADNCCVQIMGGYFTWTPDGIPTLSNITIRIPRGQLTMIVGQVGCGKSSLLLAALGEMQKVSGAVFWSSLPDSEIGEDPSPERETATDLDIRKRGPVAYASQKPWLLNATVEENIIFESPFNKQRYKMVIEACSLQPDIDILPHGDQTQIGERGINLSGGQRQRISVARALYQHANVVFLDDPFSALDIHLSDHLMQAGILELLRDDKRTVVLVTHKLQYLPHADWIIAMKDGTIQREGTLKDFQRSECQLFEHWKTLMNRQDQELEKETVTERKATEPPQGLSRAMSSRDGLLQDEEEEEEEAAESEEDDNLSSMLHQRAEIPWRACAKYLSSAGILLLSLLVFSQLLKHMVLVAIDYWLAKWTDSALTLTPAARNCSLSQECTLDQTVYAMVFTVLCSLGIVLCLVTSVTVEWTGLKVAKRLHRSLLNRIILAPMRFFETTPLGSILNRFSSDCNTIDQHIPSTLECLSRSTLLCVSALAVISYVTPVFLVALLPLAIVCYFIQKYFRVASRDLQQLDDTTQLPLLSHFAETVEGLTTIRAFRYEARFQQKLLEYTDSNNIASLFLTAANRWLEVRMEYIGACVVLIAAVTSISNSLHRELSAGLVGLGLTYALMVSNYLNWMVRNLADMELQLGAVKRIHGLLKTEAESYEGLLGAPSLIPKNWPDQGKIQIQNLSVRYDSSLKPVLKHVNALISPGQKIGICGRTGSGKSSFSLAFFRMVDTFEDAIITEGGENFSQGQRQLFCLARAFVRKTSIFIMDEATASIDMATENILQKVVMTAFADRTVVTIAHRVHTILSADLVIVLKRGAILEFDKPEKLLSRKDSVFASFVRADK

SEQ ID NO: 881533 - protein, 1075 aa, Homo sapiens
MNTAIPIAAVLITFVGHVSFFKEADFSPSVAFASLSLFHILVTPLFLLSSVVRSTVKALVSVQKLSEFLSSAEIREEQCAPHEPTPQGPASKYQAVPLRVVNRKRPAREDCRGLTGPLQSLVPSADGDADNCCVQIMGGYFTWTPDGIPTLSNITIRIPRGQLTMIVGQVGCGKSSLLLAALGEMQKVSGAVFWSSLPDSEIGEDPSPERETATDLDIRKRGPVAYASQKPWLLNATVEENIIFESPFNKQRYKMVIEACSLQPDIDILPHGDQTQIGERGINLSGGQRQRISVARALYQHANVVFLDDPFSALDIHLSDHLMQAGILELLRDDKRTVVLVTHKLQYLPHADWIIAMKDGTIQREGTLKDFQRSECQLFEHWKTLMNRQDQELEKETVTERKATEPPQGLSRAMSSRDGLLQDEEEEEEEAAESEEDDNLSSMLHQRAEIPWRACAKYLSSAGILLLSLLVFSQLLKHMVLVAIDYWLAKWTDSALTLTPAARNCSLSQECTLDQTVYAMVFTVLCSLGIVLCLVTSVTVEWTGLKVAKRLHRSLLNRIILAPMRFFETTPLGSILNRFSSDCNTIDQHIPSTLECLSRSTLLCVSALAVISYVTPVFLVALLPLAIVCYFIQKYFRVASRDLQQLDDTTQLPLLSHFAETVEGLTTIRAFRYEARFQQKLLEYTDSNNIASLFLTAANRWLEVRMEYIGACVVLIAAVTSISNSLHRELSAGLVGLGLTYALMVSNYLNWMVRNLADMELQLGAVKRIHGLLKTEAESYEGLLGAPSLIPKNWPDQGKIQIQNLSVRYDSSLKPVLKHVNALISPGQKIGICGRTGSGKSSFSLAFFRMVDTFEVSCKAGTPRVPTATRCGLSPGTWSDMTGGPAVTAFPCTLTGTHAGGTSSLMALTSPNCRCTPCAHASPSSCRTPSSSAAPSDAIITEGGENFSQGQRQLFCLARAFVRKTSIFIMDEATASIDMATENILQKVVMTAFADRTVVTIAPQEGHPQLWPPPRVVFPPSCPAPSCPAQHRVHTILSADLVIVLKRGAILEFDKPEKLLSRKDSVFASFVRADK

SEQ ID NO: 881534 - protein, 600 aa, Homo sapiens
RGPGGGGLTAGPGGGAARDRGAAGARSQRSQLSPSPARARAAMPLAFCGSENHSAAYRVDQGVLNNGCFVDALNVVPHVFLLFITFPILFIGWGSQSSKVHIHHSTWLHFPGHNLRWILTFMLLFVLVCEIAEGILSDGVTESHHLHLYMPAGMAFMAAVTSVVYYHNIETSNFPKLLIALLVYWTLAFITKTIKFVKFLDHAIGFSQLRFCLTGLLVILYGMLLLVEVNVIRVRRYIFFKTPREVKPPEDLQDLGVRFLQPFVNLLSKGTYWWMNAFIKTAHKKPIDLRAIGKLPIAMRALTNYQRLCEAFDAQVRKDIQGTQGARAIWQALSHAFGRRLVLSSTFRILADLLGFAGPLCIFGIVDHLGKENDVFQPKTQFLGVYFVSSQEFLANAYVLAVLLFLALLLQRTFLQASYYVAIETGINLRGAIQTKIYNKIMHLSTSNLSMGEMTAGQICNLVAIDTNQLMWFFFLCPNLWAMPVQIIVGVILLYYILGVSALIGAAVIILLAPVQYFVATKLSQAQRSTLEYSNERLKQTNEMLRGIKLLKLYAWENIFRTRVETTRRKEMTSLRAFAIYTSISIFMNTAIPIAAVLIC

SEQ ID NO: 881535 - protein, 176 aa, Homo sapiens
CGRTGSGKSSFSLAFFRMVDTFEGHIIIDGIDIAKLPLHTLRSRLSIILQAQGEGWGRVQGGVCLGWGPQGSLGMGWHFRILAVAHAWWLSPARPPAPSLIPKNWPDQGKIQIQNLSVRYDSSLKPVLKHVNALISPGQKIGICGRQLFFFLYWYPRRMPCNCSLVMIVVMNPFMS

SEQ ID NO: 881536 - protein, 904 aa, Homo sapiens
MKIMGGYFTWTPDGIPTLSNITIRIPRGQLTMIVGQVGCGKSSLLLAALGEMQKVSGAVFWSSLPDSEIGEDPSPERETATDLDIRKRGPVAYASQKPWLLNATVEENIIFESPFNKQRYKMVIEACSLQPDIDILPHGDQTQIGERGINLSGGQRQRISVARALYQHANVVFLDDPFSALDIHLSDHLMQAGILELLRDDKRTVVLVTHKLQYLPHADWIIAMKDGTIQREGTLKDFQRSECQLFEHWKTLMNRQDQELEKETVTERKATEPPQGLSRAMSSRDGLLQDEEEEEEEAAESEEDDNLSSMLHQRAEIPWRACAKYLSSAGILLLSLLVFSQLLKHMVLVAIDYWLAKWTDSALTLTPAARNCSLSQECTLDQTVYAMVFTVLCSLGIVLCLVTSVTVEWTGLKVAKRLHRSLLNRIILAPMRFFETTPLGSILNRFSSDCNTIDQHIPSTLECLSRSTLLCVSALAVISYVTPVFLVALLPLAIVCYFIQKYFRVASRDLQQLDDTTQLPLLSHFAETVEGLTTIRAFRYEARFQQKLLEYTDSNNIASLFLTAANRWLEVRMEYIGACVVLIAAVTSISNSLHRELSAGLVGLGLTYALMVSNYLNWMVRNLADMELQLGAVKRIHGLLKTEAESYEGLLGAPSLIPKNWPDQGKIQIQNLSVRYDSSLKPVLKHVNALISPGQKIGICGRTGSGKSSFSLAFFRMVDTFEGHIIIDGIDIAKLPLHTLRSRLSIILQDPVLFSGTIRFNLDPERKCSDSTLWEALEIAQLKLVVKALPGGLDAIITEGGENFSQGQRQLFCLARAFVRKTSIFIMDEATASIDMATENILQKVVMTAFADRTVVTIAHRVHTILSADLVIVLKRGAILEFDKPEKLLSRKDSVFASFVRADK

SEQ ID NO: 881537 - protein, 1084 aa, Homo sapiens
MNTAIPIAAVLITFVGHVSFFKEADFSPSVAFASLSLFHILVTPLFLLSSVVRSTVKALVSVQKLSEFLSSAEIREEQCAPHEPTPQGPASKYQAVPLRVVNRKRPAREDCRGLTGPLQSLVPSADGDADNCCVQIMGGYFTWTPDGIPTLSNITIRIPRGQLTMIVGQVGCGKSSLLLAALGEMQKVSGAVFWSSLPDSEIGEDPSPERETATDLDIRKRGPVAYASQKPWLLNATVEENIIFESPFNKQRYKMVIEACSLQPDIDILPHGDQTQIGERGINLSGGQRQRISVARALYQHANVVFLDDPFSALDIHLSDHLMQAGILELLRDDKRTVVLVTHKLQYLPHADWIIAMKDGTIQREGTLKDFQRSECQLFEHWKTLMNRQDQELEKETVTERKATEPPQGLSRAMSSRDGLLQDEEEEEEEAAESEEDDNLSSMLHQRAEIPWRACAKYLSSAGILLLSLLVFSQLLKHMVLVAIDYWLAKWTDSALTLTPAARNCSLSQECTLDQTVYAMVFTVLCSLGIVLCLVTSVTVEWTGLKVAKRLHRSLLNRIILAPMRFFETTPLGSILNRFSSDCNTIDQHIPSTLECLSRSTLLCVSALAVISYVTPVFLVALLPLAIVCYFIQKYFRVASRDLQQLDDTTQLPLLSHFAETVEGLTTIRAFRYEARFQQKLLEYTDSNNIASLFLTAANRWLEVRMEYIGACVVLIAAVTSISNSLHRELSAGLVGLGLTYALMVSNYLNWMVRNLADMELQLGAVKRIHGLLKTEAESYEGLLGEAQGEGWGRVQGGVCLGWGPQGSLGMGWHFRILAVAHAWWLSPARPPAPSLIPKNWPDQGKIQIQNLSVRYDSSLKPVLKHVNALISPGQKIGICGRTGSGKSSFSLAFFRMVDTFEGHIIIDGIDIAKLPLHTLRSRLSIILQDPVLFSGTIRFNLDPERKCSDSTLWEALEIAQLKLVVKALPGGLDAIITEGGENFSQGQRQLFCLARAFVRKTSIFIMDEATASIDMATENILQKVVMTAFADRTVVTIAHRVHTILSADLVIVLKRGAILEFDKPEKLLSRKDSVFASFVRADK

SEQ ID NO: 881538 - protein, 188 aa, Homo sapiens
MVDTFEGHIIIDGIDIAKLPLHTLRSRLSIILQDPVLFSGTIRFNLDPERKCSDSTLWEALEIAQLKLVVKALPGGLDAIITEGGENFSQGQRQLFCLARAFVRKTSIFIMDEATASIDMATENILQKVVMTAFADRTVVTIAHRVHTILSADLVIVLKRGAILEFDKPEKLLSRKDSVFASFVRADK

SEQ ID NO: 881539 - protein, 1011 aa, Homo sapiens
MNTAIPIAAVLITFVGHVSFFKEADFSPSVAFASLSLFHILVTPLFLLSSVVRSTVKALVSVQKLSEFLSSAEIREEQCAPHEPTPQGPASKYQAVPLRVVNRKRPAREDCRGLTGPLQSLVPSADGDADNCCVQIMGGYFTWTPDGIPTLSNITIRIPRGQLTMIVGQVGCGKSSLLLAALGEMQKVSGAVFWSSLPDSEIGEDPSPERETATDLDIRKRGPVAYASQKPWLLNATVEENIIFESPFNKQRYKMVIEACSLQPDIDILPHGDQTQIGERGINLSGGQRQRISVARALYQHANVVFLDDPFSALDIHLSDHLMQAGILELLRDDKRTVVLVTHKLQYLPHADWIIAMKDGTIQREGTLKDFQRSECQLFEHWKTLMNRQDQELEKETVTERKATEPPQGLSRAMSSRDGLLQDEEEEEEEAAESEEDDNLSSMLHQRAEIPWRACAKYLSSAGILLLSLLVFSQLLKHMVLVAIDYWLAKWTDSALTLTPAARNCSLSQECTLDQTVYAMVFTVLCSLGIVLCLVTSVTVEWTGLKVAKRLHRSLLNRIILAPMRFFETTPLGSILNRFSSDCNTIDQHIPSTLECLSRSTLLCVSALAVISYVTPVFLVALLPLAIVCYFIQKYFRVASRDLQQLDDTTQLPLLSHFAETVEGLTTIRAFRYEARFQQKLLEYTDSNNIASLFLTAANRWLEVRMEYIGACVVLIAAVTSISNSLHRELSAGLVGLGLTYALMVSNYLNWMVRNLADMELQLGAVKRIHGLLKTEAESYEGLLGAPSLIPKNWPDQGKIQIQNLSVRYDSSLKPVLKHVNALISPGQKIGICGRTGSGKSSFSLAFFRMVDTFEVSCKAGTPRVTHSHQMRPQPWHVVRHDRRPSSHRLPLHPHWDPCRDAIITEGGENFSQGQRQLFCLARAFVRKTSIFIMDEATASIDMATENILQKVVMTAFADRTVVTIAHRVHTILSADLVIVLKRGAILEFDKPEKLLSRKDSVFASFVRADK

SEQ ID NO: 881540 - protein, 234 aa, Homo sapiens
MAPKQDPKPKFQEGERVLCFHGPLLYEAKCVKVAIKDKQVKYFIHYSGWNKNWDEWVPESRVLKYVDTNLQKQRELQKANQEQYAEGKMRGAAPGKKTSGLQQKNVEVKTKKNKQKTPGNGDGGSTSETPQPPRKKRARVDPTVENEETFMNRVEVKVKIPEELKPWLVDDWDLITRQKQLFYLPAKKNVDSILEDYANYKKSRGNTDNKEYGVIEVVQGSDAKSWQTSEAPCP

SEQ ID NO: 881541 - protein, 108 aa, Homo sapiens
MAPKQDPKPKFQEGERVLCFHGPLLYEAKCVKVAIKDKQVKYFIHYSGWNKNWDEWVPESRVLKYVDTNLQKQRELQKANQEQYAEGKMRGAAPGKKTSGLQQKNVEV

SEQ ID NO: 881542 - protein, 155 aa, Homo sapiens
MAPKQDPKPKFQEGERVLCFHGPLLYEAKCVKVAIKDKQVKYFIHYSGWNKNWDEWVPESRVLKYVDTNLQKQRELQKANQEQYAEGKMRGAAPGKKTSGLQQKNVEVKTKKNKQKTPGNGDGGSTSETPQPPRKKRARVDPTVENEASEQVELS

SEQ ID NO: 881543 - protein, 221 aa, Homo sapiens
MAPKQDPKPKFQEGERVLCFHGPLLYEAKCVKVAIKDKQVKYFIHYSGWNKNWDEWVPESRVLKYVDTNLQKQRELQKANQEQYAEGKMRGAAPGKKTSGLQQKNVEVKTKKNKQKTPGNGDGGSTSETPQPPRKKRARVDPTVENEETFMNRVEVKVKIPEELKPWLVDDWDLITRQKQLFYLPAKKNVDSILEDYANYKKSRGNTDNKEYAVNERCGQG

SEQ ID NO: 881544 - protein, 221 aa, Homo sapiens; identical to SEQ ID NO: 881543

SEQ ID NO: 881545 - protein, 221 aa, Homo sapiens; identical to SEQ ID NO: 881543

SEQ ID NO: 881546 - protein, 221 aa, Homo sapiens; identical to SEQ ID NO: 881543

SEQ ID NO: 881547 - protein, 221 aa, Homo sapiens; identical to SEQ ID NO: 881543

SEQ ID NO: 881548 - protein, 133 aa, Homo sapiens
MRGAAPGKKTSGLQQKNVEVKTKKNKQKTPGNGDGGSTSETPQPPRKKRARVDPTVENEETFMNRVEVKVKIPEELKPWLVDDWDLITRQKQLFYLPAKKNVDSILEDYANYKKSRGNTDNKEYAVNERCGQG

SEQ ID NO: 881549 - protein, 260 aa, Homo sapiens
MAPKQDPKPKFQEGERVLCFHGPLLYEAKCVKVAIKDKQVKYFIHYSGWNKKSAVRPRRSEKSLKTHEDIVALFPVPEGAPSVHHPLLTSSWDEWVPESRVLKYVDTNLQKQRELQKANQEQYAEGKMRGAAPGKKTSGLQQKNVEVKTKKNKQKTPGNGDGGSTSETPQPPRKKRARVDPTVENEETFMNRVEVKVKIPEELKPWLVDDWDLITRQKQLFYLPAKKNVDSILEDYANYKKSRGNTDNKEYAVNERCGQG

SEQ ID NO: 881550 - protein, 206 aa, Homo sapiens
MAPKQDPKPKFQEGERVLCFHGPLLYEAKCVKVAIKDKQVKYFIHYSGWNKNWDEWVPESRVLKYVDTNLQKQRELQKANQEQYAEGKMRGAAPGKKTSGLQQKNVEVKTKKNKQKTPGNGDGGSTSETPQPPRKKRARVDPTVENEETFMNRVEVKVKIPEELKPWLVDDWDLITRQKQDYANYKKSRGNTDNKEYAVNERCGQG

SEQ ID NO: 881551 - protein, 221 aa, Homo sapiens; identical to SEQ ID NO: 881543

SEQ ID NO: 881552 - protein, 221 aa, Homo sapiens; identical to SEQ ID NO: 881543

SEQ ID NO: 881553 - protein, 164 aa, Homo sapiens
MAPKQDPKPKFQEGERVLCFHGPLLYEAKCVKVAIKDKQVKYFIHYSGWNKNWDEWVPESRVLKYVDTNLQKQRELQKANQEQYAEGKMRGAAPGKKTSGLQQKNVEVKTKKNKQKTPGNGDGGIPSESCVRGTLTHLCLDLRKHIFVLSLSLVQTMCFEDVSV

SEQ ID NO: 881554 - protein, 234 aa, Homo sapiens; identical to SEQ ID NO: 881540

SEQ ID NO: 881555 - protein, 220 aa, Homo sapiens
MAPKQDPKPKFQEGERVLCFHGPLLYEAKCVKVAIKDKQVKYFIHYSGWNKNWDEWVPESRVLKYVDTNLQKQRELQKANQEQYAEGKMRGAAPGKKTSGLQQKNVEVKTKKNKQKTPGNGDGGSTSETPQPPRKKRARVDPTVENEETFMNRVEVKVKIPEELKPWLVDDWDLITRQKQLFYLPAKKNVDSILEDYANYKKSRGNTDNKEFDRLMQACW

SEQ ID NO: 881556 - protein, 195 aa, Homo sapiens
MAPKQDPKPKFQEGERVLCFHGPLLYEAKCVKVAIKDKQVKYFIHYSGWNKNWDEWVPESRVLKYVDTNLQKQRELQKANQEQYAEGKMRGAAPGKKTSGLQQKNVEVKTKKNKQKTPGNGDGGSTSETPQPPRKKRARVDPTVENEETFMNRVEVKVKIPEELKPWLVDDWDLITRQKQLSYLPARLDIRYQLD

SEQ ID NO: 881557 - protein, 134 aa, Homo sapiens
MAPKQDPKPKFQEGERVLCFHGPLLYEAKCVKVAIKDKQVKYFIHYSGWNKNWDEWVPESRVLKYVDTNLQKQRELQKANQEQYAEGKMRGAAPGKKTSGLQQKNVEVRKRTNRKHLEKEMVEIPVRPLILLWR

SEQ ID NO: 881558 - protein, 132 aa, Homo sapiens
MAPKQDPKPKFQEGERVLCFHGPLLYEAKCVKVAIKDKQVKYFIHYSGWNKNWDEWVPESRVLKYVDTNLQKQRELQKANQEQYAEGKMRGAAPGKKTSGLQQKNVEVRKRTNRKHLHTRPRPRTPLHPPPN

SEQ ID NO: 881559 - protein, 107 aa, Homo sapiens
MRGAAPGKKTSGLQQKNVEVKTKKNKQKTPGNGDGGSTSETPQPPRKKRARVDPTVENEETFMNRVEVKVKIPEELKPWLVDDWDLITRQKQLSYLPARLDIRYQLD

SEQ ID NO: 881560 - protein, 134 aa, Homo sapiens
MAPKQDPKPKFQEGERVLCFHGPLLYEAKCVKVAIKDKQVKYFIHYSGWNKNWDEWVPESRVLKYVDTNLQKQRELQKANQEQYGEGQTCGSGLLGLRSSSPRGSEAGAAWYDTARKRPLEMGQSHALPPWIHP

SEQ ID NO: 881561 - protein, 221 aa, Homo sapiens; identical to SEQ ID NO: 881543

SEQ ID NO: 881562 - protein, 134 aa, Homo sapiens; identical to SEQ ID NO: 881557

SEQ ID NO: 881563 - protein, 221 aa, Homo sapiens; identical to SEQ ID NO: 881543

SEQ ID NO: 881564 - protein, 221 aa, Homo sapiens; identical to SEQ ID NO: 881543

SEQ ID NO: 881565 - protein, 221 aa, Homo sapiens; identical to SEQ ID NO: 881543

SEQ ID NO: 881566 - protein, 221 aa, Homo sapiens; identical to SEQ ID NO: 881543

SEQ ID NO: 881567 - protein, 133 aa, Homo sapiens; identical to SEQ ID NO: 881548

SEQ ID NO: 881568 - protein, 133 aa, Homo sapiens; identical to SEQ ID NO: 881548

SEQ ID NO: 881569 - protein, 178 aa, Homo sapiens
MGLFFMKQSWDEWVPESRVLKYVDTNLQKQRELQKANQEQYAEGKMRGAAPGKKTSGLQQKNVEVKTKKNKQKTPGNGDGGSTSETPQPPRKKRARVDPTVENEETFMNRVEVKVKIPEELKPWLVDDWDLITRQKQLFYLPAKKNVDSILEDYANYKKSRGNTDNKEYAVNERCGQG

SEQ ID NO: 881570 - protein, 221 aa, Homo sapiens; identical to SEQ ID NO: 881543

SEQ ID NO: 881571 - protein, 120 aa, Homo sapiens
MAPKQDPKPKFQEGERVLCFHGPLLYEAKCVKVAIKDKQVKYFIHYSGWNKNWDEWVPESRVLKYVDTNLQKQRELQKANQEQYAEGKMRGAAPGKKTSGLQQKNVEVTNWSNVGLYTSG

SEQ ID NO: 881572 - protein, 221 aa, Homo sapiens; identical to SEQ ID NO: 881543

SEQ ID NO: 881573 - protein, 190 aa, Homo sapiens
MAPKQDPKPKFQEGERVLCFHGPLLYEAKCVKVAIKDKQVKYFIHYSGWNKNWDEWVPESRVLKYVDTNLQKQRELQKANQEQYAEGKMRGAAPGKKTSGLQQKNVEVKTKKNKQKTPGNGDGGSTSETPQPPRKKRARVDPTVENEETFMNRVEVKVKIPEELKPWLVDDWDLITRQKQQLFISCEMWF

SEQ ID NO: 881574 - protein, 155 aa, Homo sapiens; identical to SEQ ID NO: 881542

SEQ ID NO: 881575 - protein, 115 aa, Homo sapiens
MAPKQDPKPKFQEGERVLCFHGPLLYEAKCVKVAIKDKQVKYFIHYSGWNKNWDEWVPESRVLKYVDTNLQKQRELQKANQEQYAEGKMRGAAPGKKTSGLQQKNVEVKKKKKKK

SEQ ID NO: 881576 - protein, 106 aa, Homo sapiens
MAPKQDPKPKFQEGERVLCFHGPLLYEAKCVKVAIKDKQVKYFIHYSGWNKNWDEWVPESRVLKYVDTNLQKQRELQKANQEQYAEGKMRGAAPGVFCLFFFVFTS

SEQ ID NO: 881577 - protein, 623 aa, Homo sapiens
MRVALGMLWLLALAWPPQARGFCPSQCSCSLHIMGDGSKARTVVCNDPDMTLPPASIPPDTSRLRLERTAIRRVPGEAFRPLGRLEQLWLPYNALSELNALMLRGLRRLRELRLPGNRLAAFPWAALRDAPKLRLLDLQANRLSAVPAEAARFLENLTFLDLSSNQLMRLPQELIVSWAHLETGIFPPGHHPRRVLGLQDNPWACDCRLYDLVHLLDGWAPNLAFIETELRCASPRSLAGVAFSQLELRKCQGPELHPGVASIRSLLGGTALLRCGATGVPGPEMSWRRANGRPLNGTVHQEVSSDGTSWTLLGLPAVSHLDSGDYICQAKNFLGASETVISLIVTEPPTSTEHSGSPGALWARTGGGGEAAAYNNKLVARHVPQIPKPAVLATGPSVPSTKEELTLEHFQMDALGELSDGRAGPSEARMVRSVKVVGDTYHSVSLVWKAPQAKNTTAFSVLYAVFGQHSMRRVIVQPGKTRVTITGLLPKTKYVACVCVQGLVPRKEQCVIFSTNEVVDAENTQQLINVVVISVAIVIALPLTLLVCCSALQKRCRKCFNKDSTEATVTYVNLERLGYSEDGLEELSRHSVSEADRLLSARSSVDFQAFGVKGGRRINEYFC

SEQ ID NO: 881578 - protein, 110 aa, Homo sapiens [sequence omitted]

SEQ ID NO: 881579 - protein, 71 aa, Homo sapiens
ERRQKEEEAARLALEEATKQAQEQARQKAALEKHFHFYQELHKEASGLQWTQNISRPWVYSYFQFLQIPRP

SEQ ID NO: 881580 - protein, 225 aa, Homo sapiens
MARYEAVVNRHEAPGSRSPGAMDPLSPPLCTLPPGPEPPRFVCYCEGEESGEGDRGGFNLYVTDAAELWSTCFTPDSLAALKARFGLSAAEDITPRFRAACEQQAVALTLQEDRASLTLSGGPSALAFDLSKVPGPEAAPRLRALTLGLAKRVWSLERRLAAAEETAVSPRKSPRPAGPQLFLPDPDPQRGGPGPGVRRRCPGESLINPGFKSKKPAGGVDFDET

SEQ ID NO: 881581 - protein, 225 aa, Homo sapiens; identical to SEQ ID NO: 881580

SEQ ID NO: 881582 - protein, 127 aa, Homo sapiens
MARYEAVVNRHEAPGSRSPGAMDPLSPPLCTLPPGPEPPRFVCYCEGEESGEGDRGGFNLYVTDAAELWSTCFTPDSLAALVGNWAGLGAATPLLAVQIVYGATDIWDSPEGSDTLCPPCSCSPPIG

SEQ ID NO: 881583 - protein, 71 aa, Homo sapiens
TARYEAGFMDPLSPPLCTLPPGPEPPRFVCYCEGEESGEGDRGGFNLYVTDAAELWSTCFTPDSLAALGSL

SEQ ID NO: 881584 - protein, 225 aa, Homo sapiens; identical to SEQ ID NO: 881580

SEQ ID NO: 881585 - protein, 225 aa, Homo sapiens; identical to SEQ ID NO: 881580

SEQ ID NO: 881586 - protein, 127 aa, Homo sapiens; identical to SEQ ID NO: 881582

SEQ ID NO: 881587 - protein, 127 aa, Homo sapiens; identical to SEQ ID NO: 881582

SEQ ID NO: 881588 - protein, 410 aa, Homo sapiens
MVCFRLFPVPGSGLVLVCLVLGAVRSYALELNLTDSENATCLYAKWQMNFTVRYETTNKTYKTVTISDHGTVTYNGSICGDDQNGPKIAVQFGPGFSWIANFTKAASTYSIDSVSFSYNTGDNTTFPDAEDKGILTVDELLAIRIPLNDLFRCNSLSTLEKNDVVQHYWDVLVQAFVQNGTVSTNEFLCDKDKTSTVAPTIHTTVPSPTTTPTPKEKPEAGTYSVNNGNDTCLLATMGLQLNITQDKVASVININPNTTHSTGSCRSHTALLRLNSSTIKYLDFVFAVKNENRFYLKEVNISMYLVNGSVFSIANNNLSYWDAPLGSSYMCNKEQTVSVSGAFQINTFDLRVQPFNVTQGKYSTAQECSLDDDTILIPIIVGAGLSGLIIVIVIAYVIGRRKSYAGYQTL

SEQ ID NO: 881589 - protein, 410 aa, Homo sapiens; identical to SEQ ID NO: 881588

SEQ ID NO: 881590 - protein, 410 aa, Homo sapiens; identical to SEQ ID NO: 881588

SEQ ID NO: 881591 - protein, 410 aa, Homo sapiens
MVCFRLFPVPGSGLVLVCLVLGAVRSYALELNLTDSENATCLYAKWQMNFTVRYETTNKTYKTVTISDHGTVTYNGSICGDDQNGPKIAVQFGPGFSWIANFTKAASTYSIDSVSFSYNTGDNTTFPDAEDKGILTVDELLAIRIPLNDLFRCNSLSTLEKNDVVQHYWDVLVQAFVQNGTVSTNEFLCDKDKTSTVAPTIHTTVPSPTTTPTPKEKPEAGTYSVNNGNDTCLLATMGLQLNITQDKVASVININPNTTHSTGSCRSHTALLRLNSSTIKYLDFVFAVKNENRFYLKEVNISMYLVNGSVFSIANNNLSYWDAPLGSSYMCNKEQTVSVSGAFQINTFDLRVQPFNVTQGKYSTAQDCSADDDNFLVPIAVGAALAGVLILVLLAYFIGLKHHHAGYEQF

SEQ ID NO: 881592 - protein, 410 aa, Homo sapiens; identical to SEQ ID NO: 881588

SEQ ID NO: 881593 - protein, 410 aa, Homo sapiens; identical to SEQ ID NO: 881591

SEQ ID NO: 881594 - protein, 410 aa, Homo sapiens; identical to SEQ ID NO: 881591

SEQ ID NO: 881595 - protein, 410 aa, Homo sapiens; identical to SEQ ID NO: 881588

SEQ ID NO: 881596 - protein, 410 aa, Homo sapiens; identical to SEQ ID NO: 881588

SEQ ID NO: 881597 - protein, 256 aa, Homo sapiens
MRPLSILSRERRCGTLWEFLYSFVQMAQGHKKFLCDKDKTSTVAPTIHTTVPSPTTTPTPKEKPEAGTYSVNNGNDTCLLATMGLQLNITQDKVASVININPNTTHSTGSCRSHTALLRLNSSTIKYLDFVFAVKNENRFYLKEVNISMYLVNGSVFSIANNNLSYWDAPLGSSYMCNKEQTVSVSGAFQINTFDLRVQPFNVTQGKYSTAQECSLDDDTILIPIIVGAGLSGLIIVIVIAYVIGRRKSYAGYQTL

SEQ ID NO: 881598 - protein, 66 aa, Homo sapiens
MADSMRNPALRWVTVTQGKYSQECSLDDDTILIPIIVGAGLSGLIIVIVIAYVIGRRKSYAGYQTL

SEQ ID NO: 881599 - protein, 232 aa, Homo sapiens
MVCFRLFPVPGSGLVLVCLVLGAVRSYALELNLTDSENATCLYAKWQMNFTVRYETTNKTYKTVTISDHGTVTYNGSICGDDQNGPKIAVQFGPGFSWIANFTKAASTYSIDSVSFSYNTGDNTTFPDAEDKGILTVDELLAIRIPLNDLFRCNSLSTLEKNDVVQHYWDVLVQAFVQNGTVSTNEFLCDKDKTSTVAPTIHTTVPSPTTNNPNSQGKKPKKAWGNPNSKFK

SEQ ID NO: 881600 - protein, 250 aa, Homo sapiens
MVCFRLFPVPGSGLVLVCLVLGAVRSYALELNLTDSENATCLYAKWQMNFTVRYETTNKTYKTVTISDHGTVTYNGSICGDDQNGPKIAVQFGPGFSWIANFTKAASTYSIDSVSFSYNTGDNTTFPDAEDKGILTVDELLAIRIPLNDLFRCNSLSTLEKNDVVQHYWDVLVQAFVQNGTVSTNEFLCDKDKTSTVAPTIHMWHFYIKKLSRETEGELLAIWKKLLRAPGGQENPKGGVLITPKSPSKA

SEQ ID NO: 881601 - protein, 410 aa, Homo sapiens; identical to SEQ ID NO: 881588

SEQ ID NO: 881602 - protein, 410 aa, Homo sapiens; identical to SEQ ID NO: 881591

SEQ ID NO: 881603 - protein, 410 aa, Homo sapiens; identical to SEQ ID NO: 881591

SEQ ID NO: 881604 - protein, 410 aa, Homo sapiens; identical to SEQ ID NO: 881591

SEQ ID NO: 881605 - protein, 300 aa, Homo sapiens
MVCFRLFPVPGSGLVLVCLVLGAVRSYALELNLTDSENATCLYAKWQMNFTVRYETTNKTYKTVTISDHGTVTYNGSICGDDQNGPKIAVQFGPGFSWIANFTKAASTYSIDSVSFSYNTGDNTTFPDAEDKGILTVDELLAIRIPLNDLFRCNSLSTLEKNDVVQHYWDVLVQAFVQNGTVSTNEFLCDKDKTSTVAPTIHTTVPSPTTTPTPKEKPEAGTYSVNNGNDTCLLATMGLQLNITQDKVASVININPNTTHSTGSCRSHTALLRLNSSTIKYLDFVFAVLKTFMAQDQIPD

SEQ ID NO: 881606 - protein, 406 aa, Homo sapiens
MVCFRLFPVPGSGLVLVCLVLGAVRSYALELNLTDSENATCLYAKWQMNFTVRYETTNKTYKTVTISDHGTVTYNGSICGDDQNGPKIAVQFGPGFSWIANFTKAASTYSIDSVSFSYNTGDNTTFPDAEDKGILTVDELLAIRIPLNDLFRCNSLSTLEKNDVVQHYWDVLVQAFVQNGTVSTNEFLCDKDKTSTVAPTIHTTVPSPTTTPTPKEKPEAGTYSVNNGNDTCLLATMGLQLNITQDKVASVININPNTTHSTGSCRSHTALLRLNSSTIKYLDFVFAVKNENRFYLKEVNISMYLVNGSVFSIANNNLSYWDAPLGSSYMCNKEQTVSVSGAFQINTFDLRVQPFNVTQGKYSTAQDCSADDDNFLVPIAVGAALAGVLILVLLAYFIGLKHHHAG

SEQ ID NO: 881607 - protein, 248 aa, Homo sapiens
MVCFRLFPVPGSGLVLVCLVLGAVRSYALELNLTDSENATCLYAKWQMNFTVRYETTNKTYKTVTISDHGTVTYNGSICGDDQNGPKIAVQFGPGFSWIANFTKAASTYSIDSVSFSYNTGDNTTFPDAEDKGILTVDELLAIRIPLNDLFRCNSLSTLEKNDVVQHYWDVLVQAFVQNGTVSTNEFLCDKDKTSTVAPTIHTTVPSPTTTPTPKEKPEAGTYSVNNGNDTCLLATMGLQLNITQDKV

SEQ ID NO: 881608 - protein, 198 aa, Homo sapiens
MVCFRLFPVPGSGLVLVCLVLGAVRSYALELNLTDSENATCLYAKWQMNFTVRYETTNKTYKTVTISDHGTVTYNGSICGDDQNGPKIAVQFGPGFSWIANFTKAASTYSIDSVSFSYNTGDNTTFPDAEDKGILTVDELLAIRIPLNDLFRCNSLSTLEKNDVVQHYWDVLVQAFVQNGTVSTNGVPCAKTNSQGPQ

SEQ ID NO: 881609 - protein, 337 aa, Homo sapiens
QCALFAHSQTPEFIISEPLANMYSCGNQPTRSEAGRRALPVEAAAGAGADGREPASERASRAEPPAVAMGQNDLMGTAEDFADQFLRVTKQYLPHVARLCLISTFLEDGIRMWFQWSEQRDYIDTTWNCGYLLASSFVFLNLLGQLTGCVLVLSRNFVQYACFGLFGIIALQTIAYSILWDLKFLMRNLALGGGLLLLLAESRSEGKSMFAGVPTMRESSPKQYMQLGGRVLLVLMFMTLLHFDASFFSIVQNIVGTALMILVAIGFKTKLAALTLVVWLFAINVYFNAFWTIPVYKPMHDFLKYDFFQTMSVIGGLLLVVALGPGGVSMDEKKKEW

SEQ ID NO: 881610 - protein, 370 aa, Homo sapiens
QCALFAHSQTPEFIISEPLANMYSCGNQPTRSEAGRRALPVEAAAGAGADGREPASERASRAEPPAVAMGQNDLMGTAEDFADQRLFLTHPAQGRAWQRPGAPRRSHLTLWVSVALQFLRVTKQYLPHVARLCLISTFLEDGIRMWFQWSEQRDYIDTTWNCGYLLASSFVFLNLLGQLTGCVLVLSRNFVQYACFGLFGIIALQTIAYSILWDLKFLMRNLALGGGLLLLLAESRSEGKSMFAGVPTMRESSPKQYMQLGGRVLLVLMFMTLLHFDASFFSIVQNIVGTALMILVAIGFKTKLAALTLVVWLFAINVYFNAFWTIPVYKPMHDFLKYDFFQTMSVIGGLLLVVALGPGGVSMDEKKKEW

SEQ ID NO: 881611 - protein, 337 aa, Homo sapiens; identical to SEQ ID NO: 881609

SEQ ID NO: 881612 - protein, 337 aa, Homo sapiens; identical to SEQ ID NO: 881609

SEQ ID NO: 881613 - protein, 337 aa, Homo sapiens; identical to SEQ ID NO: 881609

SEQ ID NO: 881614 - protein, 389 aa, Homo sapiens
QCALFAHSQTPEFIISEPLANMYSCGNQPTRSEAGRRALPVEAAAGAGADGREPASERASRAEPPAVAMGQNDLMGTAEDFADQFLRVTKQYLPHVARLCLISTFLEDGIRMWFQWSEQRDYIDTTWNCGYLLASSFVFLNLLGQLTGCVLVLSRNFVQYACFGLFGIIALQTIAYSILWDLKFLMRNLALGGGLLLLLAESRSEGKSMFAGVPTMRESSPKQYMQLGGRVLLVLMFMTLLHFDASFFSIVQNIVGTALMILVAIGFKTKLAALTLVVWLFAINVYFNAFWTIPVYKPMHDFLKYDFFQTLRPVAVKDWFGVDSTKLPAFMYPLPFPSLGKGTDVLRTLFAETPENRWLSLLWSHSLASDPSVQASLAAGSLPHAEALE

SEQ ID NO: 881615 - protein, 254 aa, Homo sapiens
QCALFAHSQTPEFIISEPLANMYSCGNQPTRSEAGRRALPVEAAAGAGADGREPASERASRAEPPAVAMGQNDLMGTAEDFADQFLRVTKQYLPHVARLCLISTFLEDGIRMWFQWSEQRDYIDTTWNCGYLLASSFVFLNLLGQLTGCVLVLSRNFVQYACFGLFGIIALQTIAYSILWDLKFLMRNLALGGGLLLLLAESRSEGKSMFAGVPTMRESSPKQYMQLGGRVLLVLMFMTLLHFDASFFSQPSQQ

SEQ ID NO: 881616 - protein, 303 aa, Homo sapiens
QCALFAHSQTPEFIISEPLANMYSCGNQPTRSEAGRRALPVEAAAGAGADGREPASERASRAEPPAVAMGQNDLMGTAEDFADQFLRVTKQYLPHVARLCLISTFLEDGIRMWFQWSEQRDYIDTTWNCGYLLASSFVFLNLLGQLTGCVLVLSRNFVQYACFGLFGIIALQTIAYSILWDLKFLMRNLALGGGLLLLLAESRSEGKSMFAGVPTMRESSPKQYLRPVAVKDWFGVDSTKLPAFMYPLPFPSLGKGTDVLRTLFAETPENRWLSLLWSHSLASDPSVQASLAAGSLPHAEALE

SEQ ID NO: 881617 - protein, 89 aa, Homo sapiens
ARYPVFIDATLRPVAVKDWFGVDSTKLPAFMYPLPFPSLGKGTDVLRTLFAETPENRWLSLLWSHSLASDPSVQASLAAGSLPHAEALE

SEQ ID NO: 881618 - protein, 337 aa, Homo sapiens; identical to SEQ ID NO: 881609

SEQ ID NO: 881619 - protein, 337 aa, Homo sapiens; identical to SEQ ID NO: 881609

SEQ ID NO: 881620 - protein, 337 aa, Homo sapiens; identical to SEQ ID NO: 881609

SEQ ID NO: 881621 - protein, 311 aa, Homo sapiens
QCALFAHSQTPEFIISEPLANMYSCGNQPTRSEAGRRALPVEAAAGAGADGREPASERASRAEPPAVAMGQNDLMGTAEDFADQFLRVTKQYLPHVARLCLISTFLEDGIRMWFQWSEQRDYIDTTWNCGYLLASSFVFLNLLGQLTGCVLVLSRNFVQYACFGLFGIIALQTIAYSILWDLKFLMRNLALGGGLLLLLAESRSEGKSMFAGVPTMRESSPKQYMQLGGRVLLVLMFMTLLHFDASFFSIVQNIVGTALMILVAIGFKTKLAALTLVVWLFAINVYFNAFWTIPVYKPMHDFLKYDFFQTT

SEQ ID NO: 881622 - protein, 355 aa, Homo sapiens
QCALFAHSQTPEFIISEPLANMYSCGNQPTRSEAGRRALPVEAAAGAGADGREPASERASRAEPPAVAMGQNDLMGTAEDFADQFLRVTKQYLPHVARLCLISTFLEDGIRMWFQWSEQRDYIDTTWNCGYLLASSFVFLNLLGQLTGCVLVLSRNFVQYACFGLFGIIALQTIAYSILWDLKFLMRNLALGGGLLLLLAESRSEGKSMFAGVPTMRESSPKQYMQLGGRVLLVLMFMTLLHFDASFFSIVQNIVGTALMILVAIGFKTKLAALTLVVWLFAINVYFNAFWTIPVYKPMPPSCMYCLGELSRMLGTPANMLFPSERDSARSSNSLLHQGQVPHRKLQATRLPGSQ

SEQ ID NO: 881623 - protein, 70 aa, Homo sapiens
LGTRCLSMPPPHQMTLAKSRFLCGQGWLADWWKVGWTKGGHVSSQHQFCTSSASVLVGVPVSPGPGWARA

SEQ ID NO: 881624 - protein, 337 aa, Homo sapiens; identical to SEQ ID NO: 881609

SEQ ID NO: 881625 - protein, 254 aa, Homo sapiens
AWWYSCPVPGSSSKTSSPIKCCRQSSAELLFQWSEQRDYIDTTWNCGYLLASSFVFLNLLGQLTGCVLVLSRNFVQYACFGLFGIIALQTIAYSILWDLKFLMRNLALGGGLLLLLAESRSEGKSMFAGVPTMRESSPKQYMQLGGRVLLVLMFMTLLHFDASFFSIVQNIVGTALMILVAIGFKTKLAALTLVVWLFAINVYFNAFWTIPVYKPMHDFLKYDFFQTMSVIGGLLLVVALGPGGVSMDEKKKEW

SEQ ID NO: 881626 - protein, 337 aa, Homo sapiens; identical to SEQ ID NO: 881609

SEQ ID NO: 881627 - protein, 187 aa, Homo sapiens
NVCNVSGSECPWGVFENFKATEGGVVEVLVDVLGWRLNLALGGGLLLLLAESRSEGKSMFAGVPTMRESSPKQYMQLGGRVLLVLMFMTLLHFDASFFSIVQNIVGTALMILVAIGFKTKLAALTLVVWLFAINVYFNAFWTIPVYKPMHDFLKYDFFQTMSVIGGLLLVVALGPGGVSMDEKKKEW

SEQ ID NO: 881628 - protein, 119 aa, Homo sapiens
AFGKAETQVSLSSFPSDDCLQHFMGLEVFDEIVQNIVGTALMILVAIGFKTKLAALTLVVWLFAINVYFNAFWTIPVYKPMHDFLKYDFFQTMSVIGGLLLVVALGPGGVSMDEKKKEW

SEQ ID NO: 881629 - protein, 337 aa, Homo sapiens; identical to SEQ ID NO: 881609

SEQ ID NO: 881630 - protein, 337 aa, Homo sapiens; identical to SEQ ID NO: 881609

SEQ ID NO: 881631 - protein, 337 aa, Homo sapiens; identical to SEQ ID NO: 881609

SEQ ID NO: 881632 - protein, 303 aa, Homo sapiens; identical to SEQ ID NO: 881616

SEQ ID NO: 881633 - protein, 143 aa, Homo sapiens
MSGRGKTGGKARAKAKSRSSRAGLQFPVGRVHRLLRKGHYAERVGAGAPVYLAAVLEYLTAEILELAGNAARDNKKTRIIPRHLQLAIRNDEELNKLLGGVTIAQGGVLPNIQAVLLPKKTSATVGPKAPSGGKKATQASQEY

SEQ ID NO: 881634 - protein, 143 aa, Homo sapiens; identical to SEQ ID NO: 881633

SEQ ID NO: 881635 - protein, 119 aa, Homo sapiens
MTERKTAKRQGTDRARKPTRGPSERRTDRTKSARTAEPEPRRADGNQHQHTERRSAKEAGRGARTPRPGERRQVTGPQSRPEATRKTKTRGTTDEDKHQAKESGQTQKRRAGRRRERAE

SEQ ID NO: 881636 - protein, 143 aa, Homo sapiens; identical to SEQ ID NO: 881633

SEQ ID NO: 881637 - protein, 246 aa, Homo sapiens
TQRPKGKYASRARLIAEELRALAVKQEDANHPPPPAAGHPQRRGAQQAAGRRDDRPGRRPAQHPGRAAAQEDQRHRGAEGALGRQEGHPGLPGVLRGPAPRPAARPPHATTKALLRATTALMERAEPLQTAGQAGRGSLSPPLPSPAFAARPRVPARPRSRPAPPAASASGPALSAVRPPVGFGPSGCGLGALRGPPWRGRPEPAGGRPAAPHLPASAFVTQPPHPESLRGCGEAAAPSGRLGLPL

SEQ ID NO: 881638 - protein, 131 aa, Homo sapiens
SRICIGRELPSPPLARLRRPASSPRPPPLPSRTACRVGLGPCPVRRPPSGRVRAFRMRLGRSSGTSVARKTRACRGEAGGAAPARLGVRDSAAPSRVAKGLRGGRSTFWKTWPSALTQGRGGQSRPRGRRP

SEQ ID NO: 881639 - protein, 143 aa, Homo sapiens; identical to SEQ ID NO: 881633

SEQ ID NO: 881640 - protein, 143 aa, Homo sapiens; identical to SEQ ID NO: 881633

SEQ ID NO: 881641 - protein, 143 aa, Homo sapiens; identical to SEQ ID NO: 881633

SEQ ID NO: 881642 - protein, 143 aa, Homo sapiens; identical to SEQ ID NO: 881633

SEQ ID NO: 881643 - protein, 143 aa, Homo sapiens; identical to SEQ ID NO: 881633

SEQ ID NO: 881644 - protein, 143 aa, Homo sapiens; identical to SEQ ID NO: 881633

SEQ ID NO: 881645 - protein, 143 aa, Homo sapiens; identical to SEQ ID NO: 881633

SEQ ID NO: 881646 - protein, 143 aa, Homo sapiens; identical to SEQ ID NO: 881633

SEQ ID NO: 881647 - protein, 143 aa, Homo sapiens; identical to SEQ ID NO: 881633

SEQ ID NO: 881648 - protein, 143 aa, Homo sapiens; identical to SEQ ID NO: 881633

SEQ ID NO: 881649 - protein, 143 aa, Homo sapiens; identical to SEQ ID NO: 881633

SEQ ID NO: 881650 - protein, 98 aa, Homo sapiens
QCSCCCGRSEIPTLPPSSFIGLRWGRDEALGNRHIFLPSDCLLGGHLGEGRGLQFGFTAGYVDSKSRFRGSRLAARPVGPPDAAPFPFQQTQLGNPST

SEQ ID NO: 881651 - protein, 137 aa, Homo sapiens
RAARARARARAARRGGGPRSPAKFGGTWRKRLGHAGARGGGGRSPRSCSSLSRRRRGARSPPWPAGSRPRGRSTGLRSITTMLLKMWSSPCRSVTQFTSWRCTRVGTEDIPSKINLKRQLVPGPPQYRNPWMLKSLI

SEQ ID NO: 881652 - protein, 137 aa, Homo sapiens; identical to SEQ ID NO: 881651

SEQ ID NO: 881653 - protein, 350 aa, Homo sapiens
MARWIPTKRQKYGVAIYNYNASQDVELSLQIGDTVHILEMYEGWYRGYTLQNKSKKGIFPETYIHLKEATVEDLGQHETVIPGELPLVQELTSTLREWAVIWRKLYVNNKLTLFRQLQQMTYSLIEWRSQILSGTLPKDELAELKKKVTAKIDHGNRMLGLDLVVRDDNGNILDPDETSTIALFKAHEVASKRIEEKIQEEKSILQNLDLRGQSIFSTIHTYGLYVNFKNFVCNIGEDAELFMALYDPDQSTFISENYLIRWGSNGMPKEIEKLNNLQAVFTDLSSMDLIRPRVSLVCQIVRVGHMELKEGKKHTCGLRRPFGVAVMDITDIIHGKVDDEEKQHFIPFQQ

SEQ ID NO: 881654 - protein, 282 aa, Homo sapiens
MPKRKAAGQGDMRQEPKRRSARLSAMLVPVTPEVKPKRTSSSRKMKTKSDMMEENIDTSAQAVAETKQEAVVEEDYNENAKNGEAKITEAPASEKEIVEVKEENIEDATEKGGEKKEAVAAEVKNEEEDQKEDEEDQNEEKGEAGKEDKDEKGEEDGKEDKNGNEKGEDAKEKEDGKKGEDGKGNGEDGKEKGEDEKEEEDRKETGDGKENEDGKEKGDKKEGKDVKVKEDEKEREDGKEDEGGNEEEAGKEKEDLKEEEEGKEEDEIKEDDGKKEEPQSIV

SEQ ID NO: 881655 - protein, 282 aa, Homo sapiens; identical to SEQ ID NO: 881654

SEQ ID NO: 881656 - protein, 282 aa, Homo sapiens; identical to SEQ ID NO: 881654

SEQ ID NO: 881657 - protein, 272 aa, Homo sapiens
MPKRKPKRRSARLSAMLVPVTPEVKPKRTSSSRKMKTKSDMMEENIDTSAQAVAETKQEAVVEEDYNENAKNGEAKITEAPASEKEIVEVKEENIEDATEKGGEKKEAVAAEVKNEEEDQKEDEEDQNEEKGEAGKEDKDEKGEEDGKEDKNGNEKGEDAKEKEDGKKGEDGKGNGEDGKEKGEDEKEEEDRKETGDGKENEDGKEKGDKKEGKDVKVKEDEKEREDGKEDEGGNEEEAGKEKEDLKEEEEGKEEDEIKEDDGKKEEPQSIV

SEQ ID NO: 881658 - protein, 201 aa, Homo sapiens
MPKRKAAGQGDMRQEPKRRSARLSAMLVPVTPEVKPKRTSSSRKMKTKSDMMEENIDTSAQAVAETKQEAVVEEDYNENAKNGEAKITEAPASEKEIVEVKEENIEDATEKGGEKKEAVAAEVKNEEEDQKEKRRWTQKGERRNNVNLDERLDTETTEKMTHHGRTTRQENRQMDTENCRMAQQQGQIHQEGERLYKSQTH

SEQ ID NO: 881659 - protein, 181 aa, Homo sapiens
MAVLVLSYKSICSLGCDLPQTHSLGNRRALILLGQMGRISPFSCLKDRHDFRIPQEEFDGNQFQKAQAISVLHEMIQQTFNLFSTEDSSAAWEQSLLEKFSTELYQQLNDLEACVIQEVGVEETPLMNEDSILAVRKYFQRITLYLIERKYSPCAWEVVRAEIMRSLSFSTNLQKRLRRKD

SEQ ID NO: 881660 - protein, 1490 aa, Homo sapiens
RTDSSLLLDDYSSKLSPKPKRAKHSLLSGEEKENLPSDYMVPIFSGRQKHVSGITDTEEERIKEAAAYIAQRNLLASEEGITTPKQSTASKQTTASKQSTASKQSTASKQSTASRQSTASRQSVVSKQATSALQQEETSEKKSRKVVIRGKAERLSLRKTLEETETYHAKLNEDHLLHAPEFIIKPRSHTVWEKENVKLHCSIAGWPEPRVTWYKNQVPINVHANPGKYIIESRYGMHTLEINACDFEDTAQYRASAMNVKGELSAYASVVVKRYKGEFDETRFHAGASTMPLSFGVTPYGYASRFEIHFDDKFDVSFGREGETMSLGCRVVITPEIKHFQPEIRWYRNGVPLSPSKWVQTLWSGERATLTFSHLNKEDEGLYTIRVRMGEYYEQYSAYVFVRDADAEIEGAPAAPLDVKCLEANKDYIIISWKQPAVDGGSPILGYFIDKCEVGTDSWSQCNDTPVKFARFPVTGLIEGRSYIFRVRAVNKMGIGFPSRVSEAVAALDPAEKARLKSPLSTLDWTVIVTEEEPSEGIVPGPPTDLSVTEATRSYVVLSWKPPGQRGHEGIMYFVEKCEAGTENWQRVNTELPVKSPRFALFDLAEGKSYCFRVRCSNSAGVGEPSEATEVTVVGDKLDIPKAPGKIIPSRNTDTSVVVSWEESKDAKELVGYYIEANVAGSGKWEPCNNNPVKTHRFTCHGLVTGQSYIFRVRAVNAAGLSEYSQDSEAIEVKAAIAPPSPPCDITCLESFRDSMVLGWKQPDKTGGAEITGYYVNYREVIDGVPGKWREANVKAVREEAYKISNLKENMVYQFQVAAMNMAGLGAPSAVSECFKCEEWTIAVPGPPHSLKCSEVRKDSLVLQWKPPVHSGRTPVTGYFVDLKEKAKEDQWRGLNEAAIKNVYLKVRGLKEGVSYVFRVRAINQAGVGKPSDLAGPVVAETRPGRKEVVVNVDDDGVISLNFECDKMTPKSEFSWSKDYVSTEDSPRLEVESKGNKTKMTFKDLGMDDLGIYSCDVTDTDGIASSYLIDEEELKRLLALSHEHKFPTVPVKSELAVEILEKGQVRFWMQAEKLSGNAKVNYIFNEKEIFEGPKYKMHIDRNTGIIEMFMEKLQDEDEGTYTFQLQDGKATNHSTVVLVGDVFKKLQKEAEFQRQEWIRKQGPHFVEYLSWEVTGECNVLLKCKVANIKKETHIVWYKDEREISVDEKHDFKDGICTLLITEFSKKDAGIYEVILKDDRGKDKSRLKLVDEAFKELMMEVCKKIALSATDLKIQSTAEGIQLYSFVTYYVEDLKVNWSHNGSAIRYSDRVKTGVTGEQIWLQINEPTPNDKGKYVMELFDGKTGHQKTVDLSGQAYDEAYAEFQRLKQAAIAEKNRARVLGGLPDVVTIQEGKALNLTCNVWGDPPPEVSWLKNEKALASDDHCNLKFEAGRTAYFTINGVSTADSGKYGLVVKNKYGSETSDFTVSVFIPEEEARMAALESLKGGKKAK

SEQ ID NO: 881661 - protein, 1368 aa, Homo sapiens
RTDSSLLLDDYSSKLSPKPKRAKHSLLSGEEKENLPSDYMVPIFSGRQKHVSGITDTEEERIKEAAAYIAQRNLLASEEGITTPKQSTASKQTTASKQSTASKQSTASKQSTASRQSTASRQSVVSKQATSALQQEETSEKKSRKVVIRGKAERLSLRKTLEETETYHAKLNEDHLLHAPEFIIKPRSHTVWEKENVKLHCSIAGWPEPRVTWYKNQVPINVHANPGKYIIESRYGMHTLEINACDFEDTAQYRASAMNVKGELSAYASVVVKRYKGEFDETRFHAGASTMPLSFGVTPYGYASRFEIHFDDKFDVSFGREGETMSLGCRVVITPEIKHFQPEIRWYRNGVPLSPSKWVQTLWSGERATLTFSHLNKEDEGLYTIRVRMGEYYEQYSAYVFVRDADAEIEGAPAAPLDVKCLEANKDYIIISWKQPAVDGGSPILGYFIDKCEVGTDSWSQCNDTPVKFARFPVTGLIEGRSYIFRVRAVNKMGIGFPSRVSEAVAALDPAEKARLKSPLSTLDWTVIVTEEEPSEGIVPGPPTDLSVTEATRSYVVLSWKPPGQRGHEGIMYFVEKCEAGTENWQRVNTELPVKSPRFALFDLAEGKSYCFRVRCSNSAGVGEPSEATEVTVVGDKLDIPKAPGKIIPSRNTDTSVVVSWEESKDAKELVGYYIEANVAGSGKWEPCNNNPVKTHRFTCHGLVTGQSYIFRVRAVNAAGLSEYSQDSEAIEVKAAIAPPSPPCDITCLESFRDSMVLGWKQPDKTGGAEITGYYVNYREVIDGVPGKWREANVKAVREEAYKISNLKENMVYQFQVAAMNMAGLGAPSAVSECFKCEEWTIAVPGPPHSLKCSEVRKDSLVLQWKPPVHSGRTPVTGYFVDLKEKAKEDQWRGLNEAAIKNVYLKVRGLKEGVSYVFRVRAINQAGVGKPSDLAGPVVAETRPGRKEVVVNVDDDGVISLNFECDKMTPKSEFSWSKDYVSTEDSPRLEVESKGNKTKMTFKDLGMDDLGIYSCDVTDTDGIASSYLIDEEELKRLLALSHEHKFPTVPVKSELAVEILEKGQVRFWMQAEKLSGNAKVNYIFNEKEIFEGPKYKMHIDRNTGIIEMFMEKLQDEDEGTYTFQLQDGKATNHSTVVLVGDVFKKLQKEAEFQRQEWIRKQGPHFVEYLSWEVTGECNVLLKCKVANIKKETHIVWYKDEREISVDEKHDFKDGICTLLITEFSKKDAGIYEVILKDDRGKDKSRLKLVDEAFKELMMEVCKKIALSATDLKIQSTAEGIQLYSFVTYYVEDLKVNWSHNGSAIRYSDRVKTGVTGEQIWLQINEPTPNDKGKYVMELFDGKTGHQKTVDLSGQGKQIFCRFKFTLDE

SEQ ID NO: 881662 - protein, 258 aa, Homo sapiens
MAEYSYVKSTKLVLKGTKTKSKKKKSKDKKRKREEDEETQLDIVGIWWTVTNFGEISGTIAIEMDKGTYIHALDNGLFTLGAPHKEVDEGPSPPEQFTAVKLSDSRIALKSGYGKYLGINSDGLVVGRSDAIGPREQWEPVFQNGKMALLASNSCFIRCNEAGDIEAKSKTAGEEEMIKIRSCAERETKKKDDIPEEDKGNVKQCEINYVKKFQSFQDHKLKISKEDSKILKKARKDGFLHETLLDRRAKLKADRYCK

SEQ ID NO: 881663 - protein, 205 aa, Homo sapiens
MAEYSYVKSTKLVLKGTKTKSKKKKSKDKKRKREEDEETQLDIVGIWWTVTNFGEISGTIAIEMDKGTYIHALDNGLFTLGAPHKEVDEGPSPPEQFTAVKLSDSRIALKSGYGKYLGINSDGLVVGRSDAIGPREQWEPVFQNGKMALLASNSCFIRCNEAGDIEAKSKTAGEEEMIKSWSRLDPCLKENPEGPFPRKPRKVSG

SEQ ID NO: 881664 - protein, 259 aa, Homo sapiens
KPLALRTLRGVWPHEDARINGSKKKKSKDKKRKREEDEETQLDIVGIWWTVTNFGEISGTIAIEMDKGTYIHALDNGLFTLGAPHKEVDEGPSPPEQFTAVKLSDSRIALKSGYGKYLGINSDGLVVGRSDAIGPREQWEPVFQNGKMALLASNSCFIRCNEAGDIEAKSKTAGEEEMIKIRSCAERETKKKDDIPEEDKGNVKQCEINYVKKFQSFQDHKLKISKEDSKILKKARKDGFLHETLLDRRAKLKADRYCK

SEQ ID NO: 881665 - protein, 190 aa, Homo sapiens
MAEYSYVKSTKLVLKGTKTKSKKKKSKDKKRKREEDEETQLDIVGIWWTVTNFGEISGTIAIEMDKGTYIHALDNGLFTLGAPHKEVDEGPSPPEQFTAVKLSDSRIALKSGYGKYLGINSDGLVVGRSDAIGPREQWEPVFQNGKMALLASNSCFIRCNEAGDIEAKSKTAGEEEMIKALLISVSPSPL

SEQ ID NO: 881666 - protein, 151 aa, Homo sapiens
MAEYSYVKSTKLVLKGTKTKSKKKKSKDKKRKREEDEETQLDIVGIWWTVTNFGEISGTIAIEMDKGTYIHALDNGLFTLGAPHKEVDEGPSPPEQFTAVKLSDSRIALKSGYGKYLGINSDGLVVGRSDAIGPREQWEPVFQNVSAVIVY

SEQ ID NO: 881667 - protein, 190 aa, Homo sapiens; identical to SEQ ID NO: 881665

SEQ ID NO: 881668 - protein, 616 aa, Homo sapiens [sequence omitted]

SEQ ID NO: 881669 - protein, 533 aa, Homo sapiens
MERDTEAQDTAMEQARQHTQDTQRRALLLRAQAGAMRRQQHTLRDPMQRLQNQLRRLQDMERKAKVDVTFGSLTSAALGLEPVVLRDVRTACTLRAQFLQNLLLPQAKRGSLPTPHDDHFGTSYQQWLSSVETLLTNHPPGHVLAALEHLAAEREAEIRSLCSGDGLGDTEISRPQAPDQSDSSQTLPSMVHLIQEGWRTVGVLVSQRSTLLKERQVLTQRLQGLVEEVERRVLGSSERQVLILGLRRCCLWTELKALHDQSQELQDAAGHRQLLLRELQAKQQRILHWRQLVEETQEQVRLLIKGNSASKTRLCRSPGEVLALVQRKVVPTFEAVAPQSRELLRCLEEEVRHLPHILLGTLLRHRPGELKPLPTVLPSIHQLHPASPRGSSFIALSHKLGLPPGKASELLLPAAASLRQDLLLLQDQRSLWCWDLLHMKTSLPPGLPTQELLQIQASQEKQQKENLGQALKRLEKLLKQALERIPELQGIVGDWWEQPGQAALSEELCQGLSLPQWRLRWVQAQGALQKLCS

SEQ ID NO: 881670 - protein, 533 aa, Homo sapiens; identical to SEQ ID NO: 881669

SEQ ID NO: 881671 - protein, 616 aa, Homo sapiens [sequence omitted]

SEQ ID NO: 881672 - protein, 128 aa, Homo sapiens
MASELLLPAAASLRQDLLLLQDQRSLWCWDLLHMKTSLPPGLPTQELLQIQASQEKQQKENLGQALKRLEKLLKQALERIPELQGIVGDWWEQPGQAALSEELCQGLSLPQWRLRWVQAQGALQKLCS

SEQ ID NO: 881673 - protein, 616 aa, Homo sapiens [sequence omitted]

SEQ ID NO: 881674 - protein, 103 aa, Homo sapiens
MERDTEAQDTAMEQARQHTQDTQRRALLLRAQAGAMRRQQHTLRDPMQRLQNQLRRLQDMERKAKVDVTFGSLTSAALGLEPVVLVRVLVMGEGAGSLESGRC

SEQ ID NO: 881675 - protein, 533 aa, Homo sapiens; identical to SEQ ID NO: 881669

SEQ ID NO: 881676 - protein, 515 aa, Homo sapiens
MSWKRNFCGEGIARAEVVCSACRKSSPEANVSSSFSGKTENLRRKAKVDVTFGSLTSAALGLEPVVLRDVRTACTLRAQFLQNLLLPQAKRGSLPTPHDDHFGTSYQQWLSSVETLLTNHPPGHVLAALEHLAAEREAEIRSLCSGDGLGDTEISRPQAPDQSDSSQTLPSMVHLIQEGWRTVGVLVSQRSTLLKERQVLTQRLQGLVEEVERRVLGSSERQVLILGLRRCCLWTELKALHDQSQELQDAAGHRQLLLRELQAKQQRILHWRQLVEETQEQVRLLIKGNSASKTRLCRSPGEVLALVQRKVVPTFEAVAPQSRELLRCLEEEVRHLPHILLGTLLRHRPGELKPLPTVLPSIHQLHPASPRGSSFIALSHKLGLPPGKASELLLPAAASLRQDLLLLQDQRSLWCWDLLHMKTSLPPGLPTQELLQIQASQEKQQKENLGQALKRLEKLLKQALERIPELQGIVGDWWEQPGQAALSEELCQGLSLPQWRLRWVQAQGALQKLCS

SEQ ID NO: 881677 - protein, 452 aa, Homo sapiens
MGVPVAARAPESTLRRLCLGQGADIWAYILQHVHSQRTVKKIRGNLLWYGHQDSPQVRRKLELEAAVTRLRAEIQELDQSLELMERDTEAQDTAMEQARQHTQDTQRRALLLRAQAGAMRRQQHTLRDPMQRLQNQLRRLQDMERKAKVDVTFGSLTSAALGLEPVVLRDVRTACTLRAQFLQNLLLPQAKRGSLPTPHDDHFGTSYQQWLSSVETLLTNHPPGHVLAALEHLAAEREAEIRSLCSGDGLGDTEISRPQAPDQSDSSQTLPSMVHLIQEGWRTVGVLVSQRSTLLKERQVLTQRLQGLVEEVERRVLGSSERQVLILGLRRCCLWTELKALHDQSQELQDAAGHRQLLLRELQAKQQRILHWRQLVEETQEQVRLLIKGNSASKTRLCRSPGEVLALVQRKVVPTFEAVAPQSRELLRCLEEEVRHLPHILLGTLLRHRPGE

SEQ ID NO: 881678 - protein, 2141 aa, Homo sapiens
LECLEFDPEEFYYLLEAAEGHAKEGQGIKTDIPRYIISQLGLNKDPLEEMAHLGNYDSGTAETPETDESVSSSNASLKLRRKPRESDFETIKLISNGAYGAVYFVRHKESRQRFAMKKINKQNLILRNQIQQAFVERDILTFAENPFVVSMYCSFETRRHLCMVMEYVEGGDCATLMKNMGPLPVDMARMYFAETVLALEYLHNYGIVHRDLKPDNLLVTSMGHIKLTDFGLSKVGLMSMTTNLYEGHIEKDAREFLDKQVCGTPEYIAPEVILRQGYGKPVDWWAMGIILYEFLVGCVPFFGDTPEELFGQVISDEINWPEKDEAPPPDAQDLITLLLRQNPLERLGTGGAYEVKQHRFFRSLDWNSLLRQKAEFIPQLESEDDTSYFDTRSEKYHHMETEEEDDTNDEDFNVEIRQFSSCSHRFSKVFSSIDRITQNSAEEKEDSVDKTKSTTLPSTETLSWSSEYSEMQQLSTSNSSDTESNRHKLSSGLLPKLAISTEGEQDEAASCPGDPHEEPGKPALPPEECAQEEPEVTTPASTISSSTLSVGSFSEHLDQINGRSECVDSTDNSSKPSSEPASHMARQRLESTEKKKISGKVTKSLSASALSLMIPGDMFAVSPLGSPMSPHSLSSDPSSSRDSSPSRDSSAASASPHQPIVIHSSGKNYGFTIRAIRVYVGDSDIYTVHHIVWNVEEGSPACQAGLKAGDLITHINGEPVHGLVHTEVIELLLKSGNKVSITTTPFENTSIKTGPARRNSYKSRMVRRSKKSKKKESLERRRSLFKKLAKQPSPLLHTSRSFSCLNRSLSSGESLPGSPTHSLSPRSPTPSYRSTPDFPSGTNSSQSSSPSSSAPNSPAGSGHIRPSTLHGLAPKLGGQRYRSGRRKSAGNIPLSPLARTPSPTPQPTSPQRSPSPLLGHSLGNSKIAQAFPSKMHSPPTIVRHIVRPKSAEPPRSPLLKRVQSEEKLSPSYGSDKKHLCSRKHSLEVTQEEVQREQSQREAPLQSLDENVCDVPPLSRARPVEQGCLKRPVSRKVGRQESVDDLDRDKLKAKVVVKKADGFPEKQESHQKSHGPGSDLENFALFKLEEREKKVYPKAVERSSTFENKASMQEAPPLGSLLKDALHKQASVRASEGAMSDGPVPAEHRQGGGDFRRAPAPGTLQDGLCHSLDRGISGKGEGTEKSSQAKELLRCEKLDSKLANIDYLRKKMSLEDKEDNLCPVLKPKMTAGSHECLPGNPVRPTGGQQEPPPASESRAFVSSTHAAQMSAVSFVPLKALTGRVDSGTEKPGLVAPESPVRKSPSEYKLEGRSVSCLKPIEGTLDIALLSGPQASKTELPSPESAQSPSPSGDVRASVPPVLPSSSGKKNDTTSARELSPSSLKMNKSYLLEPWFLPPSRGLQNSPAVSLPDPEFKRDRKGPHPTARSPGTVMESNPQQREGSSPKHQDHTTDPKLLTCLGQNLHSPDLARPRCPLPPEASPSREKPGLRESSERGPPTARSERSAARADTCREPSMELCFPETAKTSDNSKNLLSVGRTHPDFYTQTQAMEKAWAPGGKTNHKDGPGEARPPPRDNSSLHSAGIPCEKELGKVRRGVEPKPEALLARRSLQPPGIESEKSEKLSSFPSLQKDGAKEPERKEQPLQRHPSSIPPPPLTAKDLSSPAARQHCSSPSHASGREPGAKPSTAEPSSSPQDPPKPVAAHSESSSHKPRPGPDPGPPKTKHPDRSLSSQKPSVGATKGKEPATQSLGGSSREGKGHSKSGPDVFPATPGSQNKASDGIGQGEGGPSVPLHTDRAPLDAKPQPTSGGRPLEVLEKPVHLPRPGHPGPSEPADQKLSAVGEKQTLSPKHPKPSTVKDCPTLCKQTDNRQTDKSPSQPAANTDRRAEGKKCTEALYAPAEGDKLEAGLSFVHSENRLKGAERPAAGVGKGFPEARGKGPGPQKPPTEADKPNGMKRSPSATGQSSFRSTALPEKSLSCSSSFPETRAGVREASAASSDTSSAKAAGGMLELPAPSNRDHRKAQPAGEGRTHMTKSDSLPSFRVSTLPLESHHPDPNTMGGASHRDRALSVTATVGETKGKDPAPAQPPPARKQNVGRDVTKPSPAPNTDRPISLSNEKDFVVRQRRGKESLRSSPHKKAL

SEQ ID NO: 881679 - protein, 1911 aa, Homo sapiens
LECLEFDPEEFYYLLEAAEGHAKEGQGIKTDIPRYIISQLGLNKDPLEEMAHLGNYDSGTAETPETDESVSSSNASLKLRRKPRESDFETIKLISNGAYGAVYFVRHKESRQRFAMKKINKQNLILRNQIQQAFVERDILTFAENPFVVSMYCSFETRRHLCMVMEYVEGGDCATLMKNMGPLPVDMARMYFAETVLALEYLHNYGIVHRDLKPDNLLVTSMGHIKLTDFGLSKVGLMSMTTNLYEGHIEKDAREFLDKQVCGTPEYIAPEVILRQGYGKPVDWWAMGIILYEFLVGCVPFFGDTPEELFGQVISDEINWPEKDEAPPPDAQDLITLLLRQNPLERLGTGGAYEVKQHRFFRSLDWNSLLRQKAEFIPQLESEDDTSYFDTRSEKYHHMETEEEDDTNDEDFNVEIRQFSSCSHRFSKVFSSIDRITQNSAEEKEDSVDKTKSTTLPSTETLSWSSEYSEMQQLSTSNSSDTESNRHKLSSGLLPKLAISTEGEQDEAASCPGDPHEEPGKPALPPEECAQEEPEVTTPASTISSSTLSVGSFSEHLDQINGRSECVDSTDNSSKPSSEPASHMARQRLESTEKKKISGKVTKSLSASALSLMIPGDMFAVSPLGSPMSPHSLSSDPSSSRDSSPSRDSSAASASPHQPIVIHSSGKNYGFTIRAIRVYVGDSDIYTVHHIVWNVEEGSPACQAGLKAGDLITHINGEPVHGLVHTEVIELLLKSGNKVSITTTPFENTSIKTGPARRNSYKSRMVRRSKKSKKKESLERRRSLFKKLAKQPSPLLHTSRSFSCLNRSLSSGESLPGSPTHSLSPRSPTPSYRSTPDFPSGTNSSQSSSPSSSAPNSPAGSGHIRPSTLHGLAPKLGGQRYRSGRRKSAGNIPLSPLARTPSPTPQPTSPQRSPSPLLGHSLGNSKIAQAFPSKMHSPPTIVRHIVRPKSAEPPRSPLLKRVQSEEKLSPSYGSDKKHLCSRKHSLEVTQEEVQREQSQREAPLQSLDENVCDVPPLSRARPVEQGCLKRPVSRKVGRQESVDDLDRDKLKAKVVVKKADGFPEKQESHQKSHGPGSDLENFALFKLEEREKKVYPKAVERSSTFENKASMQEAPPLGSLLKDALHKQASVRASEGAMSDGPVPAEHRQGGGDFRRAPAPGTLQDGLCHSLDRGISGKGEGTEKSSQAKELLRCEKLDSKLANIDYLRKKMSLEDKEDNLCPVLKPKMTAGSHECLPGNPVRPTGGQQEPPPASESRAFVSSTHAAQMSAVSFVPLKALTGRVDSGTEKPGLVAPESPVRKSPSEYKLEGRSVSCLKPIEGTLDIALLSGPQASKTELPSPESAQSPSPSGDVRASVPPVLPSSSGKKNDTTSARELSPSSLKMNKSYLLEPWFLPPSRGLQNSPAVSLPDPEFKRDRKGPHPTARSPGTVMESNPQQREGSSPKHQDHTTDPKLLTCLGQNLHSPDLARPRCPLPPEASPSREKPGLRESSERGPPTARSERSAARADTCREPSMELCFPETAKTSDNSKNLLSVGRTHPDFYTQTQAMEKAWAPGGKTNHKDGPGEARPPPRDNSSLHSAGIPCEKELGKVRRGVEPKPEALLARRSLQPPGIESEKSEKLSSFPSLQKDGAKEPERKEQPLQRHPSSIPPPPLTAKTCPARLPGSIAVPQATLLAESRGPSPALQSPARAPRTLPSLLLRTVKAAATSPGLPPTEADKPNGMKRSPSATGQSSFRSTALPEKSLSCSSSFPETRAGVREASAASSDTSSAKAAGGMLELPAPSNRDHRKAQPAGEGRTHMTKSDSLPSFRVSTLPLESHHPDPNTMGGASHRDRALSVTATVGETKGKDPAPAQPPPARKQNVGRDVTKPSPAPNTDRPISLSNEKDFVVRQRRGKESLRSSPHKKAL

SEQ ID NO: 881680 - protein, 2123 aa, Homo sapiens
LECLEFDPEEFYYLLEAAEGHAKEGQGIKTDIPRYIISQLGLNKDPLEEMAHLGNYDSGTAETPETDESVSSSNASLKLRRKPRESDFETIKLISNGAYGAVYFVRHKESRQRFAMKKINKQNLILRNQIQQAFVERDILTFAENPFVVSMYCSFETRRHLCMVMEYVEGGDCATLMKNMGPLPVDMARMYFAETVLALEYLHNYGIVHRDLKPDNLLVTSMGHIKLTDFGLSKVGLMSMTTNLYEGHIEKDAREFLDKQVCGTPEYIAPEVILRQGYGKPVDWWAMGIILYEFLVGCVPFFGDTPEELFGQVISDEINWPEKDEAPPPDAQDLITLLLRQNPLERLGTGGAYEVKQHRFFRSLDWNSLLRQKAEFIPQLESEDDTSYFDTRSEKYHHMETEEEDDTNDEDFNVEIRQFSSCSHRFSKVFSSIDRITQNSAEEKEDSVDKTKSTTLPSTETLSWSSEYSEMQQLSTSNSSDTESNRHKLSSGLLPKLAISTEGEQDEAASCPGDPHEEPGKPALPPEECAQEEPEVTTPASTISSSTLSVGSFSEHLDQINGRSECVDSTDNSSKPSSEPASHMARQRLESTEKKKISGKVTKSLSASALSLMIPGDMFAVSPLGSPMSPHSLSSDPSSSRDSSPSRDSSAASASPHQPIVIHSSGKNYGFTIRAIRVYVGDSDIYTVHHIVWNVEEGSPACQAGLKAGDLITHINGEPVHGLVHTEVIELLLKSGNKVSITTTPFENTSIKTGPARRNSYKSRMVRRSKKSKKKESLERRRSLFKKLAKQPSPLLHTSRSFSCLNRSLSSGESLPGSPTHSLSPRSPTPSYRSTPDFPSGTNSSQSSSPSSSAPNSPAGSGHIRPSTLHGLAPKLGGQRYRSGRRKSAGNIPLSPLARTPSPTPQPTSPQRSPSPLLGHSLGNSKIAQAFPSKMHSPPTIVRHIVRPKSAEPPRSPLLKRVQSEEKLSPSYGSDKKHLCSRKHSLEVTQEEVQREQSQREAPLQSLDENVCDVPPLSRARPVEQGCLKRPVSRKVGRQESVDDLDRDKLKAKVVVKKADGFPEKQESHQKSHGPGSDLENFALFKLEEREKKVYPKAVERSSTFENKASMQEAPPLGSLLKDALHKQASVRASEGAMSDGPVPAEHRQGGGDFRRAPAPGTLQDGLCHSLDRGISGKGEGTEKSSQAKELLRCEKLDSKLANIDYLRKKMSLEDKEDNLCPVLKPKMTAGSHECLPGNPVRPTGGQQEPPPASESRAFVSSTHAAQMSAVSFVPLKALTGRVDSGTEKPGLVAPESPVRKSPSEYKLEGRSVSCLKPIEGTLDIALLSGPQASKTELPSPESAQSPSPSGDVRASVPPVLPSSSGKKNDTTSARELSPSSLKMNKSYLLEPWFLPPSRGLQNSPAVSLPDPEFKRDRKGPHPTARSPGTVMESNPQQREGSSPKHQDHTTDPKLLTCLGQNLHSPDLARPRCPLPPEASPSREKPGLRESSERGPPTARSERSAARADTCREPSMELCFPETAKTSDNSKNLLSVGRTHPDFYTQTQAMEKAWAPGGKTNHKDGPGEARPPPRDNSSLHSAGIPCEKELGKVRRGVEPKPEALLARRSLQPPGIESEKSEKLSSFPSLQKDGAKEPERKEQPLQRHPSSIPPPPLTAKDLSSPAARQHCSSPSHASGREPGAKPSTAEPSSSPQDPPKPVAAHSESSSHKPRPGPDPGPPKTKHPDRSLSSQKPSVGATKGKEPATQSLGGSSREGKGHSKSGPDVFPATPGSQNKASDGIGQGEGGPSVPLHTDRAPLDAKPQPTSGGRPLEVLEKPVHLPRPGHPGPSEPADQKLSAVGEKQTLSPKHPKPSTVKDCPTLCKQTDNRQTDKSPSQPAANTDRRAEGKKCTEALYAPAEGDKLEAGLSFVHSENRLKGAERPAAGVGKGFPEARGKGPGPQKPPTEADKPNGMKRSPSATGQSSFRSTALPEASAASSDTSSAKAAGGMLELPAPSNRDHRKAQPAGEGRTHMTKSDSLPSFRVSTLPLESHHPDPNTMGGASHRDRALSVTATVGETKGKDPAPAQPPPARKQNVGRDVTKPSPAPNTDRPISLSNEKDFVVRQRRGKESLRSSPHKKAL

SEQ ID NO: 881681 - protein, 187 aa, Homo sapiens
MKRSPSATGQSSFRSTALPEKSLSCSSSFPETRAGVREASAASSDTSSAKAAGGMLELPAPSNRDHRKAQPAGEGRTHMTKSDSLPSFRVSTLPLESHHPDPNTMGGASHRDRALSVTATVGETKGKDPAPAQPPPARKQNVGRDVTKPSPAPNTDRPISLSNEKDFVVRQRRGKESLRSSPHKKAL

SEQ ID NO: 881682 - protein, 1844 aa, Homo sapiens
LECLEFDPEEFYYLLEAAEGHAKEGQGIKTDIPRYIISQLGLNKDPLEEMAHLGNYDSGTAETPETDESVSSSNASLKLRRKPRESDFETIKLISNGAYGAVYFVRHKESRQRFAMKKINKQNLILRNQIQQAFVERDILTFAENPFVVSMYCSFETRRHLCMVMEYVEGGDCATLMKNMGPLPVDMARMYFAETVLALEYLHNYGIVHRDLKPDNLLVTSMGHIKLTDFGLSKVGLMSMTTNLYEGHIEKDAREFLDKQVCGTPEYIAPEVILRQGYGKPVDWWAMGIILYEFLVGCVPFFGDTPEELFGQVISDEINWPEKDEAPPPDAQDLITLLLRQNPLERLGTGGAYEVKQHRFFRSLDWNSLLRQKAEFIPQLESEDDTSYFDTRSEKYHHMETEEEDDTNDEDFNVEIRQFSSCSHRFSKVFSSIDRITQNSAEEKEDSVDKTKSTTLPSTETLSWSSEYSEMQQLSTSNSSDTESNRHKLSSGLLPKLAISTEGEQDEAASCPGDPHEEPGKPALPPEECAQEEPEVTTPASTISSSTLSDMFAVSPLGSPMSPHSLSSDPSSSRDSSPSRDSSAASASPHQPIVIHSSGKNYGFTIRAIRVYVGDSDIYTVHHIVWNVEEGSPACQAGLKAGDLITHINGEPVHGLVHTEVIELLLKSGNKVSITTTPFENTSIKTGPARRNSYKSRMVRRSKKSKKKESLERRRSLFKKLAKQPSPLLHTSRSFSCLNRSLSSGESLPGSPTHSLSPRSPTPSYRSTPDFPSGTNSSQSSSPSSSAPNSPAGSGHIRPSTLHGLAPKLGGQRYRSGRRKSAGNIPLSPLARTPSPTPQPTSPQRSPSPLLGHSLGNSKIAQAFPSKMHSPPTIVRHIVRPKSAEPPRSPLLKRVQSEEKLSPSYGSDKKHLCSRKHSLEVTQEEVQREQSQREAPLQSLDENVCDVPPLSRARPVEQGCLKRPVSRKVGRQESVDDLDRDKLKAKVVVKKADGFPEKQESHQKSHGPGSDLENFALFKLEEREKKVYPKAVERSSTFENKASMQEAPPLGSLLKDALHKQASVRASEGAMSDGPVPAEHRQGGGDFRRAPAPGTLQDGLCHSLDRGISGKGEGTEKSSQAKELLRCEKLDSKLANIDYLRKKMSLEDKEDNLCPVLKPKMTAGSHECLPGNPVRPTGGQQEPPPASESRAFVSSTHAAQMSAVSFVPLKALTGRVDSGTEKPGLVAPESPVRKSPSEYKLEGRSVSCLKPIEGTLDIALLSGPQASKTELPSPESAQSPSPSGDVRASVPPVLPSSSGKKNDTTSARELSPSSLKMNKSYLLEPWFLPPSRGLQNSPAVSLPDPEFKRDRKGPHPTARSPGTVMESNPQQREGSSPKHQDHTTDPKLLTCLGQNLHSPDLARPRCPLPPEASPSREKPGLRESSERGPPTARSERSAARADTCREPSMELCFPETAKTSDNSKNLLSVGRTHPDFYTQTQAMEKAWAPGGKTNHKDGPGEARPPPRDNSSLHSAGIPCEKELGKVRRGVEPKPEALLARRSLQPPGIESEKSEKLSSFPSLQKDGAKEPERKEQPLQRHPSSIPPPPLTAKTCPARLPGSIAVPQATLLAESRGPSPALQSPARAPRTLPSLLLRTVKAAATSPGLPPTEADKPNGMKRSPSATGQSSFRSTALPEKSLSCSSSFPETRAGVREASAASSDTSSAKAAGGMLELPAPSNRDHRKAQPAGEGRTHMTKSDSLPSFRVSTLPLESHHPDPNTMGGASHRDRALSVTATVGETKGKDPAPAQPPPARKQNVGRDVTKPSPAPNTDRPISLSNEKDFVVRQRRGKESLRSSPHKKAL

SEQ ID NO: 881683 - protein, 635 aa, Homo sapiens
LGFPFGAFAGTEKPGLVAPESPVRKSPSEYKLEGRSVSCLKPIEGTLDIALLSGPQASKTELPSPESAQSPSPSGDVRASVPPVLPSSSGKKNDTTSARELSPSSLKMNKSYLLEPWFLPPSRGLQNSPAVSLPDPEFKRDRKGPHPTARSPGTVMESNPQQREGSSPKHQDHTTDPKLLTCLGQNLHSPDLARPRCPLPPEASPSREKPGLRESSERGPPTARSERSAARADTCREPSMELCFPETAKTSDNSKNLLSVGRTHPDFYTQTQAMEKAWAPGGKTNHKDGPGEARPPPRDNSSLHSAGIPCEKELGKVRRGVEPKPEALLARRSLQPPGIESEKSEKLSSFPSLQKDGAKEPERKEQPLQRHPSSIPPPPLTAKTCPARLPGSIAVPQATLLAESRGPSPALQSPARAPRTLPSLLLRTVKAAATSPGLPPTEADKPNGMKRSPSATGQSSFRSTALPEKSLSCSSSFPETRAGVREASAASSDTSSAKAAGGMLELPAPSNRDHRKAQPAGEGRTHMTKSDSLPSFRVSTLPLESHHPDPNTMGGASHRDRALSVTATVGETKGKDPAPAQPPPARKQNVGRDVTKPSPAPNTDRPISLSNEKDFVVRQRRGKESLRSSPHKKAL

SEQ ID NO: 881684 - protein, 1890 aa, Homo sapiens
LECLEFDPEEFYYLLEAAEGHAKEGQGIKTDIPRYIISQLGLNKDPLEEMAHLGNYDSGTAETPETDESVSSSNASLKLRRKPRESDFETIKLISNGAYGAVYFVRHKESRQRFAMKKINKQNLILRNQIQQAFVERDILTFAENPFVVSMYCSFETRRHLCMVMEYVEGGDCATLMKNMGPLPVDMARMYFAETVLALEYLHNYGIVHRDLKPDNLLVTSMGHIKLTDFGLSKVGLMSMTTNLYEGHIEKDAREFLDKQVCGTPEYIAPEVILRQGYGKPVDWWAMGIILYEFLVGCVPFFGDTPEELFGQVISDEINWPEKDEAPPPDAQDLITLLLRQNPLERLGTGGAYEVKQHRFFRSLDWNSLLRQKAEFIPQLESEDDTSYFDTRSEKYHHMETEEEDDTNDEDFNVEIRQFSSCSHRFSKVFSSIDRITQNSAEEKEDSVDKTKSTTLPSTETLSWSSEYSEMQQLSTSNSSDTESNRHKLSSGLLPKLAISTEGEQDEAASCPGDPHEEPGKPALPPEECAQEEPEVTTPASTISSSTLSVGSFSEHLDQINGRSECVDSTDNSSKPSSEPASHMARQRLESTEKKKISGKVTKSLSASALSLMIPGDMFAVSPLGSPMSPHSLSSDPSSSRDSSPSRDSSAASASPHQPIVIHSSGKNYGFTIRAIRVYVGDSDIYTVHHIVWNVEEGSPACQAGLKAGDLITHINGEPVHGLVHTEVIELLLKSGNKVSITTTPFENTSIKTGPARRNSYKSRMVRRSKKSKKKESLERRRSLFKKLAKQPSPLLHTSRSFSCLNRSLSSGESLPGSPTHSLSPRSPTPSYRSTPDFPSGTNSSQSSSPSSSAPNSPAGSGHIRPSTLHGLAPKLGGQRYRSGRRKSAGNIPLSPLARTPSPTPQPTSPQRSPSPLLGHSLGNSKIAQAFPSKMHSPPTIVRHIVRPKSAEPPRSPLLKRVQSEEKLSPSYGSDKKHLCSRKHSLEVTQEEVQREQSQREAPLQSLDENVCDVPPLSRARPVEQGCLKRPVSRKVGRQESVDDLDRDKLKAKVVVKKADGFPEKQESHQKSHGPGSDLENFALFKLEEREKKVYPKAVERSSTFENKASMQEAPPLGSLLKDALHKQASVRASEGAMSDGPVPAEHRQGGGDFRRAPAPGTLQDGLCHSLDRGISGKGEGTEKSSQAKELLRCEKLDSKLANIDYLRKKMSLEDKEDNLCPVLKPKMTAGSHECLPGNPVRPTGGQQEPPPASESRAFVSSTHAAQMSAVSFVPLKALTGRVDSGTEKPGLVAPESPVRKSPSEYKLEGRSVSCLKPIEGTLDIALLSGPQASKTELPSPESAQSPSPSGDVRASVPPVLPSSSGKKNDTTSARELSPSSLKMNKSYLLEPWFLPPSRGLQNSPAVSLPDPEFKRDRKGPHPTARSPGTVMESNPQQREGSSPKHQDHTTDPKLLTCLGQNLHSPDLARPRCPLPPEASPSREKPGLRESSERGPPTARSERSAARADTCREPSMELCFPETAKTSDNSKNLLSVGRTHPDFYTQTQAMEKAWAPGGKTNHKDGPGEARPPPRDNSSLHSAGIPCEKELGKVRRGVEPKPEALLARRSLQPPGIESEKSEKLSSFPSLQKDGAKEPERKEQPLQRHPSSIPPPPLTAKDLSSPAARQHCSSPSHASGREPGAKPSTAEPSSSPQDPPKPVAAHSESSSHKPRPGPDPGPPKTKHPDRSLSSQKPSVGATKGKEPATQSLGGSSREGKGHSKSGPDVFPATPGSQNKASDGIGQGEGGPSVPLHTDRAPLDAKPQPTSGGRPLEVLEKPVHLPRPGHPGPSEPADQKLSAVGEKQTLSPKHPKPSTVKDRPISLSNEKDFVVRQRRGKESLRSSPHKKAL

SEQ ID NO: 881685 - protein, 407 aa, Homo sapiens
ELRPQAGAPGWCRPRPWPAGASLTRAAAGRVLARRSEPHSRSRQSGSRLPQVSGAEADRQAPANREHGAGLGAGWYPLRQSGGGGARRRGRTGGPEDRGQKDWWTGAAAGGEGARRRPAAMATVMAATAAERAVLEEEFRWLLHDEVHAVLKQLQDILKEASLRFTLPGSGTEGPAKQENFILGSCGTDQVKGVLTLQGDALSQADVNLKMPRNNQLLHFAFREDKQWKLQQIQDARNHVSQAIYLLTSRDQSYQFKTGAEVLKLMDAVMLQLTRARNRLTTPATLTLPEIAASGLTRMFAPALPSDLLVNVYINLNKLCLTVYQLHALQPNSTKNFRPAGGAVLHSPGAMFEWGSQRLEVSHVHKVECVIPWLNDALVYFTVSLQLCQQLKDKISVFSSYWSYRPF

SEQ ID NO: 881686 - protein, 251 aa, Homo sapiens
ELRPQAGAPGWCRPRPWPAGASLTRAAAGRVLARRSEPHSRSRQSGSRLPQVSGAEADRQAPANREHGAGLGAGWYPLRQSGGGGARRRGRTGGPEDRGQKDWWTGAAAGGEGARRRPAAMATVMAATAAERAVLEEEFRWLLHDEVHAVLKQLQDILKEASLRFTLPGSGTEGPAKQENFILGSCGFSHTILFFLLFIYSIIILILTLIFLTTIFFSFIIILFIPYTILSNFFLPSFIFTSIFLISSIFF

SEQ ID NO: 881687 - protein, 414 aa, Homo sapiens
ELRPQAGAPGWCRPRPWPAGASLTRAAAGRVLARRSEPHSRSRQSGSRLPQVSGAEADRQAPANREHGAGLGAGWYPLRQSGGGGARRRGRTGGPEDRGQKDWWTGAAAGGEGARRRPAAMATVMAATAAERAVLEEEFRWLLHDEVHAVLKQLQDILKEASLRFTLPGSGTEGPAKQENFILGSCGTDQVKGVLTLQGDALSQADVNLKMPRNNQLLHFAFREDKQWKLQQIQDARNHVSQAIYLLTSRDQSYQFKTGAEVLKLMDAVMLQLTRARNRLTTPATLTLPEIAASGLTRMFAPALPSDLLVNVYINLNKLCLTVYQLHALQPNSTKNFRPAGGAVLHSPGAMLDPLTAHSEWGSQRLEVSHVHKVECVIPWLNDALVYFTVSLQLCQQLKDKISVFSSYWSYRPF

SEQ ID NO: 881688 - protein, 197 aa, Homo sapiens
MPRNNQLLHFAFREDKQWKLQQIQDARNHVSQAIYLLTSRDQSYQFKTGAEVLKLMDAVMLQLTRARNRLTTPATLTLPEIAASGLTRMFAPALPSDLLVNVYINLNKLCLTVYQLHALQPNSTKNFRPAGGAVLHSPGAMFEWGSQRLEVSHVHKVECVIPWLNDALVYFTVSLQLCQQLKDKISVFSSYWSYRPF

SEQ ID NO: 881689 - protein, 197 aa, Homo sapiens; identical to SEQ ID NO: 881688

SEQ ID NO: 881690 - protein, 197 aa, Homo sapiens; identical to SEQ ID NO: 881688

SEQ ID NO: 881691 - protein, 313 aa, Homo sapiens
SLPRERTREGRLSRLFLFMPPISPVSLCVCVVCCVRCSRPSCLRLNAGCPSRWWASTLGAGRSRAEASLRFTLPGSGTEGPAKQENFILGSCGTDQVKGVLTLQGDALSQADVNLKMPRNNQLLHFAFREDKQWKLQQIQDARNHVSQAIYLLTSRDQSYQFKTGAEVLKLMDAVMLQLTRARNRLTTPATLTLPEIAASGLTRMFAPALPSDLLVNVYINLNKLCLTVYQLHALQPNSTKNFRPAGGAVLHSPGAMFEWGSQRLEVSHVHKVECVIPWLNDALVYFTVSLQLCQQLKDKISVFSSYWSYRPF

SEQ ID NO: 881692 - protein, 407 aa, Homo sapiens; identical to SEQ ID NO: 881685

SEQ ID NO: 881693 - protein, 518 aa, Homo sapiens
ELRPQAGAPGWCRPRPWPAGASLTRAAAGRVLARRSEPHSRSRQSGSRLPQVSGAEADRQAPANREHGAGLGAGWYPLRQSGGGGARRRGRTGGPEDRGQKDWWTGAAAGGEGARRRPAAMATVMAATAAERAVLEEEFRWLLHDEVHAVLKQLQDILKEASLRFTLPGSGTEGPAKQENFILGSCGTDQVKGVLTLQGDALSQADVNLKMPRNNQLLHFAFREDKQWKLQQIQDARNHVSQAIYLLTSRDQSYQFKTGAEVLKLMDAVMLQLTRARNRLTTPATLTLPEIAASGLTRMFAPALPSDLLVNVYINLNKLCLTVYQLHALQPNSTKNFRPAGGAVLHSPGAMFEWGSQRLEVSHVHKVECVIPWLNDALVYFTVSLQLCQQLKDKGACLQEGGPVPYSYPPQSTSQCQRQAAIYLPIPPPTPPNTFALPGMDTGSARRKEGWFGGVVGRSGRRGQGCPTFPTPPSDHHGNLWTQDRARRRALPPLPFAVPSPWRAWCRGVALSYESRGW

SEQ ID NO: 881694 - protein, 197 aa, Homo sapiens; identical to SEQ ID NO: 881688

SEQ ID NO: 881695 - protein, 383 aa, Homo sapiens
ELRPQAGAPGWCRPRPWPAGASLTRAAAGRVLARRSEPHSRSRQSGSRLPQVSGAEADRQAPANREHGAGLGAGWYPLRQSGGGGARRRGRTGGPEDRGQKDWWTGAAAGGEGARRRPAAMATVMAATAAERAVLEASLRFTLPGSGTEGPAKQENFILGSCGTDQVKGVLTLQGDALSQADVNLKMPRNNQLLHFAFREDKQWKLQQIQDARNHVSQAIYLLTSRDQSYQFKTGAEVLKLMDAVMLQLTRARNRLTTPATLTLPEIAASGLTRMFAPALPSDLLVNVYINLNKLCLTVYQLHALQPNSTKNFRPAGGAVLHSPGAMFEWGSQRLEVSHVHKVECVIPWLNDALVYFTVSLQLCQQLKDKISVFSSYWSYRPF

SEQ ID NO: 881696 - protein, 272 aa, Homo sapiens
GFWKEHWAGPEWALPAPLLPSVPQEASLRFTLPGSGTEGPAKQENFILGSCGTDQVKGVLTLQGDALSQADVNLKMPRNNQLLHFAFREDKQWKLQQIQDARNHVSQAIYLLTSRDQSYQFKTGAEVLKLMDAVMLQLTRARNRLTTPATLTLPEIAASGLTRMFAPALPSDLLVNVYINLNKLCLTVYQLHALQPNSTKNFRPAGGAVLHSPGAMFEWGSQRLEVSHVHKVECVIPWLNDALVYFTVSLQLCQQLKDKISVFSSYWSYRPF

SEQ ID NO: 881697 - protein, 433 aa, Homo sapiens
ELRPQAGAPGWCRPRPWPAGASLTRAAAGRVLARRSEPHSRSRQSGSRLPQVSGAEADRQAPANREHGAGLGAGWYPLRQSGGGGARRRGRTGGPEDRGQKDWWTGAAAGGEGARRRPAAMATVMAATAAERAVLEEEFRWLLHDEVHAVLKQLQDILKEASLRFTLPGSGTEGPAKQENFILGSCGTDQVKGVLTLQGDALSQADVNLKMPRNNQLLHFAFREDKQWKLQQIQDARNHVSQAIYLLTSRDQSYQFKTGAEVLKLMDAVMLQLTRARNRLTTPATLTLPEIAASGLTRMFAPALPSDLLVNVYINLNKLCLTVYQLHALQPNSTKRVGLSAPGGEPRAQSGVRDPLAQRRPGLLHRLPAALPAAQGQDLRVLQLLELQTLLITAPRSLSPGRRPRPLLIPTTEHQPVPTPGCYLSPYPTPYPT

SEQ ID NO: 881698 - protein, 614 aa, Homo sapiens
MGDWMTVTDPGLSSESKTISQYTSETKMSPSSLYSQQVLCSSIPLSKNVHSFFSAFCTEDNIEQSISYLDQELTTFGFPSLYEESKGKETKRELNIVAVLNCMNELLVLQRKNLLAQENVETQNLKLGSDMDHLQSCYSKLKEQLETSRREMIGLQERDRQLQCKNRNLHQLLKNEKDEVQKLQNIIASRATQYNHDMKRKEREYNKLKERLHQLVMNKKDKKIAMDILNYVGRADGKRGSWRTGKTEARNEDEMYKILLNDYEYRQKQILMENAELKKVLQQMKKEMISLLSPQKKKPRERVDDSTGTVISDVEEDAGELSRESMWDLSCETVREQLTNSIRKQWRILKSHVEKLDNQVSKVHLEGFNDEDVISRQDHEQETEKLELEIQQCKEMIKTQQQLLQQQLATAYDDDTTSLLRDCYLLEEKERLKEEWSLFKEQKKNFERERRSFTEAAIRLGLERKAFEEERASWLKQQFLNMTTFDHQNSENVKLFSAFSGSSDWDNLIVHSRQPQKKPHSVSNGSPVCMSKLTKSLPASPSTSDFCQTRSCISEHSSINVLNITAEEIKPNQVGGERTNQKWSVASRPGSQEGCYSGCSLSYTNSHVEKDDLP

SEQ ID NO: 881699 - protein, 614 aa, Homo sapiens; identical to SEQ ID NO: 881698

SEQ ID NO: 881700 - protein, 614 aa, Homo sapiens; identical to SEQ ID NO: 881698

SEQ ID NO: 881701 - protein, 614 aa, Homo sapiens; identical to SEQ ID NO: 881698

SEQ ID NO: 881702 - protein, 654 aa, Homo sapiens
RAGVGAGKGRARAEVEPAPGSAPRCSAGGSARLLGPLQGAGERRPGPLLEEEVGESKTISQYTSETKMSPSSLYSQQVLCSSIPLSKNVHSFFSAFCTEDNIEQSISYLDQELTTFGFPSLYEESKGKETKRELNIVAVLNCMNELLVLQRKNLLAQENVETQNLKLGSDMDHLQSCYSKLKEQLETSRREMIGLQERDRQLQCKNRNLHQLLKNEKDEVQKLQNIIASRATQYNHDMKRKEREYNKLKERLHQLVMNKKDKKIAMDILNYVGRADGKRGSWRTGKTEARNEDEMYKILLNDYEYRQKQILMENAELKKVLQQMKKEMISLLSPQKKKPRERVDDSTGTVISDVEEDAGELSRESMWDLSCETVREQLTNSIRKQWRILKSHVEKLDNQVSKVHLEGFNDEDVISRQDHEQETEKLELEIQQCKEMIKTQQQLLQQQLATAYDDDTTSLLRDCYLLEEKERLKEEWSLFKEQKKNFERERRSFTEAAIRLGLERKAFEEERASWLKQQFLNMTTFDHQNSENVKLFSAFSGSSDWDNLIVHSRQPQKKPHSVSNGSPVCMSKLTKSLPASPSTSDFCQTRSCISEHSSINVLNITAEEIKPNQVGGERTNQKWSVASRPGSQEGCYSGCSLSYTNSHVEKDDLP

SEQ ID NO: 881703 - protein, 538 aa, Homo sapiens
MNELLVLQRKNLLAQENVETQNLKLGSDMDHLQSCYSKLKEQLETSRREMIGLQERDRQLQCKNRNLHQLLKNEKDEVQKLQNIIASRATQYNHDMKRKEREYNKLKERLHQLVMNKKDKKIAMDILNYVGRADGKRGSWRTGKTEARKVQFKLINVIRLPSILHFHTDSFFLRNEDEMYKILLNDYEYRQKQILMENAELKKVLQQMKKEMISLLSPQKKKPRERVDDSTGTVISDVEEDAGELSRESMWDLSCETVREQLTNSIRKQWRILKSHVEKLDNQVSKVHLEGFNDEDVISRQDHEQETEKLELEIQQCKEMIKTQQQLLQQQLATAYDDDTTSLLRDCYLLEEKERLKEEWSLFKEQKKNFERERRSFTEAAIRLGLERKAFEEERASWLKQQFLNMTTFDHQNSENVKLFSAFSGSSDWDNLIVHSRQPQKKPHSVSNGSPVCMSKLTKSLPASPSTSDFCQTRSCISEHSSINVLNITAEEIKPNQVGGERTNQKWSVASRPGSQEGCYSGCSLSYTNSHVEKDDLP

SEQ ID NO: 881704 - protein, 512 aa, Homo sapiens [sequence omitted]

SEQ ID NO: 881705 - protein, 512 aa, Homo sapiens [sequence omitted]

SEQ ID NO: 881706 - protein, 512 aa, Homo sapiens [sequence omitted]

SEQ ID NO: 881707 - protein, 614 aa, Homo sapiens; identical to SEQ ID NO: 881698

SEQ ID NO: 881708 - protein, 587 aa, Homo sapiens
MSPSSLYSQQVLCSSIPLSKNVHSFFSAFCTEDNIEQSISYLDQELTTFGFPSLYEESKGKETKRELNIVAVLNCMNELLVLQRKNLLAQENVETQNLKLGSDMDHLQSCYSKLKEQLETSRREMIGLQERDRQLQCKNRNLHQLLKNEKDEVQKLQNIIASRATQYNHDMKRKEREYNKLKERLHQLVMNKKDKKIAMDILNYVGRADGKRGSWRTGKTEARNEDEMYKILLNDYEYRQKQILMENAELKKVLQQMKKEMISLLSPQKKKPRERVDDSTGTVISDVEEDAGELSRESMWDLSCETVREQLTNSIRKQWRILKSHVEKLDNQVSKVHLEGFNDEDVISRQDHEQETEKLELEIQQCKEMIKTQQQLLQQQLATAYDDDTTSLLRDCYLLEEKERLKEEWSLFKEQKKNFERERRSFTEAAIRLGLERKAFEEERASWLKQQFLNMTTFDHQNSENVKLFSAFSGSSDWDNLIVHSRQPQKKPHSVSNGSPVCMSKLTKSLPASPSTSDFCQTRSCISEHSSINVLNITAEEIKPNQVGGERTNQKWSVASRPGSQEGCYSGCSLSYTNSHVEKDDLP

SEQ ID NO: 881709 - protein, 512 aa, Homo sapiens [sequence omitted]

SEQ ID NO: 881710 - protein, 609 aa, Homo sapiens
MPSDPPFNTRRAYTSEDEAWKSYLENPLTAATKAMMIINGDEDSAAALGLLYDYYKVPRDKRLLSVSKASDSQEDQEKRNCLGTSEAQSNLSGGENRVQVLKTVPVNLSLNQDHLENSKREQYSISFPESSAIIPVSGITVVKAEDFTPVFMAPPVHYPRGDGEEQRVVIFEQTQYDVPSLATHSAYLKDDQRSTPDSTYSESFKDAATEKFRSASVGAEEYMYDQTSSGTFQYTLEATKSLRQKQGEGPMTYLNKGQFYAITLSETGDNKCFRHPISKVRSVVMVVFSEDKNRDEQLKYWKYWHSRQHTAKQRVLDIADYKESFNTIGNIEEIAYNAVSFTWDVNEEAKIFITVNCLSTDFSSQKGVKGLPLMIQIDTYSYNNRSNKPIHRAYCQIKVFCDKGAERKIRDEEQKQNRKKGKGQASQTQCNSSSDGKLAAIPLQKKSDITYFKTMPDLHSQPVLFIPDVHFANLQRTGQVYYNTDDEREGGSVLVKRMFRPMEEEFGPVPSKQMKEEGTKRVLLYVRKETDDVFDALMLKSPTVKGLMEAISEKYGLPVEKIAKLYKKSKKGILVNMDDNIIEHYSNEDTFILNMESMVEGFKVTLMEI

SEQ ID NO: 881711 - protein, 112 aa, Homo sapiens [sequence omitted]

SEQ ID NO: 881712 - protein, 619 aa, Homo sapiens
IGSNMSQESDNNKRLVALVPMPSDPPFNTRRAYTSEDEAWKSYLENPLTAATKAMMIINGDEDSAAALGLLYDYYKVPRDKRLLSVSKASDSQEDQEKRNCLGTSEAQSNLSGGENRVQVLKTVPVNLSLNQDHLENSKREQYSISFPESSAIIPVSGITVVKAEDFTPVFMAPPVHYPRGDGEEQRVVIFEQTQYDVPSLATHSAYLKDDQRSTPDSTYSESFKDAATEKFRSASVGAEEYMYDQTSSGTFQYTLEATKSLRQKQGEGPMTYLNKGQFYAITLSETGDNKCFRHPISKVRSVVMVVFSEDKNRDEQLKYWKYWHSRQHTAKQRVLDIADYKESFNTIGNIEEIAYNAVSFTWDVNEEAKIFITVNCLSTDFSSQKGVKGLPLMIQIDTYSYNNRSNKPIHRAYCQIKVFCDKGAERKIRDEEQKQNRKKGKGQASQTQCNSSSDGKLAAIPLQKKSDITYFKTMPDLHSQPVLFIPDVHFANLQRTGQVYYNTDDEREGGSVLVKRMFRPMEEEFGPVPSKQMKEEGTKRGISPAGACPLRRDAGCLSQEELASPLAQAPMALCQPGDFLFTQEVHSLLLCFKLCPFNTLRKHLSFLGAGSFLCLGRT

SEQ ID NO: 881713 - protein, 629 aa, Homo sapiens
IGSNMSQESDNNKRLVALVPMPSDPPFNTRRAYTSEDEAWKSYLENPLTAATKAMMIINGDEDSAAALGLLYDYYKVPRDKRLLSVSKASDSQEDQEKRNCLGTSEAQSNLSGGENRVQVLKTVPVNLSLNQDHLENSKREQYSISFPESSAIIPVSGITVVKAEDFTPVFMAPPVHYPRGDGEEQRVVIFEQTQYDVPSLATHSAYLKDDQRSTPDSTYSESFKDAATEKFRSASVGAEEYMYDQTSSGTFQYTLEATKSLRQKQGEGPMTYLNKGQFYAITLSETGDNKCFRHPISKVRSVVMVVFSEDKNRDEQLKYWKYWHSRQHTAKQRVLDIADYKESFNTIGNIEEIAYNAVSFTWDVNEEAKIFITVNCLSTDFSSQKGVKGLPLMIQIDTYSYNNRSNKPIHRAYCQIKVFCDKGAERKIRDEEQKQNRKKGKGQASQTQCNSSSDGKLAAIPLQKKSDITYFKTMPDLHSQPVLFIPDVHFANLQRTGQVYYNTDDEREGGSVLVKRMFRPMEEEFGPVPSKQMKEEGTKRVLLYVRKETDDVFDALMLKSPTVKGLMEAISEKYGLPVEKIAKLYKKSKKGILVNMDDNIIEHYSNEDTFILNMESMVEGFKVTLMEI

SEQ ID NO: 881714 - protein, 543 aa, Homo sapiens
IGSNMSQESDNNKRLVALVPMPSDPPFNTRRAYTSEDEAWKSYLENPLTAATKAMMIINGDEDSAAALGLLYDYYKVPRDKRLLSVSKASDSQEDQEKRNCLGTSEAQSNLSGGENRVQVLKTVPVNLSLNQDHLENSKREQYSISFPESSAIIPVSGITVVKAEDFTPVFMAPPVHYPRGDGEEQRVVIFEQTQYDVPSLATHSAYLKDDQRSTPDSTYSESFKDAATEKFRSASVGAEEYMYDQTSSGTFQYTLEATKSLRQKQGEGPMTYLNKGQFYAITLSETGDNKCFRHPISKVRSVVMVVFSEDKNRDEQLKYWKYWHSRQHTAKQRVLDIADYKESFNTIGNIEEIAYNAVSFTWDVNEEAKIFITVNCLSTDFSSQKGVKGLPLMIQIDTYSYNNRSNKPIHRAYCQIKVFCDKGAERKIRDEEQKQNRKKGKGQASQTQCNSSSDGKLAAIPLQKKSDITYFKTMPDLHSQPVLFIPDVHFANLQRTGQVYYNTDDEREGGSVLVKRMFRPMEEEFGPVPSKQMKEEGTKRDI

SEQ ID NO: 881715 - protein, 119 aa, Homo sapiens
IGSNMSQESDKKVDHTRRLLLLLPLWADGNCNKRLVALVPMPSDPPFNTRRAYTSEDEAWKSYLENPLTAATKAMMIINGDEDSAAALGLLYDYYKVPRDKRLLSVSKASDSQEDQEKR

SEQ ID NO: 881716 - protein, 344 aa, Homo sapiens
VLFLFSVLDRVPDGPVFIAMCFLVRVMDAVSFAAAMTASSSILAKAFPNNVATVLGSLETFSGLGLILGPPVGGFLYQSFGYEVPFIVLGCVVLLMVPLNMYILPNYESDPGEHSFWKLIALPKVGLIAFVINSLSSCFGFLDPTLSLFVLEKFNLPAGYVGLVFLGMALSYAISSPLFGLLSDKRPPLRKWLLVFGNLITAGCYMLLGPVPILHIKSQLWLLVLILVVSGLSAGMSIIPTFPEILSCAHENGFEEGLSTLGLVSGLFSAMWSIGAFMGPTLGGFLYEKIGFEWAAAIQGLWALISGLAMGLFYLLEYSRRKRSKSQNILSTEEERTTLLPNET

SEQ ID NO: 881717 - protein, 215 aa, Homo sapiens
VGANTLYSVLASDWRSPAVGASAPDRGTPPLSYETQFSKTTDSDISSPLFGLLSDKRPPLRKWLLVFGNLITAGCYMLLGPVPILHIKSQLWLLVLILVVSGLSAGMSIIPTFPEILSCAHENGFEEGLSTLGLVSGLFSAMWSIGAFMGPTLGGFLYEKIGFEWAAAIQGLWALISGLAMGLFYLLEYSRRKRSKSQNILSTEEERTTLLPNET

SEQ ID NO: 881718 - protein, 344 aa, Homo sapiens; identical to SEQ ID NO: 881716

SEQ ID NO: 881719 - protein, 344 aa, Homo sapiens; identical to SEQ ID NO: 881716

SEQ ID NO: 881720 - protein, 111 aa, Homo sapiens
VQGRGLKPGAGAPESTHRGWRRWVTWRDHAHQEVTMNCVAGSPETSGGFRRVSLATIELLIAVICFREIGKGWGLIVGFGPAFLFSLDGVKFQDWICVTVSNDFLTYTSAF

SEQ ID NO: 881721 - protein, 293 aa, Homo sapiens
VAPWRSSPRTWLEAGSWGAGVHAPGMEALGDLEGPRAPGGDDPAGSAGETPGWLSREQVFVLISAASVNLGSMMCYSILGPFFPKEAEKKGASNTIIGMIFGFNLPAGYVGLVFLGMALSYAISSPLFGLLSDKRPPLRKWLLVFGNLITAGCYMLLGPVPILHIKSQLWLLVLILVVSGLSAGMSIIPTFPEILSCAHENGFEEGLSTLGLVSGLFSAMWSIGAFMGPTLGGFLYEKIGFEWAAAIQGLWALISGLAMGLFYLLEYSRRKRSKSQNILSTEEERTTLLPNET

SEQ ID NO: 881722 - protein, 285 aa, Homo sapiens
VLFLFSVLDRVPDGPVFIAMCFLVRVMDAVSFAAAMTASSSILAKAFPNNVATVLGSLETFSGLGLILGPPVGGFLYQSFGYEVPFIVLGCVVLLMVPLNMYILPNYESDPGEHSFWKLIALPKVGLIAFVINSLSSCFGFLDPTLSLFVLEKFNLPAGYVGLVFLGMALSYAISSPLFGLLSDKRPPLRKWLLVFGNLITAGCYMLLGPVPILHIKSQLWLLVLILVVSGLSAGMSIIPTFPEILSCAHFTLITQAGVQWCDLGSLQPPPPRSKRFFYLSLLSS

SEQ ID NO: 881723 - protein, 79 aa, Homo sapiens
EPGIPDSLQAAIRPALELRKAFRGPRASVLEVSTCFWMILYWAVLTVILKSCPAEAAIFEILSMKGVIKNKQNKTRLSF

SEQ ID NO: 881724 - protein, 329 aa, Homo sapiens
VLFLFSVLDRVPDGPVFIAMCFLVRVMDAVSFAAAMTASSSILAKAFPNNVATVLGSLETFSGLGLILGPPVGGFLYQSFGYEVPFIVLGCVVLLMVPLNMYILPNYESDPGEHSFWKLIALPKVGLIAFVINSLSSCFGFLDPTLSLFVLEKFNLPAGYVGLVFLGMALSYAISSPLFGLLSDKRPPLRKWLLVFGNLITAGCYMLLGPVPILHIKSQLWLLVLILVVSGLSAGMSIIPTFPEILSCAHENGFEEGLSTLGLVSGLFSAMWSIGAFMGPTLGGFLYEKIGFEWAAAIQGLWALISVSNQSFICIFLIFVEKLDLENLH

SEQ ID NO: 881725 - protein, 499 aa, Homo sapiens
MTVATGDPADEAAALPGHPQDTYDPEADHECCERVVINISGLRFETQLKTLAQFPETLLGDPKKRMRYFDPLRNEYFFDRNRPSFDAILYYYQSGGRLRRPVNVPLDIFSEEIRFYELGEEAMEMFREDEGYIKEEERPLPENEFQRQVWLLFEYPESSGPARIIAIVSVMVILISIVSFCLETLPIFRDENEDMHGSGVTFHTYSNSTIGYQQSTSFTDPFFIVETLCIIWFSFEFLVRFFACPSKAGFFTNIMNIIDIVAIIPYFITLGTELAEKPEDAQQGQQAMSLAILRVIRLVRVFRIFKLSRHSKGLQILGQTLKASMRELGLLIFFLFIGVILFSSAVYFAEADERESQFPSIPDAFWWAVVSMTTVGYGDMVPTTIGGKIVGSLCAIAGVLTIALPVPVIVSNFNYFYHRETEGEEQAQYLQVTSCPKIPSSPDLKKSRSASTISKSDYMEIQEGVNNSNEDFREENLKTANCTLANTNYVNITKMLTDV

SEQ ID NO: 881726 - protein, 114 aa, Homo sapiens
IVSPLLYTVAMSDRKCVELVTGSWIGGIVNTLIHTISLRRLSFCRLNAVSHFFCDIPSLLKLSCSDTSMNELLLLTFSGVIAMATFLTVIISYIFIAFASLRIHSASGRQQAFS

SEQ ID NO: 881727 - protein, 218 aa, Homo sapiens
EELKPLEEVLNLAQSKNFHLRPRDLISNINVIVLELKMAGQCSQNEYFDSLLHACIPCQLRCSSNTPPLTCQRYCNASVTNSVKGTNAILWTCLGLSLIISLAVFVLMFLLRKISSEPLKDEFKNTGSGLLGMANIDLEKSRTGDEIILPRGLEYTVEECTCEDCIKSKPKVDSDHCFPLPAMEEGATILVTTKTNDYCKSLPAALSATEIEKSISAR

SEQ ID NO: 881728 - protein, 106 aa, Homo sapiens
QLYALMIACCPWVRCSVLAELIWPRSGVANHMVRNRATDTTRPSRSEMQTRKQKLLGIRRCGEQHSTQRSEERGACWEEGLAMVCSWISGSSPHWSTCVPTTDSLT

SEQ ID NO: 881729 - protein, 255 aa, Homo sapiens
MILNKALMLGALALTTVMSPCGGEDIVADHVASYGVNLYQSYGPSGQYSHEFDGDEEFYVDLERKETVWQLPLFRRFRRFDPQFALTNIAVLKHNLNIVIKRSNSTAATNEVPEVTVFSKSPVTLGQPNTLICLVDNIFPPVVNITWLSNGHSVTEGVSETSFLSKSDHSFFKISYLTFLPSADEIYDCKVEHWGLDEPLLKHWEPEIPTPMSELTETVVCALGLSVGLVGIVVGTVLIIRGLRSVGASRHQGPL

SEQ ID NO: 881730 - protein, 255 aa, Homo sapiens; identical to SEQ ID NO: 881729

SEQ ID NO: 881731 - protein, 255 aa, Homo sapiens; identical to SEQ ID NO: 881729

SEQ ID NO: 881732 - protein, 255 aa, Homo sapiens; identical to SEQ ID NO: 881729

SEQ ID NO: 881733 - protein, 281 aa, Homo sapiens
MAVAKHNLNIMIKRYNSTAATNEVPEVTVFSKSPVTLGQPNTLICLVEVKDIVADHVASYGVNLYQSYGPSGQYSHEFDGDEEFYVDLERKETVWQLPLFRRFRRFDPQFALTNIAVLKHNLNIVIKRSNSTAATNEVPEVTVFSKSPVTLGQPNTLICLVDNIFPPVVNITWLSNGHSVTEGVSETSFLSKSDHSFFKISYLTFLPSADEIYDCKVEHWGLDEPLLKHWEPEIPTPMSELTETVVCALGLSVGLVGIVVGTVLIIRGLRSVGASRHQGPL

SEQ ID NO: 881734 - protein, 214 aa, Homo sapiens
RVIISDLSFRVVHDELVYRNSGPDLTVWQLPLFRRFRRFDPQFALTNIAVLKHNLNIVIKRSNSTAATNEVPEVTVFSKSPVTLGQPNTLICLVDNIFPPVVNITWLSNGHSVTEGVSETSFLSKSDHSFFKISYLTFLPSADEIYDCKVEHWGLDEPLLKHWEPEIPTPMSELTETVVCALGLSVGLVGIVVGTVLIIRGLRSVGASRHQGPL

SEQ ID NO: 881735 - protein, 208 aa, Homo sapiens
MILNKALMLGALALTTVMSPCGGEDIVADHVASYGVNLYQSYGPSGQYSHEFDGDEEFYVDLERKETVWQLPLFRRFRRFDPQFALTNIAVLKHNLNIVIKRSNSTAATNEVPEVTVFSKSPVTLGQPNTLICLVDNIFPPVVNITWLSNGHSVTEGVSETSFLSKSDHSFFKISYLTFLPSADEIYDCKVEHWGLDEPLLKHWGVTY

SEQ ID NO: 881736 - protein, 160 aa, Homo sapiens
MILNKALMLGALALTTVMSPCGGEDIVADHVASYGVNLYQSYGPSGQYSHEFDGDEEFYVDLERKETVWQLPLFRRFRRFDPQFALTNIAVLKHNLNIVIKRSNSTAATNGTQSQKVFLRPASSPRVIIPSSRSVTSPSSLLLMRFMTARWSTGAWMSLF

SEQ ID NO: 881737 - protein, 77 aa, Homo sapiens
VRGLAQVIYDCKVEHWGLDEPLLKHWEPEIPTPMSELTETVVCALGLSVGLVGIVVGTVLIIRGLRSVGASRHQGPL

SEQ ID NO: 881738 - protein, 258 aa, Homo sapiens
MILNKALMLGALALTTVMSPCGGEDIVADHVASYGVNLYQSYGPSGQYSHEFDGDEEFYVDLERKETVWQLPLFRRFRRFDPQFALTNIAVLKHNLNIVIKRSNSTAATNGEEMLVGRLFQDVMQKKLRAELFTLYTSAVFLTIEVPEVTVFSKSPVTLGQPNTLICLVDNIFPPVVNITWLSNGHSVTEGVSETSFLSKSDHSFFKISYLTFLPSADEIYDCKVEHWGLDEPLLKHWGLFDWGPENSDLCSSWGCAW

SEQ ID NO: 881739 - protein, 255 aa, Homo sapiens; identical to SEQ ID NO: 881729

SEQ ID NO: 881740 - protein, 255 aa, Homo sapiens; identical to SEQ ID NO: 881729

SEQ ID NO: 881741 - protein, 255 aa, Homo sapiens; identical to SEQ ID NO: 881729

SEQ ID NO: 881742 - protein, 255 aa, Homo sapiens; identical to SEQ ID NO: 881729

SEQ ID NO: 881743 - protein, 208 aa, Homo sapiens; identical to SEQ ID NO: 881735

SEQ ID NO: 881744 - protein, 129 aa, Homo sapiens
MPNTLICLVDNIFPPVVNITWLSNGHSVTEGVSETSFLSKSDHSFFKISYLTFLPSADEIYDCKVEHWGLDEPLLKHWEPEIPTPMSELTETVVCALGLSVGLVGIVVGTVLIIRGLRSVGASRHQGPL

SEQ ID NO: 881745 - protein, 210 aa, Homo sapiens
MILNKALMLGALALTTVMSPCGGEDIVADHVASYGVNLYQSYGPSGQYSHEFDGDEEFYVDLERKETVWQLPLFRRFRRFDPQFALTNIAVLKHNLNIVIKRSNSTAATNEVPEVTVFSKSPVTLGQPNTLICLVDNIFPPVVNITWLSNGHSVTEGVSETSFLSKSDHSFFKISYLTFLPSADEIYDCKVEHWGLDEPLLKHWGWCPPM

SEQ ID NO: 881746 - protein, 129 aa, Homo sapiens; identical to SEQ ID NO: 881744

SEQ ID NO: 881747 - protein, 270 aa, Homo sapiens
MQAMIRAMETLKILYKLEQNKANALQIREVDVEKVTTFEHRYVSAIKTLWDDPGIHECYDRRREYQLSDSAKYCVTDVDCIATSSYLPTQQDVLRVRVPTTGRTFDLENIIFRMADVGGQRSAQRKWIHCFENLTSIPFLVALSEYDQVLVESDNENRMEESKALFRTIIDYPWFQNSPVITFLNKKDLLEDNILYSHMVDYFPEFEGPQQDAQAAREFILKMLVDMNPDSDKIIDSHFTYATDTKNIRFVFAAVKDTILQLSLKEYNLV

SEQ ID NO: 881748 - protein, 144 aa, Homo sapiens
MLLAMVLTSALLLCSVAGQGCPTLAGILDINFLINKMQEDPASKCHCSANVTSCLCLGIPSDNCTRPCFSERLSQMTNTTMQTRYPLIFSRVKKSVEVLKNNKCPYFSCEQPCNQTTAGNALTFLKSLLEIFQKEKMRGMRGKI

SEQ ID NO: 881749 - protein, 1675 aa, Homo sapiens
MAQILPIRFQEHLQLQNLGINPANIGFSTLTMESDKFICIREKVGEQAQVVIIDMNDPSNPIRRPISADSAIMNPASKVIALKAGKTLQIFNIEMKSKMKAHTMTDDVTFWKWISLNTVALVTDNAVYHWSMEGESQPVKMFDRHSSLAGCQIINYRTDAKQKWLLLTGISAQQNRVVGAMQLYSVDRKVSQPIEGHAASFAQFKMEGNAEESTLFCFAVRGQAGGKLHIIEVGTPPTGNQPFPKKAVDVFFPPEAQNDFPVAMQISEKHDVVFLITKYGYIHLYDLETGTCIYMNRISGETIFVTAPHEATAGIIGVNRKGQVLSVCVEEENIIPYITNVLQNPDLALRMAVRNNLAGAEELFARKFNALFAQGNYSEAAKVAANAPKGILRTPDTIRRFQSVPAQPGQTSPLLQYFGILLDQGQLNKYESLELCRPVLQQGRKQLLEKWLKEDKLECSEELGDLVKSVDPTLALSVYLRANVPNKVIQCFAETGQVQKIVLYAKKVGYTPDWIFLLRNVMRISPDQGQQFAQMLVQDEEPLADITQIVDVFMEYNLIQQCTAFLLDALKNNRPSEGPLQTRLLEMNLMHAPQVADAILGNQMFTHYDRAHIAQLCEKAGLLQRALEHFTDLYDIKRAVVHTHLLNPEWLVNYFGSLSVEDSLECLRAMLSANIRQNLQICVQVASKYHEQLSTQSLIELFESFKSFEGLFYFLGSIVNFSQDPDVHFKYIQAACKTGQIKEVERICRESNCYDPERVKNFLKEAKLTDQLPLIIVCDRFDFVHDLVLYLYRNNLQKYIEIYVQKVNPSRLPVVIGGLLDVDCSEDVIKNLILVVRGQFSTDELVAEVEKRNRLKLLLPWLEARIHEGCEEPATHNALAKIYIDSNNNPERFLRENPYYDSRVVGKYCEKRDPHLACVAYERGQCDLELINVCNENSLFKSLSRYLVRRKDPELWGSVLLESNPYRRPLIDQVVQTALSETQDPEEVSVTVKAFMTADLPNELIELLEKIVLDNSVFSEHRNLQNLLILTAIKADRTRVMEYINRLDNYDAPDIANIAISNELFEEAFAIFRKFDVNTSAVQVLIEHIGNLDRAYEFAERCNEPAVWSQLAKAQLQKGMVKEAIDSYIKADDPSSYMEVVQAANTSGNWEELVKYLQMARKKARESYVETELIFALAKTNRLAELEEFINGPNNAHIQQVGDRCYDEKMYDAAKLLYNNVSNFGRLASTLVHLGEYQAAVDGARKANSTRTWKEVCFACVDGKEFRLAQMCGLHIVVHADELEELINYYQDRGYFEELITMLEAALGLERAHMGMFTELAILYSKFKPQKMREHLELFWSRVNIPKVLRAAEQAHLWAELVFLYDKYEEYDNAIITMMNHPTDAWKEGQFKDIITKVANVELYYRAIQFYLEFKPLLLNDLLMVLSPRLDHTRAVNYFSKVKQLPLVKPYLRSVQNHNNKSVNESLNNLFITEEDYQALRTSIDAYDNFDNISLAQRLEKHELIEFRRIAAYLFKGNNRWKQSVELCKKDSLYKDAMQYASESKDTELAEELLQWFLQEEKRECFGACLFTCYDLLRPDVVLETAWRHNIMDFAMPYFIQVMKEYLTKVDKLDASESLRKEEEQATETQPIVYGQPQLMLTAGPSVAVPPQAPFGYGYTAPPYGQPQPGFGYSM

SEQ ID NO: 881750 - protein, 1675 aa, Homo sapiens; identical to SEQ ID NO: 881749

SEQ ID NO: 881751 - protein, 1723 aa, Homo sapiens
MAQILPIRFQEHLQLQNLGINPANIGFSTLTMESDKFICIREKVGEQAQVVIIDMNDPSNPIRRPISADSAIMNPASKVIALKAGKTLQIFNIEMKSKMKAHTMTDDVTFWKWISLNTVALVTDNAVYHWSMEGESQPVKMFDRHSSLAGCQIINYRTDAKQKWLLLTGISAQQNRVVGAMQLYSVDRKVSQPIEGHAASFAQFKMEGNAEESTLFCFAVRGQAGGKLHIIEVGTPPTGNQPFPKKAVDVFFPPEAQNDFPVAMQISEKHDVVFLITKYGYIHLYDLETGTCIYMNRISGETIFVTAPHEATAGIIGVNRKGQKLSTLEDTGAFSVSCSRSYYGLVARNLLEQSLSMITIKLWIQYVGKPKVLSVCVEEENIIPYITNVLQNPDLALRMAVRNNLAGAEELFARKFNALFAQGNYSEAAKVAANAPKGILRTPDTIRRFQSVPAQPGQTSPLLQYFGILLDQGQLNKYESLELCRPVLQQGRKQLLEKWLKEDKLECSEELGDLVKSVDPTLALSVYLRANVPNKVIQCFAETGQVQKIVLYAKKVGYTPDWIFLLRNVMRISPDQGQQFAQMLVQDEEPLADITQIVDVFMEYNLIQQCTAFLLDALKNNRPSEGPLQTRLLEMNLMHAPQVADAILGNQMFTHYDRAHIAQLCEKAGLLQRALEHFTDLYDIKRAVVHTHLLNPEWLVNYFGSLSVEDSLECLRAMLSANIRQNLQICVQVASKYHEQLSTQSLIELFESFKSFEGLFYFLGSIVNFSQDPDVHFKYIQAACKTGQIKEVERICRESNCYDPERVKNFLKEAKLTDQLPLIIVCDRFDFVHDLVLYLYRNNLQKYIEIYVQKVNPSRLPVVIGGLLDVDCSEDVIKNLILVVRGQFSTDELVAEVEKRNRLKLLLPWLEARIHEGCEEPATHNALAKIYIDSNNNPERFLRENPYYDSRVVGKYCEKRDPHLACVAYERGQCDLELINVCNENSLFKSLSRYLVRRKDPELWGSVLLESNPYRRPLIDQVVQTALSETQDPEEVSVTVKAFMTADLPNELIELLEKIVLDNSVFSEHRNLQNLLILTAIKADRTRVMEYINRLDNYDAPDIANIAISNELFEEAFAIFRKFDVNTSAVQVLIEHIGNLDRAYEFAERCNEPAVWSQLAKAQLQKGMVKEAIDSYIKADDPSSYMEVVQAANTSGNWEELVKYLQMARKKARESYVETELIFALAKTNRLAELEEFINGPNNAHIQQVGDRCYDEKMYDAAKLLYNNVSNFGRLASTLVHLGEYQAAVDGARKANSTRTWKEVCFACVDGKEFRLAQMCGLHIVVHADELEELINYYQDRGYFEELITMLEAALGLERAHMGMFTELAILYSKFKPQKMREHLELFWSRVNIPKVLRAAEQAHLWAELVFLYDKYEEYDNAIITMMNHPTDAWKEGQFKDIITKVANVELYYRAIQFYLEFKPLLLNDLLMVLSPRLDHTRAVNYFSKVKQLPLVKPYLRSVQNHNNKSVNESLNNLFITEEDYQALRTSIDAYDNFDNISLAQRLEKHELIEFRRIAAYLFKGNNRWKQSVELCKKDSLYKDAMQYASESKDTELAEELLQWFLQEEKRECFGACLFTCYDLLRPDVVLETAWRHNIMDFAMPYFIQVMKEYLTKVDKLDASESLRKEEEQATETQPIVYGQPQLMLTAGPSVAVPPQAPFGYGYTAPPYGQPQPGFGYSM

SEQ ID NO: 881752 - protein, 1675 aa, Homo sapiens; identical to SEQ ID NO: 881749

SEQ ID NO: 881753 - protein, 1113 aa, Homo sapiens
IDTRGSPKSIGQSKCPFRRTLILHITLMTCACVADAILGNQMFTHYDRAHIAQLCEKAGLLQRALEHFTDLYDIKRAVVHTHLLNPEWLVNYFGSLSVEDSLECLRAMLSANIRQNLQICVQVASKYHEQLSTQSLIELFESFKSFEGLFYFLGSIVNFSQDPDVHFKYIQAACKTGQIKEVERICRESNCYDPERVKNFLKEAKLTDQLPLIIVCDRFDFVHDLVLYLYRNNLQKYIEIYVQKVNPSRLPVVIGGLLDVDCSEDVIKNLILVVRGQFSTDELVAEVEKRNRLKLLLPWLEARIHEGCEEPATHNALAKIYIDSNNNPERFLRENPYYDSRVVGKYCEKRDPHLACVAYERGQCDLELINVCNENSLFKSLSRYLVRRKDPELWGSVLLESNPYRRPLIDQVVQTALSETQDPEEVSVTVKAFMTADLPNELIELLEKIVLDNSVFSEHRNLQNLLILTAIKADRTRVMEYINRLDNYDAPDIANIAISNELFEEAFAIFRKFDVNTSAVQVLIEHIGNLDRAYEFAERCNEPAVWSQLAKAQLQKGMVKEAIDSYIKADDPSSYMEVVQAANTSGNWEELVKYLQMARKKARESYVETELIFALAKTNRLAELEEFINGPNNAHIQQVGDRCYDEKMYDAAKLLYNNVSNFGRLASTLVHLGEYQAAVDGARKANSTRTWKEVCFACVDGKEFRLAQMCGLHIVVHADELEELINYYQDRGYFEELITMLEAALGLERAHMGMFTELAILYSKFKPQKMREHLELFWSRVNIPKVLRAAEQAHLWAELVFLYDKYEEYDNAIITMMNHPTDAWKEGQFKDIITKVANVELYYRAIQFYLEFKPLLLNDLLMVLSPRLDHTRAVNYFSKVKQLPLVKPYLRSVQNHNNKSVNESLNNLFITEEDYQALRTSIDAYDNFDNISLAQRLEKHELIEFRRIAAYLFKGNNRWKQSVELCKKDSLYKDAMQYASESKDTELAEELLQWFLQEEKRECFGACLFTCYDLLRPDVVLETAWRHNIMDFAMPYFIQVMKEYLTKVDKLDASESLRKEEEQATETQPIVYGQPQLMLTAGPSVAVPPQAPFGYGYTAPPYGQPQPGFGYSM

SEQ ID NO: 881754 - protein, 930 aa, Homo sapiens
TLRGSPLRYDPERVKNNLKEAKLTDQLPLIIVCDRFDFVHDLVLYLYRNNLQKYIEIYVQKVNPSRLPVVIGGLLDVDCSEDVIKNLILVVRGQFSTDELVAEVEKRNRLKLLLPWLEARIHEGCEEPATHNALAKIYIDSNNNPERFLRENPYYDSRVVGKYCEKRDPHLACVAYERGQCDLELINVCNENSLFKSLSRYLVRRKDPELWGSVLLESNPYRRPLIDQVVQTALSETQDPEEVSVTVKAFMTADLPNELIELLEKIVLDNSVFSEHRNLQNLLILTAIKADRTRVMEYINRLDNYDAPDIANIAISNELFEEAFAIFRKFDVNTSAVQVLIEHIGNLDRAYEFAERCNEPAVWSQLAKAQLQKGMVKEAIDSYIKADDPSSYMEVVQAANTSGNWEELVKYLQMARKKARESYVETELIFALAKTNRLAELEEFINGPNNAHIQQVGDRCYDEKMYDAAKLLYNNVSNFGRLASTLVHLGEYQAAVDGARKANSTRTWKEVCFACVDGKEFRLAQMCGLHIVVHADELEELINYYQDRGYFEELITMLEAALGLERAHMGMFTELAILYSKFKPQKMREHLELFWSRVNIPKVLRAAEQAHLWAELVFLYDKYEEYDNAIITMMNHPTDAWKEGQFKDIITKVANVELYYRAIQFYLEFKPLLLNDLLMVLSPRLDHTRAVNYFSKVKQLPLVKPYLRSVQNHNNKSVNESLNNLFITEEDYQALRTSIDAYDNFDNISLAQRLEKHELIEFRRIAAYLFKGNNRWKQSVELCKKDSLYKDAMQYASESKDTELAEELLQWFLQEEKRECFGACLFTCYDLLRPDVVLETAWRHNIMDFAMPYFIQVMKEYLTKVDKLDASESLRKEEEQATETQPIVYGQPQLMLTAGPSVAVPPQAPFGYGYTAPPYGQPQPGFGYSM

SEQ ID NO: 881755 - protein, 876 aa, Homo sapiens
FYFFLTKVNPSRLPVVIGGLLDVDCSEDVIKNLILVVRGQFSTDELVAEVEKRNRLKLLLPWLEARIHEGCEEPATHNALAKIYIDSNNNPERFLRENPYYDSRVVGKYCEKRDPHLACVAYERGQCDLELINVCNENSLFKSLSRYLVRRKDPELWGSVLLESNPYRRPLIDQVVQTALSETQDPEEVSVTVKAFMTADLPNELIELLEKIVLDNSVFSEHRNLQNLLILTAIKADRTRVMEYINRLDNYDAPDIANIAISNELFEEAFAIFRKFDVNTSAVQVLIEHIGNLDRAYEFAERCNEPAVWSQLAKAQLQKGMVKEAIDSYIKADDPSSYMEVVQAANTSGNWEELVKYLQMARKKARESYVETELIFALAKTNRLAELEEFINGPNNAHIQQVGDRCYDEKMYDAAKLLYNNVSNFGRLASTLVHLGEYQAAVDGARKANSTRTWKEVCFACVDGKEFRLAQMCGLHIVVHADELEELINYYQDRGYFEELITMLEAALGLERAHMGMFTELAILYSKFKPQKMREHLELFWSRVNIPKVLRAAEQAHLWAELVFLYDKYEEYDNAIITMMNHPTDAWKEGQFKDIITKVANVELYYRAIQFYLEFKPLLLNDLLMVLSPRLDHTRAVNYFSKVKQLPLVKPYLRSVQNHNNKSVNESLNNLFITEEDYQALRTSIDAYDNFDNISLAQRLEKHELIEFRRIAAYLFKGNNRWKQSVELCKKDSLYKDAMQYASESKDTELAEELLQWFLQEEKRECFGACLFTCYDLLRPDVVLETAWRHNIMDFAMPYFIQVMKEYLTKVDKLDASESLRKEEEQATETQPIVYGQPQLMLTAGPSVAVPPQAPFGYGYTAPPYGQPQPGFGYSM

SEQ ID NO: 881756 - protein, 625 aa, Homo sapiens
IIEDPPSKPSSNELFEEAFAIFRKFDVNTSAVQVLIEHIGNLDRAYEFAERCNEPAVWSQLAKAQLQKGMVKEAIDSYIKADDPSSYMEVVQAANTSGNWEELVKYLQMARKKARESYVETELIFALAKTNRLAELEEFINGPNNAHIQQVGDRCYDEKMYDAAKLLYNNVSNFGRLASTLVHLGEYQAAVDGARKANSTRTWKEVCFACVDGKEFRLAQMCGLHIVVHADELEELINYYQDRGYFEELITMLEAALGLERAHMGMFTELAILYSKFKPQKMREHLELFWSRVNIPKVLRAAEQAHLWAELVFLYDKYEEYDNAIITMMNHPTDAWKEGQFKDIITKVANVELYYRAIQFYLEFKPLLLNDLLMVLSPRLDHTRAVNYFSKVKQLPLVKPYLRSVQNHNNKSVNESLNNLFITEEDYQALRTSIDAYDNFDNISLAQRLEKHELIEFRRIAAYLFKGNNRWKQSVELCKKDSLYKDAMQYASESKDTELAEELLQWFLQEEKRECFGACLFTCYDLLRPDVVLETAWRHNIMDFAMPYFIQVMKEYLTKVDKLDASESLRKEEEQATETQPIVYGQPQLMLTAGPSVAVPPQAPFGYGYTAPPYGQPQPGFGYSM

SEQ ID NO: 881757 - protein, 1545 aa, Homo sapiens
MAQILPIRFQEHLQLQNLGINPANIGFSTLTMESDKFICIREKVGEQAQVVIIDMNDPSNPIRRPISADSAIMNPASKVIALKAGKTLQIFNIEMKSKMKAHTMTDDVTFWKWISLNTVALVTDNAVYHWSMEGESQPVKMFDRHSSLAGCQIINYRTDAKQKWLLLTGISAQQNRVVGAMQLYSVDRKVSQPIEGHAASFAQFKMEGNAEESTLFCFAVRGQAGGKLHIIEVGTPPTGNQPFPKKAVDVFFPPEAQNDFPVAMQISEKHDVVFLITKYGYIHLYDLETGTCIYMNRISGETIFVTAPHEATAGIIGVNRKGQVLSVCVEEENIIPYITNVLQNPDLALRMAVRNNLAGAEELFARKFNALFAQGNYSEAAKVAANAPKGILRTPDTIRRFQSVPAQPGQTSPLLQYFGILLDQGQLNKYESLELCRPVLQQGRKQLLEKWLKEDKLECSEELGDLVKSVDPTLALSVYLRANVPNKVIQCFAETGQVQKIVLYAKKVGYTPDWIFLLRNVMRISPDQGQQFAQMLVQDEEPLADITQIVDVFMEYNLIQQCTAFLLDALKNNRPSEGPLQTRLLEMNLMHAPQVADAILGNQMFTHYDRAHIAQLCEKAGLLQRALEHFTDLYDIKRAVVHTHLLNPEWLVNYFGSLSVEDSLECLRAMLSANIRQNLQICVQVASKYHEQLSTQSLIELFESFKSFEGLFYFLGSIVNFSQDPDVHFKYIQAACKTGQIKEVERICRESNCYDPERVKNFLKEAKLTDQLPLIIVCDRFDFVHDLVLYLYRNNLQKYIEIYVQKVNPSRLPVVIGGLLDVDCSEDVIKNLILVVRGQFSTDELVAEVEKRNRLKLLLPWLEARIHEGCEEPATHNALAKIYIDSNNNPERFLRENPYYDSRVVGKYCEKRDPHLACVAYERGQCDLELINVCNENSLFKSLSRYLVRRKDPELWGSVLLESNPYRRPLIDQVVQTALSETQDPEEVSVTVKAFMTADLPNELIELLEKIVLDNSVFSEHRNLQNLLILTAIKADRTRVMEYINRLDNYDAPDIANIAISNELFEEAFAIFRKFDVNTSAVQVLIEHIGNLDRAYEFAERCNEPAVWSQLAKAQLQKGMVKEAIDSYIKADDPSSYMEVVQAANTSGNWEELVKYLQMARKKARESYVETELIFALAKTNRLAELEEFINGPNNAHIQQVGDRCYDEKMYDAAKLLYNNVSNFGRLASTLVHLGEYQAAVDGARKANSTRTWKEVCFACVDGKEFRLAQMCGLHIVVHADELEELINYYQDRGYFEELITMLEAALGLERAHMGMFTELAILYSKFKPQKMREHLELFWSRVNIPKVLRAAEQAHLWAELVFLYDKYEEYDNAIITMMNHPTDAWKEGQFKDIITKVANVELYYRAIQFYLEFKPLLLNDLLMVLSPRLDHTRAVNYFSKVKQLPLVKPYLRSVQNHNNKSVNESLNNLFITEEDYQALRTSIDAYDNFDNISLAQRLEKHELIEFRRIAAYLFKGNNRWKQSVELCKKDSLYKVDKVAGQGLF

SEQ ID NO: 881758 - protein, 533 aa, Homo sapiens
PTLVSLPSHVTLTLVITQCRRRPQSYVETELIFALAKTNRLAELEEFINGPNNAHIQQVGDRCYDEKMYDAAKLLYNNVSNFGRLASTLVHLGEYQAAVDGARKANSTRTWKEVCFACVDGKEFRLAQMCGLHIVVHADELEELINYYQDRGYFEELITMLEAALGLERAHMGMFTELAILYSKFKPQKMREHLELFWSRVNIPKVLRAAEQAHLWAELVFLYDKYEEYDNAIITMMNHPTDAWKEGQFKDIITKVANVELYYRAIQFYLEFKPLLLNDLLMVLSPRLDHTRAVNYFSKVKQLPLVKPYLRSVQNHNNKSVNESLNNLFITEEDYQALRTSIDAYDNFDNISLAQRLEKHELIEFRRIAAYLFKGNNRWKQSVELCKKDSLYKDAMQYASESKDTELAEELLQWFLQEEKRECFGACLFTCYDLLRPDVVLETAWRHNIMDFAMPYFIQVMKEYLTKVDKLDASESLRKEEEQATETQPIVYGQPQLMLTAGPSVAVPPQAPFGYGYTAPPYGQPQPGFGYSM

SEQ ID NO: 881759 - protein, 1682 aa, Homo sapiens
MAQILPIRFQEHLQLQNLGINPANIGFSTLTMESDKFICIREKVGEQAQVVIIDMNDPSNPIRRPISADSAIMNPASKVIALKAGKTLQIFNIEMKSKMKAHTMTDDVTFWKWISLNTVALVTDNAVYHWSMEGESQPVKMFDRHSSLAGCQIINYRTDAKQKWLLLTGISAQQNRVVGAMQLYSVDRKVSQPIEGHAASFAQFKMEGNAEESTLFCFAVRGQAGGKLHIIEVGTPPTGNQPFPKKAVDVFFPPEAQNDFPVAMQISEKHDVVFLITKYGYIHLYDLETGTCIYMNRISGETIFVTAPHEATAGIIGVNRKGQVLSVCVEEENIIPYITNVLQNPDLALRMAVRNNLAGAEELFARKFNALFAQGNYSEAAKVAANAPKGILRTPDTIRRFQSVPAQPGQTSPLLQYFGILLDQGQLNKYESLELCRPVLQQGRKQLLEKWLKEDKLECSEELGDLVKSVDPTLALSVYLRANVPNKVIQCFAETGQVQKIVLYAKKVGYTPDWIFLLRNVMRISPDQGQQFAQMLVQDEEPLADITQIVDVFMEYNLIQQCTAFLLDALKNNRPSEGPLQTRLLEMNLMHAPQVADAILGNQMFTHYDRAHIAQLCEKAGLLQRALEHFTDLYDIKRAVVHTHLLNPEWLVNYFGSLSVEDSLECLRAMLSANIRQNLQICVQVASKYHEQLSTQSLIELFESFKSFEGLFYFLGSIVNFSQDPDVHFKYIQAACKTGQIKEVERICRESNCYDPERVKNFLKEAKLTDQLPLIIVCDRFDFVHDLVLYLYRNNLQKYIEIYVQKVNPSRLPVVIGGLLDVDCSEDVIKNLILVVRGQFSTDELVAEVEKRNRLKLLLPWLEARIHEGCEEPATHNALAKIYIDSNNNPERFLRENPYYDSRVVGKYCEKRDPHLACVAYERGQCDLELINVCNENSLFKSLSRYLVRRKDPELWGSVLLESNPYRRPLIDQVVQTALSETQDPEEVSVTVKAFMTADLPNELIELLEKIVLDNSVFSEHRNLQNLLILTAIKADRTRVMEYINRLDNYDAPDIANIAISNELFEEAFAIFRKFDVNTSAVQVLIEHIGNLDRAYEFAERCNEPAVWSQLAKAQLQKGMVKEAIDSYIKADDPSSYMEVVQAANTSGNWEELVKYLQMARKKARESYVETELIFALAKTNRLAELEEFINGPNNAHIQQVGDRCYDEKMYDAAKLLYNNVSNFGRLASTLVHLGEYQAAVDGARKANSTRTWKEVCFACVDGKEFRLAQMCGLHIVVHADELEELINYYQDRGYFEELITMLEAALGLERAHMGMFTELAILYSKFKPQKMREHLELFWSRVNIPKVLRAAEQAHLWAELVFLYDKYEEYDNAIITMMNHPTDAWKEGQFKDIITKVANVELYYRAIQFYLEFKPLLLNDLLMVLSPRLDHTRAVNYFSKVKQLPLVKPYLRSVQNHNNKSVNESLNNLFITEEDYQALRTSIDAYDNFDNISLAQRLEKHELIEFRRIAAYLFKGNNRWKQSVELCKKDSLYKDAMQYASESKDTELAEELLQWFLQEEKRECFGACLFTCYDLLRPDVVLETAWRHNIMDFAMPYFIQVMKEYLTKVDAIKEKVDKLDASESLRKEEEQATETQPIVYGQPQLMLTAGPSVAVPPQAPFGYGYTAPPYGQPQPGFGYSM

SEQ ID NO: 881760 - protein, 1624 aa, Homo sapiens
MAQILPIRFQEHLQLQNLGINPANIGFSTLTMESDKFICIREKVGEQAQVVIIDMNDPSNPIRRPISADSAIMNPASKVIALKAGKTLQIFNIEMKSKMKAHTMTDDVTFWKWISLNTVALVTDNAVYHWSMEGESQPVKMFDRHSSLAGCQIINYRTDAKQKWLLLTGISAQQNRVVGAMQLYSVDRKVSQPIEGHAASFAQFKMEGNAEESTLFCFAVRGQAGGKLHIIEVGTPPTGNQPFPKKAVDVFFPPEAQNDFPVAMQISEKHDVVFLITKYGYIHLYDLETGTCIYMNRISGETIFVTAPHEATAGIIGVNRKGQVLSVCVEEENIIPYITNVLQNPDLALRMAVRNNLAGAEELFARKFNALFAQGNYSEAAKVAANAPKGILRTPDTIRRFQSVPAQPGQTSPLLQYFGILLDQGQLNKYESLELCRPVLQQGRKQLLEKWLKEDKLECSEELGDLVKSVDPTLALSVYLRANVPNKVIQCFAETGQVQKIVLYAKKVGYTPDWIFLLRNVMRISPDQGQQFAQMLVQDEEPLADITQIVDVFMEYNLIQQCTAFLLDALKNNRPSEGPLQTRLLEMNLMHAPQVADAILGNQMFTHYDRAHIAQLCEKAGLLQRALEHFTDLYDIKRAVVHTHLLNPEWLVNYFGSLSVEDSLECLRAMLSANIRQNLQICVQVASKYHEQLSTQSLIELFESFKSFEGLFYFLGSIVNFSQDPDVHFKYIQAACKTGQIKEVERICRESNCYDPERVKNFLKEAKLTDQLPLIIVCDRFDFVHDLVLYLYRNNLQKYIEIYVQKVNPSRLPVVIGGLLDVDCSEDVIKNLILVVRGQFSTDELVAEVEKRNRLKLLLPWLEARIHEGCEEPATHNALAKIYIDSNNNPERFLRENPYYDSRVVGKYCEKRDPHLACVAYERGQCDLELINVCNENSLFKSLSRYLVRRKDPELWGSVLLESNPYRRPLIDQVVQTALSETQDPEEVSVTVKAFMTADLPNELIELLEKIVLDNSVFSEHRNLQNLLILTAIKADRTRVMEYINRLDNYDAPDIANIAISNELFEEAFAIFRKFDVNTSAVQVLIEHIGNLDRAYEFAERCNEPAVWSQLAKAQLQKGMVKEAIDSYIKADDPSSYMEVVQAANTSGNWEELVKYLQMARKKARESYVETELIFALAKTNRLAELEEFINGPNNAHIQQVGDRCYDEKMYDAAKLLYNNVSNFGRLASTLVHLGEYQAAVDGARKANSTRTWKEVCFACVDGKEFRLAQMCGLHIVVHADELEELINYYQDRGYFEELITMLEAALGLERAHMGMFTELAILYSKFKPQKMREHLELFWSRVNIPKVLRAAEQAHLWAELVFLYDKYEEYDNAIITMMNHPTDAWKEGQFKDIITKVANVELYYRAIQFYLEFKPLLLNDLLMVLSPRLDHTRAVNYFSKVKQLPLVKPYLRSVQNHNNKSVNESLNNLFITEEDYQALRTSIDAYDNFDNISLAQRLEKHELIEFRRIAAYLFKGNNRWKQSVELCKKDSLYKDAMQYASESKDTELAEELLQWFLQEEKRECFGACLFTCYDLLRPDVVLETAWRHNIMDFAMPYFIQVMKEYLTKVDKLDASESLRVSPS

SEQ ID NO: 881761 - protein, 1675 aa, Homo sapiens; identical to SEQ ID NO: 881749

SEQ ID NO: 881762 - protein, 148 aa, Homo sapiens
ADLQQLSKDAMQYASESKDTELAEELLQWFLQEEKRECFGACLFTCYDLLRPDVVLETAWRHNIMDFAMPYFIQVMKEYLTKVDKLDASESLRKEEEQATETQPIVYGQPQLMLTAGPSVAVPPQAPFGYGYTAPPYGQPQPGFGYSM

SEQ ID NO: 881763 - protein, 1675 aa, Homo sapiens; identical to SEQ ID NO: 881749

SEQ ID NO: 881764 - protein, 1675 aa, Homo sapiens; identical to SEQ ID NO: 881749

SEQ ID NO: 881765 - protein, 1545 aa, Homo sapiens; identical to SEQ ID NO: 881757

SEQ ID NO: 881766 - protein, 1486 aa, Homo sapiens
MAQILPIRFQEHLQLQNLGINPANIGFSTLTMESDKFICIREKVGEQAQVVIIDMNDPSNPIRRPISADSAIMNPASKVIALKAGKTLQIFNIEMKSKMKAHTMTDDVTFWKWISLNTVALVTDNAVYHWSMEGESQPVKMFDRHSSLAGCQIINYRTDAKQKWLLLTGISAQQNRVVGAMQLYSVDRKVSQPIEGHAASFAQFKMEGNAEESTLFCFAVRGQAGGKLHIIEVGTPPTGNQPFPKKAVDVFFPPEAQNDFPVAMQISEKHDVVFLITKYGYIHLYDLETGTCIYMNRISGETIFVTAPHEATAGIIGVNRKGQVLSVCVEEENIIPYITNVLQNPDLALRMAVRNNLAGAEELFARKFNALFAQGNYSEAAKVAANAPKGILRTPDTIRRFQSVPAQPGQTSPLLQYFGILLDQGQLNKYESLELCRPVLQQGRKQLLEKWLKEDKLECSEELGDLVKSVDPTLALSVYLRANVPNKVIQCFAETGQVQKIVLYAKKVGYTPDWIFLLRNVMRISPDQGQQFAQMLVQDEEPLADITQIVDVFMEYNLIQQCTAFLLDALKNNRPSEGPLQTRLLEMNLMHAPQVADAILGNQMFTHYDRAHIAQLCEKAGLLQRALEHFTDLYDIKRAVVHTHLLNPEWLVNYFGSLSVEDSLECLRAMLSANIRQNLQICVQVASKYHEQLSTQSLIELFESFKSFEGLFYFLGSIVNFSQDPDVHFKYIQAACKTGQIKEVERICRESNCYDPERVKNFLKEAKLTDQLPLIIVCDRFDFVHDLVLYLYRNNLQKYIEIYVQKVNPSRLPVVIGGLLDVDCSEDVIKNLILVVRGQFSTDELVAEVEKRNRLKLLLPWLEARIHEGCEEPATHNALAKIYIDSNNNPERFLRENPYYDSRVVGKYCEKRDPHLACVAYERGQCDLELINVCNENSLFKSLSRYLVRRKDPELWGSVLLESNPYRRPLIDQVVQTALSETQDPEEVSVTVKAFMTADLPNELIELLEKIVLDNSVFSEHRNLQNLLILTAIKADRTRVMEYINRLDNYDAPDIANIAISNELFEEAFAIFRKFDVNTSAVQVLIEHIGNLDRAYEFAERCNEPAVWSQLAKAQLQKGMVKEAIDSYIKADDPSSYMEVVQAANTSGNWEELVKYLQMARKKARESYVETELIFALAKTNRLAELEEFINGPNNAHIQQVGDRCYDEKMYDAAKLLYNNVSNFGRLASTLVHLGEYQAAVDGARKANSTRTWKEVCFACVDGKEFRLAQMCGLHIVVHADELEELINYYQDRGYFEELITMLEAALGLERAHMGMFTELAILYSKFKPQKMREHLELFWSRVNIPKVLRAAEQAHLWAELVFLYDKYEEYDNAIITMMNHPTDAWKEGQFKDIITKVANVELYYRAIQFYLEFKPLLLNDLLMVLSPRLDHTRAVNYFSKVKQLPLVKPYLRSVQNHNNKSVNESLNNLFITEEDYQVKPFDSCT

SEQ ID NO: 881767 - protein, 1478 aa, Homo sapiens
MAQILPIRFQEHLQLQNLGINPANIGFSTLTMESDKFICIREKVGEQAQVVIIDMNDPSNPIRRPISADSAIMNPASKVIALKAGKTLQIFNIEMKSKMKAHTMTDDVTFWKWISLNTVALVTDNAVYHWSMEGESQPVKMFDRHSSLAGCQIINYRTDAKQKWLLLTGISAQQNRVVGAMQLYSVDRKVSQPIEGHAASFAQFKMEGNAEESTLFCFAVRGQAGGKLHIIEVGTPPTGNQPFPKKAVDVFFPPEAQNDFPVAMQISEKHDVVFLITKYGYIHLYDLETGTCIYMNRISGETIFVTAPHEATAGIIGVNRKGQVLSVCVEEENIIPYITNVLQNPDLALRMAVRNNLAGAEELFARKFNALFAQGNYSEAAKVAANAPKGILRTPDTIRRFQSVPAQPGQTSPLLQYFGILLDQGQLNKYESLELCRPVLQQGRKQLLEKWLKEDKLECSEELGDLVKSVDPTLALSVYLRANVPNKVIQCFAETGQVQKIVLYAKKVGYTPDWIFLLRNVMRISPDQGQQFAQMLVQDEEPLADITQIVDVFMEYNLIQQCTAFLLDALKNNRPSEGPLQTRLLEMNLMHAPQVADAILGNQMFTHYDRAHIAQLCEKAGLLQRALEHFTDLYDIKRAVVHTHLLNPEWLVNYFGSLSVEDSLECLRAMLSANIRQNLQICVQVASKYHEQLSTQSLIELFESFKSFEGLFYFLGSIVNFSQDPDVHFKYIQAACKTGQIKEVERICRESNCYDPERVKNFLKEAKLTDQLPLIIVCDRFDFVHDLVLYLYRNNLQKYIEIYVQKVNPSRLPVVIGGLLDVDCSEDVIKNLILVVRGQFSTDELVAEVEKRNRLKLLLPWLEARIHEGCEEPATHNALAKIYIDSNNNPERFLRENPYYDSRVVGKYCEKRDPHLACVAYERGQCDLELINVCNENSLFKSLSRYLVRRKDPELWGSVLLESNPYRRPLIDQVVQTALSETQDPEEVSVTVKAFMTADLPNELIELLEKIVLDNSVFSEHRNLQNLLILTAIKADRTRVMEYINRLDNYDAPDIANIAISNELFEEAFAIFRKFDVNTSAVQVLIEHIGNLDRAYEFAERCNEPAVWSQLAKAQLQKGMVKEAIDSYIKADDPSSYMEVVQAANTSGNWEELVKYLQMARKKARESYVETELIFALAKTNRLAELEEFINGPNNAHIQQVGDRCYDEKMYDAAKLLYNNVSNFGRLASTLVHLGEYQAAVDGARKANSTRTWKEVCFACVDGKEFRLAQMCGLHIVVHADELEELINYYQDRGYFEELITMLEAALGLERAHMGMFTELAILYSKFKPQKMREHLELFWSRVNIPKVLRAAEQAHLWAELVFLYDKYEEYDNAIITMMNHPTDAWKEGQFKDIITKVANVELYYRAIQFYLEFKPLLLNDLLMVLSPRLDHTRAVNYFSKVNSTLGNVLRQSPYTNAVNDHDIFIQRYRPAHIIYAL

SEQ ID NO: 881768 - protein, 1330 aa, Homo sapiens
MAQILPIRFQEHLQLQNLGINPANIGFSTLTMESDKFICIREKVGEQAQVVIIDMNDPSNPIRRPISADSAIMNPASKVIALKAGKTLQIFNIEMKSKMKAHTMTDDVTFWKWISLNTVALVTDNAVYHWSMEGESQPVKMFDRHSSLAGCQIINYRTDAKQKWLLLTGISAQQNRVVGAMQLYSVDRKVSQPIEGHAASFAQFKMEGNAEESTLFCFAVRGQAGGKLHIIEVGTPPTGNQPFPKKAVDVFFPPEAQNDFPVAMQISEKHDVVFLITKYGYIHLYDLETGTCIYMNRISGETIFVTAPHEATAGIIGVNRKGQVLSVCVEEENIIPYITNVLQNPDLALRMAVRNNLAGAEELFARKFNALFAQGNYSEAAKVAANAPKGILRTPDTIRRFQSVPAQPGQTSPLLQYFGILLDQGQLNKYESLELCRPVLQQGRKQLLEKWLKEDKLECSEELGDLVKSVDPTLALSVYLRANVPNKVIQCFAETGQVQKIVLYAKKVGYTPDWIFLLRNVMRISPDQGQQFAQMLVQDEEPLADITQIVDVFMEYNLIQQCTAFLLDALKNNRPSEGPLQTRLLEMNLMHAPQVADAILGNQMFTHYDRAHIAQLCEKAGLLQRALEHFTDLYDIKRAVVHTHLLNPEWLVNYFGSLSVEDSLECLRAMLSANIRQNLQICVQVASKYHEQLSTQSLIELFESFKSFEGLFYFLGSIVNFSQDPDVHFKYIQAACKTGQIKEVERICRESNCYDPERVKNFLKEAKLTDQLPLIIVCDRFDFVHDLVLYLYRNNLQKYIEIYVQKVNPSRLPVVIGGLLDVDCSEDVIKNLILVVRGQFSTDELVAEVEKRNRLKLLLPWLEARIHEGCEEPATHNALAKIYIDSNNNPERFLRENPYYDSRVVGKYCEKRDPHLACVAYERGQCDLELINVCNENSLFKSLSRYLVRRKDPELWGSVLLESNPYRRPLIDQVVQTALSETQDPEEVSVTVKAFMTADLPNELIELLEKIVLDNSVFSEHRNLQNLLILTAIKADRTRVMEYINRLDNYDAPDIANIAISNELFEEAFAIFRKFDVNTSAVQVLIEHIGNLDRAYEFAERCNEPAVWSQLAKAQLQKGMVKEAIDSYIKADDPSSYMEVVQAANTSGNWEELVKYLQMARKKARESYVETELIFALAKTNRLAELEEFINGPNNAHIQQVGDRCYDEKMYDAAKLLYNNVSNFGRLASTLVHLGEYQAAVDGARKANSTRTWKEVCFACVDGKEFRLAQMCGLHIVVHADELEELINYYQDRGYFEELITMLEAALGLEQGRRAEQDRRPDQPGDLSKP

SEQ ID NO: 881769 - protein, 1204 aa, Homo sapiens
MAQILPIRFQEHLQLQNLGINPANIGFSTLTMESDKFICIREKVGEQAQVVIIDMNDPSNPIRRPISADSAIMNPASKVIALKAGKTLQIFNIEMKSKMKAHTMTDDVTFWKWISLNTVALVTDNAVYHWSMEGESQPVKMFDRHSSLAGCQIINYRTDAKQKWLLLTGISAQQNRVVGAMQLYSVDRKVSQPIEGHAASFAQFKMEGNAEESTLFCFAVRGQAGGKLHIIEVGTPPTGNQPFPKKAVDVFFPPEAQNDFPVAMQISEKHDVVFLITKYGYIHLYDLETGTCIYMNRISGETIFVTAPHEATAGIIGVNRKGQVLSVCVEEENIIPYITNVLQNPDLALRMAVRNNLAGAEELFARKFNALFAQGNYSEAAKVAANAPKGILRTPDTIRRFQSVPAQPGQTSPLLQYFGILLDQGQLNKYESLELCRPVLQQGRKQLLEKWLKEDKLECSEELGDLVKSVDPTLALSVYLRANVPNKVIQCFAETGQVQKIVLYAKKVGYTPDWIFLLRNVMRISPDQGQQFAQMLVQDEEPLADITQIVDVFMEYNLIQQCTAFLLDALKNNRPSEGPLQTRLLEMNLMHAPQVADAILGNQMFTHYDRAHIAQLCEKAGLLQRALEHFTDLYDIKRAVVHTHLLNPEWLVNYFGSLSVEDSLECLRAMLSANIRQNLQICVQVASKYHEQLSTQSLIELFESFKSFEGLFYFLGSIVNFSQDPDVHFKYIQAACKTGQIKEVERICRESNCYDPERVKNFLKEAKLTDQLPLIIVCDRFDFVHDLVLYLYRNNLQKYIEIYVQKVNPSRLPVVIGGLLDVDCSEDVIKNLILVVRGQFSTDELVAEVEKRNRLKLLLPWLEARIHEGCEEPATHNALAKIYIDSNNNPERFLRENPYYDSRVVGKYCEKRDPHLACVAYERGQCDLELINVCNENSLFKSLSRYLVRRKDPELWGSVLLESNPYRRPLIDQVVQTALSETQDPEEVSVTVKAFMTADLPNELIELLEKIVLDNSVFSEHRNLQNLLILTAIKADRTRVMEYINRLDNYDAPDIANIAISNELFEEAFAIFRKFDVNTSAVQVLIEHIGNLDRAYEFAERCNEPAVWSQLAKAQLQKGMVKEAIDSYIKADDPSSYMEVVQAANTSGNWEELVKYLQMARKKARESYVETELIFALAKTNRLAELEEFIRGVNPMVRARIVTW

SEQ ID NO: 881770 - protein, 1086 aa, Homo sapiens
MAQILPIRFQEHLQLQNLGINPANIGFSTLTMESDKFICIREKVGEQAQVVIIDMNDPSNPIRRPISADSAIMNPASKVIALKAGKTLQIFNIEMKSKMKAHTMTDDVTFWKWISLNTVALVTDNAVYHWSMEGESQPVKMFDRHSSLAGCQIINYRTDAKQKWLLLTGISAQQNRVVGAMQLYSVDRKVSQPIEGHAASFAQFKMEGNAEESTLFCFAVRGQAGGKLHIIEVGTPPTGNQPFPKKAVDVFFPPEAQNDFPVAMQISEKHDVVFLITKYGYIHLYDLETGTCIYMNRISGETIFVTAPHEATAGIIGVNRKGQVLSVCVEEENIIPYITNVLQNPDLALRMAVRNNLAGAEELFARKFNALFAQGNYSEAAKVAANAPKGILRTPDTIRRFQSVPAQPGQTSPLLQYFGILLDQGQLNKYESLELCRPVLQQGRKQLLEKWLKEDKLECSEELGDLVKSVDPTLALSVYLRANVPNKVIQCFAETGQVQKIVLYAKKVGYTPDWIFLLRNVMRISPDQGQQFAQMLVQDEEPLADITQIVDVFMEYNLIQQCTAFLLDALKNNRPSEGPLQTRLLEMNLMHAPQVADAILGNQMFTHYDRAHIAQLCEKAGLLQRALEHFTDLYDIKRAVVHTHLLNPEWLVNYFGSLSVEDSLECLRAMLSANIRQNLQICVQVASKYHEQLSTQSLIELFESFKSFEGLFYFLGSIVNFSQDPDVHFKYIQAACKTGQIKEVERICRESNCYDPERVKNFLKEAKLTDQLPLIIVCDRFDFVHDLVLYLYRNNLQKYIEIYVQKVNPSRLPVVIGGLLDVDCSEDVIKNLILVVRGQFSTDELVAEVEKRNRLKLLLPWLEARIHEGCEEPATHNALAKIYIDSNNNPERFLRENPYYDSRVVGKYCEKRDPHLACVAYERGQCDLELINVCNENSLFKSLSRYLVRRKDPELWGSVLLESNPYRRPLIDQVVQTALSETQDPEEVSVTVKAFMTADLPNELIELLEKIVLDNSVFSEHRNLQNLLILTAIKADRTRVMEYINRLDNYDAPDIANIAISNELFEEAFAIFRKFDVNTSAVQVIN

SEQ ID NO: 881771 - protein, 1036 aa, Homo sapiens
MAQILPIRFQEHLQLQNLGINPANIGFSTLTMESDKFICIREKVGEQAQVVIIDMNDPSNPIRRPISADSAIMNPASKVIALKAGKTLQIFNIEMKSKMKAHTMTDDVTFWKWISLNTVALVTDNAVYHWSMEGESQPVKMFDRHSSLAGCQIINYRTDAKQKWLLLTGISAQQNRVVGAMQLYSVDRKVSQPIEGHAASFAQFKMEGNAEESTLFCFAVRGQAGGKLHIIEVGTPPTGNQPFPKKAVDVFFPPEAQNDFPVAMQISEKHDVVFLITKYGYIHLYDLETGTCIYMNRISGETIFVTAPHEATAGIIGVNRKGQVLSVCVEEENIIPYITNVLQNPDLALRMAVRNNLAGAEELFARKFNALFAQGNYSEAAKVAANAPKGILRTPDTIRRFQSVPAQPGQTSPLLQYFGILLDQGQLNKYESLELCRPVLQQGRKQLLEKWLKEDKLECSEELGDLVKSVDPTLALSVYLRANVPNKVIQCFAETGQVQKIVLYAKKVGYTPDWIFLLRNVMRISPDQGQQFAQMLVQDEEPLADITQIVDVFMEYNLIQQCTAFLLDALKNNRPSEGPLQTRLLEMNLMHAPQVADAILGNQMFTHYDRAHIAQLCEKAGLLQRALEHFTDLYDIKRAVVHTHLLNPEWLVNYFGSLSVEDSLECLRAMLSANIRQNLQICVQVASKYHEQLSTQSLIELFESFKSFEGLFYFLGSIVNFSQDPDVHFKYIQAACKTGQIKEVERICRESNCYDPERVKNFLKEAKLTDQLPLIIVCDRFDFVHDLVLYLYRNNLQKYIEIYVQKVNPSRLPVVIGGLLDVDCSEDVIKNLILVVRGQFSTDELVAEVEKRNRLKLLLPWLEARIHEGCEEPATHNALAKIYIDSNNNPERFLRENPYYDSRVVGKYCEKRDPHLACVAYERGQCDLELINVCNENSLFKSLSRYLVRRKDPELWGSVLLESNPYRRPLIDQVVQTALSETQDPEEVSVTVKAFMTADLPNELIELLEKIVLDNSVFSEHRNLQTLSTAELTYRV

SEQ ID NO: 881772 - protein, 937 aa, Homo sapiens
MAQILPIRFQEHLQLQNLGINPANIGFSTLTMESDKFICIREKVGEQAQVVIIDMNDPSNPIRRPISADSAIMNPASKVIALKAGKTLQIFNIEMKSKMKAHTMTDDVTFWKWISLNTVALVTDNAVYHWSMEGESQPVKMFDRHSSLAGCQIINYRTDAKQKWLLLTGISAQQNRVVGAMQLYSVDRKVSQPIEGHAASFAQFKMEGNAEESTLFCFAVRGQAGGKLHIIEVGTPPTGNQPFPKKAVDVFFPPEAQNDFPVAMQISEKHDVVFLITKYGYIHLYDLETGTCIYMNRISGETIFVTAPHEATAGIIGVNRKGQVLSVCVEEENIIPYITNVLQNPDLALRMAVRNNLAGAEELFARKFNALFAQGNYSEAAKVAANAPKGILRTPDTIRRFQSVPAQPGQTSPLLQYFGILLDQGQLNKYESLELCRPVLQQGRKQLLEKWLKEDKLECSEELGDLVKSVDPTLALSVYLRANVPNKVIQCFAETGQVQKIVLYAKKVGYTPDWIFLLRNVMRISPDQGQQFAQMLVQDEEPLADITQIVDVFMEYNLIQQCTAFLLDALKNNRPSEGPLQTRLLEMNLMHAPQVADAILGNQMFTHYDRAHIAQLCEKAGLLQRALEHFTDLYDIKRAVVHTHLLNPEWLVNYFGSLSVEDSLECLRAMLSANIRQNLQICVQVASKYHEQLSTQSLIELFESFKSFEGLFYFLGSIVNFSQDPDVHFKYIQAACKTGQIKEVERICRESNCYDPERVKNFLKEAKLTDQLPLIIVCDRFDFVHDLVLYLYRNNLQKYIEIYVQKVNPSRLPVVIGGLLDVDCSEDVIKNLILVVRGQFSTDELVAEVEKRNRLKLLLPWLEARIHEGCEEPATHNALAKIYIDSNNNPERFLRENPYYDSRVVGKYCEKRDPHLACVAYERGQCDLELINVSTAS

SEQ ID NO: 881773 - protein, 810 aa, Homo sapiens
MAQILPIRFQEHLQLQNLGINPANIGFSTLTMESDKFICIREKVGEQAQVVIIDMNDPSNPIRRPISADSAIMNPASKVIALKAGKTLQIFNIEMKSKMKAHTMTDDVTFWKWISLNTVALVTDNAVYHWSMEGESQPVKMFDRHSSLAGCQIINYRTDAKQKWLLLTGISAQQNRVVGAMQLYSVDRKVSQPIEGHAASFAQFKMEGNAEESTLFCFAVRGQAGGKLHIIEVGTPPTGNQPFPKKAVDVFFPPEAQNDFPVAMQISEKHDVVFLITKYGYIHLYDLETGTCIYMNRISGETIFVTAPHEATAGIIGVNRKGQVLSVCVEEENIIPYITNVLQNPDLALRMAVRNNLAGAEELFARKFNALFAQGNYSEAAKVAANAPKGILRTPDTIRRFQSVPAQPGQTSPLLQYFGILLDQGQLNKYESLELCRPVLQQGRKQLLEKWLKEDKLECSEELGDLVKSVDPTLALSVYLRANVPNKVIQCFAETGQVQKIVLYAKKVGYTPDWIFLLRNVMRISPDQGQQFAQMLVQDEEPLADITQIVDVFMEYNLIQQCTAFLLDALKNNRPSEGPLQTRLLEMNLMHAPQVADAILGNQMFTHYDRAHIAQLCEKAGLLQRALEHFTDLYDIKRAVVHTHLLNPEWLVNYFGSLSVEDSLECLRAMLSANIRQNLQICVQVASKYHEQLSTQSLIELFESFKSFEGLFYFLGSIVNFSQDPDVHFKYIQAACKTGQIKEVERICRESNCYDPERVKNFLKEAKLTDQLPLIIVCDRFDFVHDLVLYLYRNNLQKYIEIYVQKVSNM

SEQ ID NO: 881774 - protein, 737 aa, Homo sapiens
MAQILPIRFQEHLQLQNLGINPANIGFSTLTMESDKFICIREKVGEQAQVVIIDMNDPSNPIRRPISADSAIMNPASKVIALKAGKTLQIFNIEMKSKMKAHTMTDDVTFWKWISLNTVALVTDNAVYHWSMEGESQPVKMFDRHSSLAGCQIINYRTDAKQKWLLLTGISAQQNRVVGAMQLYSVDRKVSQPIEGHAASFAQFKMEGNAEESTLFCFAVRGQAGGKLHIIEVGTPPTGNQPFPKKAVDVFFPPEAQNDFPVAMQISEKHDVVFLITKYGYIHLYDLETGTCIYMNRISGETIFVTAPHEATAGIIGVNRKGQVLSVCVEEENIIPYITNVLQNPDLALRMAVRNNLAGAEELFARKFNALFAQGNYSEAAKVAANAPKGILRTPDTIRRFQSVPAQPGQTSPLLQYFGILLDQGQLNKYESLELCRPVLQQGRKQLLEKWLKEDKLECSEELGDLVKSVDPTLALSVYLRANVPNKVIQCFAETGQVQKIVLYAKKVGYTPDWIFLLRNVMRISPDQGQQFAQMLVQDEEPLADITQIVDVFMEYNLIQQCTAFLLDALKNNRPSEGPLQTRLLEMNLMHAPQVADAILGNQMFTHYDRAHIAQLCEKAGLLQRALEHFTDLYDIKRAVVHTHLLNPEWLVNYFGSLSVEDSLECLRAMLSANIRQNLQICVQVASKYHEQLSTQSLIELFESFKSFEGLFYFLGSIVNFSQDPDVHFKYIQAARP

SEQ ID NO: 881775 - protein, 701 aa, Homo sapiens
MAQILPIRFQEHLQLQNLGINPANIGFSTLTMESDKFICIREKVGEQAQVVIIDMNDPSNPIRRPISADSAIMNPASKVIALKAGKTLQIFNIEMKSKMKAHTMTDDVTFWKWISLNTVALVTDNAVYHWSMEGESQPVKMFDRHSSLAGCQIINYRTDAKQKWLLLTGISAQQNRVVGAMQLYSVDRKVSQPIEGHAASFAQFKMEGNAEESTLFCFAVRGQAGGKLHIIEVGTPPTGNQPFPKKAVDVFFPPEAQNDFPVAMQISEKHDVVFLITKYGYIHLYDLETGTCIYMNRISGETIFVTAPHEATAGIIGVNRKGQVLSVCVEEENIIPYITNVLQNPDLALRMAVRNNLAGAEELFARKFNALFAQGNYSEAAKVAANAPKGILRTPDTIRRFQSVPAQPGQTSPLLQYFGILLDQGQLNKYESLELCRPVLQQGRKQLLEKWLKEDKLECSEELGDLVKSVDPTLALSVYLRANVPNKVIQCFAETGQVQKIVLYAKKVGYTPDWIFLLRNVMRISPDQGQQFAQMLVQDEEPLADITQIVDVFMEYNLIQQCTAFLLDALKNNRPSEGPLQTRLLEMNLMHAPQVADAILGNQMFTHYDRAHIAQLCEKAGLLQRALEHFTDLYDIKRAVVHTHLLNPEWLVNYFGSLSVEDSLECLRAMLSANIRQNLQICVQVASKYHDISHHGDPLGR

SEQ ID NO: 881776 - protein, 73 aa, Homo sapiens
RCDGDSCFVVAVRCARVSAPVGVHPRAGHILGASSAIGFTPLVTATRGVVNHQWDTGSFVLMVGPPDSPVRPT

SEQ ID NO: 881777 - protein, 389 aa, Homo sapiens
MAQILPIRFQEHLQLQNLGINPANIGFSTLTMESDKFICIREKVGEQAQVVIIDMNDPSNPIRRPISADSAIMNPASKVIALKAGKTLQIFNIEMKSKMKAHTMTDDVTFWKWISLNTVALVTDNAVYHWSMEGESQPVKMFDRHSSLAGCQIINYRTDAKQKWLLLTGISAQQNRVVGAMQLYSVDRKVSQPIEGHAASFAQFKMEGNAEESTLFCFAVRGQAGGKLHIIEVGTPPTGNQPFPKKAVDVFFPPEAQNDFPVAMQISEKHDVVFLITKYGYIHLYDLETGTCIYMNRISGETIFVTAPHEATAGIIGVNRKGQVLSVCVEEENIIPYITNVLQNPDLALRMAVRNNLAGAEELFARTLIRLREETPQTKMAKFVIRPAT

SEQ ID NO: 881778 - protein, 327 aa, Homo sapiens
MAQILPIRFQEHLQLQNLGINPANIGFSTLTMESDKFICIREKVGEQAQVVIIDMNDPSNPIRRPISADSAIMNPASKVIALKAGKTLQIFNIEMKSKMKAHTMTDDVTFWKWISLNTVALVTDNAVYHWSMEGESQPVKMFDRHSSLAGCQIINYRTDAKQKWLLLTGISAQQNRVVGAMQLYSVDRKVSQPIEGHAASFAQFKMEGNAEESTLFCFAVRGQAGGKLHIIEVGTPPTGNQPFPKKAVDVFFPPEAQNDFPVAMQISEKHDVVFLITKYGYIHLYDLETGTCIYMNRISGETIFVTAPHEATAGIIGVNRKGQVRKP

SEQ ID NO: 881779 - protein, 176 aa, Homo sapiens
MAQILPIRFQEHLQLQNLGINPANIGFSTLTMESDKFICIREKVGEQAQVVIIDMNDPSNPIRRPISADSAIMNPASKVIALKAGKTLQIFNIEMKSKMKAHTMTDDVTFWKWISLNTVALVTDNAVYHWSMEGESQPVKMFDRHSSLAGCQIINYRTDAKQKWLLLTGISAQVTF

SEQ ID NO: 881780 - protein, 184 aa, Homo sapiens
MAQILPIRFQEHLQLQNLGINPANIGFSTLTMESDKFICIREKVGEQAQVVIIDMNDPSNPIRRPISADSAIMNPASKVIALKAGKTLQIFNIEMKSKMKAHTMTDDVTFWKWISLNTVALVTDNAVYHWSMEGESQPVKMFDRHSSLAGCQIINYRTDAKQKWLLLTGISAQQNRVESDRDPL

SEQ ID NO: 881781 - protein, 160 aa, Homo sapiens
MAQILPIRFQEHLQLQNLGINPANIGFSTLTMESDKFICIREKVGEQAQVVIIDMNDPSNPIRRPISADSAIMNPASKVIALKAGKTLQIFNIEMKSKMKAHTMTDDVTFWKWISLNTVALVTDNAVYHWSMEGESQPVKMFDRHLTHEDAIYTHEDAIY

SEQ ID NO: 881782 - protein, 126 aa, Homo sapiens
SALRPVPPLRLSWPLEPPPPTRALSSACQFPASPERILLSPASPLPFSSSPLESPGSHCPAAPVTGGDHNPRQRHGPDSANSFSGASPGAAGPGLVRAVEKVVGRMEDAGVWARAVSELEGRGGCR

SEQ ID NO: 881783 - protein, 240 aa, Homo sapiens
TLRGSPLRYDPERVKNNLKEAKLTDQLPLIIVCDRFDFVHDLVLYLYRNNLQKYIEIYVQKVNPSRLPVVIGGLLDVDCSEDVIKNLILVVRGQFSTDELVAEVEKRNRLKLLLPWLEARIHEGCEEPATHNALAKIYIDSNNNPERFLRENPYYDSRVVGKYCEKRDPHLACVAYERGQCDLELINVCNENSLFKSLSRYLVRRKDPELWGSVLLESNPYRRPLIDQVVQTALSETGPP

SEQ ID NO: 881784 - protein, 1675 aa, Homo sapiens; identical to SEQ ID NO: 881749

SEQ ID NO: 881785 - protein, 1675 aa, Homo sapiens; identical to SEQ ID NO: 881749

SEQ ID NO: 881786 - protein, 1675 aa, Homo sapiens; identical to SEQ ID NO: 881749

SEQ ID NO: 881787 - protein, 1675 aa, Homo sapiens; identical to SEQ ID NO: 881749

SEQ ID NO: 881788 - protein, 584 aa, Homo sapiens
TLRIPVSEMFTNEPAVWSQLAKAQLQKGMVKEAIDSYIKADDPSSYMEVVQAANTSGNWEELVKYLQMARKKARESYVETELIFALAKTNRLAELEEFINGPNNAHIQQVGDRCYDEKMYDAAKLLYNNVSNFGRLASTLVHLGEYQAAVDGARKANSTRTWKEVCFACVDGKEFRLAQMCGLHIVVHADELEELINYYQDRGYFEELITMLEAALGLERAHMGMFTELAILYSKFKPQKMREHLELFWSRVNIPKVLRAAEQAHLWAELVFLYDKYEEYDNAIITMMNHPTDAWKEGQFKDIITKVANVELYYRAIQFYLEFKPLLLNDLLMVLSPRLDHTRAVNYFSKVKQLPLVKPYLRSVQNHNNKSVNESLNNLFITEEDYQALRTSIDAYDNFDNISLAQRLEKHELIEFRRIAAYLFKGNNRWKQSVELCKKDSLYKDAMQYASESKDTELAEELLQWFLQEEKRECFGACLFTCYDLLRPDVVLETAWRHNIMDFAMPYFIQVMKEYLTKVDKLDASESLRKEEEQATETQPIVYGQPQLMLTAGPSVAVPPQAPFGYGYTAPPYGQPQPGFGYSM

SEQ ID NO: 881789 - protein, 517 aa, Homo sapiens
MARKKARESYVETELIFALAKTNRLAELEEFINGPNNAHIQQVGDRCYDEKMYDAAKLLYNNVSNFGRLASTLVHLGEYQAAVDGARKANSTRTWKEVCFACVDGKEFRLAQMCGLHIVVHADELEELINYYQDRGYFEELITMLEAALGLERAHMGMFTELAILYSKFKPQKMREHLELFWSRVNIPKVLRAAEQAHLWAELVFLYDKYEEYDNAIITMMNHPTDAWKEGQFKDIITKVANVELYYRAIQFYLEFKPLLLNDLLMVLSPRLDHTRAVNYFSKVKQLPLVKPYLRSVQNHNNKSVNESLNNLFITEEDYQALRTSIDAYDNFDNISLAQRLEKHELIEFRRIAAYLFKGNNRWKQSVELCKKDSLYKDAMQYASESKDTELAEELLQWFLQEEKRECFGACLFTCYDLLRPDVVLETAWRHNIMDFAMPYFIQVMKEYLTKVDKLDASESLRKEEEQATETQPIVYGQPQLMLTAGPSVAVPPQAPFGYGYTAPPYGQPQPGFGYSM

SEQ ID NO: 881790 - protein, 1657 aa, Homo sapiens
MAQILPIRFQEHLQLQNLGINPANIGFSTLTMESDKFICIREKVGEQAQVVIIDMNDPSNPIRRPISADSAIMNPASKVIALKAGKTLQIFNIEMKSKMKAHTMTDDVTFWKWISLNTVALVTDNAVYHWSMEGESQPVKMFDRHSSLAGCQIINYRTDAKQKWLLLTGISAQQNRVVGAMQLYSVDRKVSQPIEGHAASFAQFKMEGNAEESTLFCFAVRGQAGGKLHIIEVGTPPTGNQPFPKKAVDVFFPPEAQNDFPVAMQISEKHDVVFLITKYGYIHLYDLETGTCIYMNRISGETIFVTAPHEATAGIIGVNRKGQVLSVCVEEENIIPYITNVLQNPDLALRMAVRNNLAGAEELFARKFNALFAQGNYSEAAKVAANAPKGILRTPDTIRRFQSVPAQPGQTSPLLQYFGILLDQGQLNKYESLELCRPVLQQGRKQLLEKWLKEDKLECSEELGDLVKSVDPTLALSVYLRANVPNKVIQCFAETGQVQKIVLYAKKVGYTPDWIFLLRNVMRISPDQGQQFAQMLVQDEEPLADITQIVDVFMEYNLIQQCTAFLLDALKNNRPSEGPLQTRLLEMNLMHAPQVADAILGNQMFTHYDRAHIAQLCEKAGLLQRALEHFTDLYDIKRAVVHTHLLNPEWLVNYFGSLSVEDSLECLRAMLSANIRQNLQICVQVASKYHEQLSTQSLIELFESFKSFEGLFYFLGSIVNFSQDPDVHFKYIQAACKTGQIKEVERICRESNCYDPERVKNFLKEAKLTDQLPLIIVCDRFDFVHDLVLYLYRNNLQKYIEIYVQKVNPSRLPVVIGGLLDVDCSEDVIKNLILVVRGQFSTDELVAEVEKRNRLKLLLPWLEARIHEGCEEPATHNALAKIYIDSNNNPERFLRENPYYDSRVVGKYCEKRDPHLACVAYERGQCDLELINVCNENSLFKSLSRYLVRRKDPELWGSVLLESNPYRRPLIDQVVQTALSETQDPEEVSVTVKAFMTADLPNELIELLEKIVLDNSVFSEHRNLQNLLILTAIKADRTRVMEYINRLDNYDAPDIANIAISNELFEEAFAIFRKFDVNTSAVQVLIEHIGNLDRAYEFAERCNEPAVWSQLAKAQLQKGMVKEAIDSYIKADDPSSYMEVVQAANTSGNWEELVKYLQMARKKARESYVETELIFALAKTNRLAELEEFINGPNNAHIQQVGDRCYDEKMYDAAKLLYNNVSNFGRLASTLVHLGEYQAAVDGARKANSTRTWKEVCFACVDGKEFRLAQMCGLHIVVHADELEELINYYQDRGYFEELITMLEAALGLERAHMGMFTELAILYSKFKPQKMREHLELFWSRVNIPKVLRAAEQAHLWAELVFLYDKYEEYDNAIITMMNHPTDAWKEGQFKDIITKVANVELYYRAIQFYLEFKPLLLNDLLMVLSPRLDHTRAVNYFSKVKQLPLVKPYLRSVQNHNNKSVNESLNNLFITEEDYQALRTSIDAYDNFDNISLAQRLEKHELIEFRRIAAYLFKGNNRWKQSVELCKKDSLYKDAMQYASESKDTELAEELLQWFLQEENVVLETAWRHNIMDFAMPYFIQVMKEYLTKVDKLDASESLRKEEEQATETQPIVYGQPQLMLTAGPSVAVPPQAPFGYGYTAPPYGQPQPGFGYSM

SEQ ID NO: 881791 - protein, 303 aa, Homo sapiens
PDRHTGPSHPTDAWKEGQFKDIITKVANVELYYRAIQFYLEFKPLLLNDLLMVLSPRLDHTRAVNYFSKVKQLPLVKPYLRSVQNHNNKSVNESLNNLFITEEDYQALRTSIDAYDNFDNISLAQRLEKHELIEFRRIAAYLFKGNNRWKQSVELCKKDSLYKDAMQYASESKDTELAEELLQWFLQEEKRECFGACLFTCYDLLRPDVVLETAWRHNIMDFAMPYFIQVMKEYLTKVDKLDASESLRKEEEQATETQPIVYGQPQLMLTAGPSVAVPPQAPFGYGYTAPPYGQPQPGFGYSM

SEQ ID NO: 881792 - protein, 154 aa, Homo sapiens
KRTMARPKKDSLYKDAMQYASESKDTELAEELLQWFLQEEKRECFGACLFTCYDLLRPDVVLETAWRHNIMDFAMPYFIQVMKEYLTKVDKLDASESLRKEEEQATETQPIVYGQPQLMLTAGPSVAVPPQAPFGYGYTAPPYGQPQPGFGYSM

SEQ ID NO: 881793 - protein, 1675 aa, Homo sapiens; identical to SEQ ID NO: 881749

SEQ ID NO: 881794 - protein, 1630 aa, Homo sapiens
MAQILPIRFQEHLQLQNLGINPANIGFSTLTMESDKFICIREKVGEQAQVVIIDMNDPSNPIRRPISADSAIMNPASKVIALKAGKTLQIFNIEMKSKMKAHTMTDDVTFWKWISLNTVALVTDNAVYHWSMEGESQPVKMFDRHSSLAGCQIINYRTDAKQKWLLLTGISAQQNRVVGAMQLYSVDRKVSQPIEGHAASFAQFKMEGNAEESTLFCFAVRGQAGGKLHIIEVGTPPTGNQPFPKKAVDVFFPPEAQNDFPVAMQISEKHDVVFLITKYGYIHLYDLETGTCIYMNRISGETIFVTAPHEATAGIIGVNRKGQVLSVCVEEENIIPYITNVLQNPDLALRMAVRNNLAGAEELFARKFNALFAQGNYSEAAKVAANAPKGILRTPDTIRRFQSVPAQPGQTSPLLQYFGILLDQGQLNKYESLELCRPVLQQGRKQLLEKWLKEDKLECSEELGDLVKSVDPTLALSVYLRANVPNKVIQCFAETGQVQKIVLYAKKVGYTPDWIFLLRNVMRISPDQGQQFAQMLVQDEEPLADITQIVDVFMEYNLIQQCTAFLLDALKNNRPSEGPLQTRLLEMNLMHAPQVADAILGNQMFTHYDRAHIAQLCEKAGLLQRALEHFTDLYDIKRAVVHTHLLNPEWLVNYFGSLSVEDSLECLRAMLSANIRQNLQICVQVASKYHEQLSTQSLIELFESFKSFEGLFYFLGSIVNFSQDPDVHFKYIQAACKTGQIKEVERICRESNCYDPERVKNFLKEAKLTDQLPLIIVCDRFDFVHDLVLYLYRNNLQKYIEIYVQKVNPSRLPVVIGGLLDVDCSEDVIKNLILVVRGQFSTDELVAEVEKRNRLKLLLPWLEARIHEGCEEPATHNALAKIYIDSNNNPERFLRENPYYDSRVVGKYCEKRDPHLACVAYERGQCDLELINVCNENSLFKSLSRYLVRRKDPELWGSVLLESNPYRRPLIDQVVQTALSETQDPEEVSVTVKAFMTADLPNELIELLEKIVLDNSVFSEHRNLQNLLILTAIKADRTRVMEYINRLDNYDAPDIANIAISNELFEEAFAIFRKFDVNTSAVQVLIEHIGNLDRAYEFAERCNEPAVWSQLAKAQLQKGMVKEAIDSYIKADDPSSYMEVVQAANTSGNWEELVKYLQMARKKARESYVETELIFALAKTNRLAELEEFINGPNNAHIQQVGDRCYDEKMYDAAKLLYNNVSNFGRLASTLVHLGEYQAAVDGARKANSTRTWKEVCFACVDGKEFRLAQMCGLHIVVHADELEELINYYQDRGYFEELITMLEAALGLERAHMGMFTELAILYSKFKPQKMREHLELFWSRVNIPKVLRAAEQAHLWAELVFLYDKYEEYDNAIITMMNHPTDAWKEGQFKDIITKVANVELYYRAIQFYLEFKPLLLNDLLMVLSPRLDHTRAVNYFSKVKQLPLVKPYLRSVQNHNNKSVNESLNNLFITEEDYQALRTSIDAYDNFDNISLAQRLEKHELIEFRRIAAYLFKGNNRWKQSVELCKKDSLYKDAMQYASESKDTELAEELLQWFLQEEKRECFGACLFTCYDLLRPDVVLETAWRHNIMDFAMPYFIQVMKEYLTKVMTLLSVFRTSFLACKILHAH

SEQ ID NO: 881795 - protein, 1520 aa, Homo sapiens
MAQILPIRFQEHLQLQNLGINPANIGFSTLTMESDKFICIREKVGEQAQVVIIDMNDPSNPIRRPISADSAIMNPASKVIALKAGKTLQIFNIEMKSKMKAHTMTDDVTFWKWISLNTVALVTDNAVYHWSMEGESQPVKMFDRHSSLAGCQIINYRTDAKQKWLLLTGISAQQNRVVGAMQLYSVDRKVSQPIEGHAASFAQFKMEGNAEESTLFCFAVRGQAGGKLHIIEVGTPPTGNQPFPKKAVDVFFPPEAQNDFPVAMQISEKHDVVFLITKYGYIHLYDLETGTCIYMNRISGETIFVTAPHEATAGIIGVNRKGQVLSVCVEEENIIPYITNVLQNPDLALRMAVRNNLAGAEELFARKFNALFAQGNYSEAAKVAANAPKGILRTPDTIRRFQSVPAQPGQTSPLLQYFGILLDQGQLNKYESLELCRPVLQQGRKQLLEKWLKEDKLECSEELGDLVKSVDPTLALSVYLRANVPNKVIQCFAETGQVQKIVLYAKKVGYTPDWIFLLRNVMRISPDQGQQFAQMLVQDEEPLADITQIVDVFMEYNLIQQCTAFLLDALKNNRPSEGPLQTRLLEMNLMHAPQVADAILGNQMFTHYDRAHIAQLCEKAGLLQRALEHFTDLYDIKRAVVHTHLLNPEWLVNYFGSLSVEDSLECLRAMLSANIRQNLQICVQVASKYHEQLSTQSLIELFESFKSFEGLFYFLGSIVNFSQDPDVHFKYIQAACKTGQIKEVERICRESNCYDPERVKNFLKEAKLTDQLPLIIVCDRFDFVHDLVLYLYRNNLQKYIEIYVQKVNPSRLPVVIGGLLDVDCSEDVIKNLILVVRGQFSTDELVAEVEKRNRLKLLLPWLEARIHEGCEEPATHNALAKIYIDSNNNPERFLRENPYYDSRVVGKYCEKRDPHLACVAYERGQCDLELINVCNENSLFKSLSRYLVRRKDPELWGSVLLESNPYRRPLIDQVVQTALSETQDPEEVSVTVKAFMTADLPNELIELLEKIVLDNSVFSEHRNLQNLLILTAIKADRTRVMEYINRLDNYDAPDIANIAISNELFEEAFAIFRKFDVNTSAVQVLIEHIGNLDRAYEFAERCNEPAVWSQLAKAQLQKGMVKEAIDSYIKADDPSSYMEVVQAANTSGNWEELVKYLQMARKKARESYVETELIFALAKTNRLAELEEFINGPNNAHIQQVGDRCYDEKMYDAAKLLYNNVSNFGRLASTLVHLGEYQAAVDGARKANSTRTWKEVCFACVDGKEFRLAQMCGLHIVVHADELEELINYYQDRGYFEELITMLEAALGLERAHMGMFTELAILYSKFKPQKMREHLELFWSRVNIPKVLRAAEQAHLWAELVFLYDKYEEYDNAIITMMNHPTDAWKEGQFKDIITKVANVELYYRAIQFYLEFKPLLLNDLLMVLSPRLDHTRAVNYFSKVKQLPLVKPYLRSVQNHNNKSVNESLNNLFITEEDYQALRTSIDAYDNFDNISLAQRSLSNTRPRRNLIPEQTNIEFQN

SEQ ID NO: 881796 - protein, 258 aa, Homo sapiens
MSGCELSPLGLRVGLSAGPVHGRRFPAPSGPWTGLNLASRQGAGPKPRDSRPYKAAAVGAWHARPEACAHTLSCPAFARLGRARRRPWMSHRTSSTFRAERSFHSSSSSSSSSTSSSASRALPAQDPPMEKALSMFSDDFGSFMRPHSEPLAFPARPGGAGNIKTLGDAYEFAVDVRDFSPEDIIVTTSNNHIEVRAEKLAADGTVMNTFAHKCQLPEDVDPTSVTSALREDGSLTIRARRHPHTEHVQQTFRTEIKI

SEQ ID NO: 881797 - protein, 119 aa, Homo sapiens
MQGLLHASLTAAHPTARPGGAGNIKTLGDAYEFAVDVRDFSPEDIIVTTSNNHIEVRAEKLAADGTVMNTFAHKCQLPEDVDPTSVTSALREDGSLTIRARRHPHTEHVQQTFRTEIKI

SEQ ID NO: 881798 - protein, 258 aa, Homo sapiens; identical to SEQ ID NO: 881796

SEQ ID NO: 881799 - protein, 258 aa, Homo sapiens; identical to SEQ ID NO: 881796

SEQ ID NO: 881800 - protein, 258 aa, Homo sapiens; identical to SEQ ID NO: 881796

SEQ ID NO: 881801 - protein, 250 aa, Homo sapiens
MSGCELSPLGLRVGLSAGPVHGRRFPAPSGPWTGLNLASRQGAGPKPRDSRPYKAAAVGAWHARPEACAHTLSCPAFARLGRARRRPWMSHRTSSTFRAERSFHSSSSSSSSSTSSSASRALPAQDPPMEKALSMFSDDFGSFMRPHSEPLAFPGKCPGPEGRGGAQGGDVCSRAPPKALWLPVGLEQVLHSLQPCVATKTDVATGTDVAMKTGGPLRNSCGPGGWTWFHGHPCSVTTANPSWSPGGLDG

SEQ ID NO: 881802 - protein, 258 aa, Homo sapiens; identical to SEQ ID NO: 881796

SEQ ID NO: 881803 - protein, 343 aa, Homo sapiens
RTAARTPDVRQLQASRRGIAVASWCSPRWFAGEEMAFVKSGWLLRQSTILKRWKKNWFDLWSDGHLIYYDDQTRQNIEDKVHMPMDCINIRTGQECRDTQPPDGKSKDCMLQIVCRDGKTISLCAESTDDCLAWKFTLQDSRTNTAYVGSAVMTDETSVVSSPPPYTAYAAPAPEELHSKGPKIHTTTSAKTQAVLPTRCFFPSESPIRRSVQISVLLPAVNIRRRIKLTFPQPARPRAPRSLCLWQTWFAGKRAPSLPTAATAPALPSCPSPPAPSQALPPSLAGWRSPSSAPLPPEQALAPRSFQLSKHQARPRPHRPGTPPVPAWPGVPPPPPARPPALR

SEQ ID NO: 881804 - protein, 256 aa, Homo sapiens
RTAARTPDVRQLQASRRGIAVASWCSPRWFAGEEMAFVKSGWLLRQSTILKRWKKNWFDLWSDGHLIYYDDQTRQNIEDKVHMPMDCINIRTGQECRDTQPPDGKSKDCMLQIVCRDGKTISLCAESTDDCLAWKFTLQDSRTNTAYVGSAVMTDETSVVSSPPPYTAYAAPAPEQAYGYGPYGGAYPPGTQVVYAANGQAYAVPYQYPYAGLYGQQPANQVIIRERYRDNDSDLALGMLAGAATGMALGSLFWVF

SEQ ID NO: 881805 - protein, 252 aa, Homo sapiens
GLRATRPWVASAEARSPCVLLFSTLFAGEEMAFVKSGWLLRQSTILKRWKKNWFDLWSDGHLIYYDDQTRQNIEDKVHMPMDCINIRTGQECRDTQPPDGKSKDCMLQIVCRDGKTISLCAESTDDCLAWKFTLQDSRTNTAYVGSAVMTDETSVVSSPPPYTAYAAPAPEQAYGYGPYGGAYPPGTQVVYAANGQAYAVPYQYPYAGLYGQQPANQVIIRERYRDNDSDLALGMLAGAATGMALGSLFWVF

SEQ ID NO: 881806 - protein, 264 aa, Homo sapiens
RTAARTPDVRQLQASRRGIAVASWCSPRWFAGEEMAFVKSGWLLRQSTILKRWKKNWFDLWSDGHLIYYDDQTRQNIEDKVHMPMDCINIRTGQECRDTQPPDGKSKDCMLQIVCRDGKTISLCAESTDDCLAWKFTLQDSRTNTAYVGSAVMTDETSVVSSPPPYTAYAAPAPEVGRTLSLQQAYGYGPYGGAYPPGTQVVYAANGQAYAVPYQYPYAGLYGQQPANQVIIRERYRDNDSDLALGMLAGAATGMALGSLFWVF

SEQ ID NO: 881807 - protein, 270 aa, Homo sapiens
RTAARTPDVRQLQASRRGIAVASWCSPRWFAGEEMAFVKSGWLLRQSTILKRWKKNWFDLWSDGHLIYYDDQTRQNIEDKVHMPMDCINIRTGQECRDTQPPDGKSKDCMLQIVCRDGKTISLCAESTDDCLAWKFTLQDSRTNTAYVGSAVMTDETSVVSSPPPYTAYAAPAPEQAYGYGPYGGAYPPGTQVVYAANGQAYAVPYQYPYAETILMTRHCTAVSRGLYGQQPANQVIIRERYRDNDSDLALGMLAGAATGMALGSLFWVF

SEQ ID NO: 881808 - protein, 226 aa, Homo sapiens
RTAARTPDVRQLQASRRGIAVASWCSPRWFAGEEMAFVKSGWLLRQSTILKRWKKNWFDLWSDGHLIYYDDQTRQNIEDKVHMPMDCINIRTGQECRDTQPPDGKSKDCMLQIVCRDGKTISLCAESTDDCLAWKFTLQDSRTNTAYVGSAVMTDETSVVSSPPPYTAYAAPAPEQAYGYGPYGGAYPPGTQVVYAANGQAYAVPYQYPYADFMDSSLRPMRYRLT

SEQ ID NO: 881809 - protein, 208 aa, Homo sapiens
VHIQSSSVPHRFAGEEMAFVKSGWLLRQSTILKRWKKNWFDLWSDGHLIYYDDQTRQNIEDKVHMPMDCINIRTGQECRDTQPPDGKSKDCMLQIVCRDGKTISLCAESTDDCLAWKFTLQDSRTNTAYVGSAVMTDETSVVSSPPPYTAYAAPAPEQAYGYGPYGGAYPPGTQVVYAANGQAYAVPYQYPYADFMDSSLRPMRYRLT

SEQ ID NO: 881810 - protein, 256 aa, Homo sapiens; identical to SEQ ID NO: 881804

SEQ ID NO: 881811 - protein, 241 aa, Homo sapiens
RTAARTPDVRQLQASRRGIAVASWCSPRWFAGTILKRWKKNWFDLWSDGHLIYYDDQTRQNIEDKVHMPMDCINIRTGQECRDTQPPDGKSKDCMLQIVCRDGKTISLCAESTDDCLAWKFTLQDSRTNTAYVGSAVMTDETSVVSSPPPYTAYAAPAPEQAYGYGPYGGAYPPGTQVVYAANGQAYAVPYQYPYAGLYGQQPANQVIIRERYRDNDSDLALGMLAGAATGMALGSLFWVF

SEQ ID NO: 881812 - protein, 185 aa, Homo sapiens
YDFEPACFCSVGEEMAFVKSGWLLRQSTILKRWKKNWFDLWSDGHLIYYDDQTRQNIEDKVHMPMDCINIRTGQECRDTQPPDGKSKDCMLQIVCRDGKTISLCAESTDDCFRLMAMGHTVVRTRQELKLSTLRMGRRMPCPTSTHMQDFMDSSLLTKSSFESAIETTTATWHWACWQEQPRAWP

SEQ ID NO: 881813 - protein, 474 aa, Homo sapiens
MWTVQNRESLGLLSFPVMITMVCCAHSTNEPSNMSYVKETVDRLLKGYDIRLRPDFGGPPVDVGMRIDVASIDMVSEVNMDYTLTMYFQQSWKDKRLSYSGIPLNLTLDNRVADQLWVPDTYFLNDKKSFVHGVTVKNRMIRLHPDGTVLYGLRITTTAACMMDLRRYPLDEQNCTLEIESYGYTTDDIEFYWNGGEGAVTGVNKIELPQFSIVDYKMVSKKVEFTTGAYPRLSLSFRLKRNIGYFILQTYMPSTLITILSWVSFWINYDASAARVALGITTVLTMTTISTHLRETLPKIPYVKAIDIYLMGCFVFVFLALLEYAFVNYIFFGKGPQKKGASKQDQSANEKNKLEMNKVQVDAHGNILLSTLEIRNETSGSEVLTSVSDPKATMYSYDSASIQYRKPLSSREAYGRALDRHGVPSKGRIRRRASQLKVKIPDLTDVNSIDKWSRMFFPITFSLFNVVYWLYYVH

SEQ ID NO: 881814 - protein, 69 aa, Homo sapiens [sequence omitted]

SEQ ID NO: 881815 - protein, 195 aa, Homo sapiens
MALLFPLLAALVMTSYSPVGSLGCDLPQNHGLLSRNTLVLLHQMRRISPFLCLKDRRDFRFPQEMVKGSQLQKAHVMSVLHEMLQQIFSLFHTERSSAAWNMTLLDQLHTGLHQQLQHLETCLLQVVGEGESAGAISSPALTLRRYFQGIRVYLKEKKYSDCAWEVVRMEIMKSLFLSTNMQERLRSKDRDLGSS

SEQ ID NO: 881816 - protein, 250 aa, Homo sapiens
MAALSCLLDSVRRDIKKVDRELRQLRCIDEFSTRCLCDLYMHPYCCCDLHPYPYCLCYSKRSRSCGLCDLYPCCLCDYKLYCLRPSLRSLERKAIRAIEDEKRELAKLRRTTNRILASSCCSSNILGSVNVCGFEPDQVKVRVKDGKVCVSAERENRYDCLGSKKYSYMNICKEFSLPPCVDEKDVTYSYGLGSCVKIESPCYPCTSPCSPCSPCNPCNPCSPCNPCSPYDPCNPCYPCGSRFSCRKMIL

SEQ ID NO: 881817 - protein, 171 aa, Homo sapiens
MAALSCLLDSVRRDIKKVDRELRQLRCIDEFSTRCLCDLYMHPYCCCDLHPYPYCLCYSKRSRSCGLCDLYPCCLCDYKLYCLRPSLRSLERKAIRAIEDEKRELAKLRRTTNRILASSCCSSNILGSVNVCGFEPDQVKVRVKDGKDLPETFPKLLSCDGRNMEGQRSST

SEQ ID NO: 881818 - protein, 167 aa, Homo sapiens
MAALSCLLDSVRRDIKKVDRELRQLRCIDEFSTRCLCDLYMHPYCCCDLHPYPYCLCYSKRSRSCGLCDLYPCCLCDYKLYCLRPSLRSLERKAIRAIEDEKRELAKLRRTTNRILASSCCSSNILGSVNVCGFEPDQVKVRVKDGKPVQPVQPLQPLQPLQPVQPI

SEQ ID NO: 881819 - protein, 108 aa, Homo sapiens
PQAVGSVRSRYRAGAGAKAGRDLRRDRRTSEELPCLGHLPQNRTTTAMKPKPQIFECQRRNVVSSGREEGLLSLSILSWEYSYNPGLCCLVGVINNYLTWKFNAKSPG

SEQ ID NO: 881820 - protein, 205 aa, Homo sapiens
MSGASSSEQNNNSYETKTPNLRMSEKKCSWASYMTNSPTLIVMIGLPARGKTYVSKKLTRYLNWIGVPTKVFNLGVYRREAVKSYKSYDFFRHDNEEAMKIRKQCALVALEDVKAYLTEENGQIAVFDATNTTRERRDMILNFAEQNSFKVFFVESVCDDPDVIAANILVGDTPTYHLLFTFCAVCVVGCVCVCVCVCCWGGVFS

SEQ ID NO: 881821 - protein, 471 aa, Homo sapiens
MSGASSSEQNNNSYETKTPNLRMSEKKCSWASYMTNSPTLIVMIGLPARGKTYVSKKLTRYLNWIGVPTKVFNLGVYRREAVKSYKSYDFFRHDNEEAMKIRKQCALVALEDVKAYLTEENGQIAVFDATNTTRERRDMILNFAEQNSFKVFFVESVCDDPDVIAANILEVKVSSPDYPERNRENVMEDFLKRIECYKVTYRPLDPDNYDKDLSFIKVINVGQRFLVNRVQDYIQSKIVYYLMNIHVQPRTIYLCRHGESEFNLLGKIGGDSGLSVRGKQFAQALRKFLEEQEITDLKVWTSQLKRTIQTAESLGVPYEQWKILNEIDAGVCEEMTYAEIEKRYPEEFALRDQEKYLYRYPGGESYQDLVQRLEPVIMELERQGNVLVISHQAVMRCLLAYFLDKGADELPYLRCPLHTIFKLTPVAYGCKVETIKLNVEAVNTHRDKPTAAETTLAVRRRPSAASLMLPC

SEQ ID NO: 881822 - protein, 505 aa, Homo sapiens
MSGASSSEQNNNSYETKTPNLRMSEKKCSWASYMTNSPTLIVMIGLPARGKTYVSKKLTRYLNWIGVPTKVFNLGVYRREAVKSYKSYDFFRHDNEEAMKIRKQCALVALEDVKAYLTEENGQIAVFDATNTTRERRDMILNFAEQNSFKVFFVESVCDDPDVIAANILEVKVSSPDYPERNRENVMEDFLKRIECYKVTYRPLDPDNYDKDLSFIKVINVGQRFLVNRVQDYIQSKIVYYLMNIHVQPRTIYLCRHGESEFNLLGKIGGDSGLSVRGKQFAQALRKFLEEQEITDLKVWTSQLKRTIQTAESLGVPYEQWKILNEIDAGVCEEMTYAEIEKRYPEEFALRDQEKYLYRYPGGESYQDLVQRLEPVIMELERQGNVLVISHQAVMRCLLAYFLDKGADELPYLRCPLHTIFKLTPVAYGCKVETIKLNVEAVNTHRDKPTNNFPKNQTPVRMRRNSFTPLSSSNTIRRPRNYSVGSRPLKPLSPLRAQDMQEGAD

SEQ ID NO: 881823 - protein, 505 aa, Homo sapiens; identical to SEQ ID NO: 881822

SEQ ID NO: 881824 - protein, 436 aa, Homo sapiens [sequence omitted]

SEQ ID NO: 881825 - protein, 436 aa, Homo sapiens [sequence omitted]

SEQ ID NO: 881826 - protein, 112 aa, Homo sapiens
MSSRKSKSNSLIHTECLSQVQRILRERFCRQSPHSNLFGVQVQYKHLSELLKRTALHGESNSVLIIGPRGSGKTMLISHALKELMEIEEVSENVLQVHLNGKYAIILPLEIM

SEQ ID NO: 881827 - protein, 436 aa, Homo sapiens [sequence omitted]

SEQ ID NO: 881828 - protein, 481 aa, Homo sapiens
MSSRKSKSNSLIHTECLSQVQRILRERFCRQSPHSNLFGVQVQYKHLSELLKRTALHGESNSVLIIGPRGSGKTMLISHALKELMEIEEVSENVLQVHLNGLLQINDKIALKEITRQLNLENVVGDKVFGSFAENLSFLLEALKKGDRTSSCPVIFILDEFDLFAHHKNQTLLYNLFDISQSAQTPIAVIGLTCRLDILELLEKRVKSRFSHRQIHLMNSFGFPQYVKIFKEQLSLPAEFPDKVFAEKWNENVQFSLATSAFILLGLKRQYRLWHLQLYYLIGDHISQSLENLRVLDTKYLSEDRSVQEVLQKHFNISKNLRSLHMLLMLALNRVTASHPFMTAVDLMEASQLCSMDSKANIVHGLSVLEICLIIAMKHLNDIYEEEPFNFQMVYNEFQKFVQRKAHSVYNFEKPVVMKAFEHLQQLELIKPMERTSGNSQREYQLMKLLLDNTQIMNALQKYPNCPTDVRQWATSSLSWL

SEQ ID NO: 881829 - protein, 436 aa, Homo sapiens [sequence omitted]

SEQ ID NO: 881830 - protein, 321 aa, Homo sapiens
MSSRKSKSNSLIHTECLSQVQRILRERFCRQSPHSNLFGVQVQYKHLSELLKRTALHGESNSVLIIGPRGSGKTMLISHALKELMEIEEVSENVLQVHLNGLLQINDKIALKEITRQLNLENVVGDKVFGSFAENLSFLLEALKKGDRTSSCPVIFILDEFDLFAHHKNQTLLYNLFDISQSAQTPIAVIGLTCRLDILELLEKRVKSRFSHRQIHLMNSFGFPQYVKIFKEQLSLPAEFPDKVFAEKWNENVQYLSEDRSVQEVLQKHFNISKNLRSLHMLLMLALNRVTASHPFMTAVDLMEASQLCSMDSKANIVHGF

SEQ ID NO: 881831 - protein, 240 aa, Homo sapiens
MSSRKSKSNSLIHTECLSQVQRILRERFCRQSPHSNLFGVQVQYKHLSELLKRTALHGESNSVLIIGPRGSGKTMLISHALKELMEIEEVSENVLQVHLNGLLQINDKIALKEITRQLNLENVVGDKVFGSFAENLSFLLEALKKGDRTSSCPVIFILDEFDLFAHHKNQTLLYNLFDISQSAQTPIAVIGLTCRLDILELLEKRVKSRFSHRQIHLMNSFGFPQYVKIFKEHCGHYTCY

SEQ ID NO: 881832 - protein, 362 aa, Homo sapiens [sequence omitted]

SEQ ID NO: 881833 - protein, 436 aa, Homo sapiens [sequence omitted]

SEQ ID NO: 881834 - protein, 436 aa, Homo sapiens [sequence omitted]

SEQ ID NO: 881835 - protein, 345 aa, Homo sapiens
MSSRKSKSNSLIHTECLSQVQRILRERFCRQSPHSNLFGVQVQYKHLSELLKRTALHGESNSVLIIGPRGSGKTMLISHALKELMEIEEVSENVLQVHLNGLLQINDKIALKEITRQLNLENVVGDKVFGSFAENLSFLLEALKKGDRTSSCPVIFILDEFDLFAHHKNQTLLYNLFDISQSAQTPIAVIGLTCRLDILELLEKRVKSRFSHRQIHLMNSFGFPQYVKIFKEQLSLPAEFPDKVFAEKWNENVQYLSEDRSVQEVLQKHFNISKNLRSLHMLLMLALNRVTASHPFMTAVDLMEASQLCSMDSKANIVHGLSVLEICLIIAIVSEVCSKESTFRL

SEQ ID NO: 881836 - protein, 352 aa, Homo sapiens
MEIEEVSENVLQVHLNGLLQINDKIALKEITRQLNLENVVGDKVFGSFAENLSFLLEALKKGDRTSSCPVIFILDEFDLFAHHKNQTLLYNLFDISQSAQTPIAVIGLTCRLDILELLEKRVKSRFSHRQIHLMNSFGFPQYVKIFKEQLSLPAEFPDKVFAEKWNENVQYLSEDRSVQEVLQKHFNISKNLRSLHMLLMLALNRVTASHPFMTAVDLMEASQLCSMDSKANIVHGLSVLEICLIIAMKHLNDIYEEEPFNFQMVYNEFQKFVQRKAHSVYNFEKPVVMKAFEHLQQLELIKPMERTSGNSQREYQLMKLLLDNTQIMNALQKYPNCPTDVRQWATSSLSWL

SEQ ID NO: 881837 - protein, 352 aa, Homo sapiens; identical to SEQ ID NO: 881836

SEQ ID NO: 881838 - protein, 341 aa, Homo sapiens
MDFILGLLQINDKIALKEITRQLNLENVVGDKVFGSFAENLSFLLEALKKGDRTSSCPVIFILDEFDLFAHHKNQTLLYNLFDISQSAQTPIAVIGLTCRLDILELLEKRVKSRFSHRQIHLMNSFGFPQYVKIFKEQLSLPAEFPDKVFAEKWNENVQYLSEDRSVQEVLQKHFNISKNLRSLHMLLMLALNRVTASHPFMTAVDLMEASQLCSMDSKANIVHGLSVLEICLIIAMKHLNDIYEEEPFNFQMVYNEFQKFVQRKAHSVYNFEKPVVMKAFEHLQQLELIKPMERTSGNSQREYQLMKLLLDNTQIMNALQKYPNCPTDVRQWATSSLSWL

SEQ ID NO: 881839 - protein, 256 aa, Homo sapiens
MSSRKSKSNSLIHTECLSQVQRILRERFCRQSPHSNLFGVQVQYKHLSELLKRTALHGESNSVLIIGPRGSGKTMLISHALKELMEIEEVSENVLQVHLNGLLQINDKIALKEITRQLNLENVVGDKVFGSFAENLSFLLEALKKGDRTSSCPVIFILDEFDLFAHHKNQTLLYNLFDISQSAQTPIAVIGLTCRLDILELLEKRVKSRFSHRQIHLMNSFGFPQYVKIFKEQLSLPAEFPDKVFAEKWNENVQVS

SEQ ID NO: 881840 - protein, 981 aa, Homo sapiens
MDGFAGSLDDSISAASTSDVQDRLSALESRVQQQEDEITVLKAALADVLRRLAISEDHVASVKKSVSSKGQPSPRAVIPMSCITNGSGANRKPSHTSAVSIAGKETLSSAAKSGTEKKKEKPQGQREKKEESHSNDQSPQIRASPSPQPSSQPLQIHRQTPESKNATPTKSIKRPSPAEKSHNSWENSDDSRNKLSKIPSTPKLIPKVTKTADKHKDVIINQEGEYIKMFMRGRPITMFIPSDVDNYDDIRTELPPEKLKLEWAYGYRGKDCRANVYLLPTGEIVYFIASVVVLFNYEERTQRHYLGHTDCVKCLAIHPDKIRIATGQIAGVDKDGRPLQPHVRVWDSVTLSTLQIIGLGTFERGVGCLDFSKADSGVHLCVIDDSNEHMLTVWDWQKKAKGAEIKTTNEVVLAVEFHPTDANTIITCGKSHIFFWTWSGNSLTRKQGIFGKYEKPKFVQCLAFLGNGDVLTGDSGGVMLIWSKTTVEPTPGKGPKGVYQISKQIKAHDGSVFTLCQMRNGMLLTGGGKDRKIILWDHDLNPEREIEVPDQYGTIRAVAEGKADQFLVGTSRNFILRGTFNDGFQIEVQGHTDELWGLATHPFKDLLLTCAQDRQVCLWNSMEHRLEWTRLVDEPGHCADFHPSGTVVAIGTHSGRWFVLDAETRDLVSIHTDGNEQLSVMRYSIDGTFLAVGSHDNFIYLYVVSENGRKYSRYGRCTGHSSYITHLDWSPDNKYIMSNSGDYEILYWDIPNGCKLIRNRSDCKDIDWTTYTCVLGFQVFGVWPEGSDGTDINALVRSHNRKVIAVADDFCKVHLFQYPCSKAKAPSHKYSAHSSHVTNVSFTHNDSHLISTGGKDMSIIQWKLVEKLSLPQNETVADTTLTKAPVSSTESVIQSNTPTPPPSQPLNETAEEESRISSSPTLLENSLEQTVEPSEDHSEEESEEGSGDLGEPLYEEPCNEISKEQAKATLLEDQQDPSPSS

SEQ ID NO: 881841 - protein, 116 aa, Homo sapiens
LFNYEERTQRHYLGHTDCVKCLAIHPDKIRIATGQIAGVDKDGRPLQPHVRVWDSVTLSTLQIIGLGTFERGVGCLDFSKADSGVHLCVIDDSNEHMLTVWDWQKKAKGAEIKVNF

SEQ ID NO: 881842 - protein, 98 aa, Homo sapiens
PASLRLLQVGAPGGRAGPGRGHTTSSVTGMGLTWGPPGGPPAAAAASSSLGFLRASAGGRGGGLLGGCLMVPPICGRKRFFFFFFFFSILGLFWFFIS

SEQ ID NO: 881843 - protein, 245 aa, Homo sapiens [sequence omitted]

SEQ ID NO: 881844 - protein, 125 aa, Homo sapiens
MSIIQWKLVEKLSLPQNETVADTTLTKAPVSSTESVIQSNTPTPPPSQPLNETAEEESRISSSPTLLENSLEQTVEPSEDHSEEESEEGSGDLGEPLYEEPCNEISKEQAKATLLEDQQDPSPSS

SEQ ID NO: 881845 - protein, 214 aa, Homo sapiens
SSRPCWVLGFQVFGVWPEGSDGTDINALVRSHNRKVIAVADDFCKVHLFQYPCSKAKAPSHKYSAHSSHVTNVSFTHNDSHLISTGGKDMSIIQWKLVEKLSLPQNETVADTTLTKAPVSSTESVIQSNTPTPPPSQPLNETAEEESRISSSPTLLENSLEQTVEPSEDHSEEESEEGSGDLGEPLYEEPCNEISKEQAKATLLEDQQDPSPSS

SEQ ID NO: 881846 - protein, 981 aa, Homo sapiens; identical to SEQ ID NO: 881840

SEQ ID NO: 881847 - protein, 981 aa, Homo sapiens; identical to SEQ ID NO: 881840

SEQ ID NO: 881848 - protein, 981 aa, Homo sapiens; identical to SEQ ID NO: 881840

SEQ ID NO: 881849 - protein, 981 aa, Homo sapiens; identical to SEQ ID NO: 881840

SEQ ID NO: 881850 - protein, 981 aa, Homo sapiens; identical to SEQ ID NO: 881840

SEQ ID NO: 881851 - protein, 981 aa, Homo sapiens; identical to SEQ ID NO: 881840

SEQ ID NO: 881852 - protein, 214 aa, Homo sapiens; identical to SEQ ID NO: 881845

SEQ ID NO: 881853 - protein, 981 aa, Homo sapiens; identical to SEQ ID NO: 881840

SEQ ID NO: 881854 - protein, 929 aa, Homo sapiens
MDGFAGSLDDSISAASTSDVQDRLSALESRVQQQEDEITVLKAALADVLRRLAISEDHVASVKKSVSSKGQPSPRAVIPMSCITNGSGANRKPSHTSAVSIAGKETLSSAAKSGTEKKKEKPQGQREKKEESHSNDQSPQIRASPSPQPSSQPLQIHRQTPESKNATPTKSIKRPSPAEKSHNSWENSDDSRNKLSKIPSTPKLIPKVTKTADKHKDVIINQEGEYIKMFMRGRPITMFIPSDVDNYDDIRTELPPEKLKLEWAYGYRGKDCRANVYLLPTGEIVYFIASVVVLFNYEERTQRHYLGHTDCVKCLAIHPDKIRIATGQIAGVDKDGRPLQPHVRVWDSVTLSTLQIIGLGTFERGVGCLDFSKADSGVHLCVIDDSNEHMLTVWDWQKKAKGAEIKTTNEVVLAVEFHPTDANTIITCGKSHIFFWTWSGNSLTRKQGIFGKYEKPKFVQCLAFLGNGDVLTGDSGGVMLIWSKTTVEPTPGKGPKGVYQISKQIKAHDGSVFTLCQMRNGMLLTGGGKDRKIILWDHDLNPEREIEVPDQYGTIRAVAEGKADQFLVGTSRNFILRGTFNDGFQIEVQGHTDELWGLATHPFKDLLLTCAQDRQVCLWNSMEHRLEWTRLVDEPGHCADFHPSGTVVAIGTHSGRWFVLDAETRDLVSIHTDGNEQLSVMRYSIDGTFLAVGSHDNFIYLYVVSENGRKYSRYGRCTGHSSYITHLDWSPDNKYIMSNSGDYEILYWDIPNGCKLIRNRSDCKDIDWTTYTCVLGFQVFGVWPEGSDGTDINALVRSHNRKVIAVADDFCKVHLFQYPCSKAKAPSHKYSAHSSHVTNVSFTHNDSHLISTGGKDMSIIQWKLVEKLSLPQNETVADTTLTKAPVSSTESVIQSADRRIISIREIVGIRSRIVVKYSTDATCPMMVKG

SEQ ID NO: 881855 - protein, 126 aa, Homo sapiens
MEVVQTENQVIPVLSQLQEKKLFHLLLNGTEKKKEKPQGQREKKEESHSNDQSPQIRASPSPQPSSQPLQIHRQTPESKNATPTKSIKRPSPAEKSHNSWENSDDSRNKLSKIPSTPKLIPKVTKT

SEQ ID NO: 881856 - protein, 431 aa, Homo sapiens
MALVLCAIGVYLHPPVQLLCCLVFLQPLQPHVRVWDSVTLSTLQIIGLGTFERGVGCLDFSKADSGVHLCVIDDSNEHMLTVWDWQKKAKGAEIKTTNEVVLAVEFHPTDANTIITCGKSHIFFWTWSGNSLTRKQGIFGKYEKPKFVQCLAFLGNGDVLTGDSGGVMLIWSKTTVEPTPGKGPKGVYQISKQIKAHDGSVFTLCQMRNGMLLTGGGKDRKIILWDHDLNPEREIEVPDQYGTIRAVAEGKADQFLVGTSRNFILRGTFNDGFQIEVQGHTDELWGLATHPFKDLLLTCAQDRQVCLWNSMEHRLEWTRLVDEPGHCADFHPSGTVVAIGTHSGRWFVLDAETRDLVSIHTDGNEQLSVMRYSIDGTFLAVGSHDNFIYLYVVSENGRKYSRYGRCTVSSEVEQVVKLLGNFTSVKNKFLH

SEQ ID NO: 881857 - protein, 166 aa, Homo sapiens
MDGFAGSLDDSISAASTSDVQDRLSALESRVQQQEDEITVLKAALADVLRRLAISEDHVASVKKSVSSKGQPSPRAVIPMSCITNGSGANRKPSHTSAVSIAGKETLSSAAKSGTEKKKEKPQGQREKKEESHSNDQSPQIRASPSPQPSSQPLQIHRQTPAWVTE

SEQ ID NO: 881858 - protein, 133 aa, Homo sapiens
MSCITNGSGANRKPSHTSAVSIAGKETLSSAAKRLECNGAISAHRNLHLPCSRDSPAAAPGVAGITVVQKKRKKNHKDREKKKRNLILMIKVHKFEHHLLPSPLHNLSKYTDKLQKARMLLPPKGFNCPQVQS

SEQ ID NO: 881859 - protein, 71 aa, Homo sapiens
MDGFAGSLGEYGWGVLRLLRRVGTFFLPHTAQALPSRLPLGVAAAPLHMFPSRLPPSADSGGLRAPPPCPT

SEQ ID NO: 881860 - protein, 690 aa, Homo sapiens
HASGSRGPRSRPPLAWPGPEAAPHGLGLARGAGTGARSDMGKKHKKHKSDKHLYEEYVEKPLKLVLKVGGNEVTELSTGSSGHDSSLFEDKNDHDKHKDRKRKKRKKGEKQIPGEEKGRKRRRVKEDKKKRDRDQVENEAEKDLQCHAPVRLDLPPEKPLTSSLAKQEEVEQTPLQEALNQLMRQLQRKDPSAFFSFPVTDFIAPGYSMIIKHPMDFSTMKEKIKNNDYQSIEELKDNFKLMCTNAMIYNKPETIYYKAAKKLLHSGMKILSQERIQSLKQSIDFMADLQKTRKQKDGTDTSQSGEDGGCWQREREDSGDAEAHAFKSPSKENKKKDKDMLEDKFKSNNLEREQEQLDRIVKESGGKLTRRLVNSQCEFERRKPDGTTTLGLLHPVDPIVGEPGYCPVRLGMTTGRLQSGVNTLQGFKEDKRNKVTPVLYLNYGPYSSYAPHYDSTFANISKDDSDLIYSTYGEDSDLPSDFSIHEFLATCQDYPYVMADSLLDVLTKGGHSRTLQEMEMSLPEDEGHTRTLDTAKEMEITEVEPPGRLDSSTQDRLIALKAVTNFGVPVEVFDSEEAEIFQKKLDETTRLLRELQEAQNERLSTRPPPNMICLLGPSYREMHLAEQVTNNLKELAQQVTPGDIVSTYGVRKAMGISIPSPVMENNFVDLTEDTEEPKKTDVAECGPGGS

SEQ ID NO: 881861 - protein, 690 aa, Homo sapiens; identical to SEQ ID NO: 881860

SEQ ID NO: 881862 - protein, 690 aa, Homo sapiens; identical to SEQ ID NO: 881860

SEQ ID NO: 881863 - protein, 690 aa, Homo sapiens; identical to SEQ ID NO: 881860

SEQ ID NO: 881864 - protein, 654 aa, Homo sapiens
HASGSRGPRSRPPLAWPGPEAAPHGLGLARGAGTGARSDMGKKHKKHKSDKHLYEEYVEKPLKLVLKVGGNEVTELSTGSSGHDSSLFEDKNDHDKHKDRKRKKRKKGEKQIPGEEKGRKRRRVKEDKKKRDRDQVENEAEKDLQCHAPVRLDLPPEKPLTSSLAKQEEVEQTPLQEALNQLMRQLQRKDPSAFFSFPVTDFIAPGYSMIIKHPMDFSTMKEKIKNNDYQSIEELKDNFKLMCTNAMIYNKPETIYYKAAKKLLHSGMKILSQERIQSLKQSIDFMADLQKTRKQKDGTDTSQSGEDGGCWQREREDSGDAEAHAFKSPSKENKKKDKDMLEDKFKSNNLEREQEQLDRIVKESGGKLTRRLVNSQCEFERRKPDGTTTLGLLHPVDPIVGVLYLNYGPYSSYAPHYDSTFANISKDDSDLIYSTYGEDSDLPSDFSIHEFLATCQDYPYVMADSLLDVLTKGGHSRTLQEMEMSLPEDEGHTRTLDTAKEMEITEVEPPGRLDSSTQDRLIALKAVTNFGVPVEVFDSEEAEIFQKKLDETTRLLRELQEAQNERLSTRPPPNMICLLGPSYREMHLAEQVTNNLKELAQQVTPGDIVSTYGVRKAMGISIPSPVMENNFVDLTEDTEEPKKTDVAECGPGGS

SEQ ID NO: 881865 - protein, 636 aa, Homo sapiens
HASGSRGPRSRPPLAWPGPEAAPHGLGLARGAGTGARSDMGKKHKKHKSDKHLYEEYVEKPLKLVLKVGGNEVTELSTGSSGHDSSLFEDKNDHDKHKDRKRKKRKKGEKQIPGEEKGRKRRRVKEDKKKRDRDQVENEAEKDLQCHAPVRLDLPPEKPLTSSLAKQEEVEQTPLQEALNQLMRQLQRKDPSAFFSFPVTDFIAPGYSMIIKHPMDFSTMKEKIKNNDYQSIEELKDNFKLMCTNAMIYNKPETIYYKAAKKLLHSGMKILSQERIQSLKQSIDFMADLQKTRKQKDGTDTSQSGEDGGCWQREREDSGDAEAHAFKSPSKENKKKDKDMLEDKFKSNNLEREQEQLDRIVKESGGKLTRRLVNSQCEFERRKVLYLNYGPYSSYAPHYDSTFANISKDDSDLIYSTYGEDSDLPSDFSIHEFLATCQDYPYVMADSLLDVLTKGGHSRTLQEMEMSLPEDEGHTRTLDTAKEMEITEVEPPGRLDSSTQDRLIALKAVTNFGVPVEVFDSEEAEIFQKKLDETTRLLRELQEAQNERLSTRPPPNMICLLGPSYREMHLAEQVTNNLKELAQQVTPGDIVSTYGVRKAMGISIPSPVMENNFVDLTEDTEEPKKTDVAECGPGGS

SEQ ID NO: 881866 - protein, 505 aa, Homo sapiens
HASGSRGPRSRPPLAWPGPEAAPHGLGLARGAGTGARSDMGKKHKKHKSDKHLYEEYVEKPLKLVLKVGGNEVTELSTGSSGHDSSLFEDKNDHDKHKDRKRKKRKKGEKQIPGEEKGRKRRRVKEDKKKRDRDQVENEAEKDLQCHAPVRLDLPPEKPLTSSLAKQEEVEQTPLQEALNQLMRQLQRKDPSAFFSFPVTDFIAPGYSMIIKHPMDFSTMKEKIKNNDYQSIEELKDNFKLMCTNAMIYNKPETIYYKAAKKLLHSGMKILSQERIQSLKQSIDFMADLQKTRKQKDGTDTSQSGEDGGCWQREREDSGDAEAHAFKSPSKENKKKDKDMLEDKFKSNNLEREQEQLDRIVKESGGKLTRRLVNSQCEFERRKPDGTTTLGLLHPVDPIVGEPGYCPVRLGMTTGRLQSGVNTLQGFKEDKRNKVTPVLYLNYGPYSSYAPHYDSTFANISKDDSDLIYSTYGEDSDLPSDFSHCLKMKAILGHLTQQKKWRLQK

SEQ ID NO: 881867 - protein, 690 aa, Homo sapiens; identical to SEQ ID NO: 881860

SEQ ID NO: 881868 - protein, 568 aa, Homo sapiens
HASGSRGPRSRPPLAWPGPEAAPHGLGLARGAGTGARSDMGKKHKKHKSDKHLYEEYVEKPLKLVLKVGGNEVTELSTGSSGHDSSLFEDKNDHDKHKDRKRKKRKKGEKQIPGEEKGRKRRRVKEDKKKRDRDQVENEAEKDLQCHAPVRLDLPPEKPLTSSLAKQEEVEQTPLQEALNQLMRQLQRKDPSAFFSFPVTDFIAPGYSMIIKHPMDFSTMKEKIKNNDYQSIEELKDNFKLMCTNAMIYNKPETIYYKAAKKLLHSGMKILSQERIQSLKQSIDFMADLQKTRKQKDGTDTSQSGEDGGCWQREREDSGDAEAHAFKSPSKENKKKDKDMLEDKFKSNNLEREQEQLDRIVKESGGKLTRRLVNSQCEFERRKPDGTTTLGLLHPVDPIVGEPGYCPVRLGMTTGRLQSGVNTLQGFKEDKRNKVTPVLYLNYGPYSSYAPHYDSTFANISKDDSDLIYSTYGEDSDLPSDFSIHEFLATCQDYPYVMADSLLDVLTKGGHSRTLQEMEMSLPEDEGHTRTLDTAKEMEVILFYTLQEIFKWKIRGVREVLRMGRPIG

SEQ ID NO: 881869 - protein, 341 aa, Homo sapiens
LRCTRAECGRDGAGGLSGAQSWPRVLGAWRSNLPSDLHPDPDPEPGLARPPPPPPGPMDYSYLNSYDSCVAAMEASAYGDFGACSQPGGFQYSPLRPAFPAAGPPCPALGSSNCALGALRDHQPAPYSAVPYNFFPEPSGLHEKRKQRRIRTTFTSAQLKELERVFAETHYPDIYTREELALKIDLTEARVQVWFQNRRAKFRKQERAASAKGAAGAAGAKKGEARCSSEDDDSKESTCSPTPDSTASLPPPPAPGLASPRLSPSPLPVALGSGPGPGPGPQPLKGALWAGVAGGGGGGPGAGAAELLKAWQPAESGPGPFSGVLSSFHRKPGPALKTNLF

SEQ ID NO: 881870 - protein, 342 aa, Homo sapiens
RSAGSAPRCERYGRRGGEPARSAVSSGAGVSPGPSLFEPNPTNGRMTMESREMDCYLRRLKQELMSMKEVGDGLQDQMNCMMGALQELKLLQVQTALEQLEISGGGPVPGSPEGPRTQCEHPCWEGGRGPARPTVCSPSSQPSLGSSTKFPSHRSVCGRDLAPLPRTQPHQSCAQQGPERVEPDDWTSTLMSRGRNRQPLVLGDNVFADLVGNWLDLPELEKGGEKGETGGAREPKGEKGQPQELGRRFALTANIFKKFLRSVRPDRDRLLKEKPGWVTPMVPESRTGRSQKVKKRSLSKGSGHFPFPGTGEHRRGENPPTSCPKALEHSPSGFDINTAVWV

SEQ ID NO: 881871 - protein, 282 aa, Homo sapiens
MRQLMSMKEVGDGLQDQMNCMMGALQELKLLQVQTALEQLEISGGGPVPGSPEGPRTQCEHPCWEGGRGPARPTVCSPSSQPSLGSSTKFPSHRSVCGRDLAPLPRTQPHQSCAQQGPERVEPDDWTSTLMSRGRNRQPLVLGDNVFADLVGNWLDLPELEKGGEKGETGGAREPKGEKGQPQELGRRFALTANIFKKFLRSVRPDRDRLLKEKPGWVTPMVPESRTGRSQKVKKRSLSKGSGHFPFPGTGEHRRGENPPTSCPKALEHSPSGFDINTAVWV

SEQ ID NO: 881872 - protein, 225 aa, Homo sapiens
PPFELVFIVLAEHYKVVVNGNPFYEYGHRLPLQMVTHLQVDGDLQLQSINFIGGQPLRPQGPPMMPPYPGPGHCHQQLNSLPTMEGPPTFNPPVPYFGRLQGGLTARRTIIIKGYVPPTGKSFAINFKVGSSGDIALHINPRMGNGTVVRNSLLNGSWGSEEKKITHNPFGPGQFFDLSIRCGLDRFKVYANGQHLFDFAHRLSAFQRVDTLEIQGDVTLSYVQI

SEQ ID NO: 881873 - protein, 219 aa, Homo sapiens
EERKRSMPFMVVNGNPFYEYGHRLPLQMVTHLQVDGDLQLQSINFIGGQPLRPQGPPMMPPYPGPGHCHQQLNSLPTMEGPPTFNPPVPYFGRLQGGLTARRTIIIKGYVPPTGKSFAINFKVGSSGDIALHINPRMGNGTVVRNSLLNGSWGSEEKKITHNPFGPGQFFDLSIRCGLDRFKVYANGQHLFDFAHRLSAFQRVDTLEIQGDVTLSYVQI

SEQ ID NO: 881874 - protein, 224 aa, Homo sapiens
MEIPSMSTGTGFPYRWSPTCKWMGICNFNQSTSSEASPSGPRGCSPRCTNPAPRETPESNGCVIDICRLLENEYRFFLTSQTMEGPPTFNPPVPYFGRLQGGLTARRTIIIKGYVPPTGKSFAINFKVGSSGDIALHINPRMGNGTVVRNSLLNGSWGSEEKKITHNPFGPGQFFDLSIRCGLDRFKVYANGQHLFDFAHRLSAFQRVDTLEIQGDVTLSYVQI

SEQ ID NO: 881875 - protein, 137 aa, Homo sapiens
PIMNGGGVNGVRVEGRRRRMAIIIKGYVPPTGKSFAINFKVGSSGDIALHINPRMGNGTVVRNSLLNGSWGSEEKKITHNPFGPGQFFDLSIRCGLDRFKVYANGQHLFDFAHRLSAFQRVDTLEIQGDVTLSYVQI

SEQ ID NO: 881876 - protein, 189 aa, Homo sapiens
PPFELVFIVLAEHYKVVVNGNPFYEYGHRLPLQMVTHLQVDGDLQLQSINFIGGQPLRPQGPPMMPPYPGPGHCHQQLNSLPTMEGPPTFNPPVPYFGRLQGGLTARRTIIIKGYVPPTGKSFAINFKVGSSGDIALHINPRMGNGTVVRNSLLNGSWGSEEKKITHNPFGPGQFFDLSIRCGGRIGIL

SEQ ID NO: 881877 - protein, 83 aa, Homo sapiens
ATRLSRGFPTHLVNCLMTFIPARVFSTPGALGVCSLSIRCGLDRFKVYANGQHLFDFAHRLSAFQRVDTLEIQGDVTLSYVQI

SEQ ID NO: 881878 - protein, 371 aa, Homo sapiens
MSMSPKHTTPFSVSDILSPLEESYKKVGMEGGGLGAPLAAYRQGQAAPPTAAMQQHAVGHHGAVTAAYHMTAAGVPQLSHSAVGGYCNGNLGNMSELPPYQDTMRNSASGPGWYGANPDPRFPAISRFMGPASGMNMSGMGGLGSLGDVSKNMAPLPSAPRRKRRVLFSQAQVYELERRFKQQKYLSAPEREHLASMIHLTPTQVKIWFQNHRYKMKRQAKDKAAQQQLQQDSGGGGGGGGTGCPQQQQAQQQSPRRVAVPVLVKDGKPCQAGAPAPGAASLQGHAQQQAQHQAQAAQAAAAAISVGSGGAGLGAHPGHQPGSAGQSPDLAHHAASPAALQGQVSSLSHLNSSGSDYGTMSCSTLLYGRTW

SEQ ID NO: 881879 - protein, 253 aa, Homo sapiens
KHASSPSTPRASLGGPALQSPTAVTEISPPTTGAQPEPSTTTNSLDHPLDYAAKGAFSYGPAEDREALVDTLLCVVAAVPVRQCVWGAVLWALSLVGCGAPRCPASVLAARCSSPSRSALFSLSLSLLSLSLSLSLSLSLSLSLSLSARETRRPTVRPQGSSPDSLAHLLATGAQRSEARCGPEAVGRRGAGRPRREGGAAPAGSGETPTLSLSPLLLKTCPCPGNPDRIGKWFHFVTPQVGCKAAFTFLPLN

SEQ ID NO: 881880 - protein, 371 aa, Homo sapiens; identical to SEQ ID NO: 881878

SEQ ID NO: 881881 - protein, 629 aa, Homo sapiens
KHASSPSTPRASLGGPALQSPTAVTEISPPTTGAQPEPSTTTNSLDHPLDYAAKGAFSYGPAEDREALVDTLLCVVAAVPVRQCVWGAVLWALSLVGCGAPRCPASVLAARCSSPSRSALFSLSLSLLSLSLSLSLSLSLSLSLSLSARETRRPTVRPQGSSPDSLAHLLATGAQRSEARCGPEAVGRRGAGRPRREGGAAPAGSALTPRLWWLPKTWRRAKTNARQPPSLHSSQLRRTRSTPLRVHPTRSALSRRRIMSMSPKHTTPFSVSDILSPLEESYKKVGMEGGGLGAPLAAYRQGQAAPPTAAMQQHAVGHHGAVTAAYHMTAAGVPQLSHSAVGGYCNGNLGNMSELPPYQDTMRNSASGPGWYGANPDPRFPAISRFMGPASGMNMSGMGGLGSLGDVSKNMAPLPSAPRRKRRVLFSQAQVYELERRFKQQKYLSAPEREHLASMIHLTPTQVKIWFQNHRYKMKRQAKDKAAQQQLQQDSGGGGGGGGTGCPQQQQAQQQSPRRVAVPVLVKDGKPCQAGAPAPGAASLQGHAQQQAQHQAQAAQAAAAAISVGSGGAGLGAHPGHQPGSAGQSPDLAHHAASPAALQGQVSSLSHLNSSGSDYGTMSCSTLLYGRTW

SEQ ID NO: 881882 - protein, 270 aa, Homo sapiens [sequence omitted]

SEQ ID NO: 881883 - protein, 550 aa, Homo sapiens
KHASSPSTPRASLGGPALQSPTAVTEISPPTTGAQPEPSTTTNSLDHPLDYAAKGAFSYGPAEDREALVDTLLCVVAAVPVRQCVWGAVLWALSLVGCGAPRCPASVLAARCSSPSRSALFSLSLSLLSLSLSLSLSLSLSLSLSLSAERHVDQQCGPRVRPQTRSLICWRLGLSRRRIMSMSPKHTTPFSVSDILSPLEESYKKVGMEGGGLGAPLAAYRQGQAAPPTAAMQQHAVGHHGAVTAAYHMTAAGVPQLSHSAVGGYCNGNLGNMSELPPYQDTMRNSASGPGWYGANPDPRFPAISRFMGPASGMNMSGMGGLGSLGDVSKNMAPLPSAPRRKRRVLFSQAQVYELERRFKQQKYLSAPEREHLASMIHLTPTQVKIWFQNHRYKMKRQAKDKAAQQQLQQDSGGGGGGGGTGCPQQQQAQQQSPRRVAVPVLVKDGKPCQAGAPAPGAASLQGHAQQQAQHQAQAAQAAAAAISVGSGGAGLGAHPGHQPGSAGQSPDLAHHAASPAALQGQVSSLSHLNSSGSDYGTMSCSTLLYGRTW

SEQ ID NO: 881884 - protein, 220 aa, Homo sapiens
MSWLLACRLILLISLLGKTDDAKVSEKGRLSPKASQVKRSPSDAGRSSGDESKKPLPSSSRTPTANANSFGFKKQSGSAAGLAMITASGVTVTSRSATLGKIPKSSALVSRSAGRKSSMDGAQNQDDGYLALSSRTNLQYRSLPRPSKSNSRNGAGNRSSTSSIDSNISSKSAGLPVPKLREPSKTALGSSLPGLVNQTDKEKGISSDNESVASCNSVKV

SEQ ID NO: 881885 - protein, 239 aa, Homo sapiens
SQTGSWRRGMTAQVGITMPRTKPSAPAGALKTPGTGKTDDAKVSEKGRLSPKASQVKRSPSDAGRSSGDESKKPLPSSSRTPTANANSFGFKKQSGSAAGLAMITASGVTVTSRSATLGKIPKSSALVSRSAGRKSSMDGAQNQDDGYLALSSRTNLQYRSLPRPSKSNSRNGAGNRSSTSSIDSNISSKSAGLPVPKLREPSKTALGSSLPGLVNQTDKEKGISSDNESVASCNSVKV

SEQ ID NO: 881886 - protein, 874 aa, Homo sapiens
MSLSNPTMLRTHSLSNADGQYDPYTDSRFRNSSMSLDEKSRTMSRSGSFRDGFEEVHGSSLSLVSSTSSVYSTPEEKCQSEIRKLRRELDASQEKVSALTTQLTANAHLVAAFEQSLGNMTIRLQSLTMTAEQKDSELNELRKTIELLKKQNAAAQAAINGVINTPELNCKGNGTAQSADLRIRRQHSSDSVSSINSATSHSSVGSNIESDSKKKKRKNWLRSSFKQAFGKKKSPKSASSHSDIEEMTDSSLPSSPKLPHNGSTGSTPLLRNSHSNSLISECMDSEAETVMQLRNELRDKEMKLTDIRLEALSSAHQLDQLREAMNRMQSEIEKLKAENDRLKSESQGSGCSRAPSQVSISASPRQSMGLSQHSLNLTESTSLDMLLDDTGECSARKEGGRHVKIVVSFQEEMKWKEDSRPHLFLIGCIGVSGKTKWDVLDGVVRRLFKEYIIHVDPVSQLGLNSDSVLGYSIGEIKRSNTSETPELLPCGYLVGENTTISVTVKGLAENSLDSLVFESLIPKPILQRYVSLLIEHRRIILSGPSGTGKTYLANRLSEYIVLREGRELTDGVIATFNVDHKSSKELRQYLSNLADQCNSENNAVDMPLVIILDNLHHVSSLGEIFNGLLNCKYHKCPYIIGTMNQATSSTPNLQLHHNFRWVLCANHTEPVKGFLGRFLRRKLMETEISGRVRNMELVKIIDWIPKVWHHLNRFLEAHSSSDVTIGPRLFLSCPIDVDGSRVWFTDLWNYSIIPYLLEAVREGLQLYGRRAPWEDPAKWVMDTYPWAASPQQHEWPPLLQLRPEDVGFDGYSMPREGSTSKQMPPSDAEGDPLMNMLMRLQEAANYSSPQSYDSDSNSNSHHDDILDSSLESTL

SEQ ID NO: 881887 - protein, 128 aa, Homo sapiens
SQTGSWRRGMTAQVGITMPRTKPSAPAGALKTPGTGKRPGLSWPWGTNASSSSAVSKDGLGFQSVSSLHTSCESIDISLSSGGVPSHNSSTGLIASSKDDSLTPFVRTNSVKTTLSERPCLPFSSLRV

SEQ ID NO: 881888 - protein, 278 aa, Homo sapiens
MSLSNPTMLRTHSLSNADGQYDPYTDSRFRNSSMSLDEKSRTMSRSGSFRDGFEEVHGSSLSLVSSTSSVYSTPEEKCQSEIRKLRRELDASQEKVSALTTQLTANAHLVAAFEQSLGNMTIRLQSLTMTAEQKDSELNELRKTIELLKKQNAAAQAAINGVINTPELNCKGNGTAQSADLRIRRQHSSDSVSSINSATSHSSVGSNIESDSKKKKRKNWLRSSFKQAFGKKKSPKSASSHSDIEEMTDSSLPSSPKLPHNGSTGSTPLLRNSHSNSL

SEQ ID NO: 881889 - protein, 140 aa, Homo sapiens
SQTGSWRRGMTAQVGITMPRTKPSAPAGALKTPGTGKRPGLSWPWGTNASSSSAVSKDGLGFQSVSSLHTSCESIDISLSSGGVPSHNSSTGLIASSKDDSLTPFVRTNSVKTTLSESPLSSPAASPKFCRSTLPRKQDR

SEQ ID NO: 881890 - protein, 207 aa, Homo sapiens
SQTGSWRRGMTAQVGITMPRTKPSAPAGALKTPGTGKRPGLSWPWGTNASSSSAVSKDGLGFQSVSSLHTSCESIDISLSSGGVPSHNSSTGLIASSKDDSLTPFVRTNSVKTTLSESPLSSPAASPKFCRSTLPRKQDSDPHLDRNTLPKKGLRYTPTSQLRTQEDAKEWLRSHSAGGLQDTAANSPFSSGSSVTSPSGTRFNFSQ

SEQ ID NO: 881891 - protein, 170 aa, Homo sapiens
SQTGSWRRGMTAQVGITMPRTKPSAPAGALKTPGTGKRPGLSWPWGTNASSSSAVSKDGLGFQSVSSLHTSCESIDISLSSGGVPSHNSSTGLIASSKDDSLTPFVRTNSVKTTLSERYTPTSQLRTQEDAKEWLRSHSAGGLQDTAANSPFSSGSSVTSPSGTRFNFSQ

SEQ ID NO: 881892 - protein, 93 aa, Homo sapiens
AVSKDGLGFQSVSSLHTSCESIDISLSSGGVPSHNSSTGLIASSKDDSLTPFVRTNSVKTTLSERLVLCLWLPFSERHPSKNKKISLGIPNVE

SEQ ID NO: 881893 - protein, 107 aa, Homo sapiens
NQALSHLCIVYECFCTTVAELSSCEKPRGLQSLEYLLFGSLQKNFVNPCSEVLNSGLVFISLFLNFLKKFRGTCAGLLHRQTCVMGVCCTDYFVTQVLSLVPIGYSS

SEQ ID NO: 881894 - protein, 384 aa, Homo sapiens
LCPKPGDEPTDRPPGARTRALALCSGLASARLELAARGFPAFSRPPRLRRPRRARGWRCGSRSPPVGPRAAEPRPPAPRPRAVSLSSCSPPGCSEQRCFGAPNSGCRGKCLHETQRMSGKHYKGPEVSCCIKYFIFGFNVIFWFLGITFLGIGLWAWNEKGVLSNISSITDLGGFDPVWLFLVVGGVMFILGFAGCIGALRENTFLLKFFSVFLGIIFFLELTAGVLAFVFKDWIKDQLYFFINNNIRAYRDDIDLQNLIDFTQEYWQCCGAFGADDWNLNIYFNCTDSNASRERCGVPFSCCTKDPAEDVINTQCGYDARQKPEVDQQIVIYTKGCVPQFEKWLQDNLTIVAGIFIGIALLQIFGICLAQNLVSDIEAVRASW

SEQ ID NO: 881895 - protein, 227 aa, Homo sapiens
MKKEVLSNISSITDLGGFDPVWLFLVVGGVMFILGFAGCIGALRENTFLLKFFSVFLGIIFFLELTAGVLAFVFKDWIKDQLYFFINNNIRAYRDDIDLQNLIDFTQEYWQCCGAFGADDWNLNIYFNCTDSNASRERCGVPFSCCTKDPAEDVINTQCGYDARQKPEVDQQIVIYTKGCVPQFEKWLQDNLTIVAGIFIGIALLQIFGICLAQNLVSDIEAVRASW

SEQ ID NO: 881896 - protein, 152 aa, Homo sapiens
MKKEVLSNISSITDLGGFDPVWLFLVVGGVMFILGFAGCIGALRENTFLLKFFSVFLGIIFFLELTAGVLAFVFKDWIKDQLYFFINNNIRAYRDDIDLQNLIDFTQEYIPMQVESDVAFHSPAALKIPQKMSSTLSVAMMPGKNQKLTSRL

SEQ ID NO: 881897 - protein, 384 aa, Homo sapiens; identical to SEQ ID NO: 881894

SEQ ID NO: 881898 - protein, 219 aa, Homo sapiens
PSVYGPVIARKKRFLHALLFSWKLPFLGITFLGIGLWAWNEKGVFSVFLGIIFFLELTAGVLAFVFKDWIKDQLYFFINNNIRAYRDDIDLQNLIDFTQEYWQCCGAFGADDWNLNIYFNCTDSNASRERCGVPFSCCTKDPAEDVINTQCGYDARQKPEVDQQIVIYTKGCVPQFEKWLQDNLTIVAGIFIGIALLQIFGICLAQNLVSDIEAVRASW

SEQ ID NO: 881899 - protein, 146 aa, Homo sapiens
AEVRERAVPLRRRSRRSAWGAMPGRHVSRVRALYKRVLQLHRVLPPDLKSLGDQYVKDEFRRHKTVGSDEAQRFLQEWEVYATALLQQANENRQNSTGKACFGTFLPEEKLNDFRDEQIGQLQELMQEATKPNRQFSISESMKPKF

SEQ ID NO: 881900 - protein, 137 aa, Homo sapiens
LESGHCTSASCNLHRCVCAPGTFESPHRVVGGGAVGCWDAWQVVVIGCVCGCCVGLGGVCVDGVVGCVGVWLWWGLGGRGVGGGGLGLVWMGRGGVLPEEKLNDFRDEQIGQLQELMQEATKPNRQFSISESMKPKF

SEQ ID NO: 881901 - protein, 89 aa, Homo sapiens
AEVRERAVPLRRRSRRSAWGAMPGRHVSRVRALYKRVLQLHRVLPPDLKSLGDQYVKDEFRRHKTVGSDEAQRFLQEWEGMSRNLDACI

SEQ ID NO: 881902 - protein, 87 aa, Homo sapiens
ELGMRWVWKEKREETSLDVTVYATALLQQANENRQNSTGKACFGTFLPEEKLNDFRDEQIGQLQELMQEATKPNRQFSISESMKPKF

SEQ ID NO: 881903 - protein, 99 aa, Homo sapiens
AEVRERAVPLRRRSRRSAWGAMPGRHVSRVRALYKRVLQLHRVLPPDLKSLGDQYVKDEFRRHKTVGSDEAQRFLQEWEVYATALLQQANENSPPRRKT

SEQ ID NO: 881904 - protein, 99 aa, Homo sapiens
AEVRERAVPLRRRSRRSAWGAMPGRHVSRVRALYKRVLQLHRVLPPDLKSLGDQCMQQRYCNRLTKTDKIQLEKHVLAPSSQKKNLMTFVMNKLDSCRS

SEQ ID NO: 881905 - protein, 146 aa, Homo sapiens; identical to SEQ ID NO: 881899

SEQ ID NO: 881906 - protein, 146 aa, Homo sapiens; identical to SEQ ID NO: 881899

SEQ ID NO: 881907 - protein, 78 aa, Homo sapiens
DLYLNGCQEWEVYATALLQQANENRQNSTGKACFGTFLPEEKLNDFRDEQIGQLQELMQEATKPNRQFSISESMKPKF

SEQ ID NO: 881908 - protein, 137 aa, Homo sapiens; identical to SEQ ID NO: 881900

SEQ ID NO: 881909 - protein, 625 aa, Homo sapiens
MLNMWKVRELVDKATNVVMNYSEIESKVREATNDDPWGPSGQLMGEIAKATFMYEQFPELMNMLWSRMLKDNKKNWRRVYKSLLLLAYLIRNGSERVVTSAREHIYDLRSLENYHFVDEHGKDQGINIRQKVKELVEFAQDDDRLREERKKAKKNKDKYVGVSSDSVGGFRYSERYDPEPKSKWDEEWDKNKSAFPFSDKLGELSDKIGSTIDDTISKFRRKDREDSPERCSDSDEEKKARRGRSPKGEFKDEEETVTTKHIHITQATETTTTRHKRTANPSKTIDLGAAAHYTGDKASPDQNASTHTPQSSVKTSVPSSKSSGDLVDLFDGTSQSTGGSADLFGGFADFGSAAASGSFPSQVTATSGNGDFGDWSAFNQAPSGPVASSGEFFGSASQPAVELVSGSQSALGPPPAASNSSDLFDLMGSSQATMTSSQSMNFSMMSTNTVGLGLPMSRSQNTDMVQKSVSKTLPSTWSDPSVNISLDNLLPGMQPSKPQQPSLNTMIQQQNMQQPMNVMTQSFGAVNLSSPSNMLPVRPQTNALIGGPMPMSMPNVMTGTMGMAPLGNTPMMNQSMMGMNMNIGMSAAGMGLTGTMGMGMPNIAMTSGTVQPKQDAFANFANFSK

SEQ ID NO: 881910 - protein, 643 aa, Homo sapiens
MLNMWKVRELVDKATNVVMNYSEIESKVREATNDDPWGPSGQLMGEIAKATFMYEQFPELMNMLWSRMLKDNKKNWRRVYKSLLLLAYLIRNGSERVVTSAREHIYDLRSLENYHFVDEHGKDQGINIRQKVKELVEFAQDDDRLREERKKAKKNKDKYVGVSSDSVGGFRYSERYDPEPKSKWDEEWDKNKSAFPFSDKLGELSDKIGSTIDDTISKFRRKDREDSPERCSDSDEEKKARRGRSPKGEFKDEEETVTTKHIHITQATETTTTRHKRTANPSKTIDLGAAAHYTGDKASPDQNASTHTPQSSVKTSVPSSKSSGDLVDLFDGTSQSTGGSADLFGGFADFGSAAASGSFPSQVTATSGNGDFGDWSAFNQAPSGPVASSGEFFGSASQPAVELVSGSQSALGPPPAASNSSDLFDLMGSSQATMTSSQSMNFSMMSTNTVGLGLPMSRSQPLQNVSTVLQKPNPLYNQNTDMVQKSVSKTLPSTWSDPSVNISLDNLLPGMQPSKPQQPSLNTMIQQQNMQQPMNVMTQSFGAVNLSSPSNMLPVRPQTNALIGGPMPMSMPNVMTGTMGMAPLGNTPMMNQSMMGMNMNIGMSAAGMGLTGTMGMGMPNIAMTSGTVQPKQDAFANFANFSK

SEQ ID NO: 881911 - protein, 607 aa, Homo sapiens
MLNMWKVRELVDKATNVVMNYSEIESKVREATNDDPWGPSGQLMGEIAKATFMYEQFPELMNMLWSRMLKDNKKNWRRVYKSLLLLAYLIRNGSERVVTSAREHIYDLRSLENYHFVDEHGKDQGINIRQKVKELVEFAQDDDRLREERKKAKKNKDKYVGVSSDSVGGFRYSERYDPEPKSKWDEEWDKNKSAFPFSDKLGELSDKIGSTIDDTISKFRRKDREDSPERCSKDEEETVTTKHIHITQATETTTTRHKRTANPSKTIDLGAAAHYTGDKASPDQNASTHTPQSSVKTSVPSSKSSGDLVDLFDGTSQSTGGSADLFGGFADFGSAAASGSFPSQVTATSGNGDFGDWSAFNQAPSGPVASSGEFFGSASQPAVELVSGSQSALGPPPAASNSSDLFDLMGSSQATMTSSQSMNFSMMSTNTVGLGLPMSRSQNTDMVQKSVSKTLPSTWSDPSVNISLDNLLPGMQPSKPQQPSLNTMIQQQNMQQPMNVMTQSFGAVNLSSPSNMLPVRPQTNALIGGPMPMSMPNVMTGTMGMAPLGNTPMMNQSMMGMNMNIGMSAAGMGLTGTMGMGMPNIAMTSGTVQPKQDAFANFANFSK

SEQ ID NO: 881912 - protein, 607 aa, Homo sapiens
MLNMWKVRELVDKATNVVMNYSEIESKVREATNDDPWGPSGQLMGEIAKATFMYEQFPELMNMLWSRMLKDNKKNWRRVYKSLLLLAYLIRNGSERVVTSAREHIYDLRSLEKVKELVEFAQDDDRLREERKKAKKNKDKYVGVSSDSVGGFRYSERYDPEPKSKWDEEWDKNKSAFPFSDKLGELSDKIGSTIDDTISKFRRKDREDSPERCSDSDEEKKARRGRSPKGEFKDEEETVTTKHIHITQATETTTTRHKRTANPSKTIDLGAAAHYTGDKASPDQNASTHTPQSSVKTSVPSSKSSGDLVDLFDGTSQSTGGSADLFGGFADFGSAAASGSFPSQVTATSGNGDFGDWSAFNQAPSGPVASSGEFFGSASQPAVELVSGSQSALGPPPAASNSSDLFDLMGSSQATMTSSQSMNFSMMSTNTVGLGLPMSRSQNTDMVQKSVSKTLPSTWSDPSVNISLDNLLPGMQPSKPQQPSLNTMIQQQNMQQPMNVMTQSFGAVNLSSPSNMLPVRPQTNALIGGPMPMSMPNVMTGTMGMAPLGNTPMMNQSMMGMNMNIGMSAAGMGLTGTMGMGMPNIAMTSGTVQPKQDAFANFANFSK

SEQ ID NO: 881913 - protein, 634 aa, Homo sapiens
MLNMWKVRELVDKATNVVMNYSEIESKVREATNDDPWGPSGQLMGEIAKATFMYEQFPELMNMLWSRMLKDNKKNWRRVYKSLLLLAYLIRNGSERVVTSAREHIYDLRSLENYHFVDEHGKDQGINIRQKVKELVEFAQDDDRLREERKKAKKNKDKYVGVSSDSVGGFRYSERYDPEPKSKWDEEWDKNKSAFPFSDKLGELSDKIGSTIDDTISKFRRKDREDSPERCSDSDEEKKARRGRSPKGEFKDEEETVTTKHIHITQATETTTTRHKRTANPSKTIDLGAAAHYTGDKASPDQNASTHTPQSSVKTSVPSSKSSGDLVDLFDGTSQSTGGSADLFGGFADFGSAAASGSFPSQVTATSGNGDFGDWSAFNQAPSGPVASSGEFFGSASQPAVELVSGSQSALGPPPAASNSSDLFDLMGSSQATMTSSQSMNFSMMSTNTVGLGLPMSRSQNTDMVQKSVSKTLPSTWSDPSVNISLDNLLPGMQPSKPQQPSLNTMIQQQILLSVFVLVDMQQPMNVMTQSFGAVNLSSPSNMLPVRPQTNALIGGPMPMSMPNVMTGTMGMAPLGNTPMMNQSMMGMNMNIGMSAAGMGLTGTMGMGMPNIAMTSGTVQPKQDAFANFANFSK

SEQ ID NO: 881914 - protein, 625 aa, Homo sapiens; identical to SEQ ID NO: 881909

SEQ ID NO: 881915 - protein, 643 aa, Homo sapiens; identical to SEQ ID NO: 881910

SEQ ID NO: 881916 - protein, 301 aa, Homo sapiens
MLNMWKVRELVDKATNVVMNYSEIESKVREATNDDPWGPSGQLMGEIAKATFMYEQFPELMNMLWSRMLKDNKKNWRRVYKSLLLLAYLIRNGSERVVTSAREHIYDLRSLENYHFVDEHGKDQGINIRQKVKELVEFAQDDDRLREERKKAKKNKDKYVGVSSDSVGGFRYSERYDPEPKSKWDEEWDKNKSAFPFSDKLGELSDKIGSTIDDTISKFRRKDREDSPERCSDSDEEKKARRGRSPKGEFKDEEETVTTKHIHITQATETTTTRHKRTANPSKTIDLGAAAHYTGDKARSN

SEQ ID NO: 881917 - protein, 136 aa, Homo sapiens
MLNMWKVRELVDKATNVVMNYSEIESKVREATNDDPWGPSGQLMGEIAKATFMYEQFPELMNMLWSRMLKDNKKNWRRVYKSLLLLAYLIRNGSERVVTSAREHIYDLRSLENYHFVDVHMIVSRYIYMAEGVRDL

SEQ ID NO: 881918 - protein, 625 aa, Homo sapiens; identical to SEQ ID NO: 881909

SEQ ID NO: 881919 - protein, 281 aa, Homo sapiens
MLNMWKVRELVDKATNVVMNYSEIESKVREATNDDPWGPSGQLMGEIAKATFMYEQFPELMNMLWSRMLKDNKKNWRRVYKSLLLLAYLIRNGSERVVTSAREHIYDLRSLENYHFVDEHGKDQGINIRQKVKELVEFAQDDDRLREERKKAKKNKDKYVGVSSDSVGGFRYSERYDPEPKSKWDEEWDKNKSAFPFSDKLGELSDKIGSTIDDTISKFRRKDREDSPERCSDSDEEKKARRGRSPKGEFKDEEETVTTKHIHITQATETTTTRHKRTANP

SEQ ID NO: 881920 - protein, 600 aa, Homo sapiens
MLNMWKVRELVDKATNVVMNYSEIESKVREATNDDPWGPSGQLMGEIAKATFMYEQFPELMNMLWSRMLKDNKKNWRRVYKSLLLLAYLIRNGSERVVTSAREHIYDLRSLENYHFVDEHGKDQGINIRQKVKELVEFAQDDDRLREERKKAKKNKDKYVGVSSDSVGGFRYSERYDPEPKSKWDEEWDKNKSAFPFSDKLGELSDKIGSTIDDTISKFRRKDREDSPERCSDSDEEKKARRGRSPKGEFKDEEETVTTKHIHITQATETTTTRHKRTANPSKTIDLGAAAHYTGDKASPDQNASTHTPQSSVKTSVPSSKSSGDLVDLFDGTSQSTVTATSGNGDFGDWSAFNQAPSGPVASSGEFFGSASQPAVELVSGSQSALGPPPAASNSSDLFDLMGSSQATMTSSQSMNFSMMSTNTVGLGLPMSRSQNTDMVQKSVSKTLPSTWSDPSVNISLDNLLPGMQPSKPQQPSLNTMIQQQNMQQPMNVMTQSFGAVNLSSPSNMLPVRPQTNALIGGPMPMSMPNVMTGTMGMAPLGNTPMMNQSMMGMNMNIGMSAAGMGLTGTMGMGMPNIAMTSGTVQPKQDAFANFANFSK

SEQ ID NO: 881921 - protein, 396 aa, Homo sapiens
MWSDSDEEKKARRGRSPKGEFKDEEETVTTKHIHITQATETTTTRHKRTANPSKTIDLGAAAHYTGDKASPDQNASTHTPQSSVKTSVPSSKSSGDLVDLFDGTSQSTGGSADLFGGFADFGSAAASGSFPSQVTATSGNGDFGDWSAFNQAPSGPVASSGEFFGSASQPAVELVSGSQSALGPPPAASNSSDLFDLMGSSQATMTSSQSMNFSMMSTNTVGLGLPMSRSQNTDMVQKSVSKTLPSTWSDPSVNISLDNLLPGMQPSKPQQPSLNTMIQQQNMQQPMNVMTQSFGAVNLSSPSNMLPVRPQTNALIGGPMPMSMPNVMTGTMGMAPLGNTPMMNQSMMGMNMNIGMSAAGMGLTGTMGMGMPNIAMTSGTVQPKQDAFANFANFSK

SEQ ID NO: 881922 - protein, 69 aa, Homo sapiens
IVPVKPIPAADIPMFMFMPIMLWFIIGVFPRGAIPMVPVITLGMPNIAMTSGTVQPKQDAFANFANFSK

SEQ ID NO: 881923 - protein, 474 aa, Homo sapiens
MLNMWKVRELVDKATNVVMNYSEIESKVREATNDDPWGPSGQLMGEIAKATFMYEQFPELMNMLWSRMLKDNKKNWRRVYKSLLLLAYLIRNGSERVVTSAREHIYDLRSLENYHFVDEHGKDQGINIRQKVKELVEFAQDDDRLREERKKAKKNKDKYVGVSSDSVGGFRYSERYDPEPKSKWDEEWDKNKSAFPFSDKLGELSDKIGSTIDDTISKFRRKDREDSPERCSDSDEEKKARRGRSPKGEFKDEEETVTTKHIHITQATETTTTRHKRTANPSKTIDLGAAAHYTGDKASPDQNASTHTPQSSVKTSVPSSKSSGDLVDLFDGTSQSTGGSADLFGGFADFGSAAASGSFPSQVTATSGNGDFGDWSAFNQAPSGPVASSGEFFGSASQPAVELVSGSQSALGPPPAASNSSDLFDLMGSSQATMTSSQSMNFSMMSTNTVGLGLPMSRSQVSCLVPLEFVIYNL

SEQ ID NO: 881924 - protein, 281 aa, Homo sapiens
AAAGARSREAAAAAALVASASASAAAAAASGGAGRTDRRTEGARARVPPGPAMEGASFGAGRAGAALDPVSFARRPQTLLRVASWVFSIAVFGPIVNEGYVNTDSGPELRCVFNGNAGACRFGVALGLGAFLACAAFLLLDVRFQQISSVRDRRRAVLLDLGFSGLWSFLWFVGFCFLTNQWQRTAPGPATTQAGDAARAAIAFSFFSILSWVALTVKALQRFRLGTDMSLFATEQLSTGASQAYPGYPVGSGVEGTETYQSPPFTETLDTSPKGYQVPAY

SEQ ID NO: 881925 - protein, 176 aa, Homo sapiens
VWRSRVGGVSAGEGGGTSRHAASPGEAPQASGPPTFPPPGEAAVGHRVERRPDAPHLFAGLWSFLWFVGFCFLTNQWQRTAPGPATTQAGDAARAAIAFSFFSILSWVALTVKALQRFRLGTDMSLFATEQLSTGASQAYPGYPVGSGVEGTETYQSPPFTETLDTSPKGYQVPAY

SEQ ID NO: 881926 - protein, 410 aa, Homo sapiens
RKLASWSLLSPQRQTDRQTDSWQEAAWGPQLLQQTSWLSEPPLGPAPHLSMVQAHGGRSRAQPLTLSLGAAMTQPPPEKTPAKKHVRLQERRGSNVALMLDVRSLGAVEPICSVNTPREVTLHFLRTAGHPLTRWALQRQPPSPKQLEEEFLKIPSNFVSPEDLDIPGHASKDRYKTILPNPQSRVCLGRAQSQEDGDYINANYIRGYDGKEKVYIATQGPMPNTVSDFWEMVWQEEVSLIVMLTQLREGKEKCVHYWPTEEETYGPFQIRIQDMKECPEYTVRQLTIQYQEERRSVKHILFSAWPDHQTPESAGPLLRLVAEVEESPETAAHPGPIVVHCSAGIGRTGCFIATRIGCQQLKARGEVDILGIVCQLRLDRGGMIQTAEQYQFLHHTLALYAGQLPEEPSP

SEQ ID NO: 881927 - protein, 399 aa, Homo sapiens
MGASFWPIRQAREQQRRALSFRQTSWLSEPPLGPAPHLSMVQAHGGRSRAQPLTLSLGAAMTQPPPEKTPAKKHVRLQERRGSNVALMLDVRSLGAVEPICSVNTPREVTLHFLRTAGHPLTRWALQRQPPSPKQLEEEFLKIPSNFVSPEDLDIPGHASKDRYKTILPNPQSRVCLGRAQSQEDGDYINANYIRGYDGKEKVYIATQGPMPNTVSDFWEMVWQEEVSLIVMLTQLREGKEKCVHYWPTEEETYGPFQIRIQDMKECPEYTVRQLTIQYQEERRSVKHILFSAWPDHQTPESAGPLLRLVAEVEESPETAAHPGPIVVHCSAGIGRTGCFIATRIGCQQLKARGEVDILGIVCQLRLDRGGMIQTAEQYQFLHHTLALYAGQLPEEPSP

SEQ ID NO: 881928 - protein, 291 aa, Homo sapiens
EEAGFLEPSQPSKTDRQTDRQLARGSLGATAASKIPSNFVSPEDLDIPGHASKDRYKTILPNPQSRVCLGRAQSQEDGDYINANYIRGYDGKEKVYIATQGPMPNTVSDFWEMVWQEEVSLIVMLTQLREGKEKCVHYWPTEEETYGPFQIRIQDMKECPEYTVRQLTIQYQEERRSVKHILFSAWPDHQTPESAGPLLRLVAEVEESPETAAHPGPIVVHCSAGIGRTGCFIATRIGCQQLKARGEVDILGIVCQLRLDRGGMIQTAEQYQFLHHTLALYAGQLPEEPSP

SEQ ID NO: 881929 - protein, 189 aa, Homo sapiens
EGKEKCVHSELSEHDNEGHFLLPHHLREGKEKCVHYWPTEEETYGPFQIRIQDMKECPEYTVRQLTIQYQEERRSVKHILFSAWPDHQTPESAGPLLRLVAEVEESPETAAHPGPIVVHCSAGIGRTGCFIATRIGCQQLKARGEVDILGIVCQLRLDRGGMIQTAEQYQFLHHTLALYAGQLPEEPSP

SEQ ID NO: 881930 - protein, 208 aa, Homo sapiens [sequence omitted]

SEQ ID NO: 881931 - protein, 410 aa, Homo sapiens; identical to SEQ ID NO: 881926

SEQ ID NO: 881932 - protein, 33 aa, Homo sapiens
MHLACAWAGPRVKDDLGITLFVSPRKDWLEWLL

SEQ ID NO: 881933 - protein, 308 aa, Homo sapiens
MCDCRREPICSVNTPREVTLHFLRTAGHPLTRWALQRQPPSPKQLEEEFLKIPSNFVSPEDLDIPGHASKDRYKTILPNPQSRVCLGRAQSQEDGDYINANYIRGYDGKEKVYIATQGPMPNTVSDFWEMVWQEEVSLIVMLTQLREGKEKCVHYWPTEEETYGPFQIRIQDMKECPEYTVRQLTIQYQEERRSVKHILFSAWPDHQTPESAGPLLRLVAEVEESPETAAHPGPIVVHCSAGIGRTGCFIATRIGCQQLKARGEVDILGIVCQLRLDRGGMIQTAEQYQFLHHTLALYAGQLPEEPSP

SEQ ID NO: 881934 - protein, 208 aa, Homo sapiens [sequence omitted]

SEQ ID NO: 881935 - protein, 568 aa, Homo sapiens
AVLVAALVDRGRADSGTGGGRRARPARGWGSGAAWRARRGPQAGPGREAAMGSVGSQRLEEPSVAGTPDPGVVMSFTFDSHQLEEAAEAAQGQGLRARGVPAFTDTTLDEPVPDDRYHAIYFAMLLAGVGFLLPYNSFITDVDYLHHKYPGTSIVFDMSLTYILVALAAVLLNNVLVERLTLHTRITSSICDVWLQLFSRDQAYAINLAAVGTVAFGCTVQQSSFYGYTGMLPKRYTQGVMTGESTAGVMISLSRILTKLLLPDERASTLIFFLVSVALELLCFLLHLLVRRSRFVLFYTTRPRDSHRGRPGLGRGYGYRVHHDVVAGDVHFEHPAPALAPNESPKDSPAHEVTGSGGAYMRFDVPRPRVQRSWPTFRALLLHRYVVARVIWADMLSIAVTYFITLCLFPGLESEIRHCILGEWLPILIMAVFNLSDFVGKILAALPVDWRGTHLLACSCLRVVFIPLFILCVYPSGMPALRHPAWPCIFSLLMGISNGYFGSVPMILAAGKVSPKQRELAGNTMTVSYMSGLTLGSAVAYCTYSLTRDAHGSCLHASTANGSILAGL

SEQ ID NO: 881936 - protein, 580 aa, Homo sapiens
AVLVAALVDRGRADSGTGGGRRARPARGWGSGAAWRARRGPQAGPGREAAMGSVGSQRLEEPSVAGTPDPGVVMSFTFDSHQLEEAAEAAQGQGLRARGVPAFTDTTLDEPVPDDRYHAIYFAMLLAGVGFLLPYNSFITDVDYLHHKYPGTSIVFDMSLTYILVALAAVLLNNVLVERLTLHTRITAGYLLALGPLLFISICDVWLQLFSRDQAYAINLAAVGTVAFGCTVQQSSFYGYTGMLPKRYTQGVMTGESTAGVMISLSRILTKLLLPDERASTLIFFLVSVALELLCFLLHLLVRRSRFVLFYTTRPRDSHRGRPGLGRGYGYRVHHDVVAGDVHFEHPAPALAPNESPKDSPAHEVTGSGGAYMRFDVPRPRVQRSWPTFRALLLHRYVVARVIWADMLSIAVTYFITLCLFPGLESEIRHCILGEWLPILIMAVFNLSDFVGKILAALPVDWRGTHLLACSCLRVVFIPLFILCVYPSGMPALRHPAWPCIFSLLMGISNGYFGSVPMILAAGKVSPKQRELAGNTMTVSYMSGLTLGSAVAYCTYSLTRDAHGSCLHASTANGSILAGL

SEQ ID NO: 881937 - protein, 580 aa, Homo sapiens; identical to SEQ ID NO: 881936

SEQ ID NO: 881938 - protein, 149 aa, Homo sapiens
AWHEASCQKMGAWGTQRRQARPGVHSRWPREEGMRKDRIRRGCSQEERWGSGSWRGGTVQAGVTAPHTRAAVATRWPPWPCSPQAGVVHREHHDRVLHVRADAGVRRGLLHLQPHPRRSRQLPARLHRQWFHPRRPLSQPRPLPGTPRA

SEQ ID NO: 881939 - protein, 247 aa, Homo sapiens
MLVLRSALTRALASRTLAPQMCSSFATGPRQYDGIFYEFRSYYLKPSKMNEFLENFEKNAHLRTAHSELVGYWSVEFGGRMNTVFHIWKYDNFAHRTEVRKALAKDKEWQEQFLIPNLALIDKQESEITYLVPWCKLEKPPKEGVYELATFQMKPGGPALWGDAFKRAVHAHVNLGYTKLVGVFHTEYGALNRVHVLWWNESADSRAAGRHKSHEDPRVVAAVRESVNYLVSQQNMLLIPTSFSPLK

SEQ ID NO: 881940 - protein, 184 aa, Homo sapiens
MLVLRSALTRALASRTLAPQMCSSFATGPRQYDGIFYEFRSYYLKPSKMNEFLENFEKNAHLRTAHSELVGYWSVEFGGRMNTVFHIWKYDNFAHRTEVRKALAKDKEWQEQFLIPNLALIDKQESEITYLVPWCKLEKPPKEGVYELATFQMKPGGPALWGDAFKRAVHAHVNLGYTSCSLVE

SEQ ID NO: 881941 - protein, 822 aa, Homo sapiens
MGTKPLHLPCRHSSLEFPCHHHLWDSPLCSLLRQPPPPPPGLGLGFPMAHPPNLGPPPPLRVGEPVALSEEERLKLAQQQAALLMQQEERAKQQGDHSLKEHELLEQQKRAAVLLEQERQQEIAKMGTPVPRPPQDMGQIGVRTPLGPRVAAPVGPVGPTPTVLPMGAPVPRPRGPPPPPGDENREMDDPSVGPKIPQALEKILQLKESRQEEMNSQQEEEEMETDARSSLGQSASETEEDTVSVSKKEKNRKRRNRKKKKKPQRVRGVSSESSGDREKDSTRSRGSDSPAADVEIEYVTEEPEIYEPNFIFFKRIFEAFKLTDDVKKEKEKEPEKLDKLENSAAPKKKGFEEEHKDSDDDSSDDEQEKKPEAPKLSKKKLRRMNRFTVAELKQLVARPDVVEMHDVTAQDPKLLVHLKATRNSVPVPRHWCFKRKYLQGKRGIEKPPFELPDFIKRTGIQEMREALQEKEEQKTMKSKMREKVRPKMGKIDIDYQKLHDAFFKWQTKPKLTIHGDLYYEGKEFETRLKEKKPGDLSDELRISLGMPVGPNAHKVPPPWLIAMQRYGPPPSYPNLKIPGLNSPIPESCSFGYHAGGWGKPPVDETGKPLYGDVFGTNAAEFQTKTEEEEIDRTPWGELEPSDEESSEEEEEEESDEDKPDETGFITPADSGLITPGGFSSVPAGMETPELIELRKKKIEEAMDGSETPQLFTVLPEKRTATVGGAMMGSTHIYDMSTVMSRKGPAPELQGVEVALAPEELELDPMAMTQKYEEHVREQQAQVEKEDFSDMVAEHAAKQKQKKRKAQPQDSRGGSKKYKEFKF

SEQ ID NO: 881942 - protein, 829 aa, Homo sapiens
ASSPCGGGGPKFGGWAIGKPRPRPGGGGGGGGGGCRGGSPKGGSGMGIPGSCADMGGGAALSPSSPLRVGEPVALSEEERLKLAQQQAALLMQQEERAKQQGDHSLKEHELLEQQKRAAVLLEQERQQEIAKMGTPVPRPPQDMGQIGVRTPLGPRVAAPVGPVGPTPTVLPMGAPVPRPRGPPPPPGDENREMDDPSVGPKIPQALEKILQLKESRQEEMNSQQEEEEMETDARSSLGQSASETEEDTVSVSKKEKNRKRRNRKKKKKPQRVRGVSSESSGDREKDSTRSRGSDSPAADVEIEYVTEEPEIYEPNFIFFKRIFEAFKLTDDVKKEKEKEPEKLDKLENSAAPKKKGFEEEHKDSDDDSSDDEQEKKPEAPKLSKKKLRRMNRFTVAELKQLVARPDVVEMHDVTAQDPKLLVHLKATRNSVPVPRHWCFKRKYLQGKRGIEKPPFELPDFIKRTGIQEMREALQEKEEQKTMKSKMREKVRPKMGKIDIDYQKLHDAFFKWQTKPKLTIHGDLYYEGKEFETRLKEKKPGDLSDELRISLGMPVGPNAHKVPPPWLIAMQRYGPPPSYPNLKIPGLNSPIPESCSFGYHAGGWGKPPVDETGKPLYGDVFGTNAAEFQTKTEEEEIDRTPWGELEPSDEESSEEEEEEESDEDKPDETGFITPADSGLITPGGFSSVPAGMETPELIELRKKKIEEAMDGSETPQLFTVLPEKRTATVGGAMMGSTHIYDMSTVMSRKGPAPELQGVEVALAPEELELDPMAMTQKYEEHVREQQAQVEKEDFSDMVAEHAAKQKQKKRKAQPQDSRGGSKKYKEFKF

SEQ ID NO: 881943 - protein, 292 aa, Homo sapiens
MGTKPLHLPCRHSSLEFPCHHHLWDSPLCSLLRQPPPPPPGLGLGFPMAHPPNLGPPPPLRVGEPVALSEEERLKLAQQQAALLMQQEERAKQQGDHSLKEHELLEQQKRAAVLLEQERQQEIAKMGTPVPRPPQDMGQIGVRTPLGPRVAAPVGPVGPTPTVLPMGAPVPRPRRTTHTTMTIQTRNGYTLVEPEAHSMKEKRKRSGSQERNNNTRKQAGTDGTRHRQQPTAQQRAHAGAHTRRRRAVTTHEAHQSDDPPTARRATKPPSHQRPCGTHDKEQNEPREQQRVD

SEQ ID NO: 881944 - protein, 87 aa, Homo sapiens
ALRLAPASGLVARLPAAKMATEHPEPPKAELQLPPPPPPGHYGAWAAQELQAKLAEIGAPIQGNREELVERLQSYTRQVGVGGGTSG

SEQ ID NO: 881945 - protein, 343 aa, Homo sapiens
ALRLAPASGLVARLPAAKMATEHPEPPKAELQLPPPPPPGHYGAWAAQELQAKLAEIGAPIQEEERLKLAQQQAALLMQQEERAKQQGDHSLKEHELLEQQKRAAVLLEQERQQEIAKMGTPVPRPPQDMGQIGVRTPLGPRVAAPVGPVGPTPTVLPMGAPVPRPRGPPPPPGDENREMDDPSVGPKIPQALEKILQLKESRQEEMNSQQEEAGIMEPDDSHAHGASQRQTLPRTQVRISKGEKRTRKTERRQTAPPVPQGPQHSPEGQRKHTNRISAPDDPHRRAATNIQDSTRTHRHKNNNRISAPDQQRQSHAAHHSHTERGKSGGGKQTANDKSKTRA

SEQ ID NO: 881946 - protein, 821 aa, Homo sapiens
MGTSAHLPCRHSSLEFPCHHHLWDSPLCSLLRQPPPPPPGLGLGFPMAHPPNLGPPPPLRVGEPVALSEEERLKLAQQQAALLMQQEERAKQQGDHSLKEHELLEQQKRAAVLLEQERQQEIAKMGTPVPRPPQDMGQIGVRTPLGPRVAAPVGPVGPTPTVLPMGAPVPRPRGPPPPPGDENREMDDPSVGPKIPQALEKILQLKESRQEEMNSQQEEEEMETDARSSLGQSASETEEDTVSVSKKEKNRKRRNRKKKKKPQRVRGVSSESSGDREKDSTRSRGSDSPAADVEIEYVTEEPEIYEPNFIFFKRIFEAFKLTDDVKKEKEKEPEKLDKLENSAAPKKKGFEEEHKDSDDDSSDDEQEKKPEAPKLSKKKLRRMNRFTVAELKQLVARPDVVEMHDVTAQDPKLLVHLKATRNSVPVPRHWCFKRKYLQGKRGIEKPPFELPDFIKRTGIQEMREALQEKEEQKTMKSKMREKVRPKMGKIDIDYQKLHDAFFKWQTKPKLTIHGDLYYEGKEFETRLKEKKPGDLSDELRISLGMPVGPNAHKVPPPWLIAMQRYGPPPSYPNLKIPGLNSPIPESCSFGYHAGGWGKPPVDETGKPLYGDVFGTNAAEFQTKTEEEEIDRTPWGELEPSDEESSEEEEEEESDEDKPDETGFITPADSGLITPGGFSSVPAGMETPELIELRKKKIEEAMDGSETPQLFTVLPEKRTATVGGAMMGSTHIYDMSTVMSRKGPAPELQGVEVALAPEELELDPMAMTQKYEEHVREQQAQVEKEDFSDMVAEHAAKQKQKKRKAQPQDSRGGSKKYKEFKF

SEQ ID NO: 881947 - protein, 822 aa, Homo sapiens; identical to SEQ ID NO: 881941

SEQ ID NO: 881948 - protein, 822 aa, Homo sapiens; identical to SEQ ID NO: 881941

SEQ ID NO: 881949 - protein, 822 aa, Homo sapiens; identical to SEQ ID NO: 881941

SEQ ID NO: 881950 - protein, 643 aa, Homo sapiens
ALRLAPASGLVARLPAAKMATEHPEPPKAELQLPPPPPPGHYGAWAAQELQAKLAEIGAPIQGNREELVERLQSYTRQTGIVLNRPVLRGEDGDKAAPPPMSAQLPGIPMPPPPLGIEYVTEEPEIYEPNFIFFKRIFEAFKLTDDVKKEKEKEPEKLDKLENSAAPKKKGFEEEHKDSDDDSSDDEQEKKPEAPKLSKKKLRRMNRFTVAELKQLVARPDVVEMHDVTAQDPKLLVHLKATRNSVPVPRHWCFKRKYLQGKRGIEKPPFELPDFIKRTGIQEMREALQEKEEQKTMKSKMREKVRPKMGKIDIDYQKLHDAFFKWQTKPKLTIHGDLYYEGKEFETRLKEKKPGDLSDELRISLGMPVGPNAHKVPPPWLIAMQRYGPPPSYPNLKIPGLNSPIPESCSFGYHAGGWGKPPVDETGKPLYGDVFGTNAAEFQTKTEEEEIDRTPWGELEPSDEESSEEEEEEESDEDKPDETGFITPADSGLITPGGFSSVPAGMETPELIELRKKKIEEAMDGSETPQLFTVLPEKRTATVGGAMMGSTHIYDMSTVMSRKGPAPELQGVEVALAPEELELDPMAMTQKYEEHVREQQAQVEKEDFSDMVAEHAAKQKQKKRKAQPQDSRGGSKKYKEFKF

SEQ ID NO: 881951 - protein, 804 aa, Homo sapiens
MGTKPLHLPCRHSSLEFPCHHHLWDSPLCSLLRQPPPPPPGLGLGFPMAHPPNLGPPPPLRVGEPVALSEEERLKLAQQQAALLMQQEERAKQQGDHSLKEHELLEQQKRAAVLLEQERQQEIAKMGTPVPRPPQDMGQIGVRTPLGPRVAAPVGPVGPTPTVLPMGAPVPRPRGPPPPPGDENREMDDPSVGPKIPQALEKILQLKESRQEEMNSQQEEEEMETDARSSLGQSASETEEDTVSVSKKEKNRKRRNRKKKKKPQRVRGVSSESSGDREKDSTRSRGSDSPAADVEIEYVTEEPEIYEPNFIFFKRIFEAFKLTDDVKKEKEKEPEKLDKLENSAAPKKKGFEEEHKDSDDDSSDDEQEKKPEAPKLSKKKLRRMNRFTVAELKQLVARPDVVEMHDVTAQDPKLLVHLKATRNSVPVPRHWCFKRKYLQGKRGIEKPPFELPDFIKRTGIQEMREALQEKEEQKTMKSKMREKVRPKMGKIDIDYQKLHDAFFKWQTKPKLTIHGDLYYEGKEFETRLKEKKPGDLSDELRISLGMPVGPNAHKVPPPWLIAMQRYGPPPSYPNHAGGWGKPPVDETGKPLYGDVFGTNAAEFQTKTEEEEIDRTPWGELEPSDEESSEEEEEEESDEDKPDETGFITPADSGLITPGGFSSVPAGMETPELIELRKKKIEEAMDGSETPQLFTVLPEKRTATVGGAMMGSTHIYDMSTVMSRKGPAPELQGVEVALAPEELELDPMAMTQKYEEHVREQQAQVEKEDFSDMVAEHAAKQKQKKRKAQPQDSRGGSKKYKEFKF

SEQ ID NO: 881952 - protein, 883 aa, Homo sapiens
MGTKPLHLPCRHSSLEFPCHHHLWDSPLCSLLRQPPPPPPGLGLGFPMAHPPNLGPPPPLRVGEPVALSEEERLKLAQQQAALLMQQEERAKQQGDHSLKEHELLEQQKRAAVLLEQERQQEIAKMGTPVPRPPQDMGQIGVRTPLGPRVAAPVGPVGPTPTVLPMGAPVPRPRGPPPPPGDENREMDDPSVGPKIPQALEKILQLKESRQEEMNSQQEEEEMETDARSSLGQSASETEEDTVSVSKKEKNRKRRNRKKKKKPQRVRGVSSESSGDREKDSTRSRGSDSPAADVEIEYVTEEPEIYEPNFIFFKRIFEAFKLTDDVKKEKEKEPEKLDKLENSAAPKKKGFEEEHKDSDDDSSDDEQEKKPEAPKLSKKKLRRMNRFTVAELKQLVARPDVVEMHDVTAQDPKLLVHLKATRNSVPVPRHWCFKRKYLQGKRGIEKPPFELPDFIKRTGIQEMREALQEKEEQKTMKSKMREKVRPKMGKIDIDYQKLHDAFFKWQTKPKLTIHGDLYYEGKEFETRLKEKKPGDLSDELRISLGMPVGPNAHKVPPPWLIAMQRYGPPPSYPNLKIPGLNSPIPESCSFGYHAGGWGKPPVDETGKPLYGDVFGTNAAEFQTKTEEEEIDRTPWGELEPSDEESSEEEEEEESDEDKPDETGFITPADSGLITPGGFSSVPAGMETPELIELRKKKIEEAMDGSETPQLFTVLPEKRTATVGGAMMGSTHIYDMSTVMSRKGPAPELQGVEVALAPEELELDPMAMTQKYEEHVREQQAQVEKEEGSSRTLVRVESVLARNQKLTKTREISPRTSPEGQTREIKEIQACKVPYSTYALLDLGLTVQDAMGFNTRDHFIRAVLEDVCHFNVRIVTDPEYSSVS

SEQ ID NO: 881953 - protein, 894 aa, Homo sapiens
MGTKPLHLPCRHSSLEFPCHHHLWDSPLCSLLRQPPPPPPGLGLGFPMAHPPNLGPPPPLRVGEPVALSEEERLKLAQQQAALLMQQEERAKQQGDHSLKEHELLEQQKRAAVLLEQERQQEIAKMGTPVPRPPQDMGQIGVRTPLGPRVAAPVGPVGPTPTVLPMGAPVPRPRGPPPPPGDENREMDDPSVGPKIPQALEKILQLKESRQEEMNSQQEEEEMETDARSSLGQSASETEEDTVSVSKKEKNRKRRNRKKKKKPQRVRGVSSESSGDREKDSTRSRGSDSPAADVEIEYVTEEPEIYEPNFIFFKRIFEAFKLTDDVKKEKEKEPEKLDKLENSAAPKKKGFEEEHKDSDDDSSDDEQEKKPEAPKLSKKKLRRMNRFTVAELKQLVARPDVVEMHDVTAQDPKLLVHLKATRNSVPVPRHWCFKRKYLQGKRGIEKPPFELPDFIKRTGIQEMREALQEKEEQKTMKSKMREKVRPKMGKIDIDYQKLHDAFFKWQTKPKLTIHGDLYYEGKEFETRLKEKKPGDLSDELRISLGMPVGPNAHKVPPPWLIAMQRYGPPPSYPNLKIPGLNSPIPESCSFGYHAGGWGKPPVDETGKPLYGDVFGTNAAEFQTKTEEEEIDRTPWGELEPSDEESSEEEEEEESDEDKPDETGFITPADSGLITPGGFSSVPAGMETPELIELRKKKIEEAMDGSETPQLFTVLPEKRTATVGGAMMGSTHIYDMSTVMSRKGPAPELQGVEVALAPEELELDPMAMTQKLRRMNRFTVAELKQLVARPDVVEMHDVTAQDPKLLVHLKATRNSVPVPRHWCFKRKYLQGKRGIEKPPFELPDFIKRTGIQEMREALQEKEEQKTMKSKMREKVRPKMGKIDIDYQKLHDAFFM

SEQ ID NO: 881954 - protein, 475 aa, Homo sapiens
LTLQDPLSIPLRDHSIYDEQEKKPEAPKLSKKKLRRMNRFTVAELKQLVARPDVVEMHDVTAQDPKLLVHLKATRNSVPVPRHWCFKRKYLQGKRGIEKPPFELPDFIKRTGIQEMREALQEKEEQKTMKSKMREKVRPKMGKIDIDYQKLHDAFFKWQTKPKLTIHGDLYYEGKEFETRLKEKKPGDLSDELRISLGMPVGPNAHKVPPPWLIAMQRYGPPPSYPNLKIPGLNSPIPESCSFGYHAGGWGKPPVDETGKPLYGDVFGTNAAEFQTKTEEEEIDRTPWGELEPSDEESSEEEEEEESDEDKPDETGFITPADSGLITPGGFSSVPAGMETPELIELRKKKIEEAMDGSETPQLFTVLPEKRTATVGGAMMGSTHIYDMSTVMSRKGPAPELQGVEVALAPEELELDPMAMTQKYEEHVREQQAQVEKEDFSDMVAEHAAKQKQKKRKAQPQDSRGGSKKYKEFKF

SEQ ID NO: 881955 - protein, 738 aa, Homo sapiens
MGTKPLHLPCRHSSLEFPCHHHLWDSPLCSLLRQPPPPPPGLGLGFPMAHPPNLGPPPPLRVGEPVALSEEERLKLAQQQAALLMQQEERAKQQGDHSLKEHELLEQQKRAAVLLEQERQQEIAKMGTPVPRPPQDMGQIGVRTPLGPRVAAPVGPVGPTPTVLPMGAPVPRPRGPPPPPGDENREMDDPSVGPKIPQALEKILQLKESRQEEMNSQQEEEEMETDARSSLGQSASETEEDTVSVSKKEKNRKRRNRKKKKKPQRVRGVSSESSGDREKDSTRSRGSDSPAADVEIEYVTEEPEIYEPNFIFFKRIFEAFKLTDDVKKEKEKEPEKLDKLENSAAPKKKGFEEEHKDSDDDSSDDEQEKKPEAPKLSKKKLRRMNRFTVAELKQLVARPDVVEMHDVTAQDPKLLVHLKATRNSVPVPRHWCFKRKYLQGKRGIEKPPFELPDFIKRTGIQEMREALQEKEEQKTMKSKMREKVRPKMGKIDIDYQKLHDAFFKWQTKPKLTIHGDLYYEGKEFETRLKEKKPGDLSDELRISLGMPVGPNAHKVPPPWLIAMQRYGPPPSYPNLKIPGLNSPIPESCSFGYHAGGWGKPPVDETGKPLYGDVFGTNAAEFQTKTEEEEIDRTPWGELEPSDEESSEEEEEEESDEDKPDETGFITPADSGLITPGGFSSVPAGMETPELIELRKKKIEEAMDGSETPQLFTVLPEKRTATVGGAMMGSTHIYDMSTL

SEQ ID NO: 881956 - protein, 810 aa, Homo sapiens
MGTKPLHLPCRHSSLEFPCHHHLWDSPLCSLLRQPPPPPPGLGLGFPMAHPPNLGPPPPLRVGEPVALSEEERLKLAQQQAALLMQQEERAKQQGDHSLKEHELLEQQKRAAVLLEQERQQEIAKMGTPVPRPPQDMGQIGVRTPLGPRVAAPVGPVGPTPTVLPMGAPVPRPRGPPPPPGDENREMDDPSVGPKIPQALEKILQLKESRQEEMNSQQEEEEMETDARSSLGQSASETEEDTVSVSKKEKNRKRRNRKKKKKPQRVRGVSSESSGDREKDSTRSRGSDSPAADVEIEYVTEEPEIYEPNFIFFKRIFEAFKLTDDVKKEKEKEPEKLDKLENSAAPKKKGFEEEHKDSDDDSSDDEQEKKPEAPKLSKKKLRRMNRFTVAELKQLVARPDVVEMHDVTAQDPKLLVHLKATRNSVPVPRHWCFKRKYLQGKRGIEKPPFELPDFIKRTGIQEMREALQEKEEQKTMKSKMREKVRPKMGKIDIDYQKLHDAFFKWQTKPKLTIHGDLYYEGKEFETRLKEKKPGDLSDELRISLGMPVGPNAHKVPPPWLIAMQRYGPPPSYPNLKIPGLNSPIPESCSFGYHAGGWGKPPVDETGKPLYGDVFGTNAAEFQTKTEEEEIDRTPWGELEPSDEESSEEEEEEESDEDKPDETGFITPADSGLITPGGFSSVPAGMETPELIELRKKKIEEAMDGKLRQPSSSFTCVRQDEEEQGTWWRGPLDGVHPTIYDRVTGYVDRERPVLEAAKCGKWALAPEKVGAGSLGKDHKVLGRSAETDVHRKETDWGTPNKKKGGPERGAK

SEQ ID NO: 881957 - protein, 690 aa, Homo sapiens
MGTKPLHLPCRHSSLEFPCHHHLWDSPLCSLLRQPPPPPPGLGLGFPMAHPPNLGPPPPLRVGEPVALSEEERLKLAQQQAALLMQQEERAKQQGDHSLKEHELLEQQKRAAVLLEQERQQEIAKMGTPVPRPPQDMGQIGVRTPLGPRVAAPVGPVGPTPTVLPMGAPVPRPRGPPPPPGDENREMDDPSVGPKIPQALEKILQLKESRQEEMNSQQEEEEMETDARSSLGQSASETEEDTVSVSKKEKNRKRRNRKKKKKPQRVRGVSSESSGDREKDSTRSRGSDSPAADVEIEYVTEEPEIYEPNFIFFKRIFEAFKLTDDVKKEKEKEPEKLDKLENSAAPKKKGFEEEHKDSDDDSSDDEQEKKPEAPKLSKKKLRRMNRFTVAELKQLVARPDVVEMHDVTAQDPKLLVHLKATRNSVPVPRHWCFKRKYLQGKRGIEKPPFELPDFIKRTGIQEMREALQEKEEQKTMKSKMREKVRPKMGKIDIDYQKLHDAFFKWQTKPKLTIHGDLYYEGKEFETRLKEKKPGDLSDELRISLGMPVGPNAHKVPPPWLIAMQRYGPPPSYPNLKIPGLNSPIPESCSFGYHAGGWGKPPVDETGKPLYGDVFGTNAAEFQTKTEEEEIDRTPWGELEPSDEESSEEEEEEESDEDKPDETGFITPADSDLITPGWLFLSLSTAIASYT

SEQ ID NO: 881958 - protein, 384 aa, Homo sapiens
FSMPRLPCRYLRLKHQWRGTGIQEMREALQEKEEQKTMKSKMREKVRPKMGKIDIDYQKLHDAFFKWQTKPKLTIHGDLYYEGKEFETRLKEKKPGDLSDELRISLGMPVGPNAHKVPPPWLIAMQRYGPPPSYPNLKIPGLNSPIPESCSFGYHAGGWGKPPVDETGKPLYGDVFGTNAAEFQTKTEEEEIDRTPWGELEPSDEESSEEEEEEESDEDKPDETGFITPADSGLITPGGFSSVPAGMETPELIELRKKKIEEAMDGSETPQLFTVLPEKRTATVGGAMMGSTHIYDMSTVMSRKGPAPELQGVEVALAPEELELDPMAMTQKYEEHVREQQAQVEKEDFSDMVAEHAAKQKQKKRKAQPQDSRGGSKKYKEFKF

SEQ ID NO: 881959 - protein, 316 aa, Homo sapiens
RSVPGFSLWGLYYEGKEFETRLKEKKPGDLSDELRISLGMPVGPNAHKVPPPWLIAMQRYGPPPSYPNLKIPGLNSPIPESCSFGYHAGGWGKPPVDETGKPLYGDVFGTNAAEFQTKTEEEEIDRTPWGELEPSDEESSEEEEEEESDEDKPDETGFITPADSGLITPGGFSSVPAGMETPELIELRKKKIEEAMDGSETPQLFTVLPEKRTATVGGAMMGSTHIYDMSTVMSRKGPAPELQGVEVALAPEELELDPMAMTQKYEEHVREQQAQVEKEDFSDMVAEHAAKQKQKKRKAQPQDSRGGSKKYKEFKF

SEQ ID NO: 881960 - protein, 333 aa, Homo sapiens
MKKRGVCFMSSSWLSKCLIWPVALRPDLYYEGKEFETRLKEKKPGDLSDELRISLGMPVGPNAHKVPPPWLIAMQRYGPPPSYPNLKIPGLNSPIPESCSFGYHAGGWGKPPVDETGKPLYGDVFGTNAAEFQTKTEEEEIDRTPWGELEPSDEESSEEEEEEESDEDKPDETGFITPADSGLITPGGFSSVPAGMETPELIELRKKKIEEAMDGSETPQLFTVLPEKRTATVGGAMMGSTHIYDMSTVMSRKGPAPELQGVEVALAPEELELDPMAMTQKYEEHVREQQAQVEKEDFSDMVAEHAAKQKQKKRKAQPQDSRGGSKKYKEFKF

SEQ ID NO: 881961 - protein, 154 aa, Homo sapiens
ALRLAPASGLVARLPAAKMATEHPEPPKAELQLPPPPPPGHYGAWAAQELQAKLAEIGAPIQGNREELVERLQSYTRQTGIVLNRPVLRGEDGDKAAPPPMSAQLPGIPMPPPPLGLPPLQPPPPAPTTSTRPWPWLSYGPPTKFGAPASSPCG

SEQ ID NO: 881962 - protein, 261 aa, Homo sapiens
GDSRGLVSSPFVSNLNPGLNSPSHESCSFGYHAGGWGKPPVDETGKPLYGDVFGTNAAEFQTKTEEEEIDRTPWGELEPSDEESSEEEEEEESDEDKPDETGFITPADSGLITPGGFSSVPAGMETPELIELRKKKIEEAMDGSETPQLFTVLPEKRTATVGGAMMGSTHIYDMSTVMSRKGPAPELQGVEVALAPEELELDPMAMTQKYEEHVREQQAQVEKEDFSDMVAEHAAKQKQKKRKAQPQDSRGGSKKYKEFKF

SEQ ID NO: 881963 - protein, 357 aa, Homo sapiens
MGELPDFIKRTGIQEMREALQEKEEQKTMKSKMREKVRPKMGKIDIDYQKLHDAFFKWQTKPKLTIHGDLYYEGKEFETRLKEKKPGDLSDELRISLGMPVGPNAHKVPPPWLIAMQRYGPPPSYPNHAGGWGKPPVDETGKPLYGDVFGTNAAEFQTKTEEEEIDRTPWGELEPSDEESSEEEEEEESDEDKPDETGFITPADSGLITPGGFSSVPAGMETPELIELRKKKIEEAMDGSETPQLFTVLPEKRTATVGGAMMGSTHIYDMSTVMSRKGPAPELQGVEVALAPEELELDPMAMTQKYEEHVREQQAQVEKEDFSDMVAEHAAKQKQKKRKAQPQDSRGGSKKYKEFKF

SEQ ID NO: 881964 - protein, 268 aa, Homo sapiens
KSSLGVAMDGGKSGWPVAWVGGEGTERALGPLQSDPSLLRAGNTESDSLGGGEPLYGDVFGTNAAEFQTKTEEEEIDRTPWGELEPSDEESSEEEEEEESDEDKPDETGFITPADSGLITPGGFSSVPAGMETPELIELRKKKIEEAMDGSETPQLFTVLPEKRTATVGGAMMGSTHIYDMSTVMSRKGPAPELQGVEVALAPEELELDPMAMTQKYEEHVREQQAQVEKEDFSDMVAEHAAKQKQKKRKAQPQDSRGGSKKYKEFKF

SEQ ID NO: 881965 - protein, 569 aa, Homo sapiens
MGTKPLHLPCRHSSLEFPCHHHLWDSPLCSLLRQPPPPPPGLGLGFPMAHPPNLGPPPPLRVGEPVALSEEERLKLAQQQAALLMQQEERAKQQGDHSLKEHELLEQQKRAAVLLEQERQQEIAKMGTPVPRPPQDMGQIGVRTPLGPRVAAPVGPVGPTPTVLPMGAPVPRPRGPPPPPGDENREMDDPSVGPKIPQALEKILQLKESRQEEMNSQQEEEEMETDARSSLGQSASETEEDTVSVSKKEKNRKRRNRKKKKKPQRVRGVSSESSGDREKDSTRSRGSDSPAADVEIEYVTEEPEIYEPNFIFFKRIFEAFKLTDDVKKEKEKEPEKLDKLENSAAPKKKGFEEEHKDSDDDSSDDEQEKKPEAPKLSKKKLRRMNRFTVAELKQLVARPDVVEMHDVTAQDPKLLVHLKATRNSVPVPRHWCFKRKYLQGKRGIEKPPFELPDFIKRTGIQEMREALQEKEEQKTMKSKMREKYDALVGIETERDSRDRESRREKEEARGKEKPEVTDRAGGNKTVEPPISQVGNVDTASELEKGVSEAAVLKPSEELPAEVTHPLNRK

SEQ ID NO: 881966 - protein, 412 aa, Homo sapiens
MGTKPLHLPCRHSSLEFPCHHHLWDSPLCSLLRQPPPPPPGLGLGFPMAHPPNLGPPPPLRVGEPVALSEEERLKLAQQQAALLMQQEERAKQQGDHSLKEHELLEQQKRAAVLLEQERQQEIAKMGTPVPRPPQDMGQIGVRTPLGPRVAAPVGPVGPTPTVLPMGAPVPRPRGPPPPPGDENREMDDPSVGPKIPQALEKILQLKESRQEEMNSQQEEEEMETDARSSLGQSASETEEDTVSVSKKEKNRKRRNRKKKKKPQRVRGVSSESSGDREKDSTRSRGSDSPAADVEIEYVTEEPEIYEPNFIFFKRIFEAFKLTDDVKKEKEKEPEKLDKLENSAAPKKKGFEEEHKDSDDDSSDDEQEKKPEAPKLSKKKLRRMNRFTVAELKQLVARPDVVEMHDVTADPN

SEQ ID NO: 881967 - protein, 137 aa, Homo sapiens
LEVIQRIFKSALFYIYMDRSETPQLFTVLPEKRTATVGGAMMGSTHIYDMSTVMSRKGPAPELQGVEVALAPEELELDPMAMTQKYEEHVREQQAQVEKEDFSDMVAEHAAKQKQKKRKAQPQDSRGGSKKYKEFKF

SEQ ID NO: 881968 - protein, 133 aa, Homo sapiens
MDATKRIMQMLKLDGSETPQLFTVLPEKRTATVGGAMMGSTHIYDMSTVMSRKGPAPELQGVEVALAPEELELDPMAMTQKYEEHVREQQAQVEKEDFSDMVAEHAAKQKQKKRKAQPQDSRGGSKKYKEFKF

SEQ ID NO: 881969 - protein, 154 aa, Homo sapiens; identical to SEQ ID NO: 881961

SEQ ID NO: 881970 - protein, 287 aa, Homo sapiens
MGTPVPRPPQDMGQIGVRTPLGPRVAAPVGPVGPTPTVLPMGAPVPRPRGPPPPPGDENREMDDPSVGPKIPQALEKILQLKESRQEEMNSQQEEEEMETDARSSLGQSASETEEDTVSVSKKEKNRKRRNRKKKKKPQRVRGVSSESSGDREKDSTRSRGSDSPAADVEIEYVTEEPEIYEPNFIFFKRIFEAFKLTDDVKKEKEKEPEKLDKLENSAAPKKKGFEEEHKDSDDDSSDDEQEKKPEAPKLSKKKLRRMNRFTVAELKQLVARPDVVEMHDVTADPN

SEQ ID NO: 881971 - protein, 128 aa, Homo sapiens [sequence omitted]

SEQ ID NO: 881972 - protein, 104 aa, Homo sapiens
PPPPPGHYGAWAAQELQAKLAEIGAPIQGGTQEVEGPLRACGEAEPGYPGDSGARGGGRPLGPDLAGLACPIDRVLCPAGNREELVERLQSYTRQVGVGGGTSG

SEQ ID NO: 881973 - protein, 673 aa, Homo sapiens [sequence omitted]

SEQ ID NO: 881974 - protein, 712 aa, Homo sapiens
MNRKDSKRKSHQECTGKTGGRGRPRQVRRHKTCPSPREISKVMASMNLGLLSEGGCSEDELLEKCIQSFDSAGSLCHEDHMLNMVLAMHSWVLPSADLAARLLTSYQKATGDTQELRRLQICHLVRYWLMRHPEVMHQDPQLEEVIGRFWATVAREGNSAQRRLGDSSDLGVSPVLPSSLPHRHSAISLYIPKPSTVSHSNTLPLLAPSLSPGGPGPPLPMSSPGLGKKRKVSLLFDHLETGELAQHLTYLEFRSFQAITPQDLRSYVLQGSVRGCPALEGSVGLSNSVSRWVQVMVLSRPGPLQRAQVLDKFIHVAQRLHQLQNFNTLMAVTGGLCHSAISRLKDSHAHLSPDSTKALLELTELLASHNNYARYRRTWAGCAGFRLPVLGVHLKDLVSLHEAQPDRLPDGRLHLPKLNNLYLRLQELVALQGQHPPCSANEDLLHLLTLSLDLFYTEDEIYELSYAREPRCPKSLPPSPFNAPLVVEWAPGVTPKPDRVTLGRHVEQLVESVFKNYDPEGRGTISQEDFERLSGNFPFACHGLHPPPRQGRGSFSREELTGYLLRASAICSKLGLAFLHTFHEVTFRKPTFCDSCSGFLWGVTKQGYRCRECGLCCHKHCRDQVKVECKKRPGAKGDAGPPGAPVPSTPAPHASCGSEENHSYTLSLEPETGCQLRHAWTQTESPHPSWETDTVPCPVMDPPSTASSKLDS

SEQ ID NO: 881975 - protein, 659 aa, Homo sapiens [sequence omitted]

SEQ ID NO: 881976 - protein, 68 aa, Homo sapiens
LLPPPASVGRAPPAPGGSPTRPRHAPPCPANFCIFSRDGVSPCWPRWSQTPDLMIHQPQPPKVLGIQA

SEQ ID NO: 881977 - protein, 617 aa, Homo sapiens [sequence omitted]

SEQ ID NO: 881978 - protein, 480 aa, Homo sapiens
MFPNSILGRPPFTPNHQQHNNFFTLSPTVYSHQQLIDAQFNFQNADLSRAVSLQQLTYGNVSPIQTSASPLFRGRKRLSDEKNLPLDGKRQRFHSPHQEPTVVNQIVPLSGERRYSMPPLFHTHYVPDIVRCVPPFREIAFLEPREITLPEAKDKLSQQILELFETCQQQISDLKKKELCRTQLQREIQLLFPQSRLFLVGSSLNGFGTRSSDGDLCLVVKEEPVNQKTEARHILTLVHKHFCTRLSGYIERPQLIRAKVPIVKFRDKVSCVEFDLNVNNIVGIRNTFLLRTYAYLENRVRPLVLVIKKWASHHQINDASRGTLSSYSLVLMVLHYLQTLPEPILPSLQKIYPESFSPAIQLHLVHQAPCNVPPYLSKNESNLGDLLLGFLKYYATEFDWNSQMISVREAKAIPRPDGIEWRNKYICVEEPFDGTNTARAVHEKQKFDMIKDQFLKSWHRLKNKRDLNSILPVRAAVLKR

SEQ ID NO: 881979 - protein, 341 aa, Homo sapiens
MFPNSILGRPPFTPNHQQHNNFFTLSPTVYSHQQLIDAQFNFQNADLSRAVSLQQLTYGNVSPIQTSASPLFRGRKRLSDEKNLPLDGKRQRFHSPHQEPTVVNQIVPLSGERRYSMPPLFHTHYVPDIVRCVPPFREIAFLEPREITLPEAKDKLSQQILELFETCQQQISDLKKKELCRTQLQREIQLLFPQSRLFLVGSSLNGFGTRSSDGDLCLVVKEEPVNQKTEARHILTLVHKHFCTRLSGYIERPQLIRAKVPIVKFRDKVSCVEFDLNVNNIVGIRNTFLLRTYAYLENRVRPLVLVIKKWASHHQINDASRGTLSSYSLVLMVLHYLQRVF

SEQ ID NO: 881980 - protein, 480 aa, Homo sapiens; identical to SEQ ID NO: 881978

SEQ ID NO: 881981 - protein, 480 aa, Homo sapiens; identical to SEQ ID NO: 881978

SEQ ID NO: 881982 - protein, 480 aa, Homo sapiens; identical to SEQ ID NO: 881978

SEQ ID NO: 881983 - protein, 159 aa, Homo sapiens
MFPNSILGRPPFTPNHQQHNNFFTLSPTVYSHQQLIDAQFNFQNADLSRAVSLQQLTYGNVSPIQTSASPLFRGRKRLSDEKNLPLDGKRQRFHSPHQEPTVVNQIVPLSGERRYSMPPLFHTHYVPDIVRCVPPFREIAFLEPREITLPEAKDKVIIM

SEQ ID NO: 881984 - protein, 337 aa, Homo sapiens
MFPNSILGRPPFTPNHQQHNNFFTLSPTVYSHQQLIDAQFNFQNADLSRAVSLQQLTYGNVSPIQTSASPLFRGRKRLSDEKNLPLDGKRQRFHSPHQEPTVVNQIVPLSGERRYSMPPLFHTHYVPDIVRCVPPFREIAFLEPREITLPEAKDKLSQQILELFETCQQQISDLKKKELCRTQLQREIQLLFPQSRLFLVGSSLNGFGTRSSDGDLCLVVKEEPVNQKTEARHILTLVHKHFCTRLSGYIERPQLIRAKVPIVKFRDKVSCVAVWLECNHCWENLPPNLSLKPVAVRDKRDPQMRGYTFWLQTLPPPISRRTVPKAGYVPLSSDILW

SEQ ID NO: 881985 - protein, 230 aa, Homo sapiens
MFPNSILGRPPFTPNHQQHNNFFTLSPTVYSHQQLIDAQFNFQNADLSRAVSLQQLTYGNVSPIQTSASPLFRGRKRLSDEKNLPLDGKRQRFHSPHQEPTVVNQIVPLSGERRYSMPPLFHTHYVPDIVRCVPPFREIAFLEPREITLPEAKDKLSQQILELFETCQQQISDLKKKELCRTQLQREIQLLFPQSRLFLVGSSLNGFGTRSSDGDLCLVVKEEPVSKETF

SEQ ID NO: 881986 - protein, 762 aa, Homo sapiens
APDRPPPRHQDTGPCLEKTPAEGRDSPTREPGALPCACGQLPDLEDELSLLDPLPRYLKSCQDLIVPEQCRCADTRPGSEQPPLGGAASPEVLAPVSKEAADLAPTGPSPRPGPGLLLDVCTKDLADAPAEELQEKGSPAGPPPSQGQPAARPPKEVPASRLAQQLREEGWNLQTSESLTLAEVYLMMGKPSKLQLEYDWLGPGRQDPRPGSLPTALHKQRLLSCLLKLISTEVNPKLALEANTISTASVRPAQEEQSMTPPGKVVTVSSRSPRCPRNQASLRSSKTFPPSSAPCSSGLRNPPRPLLVPGPSSTGSNDSDGGLFAVPTTLPPNSRHGKLFSPSKEAELTFRQHLNSISMQSDFFLPKPRKLRNRHLRKPLVVQRTLLPRPSENQSHNVCSFSILSNSSVTGRGSFRPIQSSLTKAALSRPIVPKVLPPQATSHLASAIDLAATSAGILSGNPLPALDTEGLSGISPLSSDEVTGAISGQDSTGTHQDGDTLPTVGGSDPFVSIPSRPEQEPVADSFQGSSVLSLSELPKAPLQNGLSIPLSSSESSSTRLSPPDVSALLDISLPGPPEDALSQGEPATHISDSIIEIAISSGQYGEGVPLSPAKLNGSDSSKSLPSPSSSPQPHWIASPTHDPQWYPSDSTDSSLSSLFASFISPEKSRKMLPTPIGTNSGTSLLGPSLLDGNSRDSFVSRSLADVAEVVDSQLVCMMNENSIDYISRFNDLAQELSIAEPGRREALFDGGGGGPAVSDLSQ

SEQ ID NO: 881987 - protein, 792 aa, Homo sapiens
APDRPPPRHQDTGPCLEKTPAEGRDSPTREPGALPCACGQLPDLEDELSLLDPLPRYLKSCQDLIVPEQCRCADTRPGSEQPPLGGAASPEVLAPVSKEAADLAPTGPSPRPGPGLLLDVCTKDLADAPAEELQEKGSPAGPPPSQGQPAARPPKEVPASRLAQQLREEGWNLQTSESLTLAEVYLMMGKPSKLQLEYDWLGPGRQDPRPGSLPTALHKQRLLSCLLKLISTEVNPKLALEANTISTASVRPAQEEQSMTPPGKVVTVSSRSPRCPRNQASLRSSKTFPPSSAPCSSGLRNPPRPLLVPGPSSTGSNDSDGGLFAVPTTLPPNSRHGKLFSPSKEAELTFRQHLNSISVSVWGRAARVRASPWSGELHLQVPDAAPLQMQSDFFLPKPRKLRNRHLRKPLVVQRTLLPRPSENQSHNVCSFSILSNSSVTGRGSFRPIQSSLTKAALSRPIVPKVLPPQATSHLASAIDLAATSAGILSGNPLPALDTEGLSGISPLSSDEVTGAISGQDSTGTHQDGDTLPTVGGSDPFVSIPSRPEQEPVADSFQGSSVLSLSELPKAPLQNGLSIPLSSSESSSTRLSPPDVSALLDISLPGPPEDALSQGEPATHISDSIIEIAISSGQYGEGVPLSPAKLNGSDSSKSLPSPSSSPQPHWIASPTHDPQWYPSDSTDSSLSSLFASFISPEKSRKMLPTPIGTNSGTSLLGPSLLDGNSRDSFVSRSLADVAEVVDSQLVCMMNENSIDYISRFNDLAQELSIAEPGRREALFDGGGGGPAVSDLSQ

SEQ ID NO: 881988 - protein, 757 aa, Homo sapiens
APDRPPPRHQDTGPCLEKTPAEGRDSPTREPGALPCACGQLPDLEDELSLLDPLPRYLKSCQDLIVPEQCRCADTRPGSEQPPLGGAASPEVLAPVSKEAADLAPTGPSPRPGPGLLLDVCTKDLADAPAEELQEKGSPAGPPPSQGQPAARPPKEVPASRLAQQLREEGWNLQTSESLTLAEVYLMMGKPSKLQLEYDWLGPGRQDPRPGSLPTALHKQRLLSCLLKLISTEVNPKLALEANTISTASVRPAQEEQSMTPPGKVVTVSSRSPRCPRNQASLRSSKTFPPSSAPCSSGLRNPPRPLLVPGPSSTGSNDSDGGLFAVPTTLPPNSRHGKLFSPSKEAELTFRQHLNSISVSVWGRAARVRASPWSGELHLQVPDAAPLQMQSDFFLPKPRKLRNRHLRKPLVVQRTLLPRPSENQSHNVCSFSILSNSSVTGAIDLAATSAGILSGNPLPALDTEGLSGISPLSSDEVTGAISGQDSTGTHQDGDTLPTVGGSDPFVSIPSRPEQEPVADSFQGSSVLSLSELPKAPLQNGLSIPLSSSESSSTRLSPPDVSALLDISLPGPPEDALSQGEPATHISDSIIEIAISSGQYGEGVPLSPAKLNGSDSSKSLPSPSSSPQPHWIASPTHDPQWYPSDSTDSSLSSLFASFISPEKSRKMLPTPIGTNSGTSLLGPSLLDGNSRDSFVSRSLADVAEVVDSQLVCMMNENSIDYISRFNDLAQELSIAEPGRREALFDGGGGGPAVSDLSQ

SEQ ID NO: 881989 - protein, 737 aa, Homo sapiens
APDRPPPRHQDTGPCLEKTPAEGRDSPTREPGALPCACGQLPDLEDELSLLDPLPRYLKSCQDLIVPEQCRCADTRPGSEQPPLGGAASPEVLAPVSKEAADLAPTGPSPRPGPGLLLDVCTKDLADAPAEELQEKGSPAGPPPSQGQPAARPPKEVPASRLAQQLREEGWNLQTSESLTLAEVYLMMGKPSKLQLEYDWLGPGRQDPRPGSLPTALHKQRLLSCLLKLISTEVNPKLALEANTISTASVRPAQEEQSMTPPGKVVTVSSRSPRCPRNQASLRSSKTFPPSSAPCSSGLRNPPRPLLVPGPSSTGSNDSDGGLFAVPTTLPPNSRHGKLFSPSKEAELTFRQHLNSISRTLLPRPSENQSHNVCSFSILSNSSVTGRGSFRPIQSSLTKAALSRPIVPKVLPPQATSHLASAIDLAATSAGILSGNPLPALDTEGLSGISPLSSDEVTGAISGQDSTGTHQDGDTLPTVGGSDPFVSIPSRPEQEPVADSFQGSSVLSLSELPKAPLQNGLSIPLSSSESSSTRLSPPDVSALLDISLPGPPEDALSQGEPATHISDSIIEIAISSGQYGEGVPLSPAKLNGSDSSKSLPSPSSSPQPHWIASPTHDPQWYPSDSTDSSLSSLFASFISPEKSRKMLPTPIGTNSGTSLLGPSLLDGNSRDSFVSRSLADVAEVVDSQLVCMMNENSIDYISRFNDLAQELSIAEPGRREALFDGGGGGPAVSDLSQ

SEQ ID NO: 881990 - protein, 705 aa, Homo sapiens
APDRPPPRHQDTGPCLEKTPAEGRDSPTREPGALPCACGQLPDLEDELSLLDPLPRYLKSCQDLIVPEQCRCADTRPGSEQPPLGGAASPEVLAPVSKEAADLAPTGPSPRPGPGLLLDVCTKDLADAPAEELQEKGSPAGPPPSQGQPAARPPKEVPASRLAQQLREEGWNLQTSESLTLAEVYLMMGKPSKLQLEYDWLGPGRQDPRPGSLPTALHKQRLLSCLLKLISTEVNPKLALEANTISTASVRPAQEEQSMTPPGKVVTVSSRSPRCPRNQASLRSSKTFPPSSAPCSSGLRNPPRPLLVPGPSSTGSNDSDGGLFAVPTTLPPNSRHGKLFSPSKEAELTFRQHLNSISMQSDFFLPKPRKLRNRHLRKPLVVQRTLLPRPSENQSHNVCSFSILSNSSVTGAIDLAATSAGILSGNPLPALDTEGLSGISPLSSDEVTGAISGQDSTGTHQDGDTLPTVGGSSVLSLSELPKAPLQNGLSIPLSSSESSSTRLSPPDVSALLDISLPGPPEDALSQGEPATHISDSIIEIAISSGQYGEGVPLSPAKLNGSDSSKSLPSPSSSPQPHWIASPTHDPQWYPSDSTDSSLSSLFASFISPEKSRKMLPTPIGTNSGTSLLGPSLLDGNSRDSFVSRSLADVAEVVDSQLVCMMNENSIDYISRFNDLAQELSIAEPGRREALFDGGGGGPAVSDLSQ

SEQ ID NO: 881991 - protein, 367 aa, Homo sapiens
MAGGLDMSAFALALAGRGSFRPIQSSLTKAALSRPIVPKVLPPQATSHLASAIDLAATSAGILSGNPLPALDTEGLSGISPLSSDEVTGAISGQDSTGTHQDGDTLPTVGGSDPFVSIPSRPEQEPVADSFQGSSVLSLSELPKAPLQNGLSIPLSSSESSSTRLSPPDVSALLDISLPGPPEDALSQGEPATHISDSIIEIAISSGQYGEGVPLSPAKLNGSDSSKSLPSPSSSPQPHWIASPTHDPQWYPSDSTDSSLSSLFASFISPEKSRKMLPTPIGTNSGTSLLGPSLLDGNSRDSFVSRSLADVAEVVDSQLVCMMNENSIDYISRFNDLAQELSIAEPGRREALFDGGGGGPAVSDLSQ

SEQ ID NO: 881992 - protein, 792 aa, Homo sapiens; identical to SEQ ID NO: 881987

SEQ ID NO: 881993 - protein, 792 aa, Homo sapiens; identical to SEQ ID NO: 881987

SEQ ID NO: 881994 - protein, 792 aa, Homo sapiens; identical to SEQ ID NO: 881987

SEQ ID NO: 881995 - protein, 419 aa, Homo sapiens
APDRPPPRHQDTGPCLEKTPAEGRDSPTREPGALPCACGQLPDLEDELSLLDPLPRYLKSCQDLIVPEQCRCADTRPGSEQPPLGGAASPEVLAPVSKEAADLAPTGPSPRPGPGLLLDVCTKDLADAPAEELQEKGSPAGPPPSQGQPAARPPKEVPASRLAQQLREEGWNLQTSESLTLAEVYLMMGKPSKLQLEYDWLGPGRQDPRPGSLPTALHKQRLLSCLLKLISTEVNPKLALEANTISTASVRPAQEEQSMTPPGKVVTVSSRSPRCPRNQASLRSSKTFPPSSAPCSSGLRNPPRPLLVPGPSSTGSNDSDGGLFAVPTTLPPNSRHGKLFSPSKEAELTFRQHLNSISVSVWGRAARVRASPWSGECTFRCRTLLPYRCSRISSCQSPGSCGTGTCGSHWWSRSGSSQV

SEQ ID NO: 881996 - protein, 401 aa, Homo sapiens
MVVFLDGGQLGTLVGKRVSNLSEAVGSPLPEPPEKMVPRGCLSPRAVPPATRERGGGGPEEEPVDGLAGSAAGPGAEPQVAGAAMLGPGPPAPSVDSLSGQGQPSSSDTESDFYEEIEVSCTPDCATGNAEYQHSKGSGSEALVGSPNGGSETPKSNGGSGGGGSQGTLACSASDQMRRYRTAFTREQIARLEKEFYRENYVSRPRRCELAAALNLPETTIKVWFQNRRMKDKRQRLAMTWPHPADPAFYTYMMSHAAAAGGLPYPFPSHLPLPYYSPVGLGAASAASAAASPFSGSLRPLDTFRVLSQPYPRPELLCAFRHPPLYPGPAHGLGASAGGPCSCLACHSGPANGLAPRAAAASDFTCASTSRSDSFLTFAPSVLSKASSVALDQREEVPLTR

SEQ ID NO: 881997 - protein, 283 aa, Homo sapiens
MAFVCLCLYTPVLWTRCAGSGSEALVGSPNGGSETPKSNGGSGGGGSQGTLACSASDQMRRYRTAFTREQIARLEKEFYRENYVSRPRRCELAAALNLPETTIKVWFQNRRMKDKRQRLAMTWPHPADPAFYTYMMSHAAAAGGLPYPFPSHLPLPYYSPVGLGAASAASAAASPFSGSLRPLDTFRVLSQPYPRPELLCAFRHPPLYPGPAHGLGASAGGPCSCLACHSGPANGLAPRAAAASDFTCASTSRSDSFLTFAPSVLSKASSVALDQREEVPLTR

SEQ ID NO: 881998 - protein, 350 aa, Homo sapiens
MSNITDPQMWDFDDLNFTGMPPADEDYSPCMLETETLNKYVVIIAYALVFLLSLLGNSLVMLVILYSRVGRSVTDVYLLNLALADLLFALTLPIWAASKVNGWIFGTFLCKVVSLLKEVNFYSGILLLACISVDRYLAIVHATRTLTQKRHLVKFVCLGCWGLSMNLSLPFFLFRQAYHPNNSSPVCYEVLGNDTAKWRMVLRILPHTFGFIVPLFVMLFCYGFTLRTLFKAHMGQKHRAMRVIFAVVLIFLLCWLPYNLVLLADTLMRTQVIQESCERRNNIGRALDATEILGFLHSCLNPIIYAFIGQNFRHGFLKILAMHGLVSKEFLARHRVTSYTSSSVNVSSNL

SEQ ID NO: 881999 - protein, 390 aa, Homo sapiens
NHKHQSRGAGSTPPSSQSTSPAMVLEVSDHQVLNDAEVAALLENFSSSYDYGENESDSCCTSPPCPQDFSLNFDRAFLPALYSLLFLLGLLGNGAVAAVLLSRRTALSSTDTFLLHLAVADTLLVLTLPLWAVDAAVQWVFGSGLCKVAGALFNINFYAGALLLACISFDRYLNIVHATQLYRRGPPARVTLTCLAVWGLCLLFALPDFIFLSAHHDERLNATHCQYNFPQVGRTALRVLQLVAGFLLPLLVMAYCYAHILAVLLVSRGQRRLRAMRLVVVVVVAFALCWTPYHLVVLVDILMDLGALARNCGRESRVDVAKSVTSGLGYMHCCLNPLLYAFVGVKFRERMWMLLLRLGCPNQRGLQRQPSSSRRDSSWSETSEASYSGL

SEQ ID NO: 882000 - protein, 153 aa, Homo sapiens
MASPDPPATSYAPSDVPSGVALFLTIPFAFFLPELIFGFLVWTMVAATHIVYPLLQGWVMYVSLTSFLISLMFLLSYLFGFYKRFESWRVLDSLYHGTTGILYMSAAVLQVHATIVSEKLLDPRIYYINSAASFFAFIATLLYILHAFSIYYH

SEQ ID NO: 882001 - protein, 153 aa, Homo sapiens; identical to SEQ ID NO: 882000

SEQ ID NO: 882002 - protein, 248 aa, Homo sapiens
MSGAGLAAVVSCLRPQPGEEPQTHETFCQKVGLLCTLQGKLQPQDWTLLDELLQGLQTLLLMILWQASRGLFLHYHVEALTLRRISSFRQYKYDLVAAGKALEGMFCKLNHLLEHPHQLFFLYLLPTLSRFVSIGLYMPATSFLLLVLGFKALQLWMQLHEAGVGLEELRGVPDPSVPPPPAQDGKHTGPRQGLDGSEAGSPDLPNTAAGLHRPHQLLTGLPAGRHYGAAAVLAEPLGPGPSVLPCWC

SEQ ID NO: 882003 - protein, 153 aa, Homo sapiens; identical to SEQ ID NO: 882000

SEQ ID NO: 882004 - protein, 143 aa, Homo sapiens [sequence omitted]

SEQ ID NO: 882005 - protein, 110 aa, Homo sapiens [sequence omitted]

SEQ ID NO: 882006 - protein, 153 aa, Homo sapiens; identical to SEQ ID NO: 882000

SEQ ID NO: 882007 - protein, 153 aa, Homo sapiens; identical to SEQ ID NO: 882000

SEQ ID NO: 882008 - protein, 112 aa, Homo sapiens
QEVIFDKAARGRAAAEHPAGADSMASPDPPATSYAPSDVPSGVALFLTIPFAFFLPELIFGFLVWTMVAATHIVYPSHSLKHPVALRGLAEWWCPRGWARAHQDLNGQSCAH

SEQ ID NO: 882009 - protein, 119 aa, Homo sapiens
MVAATHIVYPLLQGWVMYVSLTSFLISLMFLLSYLFGFYKRFESWRVLDSLYHGTTGILYMSAAVLQVHATIVSEKLLDPRIYYINSAASFFAFIATLLYILLPQPHWKKRLPQHLSEE

SEQ ID NO: 882010 - protein, 507 aa, Homo sapiens
RVLQEQPVGTAAVVGGGRGSVAAPPCPAMGLLSDPVRRRALARLVLRLNAPLCVLSYVAGIAWFLALVFPPLTQRTYMSENAMGSTMVEEQFAGGDRARAFARDFAAHRKKSGALPVAWLERTMRSVGLEVYTQSFSRKLPFPDETHERYMVSGTNVYGILRAPRAASTESLVLTVPCGSDSTNSQAVGLLLALAAHFRGQIYWAKDIVFLVTEHDLLGTEAWLEAYHDVNVTGMQSSPLQGRAGAIQAAVALELSSDVVTSLDVAVEGLNGQLPNLDLLNLFQTFCQKVGLLCTLQGKLQPQDWTLLDELLQGLQTLLLMILWQASRGLFLHYHVEALTLRRISSFRQYKYDLVAAGKALEGMFCKLNHLLEHPHQLFFLYLLPTLSRFVSIGLYMPATSFLLLVLGFKALQLWMQLHEAGVGLEELRGVPDPSVPPPPAQDGKHTGPRQGLDGSEAGSPDLPNTAAGLHRPHQLLTGLPAGRHYGAAAVLAEPLGPGPSVLPCWC

SEQ ID NO: 882011 - protein, 507 aa, Homo sapiens; identical to SEQ ID NO: 882010

SEQ ID NO: 882012 - protein, 385 aa, Homo sapiens
GGSSHPMSSAPEKQQPPHGGGGGGGGGGGAAMDPASSGPSKAKKTNAGIRRPEKPPYSYIALIVMAIQSSPTKRLTLSEIYQFLQSRFPFFRGSYQGWKNSVRHNLSLNECFIKLPKGLGRPGKGHYWTIDPASEFMFEEGSFRRRPRGFRRKCQALKPMYSMMNGLGFNHLPDTYGFQGSAGGLSCPPNSLALEGGLGMMNGHLPGNVDGMALPSHSVPHLPSNGGHSYMGGCGGAAAGEYPHHDSSVPASPLLPTGAGGVMEPHAVYSGSAAAWPPSASAALNSGASYIKQQPLSPCNPAANPLSGSLSTHSLEQPYLHQNSHNAPAELQGIPRYHSQSPSMCDRKEFVFSFNAMASSSMHSAGGGSYYHQQVTYQDIKPCVM

SEQ ID NO: 882013 - protein, 418 aa, Homo sapiens
DRDKSDFLFPVHLRRSLEVPGSTGGHPVMGDTFIRHIALLGFEKRFVPSQHYVYMFLVKWQDLSEKVVYRRFTEIYEFHKTLKEMFPIEAGAINPENRIIPHLPAPKWFDGQRAAENRQGTLTEYCSTLMSLPTKISRCPHLLDFFKVRPDDLKLPTDNQTKKPETYLMPKDGKSTATDITGPIILQTYRAIANYEKTSGSEMALSTGDVVEVVEKSESGWWFCQMKAKRGWIPASFLEPLDSPDETEDPEPNYAGEPYVAIKAYTAVEGDEVSLLEGEAVEVIHKLLDGWWVIRKDDVTGYFPSMYLQKSGQDVSQAQRQIKRGAPPRRSSIRNAHSIHQRSRKRLSQDAYRRNSVRFLQQRRRQARPGPQSPGSPLEEERQTQRSKPQPAVPPRPSADLILNRCSESTKRKLASAV

SEQ ID NO: 882014 - protein, 418 aa, Homo sapiens; identical to SEQ ID NO: 882013

SEQ ID NO: 882015 - protein, 401 aa, Homo sapiens
SCEPFRERHPVMGDTFIRHIALLGFEKRFVPSQHYVYMFLVKWQDLSEKVVYRRFTEIYEFHKTLKEMFPIEAGAINPENRIIPHLPAPKWFDGQRAAENRQGTLTEYCSTLMSLPTKISRCPHLLDFFKVRPDDLKLPTDNQTKKPETYLMPKDGKSTATDITGPIILQTYRAIANYEKTSGSEMALSTGDVVEVVEKSESGWWFCQMKAKRGWIPASFLEPLDSPDETEDPEPNYAGEPYVAIKAYTAVEGDEVSLLEGEAVEVIHKLLDGWWVIRKDDVTGYFPSMYLQKSGQDVSQAQRQIKRGAPPRRSSIRNAHSIHQRSRKRLSQDAYRRNSVRFLQQRRRQARPGPQSPGSPLEEERQTQRSKPQPAVPPRPSADLILNRCSESTKRKLASAV

SEQ ID NO: 882016 - protein, 418 aa, Homo sapiens; identical to SEQ ID NO: 882013

SEQ ID NO: 882017 - protein, 418 aa, Homo sapiens; identical to SEQ ID NO: 882013

SEQ ID NO: 882018 - protein, 573 aa, Homo sapiens
DRDKSDFLFPVHLRRSLEVPGSTGGHPVMGDTFIRHIALLGFEKRFVPSQHYVYMFLVKWQDLSEKVVYRRFTEIYEFHKTLKEMFPIEAGAINPENRIIPHLPAPKWFDGQRAAENRQGTLTEYCSTLMSLPTKISRCPHLLDFFKVRPDDLKLPTDNQTKKPETYLMPKDGKSTATDITGPIILQTYRAIANYEKTSGSEMALSTGDVVEVVEKSESGQTSHLTGLLPLVLRNPQPQAPCQGSGSLAPGRTPALLGALNVLPTLWVAFCLSVHPVVAVGICAWQAGAGHVCVFCLDGVWDRLFIMKWAQSCDSVSMCACMHVTSLSSVVKVTFPNLSIGHQCVCVPVSSPSLMAAEEPLGPAPQSHSRTSGTGWWFCQMKAKRGWIPASFLEPLDSPDETEDPEPNYAGEPYVAIKAYTAVEGDEVSLLEGEAVEVIHKLLDGWWVIRKDDVTGYFPSMYLQKSGQDVSQAQRQIKRGAPPRRSSIRNAHSIHQRSRKRLSQDAYRRNSVRFLQQRRRQARPGPQSPGSPLEEERQTQRSKPQPAVPPRPSADLILNRCSESTKRKLASAV

SEQ ID NO: 882019 - protein, 412 aa, Homo sapiens
SISRISGSRCATVLEKMLPVTSFTFIRAHRSIAAHLLIKPLLGLSGLVQSHAGRCGRAPGAVGVPRQHTVLAGAVLPTEGQRGLDHARVRASIDKPVALLGRQQQGLDWLKVLEVLGLLDDVNKLGSRPGARCPHLLDFFKVRPDDLKLPTDNQTKKPETYLMPKDGKSTATDITGPIILQTYRAIANYEKTSGSEMALSTGDVVEVVEKSESGWWFCQMKAKRGWIPASFLEPLDSPDETEDPEPNYAGEPYVAIKAYTAVEGDEVSLLEGEAVEVIHKLLDGWWVIRKDDVTGYFPSMYLQKSGQDVSQAQRQIKRGAPPRRSSIRNAHSIHQRSRKRLSQDAYRRNSVRFLQQRRRQARPGPQSPGSPLEEERQTQRSKPQPAVPPRPSADLILNRCSESTKRKLASAV

SEQ ID NO: 882020 - protein, 374 aa, Homo sapiens
DRDKSDFLFPVHLRRSLEVPGSTGGHPVMGDTFIRHIALLGFEKRFVPSQHYVYMFLVKWQDLSEKVVYRRFTEIYEFHKTLKEMFPIEAGAINPENRIIPHLPAPKWFDGQRAAENRQGTLTEYCSTLMSLPTKISRCPHLLDFFKVRPDDLKLPTDNQTKKPETYLMPKDGKSTATDITGPIILQTYRAIANYEKTSGSEMALSTGDVVEVVEKSESGWWFCQMKAKRGWIPASFLEPLDSPDETEDPEPNYAGEPYVAIKAYTAVEGDEVSLLEGEAVEERRRHRLLPVHVPAKVRARRVPGPTPDQAGGAAPQVVHPQRAQHPPAVAEAPQPGRLSPQQRPFSAAATPPGAAGTAEPREPARGGAADAAL

SEQ ID NO: 882021 - protein, 670 aa, Homo sapiens
DRDKSDFLFPVHLRRSLEVPGSTGGHPVMGDTFIRHIALLGFEKRFVPSQHYVYMFLVKWQDLSEKVVYRRFTEIYEFHKTLKEMFPIEAGAINPENRIIPHLPAPKWFDGQRAAENRQGTLTEYCSTLMSLPTKISRCPHLLDFFKVRPDDLKLPTDNQTKKPETYLMPKDGKSTATDITGPIILQTYRAIANYEKTSGSEMALSTGDVVEVVEKSESGQTSHLTGLLPLVLRNPQPQAPCQGSGSLAPGRTPALLGALNVLPTLWVAFCLSVHPVVAVGICAWQAGAGHVCVFCLDGVWDRLFIMKWAQSCDSVSMCACMHVTSLSSVVKVTFPNLSIGHQCVCVPVSSPSLMAAEEPLGPAPQSHSRTSGTGWWFCQMKAKRGWIPASFLEPLDSPDETEDPEPNYAGEPYVAIKAYTAVEGDEVSLLEGEAVEVIHKLLDGWWVIRKDDVTGYFPSMYLQKSGQDVSQAQRQIKRGAPPRRYSRGVPGAGRGRAGRTTGSLCLGHSLAVPGRGLSAWQERQDPHGGKGLDAPGRGVGLARGRKESGDAPHFLDQGCPSESLGAGAPSGFDDAPSRWARSSIRNAHSIHQRSRKRLSQDAYRRNSVRFLQQRRRQARPGPQSPGSPLEEERQTQRSKPQPAVPPRPSADLILNRCSESTKRKLASAV

SEQ ID NO: 882022 - protein, 502 aa, Homo sapiens
DRDKSDFLFPVHLRRSLEVPGSTGGHPVMGDTFIRHIALLGFEKRFVPSQHYVYMFLVKWQDLSEKVVYRRFTEIYEFHKTLKEMFPIEAGAINPENRIIPHLPAPKWFDGQRAAENRQGTLTEYCSTLMSLPTKISRCPHLLDFFKVRPDDLKLPTDNQTKKPETYLMPKDGKSTATDITGPIILQTYRAIANYEKTSGSEMALSTGDVVEVVEKSESGWWFCQMKAKRGWIPASFLEPLDSPDETEDPEPNYAGEPYVAIKAYTAVEGDEVSLLEGEAVEERRRHRLLPVHVPAKVRARRVPGPTPDQAGGAAPQVQPGVPGAGRGRAGRTTGSLCLGHSLAVPGRGLSAWQERQDPHGGKGLDAPGRGVGLARGRKESGDAPHFLDQGCPSESLGAGAPSGFDDAPSRWARSSIRNAHSIHQRSRKRLSQDAYRRNSVRFLQQRRRQARPGPQSPGSPLEEERQTQRSKPQPAVPPRPSADLILNRCSESTKRKLASAV

SEQ ID NO: 882023 - protein, 435 aa, Homo sapiens
DRDKSDFLFPVHLRRSLEVPGSTGGHPVMGDTFIRHIALLGFEKRFVPSQHYVYMFLVKWQDLSEKVVYRRFTEIYEFHKTLKEMFPIEAGAINPENRIIPHLPAPKWFDGQRAAENRQGTLTEYCSTLMSLPTKISRCPHLLDFFKVRPDDLKLPTDNQTKKPETYLMPKDGKSTATDITGPIILQTYRAIANYEKTSGSEMALSTGDVVEVVEKSESGQTSHLTGLLPLVLRNPQPQAPCQGSGSLAPGRTPALLGALNVLPTLWVAFCLSVHPVVAVGICAWQAGAGHVCVFCLDGVWDRLFIMKWAQSCDSVSMCACMHVTSLSSVVKVTFPNLSIGHQCVCVPVSSPSLMAAEEPLGPAPQSHSRTSGTGWWFCQMKAKRGWIPASFLEPLDSPDETEDPEPNYAATPPGAAGTAEPREPARGGAADAAL

SEQ ID NO: 882024 - protein, 377 aa, Homo sapiens
DRDKSDFLFPVHLRRSLEVPGSTGGHPVMGDTFIRHIALLGFEKRFVPSQHYVYMFLVKWQDLSEKVVYRRFTEIYEFHKTLKEMFPIEAGAINPENRIIPHLPAPKWFDGQRAAENRQGTLTEYCSTLMSLPTKISRCPHLLDFFKVRPDDLKLPTDNQTKKPETYLMPKDGKSTATDITGPIILQTYRAIANYEKTSGSEMALSTGDVVEVVEKSESGWWFCQMKAKRGWIPASFLEPLDSPDETEDPEPNYAGEPYVAIKAYTAVEGDEVSLLEGEAVEVIHKLLDGWWVIRKDDVTGYFPSMYLQKSGQDVSQAQRQIKRGAPPRRYSRGVPGEEERQTQRSKPQPAVPPRPSADLILNRCSESTKRKLASAV

SEQ ID NO: 882025 - protein, 348 aa, Homo sapiens
DRDKSDFLFPVHLRRSLEVPGSTGGHPVMGDTFIRHIALLGFEKRFVPSQHYVYMFLVKWQDLSEKVVYRRFTEIYEFHKTLKEMFPIEAGAINPENRIIPHLPAPKWFDGQRAAENRQGTLTEYCSTLMSLPTKISRCPHLLDFFKVRPDDLKLPTDNQTKKPETYLMPKDGKSTATDITGPIILQTYRAIANYEKTSGSEMALSTGDVVEVVEKSESGQTSHLTGLLPLVLRNPQPQAPCQGSGSLAPGRTPALLGALNVLPTLWVAFCLSVHPVVAVGICAWQAGAGHVCVFCLDGVWDRLFIMKWAQSCDSVSMCACMHVTSLSSVVKVTFPNLSRGRGVPARG

SEQ ID NO: 882026 - protein, 280 aa, Homo sapiens
DRDKSDFLFPVHLRRSLEVPGSTGGHPVMGDTFIRHIALLGFEKRFVPSQHYVYMFLVKWQDLSEKVVYRRFTEIYEFHKTLKEMFPIEAGAINPENRIIPHLPAPKWFDGQRAAENRQGTLTEYCSTLMSLPTKISRCPHLLDFFKVRPDDLKLPTDNQTKKPETYLMPKDGKSTATDITGPIILQTYRAIANYEKTSGSEMALSTGDVVEVVEKSESGWWFCQMKAKRGWIPASFLEPLDSPDETEDPEPNYAATPPGAAGTAEPREPARGGAADAAL

SEQ ID NO: 882027 - protein, 210 aa, Homo sapiens
MYLQKSGQDVSQAQRQIKRGAPPRRYSRGVPGAGRGRAGRTTGSLCLGHSLAVPGRGLSAWQERQDPHGGKGLDAPGRGVGLARGRKESGDAPHFLDQGCPSESLGAGAPSGFDDAPSRWARSSIRNAHSIHQRSRKRLSQDAYRRNSVRFLQQRRRQARPGPQSPGSPLEEERQTQRSKPQPAVPPRPSADLILNRCSESTKRKLASAV

SEQ ID NO: 882028 - protein, 225 aa, Homo sapiens
DRDKSDFLFPVHLRRSLEVPGSTGGHPVMGDTFIRHIALLGFEKRFVPSQHYVYMFLVKWQDLSEKVVYRRFTEIYEFHKTLKEMFPIEAGAINPENRIIPHLPAPKWFDGQRAAENRQGTLTEYCSTLMSLPTKISRCPHLLDFFKVRPDDLKLPTDNQTKKPETYLMPKDGKSTATDITGPIILQTYRAIANYEKTSGSEMALSTGDVVEVVEKSESGQTSQG

SEQ ID NO: 882029 - protein, 566 aa, Homo sapiens
MISKHLPENFQGLSGYPHPPRGPRLGARFPSQIQEPTSAARQHHCVGLVLVQLAPHLRFTPGQMSGGRRGHMQMAEEDAGSGGRRRPRGGHSSMGQSGRSRHQKRARAQAQLRNLEAYAANPHSFVFTRGCTGRNIRQLSLDVRRVMEPLTASRLQVRKKNSLKDCVAVAGPLGVTHFLILSKTETNVYFKLMRLPGGPTLTFQVKKYSLVRDVVSSLRRHRMHEQQFAHPPLLVLNSFGPHGMHVKLMATMFQNLFPSINVHKVNLNTIKRCLLIDYNPDSQELDFRHYSIKVVPVGASRGMKKLLQEKFPNMSRLQDISELLATGAGLSESEAEPDGDHNITELPQAVAGRGNMRAQQSAVRLTEIGPRMTLQLIKVQEGVGEGKVMFHSFVSKTEEELQAILEAKEKKLRLKAQRQAQQAQNVQRKQEQREAHRKKSLEGMKKARVGGSDEEASGIPSRTASLELGEDDDEQEDDDIEYFCQAVGEAPSEDLFPEAKQKRLAKSPGRKRKRWEMDRGRGRLCDQKFPKTKDKSQGAQARRGPRGASRDGGRGRGRGRPGKRVA

SEQ ID NO: 882030 - protein, 550 aa, Homo sapiens
GTLWGESGFLAATPWPSVSTWKQKDGAGLQRSRVLSGGHGEKRLWAAAGAKVRAEWGLDPHGALDGTDLKWSRQALLGLDFGEEASSGARCGGGVGWPLSVLPVDLELQDCLARLSWSIGAQCITLALSLNPVHIKEWSPVPLQGGERTRVQGSTPWQTWALGVAGAALWGNRAQLVTPSAHRCQVLPCQLLGSCRRQTQWVPGDFLWPILVVEFLVAVASNGLALYRFSIRKQRPWHPAVVFSVQLAVSDLLCALTLPPLAAYLYPPKHWRYGEAACRLERFLFTCNLLGSVIFITCISLNRYLGIVHPFFARSHLRPKHAWAVSAAGWVLAALLAMPTLSFSHLKRPQQGAGNCSVARPEACIKCLGTADHGLAAYRAYSLVLAGLGCGLPLLLTLAAYGALGRAVLRSPGMTVAEKLRVAALVASGVALYASSYVPYHIMRVLNVDARRRWSTRCPSFADIAQATAALELGPYVGYQVMRGLMPLAFCVHPLLYMAAVPSLGCCCRHCPGYRDSWNPEDAKSTGQALPLNATAAPKPSEPQSRELSQ

SEQ ID NO: 882031 - protein, 887 aa, Homo sapiens
MISKHLPENFQGLSGYPHPPRGPRLGARFPSQIQEPTSAARQHHCVGLVLVQLAPHLRFTPGQMSGGRRGHMQMAEEDAGSGGRRRPRGGHSSMGQSGRSRHQKRARAQAQLRNLEAYAANPHSFVFTRGCTGRNIRQLSLDVRRVMEPLTASRLQVRKKNSLKDCVAVAGPLGVTHFLILSKTETNVYFKLMRLPGGPTLTFQVKKYSLVRDVVSSLRRHRMHEQQFAHPPLLVLNSFGPHGMHVKLMATMFQNLFPSINVHKVNLNTIKRCLLIDYNPDSQELDFRHYSIKVVPVGASRGMKKLLQEKFPNMSRLQDISELLATGAGLSESEAEPDGDHNITELPQAVAGRGNMRAQQSAVRLTEIGPRMTLQLIKVQEGVGEGKVMFHSFVSKTEEELQAILEAKEKKLRLKAQRQAQQAQNVQRKQEQREAHRKKSLEGMKKARVGGSDEEASGIPSRTASLELGEDDDEQEDDDIEYFCQAVGEAPSEDLFPEAKQKRLAKSPGRKRKRWEMDRGAKSCPANFLAAADDKLSGFQGDFLWPILVVEFLVAVASNGLALYRFSIRKQRPWHPAVVFSVQLAVSDLLCALTLPPLAAYLYPPKHWRYGEAACRLERFLFTCNLLGSVIFITCISLNRYLGIVHPFFARSHLRPKHAWAVSAAGWVLAALLAMPTLSFSHLKRPQQGAGNCSVARPEACIKCLGTADHGLAAYRAYSLVLAGLGCGLPLLLTLAAYGALGRAVLRSPGMTVAEKLRVAALVASGVALYASSYVPYHIMRVLNVDARRRWSTRCPSFADIAQATAALELGPYVGYQVMRGLMPLAFCVHPLLYMAAVPSLGCCCRHCPGYRDSWNPEDAKSTGQALPLNATAAPKPSEPQSRELSQ

SEQ ID NO: 882032 - protein, 566 aa, Homo sapiens; identical to SEQ ID NO: 882029

SEQ ID NO: 882033 - protein, 103 aa, Homo sapiens
MKRPLGSLQGRRAWSWVRTMMNRKMMTSSISARRWARRPVRTCSPRPSRNGLPSLQGGSGSGGKWIEAGVAFVTRSFPRPRTSPREPRPGGGRGRGRPGKRVA

SEQ ID NO: 882034 - protein, 541 aa, Homo sapiens
MISKHLPENFQGLSGYPHPPRGPRLGARFPSQIQEPTSAARQHHCVGLVLVQLAPHLRFTPGQMSGGRRGHMQMAEEDAGSGGRRRPRGGHSSMGQSGRSRHQKRARAQAQLRNLEAYAANPHSFVFTRGCTGRNIRQLSLDVRRVMEPLTASRLQVRKKNSLKDCVAVAGPLGVTHFLILSKTETNVYFKLMRLPGGPTLTFQVKKYSLVRDVVSSLRRHRMHEQQFAHPPLLVLNSFGPHGMHVKLMATMFQNLFPSINVHKVNLNTIKRCLLIDYNPDSQELDFRHYSIKVVPVGASRGMKKLLQEKFPNMSRLQDISELLATGAGLSESEAEPDGDHNITELPQAVAGRGNMRAQQSAVRLTEIGPRMTLQLIKVQEGVGEGKVMFHSFVSKTEEELQAILEAKEKKLRLKAQRQAQQAQNVQRKQEQREAHRKKSLEGMKKARVGGSDEEASGIPSRTASLELDLFPEAKQKRLAKSPGRKRKRWEMDRGRGRLCDQKFPKTKDKSQGAQARRGPRGASRDGGRGRGRGRPGKRVA

SEQ ID NO: 882035 - protein, 541 aa, Homo sapiens; identical to SEQ ID NO: 882034

SEQ ID NO: 882036 - protein, 541 aa, Homo sapiens
MISKHLPENFQGLSGYPHPPRGPRLGARFPSQIQEPTSAARQHHCVGLVLVQLAPHLRFTPGQMSGGRRGHMQMAEEDAGSGGRRRPRGGHSSMGQSGRSRHQKRARAQAQLRNLEAYAANPHSFVFTRGCTGRNIRQLSLDVRRVMEPLTASRLQVRKKNSLKDCVAVAGPLGVTHFLILSKTETNVYFKLMRLPGGPTLTFQVKKYSLVRDVVSSLRRHRMHEQQFAHPPLLVLNSFGPHGMHVKLMATMFQNLFPSINVHKVNLNTIKRCLLIDYNPDSQELDFRHYSIKVVPVGASRGMKKLLQEKFPNMSRLQDISELLATGAGLSESEAEPDGDHNITELPQAVAGRGNMRAQQSAVRLTEIGPRMTLQLIKVQEGVGEGKVMFHSFVSKTEEELQAILEAKEKKLRLKAQRQAQQAQNVQRKQEQREAHRKKSLEGMKKARVGGSDEEASGIPSRTASLELGEDDDEQEDDDIEYFCQAVGEAPSEDLFPEAKQKRLAKSHRSSGWIERPRLGPEMWPSVSFHKGVVSPALPLQ

SEQ ID NO: 882037 - protein, 522 aa, Homo sapiens
MAKRTPEAADAGGLVEDTAAWDSQGGKGPAAWEAGGAGGVPAEVAALTLCLSSPQSRHQKRARAQAQLRNLEAYAANPHSFVFTRGCTGRNIRQLSLDVRRVMEPLTASRLQVRKKNSLKDCVAVAGPLGVTHFLILSKTETNVYFKLMRLPGGPTLTFQVKKYSLVRDVVSSLRRHRMHEQQFAHPPLLVLNSFGPHGMHVKLMATMFQNLFPSINVHKVNLNTIKRCLLIDYNPDSQELDFRHYSIKVVPVGASRGMKKLLQEKFPNMSRLQDISELLATGAGLSESEAEPDGDHNITELPQAVAGRGNMRAQQSAVRLTEIGPRMTLQLIKVQEGVGEGKVMFHSFVSKTEEELQAILEAKEKKLRLKAQRQAQQAQNVQRKQEQREAHRKKSLEGMKKARVGGSDEEASGIPSRTASLELGEDDDEQEDDDIEYFCQAVGEAPSEDLFPEAKQKRLAKSPGRKRKRWEMDRGRGRLCDQKFPKTKDKSQGAQARRGPRGASRDGGRGRGRGRPGKRVA

SEQ ID NO: 882038 - protein, 591 aa, Homo sapiens
MISKHLPENFQGLSGYPHPPRGPRLGARFPSQIQEPTSAARQHHCVGLVLVQLAPHLRFTPGQMSGGRRGHMQMAEEDAGSGGRRRPRGGHSSMGQSGRSRHQKRARAQAQLRNLEAYAANPHSFVFTRGCTGRNIRQLSLDVRRVMEPLTASRLQVRKKNSLKDCVAVAGPLGVTHFLILSKTETNVYFKLMRLPGGPTLTFQVKKYSLVRDVVSSLRRHRMHEQQFAHPPLLVLNSFGPHGMHVKLMATMFQNLFPSINVHKVNLNTIKRCLLIDYNPDSQELDFRHYSIKVVPVGASRGMKKLLQEKFPNMSRLQDISELLATGAGLSESEAEPDGDHNITELPQAVAGRGNMRAQQSAVRLTEVRPRAGGPPGSTSPNGGLTLLPRPQIGPRMTLQLIKVQEGVGEGKVMFHSFVSKTEEELQAILEAKEKKLRLKAQRQAQQAQNVQRKQEQREAHRKKSLEGMKKARVGGSDEEASGIPSRTASLELGEDDDEQEDDDIEYFCQAVGEAPSEDLFPEAKQKRLAKSPGRKRKRWEMDRGRGRLCDQKFPKTKDKSQGAQARRGPRGASRDGGRGRGRGRPGKRVA

SEQ ID NO: 882039 - protein, 253 aa, Homo sapiens
MSRLQDISELLATGAGLSESEAEPDGDHNITELPQAVAGRGNMRAQQSAVRLTEIGPRMTLQLIKVQEGVGEGKVMFHSFVSKTEEELQAILEAKEKKLRLKAQRQAQQAQNVQRKQEQREAHRKKSLEGMKKARVGGSDEEASGIPSRTASLELGEDDDEQEDDDIEYFCQAVGEAPSEDLFPEAKQKRLAKSPGRKRKRWEMDRGRGRLCDQKFPKTKDKSQGAQARRGPRGASRDGGRGRGRGRPGKRVA

SEQ ID NO: 882040 - protein, 228 aa, Homo sapiens
MSRLQDISELLATGAGLSESEAEPDGDHNITELPQAVAGRGNMRAQQSAVRLTEIGPRMTLQLIKVQEGVGEGKVMFHSFVSKTEEELQAILEAKEKKLRLKAQRQAQQAQNVQRKQEQREAHRKKSLEGMKKARVGGSDEEASGIPSRTASLELDLFPEAKQKRLAKSPGRKRKRWEMDRGRGRLCDQKFPKTKDKSQGAQARRGPRGASRDGGRGRGRGRPGKRVA

SEQ ID NO: 882041 - protein, 281 aa, Homo sapiens
LGTPARWTLSRPPTHFSGTDSLVEPAQQWYRELQLSTESKVTEFLHQSKLKSFESERVQLLQEETARNLTQCQLECEKYQKKLEVLTKEFYSLQASSEKRITELQAQNSEHQARLDIYEKLEKELDEIIMQTAEIENEDEAERVLFSYGYGANVPTTAKRRLKQSVHLARRVLQLEKQNSLILKDLEHRKDQVTQLSQELDRANSLLNQTQQPYRYLIESVRQRDSKIDSLTESIAQLEKDVSNLNKEKSALLQTKNQMALDLEQLLNHREVFFLFCHNCN

SEQ ID NO: 882042 - protein, 757 aa, Homo sapiens
MSRKISKESKKVNISSSLESEDISLETTVPTDDISSSEEREGKVRITRQLIERKELLHNIQLLKIELSQKTMMIDNLKVDYLTKIEELEEKLNDALHQKQLLTLRLDNQLAFQQKDASKYQELMKQEMETILLRQKQLEETNLQLREKAGDVRRNLRDFELTEEQYIKLKAFPEDQLSIPEYVSVRFYELVNPLRKEICELQVKKNILAEELSTNKNQLKQLTETYEEDRKNYSEVQIRCQRLALELADTKQLIQQGDYRQENYDKVKSERDALEQEVIELRRKHEILEASHMIQTKERSELSKEVVTLEQTVTLLQKDKEYLNRQNMELSVRCAHEEDRLERLQAQLEESKKAREEMYEKYVASRDHYKTEYENKLHDELEQIRLKTNQEIDQLRNASREMYERENRNLREARDNAVAEKERAVMAEKDALEKHDQLLDRYRELQLSTESKVTEFLHQSKLKSFESERVQLLQEETARNLTQCQLECEKYQKKLEVLTKEFYSLQASSEKRITELQAQNSEHQARLDIYEKLEKELDEIIMQTAEIENEDEAERVLFSYGYGANVPTTAKRRLKQSVHLARRVLQLEKQNSLILKDLEHRKDQVTQLSQELDRANSLLNQTQQPYRYLIESVRQRDSKIDSLTESIAQLEKDVSNLNKEKSALLQTKNQMALDLEQLLNHREELAAMKQILVKMHSKHSENSLLLTKTEPKHVTENQKSKTLNVPKEHEDNIFTPKPTLFTKKEAPEWSKKQKMKT

SEQ ID NO: 882043 - protein, 757 aa, Homo sapiens; identical to SEQ ID NO: 882042

SEQ ID NO: 882044 - protein, 757 aa, Homo sapiens; identical to SEQ ID NO: 882042

SEQ ID NO: 882045 - protein, 696 aa, Homo sapiens
MSRKISKESKKVNISSSLESEDISLETTVPTDDISSSEEREGKVRITRQLIERKELLHNIQLLKIELSQKTMMIDNLKVDYLTKIEELEEKLNDALHQKQLLTLRLDNQLAFQQKDASKYQELMKQEMETILLRQKQLEETNLQLREKAGDVRRNLRDFELTEEQYIKLKAFPEDQLSIPEYVSVRFYELVNPLRKEICELQVKKNILAEELSTNKNQLKQLTETYEEDRKNYSEVQIRCQRLALELADTKQLIQQGDYRQENYDKVKSERDALEQEVIELRRKHEILEASHMIQTKEEVNYQKRDHYKTEYENKLHDELEQIRLKTNQEIDQLRNASREMYERENRNLREARDNAVAEKERAVMAEKDALEKHDQLLDRYRELQLSTESKVTEFLHQSKLKSFESERVQLLQEETARNLTQCQLECEKYQKKLEVLTKEFYSLQASSEKRITELQAQNSEHQARLDIYEKLEKELDEIIMQTAEIENEDEAERVLFSYGYGANVPTTAKRRLKQSVHLARRVLQLEKQNSLILKDLEHRKDQVTQLSQELDRANSLLNQTQQPYRYLIESVRQRDSKIDSLTESIAQLEKDVSNLNKEKSALLQTKNQMALDLEQLLNHREELAAMKQILVKMHSKHSENSLLLTKTEPKHVTENQKSKTLNVPKEHEDNIFTPKPTLFTKKEAPEWSKKQKMKT

SEQ ID NO: 882046 - protein, 632 aa, Homo sapiens
MSRKISKESKKVNISSSLESEDISLETTVPTDDISSSEEREGKVRITRQLIERKELLHNIQLLKIELSQKTMMIDNLKVDYLTKIEELEEKLNDALHQKQLLTLRLDNQLAFQQKDASKYQELMKQEMETILLRQKQLEETNLQLREKAGDVRRNLRDFELTEEQYIKLKAFPEDQLSIPEYVSVRFYELVNPLRKEICELQVKKNILAEELSTNKNQLKQLTETYEEDRKNYSEVQIRCQRLALELADTKQLIQQGDYRQENYDKVKSERDALEQEVIELRRKHEILEASHMIQTKERSELSKEVVTLEQTVTLLQKDKEYLNRQNMELSVRCAHEEDRLERLQAQLEESKKAREEMYEKYVASRDHYKTEYENKLHDELEQIRLKTNQEIDQLRNASREMYERENRNLREARDNAVAEKERAVMAEKDALEKHDQLLDRYRELQLSTESKVTEFLHQSKLKSFESERVQLLQEETARNLTQCQLECEKYQKKLEVLTKEFYSLQASSEKRITELQAQNSEHQARLDIYEKLEKELDEIIMQTAEIENEDEAERVLFSYGYGANVPTTAKRRLKQSVHLARRVLQLEKQNSLILKDLEHRKDQVTQLSQELDRANSLLNQTQQPYRYLIEF

SEQ ID NO: 882047 - protein, 655 aa, Homo sapiens
MSRKISKESKKVNISSSLESEDISLETTVPTDDISSSEEREGKVRITRQLIERKELLHNIQLLKIELSQKTMMIDNLKVDYLTKIEELEEKLNDALHQKQLLTLRLDNQLAFQQKDASKYQELMKQEMETILLRQKQLEETNLQLREKAGDVRRNLRDFELTEEQYIKLKAFPEDQLSIPEYVSVRFYELVNPLRKEICELQVKKNILAEELSTNKNQLKQLTETYEEDRKNYSEVQIRCQRLALELADTKQLIQQGDYRQENYDKVKSERDALEQEVIELRRKHEILEASHMIQTKERSELSKEVVTLEQTVTLLQKDKEYLNRQNMELSVRCAHEEDRLERLQAQLEESKKAREEMYEKYVASRDHYKTEYENKLHDELEQIRLKTNQEIDQLRNASREMYERENRNLREARDNAVAEKERAVMAEKDALEKHDQLLDRYRELQLSTESKVTEFLHQSKLKSFESERVQLLQEETARNLTQCQLECEKYQKKLEVLTKEFYSLQASSEKRITELQAQNSEHQARLDIYEKLEKELDEIIMQTAEIENEDEAERVLFSYGYGANVPTTAKRRLKQSVHLARRVLQLEKQNSLILKDLEHRKDQVTQLSQELDRANSLLNQTQQPYRYLIESVRQRDSKIDSLTESIAQLEKDVR

SEQ ID NO: 882048 - protein, 634 aa, Homo sapiens
MKQEMETILLRQKQLEETNLQLREKAGDVRRNLRDFELTEEQYIKLKAFPEDQLSIPEYVSVRFYELVNPLRKEICELQVKKNILAEELSTNKNQLKQLTETYEEDRKNYSEVQIRCQRLALELADTKQLIQQGDYRQENYDKVKSERDALEQEVIELRRKHEILEASHMIQTKERSELSKEVVTLEQTVTLLQKDKEYLNRQNMELSVRCAHEEDRLERLQAQLEESKKAREEMYEKYVASRDHYKTEYENKLHDELEQIRLKTNQEIDQLRNASREMYERENRNLREARDNAVAEKERAVMAEKDALEKHDQLLDRYRELQLSTESKVTEFLHQSKLKSFESERVQLLQEETARNLTQCQLECEKYQKKLEVLTKEFYSLQASSEKRITELQAQNSEHQARLDIYEKLEKELDEIIMQTAEIENEDEAERVLFSYGYGANVPTTAKRRLKQSVHLARRVLQLEKQNSLILKDLEHRKDQVTQLSQELDRANSLLNQTQQPYRYLIESVRQRDSKIDSLTESIAQLEKDVSNLNKEKSALLQTKNQMALDLEQLLNHREELAAMKQILVKMHSKHSENSLLLTKTEPKHVTENQKSKTLNVPKEHEDNIFTPKPTLFTKKEAPEWSKKQKMKT

SEQ ID NO: 882049 - protein, 558 aa, Homo sapiens
MSRKISKESKKVNISSSLESEDISLETTVPTDDISSSEEREGKVRITRQLIERKELLHNIQLLKIELSQKTMMIDNLKVDYLTKIEELEEKLNDALHQKQLLTLRLDNQLAFQQKDASKYQELMKQEMETILLRQKQLEETNLQLREKAGDVRRNLRDFELTEEQYIKLKAFPEDQLSIPEYVSVRFYELVNPLRKEICELQVKKNILAEELSTNKNQLKQLTETYEEDRKNYSEVQIRCQRLALELADTKQLIQQGDYRQENYDKVKSERDALEQEVIELRRKHEILEASHMIQTKERSELSKEVVTLEQTVTLLQKDKEYLNRQNMELSVRCAHEEDRLERLQAQLEESKKAREEMYEKYVASRDHYKTEYENKLHDELEQIRLKTNQEIDQLRNASREMYERENRNLREARDNAVAEKERAVMAEKDALEKHDQLLDRYRELQLSTESKVTEFLHQSKLKSFESERVQLLQEETARNLTQCQLECEKYQKKLEVLTKEFYSLQASSEKRITELQAQNSEHQARLDIYEKLGSFSTVAKFINAKDTKEVYLAESVN

SEQ ID NO: 882050 - protein, 533 aa, Homo sapiens
MSRKISKESKKVNISSSLESEDISLETTVPTDDISSSEEREGKVRITRQLIERKELLHNIQLLKIELSQKTMMIDNLKVDYLTKIEELEEKLNDALHQKQLLTLRLDNQLAFQQKDASKYQELMKQEMETILLRQKQLEETNLQLREKAGDVRRNLRDFELTEEQYIKLKAFPEDQLSIPEYVSVRFYELVNPLRKEICELQVKKNILAEELSTNKNQLKQLTETYEEDRKNYSEVQIRCQRLALELADTKQLIQQGDYRQENYDKVKSERDALEQEVIELRRKHEILEASHMIQTKERSELSKEVVTLEQTVTLLQKDKEYLNRQNMELSVRCAHEEDRLERLQAQLEESKKAREEMYEKYVASRDHYKTEYENKLHDELEQIRLKTNQEIDQLRNASREMYERENRNLREARDNAVAEKERAVMAEKDALEKHDQLLDRYRELQLSTESKVTEFLHQSKLKSFESERVQLLQEETARNLTQCQLECEKYQKKLEVHVQAFLSTLAWHVNSLSTRFILSFISPIGCITILHK

SEQ ID NO: 882051 - protein, 216 aa, Homo sapiens
MQTAEIENEDEAERVLFSYGYGANVPTTAKRRLKQSVHLARRVLQLEKQNSLILKDLEHRKDQVTQLSQELDRANSLLNQTQQPYRYLIESVRQRDSKIDSLTESIAQLEKDVSNLNKEKSALLQTKNQMALDLEQLLNHREELAAMKQILVKMHSKHSENSLLLTKTEPKHVTENQKSKTLNVPKEHEDNIFTPKPTLFTKKEAPEWSKKQKMKT

SEQ ID NO: 882052 - protein, 204 aa, Homo sapiens
MLWARGGTPGRWAGVLGPRRPGPALPCAARSPWWAPRRGGGCGRWQRWPWSWRWPRGCPQPGPGSTPRPAERGPPVRLFTEEELARYGGEEEDQPIYLAVKGVVFDVTSGKEFYGRGAPYNALTGKDSTRGVAKMSLDPADLTHDTTGLTAKELEALDEVFTKVYKAKYPIVGYTARRILNEDGSPNLDFKPEDQPHFDIKDEF

SEQ ID NO: 882053 - protein, 152 aa, Homo sapiens
MVGPAPRRRLRPLAALALVLALAPGLPTARAGQYTAPCRAGAPSAAFHRGGAGPLWRGGEFYGRGAPYNALTGKDSTRGVAKMSLDPADLTHDTTGLTAKELEALDEVFTKVYKAKYPIVGYTARRILNEDGSPNLDFKPEDQPHFDIKDEF

SEQ ID NO: 882054 - protein, 105 aa, Homo sapiens
MALGAGRDSGTLGGRARAPPPWPGLALRCALTMVGPAPRRRLRPLAALALVLALAPGLPTARAGQYTAPCRAGAPSAAFHRGGAGPLWRGGGRSAHLLGSEGSGV

SEQ ID NO: 882055 - protein, 204 aa, Homo sapiens; identical to SEQ ID NO: 882052

SEQ ID NO: 882056 - protein, 152 aa, Homo sapiens; identical to SEQ ID NO: 882053

SEQ ID NO: 882057 - protein, 152 aa, Homo sapiens; identical to SEQ ID NO: 882053

SEQ ID NO: 882058 - protein, 126 aa, Homo sapiens
MRLSRGEWTHRREEDQPIYLAVKGVVFDVTSGKEFYGRGAPYNALTGKDSTRGVAKMSLDPADLTHDTTGLTAKELEALDEVFTKVYKAKYPIVGYTARRILNEDGSPNLDFKPEDQPHFDIKDEF

SEQ ID NO: 882059 - protein, 121 aa, Homo sapiens
MLWARGGTPGRWAGVLGPRRPGPALPCAARSPWWAPRRGGGCGRWQRWPWSWRWPRGCPQPGPGSTPRPAERGPPVRLFTEEELARYGGEETARRILNEDGSPNLDFKPEDQPHFDIKDEF

SEQ ID NO: 882060 - protein, 204 aa, Homo sapiens; identical to SEQ ID NO: 882052

SEQ ID NO: 882061 - protein, 204 aa, Homo sapiens; identical to SEQ ID NO: 882052

SEQ ID NO: 882062 - protein, 179 aa, Homo sapiens
MVGPAPRRRLRPLAALALVLALAPGLPTARAGQYTAPCRAGAPSAAFHRGGAGPLWRGGASPLLSEEDQPIYLAVKGVVFDVTSGKEFYGRGAPYNALTGKDSTRGVAKMSLDPADLTHDTTGLTAKELEALDEVFTKVYKAKYPIVGYTARRILNEDGSPNLDFKPEDQPHFDIKDEF

SEQ ID NO: 882063 - protein, 126 aa, Homo sapiens; identical to SEQ ID NO: 882058

SEQ ID NO: 882064 - protein, 119 aa, Homo sapiens
LRYSSRISTSALLAVKGVVFDVTSGKEFYGRGAPYNALTGKDSTRGVAKMSLDPADLTHDTTGLTAKELEALDEVFTKVYKAKYPIVGYTARRILNEDGSPNLDFKPEDQPHFDIKDEF

SEQ ID NO: 882065 - protein, 645 aa, Homo sapiens
GSSLEVGWRGRRHRVLTLSPLPQLHQVLVQLQAGEKEQDLASAPIQVSISVQLWRLPGCHEFLAALGFDLCEVGQEEVILKTGKQANRRTVHFALQSLLSLFDSTELPKRLSLDSSSSLESLASAQSVSNALPLGYQQPPFSPTGADSIASDAISVYSLSSIASSMSFVSKPEGGSEGGGPGGRQDHDRSKNAYLQRSTLPRSQLPPQTRPAGNKDEEEYEGFSIISNEPLATYQENRNTCFSPDHKQPQPGTAGGMRVSVSSKGSISTPNSPVKMTLIPSPNSPFQKVGKLASSDTGESDQSSTETDSTVKSQEESNPKLDPQELAQKILEETQSHLIAVERLQRSGGQVSKSNNPEDGVQAPSSTAVFRASETSAFSRPVLSHQKSQPSPVTVKPKPPARSSSLPKVSSGYSSPTTSEMSIKDSPSQHSGRPSPGCDSQTSQLDQPLFKLKYPSSPYSAHISKSPRNMSPSSGHQSPAGSAPSPALSYSSAGSARSSPADAPDIDKLKMAAIDEKVQAVHNLKMFWQSTPQHSTGPMKIFRGAPGTMTSKRDVLSLLNLSPRHNKKEEGVDKLELKELSLQQHDGAPPKAPPNGHWRTETTSLGSLPLPAGPPATAPARPLRLPSGNGYKFLSPGRFFPSSKC

SEQ ID NO: 882066 - protein, 1699 aa, Homo sapiens
VYQELSDLPGECRAHGHLAAVYMALGKYTMAFKCYEEQLDLGQKLKDPSLEAQVYGNMGITKMNMNVMEEAIGYFEQQLAMLQQLSGNESVLDRGRAYGNLGDCYEALGDYEEAIKYYEQYLSVAQSLNRMQDQAKAYRGLGNGHRAMGSLQQALVCFEKRLVVAHELGEAFNKAQAYGELGSLHSQLGNYEQAISCLERQLNIARDMKDRALESDAACGLGGVYQQMGEYDTALQYHQLDLQIAEETNNPTCQGRAYGNLGLTYESLGTFERAVVYQEQHLSIAAQMNDLAAKTVSYSSLGRTHHALQNYSQAVMYLQEGLRLAEQLGRREDEAKIRHGLGLSLWASGNLEEAQHQLYRASALFETIRHEAQLSTDYKLSLFDLQTSSYQALQRVLVSLGHHDEALAVAERGRTRAFADLLVERQTGQQDSDPYSPVTIDQILEMVNGQRGLVLYYSLAAGYLYSWLLAPGAGIVKFHEHYLGENTVENSSDFQASSSVTLPTATGSALEQHIASVREALGVESHYSRACASSETESEAGDIMDQQFEEMNNKLNSVTDPTGFLRMVRRNNLFNRSCQSMTSLFSNTVSPTQDGTSSLPRRQSSFAKPPLRALYDLLIAPMEGGLMHSSGPVGRHRQLILVLEGELYLIPFALLKGSSSNEYLYERFGLLAVPSIRSLSVQSKSHLRKNPPTYSSSTSMAAVIGNPKLPSAVMDRWLWGPMPSAEEEAYMVSELLGCQPLVGSVATKERVMSALTQAECVHFATHISWKLSALVLTPSMDGNPASSKSSFGHPYTIPESLRVQDDASDGESISDCPPLQELLLTAADVLDLQLPVKLVVLGSSQESNSKVTADGVIALTRAFLAAGAQCVLVSLWPVPVAASKMFIHAFYSSLLNGLKASAALGEAMKVVQSSKAFSHPSNWAGFMLIGSDVKLNSPSSLIGQALTEILQHPERARDALRVLLHLVEKSLQRIQNGQRNAMYTSQQSVENKVGGIPGWQALLTAVGFRLDPPTSGLPAAVFFPTSDPGDRLQQCSSTLQSLLGLPNPALQALCKLITASETGEQLISRAVKNMVGMLHQVLVQLQAGEKEQDLASAPIQVSISVQLWRLPGCHEFLAALGFDLCEVGQEEVILKTGKQANRRTVHFALQSLLSLFDSTELPKRLSLDSSSSLESLASAQSVSNALPLGYQQPPFSPTGADSIASDAISVYSLSSIASSMSFVSKPEGGSEGGGPGGRQDHDRSKNAYLQRSTLPRSQLPPQTRPAGNKDEEEYEGFSIISNEPLATYQENRNTCFSPDHKQPQPGTAGGMRVSVSSKGSISTPNSPVKMTLIPSPNSPFQKVGKLASSDTGESDQSSTETDSTVKSQEESNPKLDPQELAQKILEETQSHLIAVERLQRSGGQVSKSNNPEDGVQAPSSTAVFRASETSAFSRPVLSHQKSQPSPVTVKPKPPARSSSLPKVSSGYSSPTTSEMSIKDSPSQHSGRPSPGCDSQTSQLDQPLFKLKYPSSPYSAHISKSPRNMSPSSGHQSPAGSAPSPALSYSSAGSARSSPADAPDIDKLKMAAIDEKVQAVHNLKMFWQSTPQHSTGPMKIFRGAPGTMTSKRDVLSLLNLSPRHNKKEEGVDKLELKELSLQQHDGAPPKAPPNGHWRTETTSLGSLPLPAGPPATAPARPLRLPSGNGYKFLSPGRFFPSSKC

SEQ ID NO: 882067 - protein, 618 aa, Homo sapiens
VYQELSDLPGECRAHGHLAAVYMALGKYTMAFKCYEEQLDLGQKLKDPSLEAQVYGNMGITKMNMNVMEEAIGYFEQQLAMLQQLSGNESVLDRGRAYGNLGDCYEALGDYEEAIKYYEQYLSVAQSLNRMQDQAKAYRGLGNGHRAMGSLQQALVCFEKRLVVAHELGEAFNKAQAYGELGSLHSQLGNYEQAISCLERQLNIARDMKDRALESDAACGLGGVYQQMGEYDTALQYHQLDLQIAEETNNPTCQGRAYGNLGLTYESLGTFERAVVYQEQHLSIAAQMNDLAAKTVSYSSLGRTHHALQNYSQAVMYLQEGLRLAEQLGRREDEAKIRHGLGLSLWASGNLEEAQHQLYRASALFETIRHEAQLSTDYKLSLFDLQTSSYQALQRVLVSLGHHDEALAVAERGRTRAFADLLVERQTGQQDSDPYSPVTIDQILEMVNGQRGLVLYYSLAAGYLYSWLLAPGAGIVKFHEHYLGENTVENSSDFQASSSVTLPTATGSALEQHIASVREALGVESHYSRACASSETESEAGDIMDQQFEEMNNKLNSVTDPTGFLRMVRRNNLFNRDATRFAEAWDWAWTHVLALPTSQPVKAGDTYLHQVMQAVVIN

SEQ ID NO: 882068 - protein, 521 aa, Homo sapiens
MNSSTPSTANGNDSKKFKRDRPPCSPSRVLHLRKIPCDVTEAEIISLGLPFGKVTNLLMLKGKSQAFLEMASEEAAVTMVNYYTPITPHLRSQPVYIQYSNHRELKTDNLPNQARAQAALQAVSAVQSGSLALSGGPSNEGTVLPGQSPVLRIIIENLFYPVTLEVLHQIFSKFGTVLKIITFTKNNQFQALLQYADPVNAHYAKMALDGQNIYNACCTLRIDFSKLTSLNVKYNNDKSRDFTRLDLPTGDGQPSLEPPMAAAFGAPGIISSPYAGAAGFAPAIGFPQATGLSVPAVPGALGPLTITSSAVTGRMAIPGASGIPGNSVLLVTNLNPDLITPHGLFILFGVYGDVHRVKIMFNKKENALVQMADANQAQLAMNHLSGQRLYGKVLRATLSKHQAVQLPREGQEDQGLTKDFSNSPLHRFKKPGSKNFQNIFPPSATLHLSNIPPSVTVDDLKNLFIEAGCSVKAFKFFQKDRKMALIQLGSVEEAIQALIELHNHDLGENHHLRVSFSKSTI

SEQ ID NO: 882069 - protein, 521 aa, Homo sapiens; identical to SEQ ID NO: 882068

SEQ ID NO: 882070 - protein, 521 aa, Homo sapiens; identical to SEQ ID NO: 882068

SEQ ID NO: 882071 - protein, 521 aa, Homo sapiens; identical to SEQ ID NO: 882068

SEQ ID NO: 882072 - protein, 521 aa, Homo sapiens; identical to SEQ ID NO: 882068

SEQ ID NO: 882073 - protein, 521 aa, Homo sapiens; identical to SEQ ID NO: 882068

SEQ ID NO: 882074 - protein, 594 aa, Homo sapiens
PVPTLLPPRTGRGSAEPKLACPRNRPAAAACFLCSRLARQSLLCARLHLGHGWRGSDELLSSGIINGPFTMNSSTPSTGVYANGNDSKKFKRDRPPCSPSRVLHLRKIPCDVTEAEIISLGLPFGKVTNLLMLKGKSQAFLEMASEEAAVTMVNYYTPITPHLRSQPVYIQYSNHRELKTDNLPNQARAQAALQAVSAVQSGSLALSGGPSNEGTVLPGQSPVLRIIIENLFYPVTLEVLHQIFSKFGTVLKIITFTKNNQFQALLQYADPVNAHYAKMALDGQNIYNACCTLRIDFSKLTSLNVKYNNDKSRDFTRLDLPTGDGQPSLEPPMAAAFGAPGIISSPYAGAAGFAPAIGFPQATGLSVPAVPGALGPLTITSSAVTGRMAIPGASGIPGNSVLLVTNLNPDLITPHGLFILFGVYGDVHRVKIMFNKKENALVQMADANQAQLAMNHLSGQRLYGKVLRATLSKHQAVQLPREGQEDQGLTKDFSNSPLHRFKKPGSKNFQNIFPPSATLHLSNIPPSVTVDDLKNLFIEAGCSVKAFKFFQKDRKMALIQLGSVEEAIQALIELHNHDLGENHHLRVSFSKSTI

SEQ ID NO: 882075 - protein, 235 aa, Homo sapiens
MAFLEMASEEAAVTMVNYYTPITPHLRSQPVYIQYSNHRELKTDNLPNQARAQAALQAVSAVQSGSLALSGGPSNEGTVLPGQSPVLRIIIENLFYPVTLEVLHQIFSKFGTVLKIITFTKNNQFQALLQYADPVNAHYAKMALDGQNIYNACCTLRIDFSKLTSLNVKYNNDKSRDFTRLDLPTGDGQPSLEPPMAAAFGAPGIISSPYAGAAGFAPAIGFPQATGDSFKLDLK

SEQ ID NO: 882076 - protein, 205 aa, Homo sapiens
PVPTLLPPRTGRGSAEPKLACPRNRPAAAACFLCSRLARQSLLCARLHLGHGWRGSDELLSSGIINGPFTMNSSTPSTGVYANGNDSKKFKRDRPPCSPSRVLHLRKIPCDVTEAEIISLGLPFGKVTNLLMLKGKSQAFLEMASEEAAVTMVNYYTPITPHLRSQPVYIQYSNHRELKTDNLPNQARCGHAPFPSPTSQPRTQR

SEQ ID NO: 882077 - protein, 87 aa, Homo sapiens
ERSRARATAHSPCARRSPKLATAGSGGDSGDRELRPGRAGASAAESAPEGHGDRVLLCCPGWNAVAQSWLTAASTFQGLSDPLTSSS

SEQ ID NO: 882078 - protein, 80 aa, Homo sapiens
PSAAGRAPPPTRPVPAAARNWPRPGAEGTAGIVSSGPGERVRLPQSRHLKDMERPSATLEGQSCMALDSAPWTVGNSERC

SEQ ID NO: 882079 - protein, 108 aa, Homo sapiens
PSAAGRAPPPTRPVPAAARNWPRPGAEGTAGIVSSGPGERVRLPQSRHLKDMEGINLLVGQWLLLKFLCPNAWKTKNNKNETNKQKNNMQLLVKKVKRKSRGQGSDHS

SEQ ID NO: 882080 - protein, 467 aa, Homo sapiens
PSAAGRAPPPTRPVPAAARNWPRPGAEGTAGIVSSGPGERVRLPQSRHLKDMEERPAETNANVDNSASPSVAQLAGRFREQAAAAKETPASKPTRRKPPCSLPLFPPKVDLGQNGEEKSPPNASHPPKFKVKSSPLIEKLQANLTFDPAALLPGASPKSPGLKAMVSPFHSPPSTPSSPGVRSRPSEAEEVPVSFDQPPEGSHLPCYNKVRTRGSIKRRPPSRRFRRSQSDCGELGDFRAVESSQQNGAKEEDGDEVLPSKSKAPGSPLSSEGAAGEGVRTLGPAEKPPLRRSPSRTEKQEEDRATEEAKNGEKARRSSEEVDGQHPAQEEVPESPQTSGPEAENRCGSPREEKPAGEEAEMEKATEVKGERVQNEEVGPEHDSQETKKLEEGAAVKETPHSPPGGVKGGDVPKQEKGKEKQQEGAVLEPGCSPQTGPAQLETSSEVQSEPAVPKPEDDTPVQDTKM

SEQ ID NO: 882081 - protein, 467 aa, Homo sapiens; identical to SEQ ID NO: 882080

SEQ ID NO: 882082 - protein, 467 aa, Homo sapiens; identical to SEQ ID NO: 882080

SEQ ID NO: 882083 - protein, 80 aa, Homo sapiens; identical to SEQ ID NO: 882078

SEQ ID NO: 882084 - protein, 133 aa, Homo sapiens
GGFLPEGGTRAGRWGAGARVRGGAGGMASGAARWLVLAPVRSGALRSGPSLRKDGDVSAAWSGSGRSLVPSRSVIVTRSGAILPKPVKMSFGLLRVFSIVIPFLYVGTLISKNFAALLEEHDIFVPEDDDDDD

SEQ ID NO: 882085 - protein, 133 aa, Homo sapiens; identical to SEQ ID NO: 882084

SEQ ID NO: 882086 - protein, 83 aa, Homo sapiens
GGFLPEGGTRAGRWGAGARVRGGAGGMASGAARWLVLAPVRSGALRSGPSLRKDGDVSAAWSGSGRSLVPSRCPSAFSVCSPL

SEQ ID NO: 882087 - protein, 97 aa, Homo sapiens
GGFLPEGGTRAGRWGAGARVRGGAGGMASGAARWLVLAPVRSGALRSGPSLRKDGDVSAAWSGSGRSLVPSRSVIVTRSGAILPKPVKELQKGESTN

SEQ ID NO: 882088 - protein, 133 aa, Homo sapiens; identical to SEQ ID NO: 882084

SEQ ID NO: 882089 - protein, 111 aa, Homo sapiens; identical to SEQ ID NO: 880207

SEQ ID NO: 882090 - protein, 111 aa, Homo sapiens; identical to SEQ ID NO: 880207

SEQ ID NO: 882091 - protein, 111 aa, Homo sapiens; identical to SEQ ID NO: 880207

SEQ ID NO: 882092 - protein, 102 aa, Homo sapiens
MADWARAQSPGAVEEILDRENKRMADSLASKVTRLKSLALDIDRDAEDQNRYLDGMVRAHGVRVSVPCPSTTCCRACSVSFSTGAGGWSNHHFCVILLGFLP

SEQ ID NO: 882093 - protein, 144 aa, Homo sapiens
RTDVATFMRLASVPGDRDVLQLDVTPGGSVTDVRDWVSGAQSPGAVEEILDRENKRMADSLASKVTRLKSLALDIDRDAEDQNRYLDGMDSDFTSMTSLLTGSVKRFSTMARSGQDNRKLLCGMAVGLIVAFFILSYFLSRART

SEQ ID NO: 882094 - protein, 171 aa, Homo sapiens
MPAAPLCSPFPSPPPSFHTASLPFSIHAHHSPLPCDLDPPLYLAETVSLLEEWGPPSSCPMQCKLTSHPARLTHLPPCLWGFAVALKPSWAGLAPSLLPPPRMSLCRPLSFLRHQCPWLPWQAHQGLVPWSPSMVAAACIVSPSGHCRCQPFIPHVFLGHGGLTSVSGECG

SEQ ID NO: 882095 - protein, 111 aa, Homo sapiens; identical to SEQ ID NO: 880207

SEQ ID NO: 882096 - protein, 111 aa, Homo sapiens; identical to SEQ ID NO: 880207

SEQ ID NO: 882097 - protein, 111 aa, Homo sapiens; identical to SEQ ID NO: 880207

SEQ ID NO: 882098 - protein, 111 aa, Homo sapiens; identical to SEQ ID NO: 880207

SEQ ID NO: 882099 - protein, 171 aa, Homo sapiens; identical to SEQ ID NO: 882094

SEQ ID NO: 882100 - protein, 111 aa, Homo sapiens; identical to SEQ ID NO: 880207

SEQ ID NO: 882101 - protein, 111 aa, Homo sapiens; identical to SEQ ID NO: 880207

SEQ ID NO: 882102 - protein, 111 aa, Homo sapiens; identical to SEQ ID NO: 880207

SEQ ID NO: 882103 - protein, 111 aa, Homo sapiens; identical to SEQ ID NO: 880207

SEQ ID NO: 882104 - protein, 106 aa, Homo sapiens
MVEAGANRPRARLRGCGGCGRVGVRVEEPGQGTMADWARAQSPGAVEEILDRENKRMADSLASKVTRLKSLALDIDRDAEDQNRYLDGMVQVMVLPVCLLRSPVLK

SEQ ID NO: 882105 - protein, 385 aa, Homo sapiens
MSGDSSGRGPEGRGRGRDPHRDRTRSRSRSRSPLSPRSRRGSARERREAPERPSLEDTEPSDSGDEMMDPASLEAEADQGLCRQIRHQYRALINSVQQNREDILNAGDKLTEVLEEANTLFNEVSRAREAVLDAHFLVLASDLGKEKAKQLRSDLSSFDMLRYVETLLTHMGVNPLEAEELIRDEDSPDFEFIVYDSWKITGRTAENTFNKTHTFHFLLGSIYGECPVPKPRVDRPRKVPVIQEERAMPAQLRRMEESHQEATEKEVERILGLLQTYFREDPDTPMSFFDFVVDPHSFPRTVENIFHVSFIIRDGFARIRLDQDRLPVIEPVSINEENEGFEHNTQVRNQGIIALSYRDWEEIVKTFEISEPVITPSQRQQKPSA

SEQ ID NO: 882106 - protein, 218 aa, Homo sapiens
MSGDSSGRGPEGRGRGRDPHRDRTRSRSRSRSPLSPRSRRGSARERREAPERPSLEDTEPSDSGDEMMDPASLEAEADQGLCRQIRHQYRALINSVQQNREDILNAGDKLTEVLEEANTLFNEVSRAREAVLDAHFLVLASDLGKEKAKQLRSDLSSFDMLRYVETLLTHMGVNPLEAEELIRDEDSPDFEFIVYDSWKITGRTAENTFNKTHTFHFL

SEQ ID NO: 882107 - protein, 316 aa, Homo sapiens
MSGDSSGRGPEGRGRGRDPHRDRTRSRSRSRSPLSPRSRRGSARERREAPERPSLEDTEPSDSGDEMMDPASLEAEADQGLCRQIRHQYRALINSVQQNREDILNAGDKLTEVLEEANTLFNEVSRAREAVLDAHFLVLASDLGKEKAKQLRSDLSSFDMLRYVETLLTHMGVNPLEAEELIRDEDSPDFEFIVYDSWKITGRTAENTFNKTHTFHFLLGSIYGECPVPKPRVDRPRKVPVIQEERAMPAQLRRMEESHQEATEKEVERILGLLQTYFREDRDSLTLSPRLECSGTISTHCNLHLLDSSNSPASAS

SEQ ID NO: 882108 - protein, 331 aa, Homo sapiens [sequence omitted]

SEQ ID NO: 882109 - protein, 331 aa, Homo sapiens [sequence omitted]

SEQ ID NO: 882110 - protein, 331 aa, Homo sapiens [sequence omitted]

SEQ ID NO: 882111 - protein, 385 aa, Homo sapiens; identical to SEQ ID NO: 882105

SEQ ID NO: 882112 - protein, 331 aa, Homo sapiens [sequence omitted]

SEQ ID NO: 882113 - protein, 385 aa, Homo sapiens; identical to SEQ ID NO: 882105

SEQ ID NO: 882114 - protein, 335 aa, Homo sapiens
MSGDSSGRGPEGRGRGRDPHRDRTRSRSRSRSPLSPRSRRGSARERREAPERPSLEDTEPSDSGDEMMDPASLEAEADQGLCRQIRHQYRALINSVQQNREDILNAGDKLTEVLEEANTLFNEVSRAREAVLDAHFLVLASDLGKEKAKQLRSDLSSFDMLRYVETLLTHMGVNPLEAEELIRDEDSPDFEFIVYDSWKITGRTAENTFNKTHTFHFLLGSIYGECPVPKPRVDRPRKVPVIQEERAMPAQLRRMEESHQEATEKEVERILGLLQTYFREDPDTPMSFFDFVVDPHSFPRTVENIFHVSFIIRDGFARIRLDQDRLPVIGDCEDL

SEQ ID NO: 882115 - protein, 172 aa, Homo sapiens [sequence omitted]

SEQ ID NO: 882116 - protein, 226 aa, Homo sapiens
MLRYVETLLTHMGVNPLEAEELIRDEDSPDFEFIVYDSWKITGRTAENTFNKTHTFHFLLGSIYGECPVPKPRVDRPRKVPVIQEERAMPAQLRRMEESHQEATEKEVERILGLLQTYFREDPDTPMSFFDFVVDPHSFPRTVENIFHVSFIIRDGFARIRLDQDRLPVIEPVSINEENEGFEHNTQVRNQGIIALSYRDWEEIVKTFEISEPVITPSQRQQKPSA

SEQ ID NO: 882117 - protein, 172 aa, Homo sapiens [sequence omitted]

SEQ ID NO: 882118 - protein, 499 aa, Homo sapiens
MSGDSSGRGPEGRGRGRDPHRDRTRSRSRSRSPLSPRSRRGSARERREAPERPSLEDTEPSDSGDEMMDPASLEAEADQGLCRQIRHQYRALINSVQRKAAPPGGAGPDGPLSPPLRRARGEGTGGRCRAEARRGVSRDAPGASPSPHLKLLTKCSHFVAGAVRPWRGSPSGGLEKLEARAVRGLARAQPASGERQDADSACFDCARQSSAWAPGLAAAAAAAAARESCQMHVLGPHPDPRNSNLWVGPRNCGVALQVMFVFLKIENREDILNAGDKLTEVLEEANTLFNEVSRAREAVLDAHFLVLASDLGKEKAKQLRSDLSSFDMLRYVETLLTHMGVNPLEAEELIRDEDSPDFEFIVYDSWKITGRTAENTFNKTHTFHFLLGSIYGECPVPKPRVDRPRKVPVIQEERAMPAQLRRMEESHQEATEKEVERILGLLQTYFREDPDTPMSFFDFVVDPHSFPRTVENIFHVSFIIRDGFARIRLDQDRLPVIGK

SEQ ID NO: 882119 - protein, 172 aa, Homo sapiens [sequence omitted]

SEQ ID NO: 882120 - protein, 248 aa, Homo sapiens
RPLLSPDKRQFTVQQNREDILNAGDKLTEVLEEANTLFNEVSRAREAVLDAHFLVLASDLGKEKAKQLRSDLSSFDMLRYVETLLTHMGVNPLEAEELIRDEDSPDFEFIVYDSWKITGRTAENTFNKTHTFHFLLGSIYGECPVPKPRVDRPRKVPVIQEERAMPAQLRRMEESHQEATEKEVERILGLLQTYFREDPDTPMSFFDFVVDPHSFPRTVENIFHVSFIIRDGFARIRLDQDRLPVIGK

SEQ ID NO: 882121 - protein, 168 aa, Homo sapiens
GIVTGNNFTRVQLMADYLFYPLRHRNLGLEEPKFSPRQSIQQRSPFNKTHTFPFLLGSIYGECPVPKPRVDRPRKVPVIQEERAMPAQLRRMEESHQEATEKEVERILGLLQTYFREDPDTPMSFFDFVVDPHSFPRTVENIFHVSFIIRDGFARIRLDQDRLPVIGK

SEQ ID NO: 882122 - protein, 555 aa, Homo sapiens
MTLRAAVFDLDGVLALPAVFGVLGRTEEALALPRGLLNDAFQKGGPEGATTRLMKGEITLSQWIPLMEENCRKCSETAKVCLPKNFSIKEIFDKAISARKINRPMLQAALMLRKKGFTTAILTNTWLDDRAERDGLAQLMCELKMHFDFLIESCQVGMVKPEPQIYKFLLDTLKASPSEVVFLDDIGANLKPARDLGMVTILVQDTDTALKELEKVTGIQLLNTPAPLPTSCNPSDMSHGYVTVKPRVRLHFVELGSGPAVCLCHGFPESWYSWRYQIPALAQAGYRVLAMDMKGYGESSAPPEIEEYCMEVLCKEMVTFLDKLGLSQAVFIGHDWGGMLVWYMALFYPERVRAVASLNTPFIPANPNMSPLESIKANPVFDYQLYFQEPGVAEAELEQNLSRTFKSLFRASDESVLSMHKVCEAGGLFVNSPEEPSLSRMVTEEEIQFYVQQFKKSGFRGPLNWYRNMERNWKWACKSLGRKILIPALMVTAEKDFVLVPQMSQHMEDWIPHLKRGHIEDCGHWTQMDKPTEVNQILIKWLDSDARNPPVVSKM

SEQ ID NO: 882123 - protein, 168 aa, Homo sapiens
MKGEITLSQWIPLMEENCRKCSETAKVCLPKNFSIKEIFDKAISARKINRPMLQAALMLRKKGFTTAILTNTWLDDRAERDGLAQLMCELKMHFDFLIESCQVGMVKPEPQIYKFLLDTLKASPSEVVFLDDIGANLKPARDLGMVTILVQDTDTALKELEKVTGIQG

SEQ ID NO: 882124 - protein, 588 aa, Homo sapiens
MTLRAAVFDLDGVLALPAVFGVLGRTEEALALPSPSGRQVKDVCDSSPHDLSLGPSGDPYWGRLVDRGLLNDAFQKGGPEGATTRLMKGEITLSQWIPLMEENCRKCSETAKVCLPKNFSIKEIFDKAISARKINRPMLQAALMLRKKGFTTAILTNTWLDDRAERDGLAQLMCELKMHFDFLIESCQVGMVKPEPQIYKFLLDTLKASPSEVVFLDDIGANLKPARDLGMVTILVQDTDTALKELEKVTGIQLLNTPAPLPTSCNPSDMSHGYVTVKPRVRLHFVELGSGPAVCLCHGFPESWYSWRYQIPALAQAGYRVLAMDMKGYGESSAPPEIEEYCMEVLCKEMVTFLDKLGLSQAVFIGHDWGGMLVWYMALFYPERVRAVASLNTPFIPANPNMSPLESIKANPVFDYQLYFQEPGVAEAELEQNLSRTFKSLFRASDESVLSMHKVCEAGGLFVNSPEEPSLSRMVTEEEIQFYVQQFKKSGFRGPLNWYRNMERNWKWACKSLGRKILIPALMVTAEKDFVLVPQMSQHMEDWIPHLKRGHIEDCGHWTQMDKPTEVNQILIKWLDSDARNPPVVSKM

SEQ ID NO: 882125 - protein, 502 aa, Homo sapiens
MKGEITLSQWIPLMEENCRKCSETAKVCLPKNFSIKEIFDKAISARKINRPMLQAALMLRKKGFTTAILTNTWLDDRAERDGLAQLMCELKMHFDFLIESCQVGMVKPEPQIYKFLLDTLKASPSEVVFLDDIGANLKPARDLGMVTILVQDTDTALKELEKVTGIQLLNTPAPLPTSCNPSDMSHGYVTVKPRVRLHFVELGSGPAVCLCHGFPESWYSWRYQIPALAQAGYRVLAMDMKGYGESSAPPEIEEYCMEVLCKEMVTFLDKLGLSQAVFIGHDWGGMLVWYMALFYPERVRAVASLNTPFIPANPNMSPLESIKANPVFDYQLYFQEPGVAEAELEQNLSRTFKSLFRASDESVLSMHKVCEAGGLFVNSPEEPSLSRMVTEEEIQFYVQQFKKSGFRGPLNWYRNMERNWKWACKSLGRKILIPALMVTAEKDFVLVPQMSQHMEDWIPHLKRGHIEDCGHWTQMDKPTEVNQILIKWLDSDARNPPVVSKM

SEQ ID NO: 882126 - protein, 491 aa, Homo sapiens
MTLRAAVFDLDGVLALPAVFGVLGRTEEALALPRGLLNDAFQKGGPEGATTRLMKGEITLSQWIPLMEENCRKCSETAKVCLPKNFSIKEIFDKAISARKINRPMLQAALMLRKKGFTTAILTNTWLDDRAERDGLAQLMCELKMHFDFLIESCQVGMVKPEPQIYKFLLDTLKASPSEVVFLDDIGANLKPARDLGMVTILVQDTDTALKELEKVTGIQLLNTPAPLPTSCNPSDMSHGYVTVKPRVRLHFVELGSGPAVCLCHGFPESWYSWRYQIPALAQAGYRVLAMDMKGYGESSAPPEIEEYCMEVLCKEMVTFLDKLGLSQAVFIGHDWGGMLVWYMALFYPERVRAVASLNTPFIPANPNMSPLESIKANPVFDYQLYFQEPGVAEAELEQNLSRTFKSLFRASDESVLSMHKVCEAGGLFVNSPEEPSLSRMVTEEEIQFYVQQFKKSGFRGPLNWYRNMERNWKWACKSLGRKVSARFSVV

SEQ ID NO: 882127 - protein, 465 aa, Homo sapiens
MTLRAAVFDLDGVLALPAVFGVLGRTEEALALPRGLLNDAFQKGGPEGATTRLMKGEITLSQWIPLMEENCRKCSETAKVCLPKNFSIKEIFDKAISARKINRPMLQAALMLRKKGFTTAILTNTWLDDRAERDGLAQLMCELKMHFDFLIESCQVGMVKPEPQIYKFLLDTLKASPSEVVFLDDIGANLKPARDLGMVTILVQDTDTALKELEKVTGIQLLNTPAPLPTSCNPSDMSHGYVTVKPRVRLHFVELGSGPAVCLCHGFPESWYSWRYQIPALAQAGYRVLAMDMKGYGESSAPPEIERILPGSGYVGDWYRSWINWGFLKQCSWALTGGGMQGWTLVSYNPERIRAGHIDIIPGQTQNNTQGPTLGKRMTKTKTRYGKHGLNRKKQEEDDDSKGHTTRKGEHKHHHENTQTGEQHDKKNKGGNGTTKTLPQMDQRGNTTIGIQKGKKTEVTKKRKW

SEQ ID NO: 882128 - protein, 221 aa, Homo sapiens
MTLRAAVFDLDGVLALPAVFGVLGRTEEALALPRGLLNDAFQKGGPEGATTRLMKGEITLSQWIPLMEENCRKCSETAKVCLPKNFSIKEIFDKAISARKINRPMLQAALMLRKKGFTTAILTNTWLDDRAERDGLAQLMCELKMHFDFLIESCQVGMVKPEPQIYKFLLDTLKASPSEVVFLDDIGANLKPARDLGMVTILVQDTDTALKELEKVTGIQG

SEQ ID NO: 882129 - protein, 179 aa, Homo sapiens
MTLRAAVFDLDGVLALPAVFGVLGRTEEALALPRGLLNDAFQKGGPEGATTRLMKGEITLSQWIPLMEENCRKCSETAKVCLPKNFSIKEIFDKAISARKINRPMLQAALMLRKKGFTTAILTNTWLDDRAERDGLAQLMCELKMHFDFLIESCQVGMVKPEPQIYKFLLDTLKASPSE

SEQ ID NO: 882130 - protein, 555 aa, Homo sapiens; identical to SEQ ID NO: 882122

SEQ ID NO: 882131 - protein, 555 aa, Homo sapiens; identical to SEQ ID NO: 882122

SEQ ID NO: 882132 - protein, 357 aa, Homo sapiens
MYILVQDTDTALKELEKVTGIQLLNTPAPLPTSCNPSDMSHGYVTVKPRVRLHFVELGSGPAVCLCHGFPESWYSWRYQIPALAQAGYRVLAMDMKGYGESSAPPEIEEYCMEVLCKEMVTFLDKLGLSQAVFIGHDWGGMLVWYMALFYPERVRAVASLNTPFIPANPNMSPLESIKANPVFDYQLYFQEPGVAEAELEQNLSRTFKSLFRASDESVLSMHKVCEAGGLFVNSPEEPSLSRMVTEEEIQFYVQQFKKSGFRGPLNWYRNMERNWKWACKSLGRKILIPALMVTAEKDFVLVPQMSQHMEDWIPHLKRGHIEDCGHWTQMDKPTEVNQILIKWLDSDARNPPVVSKM

SEQ ID NO: 882133 - protein, 254 aa, Homo sapiens [sequence omitted]

SEQ ID NO: 882134 - protein, 231 aa, Homo sapiens
MTLRAAVFDLDGVLALPAVFGVLGRTEEALALPRGLLNDAFQKGGPEGATTRLMKGEITLSQWIPLMEENCRKCSETAKVCLPKNFSIKEIFDKAISARKINRPMLQAALMLRKKGFTTAILTNTWLDDRAERDGLAQLMCELKMHFDFLIESCQVGMVKPEPQIYKFLLDTLKASPSEVVFLDDIGANLKPARDLGMVTILVQDTDTALKELEKVTGIQPQQTNTKAQRV

SEQ ID NO: 882135 - protein, 144 aa, Homo sapiens
PRGRGGRCGAEGVLEGSPRGLRPGPSRGARAPQIFHRDRTPGTRLFPGRSFLAGLWAAGVGAEEDDPGWTLVSILLVRPVPRSAALVAARFVYGRICRLSYLKTTASAKREKPYLPTDAREIIVELYQRWGCWSPLPSLSFLFS

SEQ ID NO: 882136 - protein, 138 aa, Homo sapiens
SFAHRDFQGHILCSSLPAIQTIPSQGGRSCCPFLPESWSWVVEMCHDAHGGMLTPSSVAEGMAARQLFPVLSKASVVPLFGAKQEYWKREKVVLSIVIKLTLIQVHAWGKDRATNNYNAGSNGIFSWVCGRFNFNYPS

SEQ ID NO: 882137 - protein, 210 aa, Homo sapiens
MANSGCKDVTGPDEESFLYFAYGSNLLTERIHLRNPSAAFFCVARLQAREFFKSFEPLGKFPKAKNQSAKTFGRIAQRPTLAPNPIFFFPKKVSLWAGLHRLVGGTVTINWAPTLETKKGQQFFNKNFSFLRRTLERANKETRAGGFFNTPTGFGGKHLGFNFVFSGLTQFTAKNGFLTNKGVFLGPKKTFPKRETRRHPTREKNFKTPL

SEQ ID NO: 882138 - protein, 98 aa, Homo sapiens
MANSGCKDVTGPDEESFLYFAYGSNLLTERIHLRNPSAAFFCVARLQNLNAFVHFPYYSPHFIARTLKNGGYPSMPSLTCFALGIAKVKLKILQAGHT

SEQ ID NO: 882139 - protein, 188 aa, Homo sapiens
MANSGCKDVTGPDEESFLYFAYGSNLLTERIHLRNPSAAFFCVARLQDFKLDFGNSQGKTSQTWHGGIATIFQSPGDEVWGVVWKMNKSNLNSLDEQEGVKSGMYVVIEVKVATQEGKEITCRSYLMTNYESAPPSPQYKKIICMGAKENGLPLEYQEKLKAIEPNDYTGKVSEEIEDIIKKGETQTL

SEQ ID NO: 882140 - protein, 188 aa, Homo sapiens; identical to SEQ ID NO: 882139

SEQ ID NO: 882141 - protein, 166 aa, Homo sapiens
MANSGCKDVTGPDEESFLYFAYGSNLLTERIHLRNPSAAFFCVARLQDFKLDFGNSQGKTSQTWHGGIATIFQSPGDEVWGVVWKMNKSNLNSLDEQEGVKSGMYVVIEVKVATQEGKEITCRSYLMTNYESAPPSPQYKKVEKETSHCLSESGKSPLQAQDKNVG

SEQ ID NO: 882142 - protein, 133 aa, Homo sapiens
MPNSLTFVIVRDIHYCLTVLGYRKGGNTVVHEHKGLHSLDEQEGVKSGMYVVIEVKVATQEGKEITCRSYLMTNYESAPPSPQYKKIICMGAKENGLPLEYQEKLKAIEPNDYTGKVSEEIEDIIKKGETQTL

SEQ ID NO: 882143 - protein, 201 aa, Homo sapiens
MANSGCKDVTGPDEESFLYFAYGSNLLTERIHLRNPSAAFFCVARLQDFKLDFGNSQGKTSQTWHGGIATIFQSPGDEVWGVVWKMNKSNLNSLDEQEGVKSGMYVVIEVKVATQEGKEITCRSYLMTNYESAPPSPQYKKIICMGAKENGLPLEYQEKLKAIEPNDYTGKVSEEIEDIIKKGETQTFLTLENRDLGDLHV

SEQ ID NO: 882144 - protein, 166 aa, Homo sapiens; identical to SEQ ID NO: 882141

SEQ ID NO: 882145 - protein, 154 aa, Homo sapiens
MANSGCKDVTGPDEESFLYFAYGSNLLTERIHLRNPSAAFFCVARLQGECPLPRYPRRGRDAQKALPRGHTWPIGPGMQFFLMRVLGRGFRLLGGSTSSAAPTARPCPGHGALSGCLELSPSWPLHRLLGLHRFGLSSTNLTDCIQLVLLESLL

SEQ ID NO: 882146 - protein, 188 aa, Homo sapiens; identical to SEQ ID NO: 882139

SEQ ID NO: 882147 - protein, 188 aa, Homo sapiens; identical to SEQ ID NO: 882139

SEQ ID NO: 882148 - protein, 114 aa, Homo sapiens
MANSGCKDVTGPDEESFLYFAYGSNLLTERIHLRNPSAAFFCVARLQDFKLDFGNSQGKTSQTWHGGIATIFQSPGDEVWGVVWKMNKSNLNSLDELFAWVQKKMVCRWSIKRS

SEQ ID NO: 882149 - protein, 166 aa, Homo sapiens
MANSGCKDVTGPDEESFLYFAYGSNLLTERIHLRNPSAAFFCVARLQDFKLDFGNSQGKTSQTWHGGIATIFQSPGDEVWGVVWKMNKSNLNSLDEWRKKRHTAFQNQGNHPCKHKTRMWDRDPKIPVQNLSLALCWQAQSGHGTCNRLFAWVQKKMVCRWSIKRS

SEQ ID NO: 882150 - protein, 65 aa, Homo sapiens
PLPSLTYESAPPSPQYKKIICMGAKENGLPLEYQEKLKAIEPNDYTGKVSEEIEDIIKKGETQTL

SEQ ID NO: 882151 - protein, 159 aa, Homo sapiens
MANSGCKDVTGPDEESFLYFAYGSNLLTERIHLRNPSAAFFCVARLQDFKLDFGNSQGKTSQTWHGGIATIFQSPGDEVWGVVWKMNKSNLNSLDEQEGVKSGMYVVIEVKVATQEGKEITCRSYLMTNYESAPPSPQYKKVSYLQTGGDYFLNFTERN

SEQ ID NO: 882152 - protein, 556 aa, Homo sapiens [sequence omitted]

SEQ ID NO: 882153 - protein, 116 aa, Homo sapiens
MARFGLPALLCTLAVLSAALLAAELKSKSCSEVRRLYVSKGFNKNDAPLHEINGDHLKICPQGSTCCSQEMEEKYSLQSKDDFKSVVSEQCNHLQAVFASRYKKFDGMLFKSYVRT

SEQ ID NO: 882154 - protein, 112 aa, Homo sapiens
ICHPLRYTTIMKEGLCNLLVTVSWILSCTNALSHTLLLAQLSFCADNTIPHFFCDLVALLKLSCSDISLNELVIFTVGQAVITLPLICILISYGHIGVTILKAPSTKGIFKA

SEQ ID NO: 882155 - protein, 419 aa, Homo sapiens
MSGLESARVLLCALGSFLLNSLLSTFRLAELQCTQLDLERKLKLNENAISRLQANQKSVLVSVSEVKAVAEMQFGELLAAVRKAQANVMLFLEEKEQAALSQANGIKAHLEYRSAEMEKSKQELERMAAISNTVQFLEEYCKFKNTEDITFPSVYVGLKDKLSGIRKVITESTVHLIQLLENYKKKLQEFSKEEEYDIRTQVSAVVQRKYWTSKPEPSTREQFLQYAYDITFDPDTAHKYLRLQEENRKVTNTTPWEHPYPDLPSRFLHWRQVLSQQSLYLHRYYFEVEIFGAGTYVGLTCKGIDRKGEERNSCISGNNFSWSLQWNGKEFTAWYSDMETPLKAGPFRRLGVYIDFPGGILSFYGVEYDTMTLVHKFACKFSEPVYAAFWLSKKENAIRIVDLGEEPEKPAPSLVGTAP

SEQ ID NO: 882156 - protein, 564 aa, Homo sapiens
MAELDLMAPGPLPRATAQPPAPLSPDSGSPSPDSGSASPVEEEDVGSSEKLGRETEEQDSDSAEQGDPAGEGKEVLCDFCLDDTRRVKAVKSCLTCMVNYCEEHLQPHQVNIKLQSHLLTEPVKDHNWRYCPAHHSPLSAFCCPDQQCICQDCCQEHSGHTIVSLDAARRDKEAELQCTQLDLERKLKLNENAISRLQANQKSVLVSVSEVKAVAEMQFGELLAAVRKAQANVMLFLEEKEQAALSQANGIKAHLEYRSAEMEKSKQELERMAAISNTVQFLEEYCKFKNTEDITFPSVYVGLKDKLSGIRKVITESTVHLIQLLENYKKKLQEFSKEEEYDIRTQVSAVVQRKYWTSKPEPSTREQFLQYAYDITFDPDTAHKYLRLQEENRKVTNTTPWEHPYPDLPSRFLHWRQVLSQQSLYLHRYYFEVEIFGAGTYVGLTCKGIDRKGEERNSCISGNNFSWSLQWNGKEFTAWYSDMETPLKAGPFRRLGVYIDFPGGILSFYGVEYDTMTLVHKFACKFSEPVYAAFWLSKKENAIRIVDLGEEPEKPAPSLVGTAP

SEQ ID NO: 882157 - protein, 564 aa, Homo sapiens; identical to SEQ ID NO: 882156

SEQ ID NO: 882158 - protein, 348 aa, Homo sapiens
MQFGELLAAVRKAQANVMLFLEEKEQAALSQANGIKAHLEYRSAEMEKSKQELERMAAISNTVQFLEEYCKFKNTEDITFPSVYVGLKDKLSGIRKVITESTVHLIQLLENYKKKLQEFSKEEEYDIRTQVSAVVQRKYWTSKPEPSTREQFLQYAYDITFDPDTAHKYLRLQEENRKVTNTTPWEHPYPDLPSRFLHWRQVLSQQSLYLHRYYFEVEIFGAGTYVGLTCKGIDRKGEERNSCISGNNFSWSLQWNGKEFTAWYSDMETPLKAGPFRRLGVYIDFPGGILSFYGVEYDTMTLVHKFACKFSEPVYAAFWLSKKENAIRIVDLGEEPEKPAPSLVGTAP

SEQ ID NO: 882159 - protein, 360 aa, Homo sapiens
MVSVSEVKAVAEMQFGELLAAVRKAQANVMLFLEEKEQAALSQANGIKAHLEYRSAEMEKSKQELERMAAISNTVQFLEEYCKFKNTEDITFPSVYVGLKDKLSGIRKVITESTVHLIQLLENYKKKLQEFSKEEEYDIRTQVSAVVQRKYWTSKPEPSTREQFLQYAYDITFDPDTAHKYLRLQEENRKVTNTTPWEHPYPDLPSRFLHWRQVLSQQSLYLHRYYFEVEIFGAGTYVGLTCKGIDRKGEERNSCISGNNFSWSLQWNGKEFTAWYSDMETPLKAGPFRRLGVYIDFPGGILSFYGVEYDTMTLVHKFACKFSEPVYAAFWLSKKENAIRIVDLGEEPEKPAPSLVGTAP

SEQ ID NO: 882160 - protein, 348 aa, Homo sapiens; identical to SEQ ID NO: 882158

SEQ ID NO: 882161 - protein, 304 aa, Homo sapiens
MRREAQSLEIQKPQQVLLFPFLQEYCKFKNTEDITFPSVYVGLKDKLSGIRKVITESTVHLIQLLENYKKKLQEFSKEEEYDIRTQVSAVVQRKYWTSKPEPSTREQFLQYAYDITFDPDTAHKYLRLQEENRKVTNTTPWEHPYPDLPSRFLHWRQVLSQQSLYLHRYYFEVEIFGAGTYVGLTCKGIDRKGEERNSCISGNNFSWSLQWNGKEFTAWYSDMETPLKAGPFRRLGVYIDFPGGILSFYGVEYDTMTLVHKFACKFSEPVYAAFWLSKKENAIRIVDLGEEPEKPAPSLVGTAP

SEQ ID NO: 882162 - protein, 243 aa, Homo sapiens
MSGLESARVLLCALGSFLLNSLLSTFRLAELQCTQLDLERKLKLNENAISRLQANQKSVLVSVSEVKAVAEMQFGELLAAVRKAQANVMLFLEEKEQAALSQANGIKAHLEYRSAEMEKSKQELERMAAISNTVQFLERSMTSELKCLPLFSANIGLPNLSPAPGNSSSNMRMTSRLTRTQHTSISGCRRRTARSPTPRPGSIPTRTSPAGSCTGGRCCPSRVCTCTGTILRWRSSGQAPMLA

SEQ ID NO: 882163 - protein, 107 aa, Homo sapiens
PGGRARSGIWLLESREQSPPRTVLASRVPLPDLQSGWLGVYIDFPGGILSFYGVEYDTMTLVHKFACKFSEPVYAAFWLSKKENAIRIVDLGEEPEKPAPSLVGTAP

SEQ ID NO: 882164 - protein, 384 aa, Homo sapiens
MAELDLMAPGPLPRATAQPPAPLSPDSGSPSPDSGSASPVEEEDVGSSEKLGRETEEQDSDSAEQGDPAGEGKEVLCDFCLDDTRRVKAVKSCLTCMVNYCEEHLQPHQVNIKLQSHLLTEPVKDHNWRYCPAHHSPLSAFCCPDQQCICQDCCQEHSGHTIVSLDAARRDKEAELQCTQLDLERKLKLNENAISRLQANQKSVLVSVSEVKAVAEMQFGELLAAVRKAQANVMLFLEEKEQAALSQANGIKAHLEYRSAEMEKSKQELERMAAISNTVQFLEEYCKFKNTEDITFPSVYVGLKDKLSGIRKVITESTVHLIQLLENYKKKLQEFSKEEEYDIRTQVSAVVQRKYWTSKPEPSTREQFLQCKCHTVPRMDDQEP

SEQ ID NO: 882165 - protein, 207 aa, Homo sapiens [sequence omitted]

SEQ ID NO: 882166 - protein, 394 aa, Homo sapiens
PRPSGADRNVSVDSTHPTKKPGTRRPPLPPRPTHPRRKPLPPNNVTGKPGSAGIISSGPITTPPLRSTPRPTGTPLERIETDIKQPTVPASGEELENITDFSSSPTRETDPLGKPRFKGPHVRYIQKPDNSPCSITDSVKRFPKEEATEGNATSPPQNPPTNLTVVTVEGCPSFVILDWEKPLNDTVTEYEVISRENGSFSGKNKSIQMTNQTFSTVENLKPNTSYEFQVKPKNPLGEGPVSNTVAFSTESADPRVSEPVSAGRDAIWTERPFNSDSYSECKGKQYVKRTWYKKFVGVQLCNSLRYKIYLSDSLTGKFYNIGDQRGHGEDHCQFVDSFLDGRTGQQLTSDQLPIKEGYFRAVRQEPVQFGEIGGHTQINYVQWYECGTTIPGKW

SEQ ID NO: 882167 - protein, 394 aa, Homo sapiens; identical to SEQ ID NO: 882166

SEQ ID NO: 882168 - protein, 394 aa, Homo sapiens; identical to SEQ ID NO: 882166

SEQ ID NO: 882169 - protein, 1927 aa, Homo sapiens [sequence omitted]

SEQ ID NO: 882170 - protein, 1704 aa, Homo sapiens
MELSWHVVFIALLSFSCWGSDWESDRNFISTAGPLTNDLLHNLSGLLGDQSSNFVAGDKDMYVCHQPLPTFLPEYFSSLHASQITHYKVFLSWAQLLPAGSTQNPDEKTVQCYRRLLKALKTARLQPMVILHHQTLPASTLRRTEAFADLFADYATFAFHSFGDLVGIWFTFSDLEEVIKELPHQESRASQLQTLSDAHRKAYEIYHESYAFQGGKLSVVLRAEDIPELLLEPPISALAQDTVDFLSLDLSYECQNEASLRQKLSKLQTIEPKVKVFIFNLKLPDCPSTMKNPASLLFSLFEAINKDQVLTIGFDINEFLSCSSSSKKSMSCSLTGSLALQPDQQQDHETTDSSPASAYQRVWEAFANQSRAERDAFLQDTFPEGFLWGASTGAFNVEGGWAEGGRGVSIWDPRRPLNTTEGQATLEVASDSYHKVASDVALLCGLRAQVYKFSISWSRIFPMGHGSSPSLPGVAYYNKLIDRLQDAGIEPMATLFHWDLPQALQDHGGWQNESVVDAFLDYAAFCFSTFGDRVKLWVTFHEPWVMSYAGYGTGQHPPGISDPGVASFKVAHLVLKAHARTWHHYNSHHRPQQQGHVGIVLNSDWAEPLSPERPEDLRASERFLHFMLGWFAHPVFVDGDYPATLRTQIQQMNRQCSHPVAQLPEFTEAEKQLLKGSADFLGLSHYTSRLISNAPQNTCIPSYDTIGGFSQHVNHVWPQTSSSWIRVVPWGIRRLLQFVSLEYTRGKVPIYLAGNGMPIGESENLFDDSLRVDYFNQYINEVLKAIKEDSVDVRSYIARSLIDGFEGPSGYSQRFGLHHVNFSDSSKSRTPRKSAYFFTSIIEKNGFLTKGAKRLLPPNTVNLPSKVRAFTFPSEVPSKAKVVWEKFSSQPKFERDLFYHGTFRDDFLWGVSSSAYQIEGAWDADGKGPSIWDNFTHTPGSNVKDNATGDIACDSYHQLDADLNMLRALKVKAYRFSISWSRIFPTGRNSSINSHGVDYYNRLINGLVASNIFPMVTLFHWDLPQALQDIGGWENPALIDLFDSYADFCFQTFGDRVKFWMTFNEPMYLAWLGYGSGEFPPGVKDPGWAPYRIAHTVIKAHARVYHTYDEKYRQEQKGVISLSLSTHWAEPKSPGVPRDVEAADRMLQFSLGWFAHPIFRNGDYPDTMKWKVGNRSELQHLATSRLPSFTEEEKRFIRATADVFCLNTYYSRIVQHKTPRLNPPSYEDDQEMAEEEDPSWPSTAMNRAAPWGTRRLLNWIKEEYGDIPIYITENGVGLTNPNTEDTDRIFYHKTYINEALKAYRLDGIDLRGYVAWSLMDNFEWLNGYTVKFGLYHVDFNNTNRPRTARASARYYTEVITNNGMPLAREDEFLYGRFPEGFIWSAASAAYQIEGAWRADGKGLSIWDTFSHTPLRVENDAIGDVACDSYHKIAEDLVTLQNLGVSHYRFSISWSRILPDGTTRYINEAGLNYYVRLIDTLLAASIQPQVTIYHWDLPQTLQDVGGWENETIVQRFKEYADVLFQRLGDKVKFWITLNEPFVIAYQGYGYGTAAPGVSNRPGTAPYIVGHNLIKAHAEAWHLYNDVYRASQGGVISITISSDWAEPRDPSNQEDVEAARRYVQFMGGWFAHPIFKNGDYNEVMKTRIRDRSLAAGLNKSRLPEFTESEKRRINGTYDFFGFNHYTTVLAYNLNYATAISSFDADR

SEQ ID NO: 882171 - protein, 486 aa, Homo sapiens
ARGEKLQRAQAELENVSGALNEALLSSKDDVGKSVHELERACRVAEQAANDLRAQVTELEDELTAAEDAKLRLEVTVQALKTQHERDLQGRDEAGEERRRQLAKQLRDAEVERDEERKQRTLAVAARKKLEGELEELKAQMASAGQGKEEAVKQLRKMQAQMKELWREVEETRTSREEIFSQNRESEKRLKGLEAEVLRLQEELAASDRARRQAQQDRDEMADEVANGNLSKAAILEEKRQLEGRLGQLEEELEEEQSNSELLNDRYRKLLLQVESLTTELSAERSFSAKAESGRQQLERQIQELRGRLGEEDAGARARHKMTIAALESKLAQAEEQLEQETRERILSGKLVRRAEKRLKEVVLQVEEERRVADQLRDQLEKGNLRVKQLKRQLEEAEEEASRAQAGRRRLQRELEDVTESAESMNREVTTLRNRLRRGPLTFTTRTVRQVFRLEEGVASDEEAEEAQPGSGPSPEPEGSPPAHPQ

SEQ ID NO: 882172 - protein, 246 aa, Homo sapiens
HQGKGAWEKTRLALEAEVSELRAELSSLQTARQEGEQRRRRLELQLQEVQGRAGDGERARAEAAEKLQRAQAELENVSGALNEAESKTIRLSKELSSTEAQLHDAQELLQEETRAKLALGSRVRAMEAEAAGLREQLEEEAAARERAGRELQTAQAQLSEWRRRQEEEAGALEAGEEARRRAAREAEALTQRLAEKTETVDRLERGRRRLQQELDDATLSPDALTDGAQPPSSLDPTGPCPRNPAL

SEQ ID NO: 882173 - protein, 763 aa, Homo sapiens
HQGKGAWEKTRLALEAEVSELRAELSSLQTARQEGEQRRRRLELQLQEVQGRAGDGERARAEAAEKLQRAQAELENVSGALNEAESKTIRLSKELSSTEAQLHDAQELLQEETRAKLALGSRVRAMEAEAAGLREQLEEEAAARERAGRELQTAQAQLSEWRRRQEEEAGALEAGEEARRRAAREAEALTQRLAEKTETVDRLERGRRRLQQELDDATMDLEQQRQLVSTLEKKQRKFDQLLAEEKAAVLRAVEERERAEAEGREREARALSLTRALEEEQEAREELERQNRALRAELEALLSSKDDVGKSVHELERACRVAEQAANDLRAQVTELEDELTAAEDAKLRLEVTVQALKTQHERDLQGRDEAGEERRRQLAKQLRDAEVERDEERKQRTLAVAARKKLEGELEELKAQMASAGQGKEEAVKQLRKMQAQMKELWREVEETRTSREEIFSQNRESEKRLKGLEAEVLRLQEELAASDRARRQAQQDRDEMADEVANGNLSKAAILEEKRQLEGRLGQLEEELEEEQSNSELLNDRYRKLLLQVESLTTELSAERSFSAKAESGRQQLERQIQELRGRLGEEDAGARARHKMTIAALESKLAQAEEQLEQETRERILSGKLVRRAEKRLKEVVLQVEEERRVADQLRDQLEKGNLRVKQLKRQLEEAEEEASRAQAGRRRLQRELEDVTESAESMNREVTTLRNRLRRGPLTFTTRTVRQVFRLEEGVASDEEAEEAQPGSGPSPEPEGSPPAHPQ

SEQ ID NO: 882174 - protein, 763 aa, Homo sapiens; identical to SEQ ID NO: 882173

SEQ ID NO: 882175 - protein, 763 aa, Homo sapiens; identical to SEQ ID NO: 882173

SEQ ID NO: 882176 - protein, 270 aa, Homo sapiens
MDGDEMERGGNGNLSKAAILEEKRQLEGRLGQLEEELEEEQSNSELLNDRYRKLLLQVESLTTELSAERSFSAKAESGRQQLERQIQELRGRLGEEDAGARARHKMTIAALESKLAQAEEQLEQETRERILSGKLVRRAEKRLKEVVLQVEEERRVADQLRDQLEKGNLRVKQLKRQLEEAEEEASRAQAGRRRLQRELEDVTESAESMNREVTTLRNRLRRGPLTFTTRTVRQVFRLEEGVASDEEAEEAQPGSGPSPEPEGSPPAHPQ

SEQ ID NO: 882177 - protein, 763 aa, Homo sapiens; identical to SEQ ID NO: 882173

SEQ ID NO: 882178 - protein, 763 aa, Homo sapiens; identical to SEQ ID NO: 882173

SEQ ID NO: 882179 - protein, 763 aa, Homo sapiens; identical to SEQ ID NO: 882173

SEQ ID NO: 882180 - protein, 763 aa, Homo sapiens; identical to SEQ ID NO: 882173

SEQ ID NO: 882181 - protein, 767 aa, Homo sapiens
HQGKGAWEKTRLALEAEVSELRAELSSLQTARQEGEQRRRRLELQLQEVQGRAGDGERARAEAAEKLQRAQAELENVSGALNEAESKTIRLSKELSSTEAQLHDAQELLQEETRAKLALGSRVRAMEAEAAGLREQLEEEAAARERAGRELQTAQAQLSEWRRRQEEEAGALEAGEEARRRAAREAEALTQRLAEKTETVDRLERGRRRLQQELDDATMDLEQQRQLVSTLEKKQRKFDQLLAEEKAAVLRAVEERERAEAEGREREARALSLTRALEEEQEAREELERQNRALRAELEALLSSKDDVGKSVHELERACRVAEQAANDLRAQVTELEDELTAAEDAKLRLEVTVQALKTQHERDLQGRDEAGEERRRQLAKQLRDAEVERDEERKQRTLAVAARKKLEGELEELKAQMASAGQGKEEAVKQLRKMQAQMKELWREVEETRTSREEIFSQNRESEKRLKGLEAEVLRLQEELAASDRARRQAQQDRDEMADEVANGNLSKAAILEEKRQLEGRLGQLEEELEEEQSNSELLNDRYRKLLLQVESLTTELSAERSFSAKAESGRQQLERQIQELRGRLGEEDAGARARHKMTIAALESKLAQAEEQLEQETRERILSGKLVRRAEKRLKEVVLQVEEERRVADQLRDQLEKGNLRVKQLKRQLEEAEEEASRAQAGRRRLQRELEDVTESAESMNREVTTLRNRLRRGPLTFTTRTVRQVFRLEEGVASDEEAEEAQPGSGHPLSLLLLPMLCPPFWLL

SEQ ID NO: 882182 - protein, 1038 aa, Homo sapiens
EGIPACQTLAIILEVRLEAYVGLPSAGTARLSPLGWNNQPPRRLCLQVSITFKDLAVRFSEEEWRLLEEGQREFYRDVMRENYETLVSVGTAELLPLSAFLSPSEPGRAVGGGSHADEGQEPAGCGDPQGGQPRHSLHLTALVQLVKEIPEFLFGEVKGAMDSPESESRGASLDGERASPEAAAREPCPLRGLLSCLPDGPTSQPHLATTPTDSSCSSGPTGDGVQGSPLPIKTADKPWPTRKEGPGALGGEPSPPTHSPSRRKSHRGQERGTSEAGISPGNSPLQGLINCLKEILVPGPRHPETSPSFLPPLPSLGTSRLTRADLGPGSPPWAVKTEAVSGDCPLQGLLHCLKELPEAQDRHPSPSGVGNRRLQENPGAWKRGSGGPGYLLTPPPHPDLGAGGLLSVKMENSWVQSPPGPASCQPGRQPLSPSATGDTRGVPQPSWGPEAQAASASSSPLEALEACLKGIPPNGSSPSQLPPTSCSQNPQPGDSRSQKPELQPHRSHSEEATREPVLPLGLQSCVRDGPSRPLAARGSPTSFSSSSSTDWDLDFGSPVGNQGQHPGKGSPPGSSPLQGLENCLKEIPVPVLRPAWPCSSAADRGPRRAEPRNWTADKEGSAPKPSPLHCLESALRGILPVRPLRFACVGGPSPSPSPGSSSSFSGSEGEDPRPEPDLWKPLPQERDRLPSCKPPVPLSPCPGGTPAGSSGGSPGEDPRRTEPRYSSGSCPVSQLEKRPRVSEASRGLELGHGRPRVAAKTHERLLPQGPPELPSESPPPELPPPEAAPPVLPASSLQPPCHCGKPLQQELHSLGAALAEKLDRLATALAGLAQEVATMRTQVNRLGRRPQGPGPMGQASWMWTLPRGPRWAHGPGHRHLPYWRQKGPTRPKPKILRGQGESCRAGDLQGLSRGTARRARPLPPDAPPAEPPGLHCSSSQQLLSSTPSCHAAPPAHPLLAHTGGHQSPLPPLVPAALPLQGASPPAASADADVPTSGVAPDGIPERPKEPSSLLGGVQRALQEELWGGEHRDPRWGAH

SEQ ID NO: 882183 - protein, 1263 aa, Homo sapiens
MRENYETLVSVGTAELLPLSAFLSPSEPGRAVGGGSHADEGQEPAGCGDPQGGQPRHSLHLTALVQLVKEIPEFLFGEVKGAMDSPESESRGASLDGERASPEAAAREPCPLRGLLSCLPDGPTSQPHLATTPTDSSCSSGPTGDGVQGSPLPISESDTAGTGRTSISKALIVASEDLDPVPSSFFSRTQFPCCAVLLLTKYAREQDNIFSLWCNHQRGGMMLSPWGACHPAPITEHFVHRKSPAVSNMQPTASSIDLPVCTGLILRPSHHSNPNCRAGQGELLGFLWGLILFLKLLTNFDMSVFIKKYFKFIWNKIGTPKEHTPFSCGFIWCSGVVGHTCSGVLCALCVPWFEKRECEIVAYMSRLPASLPEPNSEAGLRGKGLGVFTVNQQSCCFQLNQKETVKALSPPRTGTWVAGEGFLYGNQIWCDFPESGAGARKALLSSPATETADKPWPTRKEGPGALGGEPSPPTHSPSRRKSHRGQERGTSEAGISPGNSPLQGLINCLKEILVPGPRHPETSPSFLPPLPSLGTSRLTRADLGPGSPPWAVKTEAVSGDCPLQGLLHCLKELPEAQDRHPSPSGVGNRRLQENPGAWKRGSGGPGYLLTPPPHPDLGAGGLLSVKMENSWVQSPPGPASCQPGRQPLSPSATGDTRGVPQPSWGPEAQAASASSSPLEALEACLKGIPPNGSSPSQLPPTSCSQNPQPGDSRSQKPELQPHRSHSEEATREPVLPLGLQSCVRDGPSRPLAARGSPTSFSSSSSTDWDLDFGSPVGNQGQHPGKGSPPGSSPLQGLENCLKEIPVPVLRPAWPCSSAADRGPRRAEPRNWTADKEGSAPKPSPLHCLESALRGILPVRPLRFACVGGPSPSPSPGSSSSFSGSEGEDPRPEPDLWKPLPQERDRLPSCKPPVPLSPCPGGTPAGSSGGSPGEDPRRTEPRYCSGLGAGTAQDPCPVSQLEKRPRVSEASRGLELGHGRPRVAAKTHERLLPQGPPELPSESPPPELPPPEAAPPVLPASSLQPPCHCGKPLQQELHSLGAALAEKLDRLATALAGLAQEVATMRTQVNRLGRRPQGPGPMGQASWMWTLPRGPRWAHGPGHRHLPYWRQKGPTRPKPKILRGQGESCRAGDLQGLSRGTARRARPLPPDAPPAEPPGLHCSSSQQLLSSTPSCHAAPPAHPLLAHTGGHQSPLPPLVPAALPLQGASPPAASADADVPTSGVAPDGIPERPKEPSSLLGGVQRALQEELWGGEHRDPRWGAH

SEQ ID NO: 882184 - protein, 164 aa, Homo sapiens
SAYKPLLKSRLYGPESRHRGRLCLKNNNQIKYFKFGSSFFQERLFGYLEYLHVCGLISVSGKGGREERQQPCSRVCPEMSLSPDTWAARALQMTKAGSSAHVQEGLKPILSFCSCCFNLNDYSPVKIIWEGRVLFGVCVCVCVCVCVYFFFYSGACLKYFSQHV

SEQ ID NO: 882185 - protein, 202 aa, Homo sapiens
MALTFPWEISSLWKSVPVALGEVSEKRGQDEHSRLSWVQLRPWRVRDCAPFHTCVACCCLWAFSFRGAWCVRAWRERTGVGVGGGSPTPVPVWPEPAPSRERPSRGASVITCCCSLPRGDYMSSGLPVATLMGDLCLLLGHCRLASSIQADVCRERRVLGLHHVLVTNRGRLLAWSAQAGPDPRGFLASETQRILPVSGSVL

SEQ ID NO: 882186 - protein, 354 aa, Homo sapiens
CGSAVRADLPRPEVAPLRGLPRPKFSAPRGLRAPRSPRPEVSARTMRLGSPGLLFLLFSSLRADTQEKEVRAMVGSDVELSCACPEGSRFDLNDVYVYWQTSESKTVVTYHIPQNSSLENVDSRYRNRALMSPAGMLRGDFSLRLFNVTPQDEQKFHCLVLSQSLGFQEVLSVEVTLHVAANFSVPVVSAPHSPSQDELTFTCTSINGYPRPNVYWINKTDNSLLDQALQNDTVFLNMRGLYDVVSVLRIARTPSVNIGCCIENVLLQQNLTVGSQTGNDIGERDKITENPVSTGEKNAATWSILAVLCLLVVVAVAIGWVCRDRCLQHSYAGAWAVSPETELTESWNLLLLLS

SEQ ID NO: 882187 - protein, 123 aa, Homo sapiens
MLSPISRAGQAWPFTPRILLRTATNSPPSHHDPCHTGALVALVAWAVALLPATLSEDPGSLGATQLLCGELAPGVMRALPNPPSALGQPGSPGAVCIQTSQGSSQLGPLSPQNPGTCSFCSRD

SEQ ID NO: 882188 - protein, 123 aa, Homo sapiens; identical to SEQ ID NO: 882187

SEQ ID NO: 882189 - protein, 347 aa, Homo sapiens
CGSAVRADLPRPEVAPLRGLPRPKFSAPRGLRAPRSPRPEVSARTMRLGSPGLLFLLFSSLRADTQEKEVRAMVGSDVELSCACPEGSRFDLNDVYVYWQTSESKTVVTYHIPQNSSLENVDSRYRNRALMSPAGMLRGDFSLRLFNVTPQDEQKFHCLVLSQSLGFQEVLSVEVTLHVAANFSVPVVSAPHSPSQDELTFTCTSINGYPRPNVYWINKTDNSLLDQALQNDTVFLNMRGLYDVVSVLRIARTPSVNIGCCIENVLLQQNLTVGSQTGNDIGERDKITENPVSTGEKNAATWSILAVLCLLVVVAVAIGWVCRDRCLQHSYAGAWAVSPETELTGHV

SEQ ID NO: 882190 - protein, 718 aa, Homo sapiens
ETTVPFWRFFVLETWQVLNQQNIPQISIVVDGGKKVVEFMFQATEGDVLNYIFRNRELRPLFDRQWHKLGISIQSQVISLYMDCNLIARRQTDEKDTVDFHGRTVIATRASDGKPVDIELHQLKIYCSANLIAQETCCEISDTKCPEQDGFGNIASSWVTAHASKMSSYLPAKQELKDQCQCIPNKGEAGLPGAPGSPGQKGHKGEPGENGLHGAPGFPGQKGEQGFEGSKGETGEKGEQGEKGDPALAGLNGENGLKGDLGPHGPPGPKGEKGDTGPPGPPALPGSLGIQGPQGPPGKEGQRGRRGKTGPPGKPGPPGPPGPPGIQGIHQTLGGYYNKDNKGNDEHEAGGLKGDKGETGLPGFPGSVGPKGQKGEPGEPFTKGEKGDRGEPGVIGSQGVKGEPGDPGPPGLIGSPGLKGQQGSAGSMGPRGPPGDVGLPGEHGIPGKQGIKGEKGDPGGIIGPPGLPGPKGEAGPPGKSLPGEPGLDGNPGAPGPRGPKGERGLPGVHGSPGDIGPQGIGIPGRTGAQGPAGEPGIQGPRGLPGLPGTPGTPGNDGVPGRDGKPGLPGPPGDPIALPLLGDIGALLKNFCGNCQASVPGLKSNKGEEGGAGEPGKYDSMARKGDIGPRGPPGIPGREGPKGSKGERGYPGIPGEKGDEGLQGIPGIPGAPGPTGPPGLMGRTGHPGPTGAKGEKGSDGPPGKPGPPGPPVSCSRLKI

SEQ ID NO: 882191 - protein, 249 aa, Homo sapiens
ETTVPFWRFFVLETWQVLNQQNIPQISIVVDGGKKVVEFMFQATEGDVLNYIFRNRELRPLFDRQWHKLGISIQSQVISLYMDCNLIARRQTDEKDTVDFHGRTVIATRASDGKPVDIELHQLKIYCSANLIAQETCCEISDTKCPEQDGFGNIASSWVTAHASKMSSYLPAKQELKDQCQCIPNKGEAGLPGAPGSPGQKGHKGEPGENGLHGAPGFPGQKGEQGFEGSKGETGEKELPACELLSQSM

SEQ ID NO: 882192 - protein, 357 aa, Homo sapiens
ETTVPFWRFFVLETWQVLNQQNIPQISIVVDGGKKVVEFMFQATEGDVLNYIFRNRELRPLFDRQWHKLGISIQSQVISLYMDCNLIARRQTDEKDTVDFHGRTVIATRASDGKPVDIELHQLKIYCSANLIAQETCCEISDTKCPEQDGFGNIASSWVTAHASKMSSYLPAKQELKDQCQCIPNKGEAGLPGAPGSPGQKGHKGEPGENGLHGAPGFPGQKGEQGFEGSKGETGEKGEQGEKGDPALAGLNGENGLKGDLGPHGPPGPKGEKGDTGPPGPPALPGSLGIQGPQGPPGKEGQRGRRGKTGPPGKPGPPGPPGPPGIQGIHQTLGGYYNKDNKGNDEHEAGGLKGDKV

SEQ ID NO: 882193 - protein, 1142 aa, Homo sapiens
MRLTGPWKLWLWMSIFLLPASTSVTVRDKTEESCPILRIEGHQLTYDNINKLEVSGFDLGDSFSLRRAFCESDKTCFKLGSALLIRDTIKIFPKGLPEEYSVAAMFRVRRNAKKERWFLWQVLNQQNIPQISIVVDGGKKVVEFMFQATEGDVLNYIFRNRELRPLFDRQWHKLGISIQSQVISLYMDCNLIARRQTDEKDTVDFHGRTVIATRASDGKPVDIELHQLKIYCSANLIAQETCCEISDTKCPEQDGFGNIASSWVTAHASKMSSYLPAKQELKDQCQCIPNKGEAGLPGAPGSPGQKGHKGEPGENGLHGAPGFPGQKGEQGFEGSKGETGEKGEQGEKGDPALAGLNGENGLKGDLGPHGPPGPKGEKGDTGPPGPPALPGSLGIQGPQGPPGKEGQRGRRGKTGPPGKPGPPGPPGPPGIQGIHQTLGGYYNKDNKGNDEHEAGGLKGDKGETGLPGFPGSVGPKGQKGEPGEPFTKGEKGDRGEPGVIGSQGVKGEPGDPGPPGLIGSPGLKGQQGSAGSMGPRGPPGDVGLPGEHGIPGKQGIKGEKGDPGGIIGPPGLPGPKGEAGPPGKSLPGEPGLDGNPGAPGPRGPKGERGLPGVHGSPGDIGPQGIGIPGRTGAQGPAGEPGIQGPRGLPGLPGTPGTPGNDGVPGRDGKPGLPGPPGDPIALPLLGDIGALLKNFCGNCQASVPGLKSNKGEEGGAGEPGKYDSMARKGDIGPRGPPGIPGREGPKGSKGERGYPGIPGEKGDEGLQGIPGIPGAPGPTGPPGLMGRTGHPGPTGAKGEKGSDGPPGKPGPPGPPGIPFNERNGMSSLYKIKGGVNVPSYPGPPGPPGPKGDPGPVGEPGAMGLPGLEGFPGVKGDRGPAGPPGIAGMSGKPGAPGPPGVPGEPGERGPVGDIGFPGPEGPSGKPGINGKDGIPGAQGIMGKPGDRGPKGERGDQGIPGDRGSQGERGKPGLTGMKGAIGPMGPPGNKGSMGSPGHQGPPGSPGIPGIPADAVSFEEIKKYINQEVLRIFEERMAVFLSQLKLPAAMLAAQAYGRPGPPGKDGLPGPPGDPGPQGYRGQKGERGEPGIGLPGSPGLPGTSALGLPGSPGAPGPQGPPGPSGRCNPEDCLYPVSHAHQRTGGN

SEQ ID NO: 882194 - protein, 72 aa, Homo sapiens
RRRAAQLGRCRVARKFVGPEPSTPSGTLAPREQAGASVAVHMVSRHNETHWPLETLALDVNISASCFHFRDR

SEQ ID NO: 882195 - protein, 218 aa, Homo sapiens
HTWTFFISSNETASAGMPGMPGGPKGERGDQGIPGDRGSQGERGKPGLTGMKGAIGPMGPPGNKGSMGSPGHQGPPGSPGIPGIPADAVSFEEIKKYINQEVLRIFEERMAVFLSQLKLPAAMLAAQAYGRPGPPGKDGLPGPPGDPGPQGYRGQKGERGEPGIGLPGSPGLPGTSALGLPGSPGAPGPQGPPGPSGRCNPEDCLYPVSHAHQRTGGN

SEQ ID NO: 882196 - protein, 141 aa, Homo sapiens
MAGMKIQLVCMLLLAFSSWSLCSDSEEEMKALEADFLTNMHTSKISKAHVPSWKMTLLNVCSLVNNLNSPAEETGEVHEEELVARRKLPTALDGFSLEAMLTIYQLHKICHSRAFQHWELIPRKNILLYTVEMTKMERKKS

SEQ ID NO: 882197 - protein, 141 aa, Homo sapiens; identical to SEQ ID NO: 882196

SEQ ID NO: 882198 - protein, 69 aa, Homo sapiens
EQMEKMSREKRALLMPVNTQEEYSFVYRGNDKNGKEEVIKRKIPYILKRQLYENKPRRPYILKRDSYYY

SEQ ID NO: 882199 - protein, 70 aa, Homo sapiens
ARTLLMHSALTHDRRRLINTQEEYSFVYRGNDKNGKEEVIKRKIPYILKRQLYENKPRRPYILKRDSYYY

SEQ ID NO: 882200 - protein, 71 aa, Homo sapiens
LEWPTTCTLRLITKLIDNINTQEEYSFVYRGNDKNGKEEVIKRKIPYILKRQLYENKPRRPYILKRDSYYY

SEQ ID NO: 882201 - protein, 141 aa, Homo sapiens; identical to SEQ ID NO: 882196

SEQ ID NO: 882202 - protein, 141 aa, Homo sapiens; identical to SEQ ID NO: 882196

SEQ ID NO: 882203 - protein, 73 aa, Homo sapiens
DSDEEVAFKKTEEGAAYGTEVNTQEEYSFVYRGNDKNGKEEVIKRKIPYILKRQLYENKPRRPYILKRDSYYY

SEQ ID NO: 882204 - protein, 77 aa, Homo sapiens
VMIPGKQEYSRGNARGGCASVNSEINTQEEYSFVYRGNDKNGKEEVIKRKIPYILKRQLYENKPRRPYILKRDSYYY

SEQ ID NO: 882205 - protein, 70 aa, Homo sapiens
LMLFTYRSRYIRGSLDNINTQEEYSFVYRGNDKNGKEEVIKRKIPYILKRQLYENKPRRPYILKRDSYYY

SEQ ID NO: 882206 - protein, 141 aa, Homo sapiens; identical to SEQ ID NO: 882196

SEQ ID NO: 882207 - protein, 141 aa, Homo sapiens; identical to SEQ ID NO: 882196

SEQ ID NO: 882208 - protein, 336 aa, Homo sapiens
RVSKEGSAPPPGSPGELIEGSFPPFAVPTPVPTTQERVSQSMENQEKASIAGHMFDVVVIGGGISGLSAAKLLTEYGVSVLVLEARDRVGGRTYTIRNEHVDYVDVGGAYVGPTQNRILRLSKELGIETYKVNVSERLVQYVKGKTYPFRGAFPPVWNPIAYLDYNNLWRTIDNMGKEIPTDAPWEAQHADKWDKMTMKELIDKICWTKTARRFAYLFVNINVTSEPHEVSALWFLWYVKQCGGTTRIFSVTNGGQERKLEVDRSVERKGLMGPPSGEPRGKLEPFRVPHGGPRPGDTLHHKKRRNQEHYEMAQTAMKGTLRTGMANAFDQKIPER

SEQ ID NO: 882209 - protein, 321 aa, Homo sapiens
MEFLTFLKSDYTHANLVDKALQLLKERILKGDTLAYFLRGQLYFEEGWYEEALEQFEEIKEKDHQATYQLGVMYYDGLGTTLDAEKGVDYMKKILDSPCPKARHLKFAAAYNLGRAYYEGKGVKRSNEEAERLWLIAADNGNPKASVKAQSMLGLYYSTKEPKELEKAFYWHSEACGNGNLESQGALGLMYLYGQGIRQDTEAALQCLREAAERGNVYAQGNLVEYYYKMKFFTKCVAFSKRIADYDEVHDIPMIAQVTDCLPEFIGRGMAMASFYHARCLQLGLGITRDETTAKHYYSKACRLNPALADELHSLLIRQRI

SEQ ID NO: 882210 - protein, 347 aa, Homo sapiens
MKLTSEKLPKNPFYASVSQYAAKNQKFFQWKKEKTDYTHANLVDKALQLLKERILKGDTLAYFLRGQLYFEEGWYEEALEQFEEIKEKDHQATYQLGVMYYDGLGTTLDAEKGVDYMKKILDSPCPKARHLKFAAAYNLGRAYYEGKGVKRSNEEAERLWLIAADNGNPKASVKAQSMLGLYYSTKEPKELEKAFYWHSEACGNGNLESQGALGLMYLYGQGIRQDTEAALQCLREAAERGNVYAQGNLVEYYYKMKFFTKCVAFSKRIADYDEVHDIPMIAQVTDCLPEFIGRGMAMASFYHARCLQLGLGITRDETTAKHYYSKACRLNPALADELHSLLIRQRI

SEQ ID NO: 882211 - protein, 170 aa, Homo sapiens [sequence omitted]

SEQ ID NO: 882212 - protein, 249 aa, Homo sapiens
MYYDGLGTTLDAEKGVDYMKKILDSPCPKARHLKFAAAYNLGRAYYEGKGVKRSNEEAERLWLIAADNGNPKASVKAQSMLGLYYSTKEPKELEKAFYWHSEACGNGNLESQGALGLMYLYGQGIRQDTEAALQCLREAAERGNVYAQGNLVEYYYKMKFFTKCVAFSKRIADYDEVHDIPMIAQVTDCLPEFIGRGMAMASFYHARCLQLGLGITRDETTAKHYYSKACRLNPALADELHSLLIRQRI

SEQ ID NO: 882213 - protein, 504 aa, Homo sapiens
MLKMAEPIASLMIVECRACLRCSPLFLYQREKDRMTENMKECLAQTNAAVGDMVTVVNPSQEYGQPCSRRPDSSAMEVEPKKLKGKRDLIVPKSFQQVDFWFCESCQEYFVDECPNHGPPVFVSDTPVPVGIPDRAALTIPQGMEVVKDTSGESDVRCVNEVIPKGHIFGPYEGQISTQDKSAGFFSWLIVDKNNRYKSIDGSDETKANWMRYVVISREEREQNLLAFQHSERIYFRACRDIRPGEWLRVWYSEDYMKRLHSMSQETIHRNLARGEKRLQREKSEQVLDNPEDLRGPIHLSVLRQGKSPYKRGFDEGDVHPQAKKKKIDLIFKDVLEASLESAKVEAHQLALSTSLVIRKVPKYQDDAYSQCATTMTHGVQNIGQTQGEGDWKVPQGVSKEPGQLEDEEEEPSSFKADSPAEASLASDPHELPTTSFCPNCIRLKKKVRELQAELDMLKSGKLPEPPVLPPQVLELPEFSDPAGKLVWMRLLSEGRVRSGLCGG

SEQ ID NO: 882214 - protein, 511 aa, Homo sapiens
MLKMAEPIASLMIVECRACLRCSPLFLYQREKDRMTENMKECLAQTNAAVGDMVTVVKTEVCSPLRDQEYGQPCSRRPDSSAMEVEPKKLKGKRDLIVPKSFQQVDFWFCESCQEYFVDECPNHGPPVFVSDTPVPVGIPDRAALTIPQGMEVVKDTSGESDVRCVNEVIPKGHIFGPYEGQISTQDKSAGFFSWLIVDKNNRYKSIDGSDETKANWMRYVVISREEREQNLLAFQHSERIYFRACRDIRPGEWLRVWYSEDYMKRLHSMSQETIHRNLARGEKRLQREKSEQVLDNPEDLRGPIHLSVLRQGKSPYKRGFDEGDVHPQAKKKKIDLIFKDVLEASLESAKVEAHQLALSTSLVIRKVPKYQDDAYSQCATTMTHGVQNIGQTQGEGDWKVPQGVSKEPGQLEDEEEEPSSFKADSPAEASLASDPHELPTTSFCPNCIRLKKKVRELQAELDMLKSGKLPEPPVLPPQVLELPEFSDPAGKLVWMRLLSEGRVRSGLCGG

SEQ ID NO: 882215 - protein, 309 aa, Homo sapiens
MLKMAEPIASLMIVECRACLRCSPLFLYQREKDRMTENMKECLAQTNAAVGDMVTVVKTEVCSPLRDQEYGQPCSRRPDSSAMEVEPKKLKGKRDLIVPKSFQQVDFWFCESCQEYFVDECPNHGPPVFVSDTPVPVGIPDRAALTIPQGMEVVKDTSGESDVRCVNEVIPKGHIFGPYEGQISTQDKSAGFFSWLIVDKNNRYKSIDGSDETKANWMRNVAHLAERKRKPKFSKEELDILVTEVTHHEAVLFGRETMRLSHADRDKIWEGIARKITSVSQVPRSVKDIKHRWDDLKRRTKDKLAFMQQ

SEQ ID NO: 882216 - protein, 202 aa, Homo sapiens
MAAPWRRWPTGLLAVLRPLLTCRPLQGTTLQRDVLLFEHDRGRFFTILGLFCAGQGVFWASMAVAAVSRPPVPVQPLDAEVPNRGPFDLRSALWRYGLAVGCGAIGALVLGAGLLFSLRSVRSVVLRAGGQQVTLTTHAPFGLGAHFTVPLKQVSCMAHRGEVPAMLPLKVKGRRFYFLLDKTGHFPNTKLFDNTVGAYRSL

SEQ ID NO: 882217 - protein, 169 aa, Homo sapiens
NRLERPGVNRTRYILGLFCAGQGVFWASMAVAAVSRPPVPVQPLDAEVPNRGPFDLRSALWRYGLAVGCGAIGALVLGAGLLFSLRSVRSVVLRAGGQQVTLTTHAPFGLGAHFTVPLKQVSCMAHRGEVPAMLPLKVKGRRFYFLLDKTGHFPNTKLFDNTVGAYRSL

SEQ ID NO: 882218 - protein, 37 aa, Homo sapiens
MLPLKVKGRRFYFLLDKTGHFPNTKLFDNTVGAYRSL

SEQ ID NO: 882219 - protein, 106 aa, Homo sapiens
MAAPWRRWPTGLLAVLRPLLTCRPLQGTTLQRDVLLFEHDRGRFFTILGLFCAGQGVFWASMAVAAVSRPPVPVQPLDAEVPNRGPFDLRSALWRYGLAVGCGAIA

SEQ ID NO: 882220 - protein, 137 aa, Homo sapiens
MAAPWRRWPTGLLAVLRPLLTCRPLQGTTLQRDVLLFEHDRGRFFTILGLFCAGQGVFWASMAVAAVSRPPVPVQPLDAEVPNRGPFDLRSALWRYGLAVGCGAIGYSTIRNRQKQQLMTHSNNAQHQKARKSNLRG

SEQ ID NO: 882221 - protein, 314 aa, Homo sapiens
WGRLRQAGRKPGGGVQEPRPPGLDSAGGGAAGGACGSGNPDPAPFPTPPFLAMAPALLLIPAALASFILAFGTGVEFVRFTSLRPLLGGIPESGGPDARQGWLAALQDRSILAPLAWDLGLLLLFVGQHSLMAAERVKAWTSRYFGVLQRSLYVACTALALQLVMRYWEPIPKGPVLWEARAEPWATWVPLLCFVLHVISWLLIFSILLVFDYAELMGLKQVYYHVLGLGEPLALKSPRALRLFSHLRHPVCVELLTVLWVVPTLGTDRLLLAFLLTLYLGLAHGLDQQDLRYLRAQLQRKLHLLSRPQDGEAE

SEQ ID NO: 882222 - protein, 314 aa, Homo sapiens; identical to SEQ ID NO: 882221

SEQ ID NO: 882223 - protein, 279 aa, Homo sapiens
SATRGSKEAVLYGSKVARLGGPLLIPAALASFILAFGTGVEFVRFTSLRPLLGGIPESGGPDARQGWLAALQDRSILAPLAWDLGLLLLFVGQHSLMAAERVKAWTSRYFGVLQRSLYVACTALALQLVMRYWEPIPKGPVLWEARAEPWATWVPLLCFVLHVISWLLIFSILLVFDYAELMGLKQVYYHVLGLGEPLALKSPRALRLFSHLRHPVCVELLTVLWVVPTLGTDRLLLAFLLTLYLGLAHGLDQQDLRYLRAQLQRKLHLLSRPQDGEAE

SEQ ID NO: 882224 - protein, 314 aa, Homo sapiens; identical to SEQ ID NO: 882221

SEQ ID NO: 882225 - protein, 314 aa, Homo sapiens; identical to SEQ ID NO: 882221

SEQ ID NO: 882226 - protein, 321 aa, Homo sapiens
WGRLRQAGRKPGGGVQEPRPPGLDSAGGGAAGGACGSGNPDPAPFPTPPFLAMAPALLLIPAALASFILAFGTGVEFVRFTSLRPLLGGIPESGGPDARQGWLAALQDRSILAPLAWDLGLLLLFVGQHSLMAAERVKAWTSRYFGVLQRSLYVACTALALQDEALALQLVMRYWEPIPKGPVLWEARAEPWATWVPLLCFVLHVISWLLIFSILLVFDYAELMGLKQVYYHVLGLGEPLALKSPRALRLFSHLRHPVCVELLTVLWVVPTLGTDRLLLAFLLTLYLGLAHGLDQQDLRYLRAQLQRKLHLLSRPQDGEAE

SEQ ID NO: 882227 - protein, 261 aa, Homo sapiens
ESGREATGEGDLSSKLGTQGLEFWRGGRVRTEGAEKGGDRSILNARQGWLAALQDRSILAPLAWDLGLLLLFVGQHSLMAAERVKAWTSRYFGVLQRSLYVACTALALQLVMRYWEPIPKGPVLWEARAEPWATWVPLLCFVLHVISWLLIFSILLVFDYAELMGLKQVYYHVLGLGEPLALKSPRALRLFSHLRHPVCVELLTVLWVVPTLGTDRLLLAFLLTLYLGLAHGLDQQDLRYLRAQLQRKLHLLSRPQDGEAE

SEQ ID NO: 882228 - protein, 150 aa, Homo sapiens
MRYWEPIPKGPVLWEARAEPWATWVPLLCFVLHVISWLLIFSILLVFDYAELMGLKQVYYHVLGLGEPLALKSPRALRLFSHLRHPVCVELLTVLWVVPTLGTDRLLLAFLLTLYLGLAHGLDQQDLRYLRAQLQRKLHLLSRPQDGEAE

SEQ ID NO: 882229 - protein, 150 aa, Homo sapiens; identical to SEQ ID NO: 882228

SEQ ID NO: 882230 - protein, 255 aa, Homo sapiens
WGRLRQAGRKPGGGVQEPRPPGLDSAGGGAAGGACGSGNPDPAPFPTPPFLAMAPALLLIPAALASFILAFGTGVEFVRFTSLRPLLGGIPESGGPDARQGWLAALQDRSILAPLAWDLGLLLLFVGQHSLMAAERVKAWTSRYFGVLQRSLYVACTALALQVYYHVLGLGEPLALKSPRALRLFSHLRHPVCVELLTVLWVVPTLGTDRLLLAFLLTLYLGLAHGLDQQDLRYLRAQLQRKLHLLSRPQDGEAE

SEQ ID NO: 882231 - protein, 126 aa, Homo sapiens
SATRGSKEAVLYGSKVARLGGPLLIPAALASFILAFGTGVEFVRFTSLRPLLGGIPESGGPGILPCAGAGRASGPEVSPGSQTLLPPAPPSVCGAADSAVGGAYPGHGPSPPCFPPYPLPGPGSRA

SEQ ID NO: 882232 - protein, 134 aa, Homo sapiens
MGKAAPGGPEAWRWRAGAPPSWAGFSRGRGRGRGLWQRESRPRPFPHPSISRHGPCTAPDPCCPRLFHPGLWHRSGVRALYLPSATSWRDPGVWWSGCPPGMAGCPAGPQHPCPPGMGSGAPASICWAAQPHGS

SEQ ID NO: 882233 - protein, 306 aa, Homo sapiens
PAAAAGREAMEPRALVTALSLGLSLCSLGLLVTAIFTDHWYETDPRRHKESCERSRAGADPPDQKNRLMPLSHLPLRDSPPLGRRLLPGGPGRADPESWRSLLGLGGLDAECGRPLFATYSGLWRKCYFLGIDRDIDTLILKGIAHDCTAIKYHFSQPIRLRNIPFNLTKTIQQDEWHLLHLRRITAGFLGMAVAVLLCGCIVATVSFFWEESLTQHVAGLLFLMTGIFCTISLCTYAASISYDLNRLPKLIYSLPADVEHGYSWSIFCAWCSLGFIVAAGGLCIAYPFISRTKIAQLKSGRDSTV

SEQ ID NO: 882234 - protein, 211 aa, Homo sapiens
ESVRGRVGEKSGESRDRVKGREEDEGGEERLKGEGGSLERRAELWIGGIAHDCTAIKYHFSQPIRLRNIPFNLTKTIQQDEWHLLHLRRITAGFLGMAVAVLLCGCIVATVSFFWEESLTQHVAGLLFLMTGIFCTISLCTYAASISYDLNRLPKLIYSLPADVEHGYSWSIFCAWCSLGFIVAAGGLCIAYPFISRTKIAQLKSGRDSTV

SEQ ID NO: 882235 - protein, 177 aa, Homo sapiens
TLSPALSSFCDDAGIAHDCTAIKYHFSQPIRLRNIPFNLTKTIQQDEWHLLHLRRITAGFLGMAVAVLLCGCIVATVSFFWEESLTQHVAGLLFLMTGIFCTISLCTYAASISYDLNRLPKLIYSLPADVEHGYSWSIFCAWCSLGFIVAAGGLCIAYPFISRTKIAQLKSGRDSTV

SEQ ID NO: 882236 - protein, 604 aa, Homo sapiens
NSSKPLYLGQTGLGNIEELGKLGLEPGENFCMGGPGMIFSREVLRRMVPHIGECLREMYTTHEDVEVGRCVRRFGGTQCVWSYEMQQLFHENYEHNRKGYIQDLHNSKIHAAITLHPNKRPAYQYRLHNYMLSRKISELRYRTIQLHRESALMSKLSNTEVSKEDQQLGVIPSFNHFQPRERNEVIEWEFLTGKLLYSAAENQPPRQSLSSILRTALDDTVLQVMEMINENAKSRGRLIDFKEIQYGYRRVNPMHGVEYILDLLLLYKRHKGRKLTVPVRRHAYLQQLFSKPFFRETEELDVNSLVESINSETQSFSFISNSLKILSSFQGAKEMGGHNEKKVHILVPLIGRYDIFLRFMENFENMCLIPKQNVKLVIILFSRDSGQDSSKHIELIKGYQNKYPKAEMTLIPMKGEFSRGLGLEMASAQFDNDTLLLFCDVDLIFREDFLQRCRDNTIQGQQVYYPIIFSQYDPKVTNGGNPPTDGYFIFSKKTGFWRDYGYGITCIYKSDLLGAGGFDTSIQGWGLEDVDLYNKVILSGLRPFRSQEVGVVHIFHPVHCDPNLDPKQYKMCLGSKASTFASTMQLAELWLEKHLGVRYNRTLS

SEQ ID NO: 882237 - protein, 622 aa, Homo sapiens [sequence omitted]

SEQ ID NO: 882238 - protein, 98 aa, Homo sapiens
VTKVSKEEMTVVWNPPEYDGGKSITGYFLEKKEKHSTRWVPVNKSAIPERRMKVQNLLPDHEYQFRVKAENEIGIGEPSLPSRPVVAKDPIGRMSLFF

SEQ ID NO: 882239 - protein, 1223 aa, Homo sapiens
MRSRSNSGVRLDGYARLVQQTILCHQNPVTGLLPASYDQKDAWVRDNVYSILAVWGLGLAYRKNADRDEDKAKAYELEQSVVKLMRGLLHCMIRQVDKVESFKYSQSTKDSLHAKYNTKTCATVVGDDQWGHLQLDATSVYLLFLAQMTASGLHIIHSLDEVNFIQNLVFYIEAAYKTADFGIWERGDKTNQGISELNASSVGMAKAALEALDELDLFGVKGGPQSVIHVLADEVQHCQSILNSLLPRASTSKEVDASLLSVVSFPAFAVEDSQLVELTKQEIITKLQGRYGCCRFLRDGYKTPKEDPNRLYYEPAELKLFENIECEWPLFWTYFILDGVFSGNAEQVQEYKEALEAVLIKGKNGVPLLPELYSVPPDRVDEEYQNPHTVDRVPMGKLPHMWGQSLYILGSLMAEGFLAPGEIDPLNRRFSTVPKPDVVVQVSILAETEEIKTILKDKGIYVETIAEVYPIRVQPARILSHIYSSLGCNNRMKLSGRPYRHMGVLGTSKLYDIRKTIFTFTPQFIDQQQFYLALDNKMIVEMLRTDLSYLCSRWRMTGQPTITFPISHSMLDEDGTSLNSSILAALRKMQDGYFGGARVQTGKLSEFLTTSCCTHLSFMDPGPEGKLYSEDYDDNYDYLESGNWMNDYDSTSHARCGDEVARYLDHLLAHTAPHPKLAPTSQKGGLDRFQAAVQTTCDLMSLVTKAKELHVQNVHMYLPTKLFQASRPSFNLLDSPHPRQENQVPSVRVEIHLPRDQSGEVDFKALVLQLKETSSLQEQADILYMLYTMKGPDWNTELYNERSATVRELLTELYGKVGEIRHWGLIRYISGILRKKVEALDEACTDLLSHQKHLTVGLPPEPREKTISAPLPYEALTQLIDEASEGDMSISILTQEIMVYLAMYMRTQPGLFAEMFRLRIGLIIQVMATELAHSLRCSAEEATEGLMNLSPSAMKNLLHHILSGKEFGVERSVRPTDSNVSPAISIHEIGAVGATKTERTGIMQLKSEIKQVEFRRLSISAESQSPGTSMTPSSGSFPSAYDQQSSKDSRQGQWQRRRRLDGALNRVPVGFYQKVWKVLQKCHGLSVEGFVLPSSTTREMTPGEIKFSVHVESVLNRVPQPEYRQLLVEAILVLTMLADIEIHSIGSIIAVEKIVHIANDLFLQEQKTLGADDTMLAKDPASGICTLLYDSAPSGRFGTMTYLSKAAATYVQEFLPHSICAMQ

SEQ ID NO: 882240 - protein, 1223 aa, Homo sapiens; identical to SEQ ID NO: 882239

SEQ ID NO: 882241 - protein, 1210 aa, Homo sapiens
MRSRSNSGVRLDGYARLVQQTILCHQNPVTGLLPASYDQKDAWVRDNVYSILAVWGLGLAYRKNADRDEDKAKAYELEQSVVKLMRGLLHCMIRQVDKVESFKYSQSTKDSLHAKYNTKTCATVVGDDQWGHLQLDATSVYLLFLAQMTASGLHIIHSLDEVNFIQNLVFYIEAAYKTADFGIWERGDKTNQGISELNASSVGMAKAALEALDELDLFGVKGGPQSVIHVLADEVQHCQSILNSLLPRASTSKEVDASLLSVVSFPAFAVEDSQLVELTKQEIITKLQGRYGCCRFLRDGYKTPKEDPNRLYYEPAELKLFENIECEWPLFWTYFILDGVFSGNAEQVQEYKEALEAVLIKGKNGVPLLPELYSVPPDRVDEEYQNPHTVDRVPMGKLPHMWGQSLYILGSLMAEGFLAPGEIDPLNRRFSTVPKPDVVVQVSILAETEEIKTILKDKGIYVETIAEVYPIRVQPARILSHIYSSLGCNNRMKLSGRPYRHMGVLGTSKLYDIRKTIFTFTPQFIDQQQFYLALDNKMIVEMLRTDLSYLCSRWRMTGQPTITFPISHSMLDEDGTSLNSSILAALRKMQDGYFGGARVQTGKLSEFLTTSCCTHLSFMDPGPEGKLYSEDYDDNYDYLESGNWMNDYDSTSHARCGDEVARYLDHLLAHTAPHPKLAPTSQKGGLDRFQAAVQTTCDLMSLVTKAKELHVQNVHMYLPTKLFQASRPSFNLLDSPHPRQENQVPSVRVEIHLPRDQSGEVDFKALVLQLKETSSLQEQADILYMLYTMKGPDWNTELYNERSATVRELLTELYGKVGEIRHWGLIRYISGILRKKVEALDEACTDLLSHQKHLTVGLPPEPREKTISAPLPYEALTQLIDEASEGDMSISILTQEIMVYLAMYMRTQPGLFAEMFRLRIGLIIQVMATELAHSLRCSAEEATEGLMNLSPSAMKNLLHHILSGKEFGVERSVRPTDSNVSPAISIHEIGAVGATKTERTGIMQLKSEIKQSPGTSMTPSSGSFPSAYDQQSSKDSRQGQWQRRRRLDGALNRVPVGFYQKVWKVLQKCHGLSVEGFVLPSSTTREMTPGEIKFSVHVESVLNRVPQPEYRQLLVEAILVLTMLADIEIHSIGSIIAVEKIVHIANDLFLQEQKTLGADDTMLAKDPASGICTLLYDSAPSGRFGTMTYLSKAAATYVQEFLPHSICAMQ

SEQ ID NO: 882242 - protein, 1210 aa, Homo sapiens; identical to SEQ ID NO: 882241

SEQ ID NO: 882243 - protein, 1139 aa, Homo sapiens
SCFHLFLQSVVKLMRGLLHCMIRQVDKVESFKYSQSTKDSLHAKYNTKTCATVVGDDQWGHLQLDATSVYLLFLAQMTASGLHIIHSLDEVNFIQNLVFYIEAAYKTADFGIWERGDKTNQGISELNASSVGMAKAALEALDELDLFGVKGGPQSVIHVLADEVQHCQSILNSLLPRASTSKEVDASLLSVVSFPAFAVEDSQLVELTKQEIITKLQGRYGCCRFLRDGYKTPKEDPNRLYYEPAELKLFENIECEWPLFWTYFILDGVFSGNAEQVQEYKEALEAVLIKGKNGVPLLPELYSVPPDRVDEEYQNPHTVDRVPMGKLPHMWGQSLYILGSLMAEGFLAPGEIDPLNRRFSTVPKPDVVVQVSILAETEEIKTILKDKGIYVETIAEVYPIRVQPARILSHIYSSLGCNNRMKLSGRPYRHMGVLGTSKLYDIRKTIFTFTPQFIDQQQFYLALDNKMIVEMLRTDLSYLCSRWRMTGQPTITFPISHSMLDEDGTSLNSSILAALRKMQDGYFGGARVQTGKLSEFLTTSCCTHLSFMDPGPEGKLYSEDYDDNYDYLESGNWMNDYDSTSHARCGDEVARYLDHLLAHTAPHPKLAPTSQKGGLDRFQAAVQTTCDLMSLVTKAKELHVQNVHMYLPTKLFQASRPSFNLLDSPHPRQENQVPSVRVEIHLPRDQSGEVDFKALVLQLKETSSLQEQADILYMLYTMKGPDWNTELYNERSATVRELLTELYGKVGEIRHWGLIRYISGILRKKVEALDEACTDLLSHQKHLTVGLPPEPREKTISAPLPYEALTQLIDEASEGDMSISILTQEIMVYLAMYMRTQPGLFAEMFRLRIGLIIQVMATELAHSLRCSAEEATEGLMNLSPSAMKNLLHHILSGKEFGVERSVRPTDSNVSPAISIHEIGAVGATKTERTGIMQLKSEIKQSPGTSMTPSSGSFPSAYDQQSSKDSRQGQWQRRRRLDGALNRVPVGFYQKVWKVLQKCHGLSVEGFVLPSSTTREMTPGEIKFSVHVESVLNRVPQPEYRQLLVEAILVLTMLADIEIHSIGSIIAVEKIVHIANDLFLQEQKTLGADDTMLAKDPASGICTLLYDSAPSGRFGTMTYLSKAAATYVQEFLPHSICAMQ

SEQ ID NO: 882244 - protein, 563 aa, Homo sapiens
PPLTVHARCGDEVARYLDHLLAHTAPHPKLAPTSQKGGLDRFQAAVQTTCDLMSLVTKAKELHVQNVHMYLPTKLFQASRPSFNLLDSPHPRQENQVPSVRVEIHLPRDQSGEVDFKALVLQLKETSSLQEQADILYMLYTMKGPDWNTELYNERSATVRELLTELYGKVGEIRHWGLIRYISGILRKKVEALDEACTDLLSHQKHLTVGLPPEPREKTISAPLPYEALTQLIDEASEGDMSISILTQEIMVYLAMYMRTQPGLFAEMFRLRIGLIIQVMATELAHSLRCSAEEATEGLMNLSPSAMKNLLHHILSGKEFGVERSVRPTDSNVSPAISIHEIGAVGATKTERTGIMQLKSEIKQSPGTSMTPSSGSFPSAYDQQSSKDSRQGQWQRRRRLDGALNRVPVGFYQKVWKVLQKCHGLSVEGFVLPSSTTREMTPGEIKFSVHVESVLNRVPQPEYRQLLVEAILVLTMLADIEIHSIGSIIAVEKIVHIANDLFLQEQKTLGADDTMLAKDPASGICTLLYDSAPSGRFGTMTYLSKAAATYVQEFLPHSICAMQ

SEQ ID NO: 882245 - protein, 67 aa, Homo sapiens
GGRTGLRGQERRLGRCGGALDRGKPVLALARGGPLRPPESGEGPKAPVAPGLFLRGQLVTCRHEEPE

SEQ ID NO: 882246 - protein, 383 aa, Homo sapiens
MSLVDLGKKLLEAARAGQDDEVRILMANGAPFTTDWLGTSPLHLAAQYGHYSTTEVLLRAGVSRDARTKVDRTPLHMAASEGHASIVEVLLKHGADVNAKDMLKMTALHWATEHNHQEVVELLIKYGADVHTQSKFCKTAFDISIDNGNEDLAEILQIAMQNQINTNPESPDTVTIHAATPQFIIGPGGVVNLTDETGVSAVQFGNSSTSVLATLAALAEASAPLSNSSETPVVATEEVVTAESVDGAIQQVVSSGGQQVITIVTDGIQLGNLHSIPTSGIGQPIIVTMPDGQQVLTVPATDIAEETVISEEPPAKRQCIEIIENRVESAEIEEREALQKQLDEANREAQKYRQQLLKKEQEAEAYRQKLEAMTRLQTNKEAV

SEQ ID NO: 882247 - protein, 395 aa, Homo sapiens
MSLVDLGKKLLEAARAGQDDEVRILMANGAPFTTDWLGTSPLHLAAQYGHYSTTEVLLRAGVSRDARTKVDRTPLHMAASEGHASIVEVLLKHGADVNAKDMLKMTALHWATEHNHQEVVELLIKYGADVHTQSKFCKTAFDISIDNGNEDLAEILQIAMQNQINTNPESPDTVTIHAATPQFIIGPGGVVNLTGLVSSENSSKATDETGVSAVQFGNSSTSVLATLAALAEASAPLSNSSETPVVATEEVVTAESVDGAIQQVVSSGGQQVITIVTDGIQLGNLHSIPTSGIGQPIIVTMPDGQQVLTVPATDIAEETVISEEPPAKRQCIEIIENRVESAEIEEREALQKQLDEANREAQKYRQQLLKKEQEAEAYRQKLEAMTRLQTNKEAV

SEQ ID NO: 882248 - protein, 348 aa, Homo sapiens
MSLVDLGKKLLEAARAGQDDEVRILMANGAPFTTDWLGTSPLHLAAQYGHYSTTEVLLRAGVSRDARTKVDRTPLHMAASEGHASIVEVLLKHGADVNAKDMLKMTALHWATEHNHQEVVELLIKYGADVHTQSKFCKTAFDISIDNGNEDLAEILQIAMQNQINTNPESPDTVTIHAATPQFIIGPGGVVNLTDETGVSAVQFGNSSTSVLATLAALAEASAPLSNSSETPVVATEEVVTAESVDGAIQQVVSSGGQQVITIVTDGIQLGNLHSIPTSGIGQPIIVTMPDGQQVLTVPATDIAEETVISEEPPAKRQCIEIIENRVESAEIEVRSLLPGVLCRSHPK

SEQ ID NO: 882249 - protein, 360 aa, Homo sapiens
MSLVDLGKKLLEAARAGQDDEVRILMANGAPFTTDWLGTSPLHLAAQYGHYSTTEVLLRAGVSRDARTKVDRTPLHMAASEGHASIVEVLLKHGADVNAKDMLKMTALHWATEHNHQEVVELLIKYGADVHTQSKFCKTAFDISIDNGNEDLAEILQIAMQNQINTNPESPDTVTIHAATPQFIIGPGGVVNLTGLVSSENSSKATDETGVSAVQFGNSSTSVLATLAALAEASAPLSNSSETPVVATEEVVTAESVDGAIQQVVSSGGQQVITIVTDGIQLGNLHSIPTSGIGQPIIVTMPDGQQVLTVPATDIAEETVISEEPPAKRQCIEIIENRVESAEIEVRSLLPGVLCRSHPK

SEQ ID NO: 882250 - protein, 348 aa, Homo sapiens; identical to SEQ ID NO: 882248

SEQ ID NO: 882251 - protein, 383 aa, Homo sapiens; identical to SEQ ID NO: 882246

SEQ ID NO: 882252 - protein, 488 aa, Homo sapiens
MRNDSLNNQRYLVTAYLWRKDYSLLCWTSSIHGTCPLNAEQSILTFSLQNASINIQRALKGAVLLPMRTTDFQESIYINLPYGGRARWLTPVIPALWEAEAGRHEMSLVDLGKKLLEAARAGQDDEVRILMANGAPFTTDWLGTSPLHLAAQYGHYSTTEVLLRAGVSRDARTKVDRTPLHMAASEGHASIVEVLLKHGADVNAKDMLKMTALHWATEHNHQEVVELLIKYGADVHTQSKFCKTAFDISIDNGNEDLAEILQIAMQNQINTNPESPDTVTIHAATPQFIIGPGGVVNLTDETGVSAVQFGNSSTSVLATLAALAEASAPLSNSSETPVVATEEVVTAESVDGAIQQVVSSGGQQVITIVTDGIQLGNLHSIPTSGIGQPIIVTMPDGQQVLTVPATDIAEETVISEEPPAKRQCIEIIENRVESAEIEEREALQKQLDEANREAQKYRQQLLKKEQEAEAYRQKLEAMTRLQTNKEAV

SEQ ID NO: 882253 - protein, 377 aa, Homo sapiens
MSLVDLGKKLLEAARAGQDDEVRILMANGAPFTTDWLGTSPLHLAAQYGHYSTTEVLLRAGVSRDARTKVDRTPLHMAASEGHASIVEVLLKHGADVNAKDMLKMTALHWATEHNHQEVVELLIKYGADVHTQSKFCKTAFDISIDNGNEDLAEILQIAMQNQINTNPESPDTVTIHAATPQFIIGPGGVVNLTGLVSSENSSKATDETGVSAVQFGNSSTSVLATLAALAEASAPLSNSSETPVVATEEVVTAESVDGAIQQVVSSGGQQVITIVTDGIQLGNLHSIPTSGIGQPIIVTMPDGQQVLTVPATDIAEETVISEEPPAKRQCIEIIENRVESAEIERGCLAMLPRLVLDSWPQVILPPQPPEELRLLA

SEQ ID NO: 882254 - protein, 348 aa, Homo sapiens; identical to SEQ ID NO: 882248

SEQ ID NO: 882255 - protein, 338 aa, Homo sapiens
MFQAFPGDYDSGSRCSSSPSAESQYLSSVDSFGSPPTAAASQECAGLGEMPGSFVPTVTAITTSQDLQWLVQPTLISSMAQSQGQPLASQPPVVDPYDMPGTSYSTPGMSGYSSGGASGSGGPSTSGTTSGPGPARPARARPRRPREETLTPEEEEKRRVRRERNKLAAAKCRNRRRELTDRLQAETDQLEEEKAELESEIAELQKEKERLEFVLVAHKPGCKIPYEEGPGPGPLAEVRDLPGSAPAKEDGFSWLLPPPPPPPLPFQTSQDAPPNLTASLFTHSEVQVLGDPFPVVNPSYTSSFVLTCPEVSAFAGAQRTSGSDQPSDPLNSPSLLAL

SEQ ID NO: 882256 - protein, 124 aa, Homo sapiens
MSLLRGVSYLEWDRSSGILTGPLPREGVSGTYSLGVGWPLGSLSQNISGGVNLPSDIPGKFFCLCFFLRGGGGGRRWSLIWPGRSLWLSLGWGCRSLPKDGVSLGGVVPAIRDGSGPQGTTNHP

SEQ ID NO: 882257 - protein, 114 aa, Homo sapiens
MTLAVEEPSRAVLDAWWEGKAQGGSNMQVTLIPTHDSEVMREWYQETHEKQQDLNIRVLASSSTGVMQDDSFLAMQDGPVKTRASHTTGSELLFPEILQFEITFSKKSIHLVKA

SEQ ID NO: 882258 - protein, 237 aa, Homo sapiens
MFQAFPGDYDSGSRCSSSPSAESQYLSSVDSFGSPPTAAASQECAGLGEMPGSFVPTVTAITTSQDLQWLVQPTLISSMAQSQGQPLASQPPVVDPYDMPGTSYSTPGMSGYSSGGASGSGGPSTSGTTSGPGPARPARARPRRPREETLTPEEEEKRRVRRERNKLAAAKCRNRRRELTDRLQAETDQLEEEKAELESEIAELQKEKERLEFVLVAHKPGCKIPYEEGPGPGPLAE

SEQ ID NO: 882259 - protein, 188 aa, Homo sapiens
MPGSFVPTVTAITTSQDLQWLVQPTLISSMAQSQGQPLASQPPVVDPYDMPGTSYSTPGMSGYSSGGASGSGGPSTSGTTSGPGPARPARARPRRPREETLTPEEEEKRRVRRERNKLAAAKCRNRRRELTDRLQAETDQLEEEKAELESEIAELQKEKERLEFVLVAHKPGCKIPYEEGPGPGPLAE

SEQ ID NO: 882260 - protein, 210 aa, Homo sapiens
CPNSHGHQDSISGGVFSQPGAAFQQQVQGSHDPSFPVTDMLFSPSSLSSVTWPPWPQETDQLEEEKAELESEIAELQKEKERLEFVLVAHKPGCKIPYEEGPGPGPLAEVRDLPGSAPAKEDGFSWLLPPPPPPPLPFQTSQDAPPNLTASLFTHSEVQVLGDPFPVVNPSYTSSFVLTCPEVSAFAGAQRTSGSDQPSDPLNSPSLLAL

SEQ ID NO: 882261 - protein, 237 aa, Homo sapiens; identical to SEQ ID NO: 882258

SEQ ID NO: 882262 - protein, 237 aa, Homo sapiens; identical to SEQ ID NO: 882258

SEQ ID NO: 882263 - protein, 237 aa, Homo sapiens; identical to SEQ ID NO: 882258

SEQ ID NO: 882264 - protein, 237 aa, Homo sapiens; identical to SEQ ID NO: 882258

SEQ ID NO: 882265 - protein, 237 aa, Homo sapiens; identical to SEQ ID NO: 882258

SEQ ID NO: 882266 - protein, 218 aa, Homo sapiens
MFQAFPGDYDSGSRCSSSPSAESQYLSSVDSFGSPPTAAASQECAGLGEMPGSFVPTVTAITTSQDLQWLVQPTLISSMAQSQGQPLASQPPVVDPYDMPGTSYSTPGMSGYSSGGASGSGGPSTSGTTSGPGPARPARARPRRPREETLTPEEEEKRRVRRERNKLAAAKCRNRRRELTDRLQAVRTGPGVGEGMLRGALSPFSAPSPPVPLSWVEN

SEQ ID NO: 882267 - protein, 237 aa, Homo sapiens; identical to SEQ ID NO: 882258

SEQ ID NO: 882268 - protein, 68 aa, Homo sapiens
MEGGSTKASVLQKPQDPCYTSEDRRLVFWLLGVLKEVEVRDGWRSAVSPNLMASISLTQLTPEEEEKR

SEQ ID NO: 882269 - protein, 184 aa, Homo sapiens
FAGKMEYPAPATVQAADGGAAGPYSSSELLEGQEPDGVRFDRERARRLWEAVSGAQPVGREEALHQNREMIDPDKFCSLCHATFNDPVMAQQHYVGKKHRKQETKLKLMARYGRLADPAVTDFPAGKGYPCKTCKIVLNSIEQYQAHVSGFKHKNQSPKTVASSLGQIPMQRQPIQKDSTTLED

SEQ ID NO: 882270 - protein, 298 aa, Homo sapiens
FAGKMEYPAPATVQAADGGAAGPYSSSELLEGQEPDGVRFDRERARRLWEAVSGAQPVGREEVEHMIQKNQCLFTNTQCKVCCALLISESQKLAHYQSKKHANKVKRYLAIHGMETLKGETKKLDSDQKSSRSKDKNQCCPICNMTFSSPVVAQSHYLGKTHAKNLKLKQQSTKVEALHQNREMIDPDKFCSLCHATFNDPVMAQQHYVGKKHRKQETKLKLMARYGRLADPAVTDFPAGKGYPCKTCKIVLNSIEQYQAHVSGFKHKNQSPKTVASSLGQIPMQRQPIQKDSTTLED

SEQ ID NO: 882271 - protein, 298 aa, Homo sapiens; identical to SEQ ID NO: 882270

SEQ ID NO: 882272 - protein, 122 aa, Homo sapiens
FAGKMEYPAPATVQAADGGAAGPYSSSELLEGQEPDGVRFDRERARRLWEAVSGAQPVGREEAGKGYPCKTCKIVLNSIEQYQAHVSGFKHKNQSPKTVASSLGQIPMQRQPIQKDSTTLED

SEQ ID NO: 882273 - protein, 207 aa, Homo sapiens [sequence omitted]

SEQ ID NO: 882274 - protein, 139 aa, Homo sapiens
FAGKMEYPAPATVQAADGGAAGPYSSSELLEGQEPDGVRFDRERARRLWEAVSGAQPVGREEVEHMIQKNQCLFTNTQCKVCCALLISESQKLAHYQSKKHANKVKRYLAIHGMETLKGETKKLDSDQLERATPAKHVR

SEQ ID NO: 882275 - protein, 236 aa, Homo sapiens
FAGKMEYPAPATVQAADGGAAGPYSSSELLEGQEPDGVRFDRERARRLWEAVSGAQPVGREEVEHMIQKNQCLFTNTQCKVCCALLISESQKLAHYQSKKHANKVKRYLAIHGMETLKGETKKLDSDQKSSRSKDKNQCCPICNMTFSSPVVAQSHYLGKTHAKNLKLKQQSTKVEAGKGYPCKTCKIVLNSIEQYQAHVSGFKHKNQSPKTVASSLGQIPMQRQPIQKDSTTLED

SEQ ID NO: 882276 - protein, 184 aa, Homo sapiens; identical to SEQ ID NO: 882269

SEQ ID NO: 882277 - protein, 280 aa, Homo sapiens
FAGKMEYPAPATVQAADGGAAGPYSSSELLEGQEPDGVRFDRERARRLWEAVSGAQPVGREEVEHMIQKNQCLFTNTQCKVCCALLISESQKLAHYQSKKHANKVKRYLAIHGMETLKGETKKLDSDQKSSRSKDKNQCCPICNMTFSSPVVAQSHYLGKTHAKNLKLKQQSTKVEALHQNREMIDPDKFCSLCHATFNDPVMAQQHYVGKKHRKQETKLKLMARYGRLADPAVTDFPGHQKQWHHPWARFQCKGNPFRKTQPPWKTRGDSAQHPILGQP

SEQ ID NO: 882278 - protein, 344 aa, Homo sapiens
MGRWALDVAFLWKAVLTLGLVLLYYCFSIGITFYNKWLTKSFHFPLFMTMLHLAVIFLFSALSRALVQCSSHRARVVLSWADYLRRVAPTALATALDVGLSNWSFLYVTVSLYTMTKSSAVLFILIFSLIFKLEELSTQFNVEGFALVLGASFIGGIRWTLTQMLLQKAELGLQNPIDTMFHLQPLMFLGLFPLFAVFEGLHLSTSEKIFRFQDTGLLLRVLGSLFLGGILAFGLGFSEFLLVSRTSSLTLSIAGIFKEVCTLLLAAHLLGDQISLLNWLGFALCLSGISLHVALKALHSRGDGGPKALKGLGSSPDLELLLRSSQREEGDNEEEEYFVAQGQQ

SEQ ID NO: 882279 - protein, 109 aa, Homo sapiens
SVFPCRATPLYFTPEAQTSPPHHSAGLIMVAGSCGRESPGGGAKPGTHDFCPSLQSLVTQGASTRPAWDWPELGPSCAGIAAGEGSGLVLPTTSQALTAETHFQGTAAF

SEQ ID NO: 882280 - protein, 365 aa, Homo sapiens
MGRWALDVAFLWKAVLTLGLVLLYYCFSIGITFYNKWLTKSFHFPLFMTMLHLAVIFLFSALSRALVQCSSHRARVVLSWADYLRRVAPTALATALDVGLSNWSFLYVTVSLYTMTKSSAVLFILIFSLIFKLEELRAALVLVVLLIAGGLFMFTYKSTQFNVEGFALVLGASFIGGIRWTLTQMLLQKAELGLQNPIDTMFHLQPLMFLGLFPLFAVFEGLHLSTSEKIFRFQDTGLLLRVLGSLFLGGILAFGLGFSEFLLVSRTSSLTLSIAGIFKEVCTLLLAAHLLGDQISLLNWLGFALCLSGISLHVALKALHSRGDGGPKALKGLGSSPDLELLLRSSQREEGDNEEEEYFVAQGQQ

SEQ ID NO: 882281 - protein, 334 aa, Homo sapiens
MGRWALDVAFLWKAVLTLGLVLLYYCFSIGITFYNKWLTKSFHFPLFMTMLHLAVIFLFSALSRALVQCSSHRARVVLSWADYLRRVAPTALATALDVGLSNWSFLYVTVSLYTMTKSSAVLFILIFSLIFKLEELRAALVLVVLLIAGGLFMFTYKSTQFNVEGFALVLGASFIGGIRWTLTQMLLQKAELGLQNPIDTMFHLQPLMFLGLFPLFAVFEGLHLSTSEKIFRFQDTGLLLRVLGSLFLGGILAFGLGFSEFLLVSRTSSLTLSIAGIFKEVCTLLLAAHLLGDQISLLNWLGFALCLSGISLHVALKALHSRASRSLCFLFFSL

SEQ ID NO: 882282 - protein, 342 aa, Homo sapiens
MGRWALDVAFLWKAVLTLGLVLLYYCFSIGITFYNKWLTKSFHFPLFMTMLHLAVIFLFSALSRALVQCSSHRARVVLSWADYLRRVAPTALATALDVGLSNWSFLYVTVSLYTMTKSSAVLFILIFSLIFKLEELRAALVLVVLLIAGGLFMFTYKSTQFNVEGFALVLGASFIGGIRWTLTQMLLQKAELGLQNPIDTMFHLQPLMFLGLFPLFAVFEGLHLSTSEKIFRFQDTGLLLRVLGSLFLGGILAFGLGFSEFLLVSRTSSLTLSIAGIFKEVCTLLLAAHLLGDQISLLNWLGFALCLSGISLHVALKALHSRGGNPESLPEASVFCSSPCDS

SEQ ID NO: 882283 - protein, 365 aa, Homo sapiens; identical to SEQ ID NO: 882280

SEQ ID NO: 882284 - protein, 264 aa, Homo sapiens
MGRWALDVAFLWKAVLTLGLVLLYYCFSIGITFYNKWLTKSFHFPLFMTMLHLAVIFLFSALSRALVQCSSHRARVVLSWADYLRRVAPTALATALDVGLSNWSFLYVTVSLYTMTKSSAVLFILIFSLIFKLEELRAALVLVVLLIAGGLFMFTYKSTQFNVEGFALVLGASFIGGIRWTLTQMLLQKAELGLQNPIDTMFHLQPLMFLGLFPLFAVFEGSLHFAVGSSSAGRSDQPPELAGLRPLPLGNIPPRCPQSPAFQR

SEQ ID NO: 882285 - protein, 365 aa, Homo sapiens; identical to SEQ ID NO: 882280

SEQ ID NO: 882286 - protein, 384 aa, Homo sapiens
MGRWALDVAFLWKAVLTLGLVLLYYCFSIGITFYNKWLTKSFHFPLFMTMLHLAVIFLFSALSRALVQCSSHRARVVLSWADYLRRVAPTALATALDVGLSNWSFLYVTVSLYTMTKSSAVLFILIFSLIFKLEELVRPQRLLPPSELPLLPILPRAALVLVVLLIAGGLFMFTYKSTQFNVEGFALVLGASFIGGIRWTLTQMLLQKAELGLQNPIDTMFHLQPLMFLGLFPLFAVFEGLHLSTSEKIFRFQDTGLLLRVLGSLFLGGILAFGLGFSEFLLVSRTSSLTLSIAGIFKEVCTLLLAAHLLGDQISLLNWLGFALCLSGISLHVALKALHSRGDGGPKALKGLGSSPDLELLLRSSQREEGDNEEEEYFVAQGQQ

SEQ ID NO: 882287 - protein, 251 aa, Homo sapiens
MTKSSAVLFILIFSLIFKLEELRAALVLVVLLIAGGLFMFTYKSTQFNVEGFALVLGASFIGGIRWTLTQMLLQKAELGLQNPIDTMFHLQPLMFLGLFPLFAVFEGLHLSTSEKIFRFQDTGLLLRVLGSLFLGGILAFGLGFSEFLLVSRTSSLTLSIAGIFKEVCTLLLAAHLLGDQISLLNWLGFALCLSGISLHVALKALHSRGDGGPKALKGLGSSPDLELLLRSSQREEGDNEEEEYFVAQGQQ

SEQ ID NO: 882288 - protein, 151 aa, Homo sapiens
MGRWALDVAFLWKAVLTLGLVLLYYCFSIGITFYNKWLTKSFHFPLFMTMLHLAVIFLFSALSRALVQCSSHRARVVLSWADYLRRVAPTALATALDVGLSNWSFLYVTVSLYTMTKSSAVLFILIFSLIFKLEELVRPQRLLCPSCPHRC

SEQ ID NO: 882289 - protein, 181 aa, Homo sapiens
MLLQKAELGLQNPIDTMFHLQPLMFLGLFPLFAVFEGLHLSTSEKIFRFQDTGLLLRVLGSLFLGGILAFGLGFSEFLLVSRTSSLTLSIAGIFKEVCTLLLAAHLLGDQISLLNWLGFALCLSGISLHVALKALHSRGDGGPKALKGLGSSPDLELLLRSSQREEGDNEEEEYFVAQGQQ

SEQ ID NO: 882290 - protein, 230 aa, Homo sapiens
MTKSSAVLFILIFSLIFKLEELSTQFNVEGFALVLGASFIGGIRWTLTQMLLQKAELGLQNPIDTMFHLQPLMFLGLFPLFAVFEGLHLSTSEKIFRFQDTGLLLRVLGSLFLGGILAFGLGFSEFLLVSRTSSLTLSIAGIFKEVCTLLLAAHLLGDQISLLNWLGFALCLSGISLHVALKALHSRGDGGPKALKGLGSSPDLELLLRSSQREEGDNEEEEYFVAQGQQ

SEQ ID NO: 882291 - protein, 174 aa, Homo sapiens
WVQCDCGRESPGGGAKPGLMTFAPPFRAWSHKGRAPGQPGTGQSWAQAAAGIAAGEGSGLVLPTTSQALTAETHFQGTAALSIAGIFKEVCTLLLAAHLLGDQISLLNWLGFALCLSGISLHVALKALHSRGDGGPKALKGLGSSPDLELLLRSSQREEGDNEEEEYFVAQGQQ

SEQ ID NO: 882292 - protein, 237 aa, Homo sapiens
MGRWALDVAFLWKAVLTLGLVLLYYCFSIGITFYNKWLTKSFHFPLFMTMLHLAVIFLFSALSRALVQCSSHRARVVLSWADYLRRVAPTALATALDVGLSNWSFLYVTVSLEYWPCPAASLQAEAVCLSSGVSAHPAARPATPPLWDQPLLSQPLPGTQQLFREVASLFRKPSAEEMLCPPARQRGEARELSQNPIIRAGEGRLQGHRQVATGGWYTQPQQSPMWPGGYTRVSSSL

SEQ ID NO: 882293 - protein, 365 aa, Homo sapiens; identical to SEQ ID NO: 882280

SEQ ID NO: 882294 - protein, 365 aa, Homo sapiens; identical to SEQ ID NO: 882280

SEQ ID NO: 882295 - protein, 365 aa, Homo sapiens; identical to SEQ ID NO: 882280

SEQ ID NO: 882296 - protein, 365 aa, Homo sapiens; identical to SEQ ID NO: 882280

SEQ ID NO: 882297 - protein, 365 aa, Homo sapiens; identical to SEQ ID NO: 882280

SEQ ID NO: 882298 - protein, 213 aa, Homo sapiens
MFTYKSTQFNVEGFALVLGASFIGGIRWTLTQMLLQKAELGLQNPIDTMFHLQPLMFLGLFPLFAVFEGLHLSTSEKIFRFQDTGLLLRVLGSLFLGGILAFGLGFSEFLLVSRTSSLTLSIAGIFKEVCTLLLAAHLLGDQISLLNWLGFALCLSGISLHVALKALHSRGDGGPKALKGLGSSPDLELLLRSSQREEGDNEEEEYFVAQGQQ

SEQ ID NO: 882299 - protein, 213 aa, Homo sapiens; identical to SEQ ID NO: 882298

SEQ ID NO: 882300 - protein, 213 aa, Homo sapiens; identical to SEQ ID NO: 882298

SEQ ID NO: 882301 - protein, 231 aa, Homo sapiens
MERAALVLVVLLIAGGLFMFTYKSTQFNVEGFALVLGASFIGGIRWTLTQMLLQKAELGLQNPIDTMFHLQPLMFLGLFPLFAVFEGLHLSTSEKIFRFQDTGLLLRVLGSLFLGGILAFGLGFSEFLLVSRTSSLTLSIAGIFKEVCTLLLAAHLLGDQISLLNWLGFALCLSGISLHVALKALHSRGDGGPKALKGLGSSPDLELLLRSSQREEGDNEEEEYFVAQGQQ

SEQ ID NO: 882302 - protein, 151 aa, Homo sapiens; identical to SEQ ID NO: 882288

SEQ ID NO: 882303 - protein, 782 aa, Homo sapiens
MTSIIKLTTLSGVQEESALCYLLQVDEFRFLLDCGWDEHFSMDIIDSLRKHVHQIDAVLLSHPDPLHLGALPYAVGKLGLNCAIYATIPVYKMGQMFMYDLYQSRHNTEDFTLFTLDDVDAAFDKIQQLKFSQIVNLKGKGHGLSITPLPAGHMIGGTIWKIVKDGEEEIVYAVDFNHKREIHLNGCSLEMLSRPSLLITDSFNATYVQPRRKQRDEQLLTNVLETLRGDGNVLIAVDTAGRVLELAQLLDQIWRTKDAGLGVYSLALLNNVSYNVVEFSKSQVEWMSDKLMRCFEDKRNNPFQFRHLSLCHGLSDLARVPSPKVVLASQPDLECGFSRDLFIQWCQDPKNSIILTYRTTPGTLARFLIDNPSEKITEIELRKRVKLEGKELEEYLEKEKLKKEAAKKLEQSKEADIDSSDESDIEEDIDQPSAHKTKHDLMMKGEGSRKGSFFKQAKKSYPMFPAPEERIKWDEYGEIIKPEDFLVPELQATEEEKSKLESGLTNGDEPMDQDLSDVPTKCISTTESIEIKARVTYIDYEGRSDGDSIKKIINQMKPRQLIIVHGPPEASQDLAECCRAFGGKDIKVYMPKLHETVDATSETHIYQVRLKDSLVSSLQFCKAKDAELAWIDGVLDMRVSKVDTGVILEEGELKDDGEDSEMQVEAPSDSSVIAQQKAMKSLFGDDEKETGEESEIIPTLEPLPPHEVPGHQSVFMNEPRLSDFKQVLLREGIQAEFVGGVLVCNNQVAVRRTETGRIGLEGCLCQDFYRIRDLLYEQYAIV

SEQ ID NO: 882304 - protein, 644 aa, Homo sapiens
MTSIIKLTTLSGVQEESALCYLLQVDEFRFLLDCGWDEHFSMDIIDSLRKHVHQIDAVLLSHPDPLHLGALPYAVGKLGLNCAIYATIPVYKMGQMFMYDLYQSRHNTEDFTLFTLDDVDAGLGVYSLALLNNVSYNVVEFSKSQVEWMSDKLMRCFEDKRNNPFQFRHLSLCHGLSDLARVPSPKVVLASQPDLECGFSRDLFIQWCQDPKNSIILTYRTTPGTLARFLIDNPSEKITEIELRKRVKLEGKELEEYLEKEKLKKEAAKKLEQSKEADIDSSDESDIEEDIDQPSAHKTKHDLMMKGEGSRKGSFFKQAKKSYPMFPAPEERIKWDEYGEIIKPEDFLVPELQATEEEKSKLESGLTNGDEPMDQDLSDVPTKCISTTESIEIKARVTYIDYEGRSDGDSIKKIINQMKPRQLIIVHGPPEASQDLAECCRAFGGKDIKVYMPKLHETVDATSETHIYQVRLKDSLVSSLQFCKAKDAELAWIDGVLDMRVSKVDTGVILEEGELKDDGEDSEMQVEAPSDSSVIAQQKAMKSLFGDDEKETGEESEIIPTLEPLPPHEVPGHQSVFMNEPRLSDFKQVLLREGIQAEFVGGVLVCNNQVAVRRTETGRIGLEGCLCQDFYRIRDLLYEQYAIV

SEQ ID NO: 882305 - protein, 644 aa, Homo sapiens; identical to SEQ ID NO: 882304

SEQ ID NO: 882306 - protein, 644 aa, Homo sapiens; identical to SEQ ID NO: 882304

SEQ ID NO: 882307 - protein, 731 aa, Homo sapiens
MTSIIKLTTLSGVQEESALCYLLQVDEFRFLLDCGWDEHFSMDIIDSLRKHVHQIDAVLLSHPDPLHLGALPYAVGKLGLNCAIYATIPVYKMGQMFMYDLYQSRHNTEDFTLFTLDDVDAAFDKIQQLKFSQIVNLKGKGHGLSITPLPAGHMIGGTIWKIVKDGEEEIVYAVDFNHKREIHLNGCSLEMLSRPSLLITDSFNATYVQPRRKQRDEQLLTNVLETLRGDGNVLIAVDTAGRVLELAQLLDQIWRTKDAGLGVYSLALLNNVSYNVVEFSKSQVEWMSDKLMRCFEDKRNNPFQFRHLSLCHGLSDLARVPSPKVVLASQPDLECGFSRDLFIQWCQDPKNSIILTYRTTPGTLARFLIDNPSEKITEIELRKRVKLEGKELEEYLEKEKLKKEAAKKLEQSKEADIDSSDESDIEEDIDQPSAHKTKHDLMMKGEGSRKGSFFKQAKKSYPMFPAPEERIKWDEYGEIIKARVTYIDYEGRSDGDSIKKIINQMKPRQLIIVHGPPEASQDLAECCRAFGGKDIKVYMPKLHETVDATSETHIYQVRLKDSLVSSLQFCKAKDAELAWIDGVLDMRVSKVDTGVILEEGELKDDGEDSEMQVEAPSDSSVIAQQKAMKSLFGDDEKETGEESEIIPTLEPLPPHEVPGHQSVFMNEPRLSDFKQVLLREGIQAEFVGGVLVCNNQVAVRRTETGRIGLEGCLCQDFYRIRDLLYEQYAIV

SEQ ID NO: 882308 - protein, 146 aa, Homo sapiens [sequence omitted]

SEQ ID NO: 882309 - protein, 123 aa, Homo sapiens [sequence omitted]

SEQ ID NO: 882310 - protein, 782 aa, Homo sapiens; identical to SEQ ID NO: 882303

SEQ ID NO: 882311 - protein, 644 aa, Homo sapiens; identical to SEQ ID NO: 882304

SEQ ID NO: 882312 - protein, 644 aa, Homo sapiens; identical to SEQ ID NO: 882304

SEQ ID NO: 882313 - protein, 340 aa, Homo sapiens
MKGEGSRKGSFFKQAKKSYPMFPAPEERIKWDEYGEIIKPEDFLVPELQATEEEKSKLESGLTNGDEPMDQDLSDVPTKCISTTESIEIKARVTYIDYEGRSDGDSIKKIINQMKPRQLIIVHGPPEASQDLAECCRAFGGKDIKVYMPKLHETVDATSETHIYQVRLKDSLVSSLQFCKAKDAELAWIDGVLDMRVSKVDTGVILEEGELKDDGEDSEMQVEAPSDSSVIAQQKAMKSLFGDDEKETGEESEIIPTLEPLPPHEVPGHQSVFMNEPRLSDFKQVLLREGIQAEFVGGVLVCNNQVAVRRTETGRIGLEGCLCQDFYRIRDLLYEQYAIV

SEQ ID NO: 882314 - protein, 277 aa, Homo sapiens
MSLCEDMLLCNYRKCRIKLSGYAWVTACSHIFCDQHGSGEFSRSPAICPACNSTLSGKLDIVRTELSPSEEYKAMVLAGLRPEIVLDISSRALAFWTYQVHQERLYQEYNFSKAEGHLKQMEKIYTQQIQSKDVELTSMKGEVTSMKKVLEEYKKKFSDISEKLMERNRQYQKLQGLYDSLRLRNITIANHEGTLEPSMIAQSGVLGFPLGNNSKFPLDNTPVRNRGDGDGDFQFRPFFAGSPTAPEPSNSFFSFVSPSRELEQQQVSSRAFKVKRI

SEQ ID NO: 882315 - protein, 113 aa, Homo sapiens
IPRRTAGSKVQGLYDSLRLRNITIANHEGTLEPSMIAQSGVLGFPLGNNSKFPLDNTPVRNRGDGDGDFQFRPFFAGSPTAPEPSNSFFSFVSPSRELEQQQVSSRAFKVKRI

SEQ ID NO: 882316 - protein, 277 aa, Homo sapiens; identical to SEQ ID NO: 882314

SEQ ID NO: 882317 - protein, 157 aa, Homo sapiens
MEKIYTQQIQSKDVELTSMKGEVTSMKKVLEEYKKKFSDISEKLMERNRQYQKLQGLYDSLRLRNITIANHEGTLEPSMIAQSGVLGFPLGNNSKFPLDNTPVRNRGDGDGDFQFRPFFAGSPTAPEPSNSFFSFVSPSRELEQQQVSSRAFKVKRI

SEQ ID NO: 882318 - protein, 102 aa, Homo sapiens
MSLCEDMLLCNYRKCRIKLSGYAWVTACSHIFCDQHGSGEFSRSPAICPACNSTLSGKLDIVRTELSPSEEYKAMVLAGLRPEIVLDISSRALAFWTYQASL

SEQ ID NO: 882319 - protein, 113 aa, Homo sapiens; identical to SEQ ID NO: 882315

SEQ ID NO: 882320 - protein, 102 aa, Homo sapiens; identical to SEQ ID NO: 810294

SEQ ID NO: 882321 - protein, 113 aa, Homo sapiens
MSLCEDMLLCNYRKCRIKLSGYAWVTACSHIFCDQHGSGEFSRSPAICPACNSTLSGKLDIVRTELSPSEEYKAMVLAGLRPEIVLDISSRALAFWTYQTSGTSLSRIQFTAN

SEQ ID NO: 882322 - protein, 403 aa, Homo sapiens
MQRAVSVVARLGFRLQAFPPALCRPLSCAQEVLRRTPLYDFHLAHGGKMVAFAGWSLPVQYRDSHTDSHLHTRQHCSLFDVSHMLQTKILGSDRVKLMESLVVGDIAELRPNQGTLSLFTNEAGGILDDLIVTNTSEGHLYVVSNAGCWEKDLALMQDKVRELQNQGRDVGLEVLDNALLALQGPTAAQVLQAGVADDLRKLPFMTSAVMEVFGVSGCRVTRCGYTGEDGVEISVPVAGAVHLATAILKNPEVKLAGLAARDSLRLEAGLCLYGNDIDEHTTPVEGSLSWTLGKRRRAAMDFPGAKVIVPQLKGRVQRRRVGLMCEGAPMRAHSPILNMEGTKIGTVTSGCPSPSLKKNVAMGYVPCEYSRPGTMLLVEVRRKQQMAVVSKMPFVPTNYYTLK

SEQ ID NO: 882323 - protein, 386 aa, Homo sapiens
MQRAVSVVARLGFRLQAFPPALCRPLSCAQEVLRRTPLYDFHLAHGGKMVAFAGWSLPVQYRDSHTDSHLHTRQHCSLFDVSHMLQTKILGSDRVKLMESLVVGDIAELRPNQGTLSLFTNEAGGILDDLIVTNTSEGHLYVVSNAGCWEKDLALMQDKVRELQNQGRDVGLEVLDNALLALQGPTAAQVLQAGVADDLRKLPFMTSAVMEVFGVSGCRVTRCGYTGEDGVEISVPVAGAVHLATAILKNPEVKLAGLAARDSLRLEAGLCLYGNDIDEHTTPVEGSLSWTLGKRRRAAMDFPGAKVIVPQLKGRVQRRRVGLMCEGAPMRAHSPILNMEGTKIGTVTSGCPSPSLKKNVAMGYVPCEYSRPGTMLLVELPSGPCF

SEQ ID NO: 882324 - protein, 385 aa, Homo sapiens
MQRAVSVVARLGFRLQAFPPALCRPLSCAQEVLRRTPLYDFHLAHGGKMVAFAGWSLPVQYRDSHTDSHLHTRQHCSLFDVSHMLQTKILGSDRVKLMESLVVGDIAELRPNQGTLSLFTNEAGGILDDLIVTNTSEGHLYVVSNAGCWEKDLALMQDKVRELQNQGRDVGLEVLDNALLALQGPTAAQVLQAGVADDLRKLPFMTSAVMEVFGVSGCRVTRCGYTGEDGVEISVPVAGAVHLATAILEAGLCLYGNDIDEHTTPVEGSLSWTLGKRRRAAMDFPGAKVIVPQLKGRVQRRRVGLMCEGAPMRAHSPILNMEGTKIGTVTSGCPSPSLKKNVAMGYVPCEYSRPGTMLLVEVRRKQQMAVVSKMPFVPTNYYTLK

SEQ ID NO: 882325 - protein, 439 aa, Homo sapiens [sequence omitted]

SEQ ID NO: 882326 - protein, 403 aa, Homo sapiens; identical to SEQ ID NO: 882322

SEQ ID NO: 882327 - protein, 541 aa, Homo sapiens
MQRAVSVVARLGFRLQAFPPALCRPLSCAQEVLRRTPLYDFHLAHGGKMVAFAGWSLPVQYRDSHTDSHLHTRQHCSLFDVSHMLQTKILGSDRVKLMESLVVGDIAELRPNQGTLSLFTNEAGGILDDLIVTNTSEGHLYVVSNAGCWEKDLALMQDKVRELQNQGRDVGLEVLDNALLALQGERAGLGLEPTFAFLAFIDCLAQRPYQEECVEGVIFVCHNFKFCILPSSYLPQGSMGYGTRASSPTCRVRHAQGLFWSLNKALVQLRGMLGPGYLVTGSLGPGPTAAQVLQAGVADDLRKLPFMTSAVMEVFGVSGCRVTRCGYTGEDGVEVCQEVVWGQYRAQDACEGLGVCGTGSFPSALWCFIQISVPVAGAVHLATAILKNPEVKLAGLAARDSLRLEAGLCLYGNDIDEHTTPVEGSLSWTLGKRRRAAMDFPGAKVIVPQLKGRVQRRRVGLMCEGAPMRAHSPILNMEGTKIGTVTSGCPSPSLKKNVAMGYVPCEYSRPGTMLLVEVRRKQQMAVVSKMPFVPTNYYTLK

SEQ ID NO: 882328 - protein, 342 aa, Homo sapiens
MESLVVGDIAELRPNQGTLSLFTNEAGGILDDLIVTNTSEGHLYVVSNAGCWEKDLALMQDKVRELQNQGRDVGLEVLDNALLALQGPTAAQVLQAGVADDLRKLPFMTSAVMEVFGVSGCRVTRCGYTGEDGVEVCQEVVWGQYRAQDACEGLGVCGTGSFPSALWCFIQISVPVAGAVHLATAILKNPEVKLAGLAARDSLRLEAGLCLYGNDIDEHTTPVEGSLSWTLGKRRRAAMDFPGAKVIVPQLKGRVQRRRVGLMCEGAPMRAHSPILNMEGTKIGTVTSGCPSPSLKKNVAMGYVPCEYSRPGTMLLVEVRRKQQMAVVSKMPFVPTNYYTLK

SEQ ID NO: 882329 - protein, 270 aa, Homo sapiens [sequence omitted]

SEQ ID NO: 882330 - protein, 203 aa, Homo sapiens
MQRAVSVVARLGFRLQAFPPALCRPLSCAQEVLRRTPLYDFHLAHGGKMVAFAGWSLPVQYRDSHTDSHLHTRQHCSLFDVSHMLQTKILGSDRVKLMESLVVGDIAELRPNQGTLSLFTNEAGGILDDLIVTNTSEGHLYVVSNAGCWEKDLALMQDKVRELQNQGRDVGLEVLDNALLALQGERAGLGLEPTFAFLASLTA

SEQ ID NO: 882331 - protein, 1397 aa, Homo sapiens
RAVERRWDPCGRDPRLPRGPAQPQRTKEHVRAGEGPSSGRHKAPVAAGPAPRSCPPGLRGGPLGQCAAARPAGPGPQHGAPRTPGGPRAPLLLPLSLLALLALLGGGGGGGAAALPAGCKHDGRPRGAGRAAGAAEGKVVCSSLELAQVLPPDTLPNRTVTLILSNNKISELKNGSFSGLSLLERLDLRNNLISSIDPGAFWGLSSLKRLDLTNNRIGCLNADIFRGLTNLVRLNLSGNLFSSLSQGTFDYLASLRSLEFQTEYLLCDCNILWMHRWVKEKNITVRDTRCVYPKSLQAQPVTGVKQELLTCDPPLELPSFYMTPSHRQVVFEGDSLPFQCMASYIDQDMQVLWYQDGRIVETDESQGIFVEKNMIHNCSLIASALTISNIQAGSTGNWGCHVQTKRGNNTRTVDIVVLESSAQYCPPERVVNNKGDFRWPRTLAGITAYLQCTRNTHGSGIYPGNPQDERKAWRRCDRGGFWADDDYSRCQYANDVTRVLYMFNQMPLNLTNAVATARQLLAYTVEAANFSDKMDVIFVAEMIEKFGRFTKEEKSKELGDVMVDIASNIMLADERVLWLAQREAKACSRIVQCLQRIATYRLAGGAHVYSTYSPNIALEAYVIKSTGFTGMTCTVFQKVAASDRTGLSDYGRRDPEGNLDKQLSFKCNVSNTFSSLALKNTIVEASIQLPPSLFSPKQKRELRPTDDSLYKLQLIAFRNGKLFPATGNSTNLADDGKRRTVVTPVILTKIDGVNVDTHHIPVNVTLRRIAHGADAVAARWDFDLLNGQGGWKSDGCHILYSDENITTIQCYSLSNYAVLMDLTGSELYTQAASLLHPVVYTTAIILLLCLLAVIVSYIYHHSLIRISLKSWHMLVNLCFHIFLTCVVFVGGITQTRNASICQAVGIILHYSTLATVLWVGVTARNIYKQVTKKAKRCQDPDEPPPPPRPMLRFYLIGGGIPIIVCGITAAANIKNYGSRPNAPYCWMAWEPSLGAFYGPASFITFVNCMYFLSIFIQLKRHPERKYELKEPTEEQQRLAANENGEINHQDSMSLSLISTSALENEHTFHSQLLGASLTLLLYVALWMFGALAVSLYYPLDLVFSFVFGATSLSFSAFFVVHHCVNREDVRLAWIMTCCPGRSSYSVQVNVQPPNSNGTNGEAPKCPNSSAESSCTNKSASSFKNSSQGCKLTNLQAAAAQCHANSLPLNSTPQLDNSLTEHSMDNDIKMHVAPLEVQFRTNVHSSRHHKNRSKGHRASRLTVLREYAYDVPTSVEGSVQNGLPKSRLGNNEGHSRSRRAYLAYRERQYNPPQQDSSDACSTLPKSSRNFEKPVSTTSKKDALRKPAVVELENQQKSYGLNLAIQNGPIKSNGQEGPLLGTDSTGNVRTGLWKHETTV

SEQ ID NO: 882332 - protein, 1095 aa, Homo sapiens
MPLKRNNSKYPPLELPSFYMTPSHRQVVFEGDSLPFQCMASYIDQDMQVLWYQDGRIVETDESQGIFVEKNMIHNCSLIASALTISNIQAGSTGNWGCHVQTKRGNNTRTVDIVVLESSAQYCPPERVVNNKGDFRWPRTLAGITAYLQCTRNTHGSGIYPGNPQDERKAWRRCDRGGFWADDDYSRCQYANDVTRVLYMFNQMPLNLTNAVATARQLLAYTVEAANFSDKMDVIFVAEMIEKFGRFTKEEKSKELGDVMVDIASNIMLADERVLWLAQREAKACSRIVQCLQRIATYRLAGGAHVYSTYSPNIALEAYVIKSTGFTGMTCTVFQKVAASDRTGLSDYGRRDPEGNLDKQLSFKCNVSNTFSSLALKNTIVEASIQLPPSLFSPKQKRELRPTDDSLYKLQLIAFRNGKLFPATGNSTNLADDGKRRTVVTPVILTKIDGVNVDTHHIPVNVTLRRIAHGADAVAARWDFDLLNGQGGWKSDGCHILYSDENITTIQCYSLSNYAVLMDLTGSELYTQAASLLHPVVYTTAIILLLCLLAVIVSYIYHHSLIRISLKSWHMLVNLCFHIFLTCVVFVGGITQTRNASICQAVGIILHYSTLATVLWVGVTARNIYKQVTKKAKRCQDPDEPPPPPRPMLRFYLIGGGIPIIVCGITAAANIKNYGSRPNAPYCWMAWEPSLGAFYGPASFITFVNCMYFLSIFIQLKRHPERKYELKEPTEEQQRLAANENGEINHQDSMSLSLISTSALENEHTFHSQLLGASLTLLLYVALWMFGALAVSLYYPLDLVFSFVFGATSLSFSAFFVVHHCVNREDVRLAWIMTCCPGRSSYSVQVNVQPPNSNGTNGEAPKCPNSSAESSCTNKSASSFKNSSQGCKLTNLQAAAAQCHANSLPLNSTPQLDNSLTEHSMDNDIKMHVAPLEVQFRTNVHSSRHHKNRSKGHRASRLTVLREYAYDVPTSVEGSVQNGLPKSRLGNNEGHSRSRRAYLAYRERQYNPPQQDSSDACSTLPKSSRNFEKPVSTTSKKDALRKPAVVELENQQKSYGLNLAIQNGPIKSNGQEGPLLGTDSTGNVRTGLWKHETTV

SEQ ID NO: 882333 - protein, 681 aa, Homo sapiens
PLLADPATGSGNSTNLADDGKRRTVVTPVILTKIDGVNVDTHHIPVNVTLRRIAHGADAVAARWDFDLLNGQGGWKSDGCHILYSDENITTIQCYSLSNYAVLMDLTGSELYTQAASLLHPVVYTTAIILLLCLLAVIVSYIYHHSLIRISLKSWHMLVNLCFHIFLTCVVFVGGITQTRNASICQAVGIILHYSTLATVLWVGVTARNIYKQVTKKAKRCQDPDEPPPPPRPMLRFYLIGGGIPIIVCGITAAANIKNYGSRPNAPYCWMAWEPSLGAFYGPASFITFVNCMYFLSIFIQLKRHPERKYELKEPTEEQQRLAANENGEINHQDSMSLSLISTSALENEHTFHSQLLGASLTLLLYVALWMFGALAVSLYYPLDLVFSFVFGATSLSFSAFFVVHHCVNREDVRLAWIMTCCPGRSSYSVQVNVQPPNSNGTNGEAPKCPNSSAESSCTNKSASSFKNSSQGCKLTNLQAAAAQCHANSLPLNSTPQLDNSLTEHSMDNDIKMHVAPLEVQFRTNVHSSRHHKNRSKGHRASRLTVLREYAYDVPTSVEGSVQNGLPKSRLGNNEGHSRSRRAYLAYRERQYNPPQQDSSDACSTLPKSSRNFEKPVSTTSKKDALRKPAVVELENQQKSYGLNLAIQNGPIKSNGQEGPLLGTDSTGNVRTGLWKHETTV

SEQ ID NO: 882334 - protein, 1379 aa, Homo sapiens
RAVERRWDPCGRDPRLPRGPAQPQRTKEHVRAGEGPSSGRHKAPVAAGPAPRSCPPGLRGGPLGQCAAARPAGPGPQHGAPRTPGGPRAPLLLPLSLLALLALLGGGGGGGAAALPAGCKHDGRPRGAGRAAGAAEGKVVCSSLELAQVLPPDTLPNRTVTLILSNNKISELKNGSFSGLSLLERLDLRNNLISSIDPGAFWGLSSLKRLDLTNNRIGCLNADIFRGLTNLVRLNLSGNLFSSLSQGTFDYLASLRSLEFQTEYLLCDCNILWMHRWVKEKNITVRDTRCVYPKSLQAQPVTGVKQELLTCDPPLELPSFYMTPSHRQVVFEGDSLPFQCMASYIDQDMQVLWYQDGRIVETDESQGIFVEKNMIHNCSLIASALTISNIQAGSTGNWGCHVQTKRGNNTRTVDIVVLESSAQYCPPERVVNNKGDFRWPRTLAGITAYLQCTRNTHGSGIYPGNPQDERKAWRRCDRGGFWADDDYSRCQYANDVTRVLYMFNQMPLNLTNAVATARQLLAYTVEAANFSDKMDVIFVAEMIEKFGRFTKEEKSKELGDVMVDIASNIMLADERVLWLAQREAKACSRIVQCLQRIATYRLAGGAHVYSTYSPNIALEAYVIKSTGFTGMTCTVFQKVAASDRTGLSDYGRRDPEGNLDKQLSFKCNVSNTFSSLALKNTIVEASIQLPPSLFSPKQKRELRPTDDSLYKLQLIAFRNGKLFPATGNSTNLADDGKRRTVVTPVILTKIDGVNVDTHHIPVNVTLRRIAHGADAVAARWDFDLLNGQGGWKSDGCHILYSDENITTIQCYSLSNYAVLMDLTGSELYTQAASLLHPVVYTTAIILLLCLLAVIVSYIYHHSLIRISLKSWHMLVNLCFHIFLTCVVFVGGITQTRNASICQAVGIILHYSTLATVLWVGVTARNIYKQVTKKAKRCQDPDEPPPPPRPMLRFYLIGGGIPIIVCGITAAANIKNYGSRPNAPYCWMAWEPSLGAFYGPASFITFVNCMYFLSIFIQLKRHPERKYELKEPTEEQQRLAANENGEINHQDSMSLSLISTSALENEHTFHSQLLGASLTLLLYVALWMFGALAVSLYYPLDLVFSFVFGATSLSFSAFFVVHHCVNREDVRLAWIMTCCPGRSSYSVQVNVQPPNSNGTNGEAPKCPNSSAESSCTNKSASSFKNSSQGCKLTNLQAAAAQCHANSLPLNSTPQLDNSLTEHSMDNDIKMHVAPLEVQFRTNVHSSRHHKNRSKGHRASRLTVLREYAYDVPTSVEGSVQNGLPTYRERQYNPPQQDSSDACSTLPKSSRNFEKPVSTTSKKDALRKPAVVELENQQKSYGLNLAIQNGPIKSNGQEGPLLGTDSTGNVRTGLWKHETTV

SEQ ID NO: 882335 - protein, 845 aa, Homo sapiens
RAVERRWDPCGRDPRLPRGPAQPQRTKEHVRAGEGPSSGRHKAPVAAGPAPRSCPPGLRGGPLGQCAAARPAGPGPQHGAPRTPGGPRAPLLLPLSLLALLALLGGGGGGGAAALPAGCKHDGRPRGAGRAAGAAEGKVVCSSLELAQVLPPDTLPNRTVTLILSNNKISELKNGSFSGLSLLERLDLRNNLISSIDPGAFWGLSSLKRLDLTNNRIGCLNADIFRGLTNLVRLNLSGNLFSSLSQGTFDYLASLRSLEFQTEYLLCDCNILWMHRWVKEKNITVRDTRCVYPKSLQAQPVTGVKQELLTCDPPLELPSFYMTPSHRQVVFEGDSLPFQCMASYIDQDMQVLWYQDGRIVETDESQGIFVEKNMIHNCSLIASALTISNIQAGSTGNWGCHVQTKRGNNTRTVDIVVLESSAQYCPPERVVNNKGDFRWPRTLAGITAYLQCTRNTHGSGIYPGNPQDERKAWRRCDRGGFWADDDYSRCQYANDVTRVLYMFNQMPLNLTNAVATARQLLAYTVEAANFSDKMDVIFVAEMIEKFGRFTKEEKSKELGDVMVDIASNIMLADERVLWLAQREAKACSRIVQCLQRIATYRLAGGAHVYYNKCPNSSAESSCTNKSASSFKNSSQGCKLTNLQAAAAQCHANSLPLNSTPQLDNSLTEHSMDNDIKMHVAPLEVQFRTNVHSSRHHKNRSKGHRASRLTVLREYAYDVPTSVEGSVQNGLPKSRLGNNEGHSRSRRAYLAYRERQYNPPQQDSSDACSTLPKSSRNFEKPVSTTSKKDALRKPAVVELENQQKSYGLNLAIQNGPIKSNGQEGPLLGTDSTGNVRTGLWKHETTV

SEQ ID NO: 882336 - protein, 210 aa, Homo sapiens
RAVERRWDPCGRDPRLPRGPAQPQRTKEHVRAGEGPSSGRHKAPVAAGPAPRSCPPGLRGGPLGQCAAARPAGPGPQHGAPRTPGGPRAPLLLPLSLLALLALLGGGGGGGAAALPAGCKHDGRPRGAGRAAGAAEGKVVCSSLELAQVLPPDTLPNRTVTLILSNNKISELKNGSFSGLSLLERLDLRNNLISSIDPGAFWGLSSLKRL

SEQ ID NO: 882337 - protein, 225 aa, Homo sapiens
RAVERRWDPCGRDPRLPRGPAQPQRTKEHVRAGEGPSSGRHKAPVAAGPAPRSCPPGLRGGPLGQCAAARPAGPGPQHGAPRTPGGPRAPLLLPLSLLALLALLGGGGGGGAAALPAGCKHDGRPRGAGRAAGAAEGKVVCSSLELAQVLPPDTLPNRTVTLILSNNKISELKNGSFSGLSLLERLLYRKHGAGICSASKEASGSLQSWWKAKLACHMAKTEARM

SEQ ID NO: 882338 - protein, 1216 aa, Homo sapiens
MAGAQPGVHALQLKPVCVSDSLKKGTKFVKWDDDSTIVTPIILRTDPQGFFFYWTDQNKETELLDLSLVKDARCGRHAKAPKDPKLRELLDVGNIGRLEQRMITVVYGPDLVNISHLNLVAFQEEVAKEWTNEVFSLATNLLAQNMSRDAFLEKAYTKLKLQVTPEGRIPLKNIYRLFSADRKRVETALEACSLPSSRNDSIPQEDFTPEVYRVFLNNLCPRPEIDNIFSEFGAKSKPYLTVDQMMDFINLKQRDPRLNEILYPPLKQEQVQVLIEKYEPNNSLARKGQISVDGFMRYLSGEENGVVSPEKLDLNEDMSQPLSHYFINSSHNTYLTAGQLAGNSSVEMYRQVLLSGCRCVELDCWKGRTAEEEPVITHGFTMTTEISFKEVIEAIAECAFKTSPFPILLSFENHVDSPKQQAKMAEYCRLIFGDALLMEPLEKYPLESGVPLPSPMDLMYKILVKNKKKSHKSSEGSGKKKLSEQASNTYSDSSSMFEPSSPGAGEADTESDDDDDDDDCKKSSMDEGTAGSEAMATEEMSNLVNYIQPVKFESFEISKKRNKSFEMSSFVETKGLEQLTKSPVEFVEYNKMQLSRIYPKGTRVDSSNYMPQLFWNAGCQMVALNFQTMDLAMQINMGMYEYNGKSGYRLKPEFMRRPDKHFDPFTEGIVDGIVANTLSVKIISGQFLSDKKVGTYVEVDMFGLPVDTRRKAFKTKTSQGNAVNPVWEEEPIVFKKVVLPTLACLRIAVYEEGGKFIGHRILPVQAIRPGYHYICLRNERNQPLTLPAVFVYIEVKDYVPDTYADVIEALSNPIRYVNLMEQRAKQLAALTLEDEEEVKKEADPGETPSEAPSEARTTPAENGVNHTTTLTPKPPSQALHSQPAPGSVKAPAKTEDLIQSVLTEVEAQTIEELKQQKSFVKLQKKHYKEMKDLVKRHHKKTTDLIKEHTTKYNEIQNDYLRRRAALEKSAKKDSKKKSEPSSPDHGSSTIEQDLAALDAEMTQKLIDLKDKQQQQLLNLRQEQYYSEKYQKREHIKLLIQKLTDVAEECQNNQLKKLKEICEKEKKELKKKMDKKRQEKITEAKSKDKSQMEEEKTEMIRSYIQEVVQYIKRLEEAQSKRQEKLVEKHKEIRQQILDEKPKLQVELEQEYQDKFKRLPLEILEFVQEAMKGKISEDSNHGSAPLSLSSDPGKVNHKTPSSEELGGDIPGKEFDTPL

SEQ ID NO: 882339 - protein, 1115 aa, Homo sapiens
MITVVYGPDLVNISHLNLVAFQEEVAKEWTNEVFSLATNLLAQNMSRDAFLEKAYTKLKLQVTPEGRIPLKNIYRLFSADRKRVETALEACSLPSSRNDSIPQEDFTPEVYRVFLNNLCPRPEIDNIFSEFGAKSKPYLTVDQMMDFINLKQRDPRLNEILYPPLKQEQVQVLIEKYEPNNSLARKGQISVDGFMRYLSGEENGVVSPEKLDLNEDMSQPLSHYFINSSHNTYLTAGQLAGNSSVEMYRQVLLSGCRCVELDCWKGRTAEEEPVITHGFTMTTEISFKEVIEAIAECAFKTSPFPILLSFENHVDSPKQQAKMAEYCRLIFGDALLMEPLEKYPLESGVPLPSPMDLMYKILVKNKKKSHKSSEGSGKKKLSEQASNTYSDSSSMFEPSSPGAGEADTESDDDDDDDDCKKSSMDEGTAGSEAMATEEMSNLVNYIQPVKFESFEISKKRNKSFEMSSFVETKGLEQLTKSPVEFVEYNKMQLSRIYPKGTRVDSSNYMPQLFWNAGCQMVALNFQTMDLAMQINMGMYEYNGKSGYRLKPEFMRRPDKHFDPFTEGIVDGIVANTLSVKIISGQFLSDKKVGTYVEVDMFGLPVDTRRKAFKTKTSQGNAVNPVWEEEPIVFKKVVLPTLACLRIAVYEEGGKFIGHRILPVQAIRPGYHYICLRNERNQPLTLPAVFVYIEVKDYVPDTYADVIEALSNPIRYVNLMEQRAKQLAALTLEDEEEVKKEADPGETPSEAPSEARTTPAENGVNHTTTLTPKPPSQALHSQPAPGSVKAPAKTEDLIQSVLTEVEAQTIEELKQQKSFVKLQKKHYKEMKDLVKRHHKKTTDLIKEHTTKYNEIQNDYLRRRAALEKSAKKDSKKKSEPSSPDHGSSTIEQDLAALDAEMTQKLIDLKDKQQQQLLNLRQEQYYSEKYQKREHIKLLIQKLTDVAEECQNNQLKKLKEICEKEKKELKKKMDKKRQEKITEAKSKDKSQMEEEKTEMIRSYIQEVVQYIKRLEEAQSKRQEKLVEKHKEIRQQILDEKPKLQVELEQEYQDKFKRLPLEILEFVQEAMKGKISEDSNHGSAPLSLSSDPGKVNHKTPSSEELGGDIPGKEFDTPL

SEQ ID NO: 882340 - protein, 793 aa, Homo sapiens
MAEYCRLIFGDALLMEPLEKYPLESGVPLPSPMDLMYKILVKNKKKSHKSSEGSGKKKLSEQASNTYSDSSSMFEPSSPGAGEADTESDDDDDDDDCKKSSMDEGTAGSEAMATEEMSNLVNYIQPVKFESFEISKKRNKSFEMSSFVETKGLEQLTKSPVEFVEYNKMQLSRIYPKGTRVDSSNYMPQLFWNAGCQMVALNFQTMDLAMQINMGMYEYNGKSGYRLKPEFMRRPDKHFDPFTEGIVDGIVANTLSVKIISGQFLSDKKVGTYVEVDMFGLPVDTRRKAFKTKTSQGNAVNPVWEEEPIVFKKVVLPTLACLRIAVYEEGGKFIGHRILPVQAIRPGYHYICLRNERNQPLTLPAVFVYIEVKDYVPDTYADVIEALSNPIRYVNLMEQRAKQLAALTLEDEEEVKKEADPGETPSEAPSEARTTPAENGVNHTTTLTPKPPSQALHSQPAPGSVKAPAKTEDLIQSVLTEVEAQTIEELKQQKSFVKLQKKHYKEMKDLVKRHHKKTTDLIKEHTTKYNEIQNDYLRRRAALEKSAKKDSKKKSEPSSPDHGSSTIEQDLAALDAEMTQKLIDLKDKQQQQLLNLRQEQYYSEKYQKREHIKLLIQKLTDVAEECQNNQLKKLKEICEKEKKELKKKMDKKRQEKITEAKSKDKSQMEEEKTEMIRSYIQEVVQYIKRLEEAQSKRQEKLVEKHKEIRQQILDEKPKLQVELEQEYQDKFKRLPLEILEFVQEAMKGKISEDSNHGSAPLSLSSDPGKVNHKTPSSEELGGDIPGKEFDTPL

SEQ ID NO: 882341 - protein, 1216 aa, Homo sapiens; identical to SEQ ID NO: 882338

SEQ ID NO: 882342 - protein, 1216 aa, Homo sapiens; identical to SEQ ID NO: 882338

SEQ ID NO: 882343 - protein, 1074 aa, Homo sapiens
HTHHSHLRNGFFAELGKPGRRCRSLLLWVLRGGGRYHSVGSRVRAPLEACSLPSSRNDSIPQEDFTPEVYRVFLNNLCPRPEIDNIFSEFGAKSKPYLTVDQMMDFINLKQRDPRLNEILYPPLKQEQVQVLIEKYEPNNSLARKGQISVDGFMRYLSGEENGVVSPEKLDLNEDMSQPLSHYFINSSHNTYLTAGQLAGNSSVEMYRQVLLSGCRCVELDCWKGRTAEEEPVITHGFTMTTEISFKEVIEAIAECAFKTSPFPILLSFENHVDSPKQQAKMAEYCRLIFGDALLMEPLEKYPLESGVPLPSPMDLMYKILVKNKKKSHKSSEGSGKKKLSEQASNTYSDSSSMFEPSSPGAGEADTESDDDDDDDDCKKSSMDEGTAGSEAMATEEMSNLVNYIQPVKFESFEISKKRNKSFEMSSFVETKGLEQLTKSPVEFVEYNKMQLSRIYPKGTRVDSSNYMPQLFWNAGCQMVALNFQTMDLAMQINMGMYEYNGKSGYRLKPEFMRRPDKHFDPFTEGIVDGIVANTLSVKIISGQFLSDKKVGTYVEVDMFGLPVDTRRKAFKTKTSQGNAVNPVWEEEPIVFKKVVLPTLACLRIAVYEEGGKFIGHRILPVQAIRPGYHYICLRNERNQPLTLPAVFVYIEVKDYVPDTYADVIEALSNPIRYVNLMEQRAKQLAALTLEDEEEVKKEADPGETPSEAPSEARTTPAENGVNHTTTLTPKPPSQALHSQPAPGSVKAPAKTEDLIQSVLTEVEAQTIEELKQQKSFVKLQKKHYKEMKDLVKRHHKKTTDLIKEHTTKYNEIQNDYLRRRAALEKSAKKDSKKKSEPSSPDHGSSTIEQDLAALDAEMTQKLIDLKDKQQQQLLNLRQEQYYSEKYQKREHIKLLIQKLTDVAEECQNNQLKKLKEICEKEKKELKKKMDKKRQEKITEAKSKDKSQMEEEKTEMIRSYIQEVVQYIKRLEEAQSKRQEKLVEKHKEIRQQILDEKPKLQVELEQEYQDKFKRLPLEILEFVQEAMKGKISEDSNHGSAPLSLSSDPGKVNHKTPSSEELGGDIPGKEFDTPL

SEQ ID NO: 882344 - protein, 1255 aa, Homo sapiens
MAGAQPGVHALQLKPVCVSDSLKKGTKFVKWDDDSTIVTPIILRTDPQGFFFYWTDQNKETELLDLSLVKDARCGRHAKAPKDPKLRELLDVGNIGRLEQRMITVVYGPDLVNISHLNLVAFQEEVAKEWTNEVFSLATNLLAQNMSRDAFLEKAYTKLKLQVTPEGRIPLKNIYRLFSADRKRVETALEACSLPSSRNDSIPQEDFTPEVYRVFLNNLCPRPEIDNIFSEFGAKSKPYLTVDQMMDFINLKQRDPRLNEILYPPLKQEQVQVLIEKYEPNNSLARKGQISVDGFMRYLSGEENGVVSPEKLDLNEDMSQPLSHYFINSSHNTYLTAGQLAGNSSVEMYRQVLLSGCRCVELDCWKGRTAEEEPVITHGFTMTTEISFKEVIEAIAECAFKTSPFPILLSFENHVDSPKQQAKMAEYCRLIFGDALLMEPLEKYPLESGVPLPSPMDLMYKILVKNKKKSHKSSEGSGKKKLSEQASNTYSDSSSMFEPSSPGAGEADTESDDDDDDDDCKKSSMDEGTAGSEAMATEEMSNLVNYIQPVKFESFEISKKRNKSFEMSSFVETKGLEQLTKSPVEFVEYNKMQLSRIYPKGTRVDSSNYMPQLFWNAGCQMVALNFQTMDLAMQINMGMYEYNGKSGYRLKPEFMRRPDKHFDPFTEGIVDGIVANTLSVKIISGQFLSDKKVGTYVEVDMFGLPVDTRRKAFKTKTSQGNAVNPVWEEEPIVFKKVVLPTLACLRIAVYEEGGKFIGHRILPVQAIRPGYHYICLRNERNQPLTLPAVFVYIEVKDYVPDTYADVIEALSNPIRYVNLMEQRAKQLAALTLEDEEEVKKEADPGETPSEAPSEARTTPAENGVNHTTTLTPKPPSQALHSQPAPGSVKAPAKTEDLIQSVLTEVEAQTIEELKQQKSFVKLQKKHYKEMKDLVKRHHKKTTDLIKEHTTKYNEIQNDYLRRRAALEKSAKKDSKKKSEPSSPDHGSSTIEQDLAALDAEMTQKLIDLKDKQQQQLLNLRQEQYYSEKYQKREHIKLLIQKLTDVAEECQNNQLKKLKEICEKEKKELKKKMDKKRQEKITEAKSKDKSQMEEEKTEMIRSYIQEVVQYIKRLEEAQSKRQEKLVEKHKEIRQQILDEKPKGEGSSSFLSETCHEDPSVPPTLLPPTLKLSSGDHRPSGQLQVELEQEYQDKFKRLPLEILEFVQEAMKGKISEDSNHGSAPLSLSSDPGKVNHKTPSSEELGGDIPGKEFDTPL

SEQ ID NO: 882345 - protein, 1173 aa, Homo sapiens
MAGAQPGVHALQLKPVCVSDSLKKGTKFVKWDDDSTIVTPIILRTDPQGFFFYWTDQNKETELLDLSLVKDARCGRHAKAPKDPKLRELLDVGNIGRLEQRMITVVYGPDLVNISHLNLVAFQEEVAKEWTNEVFSLATNLLAQNMSRDAFLEKAYTKLKLQVTPEGRIPLKNIYRLFSADRKRVETALEACSLPSSRNDSIPQEDFTPEVYRVFLNNLCPRPEIDNIFSEFGAKSKPYLTVDQMMDFINLKQRDPRLNEILYPPLKQEQVQVLIEKYEPNNSLARKGQISVDGFMRYLSGEENGVVSPEKLDLNEDMSQPLSHYFINSSHNTYLTAGQLAGNSSVEMYRQVLLSGCRCVELDCWKGRTAEEEPVITHGFTMTTEISFKEVIEAIAECAFKTSPFPILLSFENHVDSPKQQAKMAEYCRLIFGDALLMEPLEKYPLESGVPLPSPMDLMYKILVKNKKKSHKSSEGSGKKKLSEQASNTYSDSSSMFEPSSPGAGEADTESDDDDDDDDCKKSSMDEGTAGSEAMATEEMSNLVNYIQPVKFESFEISKKRNKSFEMSSFVETKGLEQLTKSPVEFVEYNKMQLSRIYPKGTRVDSSNYMPQLFWNAGCQMVALNFQTMDLAMQINMGMYEYNGKSGYRLKPEFMRRPDKHFDPFTEGIVDGIVANTLSVKIISGQFLSDKKVGTYVEVDMFGLPVDTRRKAFKTKTSQGNAVNPVWEEEPIVFKKVVLPTLACLRIAVYEEGGKFIGHRILPVQAIRPGYHYICLRNERNQPLTLPAVFVYIEVKDYVPDTYADVIEALSNPIRYVNLMEQRAKQLAALTLEDEEEVKKEADPGETPSEAPSEARTTPAENGVNHTTTLTPKPPSQALHSQPAPGSVKAPAKTEDLIQSVLTEVEAQTIEELKQQKSFVKLQKKHYKEMKDLVKRHHKKTTDLIKEHTTKYNEIQNDYLRRRAALEKSAKKDSKKKSEPSSPDHGSSTIEQDLAALDAEMTQKLIDLKDKQQQQLLNLRQEQYYSEKYQKREHIKLLIQKLTDVAEECQNNQLKKLKEICEKEKKELKKKMDKKRQEKITEAKSKDKSQMEEEKTEMIRSYIQEVVQYIKRLEEAQSKRQEKLVEKHKEIRQQILDEKPKGEGSSSFLSETCHEDPSVSPNFTPPNPQALKW

SEQ ID NO: 882346 - protein, 720 aa, Homo sapiens
MAEYCRLIFGDALLMEPLEKYPLESGVPLPSPMDLMYKILVKNKKKSHKSSEGSGKKKLSEQASNTYSDSSSMFEPSSPGAGEADTESDDDDDDDDCKKSSMDEGTAGSEAMATEEMSNLVNYIQPVKFESFEISKKRNKSFEMSSFVETKGLEQLTKSPVEFVEYNKMQLSRIYPKGTRVDSSNYMPQLFWNAGCQMVALNFQTMDLAMQINMGMYEYNGKSGYRLKPEFMRRPDKHFDPFTEGIVDGIVANTLSVKIISGQFLSDKKVGTYVEVDMFGLPVDTRRKAFKTKTSQGNAVNPVWEEEPIVFKKVVLPTLACLRIAVYEEGGKFIGHRILPVQAIRPGYHYICLRNERNQPLTLPAVFVYIEVKDYVPDTYADVIEALSNPIRYVNLMEQRAKQLAALTLEDEEEVKKEADPGETPSEAPSEARTTPAENGVNHTTTLTPKPPSQALHSQPAPGSVKAPAKTEDLIQSVLTEVEAQTIEELKQQKSFVKLQKKHYKEMKDLVKRHHKKTTDLIKEHTTKYNEIQNDYLRRRAALEKSAKKDSKKKSEPSSPDHGSSTIEQDLAALDAEMTQKLIDLKDKQQQQLLNLRQEQYYSEKYQKREHIKLLIQKLTDVAEECQNNQLKKLKEICEKEKKELKKKMDKKRQEKITEAKSKDKSQMEEEKTEMIRSYIQEVVQYIKRLEEAQSKRQEKLVEKHKEIRQQILDEKPKVP

SEQ ID NO: 882347 - protein, 877 aa, Homo sapiens
MAGAQPGVHALQLKPVCVSDSLKKGTKFVKWDDDSTIVTPIILRTDPQGFFFYWTDQNKETELLDLSLVKDARCGRHAKAPKDPKLRELLDVGNIGRLEQRMITVVYGPDLVNISHLNLVAFQEEVAKEWTNEVFSLATNLLAQNMSRDAFLEKAYTKLKLQVTPEGRIPLKNIYRLFSADRKRVETALEACSLPSSRNDSIPQEDFTPEVYRVFLNNLCPRPEIDNIFSEFGAKSKPYLTVDQMMDFINLKQRDPRLNEILYPPLKQEQVQVLIEKYEPNNSLARKGQISVDGFMRYLSGEENGVVSPEKLDLNEDMSQPLSHYFINSSHNTYLTAGQLAGNSSVEMYRQVLLSGCRCVELDCWKGRTAEEEPVITHGFTMTTEISFKEVIEAIAECAFKTSPFPILLSFENHVDSPKQQAKMAEYCRLIFGDALLMEPLEKYPLESGVPLPSPMDLMYKILVKNKKKSHKSSEGSGKKKLSEQASNTYSDSSSMFEPSSPGAGEADTESDDDDDDDDCKKSSMDEGTAGSEAMATEEMSNLVNYIQPVKFESFEISKKRNKSFEMSSFVETKGLEQLTKSPVEFVEYNKMQLSRIYPKGTRVDSSNYMPQLFWNAGCQMVALNFQTMDLAMQINMGMYEYNGKSGYRLKPEFMRRPDKHFDPFTEGIVDGIVANTLSVKIISGQFLSDKKVGTYVEVDMFGLPVDTRRKAFKTKTSQGNAVNPVWEEEPIVFKKVVLPTLACLRIAVYEEGGKFIGHRILPVQAIRPGYHYICLRNERNQPLTLPAVFVYIEVKDYVPDTYADVIEALSNPIRYVNLMEQRAKQLAALTLEDEEEVKKEGGFLHDEIMRLTRNTLEKLMALPLTHVVPIQSKMLS

SEQ ID NO: 882348 - protein, 1169 aa, Homo sapiens
MAGAQPGVHALQLKPVCVSDSLKKGTKFVKWDDDSTIVTPIILRTDPQGFFFYWTDQNKETELLDLSLVKDARCGRHAKAPKDPKLRELLDVGNIGRLEQRMITVVYGPDLVNISHLNLVAFQEEVAKEWTNEVFSLATNLLAQNMSRDAFLEKAYTKLKLQVTPEGRIPLKNIYRLFSADRKRVETALEACSLPSSRNDSIPQEDFTPEVYRVFLNNLCPRPEIDNIFSEFGAKSKPYLTVDQMMDFINLKQRDPRLNEILYPPLKQEQVQVLIEKYEPNNSLARKGQISVDGFMRYLSGEENGVVSPEKLDLNEDMSQPLSHYFINSSHNTYLTAGQLAGNSSVEMYRQVLLSGCRCVELDCWKGRTAEEEPVITHGFTMTTEISFKEVIEAIAECAFKTSPFPILLSFENHVDSPKQQAKMAEYCRLIFGDALLMEPLEKYPLESGVPLPSPMDLMYKILVKNKKKSHKSSEGSGKKKLSEQASNTYSDSSSMFEPSSPGAGEADTESDDDDDDDDCKKSSMDEGTAGSEAMATEEMSNLVNYIQPVKFESFEISKKRNKSFEMSSFVETKGLEQLTKSPVEFVEYNKMQLSRIYPKGTRVDSSNYMPQLFWNAGCQMVALNFQTMDLAMQINMGMYEYNGKSGYRLKPEFMRRPDKHFDPFTEGIVDGIVANTLSVKIISGQFLSDKKVGTYVEVDMFGLPVDTRRKAFKTKTSQGNAVNPVWEEEPIVFKKVVLPTLACLRIAVYEEGGKFIGHRILPVQAIRPGYHYICLRNERNQPLTLPAVFVYIEVKDYVPDTYADVIEALSNPIRYVNLMEQRAKQLAALTLEDEEEVKKEADPGETPSEAPSEARTTPAENGVNHTTTLTPKPPSQALHSQPAPGSVKAPAKTEDLIQSVLTEVEAQTIEELKQQKSFVKLQKKHYKEMKDLVKRHHKKTTDLIKEHTTKYNEIQNDYLRRRAALEKSAKKDSKKKSEPSSPDHGSSTIEQDLAALDAEMTQKLIDLKDKQQQQLLNLRQEQYYSEKYQKREHIKLVEQNKKKKQNKKNVCVGARPWAPARKLFKTTIVGGGGARAPVGVKVNTCGSKEGVPRGKPRAEDTRWGGFLSHQHLKKPRPGGRNTESGVSVRQQNHQRGRASQRRGPHTKRGTAPYSKKASALQRRERLEH

SEQ ID NO: 882349 - protein, 248 aa, Homo sapiens
MAGAQPGVHALQLKPVCVSDSLKKGTKFVKWDDDSTIVTPIILRTDPQGFFFYWTDQNKETELLDLSLVKDARCGRHAKAPKDPKLRELLDVGNIGRLEQRMITVVYGPDLVNISHLNLVAFQEEVAKEWTNEVFSLATNLLAQNMSRDAFLEKAYTKLKLQVTPEGRIPLKNIYRLFSADRKRVETALEACSLPSSRVEKANEAAKSEQSCGKAPPKHFHLHFIKQNKMLEPACYCFFVRCFGIGKI

SEQ ID NO: 882350 - protein, 204 aa, Homo sapiens [sequence omitted]

SEQ ID NO: 882351 - protein, 233 aa, Homo sapiens
HTHHSHLRNGFFAELGKPGRRCRSLLLWVLRGGGRYHSVGSRVRAPLEACSLPSSRNDSIPQEDFTPEVYRVFLNNLCPRPEIDNIFSEFGAKSKPYLTVDQMMDFINLKQRDPRLNEILYPPLKQEQVQVLIEKYEPNNSLARKGQISVDGFMRYLSGEENGVVSPEKLDLNEDMSQPLSHYFINSSHNTYLTGMNFLVLCYFSQSHQISPTSTFCCSEAEVCFLPFPAKCL

SEQ ID NO: 882352 - protein, 736 aa, Homo sapiens
MATEGMILTNHDHQIRVGVLTVSDSCFRNLAEDRSGINLKDLVQDPSLLGGTISAYKIVPDEIEEIKETLIDWCDEKELNLILTTGGTGFAPRDVTPEATKEVIEREAPGMALAMLMGSLNVTPLGMLSRPVCGIRGKTLIINLPGSKKGSQECFQFILPALPHAIDLLRDAIVKVKEVHDELEDLPSPPPPLSPPPTTSPHKQTEDKGVQCEEEEEEKKDSGVASTEDSSSSHITAAAIAAKIPDSIISRGVQVLPRDTASLSTTPSESPRAQATSRLSTASCPTPKVQSRCSSKENILRASHSAVDITKVARRHRMSPFPLTSMDKAFITVLEMTPVLGTEIINYRDGMGRVLAQDVYAKDNLPPFPASVKDGYAVRAADGPGDRFIIGESQAGEQPTQTVMPGQVMRVTTGAPIPCGADAVVQVEDTELIRESDDGTEELEVRILVQARPGQDIRPIGHDIKRGECVLAKGTHMGPSEIGLLATVGVTEVEVNKFPVVAVMSTGNELLNPEDDLLPGKIRDSNRSTLLATIQEHGYPTINLGIVGDNPDDLLNALNEGISRADVIITSGGVSMGEKDYLKQVLDIDLHAQIHFGRVFMKPGLPTTFATLDIDGVRKIIFALPGNPVSAVVTCNLFVVPALRKMQGILDPRPTIIKARLSCDVKLDPRPEYHRCILTWHHQEPLPWAQSTGNQMSSRLMSMRSANGLLMLPPKTEQYVELHKGEVVDVMVIGRL

SEQ ID NO: 882353 - protein, 380 aa, Homo sapiens
MATEGMILTNHDHQIRVGVLTVSDSCFRNLAEDRSGINLKDLVQDPSLLGGTISAYKIVPDEIEEIKKFPTFPFCGLQKGATKEVIEREAPGMALAMLMGSLNVTPLGMLSRPVCGIRGKTLIINLPGSKKGSQECFQFILPALPHAIDLLRDAIVKVKEVHDELEDLPSPPPPLSPPPTTSPHKQTEDKGVQCEEEEEEKKDSGVASTEDSSSSHITAAAIAAKKHPFYTSPAVVMAHGEQPIPGLINYSHHSTDERIPDSIISRGVQVLPRDTASLSTTPSESPRAQATSRLSTASCPTPKVQSRCSSKENILRASHSAVDITKVARRHRMSPFPLTSMDKAFITVLEMTPVLGTEIINYRGTIIFDHCPFFSSFFSK

SEQ ID NO: 882354 - protein, 769 aa, Homo sapiens
MATEGMILTNHDHQIRVGVLTVSDSCFRNLAEDRSGINLKDLVQDPSLLGGTISAYKIVPDEIEEIKETLIDWCDEKELNLILTTGGTGFAPRDVTPEATKEVIEREAPGMALAMLMGSLNVTPLGMLSRPVCGIRGKTLIINLPGSKKGSQECFQFILPALPHAIDLLRDAIVKVKEVHDELEDLPSPPPPLSPPPTTSPHKQTEDKGVQCEEEEEEKKDSGVASTEDSSSSHITAAAIAAKKHPFYTSPAVVMAHGEQPIPGLINYSHHSTDERIPDSIISRGVQVLPRDTASLSTTPSESPRAQATSRLSTASCPTPKVQSRCSSKENILRASHSAVDITKVARRHRMSPFPLTSMDKAFITVLEMTPVLGTEIINYRDGMGRVLAQDVYAKDNLPPFPASVKDGYAVRAADGPGDRFIIGESQAGEQPTQTVMPGQVMRVTTGAPIPCGADAVVQVEDTELIRESDDGTEELEVRILVQARPGQDIRPIGHDIKRGECVLAKGTHMGPSEIGLLATVGVTEVEVNKFPVVAVMSTGNELLNPEDDLLPGKIRDSNRSTLLATIQEHGYPTINLGIVGDNPDDLLNALNEGISRADVIITSGGVSMGEKDYLKQVLDIDLHAQIHFGRVFMKPGLPTTFATLDIDGVRKIIFALPGNPVSAVVTCNLFVVPALRKMQGILDPRPTIIKARLSCDVKLDPRPEYHRCILTWHHQEPLPWAQSTGNQMSSRLMSMRSANGLLMLPPKTEQYVELHKGEVVDVMVIGRL

SEQ ID NO: 882355 - protein, 555 aa, Homo sapiens
QPIPDSIISRGVQVLPRDTASLSTTPSEAARAQATSRPLYSFLPNNKTPVQVQQQGENSQQPIPDSIISRGVQVLPRDTASLSTTPSESPRAQATSRLSTASCPTPKVQSRCSSKENILRASHSAVDITKVARRHRMSPFPLTSMDKAFITVLEMTPVLGTEIINYRDGMGRVLAQDVYAKDNLPPFPASVKDGYAVRAADGPGDRFIIGESQAGEQPTQTVMPGQVMRVTTGAPIPCGADAVVQVEDTELIRESDDGTEELEVRILVQARPGQDIRPIGHDIKRGECVLAKGTHMGPSEIGLLATVGVTEVEVNKFPVVAVMSTGNELLNPEDDLLPGKIRDSNRSTLLATIQEHGYPTINLGIVGDNPDDLLNALNEGISRADVIITSGGVSMGEKDYLKQVLDIDLHAQIHFGRVFMKPGLPTTFATLDIDGVRKIIFALPGNPVSAVVTCNLFVVPALRKMQGILDPRPTIIKARLSCDVKLDPRPEYHRCILTWHHQEPLPWAQSTGNQMSSRLMSMRSANGLLMLPPKTEQYVELHKGEVVDVMVIGRL

SEQ ID NO: 882356 - protein, 722 aa, Homo sapiens
MLGGTISAYKIVPDEIEEIKETLIDWCDEKELNLILTTGGTGFAPRDVTPEATKEVIEREAPGMALAMLMGSLNVTPLGMLSRPVCGIRGKTLIINLPGSKKGSQECFQFILPALPHAIDLLRDAIVKVKEVHDELEDLPSPPPPLSPPPTTSPHKQTEDKGVQCEEEEEEKKDSGVASTEDSSSSHITAAAIAAKKHPFYTSPAVVMAHGEQPIPGLINYSHHSTDERIPDSIISRGVQVLPRDTASLSTTPSESPRAQATSRLSTASCPTPKVQSRCSSKENILRASHSAVDITKVARRHRMSPFPLTSMDKAFITVLEMTPVLGTEIINYRDGMGRVLAQDVYAKDNLPPFPASVKDGYAVRAADGPGDRFIIGESQAGEQPTQTVMPGQVMRVTTGAPIPCGADAVVQVEDTELIRESDDGTEELEVRILVQARPGQDIRPIGHDIKRGECVLAKGTHMGPSEIGLLATVGVTEVEVNKFPVVAVMSTGNELLNPEDDLLPGKIRDSNRSTLLATIQEHGYPTINLGIVGDNPDDLLNALNEGISRADVIITSGGVSMGEKDYLKQVLDIDLHAQIHFGRVFMKPGLPTTFATLDIDGVRKIIFALPGNPVSAVVTCNLFVVPALRKMQGILDPRPTIIKARLSCDVKLDPRPEYHRCILTWHHQEPLPWAQSTGNQMSSRLMSMRSANGLLMLPPKTEQYVELHKGEVVDVMVIGRL

SEQ ID NO: 882357 - protein, 800 aa, Homo sapiens [sequence omitted]

SEQ ID NO: 882358 - protein, 709 aa, Homo sapiens
MATEGMILTNHDHQIRVGVLTVSDSCFRNLAEDRSGINLKDLVQDPSLLGGTISAYKIVPDEIEEIKETLIDWCDEKELNLILTTGGTGFAPRDVTPEATKEVIEREAPGMALAMLMGSLNVTPLGMLSRPVCGIRGKTLIINLPGSKKGSQECFQFILPALPHAIDLLRDAIVKVKEVHDELEDLPSPPPPLSPPPTTSPHKQTEDKGVQCEEEEEEKKDSGVASTEDSSSSHITAAAIAAKKHPFYTSPAVVMAHGEQPIPGLINYSHHSTDERIPDSIISRGVQVLPRDTASLSTTPSESPRAQATSRLSTASCPTPKVQSRCSSKENILRASHSAVDITKVARRHRMSPFPLTSMDKAFITVLEMTPVLGTEIINYRDGMGRVLAQDVYAKDNLPPFPASVKDGYAVRAADGPGDRFIIGESQAGEQPTQTVMPGQVMRVTTGAPIPCGADAVVQVEDTELIRESDDGTEELEVRILVQARPGQDIRPIGHDIKRGECVLAKGTHMGPSEIGLLATVGVTEVEVNKFPVVAVMSTGNELLNPEDDLLPGKIRDSNRSTLLATIQEHGYPTINLGIVGDNPDDLLNALNEGISRADVIITSGGVSMGEKDYLKQVLDIDLHAQIHFGRVFMKPGLPTTFATLDIDGVRKIIFALPGNPVSAVVTCNLFVVPALRKMQGILDPRPTIIKARVMLSNDQKPKWKPGNS

SEQ ID NO: 882359 - protein, 724 aa, Homo sapiens
MATEGMILTNHDHQIRVGVLTVSDSCFRNLAEDRSGINLKDLVQDPSLLGGTISAYKIVPDEIEEIKETLIDWCDEKELNLILTTGGTGFAPRDVTPEATKEVIEREAPGMALAMLMGSLNVTPLGMLSRPVCGIRGKTLIINLPGSKKGSQECFQFILPALPHAIDLLRDAIVKVKEVHDELEDLPSPPPPLSPPPTTSPHKQTEDKGVQCEEEEEEKKDSGVASTEDSSSSHITAAAIAAKKHPFYTSPAVVMAHGEQPIPGLINYSHHSTDERIPDSIISRGVQVLPRDTASLSTTPSESPRAQATSRLSTASCPTPKVQSRCSSKENILRASHSAVDITKVARRHRMSPFPLTSMDKAFITVLEMTPVLGTEIINYRDGMGRVLAQDVYAKDNLPPFPASVKDGYAVRAADGPGDRFIIGESQAGEQPTQTVMPGQVMRVTTGAPIPCGADAVVQVEDTELIRESDDGTEELEVRILVQARPGQDIRPIGHDIKRGECVLAKGTHMGPSEIGLLATVGVTEVEVNKFPVVAVMSTGNELLNPEDDLLPGKIRDSNRSTLLATIQEHGYPTINLGIVGDNPDDLLNALNEGISRADVIITSGGVSMGEKDYLKQVLDIDLHAQIHFGRVFMKPGLPTTFATLDIDGVRKIIFALPGNPVSAVVTCNLFVVPALRKMQGILDPRPTIIKARAQWHSPVIPAPQEAQAGGLHEAKCLRPAWAT

SEQ ID NO: 882360 - protein, 622 aa, Homo sapiens
MATEGMILTNHDHQIRVGVLTVSDSCFRNLAEDRSGINLKDLVQDPSLLGGTISAYKIVPDEIEEIKETLIDWCDEKELNLILTTGGTGFAPRDVTPEATKEVIEREAPGMALAMLMGSLNVTPLGMLSRPVCGIRGKTLIINLPGSKKGSQECFQFILPALPHAIDLLRDAIVKVKEVHDELEDLPSPPPPLSPPPTTSPHKQTEDKGVQCEEEEEEKKDSGVASTEDSSSSHITAAAIAAKKHPFYTSPAVVMAHGEQPIPGLINYSHHSTDERIPDSIISRGVQVLPRDTASLSTTPSESPRAQATSRLSTASCPTPKVQSRCSSKENILRASHSAVDITKVARRHRMSPFPLTSMDKAFITVLEMTPVLGTEIINYRDGMGRVLAQDVYAKDNLPPFPASVKDGYAVRAADGPGDRFIIGESQAGEQPTQTVMPGQVMRVTTGAPIPCGADAVVQVEDTELIRESDDGTEELEVRILVQARPGQDIRPIGHDIKRGECVLAKGTHMGPSEIGLLATVGVTEVEVNKFPVVAVMSTGNELLNPEDDLLPGKIRDSNRSTLLATIQEHGYPTINLGIVGDNPDDLLNALNEGISRADVIITSGGVSMGEKLANNICNFGY

SEQ ID NO: 882361 - protein, 480 aa, Homo sapiens
MATEGMILTNHDHQIRVGVLTVSDSCFRNLAEDRSGINLKDLVQDPSLLGGTISAYKIVPDEIEEIKETLIDWCDEKELNLILTTGGTGFAPRDVTPEATKEVIEREAPGMALAMLMGSLNVTPLGMLSRPVCGIRGKTLIINLPGSKKGSQECFQFILPALPHAIDLLRDAIVKVKEVHDELEDLPSPPPPLSPPPTTSPHKQTEDKGVQCEEEEEEKKDSGVASTEDSSSSHITAAAIAAKKHPFYTSPAVVMAHGEQPIPGLINYSHHSTDERIPDSIISRGVQVLPRDTASLSTTPSESPRAQATSRLSTASCPTPKVQSRCSSKENILRASHSAVDITKVARRHRMSPFPLTSMDKAFITVLEMTPVLGTEIINYRDGMGRVLAQDVYAKDNLPPFPASVKDGYAVRAADGPGDRFIIGESQAGEQPTQTVMPGQVMRVTTGAPIPCGADAVVQVEDTELIRESDDVRHHQVLLC

SEQ ID NO: 882362 - protein, 381 aa, Homo sapiens
MDGVGVPASMYGDPHAPRPIPPVHHLNHGPPLHATQHYGAHAPHPNVMPASMGSAVNDALKRDKDAIYGHPLFPLLALVFEKCELATCTPREPGVAGGDVCSSDSFNEDIAVFAKQVRAEKPLFSSNPELDNLMIQAIQVLRFHLLELEKVHELCDNFCHRYISCLKGKMPIDLVIDERDGSSKSDHEELSGSSTNLADHNPSSWRDHDDATSTHSAGTPGPSSGGHASQSGDNSSEQGDGLDNSVASPGTGDDDDPDKDKKRQKKRGIFPKVATNIMRAWLFQHLTHPYPSEEQKKQLAQDTGLTILQVNNWFINARRRIVQPMIDQSNRAVSQGAAYSPEGQPMGSFVLDGQQHMGIRPAGPMSGMGMNMGMDGQWHYM

SEQ ID NO: 882363 - protein, 307 aa, Homo sapiens
MAQRYDELPHYGGMDGVGVPASMYGDPHAPRPIPPVHHLNHGPPLHATQHYGAHAPHPNVMPASMGSAVNDALKRDKDAIYGHPLFPLLALVFEKCELATCTPREPGVAGGDVCSSDSFNEDIAVFAKQVRAEKPLFSSNPELDNLMIQAIQVLRFHLLELEKVHELCDNFCHRYISCLKGKMPIDLVIDERDGSSKSDHEELSGSSTNLADHNPSSWRDHDDATSTHSAGTPGPSSGGHASQSGDNSSEQGDGLDNSVASPGTGDDDDPDKDKKRQKKRGIFPKVATNIMRAWLFQHLTLLMPEEE

SEQ ID NO: 882364 - protein, 394 aa, Homo sapiens
MAQRYDELPHYGGMDGVGVPASMYGDPHAPRPIPPVHHLNHGPPLHATQHYGAHAPHPNVMPASMGSAVNDALKRDKDAIYGHPLFPLLALVFEKCELATCTPREPGVAGGDVCSSDSFNEDIAVFAKQVRAEKPLFSSNPELDNLMIQAIQVLRFHLLELEKVHELCDNFCHRYISCLKGKMPIDLVIDERDGSSKSDHEELSGSSTNLADHNPSSWRDHDDATSTHSAGTPGPSSGGHASQSGDNSSEQGDGLDNSVASPGTGDDDDPDKDKKRQKKRGIFPKVATNIMRAWLFQHLTHPYPSEEQKKQLAQDTGLTILQVNNWFINARRRIVQPMIDQSNRAVSQGAAYSPEGQPMGSFVLDGQQHMGIRPAGPMSGMGMNMGMDGQWHYM

SEQ ID NO: 882365 - protein, 401 aa, Homo sapiens
MAQRYDELPHYGGMDGVGVPASMYGDPHAPRPIPPVHHLNHGPPLHATQHYGAHAPHPNVMPASMGSAVNDALKRDKDAIYGHPLFPLLALVFEKCELATCTPREPGVAGGDVCSSDSFNEDIAVFAKQVRAEKPLFSSNPELDNLMIQAIQVLRFHLLELEKVHELCDNFCHRYISCLKGKMPIDLVIDERDGSSKSDHEELSGSSTNLADHNPSSWRDHDDATSTHSAGTPGPSSGGHASQSGDNSSEQGDGLDNSVASPGTGDDDDPDKDKKRQKKRGIFPKVATNIMRAWLFQHLTHPYPSEEQKKQLAQDTGLTILQVNNWFINARRRIVQPMIDQSNRAGFLLDPSVSQGAAYSPEGQPMGSFVLDGQQHMGIRPAGPMSGMGMNMGMDGQWHYM

SEQ ID NO: 882366 - protein, 477 aa, Homo sapiens
MAQRYDELPHYGGMDGVGVPASMYGDPHAPRPIPPVHHLNHGPPLHATQHYGAHAPHPNVMPASMGSAVNDALKRDKDAIYGHPLFPLLALVFEKCELATCTPREPGVAGGDVCSSDSFNEDIAVFAKQVRAEKPLFSSNPELDNLMIQAIQVLRFHLLELEKVHELCDNFCHRYISCLKGKMPIDLVIDERDGSSKSDHEELSGSSTNLADHNPSSWRDHDDATSTHSAGTPGPSSGGHASQSGDNSSEQGDGLDNSVASPGTGDDDDPDKDKKRQKKRGIFPKVATNIMRAWLFQHLTHPYPSEEQKKQLAQDTGLTILQVNNWFINARRRIVQPMIDQSNRAGFLLDPSVSQGAAYSPEGQPMGSFVLDGQQHMGIRPAGLQSMPGDYVSQGGPMGMSMAQPSYTPPQMTPHPTQLRHGPPMHSYLPSHPHHPAMMMHGGPPTHPGMTMSAQSPTMLNSVDPNVGGQVMDIHAQ

SEQ ID NO: 882367 - protein, 470 aa, Homo sapiens
MAQRYDELPHYGGMDGVGVPASMYGDPHAPRPIPPVHHLNHGPPLHATQHYGAHAPHPNVMPASMGSAVNDALKRDKDAIYGHPLFPLLALVFEKCELATCTPREPGVAGGDVCSSDSFNEDIAVFAKQVRAEKPLFSSNPELDNLMIQAIQVLRFHLLELEKVHELCDNFCHRYISCLKGKMPIDLVIDERDGSSKSDHEELSGSSTNLADHNPSSWRDHDDATSTHSAGTPGPSSGGHASQSGDNSSEQGDGLDNSVASPGTGDDDDPDKDKKRQKKRGIFPKVATNIMRAWLFQHLTHPYPSEEQKKQLAQDTGLTILQVNNWFINARRRIVQPMIDQSNRAVSQGAAYSPEGQPMGSFVLDGQQHMGIRPAGLQSMPGDYVSQGGPMGMSMAQPSYTPPQMTPHPTQLRHGPPMHSYLPSHPHHPAMMMHGGPPTHPGMTMSAQSPTMLNSVDPNVGGQVMDIHAQ

SEQ ID NO: 882368 - protein, 212 aa, Homo sapiens [sequence omitted]

SEQ ID NO: 882369 - protein, 155 aa, Homo sapiens
MFSLMYFYFFLLGDGLDNSVASPGTGDDDDPDKDKKRQKKRGIFPKVATNIMRAWLFQHLTHPYPSEEQKKQLAQDTGLTILQVNNWFINARRRIVQPMIDQSNRAVSQGAAYSPEGQPMGSFVLDGQQHMGIRPAGPMSGMGMNMGMDGQWHYM

SEQ ID NO: 882370 - protein, 314 aa, Homo sapiens [sequence omitted]

SEQ ID NO: 882371 - protein, 276 aa, Homo sapiens
MDGVGVPASMYGDPHAPRPIPPVHHLNHGPPLHATQHYGAHAPHPNVMPASMGSAVNDALKRDKDAIYGHPLFPLLALVFEKCELATCTPREPGVAGGDVCSSDSFNEDIAVFAKQVRAEKPLFSSNPELDNLMIQAIQVLRFHLLELEKVHELCDNFCHRYISCLKGKMPIDLVIDERDGSSKSDHEELSGSSTNLADHNPSSWRDHDDATSTHSAGTPGPSSGGHASQSGDNSSEQEFFRFIPIFQMKWLGLGEGQLLDCHDRKRKQKNEDKAI

SEQ ID NO: 882372 - protein, 582 aa, Homo sapiens
MLLGAEAVGLVKECNDNTMRAFTYRTRQNFKGFDDNNDDFLTMAECQFIIKHELENLRAKDEKMIPGYPQAKLYPGKSLLRRLLTSGIVIQVFPLHDSEALKKLEDTWYTRFALKYQPIDSIRGYFGETIALYFGFLEYFTFALIPMAVIGLPYYLFVWEDYDKYVIFASFNLIWSTVILELWKRGCANMTYRWGTLLMKRKFEEPRPGFHGVLGINSITGKEEPLYPSYKRQLRIYLVSLPFVCLCLYFSLYVMMIYFDMEVWALGLHENSGSEWTSVLLYVPSIIYAIVIEIMNRLYRYAAEFLTSWENHRLESAYQNHLILKVLVFNFLNCFASLFYIAFVLKDMKLLRQSLATLLITSQILNQIMESFLPYWLQRKHGVRVKRKVQALKADIDATLYEQVILEKEMGTYLGTFDDYLELFLQFGYVSLFSCVYPLAAAFAVLNNFTEVNSDALKMCRVFKRPFSEPSANIGVWQLAFETMSVISVVTNCALIGMSPQVNAVFPESKADLILIVVAVEHALLALKFILAFAIPDKPRHIQMKLARLEFESLEALKQQQMKLVTENLKEEPMESGKEKAT

SEQ ID NO: 882373 - protein, 660 aa, Homo sapiens
MKVTLSALDTSESSFTPLVVIELAQDVKEETKEWLKNRIIAKKKDGGAQLLFRPLLNKYEQETLENQNLYLVGASKIRMLLGAEAVGLVKECNDNTMRAFTYRTRQNFKGFDDNNDDFLTMAECQFIIKHELENLRAKDEKMIPGYPQAKLYPGKSLLRRLLTSGIVIQVFPLHDSEALKKLEDTWYTRFALKYQPIDSIRGYFGETIALYFGFLEYFTFALIPMAVIGLPYYLFVWEDYDKYVIFASFNLIWSTVILELWKRGCANMTYRWGTLLMKRKFEEPRPGFHGVLGINSITGKEEPLYPSYKRQLRIYLVSLPFVCLCLYFSLYVMMIYFDMEVWALGLHENSGSEWTSVLLYVPSIIYAIVIEIMNRLYRYAAEFLTSWENHRLESAYQNHLILKVLVFNFLNCFASLFYIAFVLKDMKLLRQSLATLLITSQILNQIMESFLPYWLQRKHGVRVKRKVQALKADIDATLYEQVILEKEMGTYLGTFDDYLELFLQFGYVSLFSCVYPLAAAFAVLNNFTEVNSDALKMCRVFKRPFSEPSANIGVWQLAFETMSVISVVTNCALIGMSPQVNAVFPESKADLILIVVAVEHALLALKFILAFAIPDKPRHIQMKLARLEFESLEALKQQQMKLVTENLKEEPMESGKEKAT

SEQ ID NO: 882374 - protein, 470 aa, Homo sapiens
MKVTLSALDTSESSFTPLVVIELAQDVKEETKEWLKNRIIAKKKDGGAQLLFRPLLNKYEQETLENQNLYLVGASKIRMLLGAEAVGLVKECNDNTMRAFTYRTRQNFKGFDDNNDDFLTMAECQFIIKHELENLRAKDEKMIPGYPQAKLYPGKSLLRRLLTSGIVIQVFPLHDSEALKKLEDTWYTRFALKYQPIENHRLESAYQNHLILKVLVFNFLNCFASLFYIAFVLKDMKLLRQSLATLLITSQILNQIMESFLPYWLQRKHGVRVKRKVQALKADIDATLYEQVILEKEMGTYLGTFDDYLELFLQFGYVSLFSCVYPLAAAFAVLNNFTEVNSDALKMCRVFKRPFSEPSANIGVWQLAFETMSVISVVTNCALIGMSPQVNAVFPESKADLILIVVAVEHALLALKFILAFAIPDKPRHIQMKLARLEFESLEALKQQQMKLVTENLKEEPMESGKEKAT

SEQ ID NO: 882375 - protein, 411 aa, Homo sapiens
MKVTLSALDTSESSFTPLVVIELAQDVKEETKEWLKNRIIAKKKDGGAQLLFRPLLNKYEQETLENQNLYLVGASKIRMLLGAEAVGLVKECNDNTMRAFTYRTRQNFKGFDDNNDDFLTMAECQFIIKHELENLRAKDEKMIPGYPQAKLYPGKSLFQLPQLLCLTLLYCLCLERYEAFAPELGHSPNYLPDPQPNYGIFSSLLAPKEAWCAVKRKVQALKADIDATLYEQVILEKEMGTYLGTFDDYLELFLQFGYVSLFSCVYPLAAAFAVLNNFTEVNSDALKMCRVFKRPFSEPSANIGVWQLAFETMSVISVVTNCALIGMSPQVNAVFPESKADLILIVVAVEHALLALKFILAFAIPDKPRHIQMKLARLEFESLEALKQQQMKLVTENLKEEPMESGKEKAT

SEQ ID NO: 882376 - protein, 491 aa, Homo sapiens
MKVTLSALDTSESSFTPLVVIELAQDVKEETKEWLKNRIIAKKKDGGAQLLFRPLLNKYEQETLENQNLYLVGASKIRMLLGAEAVGLVKECNDNTMRAFTYRTRQNFKGFDDNNDDFLTMAECQFIIKHELENLRAKDEKMIPGYPQAKLYPGKSLLRRLLTSGIVIQVFPLHDSEALKKLEDTWYTRFALKYQPIDSIRGYFGETIALYFGFLEYFTFALIPMAVIGLPYYLFVWEDYDKYVIFASFNLIWSTVILELWKRGCANMTYRWGTLLMKRKFEEPRPGFHGVLGINSITGKEEPLYPSYKRQLRIYLVSLPFVCLCLYFSLYVMMIYFDMEVWALGLHENSGSEWTSVLLYVPSIIYAIVIEIMNRLYRYAAEFLTSWENHRLESAYQNHLILKVLVFNFLNCFASLFYIAFVLKDMKLLRQSLATLLITSQILNQIMESFLPYWLQRKHGVRVKRKVQALKADIDATLYEQVILCREHLKD

SEQ ID NO: 882377 - protein, 314 aa, Homo sapiens
MKVTLSALDTSESSFTPLVVIELAQDVKEETKEWLKNRIIAKKKDGGAQLLFRPLLNKYEQETLENQNLYLVGASKIRMLLGAEAVGLVKECNDNTMRAFTYRTRQNFKGFDDNNDDFLTMAECQFIIKHELENLRAKDEKMIPGYPQAKLYPGKSLLRRLLTSGIVIQVFPLHDSEALKKLEDTWYTRFALKYQPIDSIRGYFGETIALYFGFLEYFTFALIPMAVIGLPYYLFVWEDYDKYVIFASFNLIWSTVILELWKRGCANMTYRWGTLLMKRKFEEPRPGFHGVLDLFPGSLLQYINRPFININNSN

SEQ ID NO: 882378 - protein, 338 aa, Homo sapiens
AIRAKCMFFKDKTMLCPMHKIKGPCEQELSSFAVFRRVYIERDEVKQIASIIQRGERLHMFRVGGLVFHAIGQLLPHQMADFHSATALYPVGYEATRIYWSLRTNNRRCCYRCSIGENNGRPEFVIKVIEQGLEDLVFTDASPQAVWNRIIEPVAAMRKEADMLRLFPEYLKGEELFGLTVHAVLRIAESLPGVESCQNYLFRYGRHPLMELPLMINPTGCARSEPKILTHYKRPHTLNSTSMSKAYQSTFTGETNTPYSKQFVHSKSSQYRRLRTEWKNNVYLARSRIQGLGLYAAKDLEKHTMVIEYIGTIIRNEVANRREKIYEEQNRGIYMFRI

SEQ ID NO: 882379 - protein, 136 aa, Homo sapiens
MSSASQGGREARAFPEPGEAGRPGLTCSGRASKGHIRPGPSPDDFSVVFCTRKTPGDRGDGSGILSLTALNELNLSFDPFADASKGDDLLPAGTEDYIHIRIQQRNGRKTLTTVQGIADDYDKKKLVKAFKKVGLQ

SEQ ID NO: 882380 - protein, 135 aa, Homo sapiens
LSRRRGFSSLPLEPPRFPTFRSPLPAFSRHRRRRLPQAVSTEEKESYRMSAIQNLHSFDPFADASKGDDLLPAGTEDYIHIRIQQRNGRKTLTTVQGIADDYDKKKLVKAFKKKFACNGTVIEHPEYGRSNSATG

SEQ ID NO: 882381 - protein, 135 aa, Homo sapiens; identical to SEQ ID NO: 882380

SEQ ID NO: 882382 - protein, 142 aa, Homo sapiens
LSRRRGFSSLPLEPPRFPTFRSPLPAFSRHRRRRLPQAVSTEEKESYRMSAIQNLHSFDPFADASKGDDLLPAGTEDYIHIRIQQRNGRKTLTTVQGIADDYDKKKLVKAFKKKFACNGTVIEHPEYGRSNSATVMSIFWSP

SEQ ID NO: 882383 - protein, 140 aa, Homo sapiens
LSRRRGFSSLPLEPPRFPTFRSPLPAFSRHRRRRLPQAVSTEEKESYRMSAIQNLHSFDPFADASKGDDLLPAGTEDYIHIRIQQRNGRKTLTTVQGIADDYDKKKLVKAFKKKFACNGTVIEHPEYGRSCATETVQAAA

SEQ ID NO: 882384 - protein, 112 aa, Homo sapiens
LSRRRGFSSLPLEPPRFPTFRSPLPAFSRHRRRRLPQAVSTEEKESYRMSAIQNLHSFDPFADASKGDDLLPAGTEDYIHIRIQQRNGRKTLTTVQGIADDYDKKKLVKAFK

SEQ ID NO: 882385 - protein, 113 aa, Homo sapiens
RLREPLCDLTASKLVLAPGGAEPCPRWSAIQNLHSFDPFADASKGDDLLPAGTEDYIHIRIQQRNGRKTLTTVQGIADDYDKKKLVKAFKKKFACNGTVIEHPEYGRSNSATG

SEQ ID NO: 882386 - protein, 154 aa, Homo sapiens
MSSASQGGREARAFPEPGEAGRPGLTCSGRASKGHIRPGPSPDDFSVVFCTRKTPGDRGDGSGILSLTALNELNLSFDPFADASKGDDLLPAGTEDYIHIRIQQRNGRKTLTTVQGIADDYDKKKLVKAFKKKFACNGTVIEHPEYGRSNSATG

SEQ ID NO: 882387 - protein, 505 aa, Homo sapiens
MTKAQESLTLEDVAVDFTWEEWQFLSPAQKDLYRDVMLENYSNLVSVGYQAGKPDALTKLEQGEPLWTLEDEIHSPAHPEIEKADDHLQQPLQNQKILKRTGQRYEHGRTLKSYLGLTNQSRRYNRKEPAEFNGDGAFLHDNHEQMPTEIEFPESRKPISTKSQFLKHQQTHNIEKAHECTDCGKAFLKKSQLTEHKRIHTGKKPHVCSLCGKAFYKKYRLTEHERAHRGEKPHGCSLCGKAFYKRYRLTEHERAHKGEKPYGCSECGKAFPRKSELTEHQRIHTGIKPHQCSECGRAFSRKSLLVVHQRTHTGEKPHTCSECGKGFIQKGNLNIHQRTHTGEKPYGCIDCGKAFSQKSCLVAHQRYHTGKTPFVCPECGQPCSQKSGLIRHQKIHSGEKPYKCSDCGKAFLTKTMLIVHHRTHTGERPYGCDECEKAYFYMSCLVKHKRIHSREKRGDSVKVENPSTASHSLSPSEHVQGKSPVNMVTVAMVAGQCEFAHILHS

SEQ ID NO: 882388 - protein, 487 aa, Homo sapiens
MTKAQESLTLEDVAVDFTWEEWQFLSPAQKDLYRDVMLENYSNLVSVGYQAGKPDALTKLEQGEPLWTLEDEIHSPAHPEIEKADDHLQQPLQNQKILKRTGQRYEHGRTLKSYLGLTNQSRRYNRKEPAEFNGDGAFLHDNHEQMPTEIEFPESRKPISTKSQFLKHQQTHNIEKAHECTDCGKAFLKKSQLTEHKRIHTGKKPHVCSLCGKAFYKKYRLTEHERAHRGEKPHGCSLCGKAFYKRYRLTEHERAHKGEKPYGCSECGKAFPRKSELTEHQRIHTGIKPHQCSECGRAFSRKSLLVVHQRTHTGEKPHTCSECGKGFIQKGNLNIHQRTHTGEKPYGCIDCGKAFSQKSCLVAHQRYHTGKTPFVCPECGQPCSQKSGLIRHQKIHSGEKPYKCSDCGKAFLTKTMLIVHHRTHTGERPYGCDECEKAYFYMSCLVKHKRIHSREKRGDSVKVENPSTASHSLSPSEHVQGKALLIW

SEQ ID NO: 882389 - protein, 166 aa, Homo sapiens
MNAAVSKTVAVASGAASTPISISTGAPTVRQVPVSTTVVSTSQAGKLPTRITVPLSVISQPMKGKSVVTAPIIKGNLGANLSGLGRNIILTTMPAGTKLIAGNKPVSFLTAQQLQQLQQQGQATQVRIQTVPASHLQQGTASGSSKAVSTVVVTTAPSPKQAPEQQ

SEQ ID NO: 882390 - protein, 98 aa, Homo sapiens
SPGLQEFGTRANLSGLGRNIILTTMPAGTKLIAGNKPVSFLTAQQLQQLQQQGQATQVRIQTVPASHLQQGTASGSSKAVSTVVVTTAPSPKQAPEQQ

SEQ ID NO: 882391 - protein, 166 aa, Homo sapiens; identical to SEQ ID NO: 882389

SEQ ID NO: 882392 - protein, 166 aa, Homo sapiens; identical to SEQ ID NO: 882389

SEQ ID NO: 882393 - protein, 198 aa, Homo sapiens
LIETGGKMHDSNNVEKDITPSELPANPGCLHSKEHSIKATLIWRLFFLIMFLTIIVCGMVAALSAIRANCHQEPSVCLQAACPESWIGFQRKCFYFSDDTKNWTSSQRFCDSQDADLAQVESFQELNFLLRYKGPSDHWIGLSREQGQPWKWINGTEWTRQFPILGAGECAYLNDKGASSARHYTERKWICSKSDIHV

SEQ ID NO: 882394 - protein, 161 aa, Homo sapiens
LIETGGKMHDSNNVEKDITPSELPANPGCLHSKEHSIKATLIWRLFFLIMFLTIIVCGMVAALSAIRANCHQEPSVCLQAACPESWIGFQRKCFYFSDDTKNWTSSQRFCDSQDADLAQVESFQELNFLLRYKGPSDHWIGLSREQGQPWKWINGTEWTRQ

SEQ ID NO: 882395 - protein, 350 aa, Homo sapiens
MGSKVMSYVVAGRGTCAQELLFIQPSDILRQEQYGAPWCDSVLRGCSLEQHSFIFVCLVSYLSVCRHPMEDSMDMDMSPLRPQNYLFSCELKADKDDHFKVDNDENETSYLLRTVSSGAGAKDELHIVEAEAMNDEGSPIKVTLATLKMSVQPTVSLGGFEITPPVDLRLKCGSGPVHISGQHLVAVKEGAESEDEEEEDVKLLSISGKQSAPGGGQKKVKLAAAADDDDDEDDDDDDDEEAEEKAPVKKSIRDTPAKNAQKSNQNGKDSKPSSTPRSKGQESFKKQEKSPKTPKGSSSVEDIKAKMQASIEKRGSLPKVETKFINYVKNFFWMTDQEAIQDLWQWRKSL

SEQ ID NO: 882396 - protein, 198 aa, Homo sapiens; identical to SEQ ID NO: 882393

SEQ ID NO: 882397 - protein, 350 aa, Homo sapiens; identical to SEQ ID NO: 882395

SEQ ID NO: 882398 - protein, 201 aa, Homo sapiens
LIETGGKMHDSNNVEKDITPSELPANPGCLHSKEHSIKATLIWRLFFLIMFLTIIVCGMVAALSAIRANCHQEPSVCLQAACPESWIGFQRKCFYFSDDTKNWTSSQRFCDSQDADLAQVESFQELNFLLRYKGPSDHWIGLSREQGQPWKWINGTEWTRQLVMKEDGANLYVAKVSQVPRMNPRPVMVSYPGSRRVCLFE

SEQ ID NO: 882399 - protein, 350 aa, Homo sapiens; identical to SEQ ID NO: 882395

SEQ ID NO: 882400 - protein, 350 aa, Homo sapiens; identical to SEQ ID NO: 882395

SEQ ID NO: 882401 - protein, 161 aa, Homo sapiens; identical to SEQ ID NO: 882394

SEQ ID NO: 882402 - protein, 350 aa, Homo sapiens; identical to SEQ ID NO: 882395

SEQ ID NO: 882403 - protein, 350 aa, Homo sapiens; identical to SEQ ID NO: 882395

SEQ ID NO: 882404 - protein, 201 aa, Homo sapiens; identical to SEQ ID NO: 882398

SEQ ID NO: 882405 - protein, 139 aa, Homo sapiens
LIETGGKMHDSNNVEKDITPSELPANPGCLHSKEHSIKATLIWRLFFLIMFLTIIVCGMVAALSAIRANCHQEPSVCLQAACPESWIGFQRKCFYFSDDTKNWTSSQRFCDSQDADLAQVESFQELVSYPGSRRVCLFE

SEQ ID NO: 882406 - protein, 98 aa, Homo sapiens
VWPEPLGEIVRRGRAVEVLRLGAVPARLTGHLHAQGTPPYVINLDPAVHEVPFPANIDIRDTVKYKEVMKQYGLGPNGGIVTSLNLFATRFDQVFVKS

SEQ ID NO: 882407 - protein, 382 aa, Homo sapiens
GVGGARRKMAASAAAAELQASGGPRHPVCLLVLGMAGSGKTTFVQRLTGHLHAQGTPPYVINLDPAVHEVPFPANIDIRDTVKYKEVMKQYGLGPNGGIVTSLNLFATRFDQVMKFIEKAQNMSKYVLIDTPGQIEVFTWSASGTIITEALASSFPTVVIYVMDTSRSTNPVTFMSNMLYACSILYKTKLPFIVVMNKTDIIDHSFAVEWMQDFEAFQDALNQETTYVSNLTRSMSLVLDEFYSSLRVVGVSAVLGTGLDELFVQVTSAAEEYEREYRPEYERLKKSLANAESQQQREQLERLRKDMGSVALDAGTAKDSLSPVLHPSDLILTRGTLDEEDEEADSDTDDIDHRVTEESHEEPAFQNFMQESMAQYWKRNNK

SEQ ID NO: 882408 - protein, 382 aa, Homo sapiens; identical to SEQ ID NO: 882407

SEQ ID NO: 882409 - protein, 346 aa, Homo sapiens
GVGGARRKMAASAAAAELQASGGPRHPVCLLVLGMAGSGKTTFVQRLTGHLHAQGTPPYVINLDPAVHEVPFPANIDIRDTVKYKEVMKQYGLGPNGGIVTSLNLFATRFDQVMKFIEKAQNMSKYVLIDTPGQIEVFTWSASGTIITEALASSFPTVVIYVMDTSRSTNPVTFMSNMLYACSILYKTKLPFIVVMNKTDIIDHSFAVEWMQDFEAFQDALNQETTYVSNLTRSMSLVLDEFYSSLRVVGVSAVLGTGLDELFVQVTSAAEEYEREYRPEYERLKKSLANAESQQQREQLERLRKDMGSVALDAGTAKVTEESHEEPAFQNFMQESMAQYWKRNNK

SEQ ID NO: 882410 - protein, 296 aa, Homo sapiens
GVGGARRKMAASAAAAELQASGGPRHPVCLLVLGMAGSGKTTFVQRLTGHLHAQGTPPYVINLDPAVHEVPFPANIDIRDTVKYKEVMKQYGLGPNGGIVTSLNLFATRFDQVMKFIEKAQNMSKYVLIDTPGQIEVFTWSASGTIITEALASSFPTVVIYVMDTSRSTNPVTFMSNMLYACSILYKTKLPFIVVMNKTDIIDHSFAVEWMQDFEAFQDALNQETTYVSNLTRSMSLVLDEFYSSLRVVGVSAVLGTGLDELFVQVTSAAEEYERPTQRANSRENNWNAFEKIWVL

SEQ ID NO: 882411 - protein, 382 aa, Homo sapiens; identical to SEQ ID NO: 882407

SEQ ID NO: 882412 - protein, 115 aa, Homo sapiens
TVMPKNMKEYRPEYERLKKSLANAESQQQREQLERLRKDMGSVALDAGTAKDSLSPVLHPSDLILTRGTLDEEDEEADSDTDDIDHRVTEESHEEPAFQNFMQESMAQYWKRNNK

SEQ ID NO: 882413 - protein, 382 aa, Homo sapiens; identical to SEQ ID NO: 882407

SEQ ID NO: 882414 - protein, 382 aa, Homo sapiens; identical to SEQ ID NO: 882407

SEQ ID NO: 882415 - protein, 382 aa, Homo sapiens; identical to SEQ ID NO: 882407

SEQ ID NO: 882416 - protein, 197 aa, Homo sapiens
GVGGARRKMAASAAAAELQASGGPRHPVCLLVLGMAGSGKTTFVQRLTGHLHAQGTPPYVINLDPAVHEVPFPANIDIRDTVKYKEVMKQYGLGPNGGIVTSLNLFATRFDQVMKFIEKAQNMSKYVLIDTPGQIEVFTWSASGTIITEALASSFPTVVIYVMDTSRSTNPVTFMSNMLYACSIYIQYPEQQRHPPP

SEQ ID NO: 882417 - protein, 512 aa, Homo sapiens
MLFEGLDLVSALATLAACLVSVTLLLAVSQQLWQLRWAATRDKSCKLPIPKGSMGFPLIGETGHWLLQGSGFQSSRREKYGNVFKTHLLGRPLIRVTGAENVRKILMGEHHLVSTEWPRSTRMLLGPNTVSNSIGDIHRNKRKVFSKIFSHEALESYLPKIQLVIQDTLRAWSSHPEAINVYQEAQKLTFRMAIRVLLGFSIPEEDLGHLFEVYQQFVDNVFSLPVDLPFSGYRRGIQARQILQKGLEKAIREKLQCTQGKDYLDALDLLIESSKEHGKEMTMQELKDGTLELIFAAYATTASASTSLIMQLLKHPTVLEKLRDELRAHGILHSGGCPCEGTLRLDTLSGLRYLDCVIKEVMRLFTPISGGYRTVLQTFELDGFQIPKGWSVMYSIRDTHDTAPVFKDVNVFDPDRFSQARSEDKDGRFHYLPFGGGVRTCLGKHLAKLFLKVLAVELASTSRFELATRTFPRITLVPVLHPVDGLSVKFFGLDSNQNEILPETEAMLSATV

SEQ ID NO: 882418 - protein, 157 aa, Homo sapiens
MSAPFEERSGVVPCGTPWGQWYQTLEEVFIEVQVPPGTRAQDIQCGLQSRHVALSVGGREILKGKLFDSTIADEGTWTLEDRKMVRIVLTKTKRDAANCWTSLLESEYAADPWVQDQMQRKLTLERFQKENPGFDFSGAEISGNYTKGGPDFSNLEK

SEQ ID NO: 882419 - protein, 157 aa, Homo sapiens; identical to SEQ ID NO: 882418

SEQ ID NO: 882420 - protein, 114 aa, Homo sapiens
RERPRREPKRGIPRVRSAPPGAAAAGRDWIMSAPFEERSGVVPCGTPWGQWYQTLEEVFIEVQVPPGTRAQDIQCGLQSRHVALSVGGREILKVAAARGLCSVSSSQTPPAPFP

SEQ ID NO: 882421 - protein, 107 aa, Homo sapiens
MVFTCMKSLEYSLGKLFDSTIADEGTWTLEDRKMVRIVLTKTKRDAANCWTSLLESEYAADPWVQDQMQRKLTLERFQKENPGFDFSGAEISGNYTKGGPDFSNLEK

SEQ ID NO: 882422 - protein, 157 aa, Homo sapiens; identical to SEQ ID NO: 882418

SEQ ID NO: 882423 - protein, 114 aa, Homo sapiens; identical to SEQ ID NO: 882420

SEQ ID NO: 882424 - protein, 157 aa, Homo sapiens; identical to SEQ ID NO: 882418

SEQ ID NO: 882425 - protein, 409 aa, Homo sapiens
MKLKQRVVLLAILLVIFIFTKVFLIDNLDTSAANREDQRAFHRMMTGLRVELAPKLDHTLQSPWEIAAQWVVPREVYPEETPELGAVMHAMATKKIIKADVGYKGTQLKALLILEGGQKVVFKPKRYSRDHVVEGEPYAGYDRHNAEVAAFHLDRILGFHRAPLVVGRFVNLRTEIKPVATEQLLSTFLTVGNNTCFYGKCYYCRETEPACADGDIMEGSVTLWLPDVWPLQKHRHPWGRTYREGKLARWEYDESYCDAVKKTSPYDSGPRLLDIIDTAVFDYLIGNADRHHYESFQDDEGASMLILLDNAKSFGNPSLDERSILAPLYQCCIIRVSTWNRLNYLKNGVLKSALKSAMAHDPISPVLSDPHLDAVDQRLLSVLATVKQCTDQFGMDTVLVEDRMPLSHL

SEQ ID NO: 882426 - protein, 193 aa, Homo sapiens
MEGSVTLWLPDVWPLQKHRHPWGRTYREGKLARWEYDESYCDAVKKTSPYDSGPRLLDIIDTAVFDYLIGNADRHHYESFQDDEGASMLILLDNAKSFGNPSLDERSILAPLYQCCIIRVSTWNRLNYLKNGVLKSALKSAMAHDPISPVLSDPHLDAVDQRLLSVLATVKQCTDQFGMDTVLVEDRMPLSHL

SEQ ID NO: 882427 - protein, 409 aa, Homo sapiens; identical to SEQ ID NO: 882425

SEQ ID NO: 882428 - protein, 211 aa, Homo sapiens
MEGSVTLWLPDVWPLQKHRHPWGRTYREGKLARWEYDESYCDAVKKTSPYDSGPRLLDIIDTAVFDYLIGNADRHHYESFQDDEGASMLILLDNAKSFGNPSLDERSILAPLYQCCMKLCTANTCACIAFFSRLSIRVSTWNRLNYLKNGVLKSALKSAMAHDPISPVLSDPHLDAVDQRLLSVLATVKQCTDQFGMDTVLVEDRMPLSHL

SEQ ID NO: 882429 - protein, 409 aa, Homo sapiens; identical to SEQ ID NO: 882425

SEQ ID NO: 882430 - protein, 409 aa, Homo sapiens; identical to SEQ ID NO: 882425

SEQ ID NO: 882431 - protein, 544 aa, Homo sapiens
MEAWRCVRKGYGHCVVGRGRYPMFPHHSRSLGRDWTTPWENLQRCCWNRHISSCMRWPGHYSRAPYPYFSSRHFSLNWRPPCLFESRTQFQYCNWRPDNLSQTSLIHLSSYVMNAEGDEPSSKRRKHQGVIKRNWEYICSHDKEKTKILGDKNVDPKCEDSENKFDFSVMSYNILSQDLLEDNSHLYRHCRRPVLHWSFRFPNILKEIKHFDADVLCLQEVQEDHYGAEIRPSLESLGYHCEYKMRTGRKPDGCAICFKHSKFSLLSVNPVEFFRPDISLLDRDNVGLVLLLQPKIPYAACPAICVANTHLLYNPRRGDIKLTQLAMLLAEISSVAHQKDGSFCPIVMCGDFNSVPGSPLYSFIKEGKLNYEGLPIGKVSGQEQSSRGQRILSIPIWPPNLGISQNCVYEVQQVPKVEKTDSDLTQTQLKQTEVLVTAEKLSSNLQHHFSLSSVYSHYFPDTGIPEVTTCHSRSAITVDYIFYSAEKEDVAGHPGAEVALVGGLKLLARLSLLTEQDLWTVNGLPNENNSSDHLPLLAKFRLEL

SEQ ID NO: 882432 - protein, 490 aa, Homo sapiens [sequence omitted]

SEQ ID NO: 882433 - protein, 544 aa, Homo sapiens; identical to SEQ ID NO: 882431

SEQ ID NO: 882434 - protein, 435 aa, Homo sapiens
MEAWRCVRKGYGTVWWEEAGVIKRNWEYICSHDKEKTKILGDKNVDPKCEDSENKFDFSVMSYNILSQDLLEDNSHLYRHCRRPVLHWSFRFPNILKEIKHFDADVLCLQEVQEDHYGAEIRPSLESLGYHCEYKMRTGRKPDGCAICFKHSKFSLLSVNPVEFFRPDISLLDRDNVGLVLLLQPKIPYAACPAICVANTHLLYNPRRGDIKLTQLAMLLAEISSVAHQKDGSFCPIVMCGDFNSVPGSPLYSFIKEGKLNYEGLPIGKVSGQEQSSRGQRILSIPIWPPNLGISQNCVYEVQQVPKVEKTDSDLTQTQLKQTEVLVTAEKLSSNLQHHFSLSSVYSHYFPDTGIPEVTTCHSRSAITVDYIFYSAEKEDVAGHPGAEVALVGGLKLLARLSLLTEQDLWTVNGLPNENNSSDHLPLLAKFRLEL

SEQ ID NO: 882435 - protein, 300 aa, Homo sapiens [sequence omitted]

SEQ ID NO: 882436 - protein, 125 aa, Homo sapiens
EEGLGDGASGTSLQRPSGIGKPAAQLAGRWANEVWGLGAEFMGRRPGLCQWLWIPGLLPPTQPPDQRWPAPHTPQHRPGNRASAGRPPLRNTPCFPITRGVWAETGLHRGRICKGVAGTDIFLVV

SEQ ID NO: 882437 - protein, 125 aa, Homo sapiens; identical to SEQ ID NO: 882436

SEQ ID NO: 882438 - protein, 166 aa, Homo sapiens
MRWPGHYSRAPYPYFSSRHFSLNWRPPCLFESRTQFQYCNWRPDNLSQTSLIHLSSYVMNAEGDEPSSKRRKHQGVIKRNWEYICSHDKEKTKILGDKNVDPKCEDSENKFDFSVMSYNILSQDLLEDNSHLYRHCRRPVLHWSFRFPNILKEIKHFDADVSAKYY

SEQ ID NO: 882439 - protein, 205 aa, Homo sapiens
DYFRAVLQHDERSERAFKLTRDAIELNAANYTVWHFRRVLLKSLQKDLHEEMNYITAIIEEQPKNYQVWHHRRVLVEWLRDPSQELEFIADILNQDAKNYHAWQHRQWVIQEFKLWDNELQYVDQLLKEDVRNNSVWNQRYFVISNTTGYNDRAVLEREVQLVISFTCSFVTNMFACLPYLRHWGYSRSRSYPMELKEDRVLSGT

SEQ ID NO: 882440 - protein, 279 aa, Homo sapiens
DYFRAVLQHDERSERAFKLTRDAIELNAANYTVWHFRRVLLKSLQKDLHEEMNYITAIIEEQPKNYQVWHHRRVLVEWLRDPSQELEFIADILNQDAKNYHAWQHRQWVIQEFKLWDNELQYVDQLLKEDVRNNSVWNQRYFVISNTTGYNDRAVLEREVQYTLEMIKLVPHNESAWNYLKGILQDRGLSKYPNLLNQLLDLQPSHSSPYLIAFLVDIYEDMLENQCDNKEDILNKALELCEILAKEKDTIRKEYWRYIGRSLQSKHSTENDSPTNVQQ

SEQ ID NO: 882441 - protein, 379 aa, Homo sapiens
GGSDARRCRCVGVRGSVWWKGQRTKSMDWKLEGSTQKVESPVLQGQEGILEETGEDGLPEGFQLLQIDAEGECQEGEILATGSTAWCSKNVQRKQRHWEKIVAAKKSKRKQEKERRKANRAENPGICPQHSKRFLRALTKDKLLEAKHSGPRLCIDLSMTHYMSKKVEHPLSLEFLLAMREAQKGTAFRRNGQLQLLGFLSKLELSRLAGQIRRLYGSNKKADRPFWICLTGFTTDSPLYEECVRMNDGFSSYLLDITEEDCFSLFPLETLVYLTPDSEHALEDVDLNKVYILGGLVDESIQKKVTFQKAREYSVKTARLPIQEYMVRNQNGKNYHSEILAINQVFDILSTYLETHNWPEALKKGVSSGKGYILRNSVE

SEQ ID NO: 882442 - protein, 375 aa, Homo sapiens
MTSLYGSIHPADSVYLSTRTHGAVFNLEYSPDGSVLTVACEQTEVLLFDPISSKHIKTLSEAHEDCVNNIRFLDNRLFATCSDDTTIALWDLRKLNTKVCTLHGHTSWVKNIEYDTNTRLLVTSGFDGNVIIWDTNRYTEDGCPHKKFFHTRFLMRMRLTPDCSKMLISTSSGYLLILHDLDLTKSLEVGSYPILRARRTTSSSGVSPRNSLEVVTPEVLGESDHGNCITSLQLHPKGWATLLRCSSNSDDEECTCVYEFQEGAPVRPVSPRCSLRLTHYIEEANVGRGYIKELCFSPDGRMISSPHGYGIRLLGFDKQCSELVDCLPKEASPLRVIRSLYSHNDVVLTTKFSPTHCQIASGCLSGRVSLYQPKF

SEQ ID NO: 882443 - protein, 342 aa, Homo sapiens
GGSDARRCRCVGVRGSVWWKGQRTKSMDWKLEGSTQKVESPVLQGQEGILEETGEDGLPEGFQLLQIDAEGECQEGEILATGSTAWCSKNVQRKQRHWEKIVAAKKSKRKQEKERRKANRAENPGICPQHSKRFLRALTKDKLLEAKHSGPRLCIDLSMTHYMSKKELSRLAGQIRRLYGSNKKADRPFWICLTGFTTDSPLYEECVRMNDGFSSYLLDITEEDCFSLFPLETLVYLTPDSEHALEDVDLNKVYILGGLVDESIQKKVTFQKAREYSVKTARLPIQEYMVRNQNGKNYHSEILAINQVFDILSTYLETHNWPEALKKGVSSGKGYILRNSVE

SEQ ID NO: 882444 - protein, 184 aa, Homo sapiens
MTHYMSKKELSRLAGQIRRLYGSNKKADRPFWICLTGFTTDSPLYEECVRMNDGFSSYLLDITEEDCFSLFPLETLVYLTPDSEHALEDVDLNKVYILGGLVDESIQKKVTFQKAREYSVKTARLPIQEYMVRNQNGKNYHSEILAINQVFDILSTYLETHNWPEALKKGVSSGKGYILRNSVE

SEQ ID NO: 882445 - protein, 134 aa, Homo sapiens
MNDGFSSYLLDITEEDCFSLFPLETLVYLTPDSEHALEDVDLNKVYILGGLVDESIQKKVTFQKAREYSVKTARLPIQEYMVRNQNGKNYHSEILAINQVFDILSTYLETHNWPEALKKGVSSGKGYILRNSVE

SEQ ID NO: 882446 - protein, 134 aa, Homo sapiens; identical to SEQ ID NO: 882445

SEQ ID NO: 882447 - protein, 349 aa, Homo sapiens
MLSRSHRSVLTVACEQTEVLLFDPISSKHIKTLSEAHEDCVNNIRFLDNRLFATCSDDTTIALWDLRKLNTKVCTLHGHTSWVKNIEYDTNTRLLVTSGFDGNVIIWDTNRYTEDGCPHKKFFHTRFLMRMRLTPDCSKMLISTSSGYLLILHDLDLTKSLEVGSYPILRARRTTSSSGVSPRNSLEVVTPEVLGESDHGNCITSLQLHPKGWATLLRCSSNSDDEECTCVYEFQEGAPVRPVSPRCSLRLTHYIEEANVGRGYIKELCFSPDGRMISSPHGYGIRLLGFDKQCSELVDCLPKEASPLRVIRSLYSHNDVVLTTKFSPTHCQIASGCLSGRVSLYQPKF

SEQ ID NO: 882448 - protein, 379 aa, Homo sapiens; identical to SEQ ID NO: 882441

SEQ ID NO: 882449 - protein, 309 aa, Homo sapiens
MTSLYGSIHPADSVYLSTRTHGAVFNLEYSPDGSVLTVACEQTEVLLFDPISSKHIKTLSEAHEDCVNNIRYTEDGCPHKKFFHTRFLMRMRLTPDCSKMLISTSSGYLLILHDLDLTKSLEVGSYPILRARRTTSSSGVSPRNSLEVVTPEVLGESDHGNCITSLQLHPKGWATLLRCSSNSDDEECTCVYEFQEGAPVRPVSPRCSLRLTHYIEEANVGRGYIKELCFSPDGRMISSPHGYGIRLLGFDKQCSELVDCLPKEASPLRVIRSLYSHNDVVLTTKFSPTHCQIASGCLSGRVSLYQPKF

SEQ ID NO: 882450 - protein, 379 aa, Homo sapiens; identical to SEQ ID NO: 882441

SEQ ID NO: 882451 - protein, 379 aa, Homo sapiens; identical to SEQ ID NO: 882441

SEQ ID NO: 882452 - protein, 379 aa, Homo sapiens; identical to SEQ ID NO: 882441

SEQ ID NO: 882453 - protein, 379 aa, Homo sapiens; identical to SEQ ID NO: 882441

SEQ ID NO: 882454 - protein, 379 aa, Homo sapiens; identical to SEQ ID NO: 882441

SEQ ID NO: 882455 - protein, 155 aa, Homo sapiens
IPIYRTKLKTLSHLEKKKMSETQNSTSQKAMDEDNKAASQTMPNTQDKNYEDELTQVALALVEDVINYAVKIVEEERNPLKNIKWMTHGEFTVEKGLKQIDEYFSDAPIVVSYVGDHQALVHRPGMVRFRENWQKNLTDAKYSFMESFPFLFNRV

SEQ ID NO: 882456 - protein, 197 aa, Homo sapiens
MSETQNSTSQKAMDEDNKAASQTMPNTQDKNYEDELTQVALALVEDVINYAVKIVEEERNPLKNIKWMTHGEFTVEKGLKQIDEYFSKCVSKKCWAHGVEFVERKDLIHSFLYIYYVHWSISTADLPVARISAGTYFTMKVSKTKPPDAPIVVSYVGDHQALVHRPGMVRFRENWQKNLTDAKYSFMESFPFLFNRV

SEQ ID NO: 882457 - protein, 641 aa, Homo sapiens
MAKAAAIGIDLGTTYSCVGVFQHGKVEIIANDQGNRTTPSYVAFTDTERLIGDAAKNQVALNPQNTVFDAKRLIGRKFGDPVVQSDMKHWPFQVINDGDKPKVQVSYKGETKAFYPEEISSMVLTKMKEIAEAYLGYPVTNAVITVPAYFNDSQRQATKDAGVIAGLNVLRIINEPTAAAIAYGLDRTGKGERNVLIFDLGGGTFDVSILTIDDGIFEVKATAGDTHLGGEDFDNRLVNHFVEEFKRKHKKDISQNKRAVRRLRTACERAKRTLSSSTQASLEIDSLFEGIDFYTSITRARFEELCSDLFRSTLEPVEKALRDAKLDKAQIHDLVLVGGSTRIPKVQKLLQDFFNGRDLNKSINPDEAVAYGAAVQAAILMGDKSENVQDLLLLDVAPLSLGLETAGGVMTALIKRNSTIPTKQTQIFTTYSDNQPGVLIQVYEGERAMTKDNNLLGRFELSGIPPAPRGVPQIEVTFDIDANGILNVTATDKSTGKANKITITNDKGRLSKEEIERMVQEAEKYKAEDEVQRERVSAKNALESYAFNMKSAVEDEGLKGKISEADKKKVLDKCQEVISWLDANTLAEKDEFEHKRKELEQVCNPIISGLYQGAGGPGPGGFGAQGPKGGSGSGPTIEEVD

SEQ ID NO: 882458 - protein, 66 aa, Homo sapiens
EMTVRLTTIRLQLYKEVKQQRKELEQVCNPIISGLYQGAGGPGPGGFGAQGPKGGSGSGPTIEEVD

SEQ ID NO: 882459 - protein, 193 aa, Homo sapiens
MLVAVGYRRPGLRSITRLTLFEEFEKNGIYCCGLLRARKSDCTGLPLSMLTNPATPPARGQYQIKMKGNMSLICWYNKGHFRFLTNAYSPVQQGVIIKRKSGEIPCPLAVEAFAAHLSYICRYDDKYSKYFISHKPNKTWQQVFWFAISIAINNAYILYKMSDAYHVKRYSRAQFGERLVRELLGLEDASPTH

SEQ ID NO: 882460 - protein, 333 aa, Homo sapiens
GFFSNRSLALVMSQARFEKILKYFHVVAFRSSQTTHGLYKVQPFLDSLQNSFDSAFRPSQTQVLHEPLIDEDPVFIATCTERELRKRKKRKFSLWVRQCSSTGFIIQIYVHLKEGGGPDGLDALKNKPQLHSMVARSLCRNAAGKNYIIFTGPSITSLTLFEEFEKQGIYCCGLLRARKSDCTGLPLSMLTNPATPPARGQYQIKMKGNMSLICWYNKGHFRFLTNAYSPVQQGVIIKRKSGEIPCPLAVEAFAAHLSYICRYDDKYSKYFISHKPNKTWQQVFWFAISIAINNAYILYKMSDAYHVKRYSRAQFGERLVRELLGLEDASPTH

SEQ ID NO: 882461 - protein, 124 aa, Homo sapiens
MSLICWYNKGHFRFLTNAYSPVQQGVIIKRKSGEIPCPLAVEAFAAHLSYICRYDDKYSKYFISHKPNKTWQQVFWFAISIAINNAYILYKMSDAYHVKRYSRAQFGERLVRELLGLEDASPTH

SEQ ID NO: 882462 - protein, 193 aa, Homo sapiens; identical to SEQ ID NO: 882459

SEQ ID NO: 882463 - protein, 193 aa, Homo sapiens; identical to SEQ ID NO: 882459

SEQ ID NO: 882464 - protein, 193 aa, Homo sapiens; identical to SEQ ID NO: 882459

SEQ ID NO: 882465 - protein, 193 aa, Homo sapiens; identical to SEQ ID NO: 882459

SEQ ID NO: 882466 - protein, 333 aa, Homo sapiens; identical to SEQ ID NO: 882460

SEQ ID NO: 882467 - protein, 143 aa, Homo sapiens
DLSAKSASVPDELGACGHSRTSSYASQQSKVSGYSTCHSRSSSFSELCHRRNTSVGSTSTGVESILEPCDEIEQKIAEPNLDTADKEDTASEKLSRCPVKQDSVESSAEAELMTPRVDADDIVEKILQSQDFSPRFPVRKKKD

SEQ ID NO: 882468 - protein, 111 aa, Homo sapiens
DLSAKSASVPDELGACGHSRTSSYASQQSKVSGYSTCHSRSSSFSELCHRRNTSVGSTSTGVESILEPCDEIEQKIAEPNLDTADKEDTASEKLSRCPVKQDSVESQLKPS

SEQ ID NO: 882469 - protein, 540 aa, Homo sapiens
MTDTRRRVKVYTLNEDRQWDDRGTGHVSSGYVERLKGMSLLVRAESDGSLLLESKINPNTAYQKQQDTLIVWSEAENYDLALSFQEKAGCDEIWEKICQVQGKDPSVDITQDLVDESEEERFDDMSSPGLELPSCELSRLEEIAELVASSLPSPLRREKLALALENEGYIKKLLELFHVCEDLENIEGLHHLYEIIKGIFLLNRTALFEVMFSEECIMDVIGCLEYDPALSQPRKHREFLTKTAKFKEVIPISDPELKQKIHQTYRVQYIQDMVLPTPSVFEENMLSTLHSFIFFNKVEIVGMLQEDEKFLTDLFAQLTDEATDEEKRQELVNFLKEFCAFSQTLQPQNRDAFFKTLSNMGILPALEVILGMDDTQVRSAATDIFSYLVEYNPSMVREFVMQEAQQNDDDILLINLIIEHMICDTDPELGGAVQLMGLLRTLVDPENMLATANKTEKTEFLGFFYKHCMHVLTAPLLANTTEDKPSKDDFQTAQLLALVLELLTFCVEHHTYHIKNYIINKDILRRVLVLMASKHAFLAL

SEQ ID NO: 882470 - protein, 540 aa, Homo sapiens; identical to SEQ ID NO: 882469

SEQ ID NO: 882471 - protein, 820 aa, Homo sapiens
MTDTRRRVKVYTLNEDRQWDDRGTGHVSSGYVERLKGMSLLVRAESDGSLLLESKINPNTAYQKQQDTLIVWSEAENYDLALSFQEKAGCDEIWEKICQVQGKDPSVDITQDLVDESEEERFDDMSSPGLELPSCELSRLEEIAELVASSLPSPLRREKLALALENEGYIKKLLELFHVCEDLENIEGLHHLYEIIKGIFLLNRTALFEVMFSEECIMDVIGCLEYDPALSQPRKHREFLTKTAKFKEVIPISDPELKQKIHQTYRVQYIQDMVLPTPSVFEENMLSTLHSFIFFNKVEIVGMLQEDEKFLTDLFAQLTDEATDEEKRQELVNFLKEFCAFSQTLQPQNRDAFFKTLSNMGILPALEVILGMDDTQVRSAATDIFSYLVEYNPSMVREFVMQEAQQNDDDILLINLIIEHMICDTDPELGGAVQLMGLLRTLVDPENMLATANKTEKTEFLGFFYKHCMHVLTAPLLANTTEDKPSKDDFQTAQLLALVLELLTFCVEHHTYHIKNYIINKDILRRVLVLMASKHAFLALCALRFKRKIIGLKDEFYNRYIMKSFLFEPVVKAFLNNGSRYNLMNSAIIEMFEFIRVEDIKSLTAHVIENYWKALEDVDYVQTFKGLKLRFEQQRERQDNPKLDSMRSILRNHRYRRDARTLEDEEEMWFNTDEDDMEDGEAVVSPSDKTKNDDDIMDPISKFMERKKLKESEEKEVLLKTNLSGRQSPSFKLSLSSGTKTNLTSQSSTTNLPGSPGSPGSPGSPGSPGSVPKNTSQTAAITTKGGLVGLVDYPDDDEDDDEDEDKEDTLPLSKKAKFDS

SEQ ID NO: 882472 - protein, 540 aa, Homo sapiens; identical to SEQ ID NO: 882469

SEQ ID NO: 882473 - protein, 540 aa, Homo sapiens; identical to SEQ ID NO: 882469

SEQ ID NO: 882474 - protein, 833 aa, Homo sapiens
MTDTRRRVKVYTLNEDRQWDDRGTGHVSSGYVERLKGMSLLVRAESDGSLLLESKINPNTAYQKQQDTLIVWSEAENYDLALSFQEKAGCDEIWEKICQVQGKDPSVDITQDLVDESEEERFDDMSSPGLELPSCELSRLEEIAELVASSLPSPLRREKLALALENEGYIKKLLELFHVCEDLENIEGLHHLYEIIKGIFLLNRTALFEVMFSEECIMDVIGCLEYDPALSQPRKHREFLTKTAKFKEVIPISDPELKQKIHQTYRVQYIQDMVLPTPSVFEENMLSTLHSFIFFNKVEIVGMLQEDEKFLTDLFAQLTDEATDEEKRQELVNFLKEFCAFSQTLQPQNRDAFFKTLSNMGILPALEVILGMDDTQVRSAATDIFSYLVEYNPSMVREFVMQEAQQNDDVSKKLTEQKITSKDILLINLIIEHMICDTDPELGGAVQLMGLLRTLVDPENMLATANKTEKTEFLGFFYKHCMHVLTAPLLANTTEDKPSKDDFQTAQLLALVLELLTFCVEHHTYHIKNYIINKDILRRVLVLMASKHAFLALCALRFKRKIIGLKDEFYNRYIMKSFLFEPVVKAFLNNGSRYNLMNSAIIEMFEFIRVEDIKSLTAHVIENYWKALEDVDYVQTFKGLKLRFEQQRERQDNPKLDSMRSILRNHRYRRDARTLEDEEEMWFNTDEDDMEDGEAVVSPSDKTKNDDDIMDPISKFMERKKLKESEEKEVLLKTNLSGRQSPSFKLSLSSGTKTNLTSQSSTTNLPGSPGSPGSPGSPGSPGSVPKNTSQTAAITTKGGLVGLVDYPDDDEDDDEDEDKEDTLPLSKKAKFDS

SEQ ID NO: 882475 - protein, 812 aa, Homo sapiens
MTDTRRRVKVYTLNEDRQWDDRGTGHVSSGYVERLKGMSLLVRAESDGSLLLESKINPNTAYQKQQDTLIVWSEAENYDLALSFQEKAGCDEIWEKICQVQGKDPSVDITQDLVDESEEERFDDMSSPGLELPSCELSRLEEIAELVASSLPSPLRREKLALALENEGYIKKLLELFHVCEDLENIEGLHHLYEIIKGIFLLNRTALFEVMFSEECIMDVIGCLEYDPALSQPRKHREFLTKTAKFKEVIPISDPELKQKIHQTYRVQYIQDMVLPTPSVFEENMLSTLHSFIFFNKVEIVGMLQEDEKFLTDLFAQLTDEATDEEKRQELKLFEFCAFSPLQPLEVILGMDDTQVRSAATDIFSYLVEYNPSMVREFVMQEAQQNDDVSKKLTEQKITSKDILLINLIIEHMICDTDPELGGAVQLMGLLRTLVDPENMLATANKTEKTEFLGFFYKHCMHVLTAPLLANTTEDKPSKDDFQTAQLLALVLELLTFCVEHHTYHIKNYIINKDILRRVLVLMASKHAFLALCALRFKRKIIGLKDEFYNRYIMKSFLFEPVVKAFLNNGSRYNLMNSAIIEMFEFIRVEDIKSLTAHVIENYWKALEDVDYVQTFKGLKLRFEQQRERQDNPKLDSMRSILRNHRYRRDARTLEDEEEMWFNTDEDDMEDGEAVVSPSDKTKNDDDIMDPISKFMERKKLKESEEKEVLLKTNLSGRQSPSFKLSLSSGTKTNLTSQSSTTNLPGSPGSPGSPGSPGSPGSVPKNTSQTAAITTKGGLVGLVDYPDDDEDDDEDEDKEDTLPLSKKAKFDS

SEQ ID NO: 882476 - protein, 478 aa, Homo sapiens
MTDTRRRVKVYTLNEDRQWDDRGTGHVSSGYVERLKGMSLLVRAESDGSLLLESKINPNTAYQKQQDTLIVWSEAENYDLALSFQEKAGCDEIWEKICQVQGKDPSVDITQDLVDESEEERFDDMSSPGLELPSCELSRLEEIAELVASSLPSPLRREKLALALENEGYIKKLLELFHVCEDLENIEGLHHLYEIIKGIFLLNRTALFEVMFSEECIMDVIGCLEYDPALSQPRKHREFLTKTAKFKEVIPISDPELKQKIHQTYRVQYIQDMVLPTPSVFEENMLSTLHSFIFFNKVEIVGMLQEDEKFLTDLFAQLTDEATDEEKRQELVNFLKEFCAFSQTLQPQNRDAFFKTLSNMGILPALEVILGMDDTQVRSAATDIFSYLVEYNPSMVREFVMQEAQQNDDVSKKLTEQKITSKDILLINLIIEHMICDTDPELGGAVQLMGLLRTLVDPENMLATANCSFTSKYNRRQT

SEQ ID NO: 882477 - protein, 540 aa, Homo sapiens; identical to SEQ ID NO: 882469

SEQ ID NO: 882478 - protein, 540 aa, Homo sapiens; identical to SEQ ID NO: 882469

SEQ ID NO: 882479 - protein, 540 aa, Homo sapiens; identical to SEQ ID NO: 882469

SEQ ID NO: 882480 - protein, 713 aa, Homo sapiens
MTDTRRRVKVYTLNEDRQWDDRGTGHVSSGYVERLKGMSLLVRAESDGSLLLESKINPNTAYQKQQDTLIVWSEAENYDLALSFQEKAGCDEIWEKICQVQGKDPSVDITQDLVDESEEERFDDMSSPGLELPSCELSRLEEIAELVASSLPSPLRREKLALALENEGYIKKLLELFHVCEDLENIEGLHHLYEIIKGIFLLNRTALFEVMFSEECIMDVIGCLEYDPALSQPRKHREFLTKTAKFKEVIPISDPELKQKIHQTYRVQYIQDMVLPTPSVFEENMLSTLHSFIFFNKVEIVGMLQEDEKFLTDLFAQLTDEATDEEKRQELVNFLKEFCAFSQTLQPQNRDAFFKTLSNMGILPALEVILGMDDTQVRSAATDIFSYLVEYNPSMVREFVMQEAQQNDDDILLINLIIEHMICDTDPELGGAVQLMGLLRTLVDPENMLATANKTEKTEFLGFFYKHCMHVLTAPLLANTTEDKPSKDDFQTAQLLALVLELLTFCVEHHTYHIKNYIINKDILRRVLVLMASKHAFLALCALRFKRKIIGLKDEFYNRYIMKSFLFEPVVKAFLNNGSRYNLMNSAIIEMFEFIRVEDIKSLTAHVIENYWKALEDVDYVQTFKGLKLRFEQQRERQDNPKLDSMRSILRNHRYRRDARTLEDEEEMWFNTDEDDMEDGEAVVSPSDKTKNDDEDEDKEDTLPLSKKAKFDS

SEQ ID NO: 882481 - protein, 456 aa, Homo sapiens
MTDTRRRVKVYTLNEDRQWDDRGTGHVSSGYVERLKGMSLLVRAESDGSLLLESKINPNTAYQKQQDTLIVWSEAENYDLALSFQEKAGCDEIWEKICQVQGKDPSVDITQDLVDESEEERFDDMSSPGLELPSCELSRLEEIAELVASSLPSPLRREKLALALENEGYIKKLLELFHVCEDLENIEGLHHLYEIIKGIFLLNRTALFEVMFSEECIMDVIGCLEYDPALSQPRKHREFLTKTAKFKEVIPISDPELKQKIHQTYRVQYIQDMVLPTPSVFEENMLSTLHSFIFFNKVEIVGMLQEDEKFLTDLFAQLTDEATDEEKRQELVNFLKEFCAFSQTLQPQNRDAFFKTLSNMGILPALEVILGMDDTQVRSAATDIFSYLVEYNPSMVREFVMQEAQQNDDVSKKLTEQKITSKVNIICTNSKYLYIGSYNCFYYSLLRFNCCCLGKV

SEQ ID NO: 882482 - protein, 591 aa, Homo sapiens
MTDTRRRVKVYTLNEDRQWDDRGTGHVSSGYVERLKGMSLLVRAESDGSLLLESKINPNTAYQKQQDTLIVWSEAENYDLALSFQEKAGCDEIWEKICQVQGKDPSVDITQDLVDESEEERFDDMSSPGLELPSCELSRLEEIAELVASSLPSPLRREKLALALENEGYIKKLLELFHVCEDLENIEGLHHLYEIIKGIFLLNRTALFEVMFSEECIMDVIGCLEYDPALSQPRKHREFLTKTAKFKEVIPISDPELKQKIHQTYRVQYIQDMVLPTPSVFEENMLSTLHSFIFFNKVEIVGMLQEDEKFLTDLFAQLTDEATDEEKRQELKLFEFCAFSPLQPLEVILGMDDTQVRSAATDIFSYLVEYNPSMVREFVMQEAQQNDDDILLINLIIEHMICDTDPELGGAVQLMGLLRTLVDPENMLATANKTEKTEFLGFFYKHCMHVLTAPLLANTTEDKPSKDDFQTAQLLALVLELLTFCVEHHTYHIKNYIINKDILRRVLVLMASKHAFLALCALRFKRKIIGLKDEFYNRYIMKSFLFEPVVKAFLNNGSRYNLMNSAIIEMFEFIRVEILIFTVSMNSESGE

SEQ ID NO: 882483 - protein, 66 aa, Homo sapiens
KGIKIKVLANMSQNPFSLGLKKQISRAEFGTRRKKREEPLVMPVWWRRRRLRARSWALRGARKPLR

SEQ ID NO: 882484 - protein, 91 aa, Homo sapiens
REEPLVMPVWWRRRRLRARSWALRGESDRGLRSNSSTCRVPPPYGCPARPLSLPRAQRSGRLLRRPKGYAPGAPKAHELSPQAICAVAFCE

SEQ ID NO: 882485 - protein, 90 aa, Homo sapiens
PLTLLVQKLALHSGMDYAIMTGGDVAPMGREGVTAMHKLFDWANTSRRGLLLFMDEADAFLRKRATEEISKDLRATLNAFLYHMGQHSNK

SEQ ID NO: 882486 - protein, 602 aa, Homo sapiens
MQLEALNLLHTLVWARSLCRAGAVQTQERLSGSASPEQVPAGECCALQEYEAAVEQLKSEQIRAQAEERRKTLSEETRQHQARAQYQDKLARQRYEDQLKQQQLLNEENLRKQEESVQKQEAMRRATVEREMELRHKNEMLRVETEARARAKAERENADIIREQIRLKASEHRQTVLESIRTAGTLFGEGFRAFVTDRDKVTATVAGLTLLAVGVYSAKNATAVTGRFIEARLGKPSLVRETSRITVLEALRHPIQVSRRLLSRPQDVLEGVVLSPSLEARVRDIAIATRNTKKNRGLYRHILLYGPPGTGKTLFAKKLALHSGMDYAIMTGGDVAPMGREGVTAMHKLFDWANTSRRGLLLFMDEADAFLRKRATEEISKDLRATLNAFLYHMGQHSNKFMLVLASNLPEQFDCAINSRIDVMVHFDLPQQEERERLVRLHFDNCVLKPATEGKRRLKLAQFDYGRKCSEVARLTEGMSGREIAQLAVSWQATAYASKDGVLTEAMMDACVQDAVQQYRQKMRWLKAEGPGRGVEHPLSGVQGETLTSWSLATDPSYPCLAGPCTFRICSWMGTGLCPGPLSPRMSCGGGRPFCPPGHPLL

SEQ ID NO: 882487 - protein, 648 aa, Homo sapiens
MSWLFGINKGPKGEGAGPPPPLPPAQPGAEGGGDRGLGDRPAPKDKWSNFDPTGLERAAKAARELEHSRYAKDALNLAQMQEQTLQLEQQSKLKEYEAAVEQLKSEQIRAQAEERRKTLSEETRQHQARAQYQDKLARQRYEDQLKQQQLLNEENLRKQEESVQKQEAMRRATVEREMELRHKNEMLRVETEARARAKAERENADIIREQIRLKASEHRQTVLESIRTAGTLFGEGFRAFVTDRDKVTATVAGLTLLAVGVYSAKNATAVTGRFIEARLGKPSLVRETSRITVLEALRHPIQVSRRLLSRPQDVLEGVVLSPSLEARVRDIAIATRNTKKNRGLYRHILLYGPPGTGKTLFAKKLALHSGMDYAIMTGGDVAPMGREGVTAMHKLFDWANTSRRGLLLFMDEADAFLRKRATEEISKDLRATLNAFLYHMGQHSNKFMLVLASNLPEQFDCAINSRIDVMVHFDLPQQEERERLVRLHFDNCVLKPATEGKRRLKLAQFDYGRKCSEVARLTEGMSGREIAQLAVSWQATAYASKDGVLTEAMMDACVQDAVQQYRQKMRWLKAEGPGRGVEHPLSGVQGETLTSWSLATDPSYPCLAGPCTFRICSWMGTGLCPGPLSPRMSCGGGRPFCPPGHPLL

SEQ ID NO: 882488 - protein, 201 aa, Homo sapiens
MLVLASNLPEQFDCAINSRIDVMVHFDLPQQEERERLVRLHFDNCVLKPATEGKRRLKLAQFDYGRKCSEVARLTEGMSGREIAQLAVSWQATAYASKDGVLTEAMMDACVQDAVQQYRQKMRWLKAEGPGRGVEHPLSGVQGETLTSWSLATDPSYPCLAGPCTFRICSWMGTGLCPGPLSPRMSCGGGRPFCPPGHPLL

SEQ ID NO: 882489 - protein, 366 aa, Homo sapiens
MSWAASRGAESAPGHSRSPCHRGFRGCRVSPPNPRLPRQPSLEARVRDIAIATRNTKKNRGLYRHILLYGPPGTGKTLFAKKLALHSGMDYAIMTGGDVAPMGREGVTAMHKLFDWANTSRRGLLLFMDEADAFLRKRATEEISKDLRATLNAFLYHMGQHSNKFMLVLASNLPEQFDCAINSRIDVMVHFDLPQQEERERLVRLHFDNCVLKPATEGKRRLKLAQFDYGRKCSEVARLTEGMSGREIAQLAVSWQATAYASKDGVLTEAMMDACVQDAVQQYRQKMRWLKAEGPGRGVEHPLSGVQGETLTSWSLATDPSYPCLAGPCTFRICSWMGTGLCPGPLSPRMSCGGGRPFCPPGHPLL

SEQ ID NO: 882490 - protein, 508 aa, Homo sapiens
MSWLFGINKGPKGEGAGPPPPLPPAQPGAEGGGDRGLGDRPAPKDKWSNFDPTGLERAAKAARELEHSRYAKDALNLAQMQEQTLQLEQQSKLKEYEAAVEQLKSEQIRAQAEERRKTLSEETRQHQARAQYQDKLARQRYEDQLKQQQLLNEENLRKQEESVQKQEAMRRATVEREMELRHKNEMLRVETEARARAKAERENADIIREQIRLKASEHRQTVLESIRTAGTLFGEGFRAFVTDRDKVTATVAGLTLLAVGVYSAKNATAVTGRFIEARLGKPSLVRETSRITVLEALRHPIQVSRRLLSRPQDVLEGVVLSPSLEARVRDIAIATRNTKKNRGLYRHILLYGPPGTGKTLFAKKLALHSGMDYAIMTGGDVAPMGREGVTAMHKLFDWANTSRRGLLLFMDEADAFLRKRATEEISKDLRATLNAFLYHMGQHSNKFMLVLASNLPEQFDCAINSRIGLREEVLGGRSADGGHVGPGDRSAGRVLAGHGICLQGRGPH

SEQ ID NO: 882491 - protein, 648 aa, Homo sapiens; identical to SEQ ID NO: 882487

SEQ ID NO: 882492 - protein, 648 aa, Homo sapiens; identical to SEQ ID NO: 882487

SEQ ID NO: 882493 - protein, 284 aa, Homo sapiens
MSWLFGINKGPKGEGAGPPPPLPPAQPGAEGGGDRGLGDRPAPKDKWSNFDPTGLERAAKAARELEHSRYAKDALNLAQMQEQTLQLEQQSKLKEYEAAVEQLKSEQIRAQAEERRKTLSEETRQHQARAQYQDKLARQRYEDQLKQQQLLNEENLRKQEESVQKQEAMRRATVEREMELRHKNEMLRVETEARARAKAERENADIIREQIRLKASEHRQTVLESIRTAGTLFGEGFRAFVTDRDKVTATVNIFIKQGWQVAERQHVGASWSPRSCPCRLCTAL

SEQ ID NO: 882494 - protein, 292 aa, Homo sapiens
MSWLFGINKGPKGEGAGPPPPLPPAQPGAEGGGDRGLGDRPAPKDKWSNFDPTGLERAAKAARELEHSRYAKDALNLAQMQEQTLQLEQQSKLKEYEAAVEQLKSEQIRAQAEERRKTLSEETRQHQARAQYQDKLARQRYEDQLKQQQLLNEENLRKQEESVQKQEAMRRATVEREMELRHKNEMLRVETEARARAKAERENADIIREQIRLKASEHRQTVLESIRTAGTLFGEGFRAFVTDRDKVTATVNIFIKQGWQVAERHIFGGGGGRITRSGDRDHPGKSETLSLL

SEQ ID NO: 882495 - protein, 232 aa, Homo sapiens
MEHTGHYLHLAFLMTTVFSLSPGTKANYTRLWANSTSSWDSVIQNKTGRNQNENINTNPITPEVDYKGNSTNMPETSHIVALTSKSEQELYIPSVVSNSPSTVQSIENTSKSHGEIFKKDVCAENNNNMAMLICLIIIAVLFLICTFLFLSTVVLANKVSSLRRSKQVGKRQPRSNGDFLASGLWPAESDTWKRTKQLTGPNLVMQSTGVLTATRERKDEEGTEKLTNKQIG

SEQ ID NO: 882496 - protein, 259 aa, Homo sapiens
MLLRSWFGNKDFQALPILARLPSMPTDMEHTGHYLHLAFLMTTVFSLSPGTKANYTRLWANSTSSWDSVIQNKTGRNQNENINTNPITPEVDYKGNSTNMPETSHIVALTSKSEQELYIPSVVSNSPSTVQSIENTSKSHGEIFKKDVCAENNNNMAMLICLIIIAVLFLICTFLFLSTVVLANKVSSLRRSKQVGKRQPRSNGDFLASGLWPAESDTWKRTKQLTGPNLVMQSTGVLTATRERKDEEGTEKLTNKQIG

SEQ ID NO: 882497 - protein, 214 aa, Homo sapiens
MEHTGHYLHLAFLMTTVFSLSPGTKANYTRLWANSTSSWDSVIQNKTGRNQNENINTNPITPEVDYKGNSTNMPETSHIVALTSKSEQELYIPSVVSNSPSTVQSIENTSKSHGEIFKKDVCAVLICTFLFLSTVVLANKVSSLRRSKQVGKRQPRSNGDFLASGLWPAESDTWKRTKQLTGPNLVMQSTGVLTATRERKDEEGTEKLTNKQIG

SEQ ID NO: 882498 - protein, 232 aa, Homo sapiens; identical to SEQ ID NO: 882495

SEQ ID NO: 882499 - protein, 232 aa, Homo sapiens; identical to SEQ ID NO: 882495

SEQ ID NO: 882500 - protein, 232 aa, Homo sapiens; identical to SEQ ID NO: 882495

SEQ ID NO: 882501 - protein, 517 aa, Homo sapiens
MAQGFAVGFDPLGLGDLSSGSLSSLSSRGHLGSDSGSTATRYLLRKQQRLLNGPPRGIRASSPMGRVILINSPIEANSDESDIIHSVRVEKSPAGRLGFSVRGGSEHGLGIFVSKVEEGSSAERAGLCVGDKITEVNGLSLESTTMGSAVKVLTSSSRLHMMVRRMGRVPGIKFSKEKTTWVDVVNRRLVVEKCGSTPSDTSSEDGVRRIVHLYTTSDDFCLGFNIRGGKEFGLGIYVSKVDHGGLAEENGIKVGDQVLAANGVRFDDISHSQAVEVLKGQTHIMLTIKETGRYPAYKEMVSEYCWLDRLSNGVLQQLSPASESSSSVSSCASSAPYSSGSLPSDRMDICLGQEEPGSRGPGWGRADTAMQTEPDAGGRVETWCSVRPTVILRDTAIRSDGPHPGRRLDSALSESPKTALLLALSRPRPPITRSQSYLTLWEEKQQRKKEKSGSPGEKGALQRSKTLMNLFFKGGRQGRLARDGRREAWTLDSGSLAKTYPRLDIEKEMGVSPCCPG

SEQ ID NO: 882502 - protein, 1151 aa, Homo sapiens
MAQGFAVGFDPLGLGDLSSGSLSSLSSRGHLGSDSGSTATRYLLRKQQRLLNGPPRGIRASSPMGRVILINSPIEANSDESDIIHSVRVEKSPAGRLGFSVRGGSEHGLGIFVSKVEEGSSAGKQNPQAEVHAEDVTPISVNGRGCCCQGQTEESPALEGLIDGETGPTLKSEWFKGQIPRHWEHSAPALTILTLIEKLQFDPRELHLMGEAQPHPGDPCQPLPSCGAERAGLCVGDKITEVNGLSLESTTMGSAVKVLTSSSRLHMMVRRMGRVPGIKFSKEKTTWVDVVNRRLVVEKCGSTPSDTSSEDGVRRIVHLYTTSDDFCLGFNIRGGKEFGLGIYVSKLRAEAGSVFVVELRMGSGVGPRLGCGDGQQVRPGQPPVSVRAWEGAGGPSRRVKDLELVQSCVQEKGVWSGVTEGRPGAYQTERLSGLRVDHGGLAEENGIKVGDQVLAANGVRFDDISHSQAVEVLKGQTHIMLTIKETGRYPAYKEMVSEYCWLDRLSNGVLQQLSPASESSSSVSSCASSAPYSSGSLPSDRMDICLGQEEPGSRGPGWGRADTAMQTEPDAGGRVETWCSVRPTVILRDTAIRSDGPHPGRRLDSALSESPKTALLLALSRPRPPITRSQSYLTLWEEKQQRKKEKSGSPGEKGALQRSKTLMNLFFKGGRQGRLARDGRREAWTLDSGSLAKTYPRLDIEKVCARGRHRGPGEAPAGHPRQAGEAATAAGHQECGGPHRPGPLRQHGDACGAGGFGGPQEQGSPASCFETSPAGHATQASPYHPRACRGGFYLLPVNGFPEEEDNGELRERLGALKVSPSASAPRHPHKGIPPLQDVPVDAFTPLRIACTPPPQLPPVAPRPLRPNWLLTEPLSREHPPQSQIRGRAQSRSRSRSRSRSRSSRGQGKSPGRRSPSPVPTPAPSMTNGRYHKPRKARPPLPRPLDGEAAKVGAKQGPSESGTEGTAKEAAMKNPSGELKTVTLSKMKQSLGISISGGIESKVQPMVKIEKIFPGGAAFLSGALQAGFELVAVDGENLEQVTHQRAVDTIRRAYRNKAREPMELVVRVPGPSPRPSPSDSSALTDGGLPADHLPAHQPLDAAPVPAHWLPEPPTNPQTPPTDARLLQPTPSPAPSPALQTPDSKPAPSPRIP

SEQ ID NO: 882503 - protein, 610 aa, Homo sapiens
MAQGFAVGFDPLGLGDLSSGSLSSLSSRGHLGSDSGSTATRYLLRKQQRLLNGPPRGIRASSPMGRVILINSPIEANSDESDIIHSVRVEKSPAGRLGFSVRGGSEHGLGIFVSKVEEGSSAERAGLCVGDKITEVNGLSLESTTMGSAVKVLTSSSRLHMMVRRMGRVPGIKFSKEKTTWVDVVNRRLVVEKCGSTPSDTSSEDGVRRIVHLYTTSDDFCLGFNIRGGKEFGLGIYVSKLRAEAGSVFVVELRMGSGVGPRLGCGDGQQVRPGQPPVSVRAWEGAGGPSRRVKDLELVQSCVQEKGVWSGVTEGRPGAYQTERLSGLRVDHGGLAEENGIKVGDQVLAANGVRFDDISHSQAVEVLKGQTHIMLTIKETGRYPAYKEMVSEYCWLDRLSNGVLQQLSPASESSSSVSSCASSAPYSSGSLPSDRMDICLGQEEPGSRGPGWGRADTAMQTEPDAGGRVETWCSVRPTVILRDTAIRSDGPHPGRRLDSALSESPKTALLLALSRPRPPITRSQSYLTLWEEKQQRKKEKSGSPGEKGALQRSKTLMNLFFKGGRQGRLARDGRREAWTLDSGSLAKTYPRLDIEKAGGVGPVQKFVTWR

SEQ ID NO: 882504 - protein, 240 aa, Homo sapiens [sequence omitted]

SEQ ID NO: 882505 - protein, 236 aa, Homo sapiens
MLKSAVLFSHRKIQFHIFTEDSLKPEFDKQLRQWPDSYTKKFEHRIYPITFSVGNPQEWKKLFKPCAAQRLFLPVILKDVDSLLYVDTDVLFLRPVDDIWKLLRLFNSTQLAAMAPEHEIPKIGWYSRFARHPFYGSAGVNSGVMLMNLTRIRSTQFKNSMIPTGLAWEDMLYPLYQKYKNAITWGDQDLLNIIFYFNPEGFYVFPGPVDYRAITGVRKHWGGAWVLAAGGGYPTL

SEQ ID NO: 882506 - protein, 495 aa, Homo sapiens
MCQAPCWRAGGSGLGRCSLCRSCSLARFPRLPSFPPPGRLRAGVCAREGEGVGGVGGGVPVPKRPAEGGGGCEGLREAMDVERLQEALKDFEKRGKKEVCPVLDQFLCHVAKTGETMIQWSQFKGYFIFKLEKVMDDFRTSAPEPRGPPNPNVEYIPFDEMKERILKIVTGFNGIPFTIQRLCELLTDPRRNYTGTDKFLRGVEKNVMVVSCVYPSSEKNNSNSLNRMNGVMFPGNSPSYTERSNINGPGTPRPLNRPKVSLSAPMTTNGLPESTDSKEANLQQNEEKNHSDSSTSESEVSSVSPLKNKHPDEDAVEAEGHEVKRLRFDKEGEVRETASQTTSSEISSVMVGETEASSSSQDKDKDSRCTRQHCTEEDEEEDEEEEEESFMTSREMIPERKNQEKESDDALTVNEETSEENNQMEESDVSQAEKDLLHSEGSENEGPVSSSSSDCRETEELVGSNSSKTGEILSESSMENDDEATEVTDEPMEQD

SEQ ID NO: 882507 - protein, 557 aa, Homo sapiens
MLKSAVLFSHRKIQFHIFTEDSLKPEFDKQLRQWPDSYTKKFEHRIYPITFSVGNPQEWKKLFKPCAAQRLFLPVILKDVDSLLYVDTDVLFLRPVDDIWKLLRLFNSTQLAAMAPEHEIPKIGWYSRFARHPFYGSAGVNSGVMLMNLTRIRSTQFKNSMIPTGLAWEDMLYPLYQKYKNAITWGDQDLLNIIFYFNPECLYVFPCQWNYRPDHCMYGSNCREAEHEGVSVLHGNRGVYHDDKQPTFRALYEAIRDILRRGGKRKFVLSWMQFLCHVAKTGETMIQWSQFKGYFIFKLEKVMDDFRTSAPEPRGPPNPNVEYIPFDEMKERILKIVTGFNGIPFTIQRLCELLTDPRRNYTGTDKFLRGVEKNVMVVSCVYPSSEKNNSNSLNRMNGVMFPGNSPSYTERSNINGPGTPRPLNRPKVSLSAPMTTNGLPESTDSKEANLQQNEEKNHSDSSTSESEVSSVSPLKNKHPDEDAVEAEGHEVKRLRFDKEGEVRETASQTTSSEISSVMVGETEASSSSQDKDKDSRCTRQHCTEEDEEEDEEEEEGI

SEQ ID NO: 882508 - protein, 277 aa, Homo sapiens [sequence omitted]

SEQ ID NO: 882509 - protein, 495 aa, Homo sapiens; identical to SEQ ID NO: 882506

SEQ ID NO: 882510 - protein, 317 aa, Homo sapiens
MLKSAVLFSHRKIQFHIFTEDSLKPEFDKQLRQWPDSYTKKFEHRIYPITFSVGNPQEWKKLFKPCAAQRLFLPVILKDVDSLLYVDTDVLFLRPVDDIWKLLRLFNSTQLAAMAPEHEIPKIGWYSRFARHPFYGSAGVNSGVMLMNLTRIRSTQFKNSMIPTGLAWEDMLYPLYQKYKNAITWGDQDLLNIIFYFNPECLYVFPCQWNYRPDHCMYGSNCREAEHEGVSVLHGNRGVYHDDKQPTFRALYEAIRDFPFQDNLFQSMYYPLQLKFLETVHTLCGRIPQVFLKQIEKTMKRAYEKHVIIHVGPNQMH

SEQ ID NO: 882511 - protein, 185 aa, Homo sapiens
MCQAPCWRAGGSGLGRCSLCRSCSLARFPRLPSFPPPGRLRAGVCAREGEGVGGVGGGVPVPKRPAEGGGGCEGLREAMDVERLQEALKDFEKRGKKEVCPVLDQFLCHVAKTGETIIPFTIQRLCELLTDPRRNYTGTDKFLRGVEKNVMVVSCVYPSSEKTISIGFKSNELVVCFLEIHQPFL

SEQ ID NO: 882512 - protein, 495 aa, Homo sapiens; identical to SEQ ID NO: 882506

SEQ ID NO: 882513 - protein, 663 aa, Homo sapiens
MLKSAVLFSHRKIQFHIFTEDSLKPEFDKQLRQWPDSYTKKFEHRIYPITFSVGNPQEWKKLFKPCAAQRLFLPVILKDVDSLLYVDTDVLFLRPVDDIWKLLRLFNSTQLAAMAPEHEIPKIGWYSRFARHPFYGSAGVNSGVMLMNLTRIRSTQFKNSMIPTGLAWEDMLYPLYQKYKNAITWGDQDLLNIIFYFNPECLYVFPCQWNYRPDHCMYGSNCREAEHEGVSVLHGNRGVYHDDKQPTFRALYEAIRDILRRGGKRKFVLSWMQFLCHVAKTGETMIQWSQFKGYFIFKLEKVMDDFRTSAPEPRGPPNPNVEYIPFDEMKERILKIVTGFNGIPFTIQRLCELLTDPRRNYTGTDKFLRGVEKNVMVVSCVYPSSEKNNSNSLNRMNGVMFPGNSPSYTERSNINGPGTPRPLNRPKVSLSAPMTTNGLPESTDSKEANLQQNEEKNHSDSSTSESEVSSVSPLKNKHPDEDAVEAEGHEVKRLRFDKEGEVRETASQTTSSEISSVMVGETEASSSSQDKDKDSRCTRQHCTEEDEEEDEEEEEESFMTSREMIPERKNQEKESDDALTVNEETSEENNQMEESDVSQAEKDLLHSEGSENEGPVSSSSSDCRETEELVGSNSSKTGEILSESSMENDDEATEVTDEPMEQD

SEQ ID NO: 882514 - protein, 470 aa, Homo sapiens
MCQAPCWRAGGSGLGRCSLCRSCSLARFPRLPSFPPPGRLRAGVCAREGEGVGGVGGGVPVPKRPAEGGGGCEGLREAMDVERLQEALKDFEKRGKKEVCPVLDQFLCHVAKTGETMIQWSQFKGYFIFKLEKVMDDFRTSAPEPRGPPNPNVEYIPFDEMKERILKIVTGFNGIPFTIQRLCELLTDPRRNYTGTDKFLRGVEKNVMVVSCVYPSSESNINGPGTPRPLNRPKVSLSAPMTTNGLPESTDSKEANLQQNEEKNHSDSSTSESEVSSVSPLKNKHPDEDAVEAEGHEVKRLRFDKEGEVRETASQTTSSEISSVMVGETEASSSSQDKDKDSRCTRQHCTEEDEEEDEEEEEESFMTSREMIPERKNQEKESDDALTVNEETSEENNQMEESDVSQAEKDLLHSEGSENEGPVSSSSSDCRETEELVGSNSSKTGEILSESSMENDDEATEVTDEPMEQD

SEQ ID NO: 882515 - protein, 495 aa, Homo sapiens; identical to SEQ ID NO: 882506

SEQ ID NO: 882516 - protein, 251 aa, Homo sapiens
MCQAPCWRAGGSGLGRCSLCRSCSLARFPRLPSFPPPGRLRAGVCAREGEGVGGVGGGVPVPKRPAEGGGGCEGLREAMDVERLQEALKDFEKRGKKEVCPVLDQFLCHVAKTGETMIQWSQFKGYFIFKLEKVMDDFRTSAPEPRGPPNPNVEYIPFDEMKERILKIVTGFNGIPFTIQRLCELLTDPRRNYTGTDKFLRGVEKNVMVVSWCYSFFKEKQFPLVLNRMNWWYVSWKFTSLSYRPKYNGPW

SEQ ID NO: 882517 - protein, 142 aa, Homo sapiens
MSPHPEAITDCVTLNTVGQLAEGGYPLRFSTLFQEQQKMNISQASVSFKDVTIEFTQEEWQQMAPVQKNLYRDVMLENYSNLVSVGYCCFKPEVIFKLEQGEEPWFSEEEFSNQSHPSELLSSSRHNSAGVVRLQVTLGVNT

SEQ ID NO: 882518 - protein, 119 aa, Homo sapiens
LFSTSSNSEPFRLNRNVLLQASVSFKDVTIEFTQEEWQQMAPVQKNLYRDVMLENYSNLVSVGYCCFKPEVIFKLEQGEEPWFSEEEFSNQSHPSELLSSSRHNSAGVVRLQVTLGVNT

SEQ ID NO: 882519 - protein, 683 aa, Homo sapiens
MSPHPEAITDCVTLNTVGQLAEGGYPLRFSTLFQEQQKMNISQASVSFKDVTIEFTQEEWQQMAPVQKNLYRDVMLENYSNLVSVGYCCFKPEVIFKLEQGEEPWFSEEEFSNQSHPKDYRGDDLIKQNKKIKDKHLEQAICINNKTLTTEEEKVLGKPFTLHVAAVASTKMSCKCNSWEVNLQSISEFIINNRNYSTKKIGCGNVCENSPFKINFEKTQTGEKFYEHNKNMKALNYNENLPKHPKFQTLEQAFECNKIGKAFNDKANCVKHNSSHTGETSSKDDEFRKNCDKKTLFDHRRTGTGKKHLHLNQCGKSFEKSTVEEYNKLNMGIKHYELNPSGNNFNRKAHLTDPQTAVIEENPLVSNDRTQTWVKSSEYHENKKSYQTSVHRVRRRSHSMMKPYKCNECGKSFCQKGHLIQHQRTHTGEKPFECSECGKTFSQKSHLSTHQRIHTAEKPYKCNECGKTFVQKSTLRGHQRIHTGEKPYECSECGKTFVQKSTLRDHHRIHTGEKSFQCNQCGKTFGQKSNLRIHQRTHTGEKTYQCNECEKSFWRKDHLIQHQKTHTGEKPFKCNECGKTFARTSTLRVHQRIHTGEKPFKCNECGKKFVRKAILSDHQRIHTGEKPFQCNKCGKTFGQKSNLRIHQRTHSGEKSYECNEYGKLCKKSTLSLYQKIQGEGNPY

SEQ ID NO: 882520 - protein, 683 aa, Homo sapiens; identical to SEQ ID NO: 882519

SEQ ID NO: 882521 - protein, 621 aa, Homo sapiens
MAPVQKNLYRDVMLENYSNLVSVGYCCFKPEVIFKLEQGEEPWFSEEEFSNQSHPKDYRGDDLIKQNKKIKDKHLEQAICINNKTLTTEEEKVLGKPFTLHVAAVASTKMSCKCNSWEVNLQSISEFIINNRNYSTKKIGCGNVCENSPFKINFEKTQTGEKFYEHNKNMKALNYNENLPKHPKFQTLEQAFECNKIGKAFNDKANCVKHNSSHTGETSSKDDEFRKNCDKKTLFDHRRTGTGKKHLHLNQCGKSFEKSTVEEYNKLNMGIKHYELNPSGNNFNRKAHLTDPQTAVIEENPLVSNDRTQTWVKSSEYHENKKSYQTSVHRVRRRSHSMMKPYKCNECGKSFCQKGHLIQHQRTHTGEKPFECSECGKTFSQKSHLSTHQRIHTAEKPYKCNECGKTFVQKSTLRGHQRIHTGEKPYECSECGKTFVQKSTLRDHHRIHTGEKSFQCNQCGKTFGQKSNLRIHQRTHTGEKTYQCNECEKSFWRKDHLIQHQKTHTGEKPFKCNECGKTFARTSTLRVHQRIHTGEKPFKCNECGKKFVRKAILSDHQRIHTGEKPFQCNKCGKTFGQKSNLRIHQRTHSGEKSYECNEYGKLCKKSTLSLYQKIQGEGNPY

SEQ ID NO: 882522 - protein, 683 aa, Homo sapiens; identical to SEQ ID NO: 882519

SEQ ID NO: 882523 - protein, 683 aa, Homo sapiens; identical to SEQ ID NO: 882519

SEQ ID NO: 882524 - protein, 142 aa, Homo sapiens; identical to SEQ ID NO: 882517

SEQ ID NO: 882525 - protein, 97 aa, Homo sapiens
TDMRVFVCACAVNPTFRLLPVSVCWCRGFAAQVRAPGLHADCGPAGRDVLVSRGRERDVPGTPPKQAVAPCASAGPGPQPEKGRWGRAPGALGGAES

SEQ ID NO: 882526 - protein, 543 aa, Homo sapiens
MSSFSYEPYYSTSYKRRYVETPRVHISSVRSGYSTARSAYSSYSAPVSSSLSVRRSYSSSSGSLMPSLENLDLSQVAAISNDLKSIRTQEKAQLQDLNDRFASFIERVHELEQQNKVLEAELLVLRQKHSEPSRFRALYEQEIRDLRLAAEDATNEKQALQGEREGLEETLRNLQARYEEEVLSREDAEGRLMEARKGADEAALARAELEKRIDSLMDEISFLKKVHEEEIAELQAQIQYAQISVEMDVTKPDLSAALKDIRAQYEKLAAKNMQNAEEWFKSRFTVLTESAAKNTDAVRAAKDEVSESRRLLKAKTLEIEACRGMNEALEKQLQELEDKQNADISAMQDTINKLENELRTTKSEMARYLKEYQDLLNVKMALDIEIAAYRKLLEGEETRLSFTSVGSITSGYSQSSQVFGRSAYGGLQTSSYLMSTRSFPSYYTSHVQEEQIEVEETIEAAKAEEAKDEPPSEGEAEEEEKDKEEAEEEEAAEEEEAAKEESEEAKEEEEGGEGEEGEETKEAEEEEKKVEGAGEEQAAKKKD

SEQ ID NO: 882527 - protein, 543 aa, Homo sapiens; identical to SEQ ID NO: 882526

SEQ ID NO: 882528 - protein, 450 aa, Homo sapiens
MSSFSYEPYYSTSYKRRYVETPRVHISSVRSGYSTARSAYSSYSAPVSSSLSVRRSYSSSSGSLMPSLENLDLSQVAAISNDLKSIRTQEKAQLQDLNDRFASFIERVHELEQQNKVLEAELLVLRQKHSEPSRFRALYEQEIRDLRLAAEDATNEKQALQGEREGLEETLRNLQARYEEEVLSREDAEGRLMEARKGAKNTDAVRAAKDEVSESRRLLKAKTLEIEACRGMNEALEKQLQELEDKQNADISAMQDTINKLENELRTTKSEMARYLKEYQDLLNVKMALDIEIAAYRKLLEGEETRLSFTSVGSITSGYSQSSQVFGRSAYGGLQTSSYLMSTRSFPSYYTSHVQEEQIEVEETIEAAKAEEAKDEPPSEGEAEEEEKDKEEAEEEEAAEEEEAAKEESEEAKEEEEGGEGEEGEETKEAEEEEKKVEGAGEEQAAKKKD

SEQ ID NO: 882529 - protein, 214 aa, Homo sapiens
MSAFCLSSSSCSCFSSAMQDTINKLENELRTTKSEMARYLKEYQDLLNVKMALDIEIAAYRKLLEGEETRLSFTSVGSITSGYSQSSQVFGRSAYGGLQTSSYLMSTRSFPSYYTSHVQEEQIEVEETIEAAKAEEAKDEPPSEGEAEEEEKDKEEAEEEEAAEEEEAAKEESEEAKEEEEGGEGEEGEETKEAEEEEKKVEGAGEEQAAKKKD

SEQ ID NO: 882530 - protein, 543 aa, Homo sapiens; identical to SEQ ID NO: 882526

SEQ ID NO: 882531 - protein, 527 aa, Homo sapiens
MSSFSYEPYYSTSYKRRYVETPRVHISSVRSGYSTARSAYSSYSAPVSSSLSVRRSYSSSSGSLMPSLENLDLSQVAAISNDLKSIRTQEKAQLQDLNDRFASFIERVHELEQQNKVLEAELLVLRQKHSEPSRFRALYEQEIRDLRLAAEDATNEKQALQGEREGLEETLRNLQARYEEEVLSREDAEGRLMEARKGADEAALARLKKVHEEEIAELQAQIQYAQISVEMDVTKPDLSAALKDIRAQYEKLAAKNMQNAEEWFKSRFTVLTESAAKNTDAVRAAKDEVSESRRLLKAKTLEIEACRGMNEALEKQLQELEDKQNADISAMQDTINKLENELRTTKSEMARYLKEYQDLLNVKMALDIEIAAYRKLLEGEETRLSFTSVGSITSGYSQSSQVFGRSAYGGLQTSSYLMSTRSFPSYYTSHVQEEQIEVEETIEAAKAEEAKDEPPSEGEAEEEEKDKEEAEEEEAAEEEEAAKEESEEAKEEEEGGEGEEGEETKEAEEEEKKVEGAGEEQAAKKKD

SEQ ID NO: 882532 - protein, 327 aa, Homo sapiens
MDEISFLKKVHEEEIAELQAQIQYAQISVEMDVTKPDLSAALKDIRAQYEKLAAKNMQNAEEWFKSRFTVLTESAAKNTDAVRAAKDEVSESRRLLKAKTLEIEACRGMNEALEKQLQELEDKQNADISAMQDTINKLENELRTTKSEMARYLKEYQDLLNVKMALDIEIAAYRKLLEGEETRLSFTSVGSITSGYSQSSQVFGRSAYGGLQTSSYLMSTRSFPSYYTSHVQEEQIEVEETIEAAKAEEAKDEPPSEGEAEEEEKDKEEAEEEEAAEEEEAAKEESEEAKEEEEGGEGEEGEETKEAEEEEKKVEGAGEEQAAKKKD

SEQ ID NO: 882533 - protein, 426 aa, Homo sapiens
MSSFSYEPYYSTSYKRRYVETPRVHISSVRSGYSTARSAYSSYSAPVSSSLSVRRSYSSSSGSLMPSLENLDLSQVAAISNDLKSIRTQEKAQLQDLNDRFASFIERVHELEQQNKVLEAELLVLRQKHSEPSRFRALYEQEIRDLRLAAEDATNEKQALQGEREGLEETLRNLQARYEEEVLSREDAEGRLMEARKGADEAALARAELEKRIDSLMDEISFLKKVHEEEIAELQAQIQYAQISVEMDVTKPDLSAALKDIRAQYEKLAAKNMQNAEEWFKSRFTVLTESAAKNTDAVRAAKDEVSESRRLLKAKTLEIEACRGMNEALEKQLQELEDKQNADISAMQDTINKLENELRTTKSEMARYLKEYQDLLNVKMALDIEIAAYRKLLEGEETRLSFTSVGSITSGYSQSSQYARSPDAGR

SEQ ID NO: 882534 - protein, 522 aa, Homo sapiens
GFLPATKNLLNEKNHGVLHTSVVLLTEMCERSPDMLAHFRENEKLVPQLVRILKNLIMSGYSPGHDVSGISDPFLQVRILRLLRILGRNDDDSSEAMNDILAQVATNTETSKNVGNAILYETVLTIMDIKSESGLRVLAINILGRFLLNNDKNIRYVALTSLLKTVQTDHNAVQRHRSTIVDCLKDLDVSIKRRAMELSFALVNGNNIRGMMKELLYFLDSCEPEFKADCASGIFLAAEKYAPSKRWHIDTIMRVLTTAGSYVRDDAVPNLIQLITNSVEMHAYTVQRLYKAILGDYSQQPLVQVAAWCIGEYGDLLVSGQCEEEEPIQVTEDEVLDILESVLISNMSTSVTRGYALTAIMKLSTRFTCTVNRIKKVVSIYGSSIDVELQRRAVEYNALFKKYDHMRSALLERMPVMEKVTTNGPTEIVQTNGETEPAPLETKPPPSGPQPTSQANDLLDLLGGNDITPVIPTAPTSKPSSAGGELLDLLGDINLTGSHSVSQAGVQWDYLGSLQPLPPAFR

SEQ ID NO: 882535 - protein, 522 aa, Homo sapiens; identical to SEQ ID NO: 882534

SEQ ID NO: 882536 - protein, 522 aa, Homo sapiens; identical to SEQ ID NO: 882534

SEQ ID NO: 882537 - protein, 98 aa, Homo sapiens
SPLLLLLSTAQEVSLFMKRETYWEVQDSGISPLLLLLSTALDCSPEAETRQSPGGRKMLQEPTLSMSLQILTGFLWVQLWNWETFLRIRTHSTDASCP

SEQ ID NO: 882538 - protein, 452 aa, Homo sapiens
MLCGRPRSSSDNRNFLRERAGLSSAAVQTRIGNSAASRRSPAARPPVPAPPALPRGRPGTEGSTSLSAPAVLVVAVAVVVVVVSAVAWAMANYIHVPPGSPEVPKLNVTVQDQEEHRCREGALSLLQHLRPHWDPQEVTLQLFTDGITNKLIGCYVGNTMEDVVLVRIYGNKTELLVDRDEEVKSFRVLQAHGCAPQLYCTFNNGLCYEFIQGEALDPKHVCNPAIFRLIARQLAKIHAIHAHNGWIPKSNLWLKMGKYFSLIPTGFADEDINKRFLSDIPSSQILQEEMTWMKEILSNLGSPVVLCHNDLLCKNIIYNEKQGDVQFIDYEYSGYNYLAYDIGNHFNEFAGVSDVDYSLYPDRELQSQWLRAYLEAYKEFKGFGTEVTEKEVEILFIQVNQFALASHFFWGLWALIQAKYSTIEFDFLGYAIVRFNQYFKMKPEVTALKVPE

SEQ ID NO: 882539 - protein, 434 aa, Homo sapiens
MLCGRPRSSSDNRNFLRERAGLSSAAVQTRIGNSAASRRSPAARPPVPAPPALPRGRPGTEGSTSLSAPAVLVVAVAVVVVVVSAVAWAMANYIHVPPGSPEVPKLNVTVQDQEEHRCREGALSLLQHLRPHWDPQEVTLQLFTDGITNKLIGCYVGNTMEDVVLVRIYGNKTELLVDRDEEVKSFRVLQAHGCAPQLYCTFNNGLCYEFIQGEALDPKHVCNPAIFRLIARQLAKIHAIHAHNGWIPKSNLWLKMGKYFSLIPTGFADEDINKRFLSDIPSSQILQEEMTWMKEILSNLGSPVVLCHNDLLCKNIIYNEKQGDVQFIDYEYSGYNYLAYDIGNHFNEFAGVSDVDYSLYPDRELQSQWLRAYLEAYKEFKGFGTEVTEKEVEILFIQVNQFALGENLNFIIGNKYCQLFSLKWLLISFGDCGL

SEQ ID NO: 882540 - protein, 258 aa, Homo sapiens
MLCGRPRSSSDNRNFLRERAGLSSAAVQTRIGNSAASRRSPAARPPVPAPPALPRGRPGTEGSTSLSAPAVLVVAVAVVVVVVSAVAWAMANYIHVPPGSPEVPKLNVTVQDQEEHRCREGALSLLQHLRPHWDPQEVTLQLFTDGITNKLIGCYVGNTMEDVVLVRIYGNKTELLVDRDEEVKSFRVLQAHGCAPQLYCTFNNGLCYEFIQGEALDPKHVCNPAIFSLSSLTLCKGKTTRCFGLTGCRGSRLLLSFF

SEQ ID NO: 882541 - protein, 192 aa, Homo sapiens
MLCGRPRSSSDNRNFLRERAGLSSAAVQTRIGNSAASRRSPAARPPVPAPPALPRGRPGTEGSTSLSAPAVLVVAVAVVVVVVSAVAWAMANYIHVPPGSPEVPKLNVTVQDQEEHRCREGALSLLQHLRPHWDPQEVTLQEFPFFTLTAFPPGFLVHVGVSVSARSVKLLDRIHNPVKRSAFYLHLAQRLY

SEQ ID NO: 882542 - protein, 452 aa, Homo sapiens; identical to SEQ ID NO: 882538

SEQ ID NO: 882543 - protein, 452 aa, Homo sapiens; identical to SEQ ID NO: 882538

SEQ ID NO: 882544 - protein, 373 aa, Homo sapiens
KLAAAEEGLRELQRSRRLCHEDVEALAAIYEEKEAWYREESDSLSLLQHLRPHWDPQEVTLQLFTDGITNKLIGCYVGNTMEDVVLVRIYGNKTELLVDRDEEVKSFRVLQAHGCAPQLYCTFNNGLCYEFIQGEALDPKHVCNPAIFRLIARQLAKIHAIHAHNGWIPKSNLWLKMGKYFSLIPTGFADEDINKRFLSDIPSSQILQEEMTWMKEILSNLGSPVVLCHNDLLCKNIIYNEKQGDVQFIDYEYSGYNYLAYDIGNHFNEFAGVSDVDYSLYPDRELQSQWLRAYLEAYKEFKGFGTEVTEKEVEILFIQVNQFALASHFFWGLWALIQAKYSTIEFDFLGYAIVRFNQYFKMKPEVTALKVPE

SEQ ID NO: 882545 - protein, 452 aa, Homo sapiens; identical to SEQ ID NO: 882538

SEQ ID NO: 882546 - protein, 275 aa, Homo sapiens
MLCGRPRSSSDNRNFLRERAGLSSAAVQTRIGNSAASRRSPAARPPVPAPPALPRGRPGTEGSTSLSAPAVLVVAVAVVVVVVSAVAWAMANYIHVPPGSPEVPKLNVTVQDQEEHRCREGALSLLQHLRPHWDPQEVTLQLFTDGITNKLIGCYVGNTMEDVVLVRIYGNKTELLVDRDEEVKSFRVLQAHGCAPQLYCTFNNGLCYEFIQGEALDPKHVCNPAIFRLIARQLAKIHAIHAHNGWIPKSNLWLKMGKYFSLIPTGFADEDINKR

SEQ ID NO: 882547 - protein, 330 aa, Homo sapiens
MLCGRPRSSSDNRNFLRERAGLSSAAVQTRIGNSAASRRSPAARPPVPAPPALPRGRPGTEGSTSLSAPAVLVVAVAVVVVVVSAVAWAMANYIHVPPGSPEVPKLNVTVQDQEEHRCREGALSLLQHLRPHWDPQEVTLQLFTDGITNKLIGCYVGNTMEDVVLVRIYGNKTELLVDRDEEVKSFRVLQAHGCAPQLYCTFNNGLCYEFIQGEALDPKHVCNPAIFRLIARQLAKIHAIHAHNGWIPKSNLWLKMGKYFSLIPTGFADEDINKRFLSDIPSSQILQEEMTWMKEILSNLGSPVVLCHNDLLCKNIIYNEKQGRYLTLAV

SEQ ID NO: 882548 - protein, 140 aa, Homo sapiens
LSSAAVQTRIGNSAASRRSPAARPPVPAPPALPRGRPGTEGSTSLSAPAVLVVAVAVVVVVVSAVAWAMANYIHVPPGSPEVPKLNVTVQDQEEHRCREGALSLLQHLRPHWDPQEVTLQVTPTPQLWVSYAPHAALGVL

SEQ ID NO: 882549 - protein, 254 aa, Homo sapiens; identical to SEQ ID NO: 796286

SEQ ID NO: 882550 - protein, 135 aa, Homo sapiens
MPIKPVGWICGQVLKNFSGRIEGIQKAIMDLVDEFKDEFPTILRLSQSNQKREPAQKTSKIRMAIALAKINRATLIRGLNSISRSSKSVAKLLHPQLACRLLELRDISGRLLREVNAPRQPLYNIQEKKMGLQLS

SEQ ID NO: 882551 - protein, 254 aa, Homo sapiens; identical to SEQ ID NO: 796286

SEQ ID NO: 882552 - protein, 182 aa, Homo sapiens
MPIKPVGWICGQVLKNFSGRIEGIQKAIMDLVDEFKDEFPTILRLSQSNQKREPAQKTSKIRMAIALAKINRATLIRGLNSISRSSKSVAKLLHPQLACRLLELRDISGRLLREVNAPRQPLYNIQVRKGSLFEIISFPAKTALTSIIYASYAALIYLEEILSQAWWCVPIIPATQEADGGG

SEQ ID NO: 882553 - protein, 157 aa, Homo sapiens
MNLDGSAQDPEKREYSSVCVGREDDIKKSERMTAVVHDREVVIFYHKGEYHAMDIRCYHSGGPLHLGDIEDFDGRPCIVCPWHKYKITLATGEGLYQSINPKDPSAKPKWCSKGIKQRIHTVTVDNGNIYVTLSNEPFKCDSDFYATGDFKVIKSSS

SEQ ID NO: 882554 - protein, 210 aa, Homo sapiens; identical to SEQ ID NO: 779430

SEQ ID NO: 882555 - protein, 553 aa, Homo sapiens
GGAEGQARGKRFVPRVVPAPGGARERRESECRARPGDLHGRAGWNRRKRSSRVPARPAPPAAEAASARAQRSRWEPEAPRHKGRRDAGAGKGKAKAARPAGDWVKAPRSFPDAGCTRTSWSSLARRSHGHRSLATEYVFSDFLLKEPTEPKFKGLRLELAVDKMVTCIAVGLPLLLISLAFAQEISIGTQISCFSPSSFSWRQAAFVDSYCWAAVQQKNSLQSESGNLPLWLHKFFPYILLLFAILLYLPPLFWRFAAAPHICSDLKFIMEELDKVYNRAIKAAKSARDLDMRDGACSVPGVTENLGQSLWEVSESHFKYPIVEQYLKTKKNSNNLIIKYISCRLLTLIIILLACIYLGYYFSLSSLSDEFVCSIKSGILRNDSTVPDQFQCKLIAVGIFQLLSVINLVVYVLLAPVVVYTLFVPFRQKTDVLKVYEILPTFDVLHFKSEGYNDLSLYNLFLEENISEVKSYKCLKVLENIKSSGQGIDPMLLLTNLGMIKMDVVDGKTPMSAEMREEQGNQTAELQGMNIDSETKANNGEKNARQRLLDSSC

SEQ ID NO: 882556 - protein, 534 aa, Homo sapiens
GGAEGQARGKRFVPRVVPAPGGARERRESECRARPGDLHGRAGWNRRKRSSRVPARPAPPAAEAASARAQRSRWEPEAPRHKGRRDAGAGKGKAKAARPAGDWVKAPRSFPDAGCTRTSWSSLARRSHGHRSLATEYVFSDFLLKEPTEPKFKGLRLELAVDKMVTCIAVGLPLLLISLAFAQEISIGTQISCFSPSSFSWRQAAFVDSYCWAAVQQKNSLQSESGNLPLWLHKFFPYILLLFAILLYLPPLFWRFAAAPHICSDLKFIMEELDKVYNRAIKAAKSARDLDMRDGACSVPGVTENLGQSLWEVSESHFKYPIVEQYLKTKKNSNNLIIKYISCRLLTLIIILLACIYLGYYFSLSSLSDEFVCSIKSGILRNDSTVPDQFQCKLIAVGIFQLLSVINLVVYVLLAPVVVYTLFVPFRQKTDVLKVYEILPTFDVLHFKSEGYNDLSLYNLFLEENISEVKSYKCLKVLENIKSSGQGIDPMLLLTNLGMIKMDVVDGKSMNIDSETKANNGEKNARQRLLDSSC

SEQ ID NO: 882557 - protein, 553 aa, Homo sapiens; identical to SEQ ID NO: 882555

SEQ ID NO: 882558 - protein, 553 aa, Homo sapiens; identical to SEQ ID NO: 882555

SEQ ID NO: 882559 - protein, 101 aa, Homo sapiens
GRLLLLNWRPRRPSPRCWCTVRPGMSGSACRSTAWPGRSTAGVCLTASCPTSTEAAPPPQVGACAHSSTSTPRTRSLDTLGTQGLAPHPALRMNNLREEVV

SEQ ID NO: 882560 - protein, 418 aa, Homo sapiens
MAPTQGPRAPLEFGGPLGAAALLLLLPATMFHLLLAARSGPARLLGPPASLPGLEVLWSPRALLLWLAWLGLQAALYLLPARKVAEGQELKDKSRLRYPINGFQALVLTALLVGLGMSAGLPLGALPEMLLPLAFVATLTAFIFSLFLYMKAQVAPVSALAPGGNSGNPIYDFFLGRELNPRICFFDFKYFCELRPGLIGWVLINLALLMKEAELRGSPSLAMWLVNGFQLLYVGDALWHEEAVLTTMDITHDGFGFMLAFGDMAWVPFTYSLQAQFLLHHPQPLGLPMASVICLINATGYYIFRGANSQKNTFRKNPSDPRVAGLETISTATGRKLLVSGWWGMVRHPNYLGDLIMALAWSLPCGVSHLLPYFYLLYFTALLVHREARDERQCLQKYGLAWQEYCRRVPYRIMPYIY

SEQ ID NO: 882561 - protein, 439 aa, Homo sapiens
MALPAGAAALLLLLPATMFHLLLAARSGPARLLGPPASLPGLEVLWSPRALLLWLAWLGLQAALYLLPARKVRAPLADARGREANGLGEGKDAPGLIRAPLDPQVAEGQELKDKSRLRYPINGFQALVLTALLVGLGMSAGLPLGALPEMLLPLAFVATLTAFIFSLFLYMKAQVAPVSALAPGGNSGNPIYDFFLGRELNPRICFFDFKYFCELRPGLIGWVLINLALLMKEAELRGSPSLAMWLVNGFQLLYVGDALWHEEAVLTTMDITHDGFGFMLAFGDMAWVPFTYSLQAQFLLHHPQPLGLPMASVICLINATGYYIFRGANSQKNTFRKNPSDPRVAGLETISTATGRKLLVSGWWGMVRHPNYLGDLIMALAWSLPCGVSHLLPYFYLLYFTALLVHREARDERQCLQKYGLAWQEYCRRVPYRIMPYIY

SEQ ID NO: 882562 - protein, 418 aa, Homo sapiens; identical to SEQ ID NO: 882560

SEQ ID NO: 882563 - protein, 418 aa, Homo sapiens; identical to SEQ ID NO: 882560

SEQ ID NO: 882564 - protein, 523 aa, Homo sapiens
MAPTQGPRAPLEFGGPLGAAALLLLLPATMFHLLLAARSGPARLLGPPASLPGLEVLWSPRALLLWLAWLGLQAALYLLPARKVAEGQELKDKSRLRYPINGFQALVLTALLVGLGMSAGLPLGALPEMLLPLAFVATLTAFIFSLFLYMKAQVAPVSALAPGGNSGNPIYDFFLGRELNPRICFFDFKYFCELRPGLIGWVLINLALLMKEAELRGSPSLAMWLVNGFQLLYVGDALWHEEAVLTTMDITHDGFGFMLAFGDMAWVPFTYSLQAQFLLHHPQPLGLPMASVICLINGQSGRGSRLGPSSPYPFDSCSVYTHHHIGANPQGSLKPGQGPGGPGRVWAADKLEQMFGVRQEAATLDLDHRFTLSHQLLVTTSSVGRIPRKTLSERILLTPEWLVSWFSRAMGEVGQLGFLGTLHPAVFSPGLETISTATGRKLLVSGWWGMVRHPNYLGDLIMALAWSLPCGVSHLLPYFYLLYFTALLVHREARDERQCLQKYGLAWQEYCRRVPYRIMPYIY

SEQ ID NO: 882565 - protein, 302 aa, Homo sapiens
MSAGLPLGALPEMLLPLAFVATLTAFIFSLFLYMKAQVAPVSALAPGGNSGNPIYDFFLGRELNPRICFFDFKYFCELRPGLIGWVLINLALLMKEAELRGSPSLAMWLVNGFQLLYVGDALWHEEAVLTTMDITHDGFGFMLAFGDMAWVPFTYSLQAQFLLHHPQPLGLPMASVICLINATGYYIFRGANSQKNTFRKNPSDPRVAGLETISTATGRKLLVSGWWGMVRHPNYLGDLIMALAWSLPCGVSHLLPYFYLLYFTALLVHREARDERQCLQKYGLAWQEYCRRVPYRIMPYIY

SEQ ID NO: 882566 - protein, 290 aa, Homo sapiens [sequence omitted]

SEQ ID NO: 882567 - protein, 407 aa, Homo sapiens
MAPTQGPRAPLEFGGPLGAAALLLLLPATMFHLLLAARSGPARLLGPPASLPGLEVLWSPRALLLWLAWLGLQAALYLLPARKVAEGQELKDKSRLRYPINGFQALVLTALLVGLGMSAGLPLGALPEMLLPLAFVATLTAFIFSLFLYMKAQVAPVSALAPGGNSELNPRICFFDFKYFCELRPGLIGWVLINLALLMKEAELRGSPSLAMWLVNGFQLLYVGDALWHEEAVLTTMDITHDGFGFMLAFGDMAWVPFTYSLQAQFLLHHPQPLGLPMASVICLINATGYYIFRGANSQKNTFRKNPSDPRVAGLETISTATGRKLLVSGWWGMVRHPNYLGDLIMALAWSLPCGVSHLLPYFYLLYFTALLVHREARDERQCLQKYGLAWQEYCRRVPYRIMPYIY

SEQ ID NO: 882568 - protein, 355 aa, Homo sapiens
MAPTQGPRAPLEFGGPLGAAALLLLLPATMFHLLLAARSGPARLLGPPASLPGLEVLWSPRALLLWLAWLGLQAALYLLPARKVAEGQELKDKSRLRYPINGFQALVLTALLVGLGMSAGLPLGALPEMLLPLAFVATLTAFIFSLFLYMKAQVAPVSALAPGGNSGNPIYDFFLGRELNPRICFFDFKYFCELRPGLIGWVLINLALLMKEAELRGSPSLAMWLVNGFQLLYVGDALWHEEAVLTTMDITHDGFGFMLAFGDMAWVPFTYSLQAQFLLHHPQPLGLPMASVICLINVWYYIFVGRIPENIRKIFEPSGGEPFKHGELWAGAMPPHWPMAVRRVTAITQPVHDEG

SEQ ID NO: 882569 - protein, 359 aa, Homo sapiens
MWRRAAPGLTVRCGSGFQALVLTALLVGLGMSAGLPLGALPEMLLPLAFVATLTAFIFSLFLYMKAQVAPVSALAPGGNSGNPIYDFFLGRELNPRICFFDFKYFCELRPGLIGWVLINLALLMKEAELRGSPSLAMWLVNGFQLLYVGDALWHEVRLELDEGGCLRAAEGLSQCVWVLSLQEAVLTTMDITHDGFGFMLAFGDMAWVPFTYSLQAQFLLHHPQPLGLPMASVICLINATGYYIFRGANSQKNTFRKNPSDPRVAGLETISTATGRKLLVSGWWGMVRHPNYLGDLIMALAWSLPCGVSHLLPYFYLLYFTALLVHREARDERQCLQKYGLAWQEYCRRVPYRIMPYIY

SEQ ID NO: 882570 - protein, 418 aa, Homo sapiens; identical to SEQ ID NO: 882560

SEQ ID NO: 882571 - protein, 495 aa, Homo sapiens
MAPTQGPRAPLEFGGPLGAAALLLLLPATMFHLLLAARSGPARLLGPPASLPGLEVLWSPRALLLWLAWLGLQAALYLLPARKVAEGQELKDKSRLRYPINGFQALVLTALLVGLGMSAGLPLGALPEMLLPLAFVATLTAFIFSLFLYMKAQVAPVSALAPGGNSGNPIYDFFLGRELNPRICFFDFKYFCELRPGLIGWVLINLALLMKEAELRGSPSLAMWLVNGFQLLYVGDALWHEEAVLTTMDITHDGFGFMLAFGDMAWVPFTYSLQAQFLLHHPQPLGLPMASVICLINGQSGRGSRLGPSSPYPFDSCSVYTHHHIGANPQGSLKPGQGPGGPGRVWAADKLGRCSGSGRRLQPLTLTTGSHSLTTTGYYIFRGANSQKNTFRKNPSDPRVAGLETISTATGRKLLVSGWWGMVRHPNYLGDLIMALAWSLPCGVSHLLPYFYLLYFTALLVHREARDERQCLQKYGLAWQEYCRRVPYRIMPYIY

SEQ ID NO: 882572 - protein, 418 aa, Homo sapiens; identical to SEQ ID NO: 882560

SEQ ID NO: 882573 - protein, 332 aa, Homo sapiens [sequence omitted]

SEQ ID NO: 882574 - protein, 332 aa, Homo sapiens [sequence omitted]

SEQ ID NO: 882575 - protein, 209 aa, Homo sapiens [sequence omitted]

SEQ ID NO: 882576 - protein, 281 aa, Homo sapiens
RPPTTTKFGAASTKAQVAPVSALAPGGNSGNPIYDFFLGRELNPRICFFDFKYFCELRPGLIGWVLINLALLMKEAELRGSPSLAMWLVNGFQLLYVGDALWHEEAVLTTMDITHDGFGFMLAFGDMAWVPFTYSLQAQFLLHHPQPLGLPMASVICLINATGYYIFRGANSQKNTFRKNPSDPRVAGLETISTATGRKLLVSGWWGMVRHPNYLGDLIMALAWSLPCGVSHLLPYFYLLYFTALLVHREARDERQCLQKYGLAWQEYCRRVPYRIMPYIY

SEQ ID NO: 882577 - protein, 379 aa, Homo sapiens
ASCRFGTRVQAGAGAAGPDPPRGRVHLLGNGADSVSLTDYCAAALLLLLPATMFHLLLAARSGPARLLGPPASLPGLEVLWSPRALLLWLAWLGLQAALYLLPARKVAEGQELKDKSRLRYPINGFQALVLTALLVGLGMSAGLPLGALPEMLLPLAFVATLTAFIFSLFLYMKAQVAPVSALAPGGNSGNPIYDFFLGRELNPRICFFDFKYFCELRPGLIGWVLINLALLMKEAELRGSPSLAMWLVNGFQLLYVGDALWHEEAVLTTMDITHDGFGFMLAFGDMAWVPFTYSLQAQFLLHHPQPLGLPMASVICLINVWYYIFGGANSKKPSENLWNQVVVEPFKHGELWAGAMPPHWPMAVRRVTAITQPVHDEG

SEQ ID NO: 882578 - protein, 154 aa, Homo sapiens
MLVQEQFQAVLPEGAQSSSTEMSSWNQNHWLSLAACFLLSLHMRSQPSILLDARSNCTHGKSELPLSLSLSLVVIRIHQNPCLDLSLAEAALFPTEFLCPLVRTISLLLWAFPRAYFSSAGCLFFFFFLHFVTCFNIYIFYVSKEVINFNFQNS

SEQ ID NO: 882579 - protein, 958 aa, Homo sapiens
METQELRGALALLLLCFFTSASQDLQVIDLLTVGESRQMVAVAEKIRTALLTAGDIYLLSTFRLPPKQGGVLFGLYSRQDNTRWLEASVVGKINKVLVRYQREDGKVHAVNLQQAGLADGRTHTVLLRLRGPSRPSPALHLYVDCKLGDQHAGLPALAPIPPAEVDGLEIRTGQKAYLRMQGFVESMKIILGGSMARVGALSECPFQGDESIHSAVTNALHSILGEQTKALVTQLTLFNQILVELRDDIRDQVKEMSLIRNTIMECQVCGFHEQRSHCSPNPCFRGVDCMEVYEYPGYRCGPCPPGLQGNGTHCSDINECAHADPCFPGSSCINTMPGFHCEACPRGYKGTQVSGVGIDYARASKQVCNDIDECNDGNNGGCDPNSICTNTVGSFKCGPCRLGFLGNQSQGCLPARTCHSPAHSPCHIHAHCLFERNGAVSCQCNVGWAGNGNVCGTDTDIDGYPDQALPCMDNNKHCKQDNCLLTPNSGQEDADNDGVGDQCDDDADGDGIKNVEDNCRLFPNKDQQNSDTDSFGDACDNCPNVPNNDQKDTDGNGEGDACDNDVDGDGIPNGLDNCPKVPNPLQTDRDEDGVGDACDSCPEMSNPTQTDADSDLVGDVCDTNEDSDYDGDGHQDTKDNCPQLPNSSQLDSDNDGLGDECDGDDDNDGIPDYVPPGPDNCRLVPNPNQKDSDGNGVGDVCEDDFDNDAVVDPLDVCPESAEVTLTDFRAYQTVVLDPEGDAQIDPNWVVLNQGMEIVQTMNSDPGLAVGYTAFNGVDFEGTFHVNTVTDDDYAGFLFSYQDSGRFYVVMWKQTEQTYWQATPFRAVAQPGLQLKAVTSVSGPGEHLRNALWHTGHTPDQVRLLWTDPRNVGWRDKTSYRWQLLHRPQVGYIRVKLYEGPQLVADSGVIIDTSMRGGRLGVFCFSQENIIWSNLQYRCNDTVPEDFEPFRRQLLQGRV

SEQ ID NO: 882580 - protein, 137 aa, Homo sapiens [sequence omitted]

SEQ ID NO: 882581 - protein, 401 aa, Homo sapiens
VLVTTLCYPCLLGIPNGLDNCPKVPNPLQTDRDEDGVGDACDSCPEMSNPTQTDADSDLVGDVCDTNEDSDYDGDGHQDTKDNCPQLPNSSQLDSDNDGLGDECDGDDDNDGIPDYVPPGPDNCRLVPNPNQKDSDGNGVGDVCEDDFDNDAVVDPLDVCPESAEVTLTDFRAYQTVVLDPEGDAQIDPNWVVLNQGMEIVQTMNSDPGLAVGYTAFNGVDFEGTFHVNTVTDDDYAGFLFSYQDSGRFYVVMWKQTEQTYWQATPFRAVAQPGLQLKAVTSVSGPGEHLRNALWHTGHTPDQVRLLWTDPRNVGWRDKTSYRWQLLHRPQVGYIRVKLYEGPQLVADSGVIIDTSMRGGRLGVFCFSQENIIWSNLQYRCNDTVPEDFEPFRRQLLQGRV

SEQ ID NO: 882582 - protein, 409 aa, Homo sapiens
RTHDCMAKEISFYNLVVLANGIPNGLDNCPKVPNPLQTDRDEDGVGDACDSCPEMSNPTQTDADSDLVGDVCDTNEDSDYDGDGHQDTKDNCPQLPNSSQLDSDNDGLGDECDGDDDNDGIPDYVPPGPDNCRLVPNPNQKDSDGNGVGDVCEDDFDNDAVVDPLDVCPESAEVTLTDFRAYQTVVLDPEGDAQIDPNWVVLNQGMEIVQTMNSDPGLAVGYTAFNGVDFEGTFHVNTVTDDDYAGFLFSYQDSGRFYVVMWKQTEQTYWQATPFRAVAQPGLQLKAVTSVSGPGEHLRNALWHTGHTPDQVRLLWTDPRNVGWRDKTSYRWQLLHRPQVGYIRVKLYEGPQLVADSGVIIDTSMRGGRLGVFCFSQENIIWSNLQYRCNDTVPEDFEPFRRQLLQGRV

SEQ ID NO: 882583 - protein, 294 aa, Homo sapiens [sequence omitted]

SEQ ID NO: 882584 - protein, 294 aa, Homo sapiens [sequence omitted]

SEQ ID NO: 882585 - protein, 564 aa, Homo sapiens
METQELRGALALLLLCFFTSASQDLQVIDLLTVGESRQMVAVAEKIRTALLTAGDIYLLSTFRLPPKQGGVLFGLYSRQDNTRWLEASVVGKINKVLVRYQREDGKVHAVNLQQAGLADGRTHTVLLRLRGPSRPSPALHLYVDCKLGDQHAGLPALAPIPPAEVDGLEIRTGQKAYLRMQGFVESMKIILGGSMARVGALSECPFQGDESIHSAVTNALHSILGEQTKALVTQLTLFNQILVELRDDIRDQSLGGLAKGGTDSGVGWQMSSADSSSILLQVKEMSLIRNTIMECQVCGFHEQRSHCSPNPCFRGVDCMEVYEYPGYRCGPCPPGLQGNGTHCSDINECAHADPCFPGSSCINTMPGFHCEACPRGYKGTQVSGVGIDYARASKQVCNDIDECNDGNNGGCDPNSICTNTVGSFKCGPCRLGFLGNQSQGCAVTSVSGPGEHLRNALWHTGHTPDQVRLLWTDPRNVGWRDKTSYRWQLLHRPQVGYIRVKLYEGPQLVADSGVIIDTSMRGGRLGVFCFSQENIIWSNLQYRCNDTVPEDFEPFRRQLLQGRV

SEQ ID NO: 882586 - protein, 265 aa, Homo sapiens
METQELRGALALLLLCFFTSASQDLQVIDLLTVGESRQMVAVAEKIRTALLTAGDIYLLSTFRLPPKQGGVLFGLYSRQDNTRWLEASVVGKINKVLVRYQREDGKVHAVNLQQAGLADGRTHTVLLRLRGPSRPSPALHLYVDCKLGDQHAGLPALAPIPPAEVDGLEIRTGQKAYLRMQGFVESMKIILGGSMARVGALSECPFQGDESIHSAVTNALHSILGEQTKALVTQLTLFNQILVELRDDIRDQVWVGWRRVALILG

SEQ ID NO: 882587 - protein, 106 aa, Homo sapiens [sequence omitted]

SEQ ID NO: 882588 - protein, 135 aa, Homo sapiens
LGPALECGFAGLVLAPFSQAHVLLLFQGVLGCFSCRGAAALPGCPRDNTPLAARLPALLRARAGKSFLVSPGSCPSPAPGAGCRRPLQLSQCSSSPTFSAHRCVLAIGGPLAHGATGASPTDTSFWERSEQFIES

SEQ ID NO: 882589 - protein, 198 aa, Homo sapiens
LGPALECGFAGLVLAPFSQAHVLLLFQGVLGCFSCRGAAALPGCPRDNTPLAARLPALLRARAGKSFLVSPGSCPSPAPGAGCRRPLQLSQCSSSPTFSAHRCVLAIGGPLAHGATGASPTDTSFWERSCTGGMAGEASENLQSWQKVKGKPAHLHMMAGTLYVIEVSPKNEIVSFAKTWMELEAFILSELTQEQKAK

SEQ ID NO: 882590 - protein, 922 aa, Homo sapiens
MDKKSFEMVLDEIRKVVDLLRYFSWAEPQLKAMKALQHKMVAVQPTEVVNILNCFTFSKDKLVALELLASNIIDAQNSRPIEDLFRVNMSEKKRCKRILEQAFKGGCKAPHAMISSCGTIPGNPYPKGRPSRINGIFPGTPLKKDGEECTNEGKGIAARILGPSKPPPSTYNPHKPVPYPIPPCRPHATIAPSAYNNAGLVPLANVIAPPPPPYTPNPVGTENEDLSNPSKPIQNQTFSTPASQLFSPHGSNPSTPAATPVPTASPVKAINHPSASAAATVSGMNLLNTVLPVFPGQVSSAVHTPQPSIPNPTVIRTPSLPTAPVTSIHSTTTTPVPSIFSGLVSLPGPSATPTAATPTPGPTPRSTLGSSEAFASTSAPFTSLPFSTSSSAASTSNPNSASLSSVFAGLPLPLPPTSQGLSNPTPVIAGGSTPSVAGPLGVNSPLLSALKGFLTSNDTNLINSSALSSAVTSGLASLSSLTLQNSDSSASAPNKCYAPSAIPTPQRTSTPGLALFPGLPSPVANSTSTPLTLPVQSPLATAASASTSVPVSCGSSASLLRGPHPGTSDLHISSTPAATTLPVMIKTEPTSPTPSAFKGPSHSGNPSHGTLGLSGTLGRAYTSTSVPISLSACLNPALSGLSSLSTPLNGSNPLSSISLPPHGSSTPIAPVFTALPSFTSLTNNFPLTGNPSLNPSVSLPGSLIATSSTAATSTSLPHPSSTAAVLSGLSASAPVSAAPFPLNLSTAVPSLFSVTQGPLSSSNPSYPGFSVSNTPSVTPALPSFPGLQAPSTVAAVTPLPVAATAPSPAPVLPGFASAFSSNFNSALVAQAGLSSGLQAAGSSVFPGLLSLPGIPGFPQNPSQSSLQELQHNAAAQSALLQQVHSASALESYPAQPDGFPSYPSAPGTPFSLQPSLSQSGWQ

SEQ ID NO: 882591 - protein, 944 aa, Homo sapiens
MDKKSFEMVLDEIRKAVLTEYKLKAIEYVHGYFSSEQVVDLLRYFSWAEPQLKAMKALQHKMVAVQPTEVVNILNCFTFSKDKLVALELLASNIIDAQNSRPIEDLFRVNMSEKKRCKRILEQAFKGGCKAPHAMISSCGTIPGNPYPKGRPSRINGIFPGTPLKKDGEECTNEGKGIAARILGPSKPPPSTYNPHKPVPYPIPPCRPHATIAPSAYNNAGLVPLANVIAPPPPPYTPNPVGTENEDLSNPSKPIQNQTFSTPASQLFSPHGSNPSTPAATPVPTASPVKAINHPSASAAATVSGMNLLNTVLPVFPGQVSSAVHTPQPSIPNPTVIRTPSLPTAPVTSIHSTTTTPVPSIFSGLVSLPGPSATPTAATPTPGPTPRSTLGSSEAFASTSAPFTSLPFSTSSSAASTSNPNSASLSSVFAGLPLPLPPTSQGLSNPTPVIAGGSTPSVAGPLGVNSPLLSALKGFLTSNDTNLINSSALSSAVTSGLASLSSLTLQNSDSSASAPNKCYAPSAIPTPQRTSTPGLALFPGLPSPVANSTSTPLTLPVQSPLATAASASTSVPVSCGSSASLLRGPHPGTSDLHISSTPAATTLPVMIKTEPTSPTPSAFKGPSHSGNPSHGTLGLSGTLGRAYTSTSVPISLSACLNPALSGLSSLSTPLNGSNPLSSISLPPHGSSTPIAPVFTALPSFTSLTNNFPLTGNPSLNPSVSLPGSLIATSSTAATSTSLPHPSSTAAVLSGLSASAPVSAAPFPLNLSTAVPSLFSVTQGPLSSSNPSYPGFSVSNTPSVTPALPSFPGLQAPSTVAAVTPLPVAATAPSPAPVLPGFASAFSSNFNSALVAQAGLSSGLQAAGSSVFPGLLSLPGIPGFPQNPSQSSLQELQHNAAAQSALLQQVHSASALESYPAQPDGFPSYPSAPGTPFSLQPSLSQSGWQ

SEQ ID NO: 882592 - protein, 919 aa, Homo sapiens
MLSLELLVLCFQVVDLLRYFSWAEPQLKAMKALQHKMVAVQPTEVVNILNCFTFSKDKLVALELLASNIIDAQNSRPIEDLFRVNMSEKKRCKRILEQAFKGGCKAPHAMISSCGTIPGNPYPKGRPSRINGIFPGTPLKKDGEECTNEGKGIAARILGPSKPPPSTYNPHKPVPYPIPPCRPHATIAPSAYNNAGLVPLANVIAPPPPPYTPNPVGTENEDLSNPSKPIQNQTFSTPASQLFSPHGSNPSTPAATPVPTASPVKAINHPSASAAATVSGMNLLNTVLPVFPGQVSSAVHTPQPSIPNPTVIRTPSLPTAPVTSIHSTTTTPVPSIFSGLVSLPGPSATPTAATPTPGPTPRSTLGSSEAFASTSAPFTSLPFSTSSSAASTSNPNSASLSSVFAGLPLPLPPTSQGLSNPTPVIAGGSTPSVAGPLGVNSPLLSALKGFLTSNDTNLINSSALSSAVTSGLASLSSLTLQNSDSSASAPNKCYAPSAIPTPQRTSTPGLALFPGLPSPVANSTSTPLTLPVQSPLATAASASTSVPVSCGSSASLLRGPHPGTSDLHISSTPAATTLPVMIKTEPTSPTPSAFKGPSHSGNPSHGTLGLSGTLGRAYTSTSVPISLSACLNPALSGLSSLSTPLNGSNPLSSISLPPHGSSTPIAPVFTALPSFTSLTNNFPLTGNPSLNPSVSLPGSLIATSSTAATSTSLPHPSSTAAVLSGLSASAPVSAAPFPLNLSTAVPSLFSVTQGPLSSSNPSYPGFSVSNTPSVTPALPSFPGLQAPSTVAAVTPLPVAATAPSPAPVLPGFASAFSSNFNSALVAQAGLSSGLQAAGSSVFPGLLSLPGIPGFPQNPSQSSLQELQHNAAAQSALLQQVHSASALESYPAQPDGFPSYPSAPGTPFSLQPSLSQSGWQ

SEQ ID NO: 882593 - protein, 922 aa, Homo sapiens; identical to SEQ ID NO: 882590

SEQ ID NO: 882594 - protein, 852 aa, Homo sapiens
YERHYTVDTPHGIFAASTLYEQSVWITDEEVAFKGGCKAPHAMISSCGTIPGNPYPKGRPSRINGIFPGTPLKKDGEECTNEGKGIAARILGPSKPPPSTYNPHKPVPYPIPPCRPHATIAPSAYNNAGLVPLANVIAPPPPPYTPNPVGTENEDLSNPSKPIQNQTFSTPASQLFSPHGSNPSTPAATPVPTASPVKAINHPSASAAATVSGMNLLNTVLPVFPGQVSSAVHTPQPSIPNPTVIRTPSLPTAPVTSIHSTTTTPVPSIFSGLVSLPGPSATPTAATPTPGPTPRSTLGSSEAFASTSAPFTSLPFSTSSSAASTSNPNSASLSSVFAGLPLPLPPTSQGLSNPTPVIAGGSTPSVAGPLGVNSPLLSALKGFLTSNDTNLINSSALSSAVTSGLASLSSLTLQNSDSSASAPNKCYAPSAIPTPQRTSTPGLALFPGLPSPVANSTSTPLTLPVQSPLATAASASTSVPVSCGSSASLLRGPHPGTSDLHISSTPAATTLPVMIKTEPTSPTPSAFKGPSHSGNPSHGTLGLSGTLGRAYTSTSVPISLSACLNPALSGLSSLSTPLNGSNPLSSISLPPHGSSTPIAPVFTALPSFTSLTNNFPLTGNPSLNPSVSLPGSLIATSSTAATSTSLPHPSSTAAVLSGLSASAPVSAAPFPLNLSTAVPSLFSVTQGPLSSSNPSYPGFSVSNTPSVTPALPSFPGLQAPSTVAAVTPLPVAATAPSPAPVLPGFASAFSSNFNSALVAQAGLSSGLQAAGSSVFPGLLSLPGIPGFPQNPSQSSLQELQHNAAAQSALLQQVHSASALESYPAQPDGFPSYPSAPGTPFSLQPSLSQSGWQ

SEQ ID NO: 882595 - protein, 810 aa, Homo sapiens
MISSCGTIPGNPYPKGRPSRINGIFPGTPLKKDGEECTNEGKGIAARILGPSKPPPSTYNPHKPVPYPIPPCRPHATIAPSAYNNAGLVPLANVIAPPPPPYTPNPVGTENEDLSNPSKPIQNQTFSTPASQLFSPHGSNPSTPAATPVPTASPVKAINHPSASAAATVSGMNLLNTVLPVFPGQVSSAVHTPQPSIPNPTVIRTPSLPTAPVTSIHSTTTTPVPSIFSGLVSLPGPSATPTAATPTPGPTPRSTLGSSEAFASTSAPFTSLPFSTSSSAASTSNPNSASLSSVFAGLPLPLPPTSQGLSNPTPVIAGGSTPSVAGPLGVNSPLLSALKGFLTSNDTNLINSSALSSAVTSGLASLSSLTLQNSDSSASAPNKCYAPSAIPTPQRTSTPGLALFPGLPSPVANSTSTPLTLPVQSPLATAASASTSVPVSCGSSASLLRGPHPGTSDLHISSTPAATTLPVMIKTEPTSPTPSAFKGPSHSGNPSHGTLGLSGTLGRAYTSTSVPISLSACLNPALSGLSSLSTPLNGSNPLSSISLPPHGSSTPIAPVFTALPSFTSLTNNFPLTGNPSLNPSVSLPGSLIATSSTAATSTSLPHPSSTAAVLSGLSASAPVSAAPFPLNLSTAVPSLFSVTQGPLSSSNPSYPGFSVSNTPSVTPALPSFPGLQAPSTVAAVTPLPVAATAPSPAPVLPGFASAFSSNFNSALVAQAGLSSGLQAAGSSVFPGLLSLPGIPGFPQNPSQSSLQELQHNAAAQSALLQQVHSASALESYPAQPDGFPSYPSAPGTPFSLQPSLSQSGWQ

SEQ ID NO: 882596 - protein, 922 aa, Homo sapiens; identical to SEQ ID NO: 882590

SEQ ID NO: 882597 - protein, 922 aa, Homo sapiens; identical to SEQ ID NO: 882590

SEQ ID NO: 882598 - protein, 922 aa, Homo sapiens; identical to SEQ ID NO: 882590

SEQ ID NO: 882599 - protein, 888 aa, Homo sapiens
MDKKSFEMVLDEIRKVVDLLRYFSWAEPQLKAMKALQHKMVAVQPTEVVNILNCFTFSKDKLVALELLASNIIDAQNSRPIEDLFRVNMSEKKRCKRILEQAFKGGCKAPHAMISSCGTIPGNPYPKGRPSRINGIFPGTPLKKDGEECTNEGKGIAARILGPSKPPPSTYNPHKPVPYPIPPCRPHATIAPSAYNNAGLVPLANVIAPPPPPYTPNPVGTENEDLSNPSKPIQNQTFSTPASQLFSPHGSNPSTPAATPVPTASPVKAINHPSASAAATVSGMNLLNTVLPVFPGQVSSAVHTPQPSIPNPTVIRTPSLPTAPVTSIHSTTTTPVPSIFSGLVSLPGPSATPTAATPTPGPTPRSTLGSSEAFASTSAPFTSLPFSTSSSAASTSNPNSASLSSVFAGLPLPLPPTSQGLSNPTPVIAGGSTPSVAGPLGVNSPLLSALKGFLTSNDTNLINSSALSSAVTSGLASLSSLTLQNSDSSASAPNKCYAPSAIPTPQRTSTPGLALFPGLPSPVANSTSTPLTLPVQSPLATAASASTSVPVSCGSSASLLRGPHPGTSDLHISSTPAATTLPVMIKTEPTSPTPSAFKGPSHSGNPSHGTLGLSGTLGRAYTSTSVPISLSACLNPALSGLSSLSTPLNGSNPLSSISLPPHGSSTPIAPVFTALPSFTSLTNNFPLTGNPSLNPSVSLPGSLIATSSTAATSTSLPHPSSTAAVLSGLSASAPVSAAPFPLNLSTAVPSLFSVTQGPLSSSNPSYPGFSVSNTPSVTPALPSFPGLQAPSTVAAVTPLPVAATAPSPAPVLPGFASAFSSNFNSALVAQAGLSSGLQAAGSSVFPGLLSLPGIPGFPQNPSQSSLQELQHNAAAQSALLQQSNIRIA

SEQ ID NO: 882600 - protein, 922 aa, Homo sapiens; identical to SEQ ID NO: 882590

SEQ ID NO: 882601 - protein, 581 aa, Homo sapiens
MDKKSFEMVLDEIRKVVDLLRYFSWAEPQLKAMKALQHKMVAVQPTEVVNILNCFTFSKDKLVALELLASNIIDAQNSRPIEDLFRVNMSEKKRCKRILEQAFKGGCKAPHAMISSCGTIPGNPYPKGRPSRINGIFPGTPLKKDGEECTNEGKGIAARILGPSKPPPSTYNPHKPVPYPIPPCRPHATIAPSAYNNAGLVPLANVIAPPPPPYTPNPVGTENEDLSNPSKPIQNQTFSTPASQLFSPHGSNPSTPAATPVPTASPVKAINHPSASAAATVSGMNLLNTVLPVFPGQVSSAVHTPQPSIPNPTVIRTPSLPTAPVTSIHSTTTTPVPSIFSGLVSLPGPSATPTAATPTPGPTPRSTLGSSEAFASTSAPFTSLPFSTSSSAASTSNPNSASLSSVFAGLPLPLPPTSQGLSNPTPVIAGGSTPSVAGPLGVNSPLLSALKGFLTSNDTNLINSSALSSAVTSGLASLSSLTLQNSDSSASAPNKCYAPSAIPTPQRTSTPGLALFPGLPSPVANSTSTPLTLLFPSFPPRTAPQTSSCAQPPPAPNTLSLVHCFPIILSPFNLRLERSSR

SEQ ID NO: 882602 - protein, 247 aa, Homo sapiens
MQVVKEQVMRALTTKPSSLDQFKSKLQNLSYTEILKIRQSERMNQEDFQSRPILELKEKIQPEILELIKQQRLNRLVEGTCFRKLNARRRQDKFWYCRLSPNHKVLHYGDLEESPQGEVPHDSLQDKLPVADIKAVVTGKDCPHMKEKGALKQNKEVLELAFSILYDSNCQLNFIAPDKHEYCIWTDGLNALLGKDMMSDLTRNDLDTLLSMEIKLRLLDLENIQIPDAPPPIPKEPSNYDFVYDCN

SEQ ID NO: 882603 - protein, 727 aa, Homo sapiens
MPPPADIVKVAIEWPGAYPKLMEIDQKKPLSAIIKEVCDGWSLANHEYFALQHADSSNFYITEKNRNEIKNGTILRLTTSPAQNAQQLHERIQSSSMDAKLEALKDLASLSRDVTFAQEFINLDGISLLTQMVESGTERYQKLQKIMKPCFGDMLSFTLTAFVELMDHGIVSWDTFSVAFIKKIASFVNKSAIDISILQRSLAILESMVLNSHDLYQKVAQEITIGQLIPHLQGSDQEIQTYTIAVINALFLKAPDERRQEMANILAQKQLRSIILTHVIRAQRAINNEMAHQLYVLQVLTFNLLEDRMMTKMDPQDQAQRDIIFELRRIAFDAESEPNNSSGSMEKRKSMYTRDYKKLGFINHVNPAMDFTQTPPGMLALDNMLYFAKHHQDAYIRIVLENSSREDKHECPFGRSSIELTKMLCEILKVGELPSETCNDFHPMFFTHDRSFEEFFCICIQLLNKTWKEMRATSEDFNKVMQVVKEQVMRALTTKPSSLDQFKSKLQNLSYTEILKIRQSERMNQEDFQSRPILELKEKIQPEILELIKQQRLNRLVEGTCFRKLNARRRQDKFWYCRLSPNHKVLHYGDLEESPQGEVPHDSLQDKLPVADIKAVVTGKDCPHMKEKGALKQNKEVLELAFSILYDSNCQLNFIAPDKHEYCIWTDGLNALLGKDMMSDLTRNDLDTLLSMEIKLRLLDLENIQIPDAPPPIPKEPSNYDFVYDCN

SEQ ID NO: 882604 - protein, 70 aa, Homo sapiens
SACAGASGSGRGWAQDRGRATHAAAAPRWATEPPVPLQWWRVAGALIAGNPCRCCPATPSRYRHVWPFTL

SEQ ID NO: 882605 - protein, 133 aa, Homo sapiens
MQVVKEQVMRALTTKPSSLDQFKSKLQNLSYTEILKIRQSERMNQEDFQSRPILELKEKIQPEILELIKQQRLNRLVEGTCFRKLNARRRQDQVLVFVGFFPKITKVPAFSGDFIKRGPSWGKRPPPISLAGT

SEQ ID NO: 882606 - protein, 70 aa, Homo sapiens; identical to SEQ ID NO: 882604

SEQ ID NO: 882607 - protein, 727 aa, Homo sapiens; identical to SEQ ID NO: 882603

SEQ ID NO: 882608 - protein, 727 aa, Homo sapiens; identical to SEQ ID NO: 882603

SEQ ID NO: 882609 - protein, 724 aa, Homo sapiens
MPPPADIVKVAIEWPGAYPKLMEIDQKKPLSAIIKEVCDGWSLANHEYFALQHADSSNFYITEKNRNEIKNGTILRLTTSPAQNAQQLHERIQSSSMDAKLEALKDLASLSRDVTFAQEFINLDGISLLTQMVESGTERYQKLQKIMKPCFGDMLSFTLTAFVELMDHGIVSWDTFSVAFIKKIASFVNKSAIDISILQRSLAILESMVLNSHDLYQKVAQEITIGQLIPHLQGRSRNPNLYIAVIHALFLKALMRGEMANILAQKQLRSIILTHVIRAQRAINNEMAHQLYVLQVLTFNLLEDRMMTKMDPQDQAQRDIIFELRRIAFDAESEPNNSSGSMEKRKSMYTRDYKKLGFINHVNPAMDFTQTPPGMLALDNMLYFAKHHQDAYIRIVLENSSREDKHECPFGRSSIELTKMLCEILKVGELPSETCNDFHPMFFTHDRSFEEFFCICIQLLNKTWKEMRATSEDFNKVMQVVKEQVMRALTTKPSSLDQFKSKLQNLSYTEILKIRQSERMNQEDFQSRPILELKEKIQPEILELIKQQRLNRLVEGTCFRKLNARRRQDKFWYCRLSPNHKVLHYGDLEESPQGEVPHDSLQDKLPVADIKAVVTGKDCPHMKEKGALKQNKEVLELAFSILYDSNCQLNFIAPDKHEYCIWTDGLNALLGKDMMSDLTRNDLDTLLSMEIKLRLLDLENIQIPDAPPPIPKEPSNYDFVYDCN

SEQ ID NO: 882610 - protein, 247 aa, Homo sapiens; identical to SEQ ID NO: 882602

SEQ ID NO: 882611 - protein, 98 aa, Homo sapiens
KKRMEVLKAGSSSYGNEYKGQDEVQYAPDKHEYCIWTDGLNALLGKDMMSDLTRNDLDTLLSMEIKLRLLDLENIQIPDAPPPIPKEPSNYDFVYDCN

SEQ ID NO: 882612 - protein, 383 aa, Homo sapiens
MPPPADIVKVAIEWPGAYPKLMEIDQKKPLSAIIKEVCDGWSLANHEYFALQHADSSNFYITEKNRNEIKNGTILRLTTSPAQNAQQLHERIQSSSMDAKLEALKDLASLSRDVTFAQEFINLDGISLLTQMVESGTERYQKLQKIMKPCFGDMLSFTLTAFVELMDHGIVSWDTFSVAFIKKIASFVNKSAIDISILQRSLAILESMVLNSHDLYQKVAQEITIGQLIPHLQGSDQEIQTYTIAVINALFLKAPDERRQEMANILAQKQLRSIILTHVIRAQRAINNEMAHQLYVLQVLTFNLLEDRMMTKMDPQDQAQRDIIFELRRIAFDAESEPNNSSGSMEKRKSMYTRDYKKLGFIVSKLSPVCALPPASPGLTSAT

SEQ ID NO: 882613 - protein, 410 aa, Homo sapiens
MPPPADIVKVAIEWPGAYPKLMEIDQKKPLSAIIKEVCDGWSLANHEYFALQHADSSNFYITEKNRNEIKNGTILRLTTSPAQNAQQLHERIQSSSMDAKLEALKDLASLSRDVTFAQEFINLDGISLLTQMVESGTERYQKLQKIMKPCFGDMLSFTLTAFVELMDHGIVSWDTFSVAFIKKIASFVNKSAIDISILQRSLAILESMVLNSHDLYQKVAQEITIGQLIPHLQGRSRNPNLYIAVIHALFLKALMRGEMANILAQKQLRSIILTHVIRAQRAINNEMAHQLYVLQVLTFNLLEDRMMTKMDPQDQAQRDIIFELRRIAFDAESEPNNSSGSMEKRKSMYTRDYKKLGFINHVNPAMDFTQTPPGMLALDNMLYFAKHHQDAYIRVSKKPLFRYCVFPTQC

SEQ ID NO: 882614 - protein, 575 aa, Homo sapiens
MSSDEEKYSLPVVQNDSSRGSSVSSNLQEEYEELLHYAIVTPNIEPCASQSSHPKGELVPDVRISTIHDILHSQGNNSEVRETAIEVGKGCDFHISSHSKTDESSPVLSPRKPSHPVMDFFSSHLLADSSSPATNSSHTDAHEILVSDFLVSDENLQKMENVLDLWSSGLKTNIISELSKWRLNFIDWHRMEMRKEKEKHAAHLKQLCNQINELKELQKTFEISIGRKDEVISSLSHAIGKQKEKIELMRTFFHWRIGHVRARQDVYEGKLADQYYQRTLLKKVWKVWRSVVQKQWKDVVERACQARAEEVCIQISNDYEAKVAMLSGALENAKAEIQRMQHEKEHFEDSMKKAFMRGVCALNLEAMTIFQNRNDAGIDSTNNKKEEYGPGVQGKEHSAHLDPSAPPMPLPVTSPLLPSPPAAVGGASATAVPSAASMTSTRAASASSVHVPVSALGAGSAATAASEEMYVPRVVTSAQQKAGRTITARITGRCDFASKNRISSSLAIMGVSPPMSSVVVEKHHPVTVQTIPQATAAKYPRTIHPESSTSASRSLGTRSAHTQSLTSVHSIKVVD

SEQ ID NO: 882615 - protein, 560 aa, Homo sapiens
MSSDEEKYSLPVVQNDSSRGSSVSSNLQEEYEELLHYAIVTPNIEPCASQSSHPKGELVPDVRISTIHDILHSQGNNSEVRETAIEVGKGCDFHISSHSKTDESSPVLSPRKPSHPVMDFFSSHLLADSSSPATNSSHTDAHEILVSDFLVSDENLQKMENVLDLWSSGLKTNIISELSKWRLNFIDWHRMEMRKEKEKHAAHLKQLCNQINELKELQKTFEISIGRKDEVISSLSHAIGKQKEKIELMRTFFHWRIGHVRARQDVYEGKLADQYYQRTLLKKVWKVWRSVVQKQWKDVVERACQARAEEVCIQISNDYEAKVAMLSGALENAKAEIQRMQHEKEHFEDSMKKAFMRGVCALNLEAMTIFQNRNDAGIDSTNNKKEEYGPGVQGLPVTSPLLPSPPAAVGGASATAVPSAASMTSTRAASASSVHVPVSALGAGSAATAASEEMYVPRVVTSAQQKAGRTITARITGRCDFASKNRISSSLAIMGVSPPMSSVVVEKHHPVTVQTIPQATAAKYPRTIHPESSTSASRSLGTRSAHTQSLTSVHSIKVVD

SEQ ID NO: 882616 - protein, 458 aa, Homo sapiens
MDFFSSHLLADSSSPATNSSHTDAHEILVSDFLVSDENLQKMENVLDLWSSGLKTNIISELSKWRLNFIDWHRMEMRKEKEKHAAHLKQLCNQINELKELQKTFEISIGRKDEVISSLSHAIGKQKEKIELMRTFFHWRIGHVRARQDVYEGKLADQYYQRTLLKKVWKVWRSVVQKQWKDVVERACQARAEEVCIQISNDYEAKVAMLSGALENAKAEIQRMQHEKEHFEDSMKKAFMRGVCALNLEAMTIFQNRNDAGIDSTNNKKEEYGPGVQGKEHSAHLDPSAPPMPLPVTSPLLPSPPAAVGGASATAVPSAASMTSTRAASASSVHVPVSALGAGSAATAASEEMYVPRVVTSAQQKAGRTITARITGRCDFASKNRISSSLAIMGVSPPMSSVVVEKHHPVTVQTIPQATAAKYPRTIHPESSTSASRSLGTRSAHTQSLTSVHSIKVVD

SEQ ID NO: 882617 - protein, 458 aa, Homo sapiens; identical to SEQ ID NO: 882616

SEQ ID NO: 882618 - protein, 501 aa, Homo sapiens
MSSDEEKYSLPVVQNDSSRGSSVSSNLQEEYEELLHYAIVTPNIEPCASQSSHPKGELVPDVRISTIHDILHSQGNNSEVRETAIEVGKGCDFHISSHSKTDESSPVLSPRKPSHPVMDFFSSHLLADSSSPATNSSHTDAHEILVSDFLVSDENLQKMENVLDLWSSGLKTNIISELSKWRLNFIDWHRMEMRKEKEKHAAHLKQLCNQINELKELQKTFEISIGRKDEVISSLSHAIGKQKEKIELMRTFFHWRIGHVRARQDVYEGKLADQYYQRTLLKKVWKVWRSVVQKQWKDVVERACQARAEEVCIQISNDYEAKVAMLSGALENAKAEIQRMQHEKEHFEDSMKKAFMRGVCALNLEAMTIFQNRNDAGIDSTNNKKEEYGPGVQGLPVTSPLLPSPPAAVGGASATAVPSAASMTSTRAASASSVHVPVSALGAGSAATAASEEMQTIPQATAAKYPRTIHPESSTSASRSLGTRSAHTQSLTSVHSIKVVD

SEQ ID NO: 882619 - protein, 575 aa, Homo sapiens; identical to SEQ ID NO: 882614

SEQ ID NO: 882620 - protein, 415 aa, Homo sapiens
MSSDEEKYSLPVVQNDSSRGSSVSSNLQEEYEELLHYAIVTPNIEPCASQSSHPKGELVPDVRISTIHDILHSQGNNSEVRETAIEVGKGCDFHISSHSKTDESSPVLSPRKPSHPVMDFFSSHLLADSSSPATNSSHTDAHEILVSDFLVSDENLQKMENVLDLWSSGLKTNIISELSKWRLNFIDWHRMEMRKEKEKHAAHLKQLCNQINELKELQKTFEISIGRKDEVISSLSHAIGKQKEKIELMRTFFHWRIGHVRARQDVYEGKLADQYYQRTLLKKVWKVWRSVVQKQWKDVVERACQARAEEVCIQISNDYEAKVAMLSGALENAKAEIQRMQHEKEHFEDSMKKAFMRGVCALNLEAMTIFQNRNDAGQARSLTPVIPALWEAEVSGSRGQEIETILANMVKSRLY

SEQ ID NO: 882621 - protein, 458 aa, Homo sapiens; identical to SEQ ID NO: 882616

SEQ ID NO: 882622 - protein, 458 aa, Homo sapiens; identical to SEQ ID NO: 882616

SEQ ID NO: 882623 - protein, 481 aa, Homo sapiens
MLQLFFYSESSPVLSPRKPSHPVMDFFSSHLLADSSSPATNSSHTDAHEILVSDFLVSDENLQKMENVLDLWSSGLKTNIISELSKWRLNFIDWHRMEMRKEKEKHAAHLKQLCNQINELKELQKTFEISIGRKDEVISSLSHAIGKQKEKIELMRTFFHWRIGHVRARQDVYEGKLADQYYQRTLLKKVWKVWRSVVQKQWKDVVERACQARAEEVCIQISNDYEAKVAMLSGALENAKAEIQRMQHEKEHFEDSMKKAFMRGVCALNLEAMTIFQNRNDAGIDSTNNKKEEYGPGVQGKEHSAHLDPSAPPMPLPVTSPLLPSPPAAVGGASATAVPSAASMTSTRAASASSVHVPVSALGAGSAATAASEEMYVPRVVTSAQQKAGRTITARITGRCDFASKNRISSSLAIMGVSPPMSSVVVEKHHPVTVQTIPQATAAKYPRTIHPESSTSASRSLGTRSAHTQSLTSVHSIKVVD

SEQ ID NO: 882624 - protein, 167 aa, Homo sapiens
MSSDEEKYSLPVVQNDSSRGSSVSSNLQEEYEELLHYAIVTPNIEPCASQSSHPKGELVPDVRISTIHDILHSQGNNSEVRETAIEVGKGCDFHISSHSKTDESSPVLSPRKPSHPVMDFFSSHLLADSSSPATNSSHTYQLHHHCCHPHQPPSEEPARLPFPQLLR

SEQ ID NO: 882625 - protein, 385 aa, Homo sapiens
MEMRKEKEKHAAHLKQLCNQINELKELQKTFEISIGRKDEVISSLSHAIGKQKEKIELMRTFFHWRIGHVRARQDVYEGKLADQYYQRTLLKKVWKVWRSVVQKQWKDVVERACQARAEEVCIQISNDYEAKVAMLSGALENAKAEIQRMQHEKEHFEDSMKKAFMRGVCALNLEAMTIFQNRNDAGIDSTNNKKEEYGPGVQGKEHSAHLDPSAPPMPLPVTSPLLPSPPAAVGGASATAVPSAASMTSTRAASASSVHVPVSALGAGSAATAASEEMYVPRVVTSAQQKAGRTITARITGRCDFASKNRISSSLAIMGVSPPMSSVVVEKHHPVTVQTIPQATAAKYPRTIHPESSTSASRSLGTRSAHTQSLTSVHSIKVVD

SEQ ID NO: 882626 - protein, 127 aa, Homo sapiens
MSSDEEKYSLPVVQNDSSRGSSVSSNLQEEYEELLHYAIVTPNIEPCASQSSHPKGELVPDVRISTIHDILHSQGNNSEVRETAIEVGKGCDFHISSHSKTDESSPVLSPRKPSHPVMDFYIKLTQS

SEQ ID NO: 882627 - protein, 102 aa, Homo sapiens
MSSDEEKYSLPVVQNDSSRGSSVSSNLQEEYEELLHYAIVTPNIEPCASQSSHPKGELVPDVRISTIHDILHSQGNNSEVRETAIEVGKGKPERHIGFSPII

SEQ ID NO: 882628 - protein, 198 aa, Homo sapiens
MGPLEFRDVAIEFSLEEWHCLDTAQQNLYRDVMLENYRHLVFLGIVVTKPDLITCLEQGKKPFTVKRHEMIAKSPVMCFHFAQDLCPEQSLKDSFQKVIVTRYEKREYGNLELKKGCESVDEGKVHKRGYNGLNQCLTATQSKVFQCDTYVKVSHIFSNSNRHKIRDTGKKPFKCIECGKAFNQSSILATHKKIHIWY

SEQ ID NO: 882629 - protein, 146 aa, Homo sapiens [sequence omitted]

SEQ ID NO: 882630 - protein, 276 aa, Homo sapiens
MGPLEFRDVAIEFSLEEWHCLDTAQQNLYRDVMLENYRHLVFLGIVVTKPDLITCLEQGKKPFTVKRHEMIAKSPDGVHFLIQAGVQQRNLCVIIATFTSQVQAILLPQSPKKQGLQRRAVRFSESTLAAMPSKGPLQSVQVFGRKKTATAVAHCRRGNGLIKVNGQPLEMTEPRMLQYELLEPVLLLGKERFAGVDIRVRVKGGAHVAQIYAIRQSTSKALVAYYQKYVDEASKKEIKDILIQYDRTLLVADPRRCKSKKFGGPGARACYQKSYR

SEQ ID NO: 882631 - protein, 118 aa, Homo sapiens
GRTEKQVHERVCGGDGVSLQQTGHAGTQPHTRSWKRVPSPSCRTCWPREASCRGTRPTATEQNQSLPLGLRTKGGSTMSFCGTLPAPGLQPSPVDPLGKPGPGEKQGQEIPQFDVLKK

SEQ ID NO: 882632 - protein, 906 aa, Homo sapiens
AGVICRSDRLGACLSPAPLSLNSFLQVWALEASRAASRGAVSVPHASRLRPPPPPGLAGGTVRRRSLGRGVVAAEDATERACGLTMDPECAQLLPALCAVLVDPRQPVADDTCLEKLLDWFKTVTEGESSVVLLQEHPCLVELLSHVLKVQDLSSGVLSFSLRLAGTFAAQENCFQYLQQGELLPGLFGEPGPLGRATWAVPTVRSGWIQGLRSLAQHPSALRFLADHGAVDTIFSLQGDSSLFVASAASQLLVHVLALSMRGGAEGQPCLPGGDWPACAQKIMDHVEESLCSAATPKVTQALNVLTTTFGRCQSPWTEALWVRLSPRVACLLERDPIPAAHSFVDLLLCVARSPVFSSSDGSLWETVARALSCLGPTHMGPLALGILKLEHCPQALRTQAFQVLLQPLACVLKATVQAPGPPGLLDGTADDATTVDTLLASKSSCAGLLCRTLAHLEELQPLPQRPSPWPQASLLGATVTVLRLCDGSAAPASSVGGHLCGTLAGCVRVQRAALDFLGTLSQGTGPQELVTQALAVLLECLESPGSSPTVLKKAFQATLRWLLSSPKTPGCSDLGPLIPQFLRELFPVLQKRLCHPCWEVRDSALEFLTQLSRHWGGQADFRCALLASEVPQLALQLLQDPESYVRASAVTAMGQLSSQGLHAPTSPEHAEARQSLFLELLHILSVDSEGFPRRAVMQVFTEWLRDGHADAAQDTEQFVATVLQAASRDLDWEVRAQGLELALVFLGQTLGPPRTHCPYAVALPEVAPAQPLTEALRALCHVGLFDFAFCALFDCDRPVAQKSCDLLLFLRDKIASYSSLREARGSPNTASAEATLPRWRAGEQAQPPGDQEPEAVLAMLRSLDLEGLRSTLAESSDHVEKSPQSLLQDMLATGGFLQGDEADCY

SEQ ID NO: 882633 - protein, 980 aa, Homo sapiens
AGVICRSDRLGACLSPAPLSLNSFLQVWALEASRAASRGAVSVPHASRLRPPPPPGLAGGTVRRRSLGRGVVAAEDATERACGLTMDPECAQLLPALCAVLVDPRQPVADDTCLEKLLDWFKTVTEGESSVVLLQEHPCLVELLSHVLKVQDLSSGVLSFSLRLAGTFAAQENCFQYLQQGELLPGLFGEPGPLGRATWAVPTVRSGWIQGLRSLAQHPSALRFLADHGAVDTIFSLQGDSSLFVASAASQLLVHVLALSMRGGAEGQPCLPGGDWPACAQKIMDHVEESLCSAATPKVTQALNVLTTTFGRCQSPWTEALWVRLSPRVACLLERDPIPAAHSFVDLLLCVARSGPRDAAGEAWVGNCFPRITPRDVPLAAGDSLRTWPAVKRHRGDPGTLMGKGLSWAGRLQCRSHGSLSQASEWGFEGGGVIFLSGVSLSPVFSSSDGSLWETVARALSCLGPTHMGPLALGILKLEHWYGLGCISFRGGCWELGQAGRLRAQPSWQGSSGHQGQSGGRAGCDWVVRGLRAAASEEFFSNRIIVSDQSSARSPEVRRMRELLCSEQGGPADALRSAALPPVPHRSFGWGFRSSPAHTPCGWGAWGRCNGRAWGQDRWEGRGWPASVPGGLTIGVEVTSGPAAHRAQGYHEGPALSSGVSECLGESRPGEDGGTGPALQECIVGTLPPPRPRREGRSLPQSGRCTHLGTPGRLGAPHPCPPERALPLSLGAWPGPPGGPSVSAPKDIRSVRPISLVRPVLPATLSHGIPWPVACRECFSGGVPTPWLICPRLAGDIRSTANLSRSQGRGTHLAFVSSPQALRTQAFQVLLQPLACVLKATVQAPGPPGLLDGTADDATTVDTLLASKSSCAGLLCRTLAHLEELQPLPQRPSPWPQASLLGATVTVLRLCDGSAAPASSVGGHLCGTLAGCVRVQRAALDFLGTLSQGTGPQELVTQALAVLLECLESPGSSPTVRWWG

SEQ ID NO: 882634 - protein, 510 aa, Homo sapiens
MPLRLPWPCSPPYLLQVLKKAFQATLRWLLSSPKTPGCSDLGPLIPQFLRELFPVLQKRLCHPCWEVRDSALEFLTQLSRHWGGQADFRCALLASEVPQLALQLLQDPESYVRASAVTAMGQLSSQGLHAPTSPEHAEARQVGGGRFLSQQLPPGHRVCSFACGWSSGQHAAWEQLLLWAAPAAVTAEALGLCWVWDLCASPSVSPAPLHLDMVTSIGQMGKLRIGGPCAHCAAWEGVRAGCGPRLHVRGQPPSCTGVLLWEPRSCHPTNHPHLLPVPQSLFLELLHILSVDSEGFPRRAVMQVFTEWLRDGHADAAQDTEQFVATVLQAASRDLDWEVRAQGLELALVFLGQTLGPPRTHCPYAVALPEVAPAQPLTEALRALCHVGLFDFAFCALFDCDRPVAQKSCDLLLFLRDKIASYSSLREARGSPNTASAEATLPRWRAGEQAQPPGDQEPEAVLAMLRSLDLEGLRSTLAESSDHVEKSPQSLLQDMLATGGFLQGDEADCY

SEQ ID NO: 882635 - protein, 646 aa, Homo sapiens
MRGGAEGQPCLPGGDWPACAQKIMDHVEESLCSAATPKVTQALNVLTTTFGRCQSPWTEALWVRLSPRVACLLERDPIPAAHSFVDLLLCVARSPVFSSSDGSLWETVARALSCLGPTHMGPLALGILKLEHCPQALRTQAFQVLLQPLACVLKATVQAPGPPGLLDGTADDATTVDTLLASKSSCAGLLCRTLAHLEELQPLPQRPSPWPQASLLGATVTVLRLCDGSAAPASSVGGHLCGTLAGCVRVQRAALDFLGTLSQGTGPQELVTQALAVLLECLESPGSSPTVLKKAFQATLRWLLSSPKTPGCSDLGPLIPQFLRELFPVLQKRLCHPCWEVRDSALEFLTQLSRHWGGQADFRCALLASEVPQLALQLLQDPESYVRASAVTAMGQLSSQGLHAPTSPEHAEARQSLFLELLHILSVDSEGFPRRAVMQVFTEWLRDGHADAAQDTEQFVATVLQAASRDLDWEVRAQGLELALVFLGQTLGPPRTHCPYAVALPEVAPAQPLTEALRALCHVGLFDFAFCALFDCDRPVAQKSCDLLLFLRDKIASYSSLREARGSPNTASAEATLPRWRAGEQAQPPGDQEPEAVLAMLRSLDLEGLRSTLAESSDHVEKSPQSLLQDMLATGGFLQGDEADCY

SEQ ID NO: 882636 - protein, 555 aa, Homo sapiens
AGVICRSDRLGACLSPAPLSLNSFLQVWALEASRAASRGAVSVPHASRLRPPPPPGLAGGTVRRRSLGRGVVAAEDATERACGLTMDPECAQLLPALCAVLVDPRQPVADDTCLEKLLDWFKTVTEGESSVVLLQEHPCLVELLSHVLKVQDLSSGVLSFSLRLAGTFAAQENCFQYLQQGELLPGLFGEPGPLGRATWAVPTVRSGWIQGLRSLAQHPSALRFLADHGAVDTIFSLQGDSSLFVASAASQLLVHVLALSMRGGAEGQPCLPGGDWPACAQKIMDHVEESLCSAATPKVTQALNVLTTTFGRCQSPWTEALWVRLSPRVACLLERDPIPAAHSFVDLLLCVARSPVFSSSDGSLWETVARALSCLGPTHMGPLALGILKLEHCPQALRTQAFQVLLQPLACVLKATVQAPGPPGLLDGTADDATTVDTLLASKSSCAGLLCRTLAHLEELQPLPQRPSPWPQASLLGATVTVLRLCDGSAAPASSVGGHLCGTLAGCVRVQRAALDFLGTLSQGTGPQELVTQALAVLLECLESPGSSPTVRWWG

SEQ ID NO: 882637 - protein, 906 aa, Homo sapiens; identical to SEQ ID NO: 882632

SEQ ID NO: 882638 - protein, 966 aa, Homo sapiens
AGVICRSDRLGACLSPAPLSLNSFLQVWALEASRAASRGAVSVPHASRLRPPPPPGLAGGTVRRRSLGRGVVAAEDATERACGLTMDPECAQLLPALCAVLVDPRQPVADDTCLEKLLDWFKTVTEGESSVVLLQEHPCLVELLSHVLKVQDLSSGVLSFSLRLAGTFAAQENCFQYLQQGELLPGLFGEPGPLGRATWAVPTVRSGWIQGLRSLAQHPSALRFLADHGAVDTIFSLQGDSSLFVASAASQLLVHVLALSMRGGAEGQPCLPGGDWPACAQKIMDHVEESLCSAATPKVTQALNVLTTTFGRCQSPWTEALWVRLSPRVACLLERDPIPAAHSFVDLLLCVARSPVFSSSDGSLWETVARALSCLGPTHMGPLALGILKLEHCPQALRTQAFQVLLQPLACVLKATVQAPGPPGLLDGTADDATTVDTLLASKSSCAGLLCRTLAHLEELQPLPQRPSPWPQASLLGATVTVLRLCDGSAAPASSVGGHLCGTLAGCVRVQRAALDFLGTLSQGTGPQELVTQALAVLLECLESPGSSPTVLKKAFQATLRWLLSSPKTPGCSDLGPLIPQFLRELFPVLQKRLCHPCWEVRDSALEFLTQLSRHWGGQADFRCALLASEVPQLALQLLQDPESYVRASAVTAMGQLSSQGLHAPTSPEHAEARQMGKLRIGGPCAHCAAWEGVRAGCGPRLHVRGQPPSCTGVLLWEPRSCHPTNHPHLLPVPQSLFLELLHILSVDSEGFPRRAVMQVFTEWLRDGHADAAQDTEQFVATVLQAASRDLDWEVRAQGLELALVFLGQTLGPPRTHCPYAVALPEVAPAQPLTEALRALCHVGLFDFAFCALFDCDRPVAQKSCDLLLFLRDKIASYSSLREARGSPNTASAEATLPRWRAGEQAQPPGDQEPEAVLAMLRSLDLEGLRSTLAESSDHVEKSPQSLLQDMLATGGFLQGDEADCY

SEQ ID NO: 882639 - protein, 527 aa, Homo sapiens
MGPLALGILKLEHCPQALRTQAFQVLLQPLACVLKATVQAPGPPGLLDGTADDATTVDTLLASKSSCAGLLCRTLAHLEELQPLPQRPSPWPQASLLGATVTVLRLCDGSAAPASSVGGHLCGTLAGCVRVQRAALDFLGTLSQGTGPQELVTQALAVLLECLESPGSSPTVLKKAFQATLRWLLSSPKTPGCSDLGPLIPQFLRELFPVLQKRLCHPCWEVRDSALEFLTQLSRHWGGQADFRCALLASEVPQLALQLLQDPESYVRASAVTAMGQLSSQGLHAPTSPEHAEARQSLFLELLHILSVDSEGFPRRAVMQVFTEWLRDGHADAAQDTEQFVATVLQAASRDLDWEVRAQGLELALVFLGQTLGPPRTHCPYAVALPEVAPAQPLTEALRALCHVGLFDFAFCALFDCDRPVAQKSCDLLLFLRDKIASYSSLREARGSPNTASAEATLPRWRAGEQAQPPGDQEPEAVLAMLRSLDLEGLRSTLAESSDHVEKSPQSLLQDMLATGGFLQGDEADCY

SEQ ID NO: 882640 - protein, 489 aa, Homo sapiens
FLAWPPGLLDGTADDATTVDTLLASKSSCAGLLCRTLAHLEELQPLPQRPSPWPQASLLGATVTVLRLCDGSAAPASSVGGHLCGTLAGCVRVQRAALDFLGTLSQGTGPQELVTQALAVLLECLESPGSSPTVLKKAFQATLRWLLSSPKTPGCSDLGPLIPQFLRELFPVLQKRLCHPCWEVRDSALEFLTQLSRHWGGQADFRCALLASEVPQLALQLLQDPESYVRASAVTAMGQLSSQGLHAPTSPEHAEARQSLFLELLHILSVDSEGFPRRAVMQVFTEWLRDGHADAAQDTEQFVATVLQAASRDLDWEVRAQGLELALVFLGQTLGPPRTHCPYAVALPEVAPAQPLTEALRALCHVGLFDFAFCALFDCDRPVAQKSCDLLLFLRDKIASYSSLREARGSPNTASAEATLPRWRAGEQAQPPGDQEPEAVLAMLRSLDLEGLRSTLAESSDHVEKSPQSLLQDMLATGGFLQGDEADCY

SEQ ID NO: 882641 - protein, 844 aa, Homo sapiens
AGVICRSDRLGACLSPAPLSLNSFLQVWALEASRAASRGAVSVPHASRLRPPPPPGLAGGTVRRRSLGRGVVAAEDATERACGLTMDPECAQLLPALCAVLVDPRQPVADDTCLEKLLDWFKTVTEGESSVVLLQEHPCLVELLSHVLKVQDLSSGVLSFSLRLAGTFAAQENCFQYLQQGELLPGLFGEPGPLGRATWAVPTVRSGWIQGLRSLAQHPSALRFLADHGAVDTIFSLQGDSSLFVASAASQLLVHVLALSMRGGAEGQPCLPGGDWPACAQKIMDHVEESLCSAATPKVTQALNVLTTTFGRCQSPWTEALWVRLSPRVACLLERDPIPAAHSFVDLLLCVARSPVFSSSDGSLWETVARALSCLGPTHMGPLALGILKLEHCPQALRTQAFQVLLQPLACVLKATVQAPGPPGLLDGTADDATTVDTLLASKSSCAGLLCRTLAHLEELQPLPQRPSPWPQASLLGATVTVLRLCDGSAAPASSVGGHLCGTLAGCVRVQRAALDFLGTLSQGTGPQELVTQALAVLLECLESPGSSPTVLKKAFQATLRWLLSSPKTPGCSDLGPLIPQFLRELFPVLQKRLCHPCWEVRDSALEFLTQLSRHWGGQADFRCALLASEVPQLALQLLQDPESYVRASAVTAMGQLSSQGLHAPTSPEHAEARQSLFLELLHILSVDSEGFPRRAVMQVFTEWLRDGHADAAQDTEQFVATVLQAASRDLDWEVRAQGLELALVFLGQTLGPPRTHCTQPCILISSGYLFLFTCFKNKTKSILLPTKTTQTNHRTNENTKKKAKKQKKGARGRQGPHEGRGPAGAHAAGGGGPGGGGGGARRR

SEQ ID NO: 882642 - protein, 678 aa, Homo sapiens
AGVICRSDRLGACLSPAPLSLNSFLQVWALEASRAASRGAVSVPHASRLRPPPPPGLAGGTVRRRSLGRGVVAAEDATERACGLTMDPECAQLLPALCAVLVDPRQPVADDTCLEKLLDWFKTVTEGESSVVLLQEHPCLVELLSHVLKVQDLSSGVLSFSLRLAGTFAAQENCFQYLQQGELLPGLFGEPGPLGRATWAVPTVRSGWIQGLRSLAQHPSALRFLADHGAVDTIFSLQGDSSLFVASAASQLLVHVLALSMRGGAEGQPCLPGGDWPACAQKIMDHVEESLCSAATPKVTQALNVLTTTFGRCQSPWTEALWVRLSPRVACLLERDPIPAAHSFVDLLLCVARSPVFSSSDGSLWETVARALSCLGPTHMGPLALGILKLEHCPQALRTQAFQVLLQPLACVLKATVQAPGPPGLLDGTADDATTVDTLLASKSSCAGLLCRTLAHLEELQPLPQRPSPWPQASLLGATVTVLRLCDGSAAPASSVGGHLCGTLAGCVRVQRAALDFLGTLSQGTGPQELVTQALAVLLECLESPGSSPTVLKKAFQATLRWLLSSPKTPGCSDLGPLIPQFLRELFPVLQKRLCHPCWEVRDSALEFLTQLSRHWGGQADFRCALLASEVPQLASVFPGPRLWAACYHCLCGGLPRWPANHHRAWAPAMGFRSFARA

SEQ ID NO: 882643 - protein, 295 aa, Homo sapiens
SDSLRQHFDEFLTGELELALALVLKVALAPPLVVHFHYPLHVVLFTSFPRTPAPHRILEMSSTVAGGENEARALGPELLRAKAITVGVLSREKARGVAGATWGNSGEEEEEDGPAVLVLHLIQQWSQSVPTQERYKDGVTLGCVGVPLCGKVLAQAAGAEKSLISPEPRPIPETFIPTFLPPLLSSVTAQASSSHLFCLGSCRMLAGIYPAQARGSPNTASAEATLPRWRAGEQAQPPGDQEPEAVLAMLRSLDLEGLRSTLAESSDHVEKSPQSLLQDMLATGGFLQGDEADCY

SEQ ID NO: 882644 - protein, 288 aa, Homo sapiens
AGVICRSDRLGACLSPAPLSLNSFLQVWALEASRAASRGAVSVPHASRLRPPPPPGLAGGTVRRRSLGRGVVAAEDATERACGLTMDPECAQLLPALCAVLVDPRQPVADDTCLEKLLDWFKTVTEGESSVVLLQEHPCLVELLSHVLKVQDLSSGVLSFSLRLAGTFAAQENCFQYLQQGELLPGLFGEPGPLGRATWAVPTVRSGWIQGLRSLAQHPSALRFLADHGRLLLSRTRVCHWGSGPREAAPCPSVGHCQPQGSSPARWILWGSQDQERSKVKKSHSLMY

SEQ ID NO: 882645 - protein, 62 aa, Homo sapiens
MSERQGAGPTNGKDKTSGENDGQKKVQEEFDIDMDAPETERAAVAIQSQFRKFQKKKAGSQS

SEQ ID NO: 882646 - protein, 63 aa, Homo sapiens
PGAPARARQDRYFERFGDNHNHGQKKVQEEFDIDMDAPETERAAVAIQSQFRKFQKKKAGSQS

SEQ ID NO: 882647 - protein, 62 aa, Homo sapiens; identical to SEQ ID NO: 882645

SEQ ID NO: 882648 - protein, 62 aa, Homo sapiens; identical to SEQ ID NO: 882645

SEQ ID NO: 882649 - protein, 640 aa, Homo sapiens
SGGPGSGHSRGSRSRSTQSRRDEVPSESERESVLGLLRGAARGICRERSGGDNASMPVLSEDSGLHETLALLTSQLRPDSNHKEEMGFLRDVFSEKSLSYLMKIHEKLRYYERQSPTPVLHSAVALAEDVMEELQAASVHSDERELLQLLSTPHLRAVLMVHDTVAQKNFDPVLPPLPDNIDEDFDEESVKIVRLVKNKEPLGATIRRDEHSGAVVVARIMRGGAADRSGLVHVGDELREVNGIAVLHKRPDEISQILAQSQGSITLKIIPATQEEDRLKESKVFMRALFHYNPREDRAIPCQEAGLPFQRRQVLEVVSQDDPTWWQAKRVGDTNLRAGLIPSKGFQERRLSYRRAAGTLPSPQSLRKPPYDQPCDKETCDCEGYLKGHYVAGLRRSFRLGCRERLGGSQEGKMSSGAESPELLTYEEVARYQHQPGERPRLVVLIGSLGARLHELKQKVVAENPQHFGVAVPHTTRPRKSHEKEGVEYHFVSKQAFEADLHHNKFLEHGEYKENLYGTSLEAIQAVMAKNKVCLVDVEPEALKQLRTSEFKPYIIFVKPAIQEKRKTPPMSPACEDTAAPFDEQQQEMAASAAFIDRHYGHLVDAVLVKEDLQGAYSQLKVVLEKLSKDTHWVPVSWVR

SEQ ID NO: 882650 - protein, 640 aa, Homo sapiens; identical to SEQ ID NO: 882649

SEQ ID NO: 882651 - protein, 258 aa, Homo sapiens
MVSLCPSSQAGLRRSFRLGCRERLGGSQEGKMSSGAESPELLTYEEVARYQHQPGERPRLVVLIGSLGARLHELKQKVVAENPQHFGVAVPHTTRPRKSHEKEGVEYHFVSKQAFEADLHHNKFLEHGEYKENLYGTSLEAIQAVMAKNKVCLVDVEPEALKQLRTSEFKPYIIFVKPAIQEKRKTPPMSPACEDTAAPFDEQQQEMAASAAFIDRHYGHLVDAVLVKEDLQGAYSQLKVVLEKLSKDTHWVPVSWVR

SEQ ID NO: 882652 - protein, 374 aa, Homo sapiens
SGGPGSGHSRGSRSRSTQSRRDEVPSESERESVLGLLRGAARGICRERSGGDNASMPVLSEDSGLHETLALLTSQLRPDSNHKEEMGFLRDVFSEKSLSYLMKIHEKLRYYERQSPTPVLHSAVALAEDVMEELQAASVHSDERELLQLLSTPHLRAVLMVHDTVAQKNFDPVLPPLPDNIDEDFDEESVKIVRLVKNKEPLGATIRRDEHSGAVVVARIMRGGAADRSGLVHVGDELREVNGIAVLHKRPDEISQILVRATSLLGMCWVFRHPEQGTSWSQDRFWLSLAVVLRRWQAKWPYGVPLTVCPGYGVAAGGGELPFHLPLLDLLLSTAFLPSPGSLSQGPSWVLGPGCESWLCLLPAVQPWTSHQII

SEQ ID NO: 882653 - protein, 585 aa, Homo sapiens
MPVLSEDSGLHETLALLTSQLRPDSNHKEEMGFLRDVFSEKSLSYLMKIHEKLRYYERQSPTPVLHSAVALAEDVMEELQAASVHSDERELLQLLSTPHLRAVLMVHDTVAQKNFDPVLPPLPDNIDEDFDEESVKIVRLVKNKEPLGATIRRDEHSGAVVVARIMRGGAADRSGLVHVGDELREVNGIAVLHKRPDEISQILAQSQGSITLKIIPATQEEDRLKESKVFMRALFHYNPREDRAIPCQEAGLPFQRRQVLEVVSQDDPTWWQAKRVGDTNLRAGLIPSKGFQERRLSYRRAAGTLPSPQSLRKPPYDQPCDKETCDCEGYLKGHYVAGLRRSFRLGCRERLGGSQEGKMSSGAESPELLTYEEVARYQHQPGERPRLVVLIGSLGARLHELKQKVVAENPQHFGVAVPHTTRPRKSHEKEGVEYHFVSKQAFEADLHHNKFLEHGEYKENLYGTSLEAIQAVMAKNKVCLVDVEPEALKQLRTSEFKPYIIFVKPAIQEKRKTPPMSPACEDTAAPFDEQQQEMAASAAFIDRHYGHLVDAVLVKEDLQGAYSQLKVVLEKLSKDTHWVPVSWVR

SEQ ID NO: 882654 - protein, 113 aa, Homo sapiens
MAKNKVCLVDVEPEALKQLRTSEFKPYIIFVKPAIQEKRKTPPMSPACEDTAAPFDEQQQEMAASAAFIDRHYGHLVDAVLVKEDLQGAYSQLKVVLEKLSKDTHWVPVSWVR

SEQ ID NO: 882655 - protein, 260 aa, Homo sapiens
LRLREMKGLVQAGLRRSFRLGCRERLGGSQEGKMSSGAESPELLTYEEVARYQHQPGERPRLVVLIGSLGARLHELKQKVVAENPQHFGVAVPHTTRPRKSHEKEGVEYHFVSKQAFEADLHHNKFLEHGEYKENLYGTSLEAIQAVMAKNKVCLVDVEPEALKQLRTSEFKPYIIFVKPAIQEKRKTPPMSPACEDTAAPFDEQQQEMAASAAFIDRHYGHLVDAVLVKEDLQGAYSQLKVVLEKLSKDTHWVPVSWVR

SEQ ID NO: 882656 - protein, 242 aa, Homo sapiens
SGGPGSGHSRGSRSRSTQSRRDEVPSESERESVLGLLRGAARGICRERSGGDNASMPVLSEDSGLHETLALLTSQLRPDSNHKEEMGFLRDVFSEKSLSYLMKIHEKLRYYERQSPTPVLHSAVALAEDVMEELQAASVHSDERELLQLLSTPHLRAVLMVHDTVAQKNFDPVLPPLPDNIDEDFDEESVKIVRLVKNKEPLGATIRRDEHSGAVVVARIMRGGAADRSGLRLGRWKQRGKY

SEQ ID NO: 882657 - protein, 110 aa, Homo sapiens
MSMTDLLNAEDIKKAVGAFSATDSFDHKKFFQMVGLKKKSADDVKKVFHMLDKDKSGFIEEDELGFILKGFSPDARDLSAKETKMLMAAGDKDGDGKIGVDEFSTLVAES

SEQ ID NO: 882658 - protein, 110 aa, Homo sapiens; identical to SEQ ID NO: 882657

SEQ ID NO: 882659 - protein, 110 aa, Homo sapiens; identical to SEQ ID NO: 882657

SEQ ID NO: 882660 - protein, 98 aa, Homo sapiens
GLPQPSNGATDSFDHKKFFQMVGLKKKSADDVKKVFHMLDKDKSGFIEEDELGFILKGFSPDARDLSAKETKMLMAAGDKDGDGKIGVDEFSTLVAES

SEQ ID NO: 882661 - protein, 107 aa, Homo sapiens [sequence omitted]

SEQ ID NO: 882662 - protein, 107 aa, Homo sapiens [sequence omitted]

SEQ ID NO: 882663 - protein, 172 aa, Homo sapiens
MPGIVELPTLEELKVDEVKISSAVLKAAAHHYGAQCDKPNKEFMLCRWEEKDPRRCLEEGKLVNKCALDFFRQIKRHCAEPFTEYWTCIDYTGQQLFRHCRKQQAKFDECVLDKLGWVRPDLGELSKVTKVKTDRPLPENPYHSRPRPDPSPEIEGDLQPATHGSRFYFWTK

SEQ ID NO: 882664 - protein, 72 aa, Homo sapiens
DTRRRIDGYRFLHPSFQLCFCPLHPSQVTKVKTDRPLPENPYHSRPRPDPSPEIEGDLQPATHGSRFYFWTK

SEQ ID NO: 882665 - protein, 172 aa, Homo sapiens; identical to SEQ ID NO: 882663

SEQ ID NO: 882666 - protein, 172 aa, Homo sapiens; identical to SEQ ID NO: 882663

SEQ ID NO: 882667 - protein, 126 aa, Homo sapiens
MELNKDPRRCLEEGKLVNKCALDFFRQIKRHCAEPFTEYWTCIDYTGQQLFRHCRKQQAKFDECVLDKLGWVRPDLGELSKVTKVKTDRPLPENPYHSRPRPDPSPEIEGDLQPATHGSRFYFWTK

SEQ ID NO: 882668 - protein, 102 aa, Homo sapiens
MRQIKRHCAEPFTEYWTCIDYTGQQLFRHCRKQQAKFDECVLDKLGWVRPDLGELSKVTKVKTDRPLPENPYHSRPRPDPSPEIEGDLQPATHGSRFYFWTK

SEQ ID NO: 882669 - protein, 152 aa, Homo sapiens
MPGIVELPTLEELKVDEVKISSAVLKAAAHHYGAQCDKPNKEFMLCRWEEKDPRRCLEEGKLVNKCALDFFSGQQLFRHCRKQQAKFDECVLDKLGWVRPDLGELSKVTKVKTDRPLPENPYHSRPRPDPSPEIEGDLQPATHGSRFYFWTK

SEQ ID NO: 882670 - protein, 310 aa, Homo sapiens
MNGLSLSELCCLFCCPPCPGRIAAKLAFLPPEATYSLVPEPEPGPGGAGAAPLGTLRASSGAPGRWKLHLTERADFQYSQRELDTIEVFPTKSARGNRVSCMYVRCVPGARYTVLFSHGNAVDLGQMSSFYIGLGSRLHCNIFSYDYSGYGASSGRPSERNLYADIDAAWQALRTRYGISPDSIILYGQSIGTVPTVDLASRYECAAVVLHSPLTSGMRVAFPDTKKTYCFDAFPNIEKVSKITSPVLIIHGTEDEVIDFSHGLALYERCPKAVEPLWVEGAGHNDIELYSQYLERLRRFISQELPSQRA

SEQ ID NO: 882671 - protein, 265 aa, Homo sapiens
MNGLSLSELCCLFCCPPCPGRIAAKLAFLPPEATYSLVPEPEPGPGGAGAAPLGTLRASSGAPGRWKLHLTERADFQYSQRELDTIEVFPTKSARGNRVSCMYVRCVPGARYTVLFSHGNAVDLGQMSSFYIGLGSRLHCNIFSYDYSGYGASSGRPSERNLYADIDAAWQALRTSEGDPGGSSAWAHPRGDQAGGRGAGFPGRKVGGPAGGEPQWMHRAREPDRRAWVCRCRLHMAEVWPGGPPTPWPVEPGSLGTPGLRMGRG

SEQ ID NO: 882672 - protein, 265 aa, Homo sapiens; identical to SEQ ID NO: 882671

SEQ ID NO: 882673 - protein, 209 aa, Homo sapiens
MYVRCVPGARYTVLFSHGNAVDLGQMSSFYIGLGSRLHCNIFSYDYSGYGASSGRPSERNLYADIDAAWQALRTRYGISPDSIILYGQSIGTVPTVDLASRYECAAVVLHSPLTSGMRVAFPDTKKTYCFDAFPNIEKVSKITSPVLIIHGTEDEVIDFSHGLALYERCPKAVEPLWVEGAGHNDIELYSQYLERLRRFISQELPSQRA

SEQ ID NO: 882674 - protein, 337 aa, Homo sapiens
MNGLSLSELCCLFCCPPCPGRIAAKLAFLPPEATYSLVPEPEPGPGGAGAAPLGTLRASSGAPGRWKLHLTERADFQYSQRELDTIEVFPTKSARGNRVSCMYVRCVPGARYTVLFSHGNAVDLGQMSSFYIGLGSRLHCNIFSYDYSGYGASSGRPSERNLYADIDAAWQALRTRYGISPDSIILYGQSIGTVPTVDLASRYECAAVVLHSPLTSGMRVAFPDTKKTYCFDAFPKERPGRGRGRGGARAGREVSPAPRPSRSIEKVSKITSPVLIIHGTEDEVIDFSHGLALYERCPKAVEPLWVEGAGHNDIELYSQYLERLRRFISQELPSQRA

SEQ ID NO: 882675 - protein, 310 aa, Homo sapiens; identical to SEQ ID NO: 882670

SEQ ID NO: 882676 - protein, 295 aa, Homo sapiens
MNGLSLSELCCLFCCPPCPGRIAAKLAFLPPEATYSLVPEPEPGPGGAGAAPLGTLRASSGAPGRWKLHLTERADFQYSQRELDTIEVFPTKSARGNRVSCMYVRCVPGARYTVLFSHGNAVDLGQMSSFYIGLGSRLHCNIFSYDYSGYGASSGRPSERNLYADIDAAWQALRTRYGISPDSIILYGQSIGTVPTVDLASRYECAAVVLHSPLTSGALPPARDSEHPPPLPCRARPGGVVGGGPQVEARPGRRPAMTGLPLWVEGAGHNDIELYSQYLERLRRFISQELPSQRA

SEQ ID NO: 882677 - protein, 136 aa, Homo sapiens
HFRGGGENEAHFRPWGELRRWRCRRPGRGAEGPTDARAGGREPWSAALGPGGAGRGGLPTARHGDLWLRGSLGLGLDRDGAGPWPPNGAAVWGGSWGGALPPARDSEHPHPSPAGPGRAALLAGAPVEARPGRRPP

SEQ ID NO: 882678 - protein, 148 aa, Homo sapiens
MGTDRPRAHAAPWHGWMPRLPGVPSWTVAPPKDPTCHCSPAGLPTARHGDLWLRGSLGLGLDRDGAGPWPPNGAAVWGGSWGGALPPARDSEHPHPSPAGPGRAALLAGAPVEARPGRRDPAPTQGLWTMYRQQSYALLSFWKQEENT

SEQ ID NO: 882679 - protein, 543 aa, Homo sapiens
TFSNKPGSFNCQVCPRNTYSEKGAKECIRCKDDSQFSEEGSSECTERPPCTTKDYFQIHTPCDEEGKTQIMYKWIEPKICREDLTDAIRLPPSGEKKDCPPCNPGFYNNGSSSCHPCPPGTFSDGTKECRPCPAGTEPALGFEYKWWNVLPGNMKTSCFNVGNSKCDGMNGWEVAGDHIQSGAGGSDNDYLILNLHIPGFKPPTSMTGATGSELGRITFVFETLCSADCVLYFMVDINRKSTNVVESWGGTKEKQAYTHIIFKNATFTFTWAFQRTNQGQDNRRFINDMVKIYSITATNAVDGVASSCRACALGSEQSGSSCVPCPPGHYIEKETNQCKECPPDTYLSIHQVYGKEACIPCGPGSKNNQDHSVCYSDCFFYHEKENQSLHYDFSNLSSVGSLMNGPSFTSKGTKYFHFFNISLCGHEGKKMALCTNNITDFTVKEIVAGSDDYTNLVGAFVCQSTIIPSESKGFRAALSSQSIILADTFIGVTVETTLKNINIKEDMFPVPTSQIPDVHFFYKSSTATTSCINGRSTAVKMRC

SEQ ID NO: 882680 - protein, 410 aa, Homo sapiens
EFGSRLGLVSFSILDNNLNTSISAWECSRPWLGVKPAGWEVAGDHIQSGAGGSDNDYLILNLHIPGFKPPTSMTGATGSELGRITFVFETLCSADCVLYFMVDINRKSTNVVESWGGTKEKQAYTHIIFKNATFTFTWAFQRTNQGQDNRRFINDMVKIYSITATNAVDGVASSCRACALGSEQSGSSCVPCPPGHYIEKETNQCKECPPDTYLSIHQVYGKEACIPCGPGSKNNQDHSVCYSDCFFYHEKENQSLHYDFSNLSSVGSLMNGPSFTSKGTKYFHFFNISLCGHEGKKMALCTNNITDFTVKEIVAGSDDYTNLVGAFVCQSTIIPSESKGFRAALSSQSIILADTFIGVTVETTLKNINIKEDMFPVPTSQIPDVHFFYKSSTATTSCINGRSTAVKMRC

SEQ ID NO: 882681 - protein, 415 aa, Homo sapiens
TFSNKPGSFNCQVCPRNTYSEKGAKECIRCKDDSQFSEEGSSECTERPPCTTKDYFQIHTPCDEEGKTQIMYKWIEPKICREDLTDAIRLPPSGEKKDCPPCNPGFYNNGSSSCHPCPPGTFSDGTKECRPCPAGTEPALGFEYKWWNVLPGNMKTSCFNVGNSKCDGMNGWEVAGDHIQSGAGGSDNDYLILNLHIPGFKPPTSMTGATGSELGRITFVFETLCSADCVLYFMVDINRKSTNVVESWGGTKEKQAYTHIIFKNATFTFTWAFQRTNQGQDNRRFINDMVKIYSITATNAVDGVASSCRACALGSEQSGSSCVPCPPGHYIEKETNQCKECPPDTYLSIHQVYGKEACIPCGPGSKNNQDHSVCYSDCFFYHEKENQSLHYDFSNLSSVGSLMNGPSFTSKGTKY

SEQ ID NO: 882682 - protein, 207 aa, Homo sapiens
MVATCLQVVGFVTSFVGWIGVIVTTSTNDWVVTCGYTIPTCRKLDELGSKGLWADCVMATGLYHCKPLVDILILPGYVQACRALMIAASVLGLPAILLLLTVLPCIRMGQEPGVAKYRRAQLAGVLLILLALCALVATIWFPVCAHRETTIVSFGYSLYAGWIGAVLCLVGGCVILCCAGDAQAFGENRFYYTAGSSSPTHAKSAHV

SEQ ID NO: 882683 - protein, 207 aa, Homo sapiens; identical to SEQ ID NO: 882682

SEQ ID NO: 882684 - protein, 133 aa, Homo sapiens
MVATCLQVVGFVTSFVGWIGVIVTTSTNDWVVTCGYTIPTCRKLDELGSKGLWADCVMATGLYHCKPLVDILILPGYVQACRALMIAASVLGLPAILLLLTVLPCIRMGQEPGVAKYRRAQLAGVLLILLDSG

SEQ ID NO: 882685 - protein, 207 aa, Homo sapiens; identical to SEQ ID NO: 882682

SEQ ID NO: 882686 - protein, 207 aa, Homo sapiens; identical to SEQ ID NO: 882682

SEQ ID NO: 882687 - protein, 91 aa, Homo sapiens [sequence omitted]

SEQ ID NO: 882688 - protein, 351 aa, Homo sapiens
DCGPAGKGEAGRDRGREQRGAGPYPRPTRSQEARTTAPGLPRVRSPPAPSAREEDADAAAAMRMEAGEAAPPAGAGGRAAGGWGKWVRLNVGGTVFLTTRQTLCREQKSFLSRLCQGEELQSDRDETGAYLIDRDPTYFGPILNFLRHGKLVLDKDMAEEGVLEEAEFYNIGPLIRIIKDRMEEKDYTVTQVPPKHVYRVLQCQEEELTQMVSTMSDGWRFEQLVNIGSSYNYGSEDQAEFLCVVSKELHSTPNGLSSESSRKTKSTEEQLEEQQQQEEEVEEVEVEQVQVEADAQEKGSRPHPLRPEAELAVRASPRPLARPQSCHPCCYKPEAPGCEAPDHLQGLGVPI

SEQ ID NO: 882689 - protein, 454 aa, Homo sapiens
DCGPAGKGEAGRDRGREQRGAGPYPRPTRSQEARTTAPGLPRVRSPPAPSAREEDADAAAAMRMEAGEAAPPAGAGGRAAGGWGKWVRLNVGGTVFLTTRQTLCREQKSFLSRLCQGEELQSDRDETGAYLIDRDPTYFGPILNFLRHGKLVLDKDMAEEGVLEEAEFYNIGPLIRIIKDRMEEKDYTVTQVPPKHVYRVLQCQEEELTQMVSTMSDGWRFEQLVNIGSSYNYGSEDQAEFLCVVSKELHSTPNGLSSESSRKTKSTEEQLEEQQQQEEEVEEVEVEQVQVEADAQEKGAANPQEDDAKQSRSLPPTPCWSQLQNRGPRGCWGGTRVSSATCLAPHPHNHPFSHFLFAAQSSQDPANLFFIHLFFLLDLICTLPLPSLPLSGFSLCLLTPPSRVCPGPSLPCPPPRPPGPASQSVLPAASCAPSGTSCLPAWGGGAQLHLLCAH

SEQ ID NO: 882690 - protein, 478 aa, Homo sapiens
DCGPAGKGEAGRDRGREQRGAGPYPRPTRSQEARTTAPGLPRVRSPPAPSAREEDADAAAAMRMEAGEAAPPAGAGGRAAGGWGKWVRLNVGGTVFLTTRQTLCREQKSFLSRLCQGEELQSDRDETGAYLIDRDPTYFGPILNFLRHGKLVLDKDMAEEGVLEEAEFYNIGPLIRIIKDRMEEKDYTVTQVPPKHVYRVLQCQEEELTQMVSTMSDGWRFEQLVNIGSSYNYGSEDQAEFLCVVSKELHSTPNGLSSESSRKTKSTEEQLEEQQQQEEEVEEVEVEQVQVEADAQEKGAANPQEDDAKQSRSLPPTPCWSQLQNRGPRGCWGGTRVSSATCLAPHPHNHPFSHFLFAAQSSQDPANLFSLPPLPPPPLPAGGPASSSSTSSSSWISSAPCLFPLCPCPGFLSACSRLHPGSALVPASRALHPGPLALHPRASCLPPPAPLLVPPASQPGEEGRSCTSSVPTNPAGHL

SEQ ID NO: 882691 - protein, 457 aa, Homo sapiens
DCGPAGKGEAGRDRGREQRGAGPYPRPTRSQEARTTAPGLPRVRSPPAPSAREEDADAAAAMRMEAGEAAPPAGAGGRAAGGWGKWVRLNVGGTVFLTTRQTLCREQKSFLSRLCQGEELQSDRDETGAYLIDRDPTYFGPILNFLRHGKLVLDKDMAEEGVLEEAEFYNIGPLIRIIKDRMEEKDYTVTQVPPKHVYRVLQCQEEELTQMVSTMSDGWRFEQLVNIGSSYNYGSEDQAEFLCVVSKELHSTPNGLSSESSRKTKSTEEQLEEQQQQEEEVEEVEVEQVQVEADAQEKAQSSQDPANLFSLPPLLLLRFPLEVLPHLHPPLLPPGSHLHPASSLSAPVRVFSLPAHASIPGLPWSQPPVPSTQAPWPCIPERPACRLLRPFWYLLPPSLGRRGAAAPPLCPLTLPGTSETGPWLQALPPLLSSRPPPHVSSLQVPVRTLSDLRLSLQ

SEQ ID NO: 882692 - protein, 418 aa, Homo sapiens
DCGPAGKGEAGRDRGREQRGAGPYPRPTRSQEARTTAPGLPRVRSPPAPSAREEDADAAAAMRMEAGEAAPPAGAGGRAAGGWGKWVRLNVGGTVFLTTRQTLCREQKSFLSRLCQGEELQSDRDETGAYLIDRDPTYFGPILNFLRHGKLVLDKDMAEEGVLEEAEFYNIGPLIRIIKDRMEEKDYTVTQVPPKHVYRVLQCQEEELTQMVSTMSDGWRFEQLVNIGSSYNYGSEDQAEFLCVVSKELHSTPNGLSSESSRKTKSTEEQLEEQQQQEEEVEEVEVEQVQVEADAQEKGSRPHPLRPEAELAVRASPRPLARPQSCHPWFVAWRCWREGWSEEGAHLLILGLEPSFRLIISTHQSFSSDLALHHPLLTGPTSAPPILLPFPSFFSSCYKPEAPGCEAPDHLQGLGVPI

SEQ ID NO: 882693 - protein, 351 aa, Homo sapiens; identical to SEQ ID NO: 882688

SEQ ID NO: 882694 - protein, 148 aa, Homo sapiens
YSGLGVPSEILYIWYHGVGPESLRTDYTVTQVPPKHVYRVLQCQEEELTQMVSTMSDGWRFEQLVNIGSSYNYGSEDQAEFLCVVSKELHSTPNGLSSESSRKTKSTEEQLEEQQQQEEEVEEVEVEQVQVEADAQEKGAANPQEDDC

SEQ ID NO: 882695 - protein, 191 aa, Homo sapiens
DCGPAGKGEAGRDRGREQRGAGPYPRPTRSQEARTTAPGLPRVRSPPAPSAREEDADAAAAMRMEAGEAAPPAGAGGRAAGGWGKWVRLNVGGTVFLTTRQTLCREQKSFLSRLCQGEELQSDRLPLSGFSLCLLTPPSRVCPGPSLPCPPPRPPGPASQSVLPAASCAPSGTSCLPAWGGGAQLHLLCAH

SEQ ID NO: 882696 - protein, 322 aa, Homo sapiens
DCGPAGKGEAGRDRGREQRGAGPYPRPTRSQEARTTAPGLPRVRSPPAPSAREEDADAAAAMRMEAGEAAPPAGAGGRAAGGWGKWVRLNVGGTVFLTTRQTLCREQKSFLSRLCQGEELQSDRDETGAYLIDRDPTYFGPILNFLRHGKLVLDKDMAEEGVLEEAEFYNIGPLIRIIKDRMEEKDYTVTQVPPKHVYRVLQCQEEELTQMVSTMSDGWRFEQLVNIGSSYNYGSEDQAEFLCVVSKELHSTPNGLSSESSRKTKSTEEQLEEQQQQEEEVEEVEVEQVQVEADAQEKGAANPQEVLEVSKLIRSVHAHSLV

SEQ ID NO: 882697 - protein, 264 aa, Homo sapiens
RRRGCGSRISGGMGRLSWQVAAAAAVGLALTLEALPWVLRWLRSRRRRPRREALFFPSQVTCTEALLRAPGAELAELPEGCPCGLPHGESALSRLLRALLAARASLDLCLFAFSSPQLGRAVQLLHQRGVRVRVVTDCDYMALNGSQIGLLRKAGIQVRHDQDPGYMHHKFAIVDKRVLITGSLNWTTQAIQNNRENVLITEDDEYVRLFLEEFERIWEQFNPTKYTFFPPKKSHGSCAPPVSRAGGRLLSWHRTCGTSSESQT

SEQ ID NO: 882698 - protein, 264 aa, Homo sapiens; identical to SEQ ID NO: 882697

SEQ ID NO: 882699 - protein, 184 aa, Homo sapiens
MASPAASSVRPPRPKKEPQTLVIPKNAAEEQKLKLERLMKNPDKAVPIPEKMSEWAPRPPPEFVRDVMGSSAGAGSGEFHVYRHLRRREYQRQDYMDAMAEKQKLDAEFQKRLEKNKIAAEEQTAKRRKKRQKLKEKKLLAKKMKLEQKKQEGPGQPKEQGSSSSAEASGTEEEEEVPSFTMGR

SEQ ID NO: 882700 - protein, 102 aa, Homo sapiens
MNTLQGPVSFKDVAVDFTQEEWQQLDPDEKIAYGDVMLENYSHLVSVGYDYHQAKHHHGVEVKEVEQGEEPWIMEGEFPCQHSPAFTALKRSLAGGSDCFRL

SEQ ID NO: 882701 - protein, 102 aa, Homo sapiens; identical to SEQ ID NO: 882700

SEQ ID NO: 882702 - protein, 184 aa, Homo sapiens; identical to SEQ ID NO: 882699

SEQ ID NO: 882703 - protein, 200 aa, Homo sapiens
MNTLQGPVSFKDVAVDFTQEEWQQLDPDEKIAYGDVMLENYSHLVSVGYDYHQAKHHHGVEVKEVEQGEEPWIMEGEFPCQHSPGSSAGAGSGEFHVYRHLRRREYQRQDYMDAMAEKQKLDAEFQKRLEKNKIAAEEQTAKRRKKRQKLKEKKLLAKKMKLEQKKQEGPGQPKEQGSSSSAEASGTEEEEEVPSFTMGR

SEQ ID NO: 882704 - protein, 200 aa, Homo sapiens; identical to SEQ ID NO: 882703

SEQ ID NO: 882705 - protein, 200 aa, Homo sapiens; identical to SEQ ID NO: 882703

SEQ ID NO: 882706 - protein, 200 aa, Homo sapiens; identical to SEQ ID NO: 882703

SEQ ID NO: 882707 - protein, 164 aa, Homo sapiens
MLENYSHLVSVGYDYHQAKHHHGVEVKEVEQGEEPWIMEGEFPCQHSPGSSAGAGSGEFHVYRHLRRREYQRQDYMDAMAEKQKLDAEFQKRLEKNKIAAEEQTAKRRKKRQKLKEKKLLAKKMKLEQKKQEGPGQPKEQGSSSSAEASGTEEEEEVPSFTMGR

SEQ ID NO: 882708 - protein, 184 aa, Homo sapiens; identical to SEQ ID NO: 882699

SEQ ID NO: 882709 - protein, 184 aa, Homo sapiens; identical to SEQ ID NO: 882699

SEQ ID NO: 882710 - protein, 214 aa, Homo sapiens
MPPFPRGLKTHYVDLVPGSVRRWPQLWGWSMLPTHSSGKWGPRHRGSAPTAAPGALVFWEGLGVCTRRPGPGTSPGAGSQGHRVCGKRCGGRAGHRRVSRRRLQAGLSQSRRRGIPSRTGVLSPTAVISSRSGRGSKQNRLREAGLGQVGGAPPCMTATVGAFRRLTAVGASGEKRGGTAVSSCGAASNWHPGTGPVQRRHLQRAGQPGAGACA

SEQ ID NO: 882711 - protein, 184 aa, Homo sapiens; identical to SEQ ID NO: 882699

SEQ ID NO: 882712 - protein, 184 aa, Homo sapiens; identical to SEQ ID NO: 882699

SEQ ID NO: 882713 - protein, 184 aa, Homo sapiens; identical to SEQ ID NO: 882699

SEQ ID NO: 882714 - protein, 115 aa, Homo sapiens
MNTLQGPVSFKDVAVDFTQEEWQQLDPDEKIAYGDVMLENYSHLVSVGYDYHQAKHHHGVEVKEVEQGEEPWIMEGEFPCQHSPGKLVDYHMLKNTHPRPLGVTKELFICTRYPQ

SEQ ID NO: 882715 - protein, 115 aa, Homo sapiens; identical to SEQ ID NO: 882714

SEQ ID NO: 882716 - protein, 475 aa, Homo sapiens
MVDTEMPFWPTNFGISSVDLSVMEDHSHSFDIKPFTTVDFSSISTPHYEDIPFTRTDPVVADYKYDLKLQEYQSAIKVEPASPPYYSEKTQLYNKPHEEPSNSLMAIECRVCGDKASGFHYGVHACEGCKGFFRRTIRLKLIYDRCDLNCRIHKKSRNKCQYCRFQKCLAVGMSHNAIRFGRMPQAEKEKLLAEISSDIDQLNPESADLRALAKHLYDSYIKSFPLTKAKARAILTGKTTDKSPFVIYDMNSLMMGEDKIKFKHITPLQEQSKEVAIRIFQGCQFRSVEAVQEITEYAKSIPGFVNLDLNDQVTLLKYGVHEIIYTMLASLMNKDGVLISEGQGFMTREFLKSLRKPFGDFMEPKFEFAVKFNALELDDSDLAIFIAVIILSGDRPGLLNVKPIEDIQDNLLQALELQLKLNHPESSQLFAKLLQKMTDLRQIVTEHVQLLQVIKKTETDMSLHPLLQEIYKDLY

SEQ ID NO: 882717 - protein, 477 aa, Homo sapiens
MTMVDTEMPFWPTNFGISSVDLSVMEDHSHSFDIKPFTTVDFSSISTPHYEDIPFTRTDPVVADYKYDLKLQEYQSAIKVEPASPPYYSEKTQLYNKPHEEPSNSLMAIECRVCGDKASGFHYGVHACEGCKGFFRRTIRLKLIYDRCDLNCRIHKKSRNKCQYCRFQKCLAVGMSHNAIRFGRMPQAEKEKLLAEISSDIDQLNPESADLRALAKHLYDSYIKSFPLTKAKARAILTGKTTDKSPFVIYDMNSLMMGEDKIKFKHITPLQEQSKEVAIRIFQGCQFRSVEAVQEITEYAKSIPGFVNLDLNDQVTLLKYGVHEIIYTMLASLMNKDGVLISEGQGFMTREFLKSLRKPFGDFMEPKFEFAVKFNALELDDSDLAIFIAVIILSGDRPGLLNVKPIEDIQDNLLQALELQLKLNHPESSQLFAKLLQKMTDLRQIVTEHVQLLQVIKKTETDMSLHPLLQEIYKDLY

SEQ ID NO: 882718 - protein, 505 aa, Homo sapiens
MGETLGDSPIDPESDSFTDTLSANISQEMTMVDTEMPFWPTNFGISSVDLSVMEDHSHSFDIKPFTTVDFSSISTPHYEDIPFTRTDPVVADYKYDLKLQEYQSAIKVEPASPPYYSEKTQLYNKPHEEPSNSLMAIECRVCGDKASGFHYGVHACEGCKGFFRRTIRLKLIYDRCDLNCRIHKKSRNKCQYCRFQKCLAVGMSHNAIRFGRMPQAEKEKLLAEISSDIDQLNPESADLRALAKHLYDSYIKSFPLTKAKARAILTGKTTDKSPFVIYDMNSLMMGEDKIKFKHITPLQEQSKEVAIRIFQGCQFRSVEAVQEITEYAKSIPGFVNLDLNDQVTLLKYGVHEIIYTMLASLMNKDGVLISEGQGFMTREFLKSLRKPFGDFMEPKFEFAVKFNALELDDSDLAIFIAVIILSGDRPGLLNVKPIEDIQDNLLQALELQLKLNHPESSQLFAKLLQKMTDLRQIVTEHVQLLQVIKKTETDMSLHPLLQEIYKDLY

SEQ ID NO: 882719 - protein, 505 aa, Homo sapiens; identical to SEQ ID NO: 882718

SEQ ID NO: 882720 - protein, 529 aa, Homo sapiens
PRRARLGPTRLRRGQAGPSALGARARAAAAAWGAWVGLEDTGEGRHAAVAAEMTMVDTEMPFWPTNFGISSVDLSVMEDHSHSFDIKPFTTVDFSSISTPHYEDIPFTRTDPVVADYKYDLKLQEYQSAIKVEPASPPYYSEKTQLYNKPHEEPSNSLMAIECRVCGDKASGFHYGVHACEGCKGFFRRTIRLKLIYDRCDLNCRIHKKSRNKCQYCRFQKCLAVGMSHNAIRFGRMPQAEKEKLLAEISSDIDQLNPESADLRALAKHLYDSYIKSFPLTKAKARAILTGKTTDKSPFVIYDMNSLMMGEDKIKFKHITPLQEQSKEVAIRIFQGCQFRSVEAVQEITEYAKSIPGFVNLDLNDQVTLLKYGVHEIIYTMLASLMNKDGVLISEGQGFMTREFLKSLRKPFGDFMEPKFEFAVKFNALELDDSDLAIFIAVIILSGDRPGLLNVKPIEDIQDNLLQALELQLKLNHPESSQLFAKLLQKMTDLRQIVTEHVQLLQVIKKTETDMSLHPLLQEIYKDLY

SEQ ID NO: 882721 - protein, 477 aa, Homo sapiens; identical to SEQ ID NO: 882717

SEQ ID NO: 882722 - protein, 250 aa, Homo sapiens
MTMVDTEMPFWPTNFGISSVDLSVMEDHSHSFDIKPFTTVDFSSISTPHYEDIPFTRTDPVVADYKYDLKLQEYQSAIKVEPASPPYYSEKTQLYNKPHEEPSNSLMAIECRVCGDKASGFHYGVHACEGCKGFFRRTIRLKLIYDRCDLNCRIHKKSRNKCQYCRFQKCLAVGMSHNAIRFGRMPQAEKEKLLAEISSDIDQLNPESADLRALAKHLYDSYIKSFPLTKAKARAILTGKTTDKSTAQVC

SEQ ID NO: 882723 - protein, 266 aa, Homo sapiens
MTMVDTEMPFWPTNFGISSVDLSVMEDHSHSFDIKPFTTVDFSSISTPHYEDIPFTRTDPVVADYKYDLKLQEYQSAIKVEPASPPYYSEKTQLYNKPHEEPSNSLMAIECRVCGDKASGFHYGVHACEGCKGFFRRTIRLKLIYDRCDLNCRIHKKSRNKCQYCRFQKCLAVGMSHNAIRFGRMPQAEKEKLLAEISSDIDQLNPESADLRALAKHLYDSYIKSFPLTKAKARAILTGKTTDKSVSSLLLSSLGEAGSCFGFLFL

SEQ ID NO: 882724 - protein, 112 aa, Homo sapiens
ICNPLQYHIMMSKKLCIQMTTGAFIAGNLHSMIHVGLVFRLVFCGSNHINHFYCDILPLYRLSCVDPYINELVLFIFSGSVQVFTIGSVLISYLYILLTIFKMKSKEGRAKA

SEQ ID NO: 882725 - protein, 524 aa, Homo sapiens
MAGGTRGSCGRSGPAPSTASPASAAAMAEDSESAASQQSLELDDQDTCGIDGDNEEETEHAKGSPGGYLGAKKKKKKQKRKKEKPNSGGTKSDSASDSQEIKIQQPSKNPSVPMQKLQDIQRAMELLSACQGPARNIDEAAKHRYQFWDTQPVPKLDEVITSHGAIEPDKDNVRQEPYSLPQGFMWDTLDLSDAEVLKELYTLLNENYVEDDDNMFRFDYSPEFLLWALRPPGWLLQWHCGVRVSSNKKLVGFISAIPANIRIYDSVKKMVEINFLCVHKKLRSKRVAPVLIREITRRVNLEGIFQAVYTAGVVLPKPIATCRYWHRSLNPRKLVEVKFSHLSRNMTLQRTMKLYRLPDVTKTSGLRPMEPKDIKSVRELINTYLKQFHLAPVMDEEEVAHWFLPREHIIDTFVVESPNGKLTDFLSFYTLPSTVMHHPAHKSLKAAYSFYNIHTETPLLDLMSDALILAKSKGFDVFNALDLMENKTFLEKLKFGIGDGNLQYYLYNWRCPGTDSEKVGLVLQ

SEQ ID NO: 882726 - protein, 521 aa, Homo sapiens
MAGGTRGSCGRSGPAPSTASPASAAAMAEDSESAASQQSLELDDQDTCGIDGDNEEETEHAKGSPGGYLGAKKKKKKQKRKKEKPNSGGTKSDSASDSQEIKIQQPSKNPSVPMQKLQDIQRAMELLSACQGPARNIDEAAKHRYQFWDTQPVPKLDEVITSHGAIEPDKDNVRQEPYSLPQGFMWDTLDLSDAEVLKELYTLLNENYVEDDDNMFRFDYSPEFLLWALRPPGWLLQWHCGVRVSSNKKLVGFISAIPANIRIYDSVKKMVEINFLCVHKKLRSKRVAPVLIREITRRVNLEGIFQAVYTAGVVLPKPIATCRYWHRSLNPRKLVEVKFSHLSRNMTLQRTMKLYRLPDVTKTSGLRPMEPKDIKSVRELINTYLKQFHLAPVMDEEEVAHWFLPREHIIDTFVVESPNGKLTDFLSFYTLPSTVMHHPAHKSLKAAYSFYNIHTETPLLDLMSDALILAKSKGFDVFNALDLMENKTFLEKLKFGIGDGNLQYYLYNWRCPGTDSEKKVC

SEQ ID NO: 882727 - protein, 485 aa, Homo sapiens
MRRRRSTPKEVLEGIWEPKRKRRNRREKRRNQIPEAPSQTRHLIPRRLKFSSLRNTTPSGSRFQREQPWNPSVPMQKLQDIQRAMELLSACQGPARNIDEAAKHRYQFWDTQPVPKLDEVITSHGAIEPDKDNVRQEPYSLPQGFMWDTLDLSDAEVLKELYTLLNENYVEDDDNMFRFDYSPEFLLWALRPPGWLLQWHCGVRVSSNKKLVGFISAIPANIRIYDSVKKMVEINFLCVHKKLRSKRVAPVLIREITRRVNLEGIFQAVYTAGVVLPKPIATCRYWHRSLNPRKLVEVKFSHLSRNMTLQRTMKLYRLPDVTKTSGLRPMEPKDIKSVRELINTYLKQFHLAPVMDEEEVAHWFLPREHIIDTFVVESPNGKLTDFLSFYTLPSTVMHHPAHKSLKAAYSFYNIHTETPLLDLMSDALILAKSKGFDVFNALDLMENKTFLEKLKFGIGDGNLQYYLYNWRCPGTDSEKVGLVLQ

SEQ ID NO: 882728 - protein, 411 aa, Homo sapiens
MQKLQDIQRAMELLSACQGPARNIDEAAKHRYQFWDTQPVPKLDEVITSHGAIEPDKDNVRQEPYSLPQGFMWDTLDLSDAEVLKELYTLLNENYVEDDDNMFRFDYSPEFLLWALRPPGWLLQWHCGVRVSSNKKLVGFISAIPANIRIYDSVKKMVEINFLCVHKKLRSKRVAPVLIREITRRVNLEGIFQAVYTAGVVLPKPIATCRYWHRSLNPRKLVEVKFSHLSRNMTLQRTMKLYRLPDVTKTSGLRPMEPKDIKSVRELINTYLKQFHLAPVMDEEEVAHWFLPREHIIDTFVVESPNGKLTDFLSFYTLPSTVMHHPAHKSLKAAYSFYNIHTETPLLDLMSDALILAKSKGFDVFNALDLMENKTFLEKLKFGIGDGNLQYYLYNWRCPGTDSEKVGLVLQ

SEQ ID NO: 882729 - protein, 539 aa, Homo sapiens
MAGGTRGSCGRSGPAPSTASPASAAAMAEDSESAASQQSLELDDQDTCGIDGDNEEETEHAKGSPGGYLGAKKKKKKQKRKKEKPNSGGTKSDSASDSQEIKIQQPSKNPSVPMQKLQDIQRAMELLSACQGPARNIDEAAKHRYQFWDTQPVPKLDEVITSHGAIEPDKDNVRQEPYSLPQGFMWDTLDLSDAEVLKELYTLLNENYVEDDDNMFRFDYSPEFLLWALRPPGWLLQWHCGVRVSSNKKLVGFISAIPANIRIYDSVKKMVEINFLCVHKKLRSKRVAPVLIREITRRVNLEGIFQAVYTAGVVLPKPIATCRYWHRSLNPRKLVEVKFSHLSRNMTLQRTMKLYRLPDVTKTSGLRPMEPKDIKSVRELINTYLKQFHLAPVMDEEEVAHWFLPREHIIDTFVVESPNGKLTDFLSFYTLPSTVMHHPAHKSLKAAYSFYNIHTETPLLDLMSDALILAKSKGFDVFNALDLMENKTFLEKLKFGIGDGNLQYYLYNWRCPGTDSEKGSGNFVNANGKLLPDVCRRPP

SEQ ID NO: 882730 - protein, 156 aa, Homo sapiens [sequence omitted]

SEQ ID NO: 882731 - protein, 539 aa, Homo sapiens; identical to SEQ ID NO: 882729

SEQ ID NO: 882732 - protein, 539 aa, Homo sapiens; identical to SEQ ID NO: 882729

SEQ ID NO: 882733 - protein, 145 aa, Homo sapiens
CLSPLGRQPSLLIPEAELPLPAVPSENQLTAGWLTCHSDQNLWLLTSKMSVDFENGQGWSNHCLSQASLAYLSSEGLSFRQQSLLEGIPLLASFLFSLHMSSSFLSLSSNSYASSDPSDQPSAWIIAQENAETMACQAGCSGSHL

SEQ ID NO: 882734 - protein, 118 aa, Homo sapiens
MGRSRSRSSSRSKHTKSSKHNKKRSRSRSRSRDKERVRKRSKSRESKRNRRRESRSRSRSTNTAVSRRERDRERASSPPDRIDIFGRTVSKRSSLDEKQKREEEEKKAEFERQRKIRQ

SEQ ID NO: 882735 - protein, 103 aa, Homo sapiens
MAQFVRNLVEKTPALVNAAVTYSKPRLATFWYYAKVELVPPTPAEIPRAIQSLKKIVNSAQTGSFKQLTVKEAVLNGLVATEVLMWFYVGEIIGKRGIIGYDV

SEQ ID NO: 882736 - protein, 103 aa, Homo sapiens; identical to SEQ ID NO: 882735

SEQ ID NO: 882737 - protein, 103 aa, Homo sapiens; identical to SEQ ID NO: 882735

SEQ ID NO: 882738 - protein, 103 aa, Homo sapiens; identical to SEQ ID NO: 882735

SEQ ID NO: 882739 - protein, 103 aa, Homo sapiens; identical to SEQ ID NO: 882735

SEQ ID NO: 882740 - protein, 103 aa, Homo sapiens; identical to SEQ ID NO: 882735

SEQ ID NO: 882741 - protein, 103 aa, Homo sapiens; identical to SEQ ID NO: 882735

SEQ ID NO: 882742 - protein, 103 aa, Homo sapiens; identical to SEQ ID NO: 882735

SEQ ID NO: 882743 - protein, 103 aa, Homo sapiens; identical to SEQ ID NO: 882735

SEQ ID NO: 882744 - protein, 130 aa, Homo sapiens
MSRSVAVVLISCRWAGGSGRRTLHSRTMAQFVRNLVEKTPALVNAAVTYSKPRLATFWYYAKVELVPPTPAEIPRAIQSLKKIVNSAQTGSFKQLTVKEAVLNGLVATEVLMWFYVGEIIGKRGIIGYDV

SEQ ID NO: 882745 - protein, 103 aa, Homo sapiens; identical to SEQ ID NO: 882735

SEQ ID NO: 882746 - protein, 87 aa, Homo sapiens
EMLRVVSNIIANDAPWPMISPTVKPHQHLRGQQTIQHSFLNCELFEATSLSTMDYFFQALNSFRRVTFSRRFGATDSPFQNHGPICP

SEQ ID NO: 882747 - protein, 87 aa, Homo sapiens; identical to SEQ ID NO: 882746

SEQ ID NO: 882748 - protein, 103 aa, Homo sapiens; identical to SEQ ID NO: 882735

SEQ ID NO: 882749 - protein, 103 aa, Homo sapiens; identical to SEQ ID NO: 882735

SEQ ID NO: 882750 - protein, 103 aa, Homo sapiens; identical to SEQ ID NO: 882735

SEQ ID NO: 882751 - protein, 277 aa, Homo sapiens
MAQFVRNLVEKTPALVNAAVTYSKPRLATFWYYAKVELVPPTPAEIPRAIQSLKKIVNSAQTGSFKQLTVKEAVLNGLVATEVLMWFYVGEIIRSQGTIAYDVRTPMFSIGPATSEQQSAVAPGGIALPGPRSISGPPPPSIFSSPATQPRPNPPPLPLPKDYRMQPPEGIGGRREHPRTGKRVPTASTALNVPPVPRSRDDFSRTRVTIALSAPIPRISAPPPSLSLVSHARPNSVTMLGSVYCVGHKYTHERPGRSSSTPADGAARAKGPTRARG

SEQ ID NO: 882752 - protein, 125 aa, Homo sapiens
MAQFVRNLVEKTPALVNAAVTYSKPRLATFWYYAKVELVPPTPAEIPRAIQSLKKIVNSAQTGSFKQLTVKKKKQHLRILNSSLLSDDQAFLWTSLNNSATVLCWRTLGLLMQCVHLGALWRKNC

SEQ ID NO: 882753 - protein, 103 aa, Homo sapiens; identical to SEQ ID NO: 882735

SEQ ID NO: 882754 - protein, 103 aa, Homo sapiens; identical to SEQ ID NO: 882735

SEQ ID NO: 882755 - protein, 103 aa, Homo sapiens; identical to SEQ ID NO: 882735

SEQ ID NO: 882756 - protein, 103 aa, Homo sapiens; identical to SEQ ID NO: 882735

SEQ ID NO: 882757 - protein, 103 aa, Homo sapiens; identical to SEQ ID NO: 882735

SEQ ID NO: 882758 - protein, 103 aa, Homo sapiens; identical to SEQ ID NO: 882735

SEQ ID NO: 882759 - protein, 103 aa, Homo sapiens; identical to SEQ ID NO: 882735

SEQ ID NO: 882760 - protein, 103 aa, Homo sapiens; identical to SEQ ID NO: 882735

SEQ ID NO: 882761 - protein, 125 aa, Homo sapiens
WPGPGGSFLAGGSGRRTLHSRTMAQFVRNLVEKTPALVNAAVTYSKPRLATFWYYAKVELVPPTPAEIPRAIQSLKKIVNSAQTGSFKQLTVKEAVLNGLVATEVLMWFYVGEIIGKRGIIGYDV

SEQ ID NO: 882762 - protein, 103 aa, Homo sapiens; identical to SEQ ID NO: 882735

SEQ ID NO: 882763 - protein, 121 aa, Homo sapiens
MAQFVRNLVEKTPALVNGIGSSVWNYLLELCVCLKAAVTYSKPRLATFWYYAKVELVPPTPAEIPRAIQSLKKIVNSAQTGSFKQLTVKEAVLNGLVATEVLMWFYVGEIIGKRGIIGYDV

SEQ ID NO: 882764 - protein, 103 aa, Homo sapiens; identical to SEQ ID NO: 882735

SEQ ID NO: 882765 - protein, 82 aa, Homo sapiens
GSLHKVTDKWCHGSGMESPSPPAEIPRAIQSLKKIVNSAQTGSFKQLTVKEAVLNGLVATEVLMWFYVGEIIGKRGIIGYDV

SEQ ID NO: 882766 - protein, 103 aa, Homo sapiens; identical to SEQ ID NO: 882735

SEQ ID NO: 882767 - protein, 174 aa, Homo sapiens
MAQFVRNLVEKTPALVNAAVTYSKPRLATFWYYAKVELVPPTPAEIPRAIQSLKKIVNSAQTGSFKQLTVKEAVLNGLVATEVLMWFYVGEFIDRWGLIVYEVCRPTGTVGLCLTSDMARCSDISPPACIPELRTSRHPVFARHRPSRRASASGRLRDERFRPRTCGPPHVLRP

SEQ ID NO: 882768 - protein, 77 aa, Homo sapiens
MAQFVRNLVEKTPALVNAAVTYSKPRLATFWYYAKVELVPPTPAEIPRAIQSLKKIVNSAQTGSFKQLTVRSCDVVH

SEQ ID NO: 882769 - protein, 558 aa, Homo sapiens
MAQDSVDLSCDYQFWMQKLSVWDQASTLETQQDTCLHVAQFQEFLRKMYEALKEMDSNTVIERFPTIGQLLAKACWNPFILAYDESQKILIWCLCCLINKEPQNSGQSKLNSWIQGVLSHILSALRFDKEVALFTQGLGYAPIDYYPGLLKNMVLSLASELRENHLNGFNTQRRMAPERVASLSRVCVPLITLTDVDPLVEALLICHGREPQEILQPEFFEAVNEAILLKKISLPMSAVVCLWLRHLPSLEKAMLHLFEKLISSERNCLRRIECFIKDSSLPQAACHPAIFRVVDEMFRCALLETDGALEIIATIQVFTQCFVEALEKASKQLRFALKTYFPYTSPSLAMVLLQDPQDIPRGHWLQTLKHISELLREAVEDQTHGSCGGPFESWFLFIHFGGWAEMVAEQLLMSAAEPPTALLWLLAFYYGPRDGRQQRAQTMVQVKAVLGHLLAMSRSSSLSAQDLQTVAGQGTDTDLRAPAQQLIRHLLLNFLLWAPGGHTIAWDVITLMAHTAEITHEIIGFLDQTLYRWNRLGIESPRSEKLARELLKELRTQV

SEQ ID NO: 882770 - protein, 558 aa, Homo sapiens; identical to SEQ ID NO: 882769

SEQ ID NO: 882771 - protein, 115 aa, Homo sapiens
MAQDSVDLSCDYQFWMQKLSVWDQASTLETQQDTCLHVAQFQEFLRKMYEALKEMDSNTVIERFPTIGQLLAKACWNPFILAYDESQKILIWCLCCLINKEPQNSGQSKLNSWIQ

SEQ ID NO: 882772 - protein, 253 aa, Homo sapiens
SHFCLKFCLFLSERKKISLPMSAVVCLWLRHLPSLEKAMLHLFEKLISSERNCLRRIECFIKDSSLPQAACHPAIFRVVDEMFRCALLETDGALEIIATIQVFTQCFVEALEKASKQLRFALKTYFPYTSPSLAMVLLQDPQDIPRGHWLQTLKHISELLREAVEDQTHGSCGGPFESWFLFIHFGGWAEMVAEQLLMSAAEPPTALLWLLAFYYGPRDGRQQRAQTMAQLNQLVAYPRIVCWAWRHCLCGCP

SEQ ID NO: 882773 - protein, 558 aa, Homo sapiens; identical to SEQ ID NO: 882769

SEQ ID NO: 882774 - protein, 558 aa, Homo sapiens; identical to SEQ ID NO: 882769

SEQ ID NO: 882775 - protein, 262 aa, Homo sapiens [sequence omitted]

SEQ ID NO: 882776 - protein, 558 aa, Homo sapiens; identical to SEQ ID NO: 882769

SEQ ID NO: 882777 - protein, 411 aa, Homo sapiens
MAQDSVDLSCDYQFWMQKLSVWDQASTLETQQDTCLHVAQFQEFLRKMYEALKEMDSNTVIERFPTIGQLLAKACWNPFILAYDESQKILIWCLCCLINKEPQNSGQSKLNSWIQGVLSHILSALRFDKEVALFTQGLGYAPIDYYPGLLKNMVLSLASELRENHLNGFNTQRRMAPERVASLSRVCVPLITLTDVDPLVEALLICHGREPQEILQPEFFEAVNEAILLKKISLPMSAVVCLWLRHLPSLEKAMLHLFEKLISSERNCLRRIECFIKDSSLPQAACHPAIFRVVDEMFRCALLETDGALEIIATIQVFTQCFVEALEKASKQLRFALKTYFPYTSPSLAMVLLQDPQDIPRGHWLQTLKHISELLREAVEDQTHGSCGGPFESWFLFIHPAKRRPFFPKVI

SEQ ID NO: 882778 - protein, 245 aa, Homo sapiens
MAQDSVDLSCDYQFWMQKLSVWDQASTLETQQDTCLHVAQFQEFLRKMYEALKEMDSNTVIERFPTIGQLLAKACWNPFILAYDESQKILIWCLCCLINKEPQNSGQSKLNSWIQGVLSHILSALRFDKEVALFTQGLGYAPIDYYPGLLKNMVLSLASELRENHLNGFNTQRRMAPERVASLSRVCVPLITLTDVDPLVEALLICHGREPQEILQPEFFEAVNEAILLCREDTQCCWGKTPVSI

SEQ ID NO: 882779 - protein, 131 aa, Homo sapiens
MAQDSVDLSCDYQFWMQKLSVWDQASTLETQQDTCLHVAQFQEFLRKMYEALKEMDSNTVIERFPTIGQLLAKACWNPFILAYDESQKILIWCLCCLINKEPQNSGQSKLNSWIQTETSPLPGSKACWPSD

SEQ ID NO: 882780 - protein, 180 aa, Homo sapiens
MAAAEEEDGGPEGPNRERGGAGATFECNICLETAREAVVSVCGHLYCWPCLHQWLETRPERQECPVCKAGISREKVVPLYGRGSQKPQDPRLKTPPRPQGQRPAPESRGGFQPFGDTGGFHFSFGVGAFPFGFFTTVFNAHEPFRRGTGVDLGQGHPASSWQDSLFLFLAIFFFFWLLSI

SEQ ID NO: 882781 - protein, 180 aa, Homo sapiens; identical to SEQ ID NO: 882780

SEQ ID NO: 882782 - protein, 180 aa, Homo sapiens; identical to SEQ ID NO: 882780

SEQ ID NO: 882783 - protein, 180 aa, Homo sapiens; identical to SEQ ID NO: 882780

SEQ ID NO: 882784 - protein, 180 aa, Homo sapiens; identical to SEQ ID NO: 882780

SEQ ID NO: 882785 - protein, 180 aa, Homo sapiens; identical to SEQ ID NO: 882780

SEQ ID NO: 882786 - protein, 111 aa, Homo sapiens
LILGFSSVFFNYRERVKSSHLCETCLIICRHLCMTPSVFHCLDCTALVPPDPHPPITFSGVLNFLTNFFNVDLGLKRIVSLGSVTDTKTTNSGLTCQISERLFLTVLLPQI

SEQ ID NO: 882787 - protein, 191 aa, Homo sapiens
FFVVIGIAPIFILYELDSPLCWNEVFIGYGSALGSASFLTSFLGIWLFSYCMEDIHMAFIGIFTTMTGMAMTAFASTTLMMFLARVPFLFTIVPFSVLRSMLSKVVRSTEQGTLFACIAFLETLGGVTAVSTFNGIYSATVAWYPGFTFLLSAGLLLLPAISLCVVKCTSWNEGSYELLIQEESSEDASDR

SEQ ID NO: 882788 - protein, 193 aa, Homo sapiens
FFVVIGIAPIFILYELDSPLCWNEVFIGYGSALGSASFLTSFLGIWLFSYCMEDIHMAFIGIFTTMTGMAMTAFASTTLMMFLARVPFLFTIVPFSVLRSMLSKVVRSTEQGTLFACIAFLETLGGVTAVSTFNGIYSATVAWYPGFTFLLSAGLLLLPAISLCVVKCTSWNEGSYELLIQEESSEDASDRAC

SEQ ID NO: 882789 - protein, 233 aa, Homo sapiens
ILPHTSYKYLLELIAVTIVFQSYRFYSANQSNFSTNVSLERNWTGNATLIPGSILSFETTTLWPITTINYITVAFIFSKGKPFRKPIYTNYIFSFLLLAALGLTIFILFSDFQVIYRGMELIPTITSWRVLILVVALTQFCVAFFAEDSILQNHELWLLIKREFGFYSKSQYRTWQKKLAEDSTWPPINRTDYSGDGKNGFYINGGYESHEQIPKRKLKLGGQPTEQHFWARL

SEQ ID NO: 882790 - protein, 734 aa, Homo sapiens
MGSVTSSNTTSACCWQAAETQHGGLKSLYLCECLMKECDFPSLNDQPLKQLEGKQLEQDPMDIKRPSNNLITLPRNQCHQTPPKNGRLIQPQIRTFTPPQSPKYILMCTGRGSESSVTYPKQSQLDSGFFLRAIEARAARRNRPAWNICWDLCYLQNPDFEEHFSTFLMNTVFHKTWEPTRNSPQACPTLRPFTDEPEKVRTLGNKSHSLISPHIPSGAPDLPEMASGSGLLPGRSSTDVLLPSAPTPHPRGPMALERRRSWISSEIISRFFRAILYSPFARVSLACRSSKSFSVADQENRRLSEDYPASLKMLSEGQVQVHFLPIILLQGIFQDMTEDLITIVTAIHSPDKISHHHPQITIQVTTSEYPKTLTGGTNPIREAKMGIRHTKVPQSRHLVPSTVVLKVELASKSPWVLRLSSLDSNLRVSNSVGLEWDLVYSGLQVMLMLLVLRACCENHWPSTTEKVTEWQLQSSETTEDPTETILRSENSVKPVSPLSPYSKLAHVILCYPRKVKLRVQKNLISDEAQSYTYLELHIVLCLEFKIRPAEDRKESHQSNKYSDHNQLHKMNKRHQLPLARSSFQYLVNSLQGRDMSVMLLALETDRHQMERLGSPRAILTGGPSQDTGNPHTHILGTLQLSSCSSSVGRLFRASQVIPSSKGGLVCSPNEVGSPGDEEQLRLEKGLLKPPPLLKSTGEEREAPLLPHSTARPPLGGGLRLVLPNLVQRLELLVG

SEQ ID NO: 882791 - protein, 97 aa, Homo sapiens
PKGAQGEEYVCEWASEGTGKMSQQKEHEHPCKGVWLERQGGHGGGLEATLWNAQMYILTFGQTGATQDYDLSLYSSRSLKRLAKYNHKIYFLKQVNG

SEQ ID NO: 882792 - protein, 94 aa, Homo sapiens
PKGAQGEEYVCEWASEGTGKMSQQKEHEHPCKGVWLERQGGHGGGLEATLWNAQMYILTFGQTGATQDYDLSLYSSRSLKREMKMNCVTDAVDY

SEQ ID NO: 882793 - protein, 716 aa, Homo sapiens
MGSVTSSNTTSACCWQAAETQHGGLKSLYLCECLMKECDFPSLNDQPLKQLEGKQLEQDPMDIKRPSNNLITLPRNQCHQTPPKNGRLIQPQIRTFTPPQSPKYILMCTGRGSESSVTYPKQSQLDSGFFLRAIEARAARRNRPAWNICWDLCYLQNPDFEEHFSTFLMNTVFHKTWEPTRNSPQACPTLRPFTDEPEKVRTLGNKSHSLISPHIPSGAPDLPEMASGSGLLPGRSSTDVLLPSAPTPHPRGPMALERRRSWISSEIISRFFRAILYSPFARVSLACRSSKSFSVADQENRRLSEDYPASLKMLSEGQVQVHFLPIILLQGIFQDMTEDLITIVTAIHSPDKISHHHPQITIQVTTSEYPKTLTGGTNPIREAKMGIRHTKVPQSRHLVPSTVVLKVELASKSPWVLRLSSLDSNLRVSNSVGLEWDLVYSGLQVMLMLLVLRACCENHWPSTTEKVTEWQLQSSETTEDPTETILRSENSVKPVSPLSPYSKLAHVILCYPRKVKLRVQKNLISDEAQSYTYLELHIVLALSSDHNQLHKMNKRHQLPLARSSFQYLVNSLQGRDMSVMLLALETDRHQMERLGSPRAILTGGPSQDTGNPHTHILGTLQLSSCSSSVGRLFRASQVIPSSKGGLVCSPNEVGSPEDEEQLRLEKGLLKPPPLLKSTGEEREAPLLPHSTARPPLGGGLRLVLPNLVQRLELLVG

SEQ ID NO: 882794 - protein, 734 aa, Homo sapiens; identical to SEQ ID NO: 882790

SEQ ID NO: 882795 - protein, 712 aa, Homo sapiens
MGSVTSSNTTSACCWQAAETQHGGLKSLYLCECLMKECDFPSLNDQPLKQLEGKQLEQDPMDIKRPSNNLITLPRNQCHQTPPKNGRLIQPQIRTFTPPQSPKYILMCTGRGSESSVTYPKQSQLDSGFFLRAIEARAARRNRPAWNICWDLCYLQNPDFEEHFSTFLMNTVFHKTWEPTRNSPQACPTLRPFTDEPEKVRTLGNKSHSLISPHIPSGAPDLPEMASGSGLLPGRSSTDVLLPSAPTPHPRGPMALERRRSWISSEIISRFFRAILYSPFARVSLACRSSKSFSVADQENRRLSEDYPASLKMLSEGQVQVHFLPIILLQGIFQDMTEDLITIVTAIHSPDKISHHHPQITIQVTTSEYPKTLTGGTNPIREAKMGIRHTKVPQSRHLVPSTVVLKVELASKSPWVLRLSSLDSNLRVSNSVGLEWDLVYSGLQVMLMLLVLRACCENHWPSTTEKVTEWQLQSSETTEDPTETILRSENSVKPVSPLSPYSKLAHVILCYPRKVKLRVQKNLISDEAQSYTYLELHIVLCLEFKIRPAEDRKESHQSNKYSDHNQLHKMNKRHQLPLARSSFQYLVNSLQGRDMSVMLLALETDRHQMERLGSPRAILTGGPSQDTGNPHTHILGTLQLSSCSSSVGRLFRASQVIPSSKGGLVCSPNEVGSPGDEEQLRLEKGLLKPPPLPKSRERYTGEMALEDPLEHY

SEQ ID NO: 882796 - protein, 303 aa, Homo sapiens
MGRPLLLPLLPLLLPPAFLQPSGSTGSGPSYLYGVTQPKHLSASMGGSVEIPFSFYYPWELATAPDVRISWRRGHFHGQSFYSTRPPSIHKDYVNRLFLNWTEGQKSGFLRISNLQKQDQSVYFCRVELDTRSSGRQQWQSIEGTKLSITQAVTTTTQRPSSMTTTWRLSSTTTTTGLRVTQGKRRSDSWHISLETAVGVAVAVTVLGIMILGLICLLRWRRRKGQQRTKATTPAREPFQNTEEPYENIRNEGQNTDPKLNPKDDGIVYASLALSSSTSPRAPPSHRPLKSPQNETLYSVLKA

SEQ ID NO: 882797 - protein, 230 aa, Homo sapiens [sequence omitted]

SEQ ID NO: 882798 - protein, 336 aa, Homo sapiens
MGPGLCVGRPLHRAPLLPGRLCWSPRPLEKNKAMGRPLLLPLLPLLLPPAFLQPSGSTGSGPSYLYGVTQPKHLSASMGGSVEIPFSFYYPWELATAPDVRISWRRGHFHGQSFYSTRPPSIHKDYVNRLFLNWTEGQKSGFLRISNLQKQDQSVYFCRVELDTRSSGRQQWQSIEGTKLSITQAVTTTTQRPSSMTTTWRLSSTTTTTGLRVTQGKRRSDSWHISLETAVGVAVAVTVLGIMILGLICLLRWRRRKGQQRTKATTPAREPFQNTEEPYENIRNEGQNTDPKLNPKDDGIVYASLALSSSTSPRAPPSHRPLKSPQNETLYSVLKA

SEQ ID NO: 882799 - protein, 175 aa, Homo sapiens [sequence omitted]

SEQ ID NO: 882800 - protein, 193 aa, Homo sapiens
MGRPLLLPLLPLLLPPAFLQPSGSTGSGPSYLYGVTQPKHLSASMGGSVEIPFSFYYPWELATAPDVRISWRRGHFHGQSFYSTRPPSIHKDYVNRLFLNWTEGQKSGFLRISNLQKQDQSVYFCRVELDTRSSGRQQWQSIEGTKLSITQGTCRDGHSRCLRPGKPLHHLNHCVGFGADGKWLHNLNEARQP

SEQ ID NO: 882801 - protein, 200 aa, Homo sapiens
MREIVASRDEGQRQEERSCRREVKVGHLGDRKRIRNVDEENNRTATTTQPQARSTSRESRRGTEERELASDDARHDSGTDVRGAAVRSYTKIDTTTIRNEDTDCCMRHKPRKWYTEHESEKRRTAAMRTETFSCCFREHYEPQSDKQGTSSDADAAEPTTLAITVQRSRPQATITSPDLDASTSLYAVASTQLKTRGAKK

SEQ ID NO: 882802 - protein, 193 aa, Homo sapiens; identical to SEQ ID NO: 882800

SEQ ID NO: 882803 - protein, 73 aa, Homo sapiens
RSPAIIGTEPFQNTEEPYENIRNEGESLPPSFPSFYPWHFLFPQIPPTWVRAPVSIFFFPFLAPCPHVTLALT

SEQ ID NO: 882804 - protein, 152 aa, Homo sapiens
MGRPLLLPLLPLLLPPAFLQPSGSTGSGPSYLYGVTQPKHLSASMGGSVEIPFSFYYPWELATAPDVRISWRRGHFHGQSFYSTRPPSIHKDYVNRLFLNWTEGQKSGFLRISNLQKQDQSVYFCRVELDTRSSGRQQWQSIEGTKLSITQG

SEQ ID NO: 882805 - protein, 187 aa, Homo sapiens [sequence omitted]

SEQ ID NO: 882806 - protein, 257 aa, Homo sapiens
MYQTNDQIINGLFPLNKDLALEMAALLSQVEIGDFERPFSTPAGHVTNQCKVNQTLKQVIEKFYPKRYRDGCSEEQLRQLCQRLSTRWMALRGHSAADCVRIYLTVARKWPFFGAKLFLAKPITPSSLGSTFLWLAVHEDGLSLLEYNSMRLIVSYVYKSLMTFGGYQDDFMVVINNTHSKDKPTEKLLFAMAKPKILEITLLIASYINNFHQQKAAFHHLSAPALLSAQTRGPQARMMGSQPLLSSSRPTKGPTLL

SEQ ID NO: 882807 - protein, 257 aa, Homo sapiens; identical to SEQ ID NO: 882806

SEQ ID NO: 882808 - protein, 257 aa, Homo sapiens; identical to SEQ ID NO: 882806

SEQ ID NO: 882809 - protein, 257 aa, Homo sapiens; identical to SEQ ID NO: 882806

SEQ ID NO: 882810 - protein, 96 aa, Homo sapiens
MSAPLDAALHALQEEQARLKMRLWDLQQLRKELGDSPKDKVPFSVPKIPLVFRGHTQQDPEVPKSLVSNLRIHCPLLAGSALITFDDPKGLMGSLM

SEQ ID NO: 882811 - protein, 299 aa, Homo sapiens
MVSNDWFTRRKLGGTGRWCEPRAAGGLGLGVGPRGMWRAGSMSAELGVGCALRAVNERVQQAVARRPRDLPAIQPRLVAVSKTKPADMVIEAYGHGQRTFGENYVQELLEKASNPKILSLCPEIKWHFIGHLQKQNVNKLMAVPNLFMLETVDSVKLADKVNSSWQRKGSPERLKVMVQINTSGEESKHGLPPSETIAIVEHINAKCPNLEFVGLMTIGSFGHDLSQGPNPDFQLLLSLREELCKKLNIPADQVELSMGMSADFQHAVEVGSTNVRIGSTILESGITQRNPPRTSAQQT

SEQ ID NO: 882812 - protein, 159 aa, Homo sapiens
MAVPNLFMLETVDSVKLADKVNSSWQRKGSPERLKVMVQINTSGEESKHGLPPSETIAIVEHINAKCPNLEFVGLMTIGSFGHDLSQGPNPDFQLLLSLREELCKKLNIPADQVELSMGMSADFQHAVEVGSTNVRIGSTILESGITQRNPPRTSAQQT

SEQ ID NO: 882813 - protein, 202 aa, Homo sapiens
MVSNDWFTRRKLGGTGRWCEPRAAGGLGLGVGPRGMWRAGSMSAELGVGCALRAVNERVQQAVARRPRDLPAIQPRLVAVSKTKPADMVIEAYGHGQRTFGENYVQELLEKASNPKILSLCPEIKWHFIGHLQKQNVNKLMAVPNLFMLETVDSVKLADKVNSSWQRKGSPERLKVMVQINTSGEESKHGLPPSETIAIVEH

SEQ ID NO: 882814 - protein, 158 aa, Homo sapiens
MVSNDWFTRRKLGGTGRWCEPRAAGGLGLGVGPRGMWRAGSMSAELGVGCALRAVNERVQQAVARRPRDLPAIQPRLVAVSKTKPADMVIEAYGHGQRTFGENYVQELLEKASNPKILSLCPEIKWHFIGHLQKQNVNKLMGKSEFLIKRENIMPRTE

SEQ ID NO: 882815 - protein, 169 aa, Homo sapiens
MVSNDWFTRRKLGGTGRWCEPRAAGGLGLGVGPRGMWRAGSMSAELGVGCALRAVNERVQQAVARRPRDLPAIQPRLVAVSKTKPADMVIEAYGHGQRTFGENYVQELLEKASNPKILSLCPEIKWHFIGHLQKQNVNKLMGKIKLNMKTKLFCHCIASTTLCGRESNF

SEQ ID NO: 882816 - protein, 499 aa, Homo sapiens
MSLADELLADLEEAAEEEEGGSYGEEEEEPAIEDVQEETQLDLSGDSVKTIAKLWDSKMFAEIMMKIEEYISKQAKASEVMGPVEAAPEYRVIVDANNLTVEIENELNIIHKFIRDKYSKRFPELESLVPNALDYIRTVKELGNSLDKCKNNENLQQILTNATIMVVSVTASTTQGQQLSEEELERLEEACDMALELNASKHRIYEYVESRMSFIAPNLSIIIGASTAAKIMGVAGGLTNLSKMPACNIMLLGAQRKTLSGFSSTSVLPHTGYIYHSDIVQSLPPDLRRKAARLVAAKCTLAARVDSFHESTEGKVGYELKDEIERKFDKWQEPPPVKQVKPLPAPLDGQRKKRGGRRYRKMKERLGLTEIRKQANRMSFGEIEEDAYQEDLGFSLGHLGKSGSGRVRQTQVNEATKARISKTLQRTLQKQSVVYGGKSTIRDRSSGTASSVAFTPLQGLEIVNPQAAEKKVAEANQKYFSSMAEFLKVKGEKSGLMST

SEQ ID NO: 882817 - protein, 309 aa, Homo sapiens
MSLADELLADLEEAAEEEEGGSYGEEEEEPAIEDVQEETQLDLSGDSVKTIAKLWDSKMFAEIMMKIEEYISKQAKASEVMGPVEAAPEYRVIVDANNLTVEIENELNIIHKFIRDKYSKRFPELESLVPNALDYIRTVKELGNSLDKCKNNENLQQILTNATIMVVSVTASTTQGQQLSEEELERLEEACDMALELNASKHRIYEYVESRMSFIAPNLSIIIGASTAAKIMGVAGGLTNLSKMPACNIMLLGAQRKTLSGFSSTSVLPPGALPGALWPAPILGSPVGPQLAVGSHRGGPGQHKAGRIA

SEQ ID NO: 882818 - protein, 563 aa, Homo sapiens
MSLADELLADLEEAAEEEEGGSYGEEEEEPAIEDVQEETQLDLSGDSVKTIAKLWDSKMFAEIMMKIEEYISKQAKASEVMGPVEAAPEYRVIVDANNLTVEIENELNIIHKFIRDKYSKRFPELESLVPNALDYIRTVKELGNSLDKCKNNENLQQILTNATIMVVSVTASTTQGQQLSEEELERLEEACDMALELNASKHRIYEYVESRMSFIAPNLSIIIGASTAAKIMGVAGGLTNLSKMPACNIMLLGAQRKTLSGFSSTSVLPHTGYIYHSDIVQSLPPDLRRKAARLVAAKCTLAARVDSFHESTEGKVGYELKDEIERKFDKWQEPPPVKQVKPLPAPLDGQRKKRGGRRLRGPGGPVGMGVMEGRSRRPPPSRLPGAAHPPVPRYRKMKERLGLTEIRKQANRMSFGEIEEDAYQEDLGFSLGHLGKSGSGRVRQTQVNEATKARISKTLQVWARPKVGLGTEGHKVGGAQIAASLSSPQRTLQKQSVVYGGKSTIRDRSSGTASSVAFTPLQGLEIVNPQAAEKKVAEANQKYFSSMAEFLKVKGEKSGLMST

SEQ ID NO: 882819 - protein, 444 aa, Homo sapiens
MSLADELLADLEEAAEEEEGGSYGEEEEEPAIEDVQEETQLDLSGDSVKTIAKLWDSKMFAEIMMKIEEYISKQAKASEVMGPVEAAPEYRVIVDANNLTVEIENELNIIHKFIRDKYSKRFPELESLVPNALDYIRTVKELGNSLDKCKNNENLQQILTNATIMVVSVTASTTQGQQLSEEELERLEEACDMALELNASKHRIYEYVESRMSFIAPNLSIIIGASTAAKIMGVAGGLTNLSKMPACNIMLLGAQRKTLSGFSSTSVLPHTGYIYHSDIVQSLPPDLRRKAARLVAAKCTLAARVDSFHESTEGKVGYELKDEIERKFDKWQEPPPVKQVKPLPAPLDGQRKKRGGRRYRKMKERLGLTEIRKQANRMSFGEIGEDAYRRLDSAWAWAVGRGCAPPPVTGPGGSRRGGLNNVFGGTPRTLEAGPPAVSREKGAH

SEQ ID NO: 882820 - protein, 499 aa, Homo sapiens; identical to SEQ ID NO: 882816

SEQ ID NO: 882821 - protein, 499 aa, Homo sapiens; identical to SEQ ID NO: 882816

SEQ ID NO: 882822 - protein, 499 aa, Homo sapiens; identical to SEQ ID NO: 882816

SEQ ID NO: 882823 - protein, 524 aa, Homo sapiens
DGDHGEREAGLLGLGEEVCEEKGLGMSLADELLADLEEAAEEEEGGSYGEEEEEPAIEDVQEETQLDLSGDSVKTIAKLWDSKMFAEIMMKIEEYISKQAKASEVMGPVEAAPEYRVIVDANNLTVEIENELNIIHKFIRDKYSKRFPELESLVPNALDYIRTVKELGNSLDKCKNNENLQQILTNATIMVVSVTASTTQGQQLSEEELERLEEACDMALELNASKHRIYEYVESRMSFIAPNLSIIIGASTAAKIMGVAGGLTNLSKMPACNIMLLGAQRKTLSGFSSTSVLPHTGYIYHSDIVQSLPPDLRRKAARLVAAKCTLAARVDSFHESTEGKVGYELKDEIERKFDKWQEPPPVKQVKPLPAPLDGQRKKRGGRRYRKMKERLGLTEIRKQANRMSFGEIEEDAYQEDLGFSLGHLGKSGSGRVRQTQVNEATKARISKTLQRTLQKQSVVYGGKSTIRDRSSGTASSVAFTPLQGLEIVNPQAAEKKVAEANQKYFSSMAEFLKVKGEKSGLMST

SEQ ID NO: 882824 - protein, 508 aa, Homo sapiens
MSLADELLADLEEAAEEEEGGSYGEEEEEPAIEDVQEETQLDLSGDSVKTIAKLWDSKMFAEIMMKIEEYISKQAKASEVMGPVEAAPEYRVIVDANNLTVEIENELNIIHKFIRDKYSKRFPELESLVPNALDYIRTVKELGNSLDKCKNNENLQQILTNATIMVVSVTASTTQGQQLSEEELERLEEACDMALELNASKHRIYEYVESRMSFIAPNLSIIIGASTAAKIMGVAGGLTNLSKMPACNIMLLGAQRKTLSGFSSTSVLPHTGYIYHSDIVQSLPPIPPPFSVLQDLRRKAARLVAAKCTLAARVDSFHESTEGKVGYELKDEIERKFDKWQEPPPVKQVKPLPAPLDGQRKKRGGRRYRKMKERLGLTEIRKQANRMSFGEIEEDAYQEDLGFSLGHLGKSGSGRVRQTQVNEATKARISKTLQRTLQKQSVVYGGKSTIRDRSSGTASSVAFTPLQGLEIVNPQAAEKKVAEANQKYFSSMAEFLKVKGEKSGLMST

SEQ ID NO: 882825 - protein, 630 aa, Homo sapiens
MSLADELLADLEEAAEEEEGGSYGEEEEEPAIEDVQEETQLDLSGDSVKTIAKLWDSKMFAEIMMKIEEYISKQAKASEVMGPVEAAPEYRVIVDANNLTVEIENELSECWGAGGDSPVDVPHAPSPFPTGLSQGPAPKPKLRSRLTCCHRVAEIRRKCVLSRMSLRSLGDGVAAWLPVGPRLFPSCWSATCLTVRGDCPTSSHHLRIPTSKALLFFKNMSLQLTFYRPELIPLVTPSDIIHKFIRDKYSKRFPELESLVPNALDYIRTVKELGNSLDKCKNNENLQQILTNATIMVVSVTASTTQGQQLSEEELERLEEACDMALELNASKHRIYEYVESRMSFIAPNLSIIIGASTAAKIMGVAGGLTNLSKMPACNIMLLGAQRKTLSGFSSTSVLPHTGYIYHSDIVQSLPPDLRRKAARLVAAKCTLAARVDSFHESTEGKVGYELKDEIERKFDKWQEPPPVKQVKPLPAPLDGQRKKRGGRRYRKMKERLGLTEIRKQANRMSFGEIEEDAYQEDLGFSLGHLGKSGSGRVRQTQVNEATKARISKTLQRTLQKQSVVYGGKSTIRDRSSGTASSVAFTPLQGLEIVNPQAAEKKVAEANQKYFSSMAEFLKVKGEKSGLMST

SEQ ID NO: 882826 - protein, 309 aa, Homo sapiens; identical to SEQ ID NO: 882817

SEQ ID NO: 882827 - protein, 294 aa, Homo sapiens
MSLADELLADLEEAAEEEEGGSYGEEEEEPAIEDVQEETQLDLSGDSVKTIAKLWDSKMFAEIMMKIEEYISKQAKASEVMGPVEAAPEYRVIVDANNLTVEIENELNIIHKFIRDKYSKRFPELESLVPNALDYIRTVKELGNSLDKCKNNENLQQILTNATIMVVSVTASTTQGQQLSEEELERLEEACDMALELNASKHRIYEYVESRMSFIAPNLSIIIGASTAAKIMGCRASRLPQCCPTPATSTTVTSCSPCHRICGGKRPGWWPPSAHWQPVWTVSTRAQKGRWATN

SEQ ID NO: 882828 - protein, 477 aa, Homo sapiens
MSLADELLADLEEAAEEEEGGSYGEEEEEPAIEDVQEETQLDLSGDSVKTIAKLWDSKMFAEIMMKIEEYISKQAKASEVMGPVEAAPEYRVIVDANNLTVEIENELNIIHKFIRDKYSKRFPELESLVPNALDYIRTVKELGNSLDKCKNNENLQQILTNATIMVVSVTASTTQGQQLSEEELERLEEACDMALELNASKHRIYEYVESRMSFIAPNLSKMPACNIMLLGAQRKTLSGFSSTSVLPHTGYIYHSDIVQSLPPDLRRKAARLVAAKCTLAARVDSFHESTEGKVGYELKDEIERKFDKWQEPPPVKQVKPLPAPLDGQRKKRGGRRYRKMKERLGLTEIRKQANRMSFGEIEEDAYQEDLGFSLGHLGKSGSGRVRQTQVNEATKARISKTLQRTLQKQSVVYGGKSTIRDRSSGTASSVAFTPLQGLEIVNPQAAEKKVAEANQKYFSSMAEFLKVKGEKSGLMST

SEQ ID NO: 882829 - protein, 316 aa, Homo sapiens
MERLEEACDMALELNASKHRIYEYVESRMSFIAPNLSIIIGASTAAKIMGVAGGLTNLSKMPACNIMLLGAQRKTLSGFSSTSVLPHTGYIYHSDIVQSLPPDLRRKAARLVAAKCTLAARVDSFHESTEGKVGYELKDEIERKFDKWQEPPPVKQVKPLPAPLDGQRKKRGGRRYRKMKERLGLTEIRKQANRMSFGEIEEDAYQEDLGFSLGHLGKSGSGRVRQTQVNEATKARISKTLQRTLQKQSVVYGGKSTIRDRSSGTASSVAFTPLQGLEIVNPQAAEKKVAEANQKYFSSMAEFLKVKGEKSGLMST

SEQ ID NO: 882830 - protein, 294 aa, Homo sapiens; identical to SEQ ID NO: 882827

SEQ ID NO: 882831 - protein, 138 aa, Homo sapiens [sequence omitted]

SEQ ID NO: 882832 - protein, 185 aa, Homo sapiens
MSLADELLADLEEAAEEEEGGSYGEEEEEPAIEDVQEETQLDLSGDSVKTIAKLWDSKMFAEIMMKIEEYISKQAKASEVMGPVEAAPEYRVIVDANNLTVEIENELNIIHKFIRDKYSKRFPELESLVPNALDYIRTVKELGNSLDKCKNNENLQQILLLLSLPVPRLLHTILITAATCRQSVN

SEQ ID NO: 882833 - protein, 142 aa, Homo sapiens
MSLADELLADLEEAAEEEEGGSYGEEEEEPAIEDVQEETQLDLSGDSVKTIAKLWDSKMFAEIMMKIEEYISKQAKASEGASSHSVPLPISCLSCQAPWLPGCLWLGISPSQPFPEPSFFFVSPQPVPFSTKYILHCKAHAS

SEQ ID NO: 882834 - protein, 262 aa, Homo sapiens
MVAWRSAFLVCLAFSLATLVQRGSGDFDDFNLEDAVKETSSVKQPWDHTTTTTTNRPGTTRAPAKPPGSGLDLADALDDQDDGRRKPGIGGRERWNHVTTTTKRPVTTRAPANTLGNDFDLADALDDRNDRDDGRRKPIAGGGGFSDKDLEDIVGGGEYKPDKGKGDGRYGSNDDPGSGMVAEPGTIAGVASALAMALIGAVSSYISYQQKKFCFSIQQGLNADYVKGENLEAVVCEEPQVKYSTLHTQSAEPPPPPEPARI

SEQ ID NO: 882835 - protein, 276 aa, Homo sapiens
RLIGSGIWDSLLPAMVAWRSAFLVCLAFSLATLVQRGSGDFDDFNLEDAVKETSSVKQPWDHTTTTTTNRPGTTRAPAKPPGSGLDLADALDDQDDGRRKPGIGGRERWNHVTTTTKRPVTTRAPANTLGNDFDLADALDDRNDRDDGRRKPIAGGGGFSDKDLEDIVGGGEYKPDKGKGDGRYGSNDDPGSGMVAEPGTIAGVASALAMALIGAVSSYISYQQKKFCFSIQQGLNADYVKGENLEAVVCEEPQVKYSTLHTQSAEPPPPPEPARI

SEQ ID NO: 882836 - protein, 246 aa, Homo sapiens
LLPHERGSGDFDDFNLEDAVKETSSVKQPWDHTTTTTTNRPGTTRAPAKPPGSGLDLADALDDQDDGRRKPGIGGRERWNHVTTTTKRPVTTRAPANTLGNDFDLADALDDRNDRDDGRRKPIAGGGGFSDKDLEDIVGGGEYKPDKGKGDGRYGSNDDPGSGMVAEPGTIAGVASALAMALIGAVSSYISYQQKKFCFSIQQGLNADYVKGENLEAVVCEEPQVKYSTLHTQSAEPPPPPEPARI

SEQ ID NO: 882837 - protein, 213 aa, Homo sapiens
MVAWRSAFLVCLAFSLATLVQRGSGDFDDFNLEDAVKETSSVKQRWNHVTTTTKRPVTTRAPANTLGNDFDLADALDDRNDRDDGRRKPIAGGGGFSDKDLEDIVGGGEYKPDKGKGDGRYGSNDDPGSGMVAEPGTIAGVASALAMALIGAVSSYISYQQKKFCFSIQQGLNADYVKGENLEAVVCEEPQVKYSTLHTQSAEPPPPPEPARI

SEQ ID NO: 882838 - protein, 262 aa, Homo sapiens; identical to SEQ ID NO: 882834

SEQ ID NO: 882839 - protein, 262 aa, Homo sapiens; identical to SEQ ID NO: 882834

SEQ ID NO: 882840 - protein, 262 aa, Homo sapiens; identical to SEQ ID NO: 882834

SEQ ID NO: 882841 - protein, 194 aa, Homo sapiens
MVAWRSAFLVCLAFSLATLVQRGSGDFDDFNLEDAVKETSSVKQPWDHTTTTTTNRPGTTRAPAKPPGSGLDLADALDDQDDGRRKPGIGGRERWNHVTTTTKRPVTTRAPANTLGNDFDLADALDDRNDRDDGRRKPIAGGGGFSDKDLEDIVGGGEYKPDKGKGDGRYGSNDDPGSGGFLNPEAPVGHVKGK

SEQ ID NO: 882842 - protein, 145 aa, Homo sapiens
MVAWRSAFLVCLAFSLATLVQRGSGDFDDFNLEDAVKETSSVKPALGMYHKLDGLKQQNFILSLFWMLEVLYQGVGWATFSLKALGKNLSLTFPTSGGSRCSLVCGCITPISASVVTWCSPFCVSLLSLTKMLVSGFKAHLDNPG

SEQ ID NO: 882843 - protein, 262 aa, Homo sapiens; identical to SEQ ID NO: 882834

SEQ ID NO: 882844 - protein, 262 aa, Homo sapiens; identical to SEQ ID NO: 882834

SEQ ID NO: 882845 - protein, 1038 aa, Homo sapiens
MFPTESAWLGKRGANPAPEAAVRETVMLLLCLGVPTGRPYNVDTESALLYQGPHNTLFGYSVVLHSHGANRWLLVGAPTANWLANASVINPGAIYRCRIGKNPGQTCEQLQLGSPNGEPCGKTCLEERDNQWLGVTLSRQPGENGSIVTCGHRWKNIFYIKNENKLPTGGCYGVPPDLRTELSKRIAPCYQDYVKKFGENFASCQAGISSFYTKDLIVMGAPGSSYWTGSLFVYNITTNKYKAFLDKQNQVKFGSYLGYSVGAGHFRSQHTTEVVGGAPQHEQIGKAYIFSIDEKELNILHEMKGKKLGSYFGASVCAVDLNADGFSDLLVGAPMQSTIREEGRVFVYINSGSGAVMNAMETNLVGSDKYAARFGESIVNLGDIDNDGFEDVAIGAPQEDDLQGAIYIYNGRADGISSTFSQRIEGLQISKSLSMFGQSISGQIDADNNGYVDVAVGAFRSDSAVLLRTRPVVIVDASLSHPESVNRTKFDCVENGWPSVCIDLTLCFSYKGKEVPGYIVLFYNMSLDVNRKAESPPRFYFSSNGTSDVITGSIQVSSREANCRTHQAFMRKDVRDILTPIQIEAAYHLGPHVISKRSTEEFPPLQPILQQKKEKDIMKKTINFARFCAHENCSADLQVSAKIGFLKPHENKTYLAVGSMKTLMLNVSLFNAGDDAYETTLHVKLPVGLYFIKILELEEKQINCEVTDNSGVVQLDCSIGYIYVDHLSRIDISFLLDVSSLSRAEEDLSITVHATCENEEEMDNLKHSRVTVAIPLKYEVKLTVHGFVNPTSFVYGSNDENEPETCMVEKMNLTFHVINTGNSMAPNVSVEIMVPNSFSPQTDKLFNILDVQTTTGECHFENYQRVCALEQQKSAMQTLKGIVRFLSKTDKRLLYCIKADPHCLNFLCNFGKMESGKEASVHIQLEGRPSILEMDETSALKFEIRATGFPEPNPRVIELNKDENVAHVLLEGLHHQRPKRYFTIVIISSSLLLGLIVLLLISYVMWKAGFFKRQYKSILQEENRRDSWSYINSKSNDD

SEQ ID NO: 882846 - protein, 165 aa, Homo sapiens
MFPTESAWLGKRGANPAPEAAVRETVMLLLCLGVPTGRPYNVDTESALLYQGPHNTLFGYSVVLHSHGANRWLLVGAPTANWLANASVINPGAIYRCRIGKNPGQTCEQLQLGELGMGPGVSDLPTPHVDPTIGQVLERFTLPVTSGLKSIKFSVSTPSHLASLI

SEQ ID NO: 882847 - protein, 1017 aa, Homo sapiens
MFPTESAWLGKRGANPAPEAAVRETVMLLLCLGVPTGRPYNVDTESALLYQGPHNTLFGYSVVLHSHGANRWLLVGAPTANWLANASVINPGAIYRCRIGKNPGQTCEQLQLGSPNGEPCGKTCLEERDNQWLGVTLSRQPGENGSIVVGIGTGPQIHREISYPGCSFHIIVVYFYFIQTCGHRWKNIFYIKNENKLPTGGCYGVPPDLRTELSKRIAPCYQDYVKKFGENFASCQAGISSFYTKDLIVMGAPGSSYWTGSLFVYNITTNKYKAFLDKQNQVKFGSYLGYSVGAGHFRSQHTTEVVGGAPQHEQIGKAYIFSIDEKELNILHEMKGKKLGSYFGASVCAVDLNADGFSDLLVGAPMQSTIREEGRVFVYINSGSGAVMNAMETNLVGSDKYAARFGESIVNLGDIDNDGFEDVAIGAPQEDDLQGAIYIYNGRADGISSTFSQRIEGLQISKSLSMFGQSISGQIDADNNGYVDVAVGAFRSDSAVLLSFVLYMSLDVNRKAESPPRFYFSSNGTSDVITGSIQVSSREANCRTHQAFMRKDVRDILTPIQIEAAYHLGPHVISKRSTEEFPPLQPILQQKKEKDIMKKTINFARFCAHENCSADLQVSAKIGFLKPHENKTYLAVGSMKTLMLNVSLFNAGDDAYETTLHVKLPVGLYFIKILELEEKQINCEVTDNSGVVQLDCSIGYIYVDHLSRIDISFLLDVSSLSRAEEDLSITVHATCENEEEMDNLKHSRVTVAIPLKYEVKLTVHGFVNPTSFVYGSNDENEPETCMVEKMNLTFHVINTGNSMAPNVSVEIMVPNSFSPQTDKLFNILDVQTTTGECHFENYQRVCALEQQKSAMQTLKGIVRFLSKTDKRLLYCIKADPHCLNFLCNFGKMESGKEASVHIQLEGRPSILEMDETSALKFEIRATGFPEPNPRVIELNKDENVAHVLLEGLHHQRPKRYFTIVIISSSLLLGLIVLLLISYVMWKAGFFKRQYKSILQEENRRDSWSYINSKSNDD

SEQ ID NO: 882848 - protein, 820 aa, Homo sapiens
MGAPGSSYWTGSLFVYNITTNKYKAFLDKQNQVKFGSYLGYSVGAGHFRSQHTTEVVGGAPQHEQIGKAYIFSIDEKELNILHEMKGKKLGSYFGASVCAVDLNADGFSDLLVGAPMQSTIREEGRVFVYINSGSGAVMNAMETNLVGSDKYAARFGESIVNLGDIDNDGFEDVAIGAPQEDDLQGAIYIYNGRADGISSTFSQRIEGLQISKSLSMFGQSISGQIDADNNGYVDVAVGAFRSDSAVLLRTRPVVIVDASLSHPESVNRTKFDCVENGWPSVCIDLTLCFSYKGKEVPGYIVLFYNMSLDVNRKAESPPRFYFSSNGTSDVITGSIQVSSREANCRTHQAFMRKDVRDILTPIQIEAAYHLGPHVISKRSTEEFPPLQPILQQKKEKDIMKKTINFARFCAHENCSADLQVSAKIGFLKPHENKTYLAVGSMKTLMLNVSLFNAGDDAYETTLHVKLPVGLYFIKILELEEKQINCEVTDNSGVVQLDCSIGYIYVDHLSRIDISFLLDVSSLSRAEEDLSITVHATCENEEEMDNLKHSRVTVAIPLKYEVKLTVHGFVNPTSFVYGSNDENEPETCMVEKMNLTFHVINTGNSMAPNVSVEIMVPNSFSPQTDKLFNILDVQTTTGECHFENYQRVCALEQQKSAMQTLKGIVRFLSKTDKRLLYCIKADPHCLNFLCNFGKMESGKEASVHIQLEGRPSILEMDETSALKFEIRATGFPEPNPRVIELNKDENVAHVLLEGLHHQRPKRYFTIVIISSSLLLGLIVLLLISYVMWKAGFFKRQYKSILQEENRRDSWSYINSKSNDD

SEQ ID NO: 882849 - protein, 1069 aa, Homo sapiens
MFPTESAWLGKRGANPAPEAAVRETVMLLLCLGVPTGRPYNVDTESALLYQGPHNTLFGYSVVLHSHGANRWLLVGAPTANWLANASVINPGAIYRCRIGKNPGQTCEQLQLGSPNGEPCGKTCLEERDNQWLGVTLSRQPGENGSIVVGIGTGPQIHREISYPGCSFHIIVVYFYFIQTCGHRWKNIFYIKNENKLPTGGCYGVPPDLRTELSKRIAPCYQDYVKKFGENFASCQAGISSFYTKDLIVMGAPGSSYWTGSLFVYNITTNKYKAFLDKQNQVKFGSYLGYSVGAGHFRSQHTTEVVGGAPQHEQIGKAYIFSIDEKELNILHEMKGKKLGSYFGASVCAVDLNADGFSDLLVGAPMQSTIREEGRVFVYINSGSGAVMNAMETNLVGSDKYAARFGESIVNLGDIDNDGFEDVAIGAPQEDDLQGAIYIYNGRADGISSTFSQRIEGLQISKSLSMFGQSISGQIDADNNGYVDVAVGAFRSDSAVLLRTRPVVIVDASLSHPESVNRTKFDCVENGWPSVCIDLTLCFSYKGKEVPGYIVLFYNMSLDVNRKAESPPRFYFSSNGTSDVITGSIQVSSREANCRTHQAFMRKDVRDILTPIQIEAAYHLGPHVISKRSTEEFPPLQPILQQKKEKDIMKKTINFARFCAHENCSADLQVSAKIGFLKPHENKTYLAVGSMKTLMLNVSLFNAGDDAYETTLHVKLPVGLYFIKILELEEKQINCEVTDNSGVVQLDCSIGYIYVDHLSRIDISFLLDVSSLSRAEEDLSITVHATCENEEEMDNLKHSRVTVAIPLKYEVKLTVHGFVNPTSFVYGSNDENEPETCMVEKMNLTFHVINTGNSMAPNVSVEIMVPNSFSPQTDKLFNILDVQTTTGECHFENYQRVCALEQQKSAMQTLKGIVRFLSKTDKRLLYCIKADPHCLNFLCNFGKMESGKEASVHIQLEGRPSILEMDETSALKFEIRATGFPEPNPRVIELNKDENVAHVLLEGLHHQRPKRYFTIVIISSSLLLGLIVLLLISYVMWKAGFFKRQYKSILQEENRRDSWSYINSKSNDD

SEQ ID NO: 882850 - protein, 820 aa, Homo sapiens; identical to SEQ ID NO: 882848

SEQ ID NO: 882851 - protein, 423 aa, Homo sapiens
MFPTESAWLGKRGANPAPEAAVRETVMLLLCLGVPTGRPYNVDTESALLYQGPHNTLFGYSVVLHSHGANRWLLVGAPTANWLANASVINPGAIYRCRIGKNPGQTCEQLQLGSPNGEPCGKTCLEERDNQWLGVTLSRQPGENGSIVVGIGTGPQIHREISYPGCSFHIIVVYFYFIQTCGHRWKNIFYIKNENKLPTGGCYGVPPDLRTELSKRIAPCYQDYVKKFGENFASCQAGISSFYTKDLIVMGAPGSSYWTGSLFVYNITTNKYKAFLDKQNQVKFGSYLGYSVGAGHFRSQHTTEVVGGAPQHEQIGKAYIFSIDEKELNILHEMKGKKLGSYFGASVCAVDLNADGFSDLLVGAPMQSTIREEGRVFVYINSGSGAVMNAMETNLVGSDKYAARFGESIVNLGDIDNDGFEGN

SEQ ID NO: 882852 - protein, 509 aa, Homo sapiens
MPSGFQQIGSEDGEPPQQRVTGTLVLAVFSAVLGSLQFGYNIGVINAPQKVIEQSYNETWLGRQGPEGPSSIPPGTLTTLWALSVAIFSVGGMISSFLIGIISQWLGRKRAMLVNNVLAVLGGSLMGLANAAASYEMLILGRFLIGAYSGLTSGLVPMYVGEIAPTHLRGALGTLNQLAIVIGILIAQVLGLESLLGTASLWPLLLGLTVLPALLQLVLLPFCPESPRYLYIIQNLEGPARKSLKRLTGWADVSGVLAELKDEKRKLERERPLSLLQLLGSRTHRQPLIIAVVLQLSQQLSGINAVFYYSTSIFETAGVGQPAYATIGAGVVNTVFTLVSVLLVERAGRRTLHLLGLAGMCGCAILMTVALLLLERVPAMSYVSIVAIFGFVAFFEIGPGPIPWFIVAELFSQGPRPAAMAVAGFSNWTSNFIIGMGFQYVAEAMGPYVFLLFAVLLLGFFIFTFLRVPETRGRTFDQISAAFHRTPSLLEQEVKPSTELEYLGPDEND

SEQ ID NO: 882853 - protein, 369 aa, Homo sapiens
MISSFLIGIISQWLGRKRAMLVNNVLAVLGGSLMGLANAAASYEMLILGRFLIGAYSGLTSGLVPMYVGEIAPTHLRGALGTLNQLAIVIGILIAQVLGLESLLGTASLWPLLLGLTVLPALLQLVLLPFCPESPRYLYIIQNLEGPARKSLKRLTGWADVSGVLAELKDEKRKLERERPLSLLQLLGSRTHRQPLIIAVVLQLSQQLSGINAVFYYSTSIFETAGVGQPAYATIGAGVVNTVFTLVSVLLVERAGRRTLHLLGLAGMCGCAILMTVALLLLERVPAMSYVSIVAIFGFVAFFEIGPGPIPWFIVAELFSQGPRPAAMAVAGFSNWTSNFIIGMGFQYVAVGPPAPASHTVGQRWASHS

SEQ ID NO: 882854 - protein, 63 aa, Homo sapiens
MSYVSIVAIFGFVAFFEIGPGPIPWFIVAELFSQGPRPAAMAVAGFSNWTSNFIIGMGFQYVA

SEQ ID NO: 882855 - protein, 461 aa, Homo sapiens
MPSGFQQIGSEDGEPPQQRVTGTLVLAVFSAVLGSLQFGYNIGVINAPQKVIEQSYNETWLGRQGPEGPSSIPPGTLTTLWALSVAIFSVGGMISSFLIGIISQWLGRKRAMLVNNVLAVLGGSLMGLANAAASYEMLILGRFLIGAYSGLTSGLVPMYVGEIAPTHLRGALGTLNQLAIVIGILIAQVLGLESLLGTASLWPLLLGLTVLPALLQLVLLPFCPESPRYLYIIQNLEGPARKSLKRLTGWADVSGVLAELKDEKRKLERERPLSLLQLLGSRTHRQPLIIAVVLQLSQQLSGINAVFYYSTSIFETAGVGQPAYATIGAGVVNTVFTLVSVLLVERAGRRTLHLLGLAGMCGCAILMTVALLLLERVPAMSYVSIVAIFGFVAFFEIGPGPIPWFIVAELFSQGPRPAAMAVAGFSNWTSNFIIGMGFQYVAVGPPAPASHTVGQRWASHS

SEQ ID NO: 882856 - protein, 1069 aa, Homo sapiens
MLVACWPMGECARAADPQARHAAQPGPARAGRATPALGSDGVRVTMESALTARDRVGVQDFVLLENFTSEAAFIENLRRRFRENLIYTYIGPVLVSVNPYRDLQIYSRQHMERYRGVSFYEVPPHLFAVADTVYRALRTERRDQAVMISGESGAGKTEATKRLLQFYAETCPAPERGGAVRDRLLQSNPVLEAFGNAKTLRNDNSSRFGKYMDVQFDFKGAPVGGHILSYLLEKSRVVHQNHGERNFHIFYQLLEGGEEETLRRLGLERNPQSYLYLVKGQCAKVSSINDKSDWKVVRKALTVIDFTEDEVEDLLSIVASVLHLGNIHFAANEESNAQVTTENQLKYLTRLLSVEGSTLREALTHRKIIAKGEELLSPLNLEQAAYARDALAKAVYSRTFTWLVGKINRSLASKDVESPSWRSTTVLGLLDIYGFEVFQHNSFEQFCINYCNEKLQQLFIELTLKSEQEEYEAEGIAWEPVQYFNNKIICDLVEEKFKGIISILDEECLRPGEATDLTFLEKLEDTVKHHPHFLTHKLADQRTRKSLGRGEFRLLHYAGEVTYSVTGFLDKNNDLLFRNLKETMCSSKNPIMSQCFDRSELSDKKRPETVATQFKMSLLQLVEILQSKEPAYVRCIKPNDAKQPGRFDEVLIRHQVKYLGLLENLRVRRAGFAYRRKYEAFLQRYKSLCPETWPTWAGRPQDGVAVLVRHLGYKPEEYKMGRTKIFIRFPKTLFATEDALEVRRQSLATKIQAAWRGFHWRQKFLRVKRSAICIQSWWRGTLGRRKAAKRKWAAQTIRRLIRGFILRHAPRCPENAFFLDHVRTSFLLNLRRQLPRNVLDTSWPTPPPALREASELLRELCIKNMVWKYCRSISPEWKQQLQQKAVASEIFKGKKDNYPQSVPRLFISTRLGTDEISPRVLQALGSEPIQYAVPVVKYDRKGYKPRSRQLLLTPNAVVIVEDAKVKQRIDYANLTGISVSSLSDSLFVLHVQRADNKQKGDVVLQSDHVIETLTKTALSANRVNSININQGSITFAGGPGRMAPLTSHPARSCSSPRPRTGTWLWSPPG

SEQ ID NO: 882857 - protein, 1041 aa, Homo sapiens
MLVACWPMGECARAADPQARHAAQPGPARAGRATPALGSDGVRVTMESALTARDRVGVQDFVLLENFTSEAAFIENLRRRFRENLIYTYIGPVLVSVNPYRDLQIYSRQHMERYRGVSFYEVPPHLFAVADTVYRALRTERRDQAVMISGESGAGKTEATKRLLQFYAETCPAPERGGAVRDRLLQSNPVLEAFGNAKTLRNDNSSRFGKYMDVQFDFKGAPVGGHILSYLLEKSRVVHQNHGERNFHIFYQLLEGGEEETLRRLGLERNPQSYLYLVKGQCAKVSSINDKSDWKVVRKALTVIDFTEDEVEDLLSIVASVLHLGNIHFAANEESNAQVTTENQLKYLTRLLSVEGSTLREALTHRKIIAKGEELLSPLNLEQAAYARDALAKAVYSRTFTWLVGKINRSLASKDVESPSWRSTTVLGLLDIYGFEVFQHNSFEQFCINYCNEKLQQLFIELTLKSEQEEYEAEGIAWEPVQYFNNKIICDLVEEKFKGIISILDEECLRPGEATDLTFLEKLEDTVKHHPHFLTHKLADQRTRKSLGRGEFRLLHYAGEVTYSVTGFLDKNNDLLFRNLKETMCSSKNPIMSQCFDRSELSDKKRPETVATQFKMSLLQLVEILQSKEPAYVRCIKPNDAKQPGRFDEVLIRHQVKYLGLLENLRVRRAGFAYRRKYEAFLQRYKSLCPETWPTWAGRPQDGVAVLVRHLGYKPEEYKMGRTKIFIRFPKTLFATEDALEVRRQSLATKIQAAWRGFHWRQKFLRVKRSAICIQSWWRGTLGRRKAAKRKWAAQTIRRLIRGFILRHAPRCPENAFFLDHVRTSFLLNLRRQLPRNVLDTSWPTPPPALREASELLRELCIKNMVWKYCRSISPEWKQQLQQKAVASEIFKGKKDNYPQSVPRLFISTRLGTDEISPRVLQALGSEPIQYAVPVVKYDRKGYKPRSRQLLLTPNAVVIVEDAKVKQRIDYANLTGISVSSLSDSLFVLHVQRADNKQKGDVVLQSDHVIETLTKTALSANRVNSININQGRILSNPGNTV

SEQ ID NO: 882858 - protein, 770 aa, Homo sapiens
YKISVGPGWTNVQDLLSIVASVLHLGNIHFAANEESNAQVTTENQLKYLTRLLSVEGSTLREALTHRKIIAKGEELLSPLNLEQAAYARDALAKAVYSRTFTWLVGKINRSLASKDVESPSWRSTTVLGLLDIYGFEVFQHNSFEQFCINYCNEKLQQLFIELTLKSEQEEYEAEGIAWEPVQYFNNKIICDLVEEKFKGIISILDEECLRPGEATDLTFLEKLEDTVKHHPHFLTHKLADQRTRKSLGRGEFRLLHYAGEVTYSVTGFLDKNNDLLFRNLKETMCSSKNPIMSQCFDRSELSDKKRPETVATQFKMSLLQLVEILQSKEPAYVRCIKPNDAKQPGRFDEVLIRHQVKYLGLLENLRVRRAGFAYRRKYEAFLQRYKSLCPETWPTWAGRPQDGVAVLVRHLGYKPEEYKMGRTKIFIRFPKTLFATEDALEVRRQSLATKIQAAWRGFHWRQKFLRVKRSAICIQSWWRGTLGRRKAAKRKWAAQTIRRLIRGFILRHAPRCPENAFFLDHVRTSFLLNLRRQLPRNVLDTSWPTPPPALREASELLRELCIKNMVWKYCRSISPEWKQQLQQKAVASEIFKGKKDNYPQSVPRLFISTRLGTDEISPRVLQALGSEPIQYAVPVVKYDRKGYKPRSRQLLLTPNAVVIVEDAKVKQRIDYANLTGISVSSLSDSLFVLHVQRADNKQKGDVVLQSDHVIETLTKTALSANRVNSININQGSITFAGGPGRMAPLTSHPARSCSSPRPRTGTWLWSPPG

SEQ ID NO: 882859 - protein, 643 aa, Homo sapiens
RFSHNCLFAASILHSNYLLYCVSWELASSNAAAQSTKIGSRMRYEAGRASQWEPVQYFNNKIICDLVEEKFKGIISILDEECLRPGEATDLTFLEKLEDTVKHHPHFLTHKLADQRTRKSLGRGEFRLLHYAGEVTYSVTGFLDKNNDLLFRNLKETMCSSKNPIMSQCFDRSELSDKKRPETVATQFKMSLLQLVEILQSKEPAYVRCIKPNDAKQPGRFDEVLIRHQVKYLGLLENLRVRRAGFAYRRKYEAFLQRYKSLCPETWPTWAGRPQDGVAVLVRHLGYKPEEYKMGRTKIFIRFPKTLFATEDALEVRRQSLATKIQAAWRGFHWRQKFLRVKRSAICIQSWWRGTLGRRKAAKRKWAAQTIRRLIRGFILRHAPRCPENAFFLDHVRTSFLLNLRRQLPRNVLDTSWPTPPPALREASELLRELCIKNMVWKYCRSISPEWKQQLQQKAVASEIFKGKKDNYPQSVPRLFISTRLGTDEISPRVLQALGSEPIQYAVPVVKYDRKGYKPRSRQLLLTPNAVVIVEDAKVKQRIDYANLTGISVSSLSDSLFVLHVQRADNKQKGDVVLQSDHVIETLTKTALSANRVNSININQGSITFAGGPGRMAPLTSHPARSCSSPRPRTGTWLWSPPG

SEQ ID NO: 882860 - protein, 1100 aa, Homo sapiens
MLVACWPMGECARAADPQARHAAQPGPARAGRATPALGSDGVRVTMESALTARDRVGVQDFVLLENFTSEAAFIENLRRRFRENLIYTYIGPVLVSVNPYRDLQIYSRQHMERYRGVSFYEVPPHLFAVADTVYRALRTERRDQAVMISGESGAGKTEATKRLLQFYAETCPAPERGGAVRDRLLQSNPVLEAFGNAKTLRNDNSSRFGKYMDVQFDFKGAPVGGHILSYLLEKSRVVHQNHGERNFHIFYQLLEGGEEETLRRLGLERNPQSYLYLVKGQCAKVSSINDKSDWKVVRKALTVIDFTEDEVEDLLSIVASVLHLGNIHFAANEESNAQVTTENQLKYLTRLLSVEGSTLREALTHRKIIAKGEELLSPLNLEQAAYARDALAKAVYSRTFTWLVGKINRSLASKDVESPSWRSTTVLGLLDIYGFEVFQHNSFEQFCINYCNEKLQQLFIELTLKSEQEEYEAEGIAWEPVQYFNNKIICDLVEEKFKGIISILDEECLRPGEATDLTFLEKLEDTVKHHPHFLTHKLADQRTRKSLGRGEFRLLHYAGEVTYSVTGFLDKNNDLLFRNLKETMCSSKNPIMSQCFDRSELSDKKRPETVATQFKMSLLQLVEILQSKEPAYVRCIKPNDAKQPGRFDEVLIRHQVKYLGLLENLRVRRAGFAYRRKYEAFLQRYKSLCPETWPTWAGRPQDGVAVLVRHLGYKPEEYKMGRTKIFIRFPKTLFATEDALEVRRQSLATKIQAAWRGFHWRQKFLRVKRSAICIQSWWRGTLGRRKAAKRKWAAQTIRRLIRGFILRHAPRCPENAFFLDHVRTSFLLNLRRQLPRNVLDTSWPTPPPALREASELLRELCIKNMVWKYCRSISPEWKQQLQQKAVASEIFKGKKDNYPQSVPRLFISTRLGEPLTFQHSDLSSPSWSPIASTDFPPRHLSAGTDEISPRVLQALGSEPIQYAVPVVKYDRKGYKPRSRQLLLTPNAVVIVEDAKVKQRIDYANLTGISVSSLSDSLFVLHVQRADNKQKGDVVLQSDHVIETLTKTALSANRVNSININQGSITFAGGPGRMAPLTSHPARSCSSPRPRTGTWLWSPPG

SEQ ID NO: 882861 - protein, 515 aa, Homo sapiens
TCEPPCVTYMVTGFLDKNNDLLFRNLKETMCSSKNPIMSQCFDRSELSDKKRPETVATQFKMSLLQLVEILQSKEPAYVRCIKPNDAKQPGRFDEVLIRHQVKYLGLLENLRVRRAGFAYRRKYEAFLQRYKSLCPETWPTWAGRPQDGVAVLVRHLGYKPEEYKMGRTKIFIRFPKTLFATEDALEVRRQSLATKIQAAWRGFHWRQKFLRVKRSAICIQSWWRGTLGRRKAAKRKWAAQTIRRLIRGFILRHAPRCPENAFFLDHVRTSFLLNLRRQLPRNVLDTSWPTPPPALREASELLRELCIKNMVWKYCRSISPEWKQQLQQKAVASEIFKGKKDNYPQSVPRLFISTRLGTDEISPRVLQALGSEPIQYAVPVVKYDRKGYKPRSRQLLLTPNAVVIVEDAKVKQRIDYANLTGISVSSLSDSLFVLHVQRADNKQKGDVVLQSDHVIETLTKTALSANRVNSININQGSITFAGGPGRMAPLTSHPARSCSSPRPRTGTWLWSPPG

SEQ ID NO: 882862 - protein, 1102 aa, Homo sapiens
MLVACWPMGECARAADPQARHAAQPGPARAGRATPALGSDGVRVTMESALTARDRVGVQDFVLLENFTSEAAFIENLRRRFRENLIYTYIGPVLVSVNPYRDLQIYSRQHMERYRGVSFYEVPPHLFAVADTVYRALRTERRDQAVMISGESGAGKTEATKRLLQFYAETCPAPERGGAVRDRLLQSNPVLEAFGNAKTLRNDNSSRFGKYMDVQFDFKGAPVGGHILSYLLEKSRVVHQNHGERNFHIFYQLLEGGEEETLRRLGLERNPQSYLYLVKGQCAKVSSINDKSDWKVVRKALTVIDFTEDEVEDLLSIVASVLHLGNIHFAANEESNAQVTTENQLKYLTRLLSVEGSTLREALTHRKIIAKGEELLSPLNLEQAAYARDALAKAVYSRTFTWLVGKINRSLASKDVESPSWRSTTVLGLLDIYGFEVFQHNSFEQFCINYCNEKLQQLFIELTLKSEQEEYEAEGIAWEPVQYFNNKIICDLVEEKFKGIISILDEECLRPGEATDLTFLEKLEDTVKHHPHFLTHKLADQRTRKSLGRGEFRLLHYAGEVTYSVTGFLDKNNDLLFRNLKETMCSSKNPIMSQCFDRSELSDKKRPETVATQFKMSLLQLVEILQSKEPAYVRCIKPNDAKQPGRFDEVLIRHQVKYLGLLENLRVRRAGFAYRRKYEAFLQRYKSLCPETWPTWAGRPQDGVAVLVRHLGYKPEEYKMGRTKIFIRFPKTLFATEDALEVRRQSLATLPFMPLVELHTAPGSQLAPRALANCLSFPTAATKIQAAWRGFHWRQKFLRVKRSAICIQSWWRGTLGRRKAAKRKWAAQTIRRLIRGFILRHAPRCPENAFFLDHVRTSFLLNLRRQLPRNVLDTSWPTPPPALREASELLRELCIKNMVWKYCRSISPEWKQQLQQKAVASEIFKGKKDNYPQSVPRLFISTRLGTDEISPRVLQALGSEPIQYAVPVVKYDRKGYKPRSRQLLLTPNAVVIVEDAKVKQRIDYANLTGISVSSLSDSLFVLHVQRADNKQKGDVVLQSDHVIETLTKTALSANRVNSININQGSITFAGGPGRMAPLTSHPARSCSSPRPRTGTWLWSPPG

SEQ ID NO: 882863 - protein, 388 aa, Homo sapiens
MQRYKSLCPETWPTWAGRPQDGVAVLVRHLGYKPEEYKMGRTKIFIRFPKTLFATEDALEVRRQSLATKIQAAWRGFHWRQKFLRVKRSAICIQSWWRGTLGRRKAAKRKWAAQTIRRLIRGFILRHAPRCPENAFFLDHVRTSFLLNLRRQLPRNVLDTSWPTPPPALREASELLRELCIKNMVWKYCRSISPEWKQQLQQKAVASEIFKGKKDNYPQSVPRLFISTRLGTDEISPRVLQALGSEPIQYAVPVVKYDRKGYKPRSRQLLLTPNAVVIVEDAKVKQRIDYANLTGISVSSLSDSLFVLHVQRADNKQKGDVVLQSDHVIETLTKTALSANRVNSININQGSITFAGGPGRMAPLTSHPARSCSSPRPRTGTWLWSPPG

SEQ ID NO: 882864 - protein, 535 aa, Homo sapiens
MLVACWPMGECARAADPQARHAAQPGPARAGRATPALGSDGVRVTMESALTARDRVGVQDFVLLENFTSEAAFIENLRRRFRENLIYTYIGPVLVSVNPYRDLQIYSRQHMERYRGVSFYEVPPHLFAVADTVYRALRTERRDQAVMISGESGAGKTEATKRLLQFYAETCPAPERGGAVRDRLLQSNPVLEAFGNAKTLRNDNSSRFGKYMDVQFDFKGAPVGGHILSYLLEKSRVVHQNHGERNFHIFYQLLEGGEEETLRRLGLERNPQSYLYLVKGQCAKVSSINDKSDWKVVRKALTVIDFTEDEVEDLLSIVASVLHLGNIHFAANEESNAQVTTENQLKYLTRLLSVEGSTLREALTHRKIIAKGEELLSPLNLEQAAYARDALAKAVYSRTFTWLVGKINRSLASKDVESPSWRSTTVLGLLDIYGFEVFQHNSFEQFCINYCNEKLQQLFIELTLKSEQEEYEAEGIAWEPVQYFNNKIICDLVEEKFKGIISILDEECLRPGEATDLTFLEKLEDTVKHHPHFLT

SEQ ID NO: 882865 - protein, 558 aa, Homo sapiens
MLVACWPMGECARAADPQARHAAQPGPARAGRATPALGSDGVRVTMESALTARDRVGVQDFVLLENFTSEAAFIENLRRRFRENLIYTYIGPVLVSVNPYRDLQIYSRQHMERYRGVSFYEVPPHLFAVADTVYRALRTERRDQAVMISGESGAGKTEATKRLLQFYAETCPAPERGGAVRDRLLQSNPVLEAFGNAKTLRNDNSSRFGKYMDVQFDFKGAPVGGHILSYLLEKSRVVHQNHGERNFHIFYQLLEGGEEETLRRLGLERNPQSYLYLVKGQCAKVSSINDKSDWKVVRKALTVIDFTEDEVEDLLSIVASVLHLGNIHFAANEESNAQVTTENQLKYLTRLLSVEGSTLREALTHRKIIAKGEELLSPLNLEQAAYARDALAKAVYSRTFTWLVGKINRSLASKDVESPSWRSTTVLGLLDIYGFEVFQHNSFEQFCINYCNEKLQQLFIELTLKSEQEEYEAEGIAWEPVQALGGQTACPHTRAPLKDVGPFLAPDPSLAWERGDGAGLGRSGRGITSFCCFSLLLPSRAWGLPSCLYALLGVSAHC

SEQ ID NO: 882866 - protein, 681 aa, Homo sapiens
GRFADGVGERVSRLSATSGGSWAPPGSDVQLLEYEASAAGLIRSFSERFPEDGPELEEILTQLATADARFWKGPSEAPLAKLEEDVWPCPQFHQTKAASGPPFVNEANSKWLDAHYDPMANIHTFSACLALADLHGDGEYKLVVGDLGPGGQQPRLKVLKGPLVMTESPLPALPAAAATFLMEQHEPRTPALALASGPCVYVYKNLRPYFKFSLPQLPPNPLEQDLWNQAKEDRIDPLTLKEMLESIRETAEEPLSIQSLRFLQLELSEMEAFVNQHKSNSIKRQTVITTMTTLKKNLADEDAVSCLVLGTENKELLVLDPEAFTILAKMSLPSVPVFLEVSGQFDVEFRLAAACRNGNIYILRRDSKHPKYCIELSAQPVGLIRVHKVLVVGSTQDSLHGFTHKGKKLWTVQMPAAILTMNLLEQHSRGLQAVMAGLANGEVRIYRDKALLNVIHTPDAVTSLCFGRYGREDNTLIMTTRGGGLIIKILKRTAVFVEGGSEVGPPPAQAMKLNVPRKTRLYVDQTLREREAGTAMHRAFQTDLYLLRLRAARAYLQALESSLSPLSTTAREPLKLHAVVQGLGPTFKLTLHLQNTSTTRPVLGLLVCFLYNEALYSLPRAFFKVPLLVPGLNYPLETFVESLSNKGISDIIKVLVLREGQSAPLLSAHVNMPGSEGLAAA

SEQ ID NO: 882867 - protein, 290 aa, Homo sapiens
SGLAATTPAKMAAASSSDSDACGAESNEANSKWLDAHYDPMANIHTFSACLALADLHGDGEYKLVVGDLGPGGQQPRLKVLKGPLVMTESPLPALPAAAATFLMEQHEPRTPALALASGPCVYVYKNLRPYFKFSLPQLPPNPLEQDLWNQAKEDRIDPLTLKEMLESIRETAEEPLSIQSLRFLQLELSEMEAFVNQHKSNSIKRQTVITTMTTLKKNLADEDAVSCLVLGTENKELLVLDPEAFTILAKDAVTSLCFGRYGREDKTSSGPLEVWLISGPERTAGLKRT

SEQ ID NO: 882868 - protein, 315 aa, Homo sapiens
SGLAATTPAKMAAASSSDSDACGAESNEANSKWLDAHYDPMANIHTFSACLALADLHGDGEYKLVVGDLGPGGQQPRLKVLKGPLVMTESPLPALPAAAATFLMEQHEPRTPALALASGPCVYVYKNLRPYFKFSLPQLPPNPLEQDLWNQAKEGETAEEPLSIQSLRFLQLELSEMEAFVNQHKSNSIKRQTVITTMTTLKKNLADEDAVSCLVLGTENKELLVLDPEAFTILAKMSLPSVPVFLEVSGQFDVEFRLAAACRNGNIYILRRDSKAPKVLHRAERPACGTYPGTPGPKWWGSNPRKAAGFTHKGT

SEQ ID NO: 882869 - protein, 229 aa, Homo sapiens
MTESPLPALPAAAATFLMEQHEPRTPALALASGPCVYVYKNLRPYFKFSLPQLPPNPLEQDLWNQAKEGETAEEPLSIQSLRFLQLELSEMEAFVNQHKSNSIKRQTVITTMTTLKKNLADEDAVSCLVLGTENKELLVLDPEAFTILAKMSLPSVPVFLEVSGQFDVEFRLAAACRNGNIYILRRDSKAPKVLHRAERPACGTYPGTPGPKWWGSNPRKAAGFTHKGT

SEQ ID NO: 882870 - protein, 603 aa, Homo sapiens
SGLAATTPAKMAAASSSDSDACGAESNEANSKWLDAHYDPMANIHTFSACLALADLHGDGEYKLVVGDLGPGGQQPRLKVLKGPLVMTESPLPALPAAAATFLMEQHEPRTPALALASGPCVYVYKNLRPYFKFSLPQLPPNPLEQDLWNQAKEDRIDPLTLKEMLESIRETAEEPLSIQSLRFLQLELSEMEAFVNQHKSNSIKRQTVITTMTTLKKNLADEDAVSCLVLGTENKELLVLDPEAFTILAKMSLPSVPVFLEVSGQFDVEFRLAAACRNGNIYILRRDSKHPKYCIELSAQPVGLIRVHKVLVVGSTQDSLHGFTHKGKKLWTVQMPAAILTMNLLEQHSRGLQAVMAGLANGEVRIYRDKALLNVIHTPDAVTSLCFGRYGREDNTLIMTTRGGGLIIKILKRTAVFVEGGSEVGPPPAQAMKLNVPRKTRLYVDQTLREREAGTAMHRAFQTDLYLLRLRAARAYLQALESSLSPLSTTAREPLKLHAVVQGLGPTFKLTLHLQNTSTTRPVLGLLVCFLYNEALYSLPRAFFKVPLLVPGLNYPLETFVESLSNKGISDIIKVLVLREGQSAPLLSAHVNMPGSEGLAAA

SEQ ID NO: 882871 - protein, 667 aa, Homo sapiens
SGLAATTPAKMAAASSSDSDACGAESNEANSKWLDAHYDPMANIHTFSACLALADLHGDGEYKLVVGDLGPGGQQPRLKVLKGPLVMTESPLPALPAAAATFLMEQHEPRTPALALASGPCVYVYKNLRPYFKFSLPQLPPNPLEQDLWNQAKEDRIDPLTLKEMLESIRETAEEPLSIQSLRFLQLELSEMEAFVNQHKSNSIKRQTVITTMTTLKKNLADEDAVSCLVLGTENKELLVLDPEAFTILAKMSLPSVPVFLEVSGQFDVEFRLAAACRNGNIYILRMIIQATIVKVGGRQDTIVKVGGRQDTIVKVGGRHTVMFSKATHLLRWQKWNNPRVICFGASVPPRDSKHPKYCIELSAQPVGLIRVHKVLVVGSTQDSLHGFTHKGKKLWTVQMPAAILTMNLLEQHSRGLQAVMAGLANGEVRIYRDKALLNVIHTPDAVTSLCFGRYGREDNTLIMTTRGGGLIIKILKRTAVFVEGGSEVGPPPAQAMKLNVPRKTRLYVDQTLREREAGTAMHRAFQTDLYLLRLRAARAYLQALESSLSPLSTTAREPLKLHAVVQGLGPTFKLTLHLQNTSTTRPVLGLLVCFLYNEALYSLPRAFFKVPLLVPGLNYPLETFVESLSNKGISDIIKVLVLREGQSAPLLSAHVNMPGSEGLAAA

SEQ ID NO: 882872 - protein, 517 aa, Homo sapiens [sequence omitted]

SEQ ID NO: 882873 - protein, 639 aa, Homo sapiens
SGLAATTPAKMAAASSSDSDACGAESNEANSKWLDAHYDPMANIHTFSACLALADLHGDGEYKLVVGDLGPGGQQPRLKVLKGPLVMTESPLPALPAAAATFLMEQHEPRTPALALASGPCVYVYKNLRPYFKFSLPQLPPNPLEQDLWNQAKEDRIDPLTLKEMLESILVRGCLPLHTPLTPSSHLSPRAPFFHSAAMLAPFPCRETAEEPLSIQSLRFLQLELSEMEAFVNQHKSNSIKRQTVITTMTTLKKNLADEDAVSCLVLGTENKELLVLDPEAFTILAKMSLPSVPVFLEVSGQFDVEFRLAAACRNGNIYILRRDSKHPKYCIELSAQPVGLIRVHKVLVVGSTQDSLHGFTHKGKKLWTVQMPAAILTMNLLEQHSRGLQAVMAGLANGEVRIYRDKALLNVIHTPDAVTSLCFGRYGREDNTLIMTTRGGGLIIKILKRTAVFVEGGSEVGPPPAQAMKLNVPRKTRLYVDQTLREREAGTAMHRAFQTDLYLLRLRAARAYLQALESSLSPLSTTAREPLKLHAVVQGLGPTFKLTLHLQNTSTTRPVLGLLVCFLYNEALYSLPRAFFKVPLLVPGLNYPLETFVESLSNKGISDIIKVLVLREGQSAPLLSAHVNMPGSEGLAAA

SEQ ID NO: 882874 - protein, 400 aa, Homo sapiens
RPPETWAAVKAPAQSARENWAGLVAPGPLLMQQCAGATARLPSLKHPLPHHPHCWAYSSRLVSTYGGSTPPTAPTQTVCCLFHRDSKHPKYCIELSAQPVGLIRVHKVLVVGSTQDSLHGFTHKGKKLWTVQMPAAILTMNLLEQHSRGLQAVMAGLANGEVRIYRDKALLNVIHTPDAVTSLCFGRYGREDNTLIMTTRGGGLIIKILKRTAVFVEGGSEVGPPPAQAMKLNVPRKTRLYVDQTLREREAGTAMHRAFQTDLYLLRLRAARAYLQALESSLSPLSTTAREPLKLHAVVQGLGPTFKLTLHLQNTSTTRPVLGLLVCFLYNEALYSLPRAFFKVPLLVPGLNYPLETFVESLSNKGISDIIKVLVLREGQSAPLLSAHVNMPGSEGLAAA

SEQ ID NO: 882875 - protein, 603 aa, Homo sapiens; identical to SEQ ID NO: 882870

SEQ ID NO: 882876 - protein, 585 aa, Homo sapiens
SGLAATTPAKMAAASSSDSDACGAESNEANSKWLDAHYDPMANIHTFSACLALADLHGDGEYKLVVGDLGPGGQQPRLKVLKGPLVMTESPLPALPAAAATFLMEQHEPRTPALALASGPCVYVYKNLRPYFKFSLPQLPPNPLEQDLWNQAKEDRIDPLTLKEMLESIRETAEEPLSIQSLRFLQLELSEMEAFVNQHKSNSIKRQTVITTMTTLKKNLADEDAVSCLVLGTENKELLVLDPEAFTILAKMSLPSVPVFLEVSGQFDVEFRLAAACRNGNIYILRRDSKHPKYCIELSAQPVGLIRVHKVLVVGSTQDSLHGFTHKGKKLWTVQMPAAILTMNLLEQHSRGLQAVMAGLANGEVRIYRDKALLNVIHTPDAVTSLCFGRYGREDNTLIMTTRGGGLIIKILKRTAVFVEGGSEVGPPPAQAMKLNVPRKTRLYVDQTLREREAGTAMHRAFQTDLYLLRLRAARAYLQALESSLSPLSTTAREPLKLHAVVQGLGPTFKLTLHLQNTSTTRPVLGLLVCFLYNEALYSLPRAFFKVPLLVPGLNYPLETFVESLSNKGISDIIKVGPALVPRGR

SEQ ID NO: 882877 - protein, 495 aa, Homo sapiens
SGLAATTPAKMAAASSSDSDACGAESNEANSKWLDAHYDPMANIHTFSACLALADLHGDGEYKLVVGDLGPGGQQPRLKVLKGPLVMTESPLPALPAAAATFLMEQHEPRTPALALASGPCVYVYKNLRPYFKFSLPQLPPNPLEQDLWNQAKEDRIDPLTLKEMLESIRETAEEPLSIQSLRFLQLELSEMEAFVNQHKSNSIKRQTVITTMTTLKKNLADEDAVSCLVLGTENKELLVLDPEAFTILAKMSLPSVPVFLEVSGQFDVEFRLAAACRNGNIYILRRDSKHPKYCIELSAQPVGLIRVHKVLVVGSTQDSLHGFTHKGKKLWTVQMPAAILTMNLLEQHSRGLQAVMAGLANGEVRIYRDKALLNVIHTPDAVTSLCFGRYGREDNTLIMTTRGGGLIIKILKRTAVFVEGGSEVGPPPAQAMKLNVPRKTRLYVDQTLREREAGTGEPQTGSFPFFLLHCSYTAKLGECCPASLCTGRRSRPTR

SEQ ID NO: 882878 - protein, 287 aa, Homo sapiens
SGLAATTPAKMAAASSSDSDACGAESNEANSKWLDAHYDPMANIHTFSACLALADLHGDGEYKLVVGDLGPGGQQPRLKVLKGPLVMTESPLPALPAAAATFLMEQHEPRTPALALASGPCVYVYKNLRPYFKFSLPQLPPNPLEQDLWNQAKEDRIDPLTLKEMLESIRETAEEPLSIQSLRFLQLELSEMEAFVNQHKSNSIKRQTVITTMTTLKKNLADEDAVSCLVLGTENKELLVLDPEAFTILAKMSLPSVPVFLEVSGQFDVEFRLAAACRNGNIYILRR

SEQ ID NO: 882879 - protein, 217 aa, Homo sapiens
SGLAATTPAKMAAASSSDSDACGAESNEANSKWLDAHYDPMANIHTFSACLALADLHGDGEYKLVVGDLGPGGQQPRLKVLKGPLVMTESPLPALPAAAATFLMEQHEPRTPALALASGPCVYVYKNLRPYFKFSLPQLPPNPLEQDLWNQAKEDRIDPLTLKEMLESIRETAEEPLSIQSLRFLQLELSEMEAFVNQHKSNSIKRQVIPPSLFISL

SEQ ID NO: 882880 - protein, 262 aa, Homo sapiens
SGLAATTPAKMAAASSSDSDACGAESNEANSKWLDAHYDPMANIHTFSACLALADLHGDGEYKLVVGDLGPGGQQPRLKVLKGPLVMTESPLPALPAAAATFLMEQHEPRTPALALASGPCVYVYKNLRPYFKFSLPQLPPNPLEQDLWNQAKEGETAEEPLSIQSLRFLQLELSEMEAFVNQHKSNSIKRQTVITTMTTLKKNLADEDAVSCLVLGTENKELLVLDPEAFTILAKVSVRSGPGPAGGPGCILSPCSTVSSG

SEQ ID NO: 882881 - protein, 259 aa, Homo sapiens
MGLIPNCLSPTSSNEANSKWLDAHYDPMANIHTFSACLALADLHGDGEYKLVVGDLGPGGQQPRLKVLKGPLVMTESPLPALPAAAATFLMEQHEPRTPALALASGPCVYVYKNLRPYFKFSLPQLPPNPLEQDLWNQAKEGETAEEPLSIQSLRFLQLELSEMEAFVNQHKSNSIKRQTVITTMTTLKKNLADEDAVSCLVLGTENKELLVLDPEAFTILAKMSLPSVPVFLEVSGQFDVEFRLAAACRNGNIYILRR

SEQ ID NO: 882882 - protein, 272 aa, Homo sapiens
MTESPLPALPAAAATFLMEQHEPRTPALALASGPCVYVYKNLRPYFKFSLPQLPPNPLEQDLWNQAKEGETAEEPLSIQSLRKDPVEGQGLGGSRERKQPPECARMMEEGSEAGACRCQFSVVSRFLQLELSEMEAFVNQHKSNSIKRQTVITTMTTLKKNLADEDAVSCLVLGTENKELLVLDPEAFTILAKMSLPSVPVFLEVSGQFDVEFRLAAACRNGNIYILRRDSKAPKVLHRAERPACGTYPGTPGPKWWGSNPRKAAGFTHKGT

SEQ ID NO: 882883 - protein, 900 aa, Homo sapiens
SGQTPGLAPRVAPSRAEPSGAGGASGITRVAVPEQLQSIEGWRGAHTVHGAGGQGGQGAVVMAQFDTEYQRLEASYSDSPPGEEDLLVHVAEGSKSPWHHIENLDLFFSRVYNLHQKNGFTCMLIGEIFELMQFLFVVAFTTFLVSCVDYDILFANKMVNHSLHPTEPVKVTLPDAFLPAQVCSARIQENGSLITILVIAGVFWIHRLIKFIYNICCYWEIHSFYLHALRIPMSALPYCTWQEVQARIVQTQKEHQICIHKRELTELDIYHRILRFQNYMVALVNKSLLPLRFRLPGLGEAVFFTRGLKYNFELILFWGPGSLFLNEWSLKAEYKRGGQRLELAQRLSNRILWIGIANFLLCPLILIWQILYAFFSYAEVLKREPGALGARCWSLYGRCYLRHFNELEHELQSRLNRGYKPASKYMNCFLSPLLTLLAKNGAFFAGSILAVLIALTIYDEDVLAVEHVLTTVTLLGVTVTVCRSFIPDQHMVFCPEQLLRVILAHIHYMPDHWQGNAHRSQTRDEFAQLFQYKAVFILEELLSPIVTPLILIFCLRPRALEIIDFFRNFTVEVVGVGDTCSFAQMDVRQHGHPQWLSAGQTEASVYQQAEDGKTELSLMHFAITNPGWQPPRESTAFLGFLKEQVQRDGAAASLAQGGLLPENALFTSIQSLQSESEPLSLIANVVAGSSCRGPPLPRDLQGSRHRAEVASALRSFSPLQPGQAPTGRAHSTMTGSGVDARTASSGSSVWEGQLQSLVLSEYASTEMSLHALYMHQLHKQQAQAEPERHVWHRRESDESGESAPDEGGEGARAPQSIPRSASYPCAAPRPGAPETTALHGGFQRRYGGITDPGTVPRVPSHFSRLPLGGWAEDGQSASRHPEPVPEEGSEDELPPQVHKV

SEQ ID NO: 882884 - protein, 839 aa, Homo sapiens
MAQFDTEYQRLEASYSDSPPGEEDLLVHVAEGSKSPWHHIENLDLFFSRVYNLHQKNGFTCMLIGEIFELMQFLFVVAFTTFLVSCVDYDILFANKMVNHSLHPTEPVKVTLPDAFLPAQVCSARIQENGSLITILVIAGVFWIHRLIKFIYNICCYWEIHSFYLHALRIPMSALPYCTWQEVQARIVQTQKEHQICIHKRELTELDIYHRILRFQNYMVALVNKSLLPLRFRLPGLGEAVFFTRGLKYNFELILFWGPGSLFLNEWSLKAEYKRGGQRLELAQRLSNRILWIGIANFLLCPLILIWQILYAFFSYAEVLKREPGALGARCWSLYGRCYLRHFNELEHELQSRLNRGYKPASKYMNCFLSPLLTLLAKNGAFFAGSILAVLIALTIYDEDVLAVEHVLTTVTLLGVTVTVCRSFIPDQHMVFCPEQLLRVILAHIHYMPDHWQGNAHRSQTRDEFAQLFQYKAVFILEELLSPIVTPLILIFCLRPRALEIIDFFRNFTVEVVGVGDTCSFAQMDVRQHGHPQWLSAGQTEASVYQQAEDGKTELSLMHFAITNPGWQPPRESTAFLGFLKEQVQRDGAAASLAQGGLLPENALFTSIQSLQSESEPLSLIANVVAGSSCRGPPLPRDLQGSRHRAEVASALRSFSPLQPGQAPTGRAHSTMTGSGVDARTASSGSSVWEGQLQSLVLSEYASTEMSLHALYMHQLHKQQAQAEPERHVWHRRESDESGESAPDEGGEGARAPQSIPRSASYPCAAPRPGAPETTALHGGFQRRYGGITDPGTVPRVPSHFSRLPLGGWAEDGQSASRHPEPVPEEGSEDELPPQVHKV

SEQ ID NO: 882885 - protein, 839 aa, Homo sapiens; identical to SEQ ID NO: 882884

SEQ ID NO: 882886 - protein, 839 aa, Homo sapiens; identical to SEQ ID NO: 882884

SEQ ID NO: 882887 - protein, 883 aa, Homo sapiens
MRAGAKGIRAGALGYSCKVLREFSAGAKGIRDGAGGQGGQGAVVMAQFDTEYQRLEASYSDSPPGEEDLLVHVAEGSKSPWHHIENLDLFFSRVYNLHQKNGFTCMLIGEIFELMQFLFVVAFTTFLVSCVDYDILFANKMVNHSLHPTEPVKVTLPDAFLPAQVCSARIQENGSLITILVIAGVFWIHRLIKFIYNICCYWEIHSFYLHALRIPMSALPYCTWQEVQARIVQTQKEHQICIHKRELTELDIYHRILRFQNYMVALVNKSLLPLRFRLPGLGEAVFFTRGLKYNFELILFWGPGSLFLNEWSLKAEYKRGGQRLELAQRLSNRILWIGIANFLLCPLILIWQILYAFFSYAEVLKREPGALGARCWSLYGRCYLRHFNELEHELQSRLNRGYKPASKYMNCFLSPLLTLLAKNGAFFAGSILAVLIALTIYDEDVLAVEHVLTTVTLLGVTVTVCRSFIPDQHMVFCPEQLLRVILAHIHYMPDHWQGNAHRSQTRDEFAQLFQYKAVFILEELLSPIVTPLILIFCLRPRALEIIDFFRNFTVEVVGVGDTCSFAQMDVRQHGHPQWLSAGQTEASVYQQAEDGKTELSLMHFAITNPGWQPPRESTAFLGFLKEQVQRDGAAASLAQGGLLPENALFTSIQSLQSESEPLSLIANVVAGSSCRGPPLPRDLQGSRHRAEVASALRSFSPLQPGQAPTGRAHSTMTGSGVDARTASSGSSVWEGQLQSLVLSEYASTEMSLHALYMHQLHKQQAQAEPERHVWHRRESDESGESAPDEGGEGARAPQSIPRSASYPCAAPRPGAPETTALHGGFQRRYGGITDPGTVPRVPSHFSRLPLGGWAEDGQSASRHPEPVPEEGSEDELPPQVHKV

SEQ ID NO: 882888 - protein, 427 aa, Homo sapiens
MAIRSTTPRRSFIPDQHMVFCPEQLLRVILAHIHYMPDHWQGNAHRSQTRDEFAQLFQYKAVFILEELLSPIVTPLILIFCLRPRALEIIDFFRNFTVEVVGVGDTCSFAQMDVRQHGHPQWLSAGQTEASVYQQAEDGKTELSLMHFAITNPGWQPPRESTAFLGFLKEQVQRDGAAASLAQGGLLPENALFTSIQSLQSESEPLSLIANVVAGSSCRGPPLPRDLQGSRHRAEVASALRSFSPLQPGQAPTGRAHSTMTGSGVDARTASSGSSVWEGQLQSLVLSEYASTEMSLHALYMHQLHKQQAQAEPERHVWHRRESDESGESAPDEGGEGARAPQSIPRSASYPCAAPRPGAPETTALHGGFQRRYGGITDPGTVPRVPSHFSRLPLGGWAEDGQSASRHPEPVPEEGSEDELPPQVHKV

SEQ ID NO: 882889 - protein, 419 aa, Homo sapiens
PSQAGGNRTMVFCPEQLLRVILAHIHYMPDHWQGNAHRSQTRDEFAQLFQYKAVFILEELLSPIVTPLILIFCLRPRALEIIDFFRNFTVEVVGVGDTCSFAQMDVRQHGHPQWLSAGQTEASVYQQAEDGKTELSLMHFAITNPGWQPPRESTAFLGFLKEQVQRDGAAASLAQGGLLPENALFTSIQSLQSESEPLSLIANVVAGSSCRGPPLPRDLQGSRHRAEVASALRSFSPLQPGQAPTGRAHSTMTGSGVDARTASSGSSVWEGQLQSLVLSEYASTEMSLHALYMHQLHKQQAQAEPERHVWHRRESDESGESAPDEGGEGARAPQSIPRSASYPCAAPRPGAPETTALHGGFQRRYGGITDPGTVPRVPSHFSRLPLGGWAEDGQSASRHPEPVPEEGSEDELPPQVHKV

SEQ ID NO: 882890 - protein, 900 aa, Homo sapiens; identical to SEQ ID NO: 882883

SEQ ID NO: 882891 - protein, 828 aa, Homo sapiens
SGQTPGLAPRVAPSRAEPSGAGGASGITRVAVPEQLQSIEGWRGAHTVHGAGGQGGQGAVVMAQFDTEYQRLEASYSDSPPGEEDLLVHVAEGSKSPWHHIENLDLFFSRVYNLHQKNGFTCMLIGEIFELMQFLFVVAFTTFLVSCVDYDILFANKMVNHSLHPTEPVKVTLPDAFLPAQVCSARIQENGSLITILVIAGVFWIHRLIKFIYNICCYWEIHSFYLHALRIPMSALPYCTWQEVQARIVQTQKEHQICIHKRELTELDIYHRILRFQNYMVALVNKSLLPLRFRLPGLGEAVFFTRGLKYNFELILFWGPGSLFLNEWSLKAEYKRGGQRLELAQRLSNRILWIGIANFLLCPLILIWQILYAFFSYAEVLKREPGALGARCWSLYGRCYLRHFNELEHELQSRLNRGYKPASKYMNCFLSPLLTLLAKNGAFFAGSILAVLIALTIYDEDVLAVEHVLTTVTLLGVTVTVCRSFIPDQHMVFCPEQLLRVILAHIHYMPDHWQGNAHRSQTRDEFAQLFQYKAVFILEELLSPIVTPLILIFCLRPRALEIIDFFRNFTVEVVGVGDTCSFAQMDVRQHGHPQWLSAGQTEASVYQQAEDGKTELSLMHFAITNPGWQPPRESTAFLGFLKEQVQRDGAAASLAQGGLLPENAGVDARTASSGSSVWEGQLQSLVLSEYASTEMSLHALYMHQLHKQQAQAEPERHVWHRRESDESGESAPDEGGEGARAPQSIPRSASYPCAAPRPGAPETTALHGGFQRRYGGITDPGTVPRVPSHFSRLPLGGWAEDGQSASRHPEPVPEEGSEDELPPQVHKV

SEQ ID NO: 882892 - protein, 190 aa, Homo sapiens
EGTAALSSLCGSQRSSQLLSVSVGRDRVDARTASSGSSVWEGQLQSLVLSEYASTEMSLHALYMHQLHKQQAQAEPERHVWHRRESDESGESAPDEGGEGARAPQSIPRSASYPCAAPRPGAPETTALHGGFQRRYGGITDPGTVPRVPSHFSRLPLGGWAEDGQSASRHPEPVPEEGSEDELPPQVHKV

SEQ ID NO: 882893 - protein, 115 aa, Homo sapiens
MYGTAGRVMRVEKAPLMKGERAPGPPSLSLALLAIPVQHPGLELLRPPPCMGASRGATVASQILAQCPGFPLISLGCLLEGGQKMGSRHQGTLSPCPKRARRMSYPLRCTRYRQG

SEQ ID NO: 882894 - protein, 900 aa, Homo sapiens; identical to SEQ ID NO: 882883

SEQ ID NO: 882895 - protein, 900 aa, Homo sapiens; identical to SEQ ID NO: 882883

SEQ ID NO: 882896 - protein, 531 aa, Homo sapiens
SGQTPGLAPRVAPSRAEPSGAGGASGITRVAVPEQLQSIEGWRGAHTVHGAGGQGGQGAVVMAQFDTEYQRLEASYSDSPPGEEDLLVHVAEGSKSPWHHIENLDLFFSRVYNLHQKNGFTCMLIGEIFELMQFLFVVAFTTFLVSCVDYDILFANKMVNHSLHPTEPVKVTLPDAFLPAQVCSARIQENGSLITILVIAGVFWIHRLIKFIYNICCYWEIHSFYLHALRIPMSALPYCTWQEVQARIVQTQKEHQICIHKRELTELDIYHRILRFQNYMVALVNKSLLPLRFRLPGLGEAVFFTRGLKYNFELILFWGPGSLFLNEWSLKAEYKRGGQRLELAQRLSNRILWIGIANFLLCPLILIWQILYAFFSYAEVLKREPGALGARCWSLYGRCYLRHFNELEHELQSRLNRGYKPASKYMNCFLSPLLTLLAKNGAFFAGSILAVLIALTIYDEDVLAVEHVLTTVTLLGVTVTVCRSFIPDQHMVFCPEQLLRVILAHIHYMPDHWQGNPSLRLSSPYNLSLSP

SEQ ID NO: 882897 - protein, 625 aa, Homo sapiens
SGQTPGLAPRVAPSRAEPSGAGGASGITRVAVPEQLQSIEGWRGAHTVHGAGGQGGQGAVVMAQFDTEYQRLEASYSDSPPGEEDLLVHVAEGSKSPWHHIENLDLFFSRVYNLHQKNGFTCMLIGEIFELMQFLFVVAFTTFLVSCVDYDILFANKMVNHSLHPTEPVKVTLPDAFLPAQVCSARIQENGSLITILVIAGVFWIHRLIKFIYNICCYWEIHSFYLHALRIPMSALPYCTWQEVQARIVQTQKEHQICIHKRELTELDIYHRILRFQNYMVALVNKSLLPLRFRLPGLGEAVFFTRGLKYNFELILFWGPGSLFLNEWSLKAEYKRGGQRLELAQRLSNRILWIGIANFLLCPLILIWQILYAFFSYAEVLKREPGALGARCWSLYGRCYLRHFNELEHELQSRLNRGYKPASKYMNCFLSPLLTLLAKNGAFFAGSILAVLIALTIYDEDVLAVEHVLTTVTLLGVTVTVCRSFIPDQHMVFCPEQLLRVILAHIHYMPDHWQGNAHRSQTRDEFAQLFQYKAVFILEELLSPIVTPLILIFCLRPRALEIIDFFRNFTVEVVGVGDTCSFAQMDVRQHGHPQVLGEEGARWPGMMLEHTVSLGKPQKDTSPES

SEQ ID NO: 882898 - protein, 551 aa, Homo sapiens
SGQTPGLAPRVAPSRAEPSGAGGASGITRVAVPEQLQSIEGWRGAHTVHGAGGQGGQGAVVMAQFDTEYQRLEASYSDSPPGEEDLLVHVAEGSKSPWHHIENLDLFFSRVYNLHQKNGFTCMLIGEIFELMQFLFVVAFTTFLVSCVDYDILFANKMVNHSLHPTEPVKVTLPDAFLPAQVCSARIQENGSLITILVIAGVFWIHRLIKFIYNICCYWEIHSFYLHALRIPMSALPYCTWQEVQARIVQTQKEHQICIHKRELTELDIYHRILRFQNYMVALVNKSLLPLRFRLPGLGEAVFFTRGLKYNFELILFWGPGSLFLNEWSLKAEYKRGGQRLELAQRLSNRILWIGIANFLLCPLILIWQILYAFFSYAEVLKREPGALGARCWSLYGRCYLRHFNELEHELQSRLNRGYKPASKYMNCFLSPLLTLLAKNGAFFAGSILAVLIALTIYDEDVLAVEHVLTTVTLLGVTVTVCRSFIPDQHMVFCPEQLLRVILAHIHYMPDHWQGNAHRSQTRDEFAQLFQYKAVFILEELLSPIVTPLIP

SEQ ID NO: 882899 - protein, 263 aa, Homo sapiens
QNYMVALVNKSLLPLRFRLPGLGEAVFFTRGLKYNFELILFWGPGSLFLNEWSLKAEYKRGGQRLELAQRLSNRILWIGIANFLLCPLILIWQILYAFFSYAEVLKREPGALGARCWSLYGRCYLRHFNELEHELQSRLNRGYKPASKYMNCFLSPLLTLLAKNGAFFAGSILAVLIALTIYDEDVLAVEHVLTTVTLLGVTVTVCRWARPQAGASRLAFLGKAYIYHDPDPTRSFIPDQHMVFCPEQLLRVILAHIHYMPDH

SEQ ID NO: 882900 - protein, 239 aa, Homo sapiens
MPKSKRDKKVSLTKTAKKGLELKQNLIEELRKCVDTYKYLFIFSVANMRNSKLKDIRNAWKHSRMFFGKNKVMMVALGRSPSDEYKDNLHQVSKRLRGEVGLLFTNRTKEEVNEWFTKYTEMDYARAGNKAAFTVSLDPGPLEQFPHSMEPQLRQLGLPTALKRGVVTLLSDYEVCKEGDVLTPEQARVLKLFGYEMAEFKVTIKYMWDSQSGRFQQMGDDLPESASESTEESDSEDDD

SEQ ID NO: 882901 - protein, 239 aa, Homo sapiens; identical to SEQ ID NO: 882900

SEQ ID NO: 882902 - protein, 239 aa, Homo sapiens; identical to SEQ ID NO: 882900

SEQ ID NO: 882903 - protein, 241 aa, Homo sapiens
MRVSKSKRDKKVSLTKTAKKGLELKQNLIEELRKCVDTYKYLFIFSVANMRNSKLKDIRNAWKHSRMFFGKNKVMMVALGRSPSDEYKDNLHQVSKRLRGEVGLLFTNRTKEEVNEWFTKYTEMDYARAGNKAAFTVSLDPGPLEQFPHSMEPQLRQLGLPTALKRGVVTLLSDYEVCKEGDVLTPEQARVLKLFGYEMAEFKVTIKYMWDSQSGRFQQMGDDLPESASESTEESDSEDDD

SEQ ID NO: 882904 - protein, 267 aa, Homo sapiens
ASAGPQSWDSARGPRSDGTLGIQGLPRHTGSCPTGAGESAGGGLAGRGRLQCTLGQAHARGSPRGPSQSPPRRRGPNGVHRLPPHVDSARCPNPSATRKVMMVALGRSPSDEYKDNLHQVSKRLRGEVGLLFTNRTKEEVNEWFTKYTEMDYARAGNKAAFTVSLDPGPLEQFPHSMEPQLRQLGLPTALKRGVVTLLSDYEVCKEGDVLTPEQARVLKLFGYEMAEFKVTIKYMWDSQSGRFQQMGDDLPESASESTEESDSEDDD

SEQ ID NO: 882905 - protein, 168 aa, Homo sapiens
PPLASHHTAAVIRLGTAWVWVSKRLRGEVGLLFTNRTKEEVNEWFTKYTEMDYARAGNKAAFTVSLDPGPLEQFPHSMEPQLRQLGLPTALKRGVVTLLSDYEVCKEGDVLTPEQARVLKLFGYEMAEFKVTIKYMWDSQSGRFQQMGDDLPESASESTEESDSEDDD

SEQ ID NO: 882906 - protein, 267 aa, Homo sapiens; identical to SEQ ID NO: 882904

SEQ ID NO: 882907 - protein, 134 aa, Homo sapiens
MNTKTTCTRWFTKYTEMDYARAGNKAAFTVSLDPGPLEQFPHSMEPQLRQLGLPTALKRGVVTLLSDYEVCKEGDVLTPEQARVLKLFGYEMAEFKVTIKYMWDSQSGRFQQMGDDLPESASESTEESDSEDDD

SEQ ID NO: 882908 - protein, 144 aa, Homo sapiens [sequence omitted]

SEQ ID NO: 882909 - protein, 114 aa, Homo sapiens
VLGVAQLDSVIIASPPIEDGVNLSLEHLQPYWEELENLVQSKKIVAIGTSDLDKGKHGVSLCLLQKLFGYEMAEFKVTIKYMWDSQSGRFQQMGDDLPESASESTEESDSEDDD

SEQ ID NO: 882910 - protein, 102 aa, Homo sapiens
MRVSKSKRDKKVSLTKTAKKGLELKQNLIEELRKCVDTYKYLFIFSVANMRNSKLKDIRNAWKHSRMFFGKNKVMMVALGRSPSDEYKDNLHQKSLALTGWS

SEQ ID NO: 882911 - protein, 227 aa, Homo sapiens
GPRSDGTLGIQGLPRHTGSCPTGAGESAGGGLAGRGRLQCTLGQAHARGSPRGPSQSPPRRRGPNGVHRLPPHVDSARCPNPSATRKRWAKGESGPWGELRGLATQPAVRASGRRGRRLERQDILEVFRCLAASWNGGFGAVKPPEVADARSGLGSGDSFCLVSGALARQLGREAAPEHRPRLCLLPFRPTFPNFGPFSSSCAPATLAAFPFFQHRFVPVSGVVCLR

SEQ ID NO: 882912 - protein, 200 aa, Homo sapiens
MERLSAAPVKGQTGPERPSPFSQLVYTNNDSYVIHHGDLRKIHKAASRGQAWKLERMMKKTTMDLNIRDAKKRTALYWACANGHAEVVTLLVDRKCQLDVLDGENRTILMKALQCQREACANILIDSGADPNIVDVYGNTAVHYAVNSENLSVVAKLLSCGTDIKVKNKAGHTPLLLAIRKRSEQIVEFLLTKKCKCKWS

SEQ ID NO: 882913 - protein, 68 aa, Homo sapiens
LLVDLISKCLHLKASIHQQLLEYKQKISKNSQNSNPEGTSEGTPDEAAPLAERTPDTAESLVERTPDE

SEQ ID NO: 882914 - protein, 180 aa, Homo sapiens
MERLSAAPVKGQTGPERPSPFSQLVYTNNDSYVIHHGDLRKIHKAASRGQAWKLERMMKKTTMDLNIRDAKKRTALYWACANGHAEVVTLLVDRKCQLDVLDGENRTILMKALQCQREACANILIDSGADPNIVDVYGNTAVHYAVNSENLSVVAKLLSCGTDIKVKNKVDINQCYFQNI

SEQ ID NO: 882915 - protein, 117 aa, Homo sapiens
AGVTVLLSCLKVLLRCLTVLLSCLTVLRSHFLPGEVGVSKSLARLRFLVLSGRMQGLKKGEGERRGLGKGEQREARALSSRWLQPWRGSLPPLSRARRAQSARAPSVSWSTPTTTLT

SEQ ID NO: 882916 - protein, 135 aa, Homo sapiens
MLARLYQKYKISWAWWRAPERETPSPKKKKKVKRSKLSKRTLRWTSGQACLRAAHLSHPQNRPPAAYPTLQYPLPRSLRSGRLQEAPESSRGLQSRARAPGSQGIRNLPIPREGPARLGRSLPAARPATTLRRGR

SEQ ID NO: 882917 - protein, 390 aa, Homo sapiens
MAAQKDLWDAIVIGAGIQGCFTAYHLAKHRKRILLLEQFFLPHSRGSSHGQSRIIRKAYLEDFYTRMMHECYQIWAQLEHEAGTQLHRQTGLLLLGMKENQELKTIQANLSRQRVEHQCLSSEELKQRFPNIRLPRGEVGLLDNSGGVIYAYKALRALQDAIRQLGGIVRDGEKVVEINPGLLVTVKTTSRSYQAKSLVITAGPWTNQLLRPLGIEMPLQTLRINVCYWREMVPGSYGVSQAFPCFLWLGLCPHHIYGLPTGEYPGLMKVSYHHGNHADPEERDCPTARTDIGDVQILSSFVRDHLPDLKPEPAVIESCMYTNTPDEQFILDRHPKYDNIVIGAGFSGHGFKLAPVVGKILYELSMKLTPSYDLAPFRISRFPSLGKAHL

SEQ ID NO: 882918 - protein, 390 aa, Homo sapiens; identical to SEQ ID NO: 882917

SEQ ID NO: 882919 - protein, 436 aa, Homo sapiens
MAAQKDLWDAIVIGAGIQGCFTAYHLAKHRKRILLLEQFFLPHSRGSSHGQSRIIRKAYLEDFYTRMMHECYQIWAQLEHEAGTQLHRQTGLLLLGMKENQELKTIQANLSRQRVEHQCLSSEELKQRFPNIRLPRGEVGLLDNSGGVIYAYKALRALQDAIRQLGGIVRDGEKVVEINPGLLVTVKTTSRSYQAKSLVITAGPWTNQLLRPLGIEMPLQTLRINVCYWREMVPGSYGVSQAFPCFLWLGLCPHHIYGLPTGEYPGLMKVSYHHGNHADPEERDCPTARTDIGDVQILSSFVRDHLPDLKPEPAVIESCMYTNTPDEQFILDRHPKYDNIVIGAGFSGHGFKLAPVVGKILYELSMKLTPSYDFCVYCQQFCMVYFHIADFFPMLFEQKRSPEMFLRISQLPGLPGRRKQSQHQSSRRENEEGTIS

SEQ ID NO: 882920 - protein, 249 aa, Homo sapiens
MAAQKDLWDAIVIGAGIQGCFTAYHLAKHRKRILLLEQFFLPHSRGSSHGQSRIIRKAYLEDFYTRMMHECYQIWAQLEHEAGTQLHRQTGLLLLGMKENQELKTIQANLSRQRVEHQCLSSEELKQRFPNIRLPRGEVGLLDNSGGVIYAYKALRALQDAIRQLGGIVRDGEKVVEINPGLLVTVLGPTSSSVPWALRCLSRPCGSTCVTGERWFLGAMVCPRPFRASCGWACVPTTSTDCPQESTQG

SEQ ID NO: 882921 - protein, 323 aa, Homo sapiens [sequence omitted]

SEQ ID NO: 882922 - protein, 294 aa, Homo sapiens
MKENQELKTIQANLSRQRVEHQCLSSEELKQRFPNIRLPRGEVGLLDNSGGVIYAYKALRALQDAIRQLGGIVRDGEKVVEINPGLLVTVKTTSRSYQAKSLVITAGPWTNQLLRPLGIEMPLQTLRINVCYWREMVPGSYGVSQAFPCFLWLGLCPHHIYGLPTGEYPGLMKVSYHHGNHADPEERDCPTARTDIGDVQILSSFVRDHLPDLKPEPAVIESCMYTNTPDEQFILDRHPKYDNIVIGAGFSGHGFKLAPVVGKILYELSMKLTPSYDLAPFRISRFPSLGKAHL

SEQ ID NO: 882923 - protein, 174 aa, Homo sapiens
MPLQTLRINVCYWREMVPGSYGVSQAFPCFLWLGLCPHHIYGLPTGEYPGLMKVSYHHGNHADPEERDCPTARTDIGDVQILSSFVRDHLPDLKPEPAVIESCMYTNTPDEQFILDRHPKYDNIVIGAGFSGHGFKLAPVVGKILYELSMKLTPSYDLAPFRISRFPSLGKAHL

SEQ ID NO: 882924 - protein, 323 aa, Homo sapiens [sequence omitted]

SEQ ID NO: 882925 - protein, 443 aa, Homo sapiens
VGTVVPCACDALYGPSCAAVLTWRHYGTGGPEYLRWGEARVSSSSDDQGEGCTSLIGFFTPAGAEGSGVEVEEKPVGSSIKDSRCWPSNSLFFLPHSRGSSHGQSRIIRKAYLEDFYTRMMHECYQIWAQLEHEAGTQLHRQTGLLLLGMKENQELKTIQANLSRQRVEHQCLSSEELKQRFPNIRLPRGEVGLLDNSGGVIYAYKALRALQDAIRQLGGIVRDGEKVVEINPGLLVTVKTTSRSYQAKSLVITAGPWTNQLLRPLGIEMPLQTLRINVCYWREMVPGSYGVSQAFPCFLWLGLCPHHIYGLPTGEYPGLMKVSYHHGNHADPEERDCPTARTDIGDVQILSSFVRDHLPDLKPEPAVIESCMYTNTPDEQFILDRHPKYDNIVIGAGFSGHGFKLAPVVGKILYELSMKLTPSYDLAPFRISRFPSLGKAHL

SEQ ID NO: 882926 - protein, 323 aa, Homo sapiens [sequence omitted]

SEQ ID NO: 882927 - protein, 321 aa, Homo sapiens
GTISCSTGTLQRRNLGPERQTGLLLLGMKENQELKTIQANLSRQRVEHQCLSSEELKQRFPNIRLPRGEVGLLDNSGGVIYAYKALRALQDAIRQLGGIVRDGEKVVEINPGLLVTVKTTSRSYQAKSLVITAGPWTNQLLRPLGIEMPLQTLRINVCYWREMVPGSYGVSQAFPCFLWLGLCPHHIYGLPTGEYPGLMKVSYHHGNHADPEERDCPTARTDIGDVQILSSFVRDHLPDLKPEPAVIESCMYTNTPDEQFILDRHPKYDNIVIGAGFSGHGFKLAPVVGKILYELSMKLTPSYDLAPFRISRFPSLGKAHL

SEQ ID NO: 882928 - protein, 1143 aa, Homo sapiens
MEKRETFVQAVSKELVGEFLQFVQLDKEASDPFSLNELLDELSRKQKEELWQRLKNLLTDVLLESPVDGWQVVEAQGEDNMETEHGSKMRKSIEIIYAITSVILASVSVINESENYEALLECVIILNGILYALPESERKLQSSIQDLCVTWWEKGLPAKEDTGKTAFVMLLRRSLETKTGADVCRLWRIHQALYCFDYDLEESGEIKDMLLECFININYIKKEEGRRFLSCLFNWNINFIKMIHGTIKNQLQGLQKSLMVYIAEIYFRAWKKASGKILEAIENDCIQDFMFHGIHLPRRSPVHSKVREVLSYFHHQKKVRQGVEEMLYRLYKPILWRGLKARNSEVRSNAALLFVEAFPIRDPNLHAIEMDSEIQKQFEELYSLLEDPYPMVRSTGILGVCKITSKYWEMMPPTILIDLLKKVTGELAFDTSSADVRCSVFKCLPMILDNKLSHPLLEQLLPALRYSLHDNSEKVRVAFVDMLLKIKAVRAAKFWKICPMEHILVRLETDSRPVSRRLVSLIFNSFLPVNQPEEVWCERCVTLVQMNHAAARRFYQYAHEHTACTNIAKLIHVIRHCLNACIQRAVREPPEDEEEEDGREKENVTVLDKTLSVNDVACMAGLLEIIVILWKSIDRSMENNKEAKLYTINKFASVLPEYLKVFKDDRCKIPLFMLMSFMPASAVPPFSCGVISTLRSREEGAVDKSYCTLLDCLCSWGQVGHILELVDNWLPTEHAQAKSNTASKGRVQIHDTRPVKPELALVYIEYLLTHPKNRECLLSAPRKKLNHLLKALETSKADLESLLQTPGGKPRGFSEAAAPRAFGLHCRLSIHLQHKFCSEGKVYLSMLEDTGFWLESKILSFIQDQEEDYLKLHRVIYQQIIQTYLTVCKDVVMVGLGDHQFQMQLLQRSLGIMQTVKGFFYVSLLLDILKEITGSSLIQKTDSDEEVAMLLDTVQKVFQKMLECIARSFRKQPEEGLRLLYSVQRPLHEFITAVQSRHTDTPVHRGVLSTLIAGPVVEISHQLRKVSDVEELTPPEHLSDLPPFSRCLIGIIIKSSNVVRSFLDELKACVASNDIEGIVCLTAAVHIILVINAGKHKSSKVREVAATVHRKLKTFMEITLEEDSIERFLYESSSRTLGELLNS

SEQ ID NO: 882929 - protein, 1143 aa, Homo sapiens; identical to SEQ ID NO: 882928

SEQ ID NO: 882930 - protein, 1063 aa, Homo sapiens
METEHGSKMRKSIEIIYAITSVILASVSVINESENYEALLECVIILNGILYALPESERKLQSSIQDLCVTWWEKGLPAKEDTGKTAFVMLLRRSLETKTGADVCRLWRIHQALYCFDYDLEESGEIKDMLLECFININYIKKEEGRRFLSCLFNWNINFIKMIHGTIKNQLQGLQKSLMVYIAEIYFRAWKKASGKILEAIENDCIQDFMFHGIHLPRRSPVHSKVREVLSYFHHQKKVRQGVEEMLYRLYKPILWRGLKARNSEVRSNAALLFVEAFPIRDPNLHAIEMDSEIQKQFEELYSLLEDPYPMVRSTGILGVCKITSKYWEMMPPTILIDLLKKVTGELAFDTSSADVRCSVFKCLPMILDNKLSHPLLEQLLPALRYSLHDNSEKVRVAFVDMLLKIKAVRAAKFWKICPMEHILVRLETDSRPVSRRLVSLIFNSFLPVNQPEEVWCERCVTLVQMNHAAARRFYQYAHEHTACTNIAKLIHVIRHCLNACIQRAVREPPEDEEEEDGREKENVTVLDKTLSVNDVACMAGLLEIIVILWKSIDRSMENNKEAKLYTINKFASVLPEYLKVFKDDRCKIPLFMLMSFMPASAVPPFSCGVISTLRSREEGAVDKSYCTLLDCLCSWGQVGHILELVDNWLPTEHAQAKSNTASKGRVQIHDTRPVKPELALVYIEYLLTHPKNRECLLSAPRKKLNHLLKALETSKADLESLLQTPGGKPRGFSEAAAPRAFGLHCRLSIHLQHKFCSEGKVYLSMLEDTGFWLESKILSFIQDQEEDYLKLHRVIYQQIIQTYLTVCKDVVMVGLGDHQFQMQLLQRSLGIMQTVKGFFYVSLLLDILKEITGSSLIQKTDSDEEVAMLLDTVQKVFQKMLECIARSFRKQPEEGLRLLYSVQRPLHEFITAVQSRHTDTPVHRGVLSTLIAGPVVEISHQLRKVSDVEELTPPEHLSDLPPFSRCLIGIIIKSSNVVRSFLDELKACVASNDIEGIVCLTAAVHIILVINAGKHKSSKVREVAATVHRKLKTFMEITLEEDSIERFLYESSSRTLGELLNS

SEQ ID NO: 882931 - protein, 1096 aa, Homo sapiens
MEKRETFVQAVSKELVGEFLQFVQLDKEASDPFSLNELLDELSRKQKEELWQRLKNLLTDVLLESPVDGWQVVEAQGEDNMETEHGSKMRKSIEIIYAITSVILASVSVINESENYEALLECVIILNGILYALPESERKLQSSIQDLCVTWWEKGLPAKEDTGKTAFVMLLRRSLETKTGADVCRLWRIHQALYCFDYDLEESGEIKDMLLECFININYIKKEEGRRFLSCLFNWNINFIKMIHGTIKNQLQGLQKSLMVYIAEIYFRAWKKASGKILEAIENDCIQDFMFHGIHLPRRSPVHSKVREVLSYFHHQKKVRQGVEEMLYRLYKPILWRGLKARNSEVRSNAALLFVEAFPIRDPNLHAIEMDSEIQKQFEELYSLLEDPYPMVRSTGILGVCKITSKYWEMMPPTILIDLLKKVTGELAFDTSSADVRCSVFKCLPMILDNKLSHPLLEQLLPALRYSLHDNSEKVRVAFVDMLLKIKAVRAAKFWKICPMEHILVRLETDSRPVSRRLVSLIFNSFLPVNQPEEVWCERCVTLVQMNHAAARRFYQYAHEHTACTNIAKLIHVIRHCLNACIQRAVREPPEDEEEEDGREKENVTVLDKTLSVNDVACMAGLLEIIVILWKSIDRSMENNKEAKLYTINKFASVLPEYLKVFKDDRCKIPLFMLMSFMPASAVPPFSCGVISTLRSREEGAVDKSYCTLLDCLCSWGQVGHILELVDNWLPTEHAQAKSNTASKGRVQIHDTRPVKPELALVYIEYLLTHPKNRECLLSAPRKKLNHLLKALETSKADLESLLQTPGGKPRGFSEAAAPRAFGLHCRLSIHLQHKFCSEGKVYLSMLEDTGFWLESKILSFIQDQEEDYLKLHRVIYQQIIQTYLTVCKDVVMVGLGDHQFQMQLLQRSLGIMQTVKGFFYVSLLLDILKEITGSSLIQKTDSDEEVAMLLDTVQKVFQKMLECIARSFRKQPEEGLRVSDVEELTPPEHLSDLPPFSRCLIGIIIKSSNVVRSFLDELKACVASNDIEGIVCLTAAVHIILVINAGKHKSSKVREVAATVHRKLKTFMEITLEEDSIERFLYESSSRTLGELLNS

SEQ ID NO: 882932 - protein, 1085 aa, Homo sapiens
MEKRETFVQAVSKELVGEFLQFVQLDKEASDPFSLNELLDELSRKQKEELWQRLKNLLTDVLLESPVDGWQVVEAQGEDNMETEHGSKMRKSIEIIYAITSVILASVSVINESENYEALLECVIILNGILYALPESERKLQSSIQDLCVTWWEKGLPAKEDTGKTAFVMLLRRSLETKTGADVCRLWRIHQALYCFDYDLEESGEIKDMLLECFININYIKKEEGRRFLSCLFNWNINFIKMIHGTIKNQLQGLQKSLMVYIAEIYFRAWKKASGKILEAIENDCIQDFMFHGIHLPRRSPVHSKVREVLSYFHHQKKVRQGVEEMLYRLYKPILWRGLKARNSEVRSNAALLFVEAFPIRDPNLHAIEMDSEIQKQFEELYSLLEDPYPMVRSTGILGVCKITSKYWEMMPPTILIDLLKKVTGELAFDTSSADVRCSVFKCLPMILDNKLSHPLLEQLLPALRYSLHDNSEKVRVAFVDMLLKIKAVRAAKFWKICPMEHILVRLETDSRPVSRRLVSLIFNSFLPVNQPEEVWCERCVTLVQMNHAAARRFYQYAHEHTACTNIAKLIHVIRHCLNACIQRAVREPPEDEEEEDGREKENVTDDRCKIPLFMLMSFMPASAVPPFSCGVISTLRSREEGAVDKSYCTLLDCLCSWGQVGHILELVDNWLPTEHAQAKSNTASKGRVQIHDTRPVKPELALVYIEYLLTHPKNRECLLSAPRKKLNHLLKALETSKADLESLLQTPGGKPRGFSEAAAPRAFGLHCRLSIHLQHKFCSEGKVYLSMLEDTGFWLESKILSFIQDQEEDYLKLHRVIYQQIIQTYLTVCKDVVMVGLGDHQFQMQLLQRSLGIMQTVKGFFYVSLLLDILKEITGSSLIQKTDSDEEVAMLLDTVQKVFQKMLECIARSFRKQPEEGLRLLYSVQRPLHEFITAVQSRHTDTPVHRGVLSTLIAGPVVEISHQLRKVSDVEELTPPEHLSDLPPFSRCLIGIIIKSSNVVRSFLDELKACVASNDIEGIVCLTAAVHIILVINAGKHKSSKVREVAATVHRKLKTFMEITLEEDSIERFLYESSSRTLGELLNS

SEQ ID NO: 882933 - protein, 625 aa, Homo sapiens
GRTRPGGESAEDQPEEVWCERCVTLVQMNHAAARRFYQYAHEHTACTNIAKLIHVIRHCLNACIQRAVREPPEDEEEEDGREKENVTVLDKTLSVNDVACMAGLLEIIVILWKSIDRSMENNKEAKLYTINKFASVLPEYLKVFKDDRCKIPLFMLMSFMPASAVPPFSCGVISTLRSREEGAVDKSYCTLLDCLCSWGQVGHILELVDNWLPTEHAQAKSNTASKGRVQIHDTRPVKPELALVYIEYLLTHPKNRECLLSAPRKKLNHLLKALETSKADLESLLQTPGGKPRGFSEAAAPRAFGLHCRLSIHLQHKFCSEGKVYLSMLEDTGFWLESKILSFIQDQEEDYLKLHRVIYQQIIQTYLTVCKDVVMVGLGDHQFQMQLLQRSLGIMQTVKGFFYVSLLLDILKEITGSSLIQKTDSDEEVAMLLDTVQKVFQKMLECIARSFRKQPEEGLRLLYSVQRPLHEFITAVQSRHTDTPVHRGVLSTLIAGPVVEISHQLRKVSDVEELTPPEHLSDLPPFSRCLIGIIIKSSNVVRSFLDELKACVASNDIEGIVCLTAAVHIILVINAGKHKSSKVREVAATVHRKLKTFMEITLEEDSIERFLYESSSRTLGELLNS

SEQ ID NO: 882934 - protein, 644 aa, Homo sapiens
MEHILVRLETDSRPVSRRLVSLIFNSFLPVNQPEEVWCERCVTLVQMNHAAARRFYQYAHEHTACTNIAKLIHVIRHCLNACIQRAVREPPEDEEEEDGREKENVTVLDKTLSVNDVACMAGLLEIIVILWKSIDRSMENNKEAKLYTINKFASVLPEYLKVFKDDRCKIPLFMLMSFMPASAVPPFSCGVISTLRSREEGAVDKSYCTLLDCLCSWGQVGHILELVDNWLPTEHAQAKSNTASKGRVQIHDTRPVKPELALVYIEYLLTHPKNRECLLSAPRKKLNHLLKALETSKADLESLLQTPGGKPRGFSEAAAPRAFGLHCRLSIHLQHKFCSEGKVYLSMLEDTGFWLESKILSFIQDQEEDYLKLHRVIYQQIIQTYLTVCKDVVMVGLGDHQFQMQLLQRSLGIMQTVKGFFYVSLLLDILKEITGSSLIQKTDSDEEVAMLLDTVQKVFQKMLECIARSFRKQPEEGLRLLYSVQRPLHEFITAVQSRHTDTPVHRGVLSTLIAGPVVEISHQLRKVSDVEELTPPEHLSDLPPFSRCLIGIIIKSSNVVRSFLDELKACVASNDIEGIVCLTAAVHIILVINAGKHKSSKVREVAATVHRKLKTFMEITLEEDSIERFLYESSSRTLGELLNS

SEQ ID NO: 882935 - protein, 1128 aa, Homo sapiens
MEKRETFVQAVSKELVGEFLQFVQLDKEASDPFSLNELLDELSRKQKEELWQRLKNLLTDVLLESPVDGWQVVEAQGEDNMETEHGSKMRKSIEIIYAITSVILASVSVINESENYEALLECVIILNGILYALPESERKLQSSIQDLCVTWWEKGLPAKEDTGKTAFVMLLRRSLETKTGADVCRLWRIHQALYCFDYDLEESGEIKDMLLECFININYIKKEEGRRFLSCLFNWNINFIKMIHGTIKNQLQGLQKSLMVYIAEIYFRAWKKASGKILEAIENDCIQDFMFHGIHLPRRSPVHSKVREVLSYFHHQKKVRQGVEEMLYRLYKPILWRGLKARNSEVRSNAALLFVEAFPIRDPNLHAIEMDSEIQKQFEELYSLLEDPYPMVRSTGILGVCKITSKYWEMMPPTILIDLLKKVTGELAFDTSSADVRCSVFKCLPMILDNKLSHPLLEQLLPALRYSLHDNSEKVRVAFVDMLLKIKAVRAAKFWKICPMEHILVRLETDSRPVSRRLVSLIFNSFLPVNQPEEVWCERCVTLVQMNHAAARRFYQYAHEHTACTNIAKLIHVIRHCLNACIQRAVREPPEDEEEEDGREKENVTVLDKTLSVNDVACMAGLLEIIVILWKSIDRSMENNKEAKLYTINKFASVLPEYLKVFKDDRCKIPLFMLMSFMPASAVPPFSCGVISTLRSREEGAVDKSYCTLLDCLCSWGQVGHILELVDNWLPTEHAQAKSNTASKGRVQIHDTRPVKPELALVYIEYLLTHPKNRECLLSAPRKKLNHLLKALETSKADLESLLQTPGGKPRGFSEAAAPRAFGLHCRLSIHLQHKFCSEGKVYLSMLEDTGFWLESKILSFIQDQEEDYLKLHRVIYQQIIQTYLTVCKDVVMVGLGDHQFQMQLLQRSLGIMQTVKGFFYVSLLLDILKEITGSSLIQKTDSDEEVAMLLDTVQKVFQKMLECIARSFRKQPEEGLRLLYSVQRPLHEFITAVQSRHTDTPVHRGVLSTLIAGPVVEISHQLRKVSDVEELTPPEHLSDLPPFSRCLIGIIIKSSNVVRSFLDELKACVASNDIEGIVCLTAAVHIILVINAGKHKSSKVREVAATVHRKLKTFMEITLEEDSIERI

SEQ ID NO: 882936 - protein, 1123 aa, Homo sapiens
MEKRETFVQAVSKELVGEFLQFVQLDKEASDPFSLNELLDELSRKQKEELWQRLKNLLTDVLLESPVDGWQVVEAQGEDNMETEHGSKMRKSIEIIYAITSVILASVSVINESENYEALLECVIILNGILYALPESERKLQSSIQDLCVTWWEKGLPAKEDTGKTAFVMLLRRSLETKTGADVCRLWRIHQALYCFDYDLEESGEIKDMLLECFININYIKKEEGRRFLSCLFNWNINFIKMIHGTIKNQLQGLQKSLMVYIAEIYFRAWKKASGKILEAIENDCIQDFMFHGIHLPRRSPVHSKVREVLSYFHHQKKVRQGVEEMLYRLYKPILWRGLKARNSEVRSNAALLFVEAFPIRDPNLHAIEMDSEIQKQFEELYSLLEDPYPMVRSTGILGVCKITSKYWEMMPPTILIDLLKKVTGELAFDTSSADVRCSVFKCLPMILDNKLSHPLLEQLLPALRYSLHDNSEKVRVAFVDMLLKIKAVRAAKFWKICPMEHILVRLETDSRPVSRRLVSLIFNSFLPVNQPEEVWCERCVTLVQMNHAAARRFYQYAHEHTACTNIAKLIHVIRHCLNACIQRAVREPPEDEEEEDGREKENVTVLDKTLSVNDVACMAGLLEIIVILWKSIDRSMENNKEAKLYTINKFASVLPEYLKVFKDDRCKIPLFMLMSFMPASAVPPFSCGVISTLRSREEGAVDKSYCTLLDCLCSWGQVGHILELVDNWLPTEHAQAKSNTASKGRVQIHDTRPVKPELALVYIEYLLTHPKNRECLLSAPRKKLNHLLKALETSKADLESLLQTPGGKPRGFSEAAAPRAFGLHCRLSIHLQHKVCLLLALYEDDDTVLFLLLIYLLVFGQFCSEGKVYLSMLEDTGFWLESKILSFIQDQEEDYLKLHRVIYQQIIQTYLTVCKDVVMVGLGDHQFQMQLLQRSLGIMQTVKGFFYVSLLLDILKEITGSSLIQKTDSDEEVAMLLDTVQKVFQKMLECIARSFRKQPEEGLRVSDVEELTPPEHLSDLPPFSRCLIGIIIKSSNVVRSFLDELKACVASNDIEGIVCLTAAVHIILVINAGKHKSSKVREVAATVHRKLKTFMEITLEEDSIERFLYESSSRTLGELLNS

SEQ ID NO: 882937 - protein, 267 aa, Homo sapiens
MGSLFPLSLLFFLAAAYPGVGSALGRRTKRAQSPKGSPLAPSGTSVPFWVRMSPEFVAVQPGKSVQLNCSNSCPQPQNSSLRTPLRQGKTLRGPGWVSYQLLDVRAWSSLAHCLVTCAGKTRWATSRITAYKPPHSVILEPPVLKGRKYTLRCHVTQVFPVGYLVVTLRHGSRVIYSESLERFTGLDLANVTLTYEFAAGPRDFWQPVICHARLNLDGLVVRNSSAPITLMLAWSPAPTALASGSILPGRLSWEDPLSPESRGCSEP

SEQ ID NO: 882938 - protein, 237 aa, Homo sapiens
MGSLFPLSLLFFLAAAYPGVGSALGRRTKRAQSPKGSPLAPSGTSVPFWVRMSPEFVAVQPGKSVQLNCSNSCPQPQNSSLRTPLRQGKTLRGPGWVSYQLLDVRAWSSLAHCLVTCAGKTRWATSRITAYKPPHSVILEPPVLKGRKYTLRCHVTQVFPVGYLVVTLRHGSRVIYSESLERFTGLDLANVTLTYEFAAGPRDFWQPVICHARLNLDGLVVRNSSAPITLMLGEAPL

SEQ ID NO: 882939 - protein, 271 aa, Homo sapiens
MGSLFPLSLLFFLAAAYPGVGSALGRRTKRAQSPKGSPLAPSGTSVPFWVRMSPEFVAVQPGKSVQLNCSNSCPQPQNSSLRTPLRQGKTLRGPGWVSYQLLDVRAWSSLAHCLVTCAGKTRWATSRITAYKPPHSVILEPPVLKGRKYTLRCHVTQVFPVGYLVVTLRHGSRVIYSESLERFTGLDLANVTLTYEFAAGPRDFWQPVICHARLNLDGLVVRNSSAPITLMLAWSPAPTALASGSIAALVGILLTVGAAYLCKCLAMKSQA

SEQ ID NO: 882940 - protein, 272 aa, Homo sapiens
MGSLFPLSLLFFLAAAYPGVGSALGRRTKRAQSPKGSPLAPSGTSVPFWVRMSPEFVAVQPGKSVQLNCSNSCPQPQNSSLRTPLRQGKTLRGPGWVSYQLLDVRAWSSLAHCLVTCAGKTRWATSRITAYSVPGGLLGGDPEAWKPGHLFRKPGALHRPGSGQRDLDLRVCCWTPRLLAARDLPRAPQSRRPGGPQQLGTHYTDARLEPRAHSFGLRFHRCPCRDPPHCGRCVPMQVPSYEVPGVKGDVLCRLSEKKRNMKQSGEMAIHGG

SEQ ID NO: 882941 - protein, 217 aa, Homo sapiens
MNGYQRGPHCCILLSLPATPLGNVEECYRYFTSVLFCHGVRRPPFSIDLFKEEQLLALEDYVVNTYFRHFKLYKYVFTPQVRLDLSLTYMGLQPPKLWPESETGKGECQGRAGLGQPGATVSSCFWFAEKEESKEMEEQAVTPQKEELETVAPPEPEPSHIHVLRAYIKTQVNKELEQLQGLVEERLKASEERLSSKLTALERPFQLPPGKGKSKTK

SEQ ID NO: 882942 - protein, 331 aa, Homo sapiens
MLNRKTSHFLGMRVQSELEHLSELRREAGKDRSSVHGSAARTRASVRTQWTTAAAAKADEDPGANLFPPPLPRPRICMWKYLDVHSMHQLEKTTNAEMREVLAELLELGCPEQSLRDAITLDLFCHALIFCRQQGFSLEQTSAACALLQDLHKACIATPLGNVEECYRYFTSVLFCHGVRRPPFSIDLFKEEQLLALEDYVVNTYFRHFKLYKYVFTPQVRLDLSLTYMGLQPPKLWPESETEKEESKEMEEQAVTPQKEELETVAPPEPEPSHIHVLRAYIKTQVNKELEQLQGLVEERLKASEERLSSKLTALERPFQLPPGKGKSKTK

SEQ ID NO: 882943 - protein, 264 aa, Homo sapiens [sequence omitted]

SEQ ID NO: 882944 - protein, 215 aa, Homo sapiens
MEAQLSLTPLSLPRVLAELLELGCPEQSLRDAITLDLFCHALIFCRQQGFSLEQTSAACALLQDLHKACIATPLGNVEECYRYFTSVLFCHGVRRPPFSIDLFKEEQLLALEDYVVNTYFRHFKLYKYVFTPQVRLDLSLTYMGLQPPKLWPESETGHIHVLRAYIKTQVNKELEQLQGLVEERLKASEERLSSKLTALERPFQLPPGKGKSKTK

SEQ ID NO: 882945 - protein, 112 aa, Homo sapiens
MLNRKTSHFLGMRVQSELEHLSELRREAGKDRSSVHGSAARTRASVRTQWTTAAAAKADEDPGANLFPVRAGQSGLLVNIYKPAPPQAPPVIMLTNVRDVSRAAWARRGRGV

SEQ ID NO: 882946 - protein, 284 aa, Homo sapiens
MLNRKTSHFLGMRVQSELEHLSELRREAGKDRSSVHGSAARTRASVRTQWTTAAAAKADEDPGANLFPPPLPRPRICMWKYLDVHSMHQLEKTTNAEMREVLAELLELGCPEQSLRDAITLDLFCHALIFLARPGKGPFLPTWRQGTFKLGLGWPLGFPGNSFNEGPLVILAKATLLEGQTVGKGSWLNPAELFKPKVGSLLYFGAPYAGESPRAGDTIPLYAQKAESRDAPLLSSTKEQRGNTKRLVAWGGTYVAHKRNTYKGEWDLRSAQRFNTVPAGPELV

SEQ ID NO: 882947 - protein, 301 aa, Homo sapiens
MLNRKTSHFLGMRVQSELEHLSELRREAGKDRSSVHGSAARTRASVRTQWTTAAAAKADEDPGANLFPPPLPRPRICMWKYLDVHSMHQLEKTTNAEMREVLAELLELGCPEQSLRDAITLDLFCHALIFCRQQGFSLEQTSAACALLQDLHKACIATPLGNVEECYRYFTSVLFCHGVRRPPFSIDLFKEEQLLALEDYVVNTYFRHFKLYKYVFTPQVRLDLSLTYMGLQPPKLWPESETGHIHVLRAYIKTQVNKELEQLQGLVEERLKASEERLSSKLTALERPFQLPPGKGKSKTK

SEQ ID NO: 882948 - protein, 264 aa, Homo sapiens [sequence omitted]

SEQ ID NO: 882949 - protein, 157 aa, Homo sapiens [sequence omitted]

SEQ ID NO: 882950 - protein, 1303 aa, Homo sapiens
RGDCGKRSDGASGCWRKEVGAGSANGVEMVQGPVQTPALTIHRRKRRRSCPPNRASYLPKAESLASLGSHLPALLSRARVPRPPAGRRERERRRRPVAKAPARLRGEYETGVKMTSRFGKTYSRKGGNGSSKFDEVFSNKRTTLSTKWGETTFMAKLGQKRPNFKPDIQEIPKKPKVEEESTGDPFGFDSDDESLPVSSKNLAQVKCSSYSESSEAAQLEEVTSVLEANSKISHVVVEDTVVSDKCFPLEDTLLGKEKSTNRIVEDDASISSCNKLITSDKVENFHEEHEKNSHHIHKNADDSTKKPNAETTVASEIKETNDTWNSQFGKRPESPSEISPIKGSVRTGLFEWDNDFEDIRSEDCILSLDSDPLLEMKDDDFKNRLENLNEAIEEDIVQSVLRPTNCRTYCRANKTKSSQGASNFDKLMDGTSQALAKANSESSKDGLNQAKKGGVSCGTSFRGTVGRTRDYTVLHPSCLSVCNVTIQDTMERSMDEFTASTPADLGEAGRLRKKADIATSKTTTRFRPSNTKSKKDVKLEFFGFEDHETGGDEGGSGSSNYKIKYFGFDDLSESEDDEDDDCQVERKTSKKRTKTAPSPSLQPPPESNDNSQDSQSGTNNAENLDFTEDLPGVPESVKKPINKQGDKSKENTRKIFSGPKRSPTKAVYNARHWNHPDSEELPGPPVVKPQSVTVRLSSKEPNQKDDGVFKAPAPPSKVIKTVTIPTQPYQDIVTALKCRREDKELYTVVQHVKHFNDVVEFGENQEFTDDIEYLLSGLKSTQPLNTRCLSVISLATKCAMPSFRMHLRAHGMVAMVFKTLDDSQHHQNLSLCTAALMYILSRDRLNMDLDRASLDLMIRLLELEQDASSAKLLNEKDMNKIKEKIRRLCETVHNKHLDLENITTGHLAMETLLSLTSKRAGDWFKEELRLLGGLDHIVDKVKECVDHLSRDEDEEKLVASLWGAERCLRVLESVTVHNPENQSYLIAYKDSQLIVSSAKALQHCEELIQQYNRAEDSICLADSKPLPHQNVTNHVGKAVEDCMRAIIGVLLNLTNDNEWGSTKTGEQDGLIGTALNCVLQVPKYLPQEQRFDIRVLGLGLLINLVEYSARNRHCLVNMETSCSFDSSICSGEGDDSLRIGGQVHAVQALVQLFLERERAAQLAESKTDELIKDAPTTQHDKSGEWQETSGEIQWVSTEKTDGTEEKHKKEEEDEELDLNKALQHAGKHMEDCIVASYTALLLGCLCQESPINVTTVREYLPEGDFSIMTEMLKKFLSFMNLTCAVGTTGQKSISRVIEYLEHC

SEQ ID NO: 882951 - protein, 427 aa, Homo sapiens
DSQHHQNLSLCTAALMYILSRDRLNMDLDRASLDLMIRLLELEQDASSAKLLNEKDMNKIKEKIRRLCETVHNKHLDLENITTGHLAMETLLSLTSKRAGDWFKEELRLLGGLDHIVDKVKECVDHLSRDEDEEKLVASLWGAERCLRVLESVTVHNPENQSYLIAYKDSQLIVSSAKALQHCEELIQQYNRAEDSICLADSKPLPHQNVTNHVGKAVEDCMRAIIGVLLNLTNDNEWGSTKTGEQDGLIGTALNCVLQVPKYLPQEQRFDIRVLLFLERERAAQLAESKTDELIKDAPTTQHDKSGEWQETSGEIQWVSTEKTDGTEEKHKKEEEDEELDLNKALQHAGKHMEDCIVASYTALLLGCLCQESPINVTTVREYLPEGDFSIMTEMLKKFLSFMNLTCAVGTTGQKSISRVIEYLEHC

SEQ ID NO: 882952 - protein, 1190 aa, Homo sapiens
MTSRFGKTYSRKGGNGSSKFDEVFSNKRTTLSTKWGETTFMAKLGQKRPNFKPDIQEIPKKPKVEEESTGDPFGFDSDDESLPVSSKNLAQVKCSSYSESSEAAQLEEVTSVLEANSKISHVVVEDTVVSDKCFPLEDTLLGKEKSTNRIVEDDASISSCNKLITSDKVENFHEEHEKNSHHIHKNADDSTKKPNAETTVASEIKETNDTWNSQFGKRPESPSEISPIKGSVRTGLFEWDNDFEDIRSEDCILSLDSDPLLEMKDDDFKNRLENLNEAIEEDIVQSVLRPTNCRTYCRANKTKSSQGASNFDKLMDGTSQALAKANSESSKDGLNQAKKGGVSCGTSFRGTVGRTRDYTVLHPSCLSVCNVTIQDTMERSMDEFTASTPADLGEAGRLRKKADIATSKTTTRFRPSNTKSKKDVKLEFFGFEDHETGGDEGGSGSSNYKIKYFGFDDLSESEDDEDDDCQVERKTSKKRTKTAPSPSLQPPPESNDNSQDSQSGTNNAENLDFTEDLPGVPESVKKPINKQGDKSKENTRKIFSGPKRSPTKAVYNARHWNHPDSEELPGPPVVKPQSVTVRLSSKEPNQKDDGVFKAPAPPSKVIKTVTIPTQPYQDIVTALKCRREDKELYTVVQHVKHFNDVVEFGENQEFTDDIEYLLSGLKSTQPLNTRCLSVISLATKCAMPSFRMHLRAHGMVAMVFKTLDDSQHHQNLSLCTAALMYILSRDRLNMDLDRASLDLMIRLLELEQDASSAKLLNEKDMNKIKEKIRRLCETVHNKHLDLENITTGHLAMETLLSLTSKRAGDWFKEELRLLGGLDHIVDKVKECVDHLSRDEDEEKLVASLWGAERCLRVLESVTVHNPENQSYLIAYKDSQLIVSSAKALQHCEELIQQYNRAEDSICLADSKPLPHQNVTNHVGKAVEDCMRAIIGVLLNLTNDNEWGSTKTGEQDGLIGTALNCVLQVPKYLPQEQRFDIRVLGLGLLINLVEYSARNRHCLVNMETSCSFDSSICSGEGDDSLRIGGQVHAVQALVQLFLERERAAQLAESKTDELIKDAPTTQHDKSGEWQETSGEIQWVSTEKTDGTEEKHKKEEEDEELDLNKALQHAGKHMEDCIVASYTALLLGCLCQESPINVTTVREYLPEGDFSIMTEMLKKFLSFMNLTCAVGTTGQKSISRVIEYLEHC

SEQ ID NO: 882953 - protein, 1184 aa, Homo sapiens
MTSRFGKTYSRKGGNGSSKFDEVFSNKRTTLSTKWGETTFMAKLGQKRPNFKPDIQEIPKKPKVEEESTGDPFGFDSDDESLPVSSKNLAQVKCSSYSESSEAAQLEEVTSVLEANSKISHVVVEDTVVSDKCFPLEDTLLGKEKSTNRIVEDDASISSCNKLITSDKVENFHEEHEKNSHHIHKNADDSTKKPNAETTVASEIKETNDTWNSQFGKRPESPSEISPIKGSVRTGLFEWDNDFEDIRSEDCILSLDSDPLLEMKDDDFKNRLENLNEAIEEDIVQSVLRPTNCRTYCRANKTKSSQGASNFDKLMDGTSQALAKANSESSKDGLNQAKKGGVSCGTSFRGTVGRTRDYTVLHPSCLSVCNVTIQDTMERSMDEFTASTPADLGEAGRLRKKADIATSKTTTRFRPSNTKSKKDVKLEFFGFEDHETGGDEGGSGSSNYKIKYFGFDDLSESEDDEDDDCQVERKTSKKRTKTAPSPSLQPPPESNDNSQDSQSGTNNAEDLPGVPESVKKPINKQGDKSKENTRKIFSGPKRSPTKAVYNARHWNHPDSEELPGPPVVKPQSVTVRLSSKEPNQKDDGVFKAPAPPSKVIKTVTIPTQPYQDIVTALKCRREDKELYTVVQHVKHFNDVVEFGENQEFTDDIEYLLSGLKSTQPLNTRCLSVISLATKCAMPSFRMHLRAHGMVAMVFKTLDDSQHHQNLSLCTAALMYILSRDRLNMDLDRASLDLMIRLLELEQDASSAKLLNEKDMNKIKEKIRRLCETVHNKHLDLENITTGHLAMETLLSLTSKRAGDWFKEELRLLGGLDHIVDKVKECVDHLSRDEDEEKLVASLWGAERCLRVLESVTVHNPENQSYLIAYKDSQLIVSSAKALQHCEELIQQYNRAEDSICLADSKPLPHQNVTNHVGKAVEDCMRAIIGVLLNLTNDNEWGSTKTGEQDGLIGTALNCVLQVPKYLPQEQRFDIRVLGLGLLINLVEYSARNRHCLVNMETSCSFDSSICSGEGDDSLRIGGQVHAVQALVQLFLERERAAQLAESKTDELIKDAPTTQHDKSGEWQETSGEIQWVSTEKTDGTEEKHKKEEEDEELDLNKALQHAGKHMEDCIVASYTALLLGCLCQESPINVTTVREYLPEGDFSIMTEMLKKFLSFMNLTCAVGTTGQKSISRVIEYLEHC

SEQ ID NO: 882954 - protein, 779 aa, Homo sapiens
MTSRFGKTYSRKGGNGSSKFDEVFSNKRTTLSTKWGETTFMAKLGQKRPNFKPDIQEIPKKPKVEEESTGDPFGFDSDDESLPVSSKNLAQVKCSSYSESSEAAQLEEVTSVLEANSKISHVVVEDTVVSDKCFPLEDTLLGKEKSTNRIVEDDASISSCNKLITSDKVENFHEEHEKNSHHIHKNADDSTKKPNAETTVASEIKETNDTWNSQFGKRPESPSEISPIKGSVRTGLFEWDNDFEDIRSEDCILSLDSDPLLEMKDDDFKNRLENLNEAIEEDIVQSVLRPTNCRTYCRANKTKSSQGASNFDKLMDGTSQALAKANSESSKDGLNQAKKGGVSCGTSFRGTVGRTRDYTVLHPSCLSVCNVTIQDTMERSMDEFTASTPADLGEAGRLRKKADIATSKTTTRFRPSNTKSKKDVKLEFFGFEDHETGGDEGGSGSSNYKIKYFGFDDLSESEDDEDDDCQVERKTSKKRTKTAPSPSLQPPPESNDNSQDSQSGTNNAENLDFTEDLPGVPESVKKPINKQGDKSKENTRKIFSGPKRSPTKAVYNARHWNHPDSEELPGPPVVKPQSVTVRLSSKEPNQKDDGVFKAPAPPSKVIKTVTIPTQPYQDIVTALKCRREDKELYTVVQHVKHFNDVVEFGENQEFTDDIEYLLSGLKSTQPLNTRCLSVISLATKCAMPSFRMHLRAHGMVAMVFKTLDDSQHHQNLSLCTAALMYILSRDRLNMDLDRASLDLMIRLLELEQDASSAKLLNEKDMNKIKEKIRRLCETW

SEQ ID NO: 882955 - protein, 1190 aa, Homo sapiens; identical to SEQ ID NO: 882952

SEQ ID NO: 882956 - protein, 261 aa, Homo sapiens [sequence omitted]

SEQ ID NO: 882957 - protein, 1190 aa, Homo sapiens; identical to SEQ ID NO: 882952

SEQ ID NO: 882958 - protein, 1190 aa, Homo sapiens; identical to SEQ ID NO: 882952

SEQ ID NO: 882959 - protein, 821 aa, Homo sapiens
MTSRFGKTYSRKGGNGSSKFDEVFSNKRTTLSTKWGETTFMAKLGQKRPNFKPDIQEIPKKPKVEEESTGDPFGFDSDDESLPVSSKNLAQVKCSSYSESSEAAQLEEVTSVLEANSKISHVVVEDTVVSDKCFPLEDTLLGKEKSTNRIVEDDASISSCNKLITSDKVENFHEEHEKNSHHIHKNADDSTKKPNAETTVASEIKETNDTWNSQFGKRPESPSEISPIKGSVRTGLFEWDNDFEDIRSEDCILSLDSDPLLEMKDDDFKNRLENLNEAIEEDIVQSVLRPTNCRTYCRANKTKSSQGASNFDKLMDGTSQALAKANSESSKDGLNQAKKGGVSCGTSFRGTVGRTRDYTVLHPSCLSVCNVTIQDTMERSMDEFTASTPADLGEAGRLRKKADIATSKTTTRFRPSNTKSKKDVKLEFFGFEDHETGGDEGGSGSSNYKIKYFGFDDLSESEDDEDDDCQVERKTSKKRTKTAPSPSLQPPPESNDNSQDSQSGTNNAENLDFTEDLPGVPESVKKPINKQGDKSKENTRKIFSGPKRSPTKAVYNARHWNHPDSEELPGPPVVKPQSVTVRLSSKEPNQKDDGVFKAPAPPSKVIKTVTIPTQPYQDIVTALKCRREDKELYTVVQHVKHFNDVVEFGENQEFTDDIEYLLSGLKSTQPLNTRCLSVISLATKCAMPSFRMHLRAHGMVAMVFKTLDDSQHHQNLSLCTAALMYILSRDRLNMDLDRASLDLMIRLLELEQDASSAKLLNEKDMNKIKEKIRRLCETVHNKHLDLENITVGSFFLPSKMRITFRKSLVSCSSCVTVGKLF

SEQ ID NO: 882960 - protein, 148 aa, Homo sapiens
MSQTRDLQGGKAFRLLKAQQEERLDEINKQFLDDPKYSSDEDLPSKLEGFKAEKYMEFDLNGNGDIDIMSLKRMLEKLGVPKTHLELKKLIGEVSSGSGETFSYPDFLRMMLGKRSAILKMILMYEEKAREKEKPTGPPAKKAISELP

SEQ ID NO: 882961 - protein, 148 aa, Homo sapiens; identical to SEQ ID NO: 882960

SEQ ID NO: 882962 - protein, 93 aa, Homo sapiens
MEFDLNGNGDIDIMSLKRMLEKLGVPKTHLELKKLIGEVSSGSGETFSYPDFLRMMLGKRSAILKMILMYEEKAREKEKPTGPPAKKAISELP

SEQ ID NO: 882963 - protein, 159 aa, Homo sapiens
MEFDLNGNGDIGEKRVICGGRVVCRPKKTEVSPTCSIPHDLGGGPPTTVGGRRMGMRKWERRERVSPPSPHPHPLPPDIMSLKRMLEKLGVPKTHLELKKLIGEVSSGSGETFSYPDFLRMMLGKRSAILKMILMYEEKAREKEKPTGPPAKKAISELP

SEQ ID NO: 882964 - protein, 132 aa, Homo sapiens; identical to SEQ ID NO: 745510

SEQ ID NO: 882965 - protein, 168 aa, Homo sapiens
RGKGKFGRKASEKTGGREGEPADRGLQLGGKAFRLLKAQQEERLDEINKQFLDDPKYSSDEDLPSKLEGFKAEKYMEFDLNGNGDIDIMSLKRMLEKLGVPKTHLELKKLIGEVSSGSGETFSYPDFLRMMLGKRSAILKMILMYEEKAREKEKPTGPPAKKAISELP

SEQ ID NO: 882966 - protein, 118 aa, Homo sapiens
MGRAYPGSYFPLHEQFLDDPKYSSDEDLPSKLEGFKDIMSLKRMLEKLGVPKTHLELKKLIGEVSSGSGETFSYPDFLRMMLGKRSAILKMILMYEEKAREKEKPTGPPAKKAISELP

SEQ ID NO: 882967 - protein, 93 aa, Homo sapiens; identical to SEQ ID NO: 882962

SEQ ID NO: 882968 - protein, 328 aa, Homo sapiens
MTGSNEFKLNQPPEDGISSVKFSPNTSQFLLVSSWDTSVRLYDVPANSMRLKYQHTGAVLDCAFYDPTHAWSGGLDHQLKMHDLNTDQENLVGTHDAPIRCVEYCPEVNVMVTGSWDQTVKLWDPRTPCNAGTFSQPEKVYTLSVSGDRLIVGTAGRRVLVWDLRNMGYVQQRRESSLKYQTRCIRAFPNKQGYVLSSIEGRVAVEYLDPSPEVQKKKYAFKCHRLKENNIEQIYPVNAISFHNIHNTFATGGSDGFVNIWDPFNKKRLCQFHRYPTSIASLAFSNDGTTLAIASSYMYEMDDTEHPEDGIFIRQVTDAETKPKSPCT

SEQ ID NO: 882969 - protein, 328 aa, Homo sapiens; identical to SEQ ID NO: 882968

SEQ ID NO: 882970 - protein, 328 aa, Homo sapiens; identical to SEQ ID NO: 882968

SEQ ID NO: 882971 - protein, 328 aa, Homo sapiens; identical to SEQ ID NO: 882968

SEQ ID NO: 882972 - protein, 326 aa, Homo sapiens
MTGSNEFKLNQPPEDGISSVKFSPNTSQFLLVSSWDTSVRLYDVPANSMRLKYQHTGAVLDCAFYDPTHAWSGGLDHQLKMHDLNTDQENLVGTHDAPIRCVEYCPEVNVMVTGSWDQTVKLWDPRTPCNAGTFSQPEKVYTLSVSGDRLIVGTAGRRVLVWDLRNMGYVQQRRESSLKYQTRCIRAFPNKQGYVLSSIEGRVAVEYLDPSPEVQKKKYAFKCHRLKENNIEQIYPVNAISFHNIHNTFATGGSDGFVNIWDPFNKKRLCQFHRYPTSIASLAFSNDGTTLAIASSYMYEMDDTEHPEDGIFIRQVTDAETKPKST

SEQ ID NO: 882973 - protein, 328 aa, Homo sapiens; identical to SEQ ID NO: 882968

SEQ ID NO: 882974 - protein, 328 aa, Homo sapiens; identical to SEQ ID NO: 882968

SEQ ID NO: 882975 - protein, 328 aa, Homo sapiens; identical to SEQ ID NO: 882968

SEQ ID NO: 882976 - protein, 326 aa, Homo sapiens; identical to SEQ ID NO: 882972

SEQ ID NO: 882977 - protein, 335 aa, Homo sapiens
MTGSNEFKLNQPPEDGISSVKFSPNTSQFLLVSSWDTSVRLYDVPANSMRLKYQHTGAVLDCAFYDPTHAWSGGLDHQLKMHDLNTDQENLVGTHDAPIRCVEYCPEVNVMVTGSWDQTVKLWDPRTPCNAGTFSQPEKVYTLSVSGDRLIVGTAGRRVLVWDLRNMGYVQQRRESSLKYQTRCIRAFPNKQGYVLSSIEGRVAVEYLDPSPEVQKKKYAFKCHRLKENNIEQIYPVNAISFHNIHNTFATGGSDGFVNIWDPFNKKRLCQFHRYPTSIASLAFSNDGTTLAIASSYMYEMDDTEHPEDGIFIRQVTDAETKPKLAPFKAIKVEI

SEQ ID NO: 882978 - protein, 349 aa, Homo sapiens
RLSVRSPSPRDPWGLWAPVLQMTGSNEFKLNQPPEDGISSVKFSPNTSQFLLVSSWDTSVRLYDVPANSMRLKYQHTGAVLDCAFYDPTHAWSGGLDHQLKMHDLNTDQENLVGTHDAPIRCVEYCPEVNVMVTGSWDQTVKLWDPRTPCNAGTFSQPEKVYTLSVSGDRLIVGTAGRRVLVWDLRNMGYVQQRRESSLKYQTRCIRAFPNKQGYVLSSIEGRVAVEYLDPSPEVQKKKYAFKCHRLKENNIEQIYPVNAISFHNIHNTFATGGSDGFVNIWDPFNKKRLCQFHRYPTSIASLAFSNDGTTLAIASSYMYEMDDTEHPEDGIFIRQVTDAETKPKSPCT

SEQ ID NO: 882979 - protein, 328 aa, Homo sapiens; identical to SEQ ID NO: 882968

SEQ ID NO: 882980 - protein, 280 aa, Homo sapiens
MRLKYQHTGAVLDCAFYDPTHAWSGGLDHQLKMHDLNTDQENLVGTHDAPIRCVEYCPEVNVMVTGSWDQTVKLWDPRTPCNAGTFSQPEKVYTLSVSGDRLIVGTAGRRVLVWDLRNMGYVQQRRESSLKYQTRCIRAFPNKQGYVLSSIEGRVAVEYLDPSPEVQKKKYAFKCHRLKENNIEQIYPVNAISFHNIHNTFATGGSDGFVNIWDPFNKKRLCQFHRYPTSIASLAFSNDGTTLAIASSYMYEMDDTEHPEDGIFIRQVTDAETKPKSPCT

SEQ ID NO: 882981 - protein, 162 aa, Homo sapiens
MTGSNEFKLNQPPEDGISSVKFSPNTSQFLLVSSWDTSVRLYDVPANSMRLKYQHTGAVLDCAFYDPTHAWSGGLDHQLKMHDLNTDQENLVGTHDAPIRCVEYCPEVNVMVTGSWDQTVKLWDPRTPCNAGTFSQPEKQAAECWCGTYGTWVTCSSAGSPA

SEQ ID NO: 882982 - protein, 306 aa, Homo sapiens
MPTTSQFLLVSSWDTSVRLYDVPANSMRLKYQHTGAVLDCAFYDPTHAWSGGLDHQLKMHDLNTDQENLVGTHDAPIRCVEYCPEVNVMVTGSWDQTVKLWDPRTPCNAGTFSQPEKVYTLSVSGDRLIVGTAGRRVLVWDLRNMGYVQQRRESSLKYQTRCIRAFPNKQGYVLSSIEGRVAVEYLDPSPEVQKKKYAFKCHRLKENNIEQIYPVNAISFHNIHNTFATGGSDGFVNIWDPFNKKRLCQFHRYPTSIASLAFSNDGTTLAIASSYMYEMDDTEHPEDGIFIRQVTDAETKPKSPCT

SEQ ID NO: 882983 - protein, 298 aa, Homo sapiens
AYPESVLMESKDAVVENEVVSTENVDYEVQAKGSNDHVTGSGRTRSIMMKLPDLYLSQENLVGTHDAPIRCVEYCPEVNVMVTGSWDQTVKLWDPRTPCNAGTFSQPEKVYTLSVSGDRLIVGTAGRRVLVWDLRNMGYVQQRRESSLKYQTRCIRAFPNKQGYVLSSIEGRVAVEYLDPSPEVQKKKYAFKCHRLKENNIEQIYPVNAISFHNIHNTFATGGSDGFVNIWDPFNKKRLCQFHRYPTSIASLAFSNDGTTLAIASSYMYEMDDTEHPEDGIFIRQVTDAETKPKSPCT

SEQ ID NO: 882984 - protein, 103 aa, Homo sapiens
MTGSNEFKLNQPPEDGISSVKFSPNTSQFLLVSSWDTSVRLYDVPANSMRLKYQHTGAVLDCAFYDPTHAWSGGLDHQLKMHDLNTDQEILLGPMSPYQMCGR

SEQ ID NO: 882985 - protein, 545 aa, Homo sapiens
CLRASRVTKTSLRRILRLTSRTELQGDHRARHLYYCHLKERVLRSQCAHREEAYFLLAACALQADLGEHRESAHAGRYFEPHSYFPQWIITKRGIDYILRHMPTLHRERQGLSPKEAMLCFIQEACRLEDVPVHFFRLHKDKKEGRPTVILGLALRGVHIYQEVDRAPQLLYDLPWPHVGKLAFLGKKLEIQLDGLPAAQKLVYYTGCTWRSRHLLHLLRASHQLHLRVRPTLQQLRQREEAEEKQHYRESYISDELELDLASRSFPGSGVSSQHCPHCLSRHSADSHGSSYTSGIKANSWLRESREMSVDVPLEVHGLHEKEPSSSPRTSRSHPSTRGDSQATRQEPCTQVRTRGQSAEAVHQIQEMTAGVSEEQHSHGLDDMQLHQLALHPAPTSLSHTFHRALDCRLAGPCETRATLPSKRSSNCLALDLFGEAHHRSLWCRHHPPSSTVRTARLSPCPPHFHMALVPSCPPDAACTSAASTLHRFTCKRCGAGSDINLGGNKQVPHLMPVCHTPGSSFPQGLREPVQGLAVKCPESHGVGP

SEQ ID NO: 882986 - protein, 242 aa, Homo sapiens
MPGPWLLLALALTLNLTGVPGGRAQPEAAQQEAVTAAEHPGLDDFLRQVERLLFLRENIQRLQGDQGEHSASQIFQSDWLSKRQHPGKREEEEEEGVEEEEEEEGGAVGPHKRQHPGRREDEASWSVDVTQHKRQHPGRRSPWLAYAVPKRQHPGRRLADPKAQRSWEEEEEEEEREEDLMPEKRQHPGKRALGGPCGPQGAYGQAGLLLGLLDDLSRSQGAEEKRQHPGRRAAWVREPLEE

SEQ ID NO: 882987 - protein, 103 aa, Homo sapiens
MPGPWLLLALALTLNLTGVPGGRAQPEAAQQEAVTAAEHPGLDDFLRQVERLLFLRENIQRLQGDQGEHSASQIFQSDWLSKRQHPGKREEEEEEGVFSLKCS

SEQ ID NO: 882988 - protein, 759 aa, Homo sapiens
IPAGMEADLSQLSEEERRQIAAVMSRAQGLPKGSVPPAAAESPSMHRKQELDSSHPPKQSGRPPDPGRPAQPGLSKSRTTDTFRSEQKLPGRSPSTISLKESKSRTDLKEEHKSSMMPGFLSEVNALSAVSSVVNKFNPFDLISDSEASQEETTKKQKVVQKEQGKPEGIIKPPLQQQPPKPIPKQQGPGRDPLQQDGTPKSISSQQPEKIKSQPPGTGKPIQGPTQTPQTDHAKLPLQRDASRPQTKQADIVRGESVKPSLPSPSKPPIQQPTPGKPPAQQPGHEKSQPGPAKPPAQPSGLTKPLAQQPGTVKPPVQPPGTTKPPAQPLGPAKPPAQQTGSEKPSSEQPGPKALAQPPGVGKTPAQQPGPAKPPTQQVGTPKPLAQQPGLQSPAKAPGPTKTPAQTKPPSQQPGSTKPPPQQPGPAKPSPQQPGSTKPPSQQPGSAKPSAQQPSPAKPSAQQFTKPVSQTGFGKPLQPPTVSPSAKQPPSQGLPKTICPLCNTTELLLHVPEKANFNTCTECQTTVCSLCGFNPNPHLTEVKEWLCLNCQMKRALGGDLAPVPSSPQPKLKTAPVTTTSAVSKSSPQPQQTSPKKDAAPKQDLSKAPEPKKPPPLVKQPTLHGSPSAKAKQPPEADSLSKPAPPKEPSVPSEQDKAPVADDKPKQPKMVKPTTDLVSSSSATTKPDIPSSKVQSQAEEKTTPPLKTDSAKPSQSFPPTGEKVTPFDSKAIPRPASDSKIISHPGPSSESKGQKQVDPV

SEQ ID NO: 882989 - protein, 293 aa, Homo sapiens
RAQPQSAAASPARPGTAHLPASPPVRSPARWGSMAGSPLLWGPRAGGVGLLVLLLLGLFRPPPALCARPVKEPRGLSAASPPLAETGAPRRFRRSVPRGEAAGAVQELARALAHLLEAERQERARAEAQEAEDQQARVLAQLLRVWGAPRNSDPALGLDDDPDAPAAQLARALLRARLDPAALAAQLVPAPVPAAALRPRPPVYDDGPAGPDAEEAGDETPDVDPELLRYLLGRILAGSADSEGVAAPRRLRRAADHDVGSELPPEGVLGALLRVKRLETPAPQVPARRLLPP

SEQ ID NO: 882990 - protein, 293 aa, Homo sapiens; identical to SEQ ID NO: 882989

SEQ ID NO: 882991 - protein, 293 aa, Homo sapiens; identical to SEQ ID NO: 882989

SEQ ID NO: 882992 - protein, 172 aa, Homo sapiens
ACAAAERRSLASSPRHCALASQSARPEPGSLGQHGGVAAALGAAGRGRRPFGAAAARPVSAAPRALRAAGKAAAALRPRPPVYDDGPAGPDAEEAGDETPDVDPELLRYLLGRILAGSADSEGVAAPRRLRRAADHDVGSELPPEGVLGALLRVKRLETPAPQVPARRLLPP

SEQ ID NO: 882993 - protein, 254 aa, Homo sapiens
RAQPQSAAASPARPGTAHLPASPPVRSPARWGSMAGSPLLWGPRAGGVGLLVLLLLGLFRPPPALCARPVKEPRGLSAASPPLAETGAPRRFRRSVPRGEAAGAVQELARALAHLLEAERQERARAEAQEAEDQQARVLAQLLRVWGAPRNSDPALGLDDDPDAPAAQLARALLRARLDPAALAAQLVPAPVPAAALRPRPPVYDDGPAGPDAEEAGDETPDVDPELLRYLLGRILAGSADSEGVAAPRRLLPP

SEQ ID NO: 882994 - protein, 257 aa, Homo sapiens
RAQPQSAAASPARPGTAHLPASPPVRSPARWGSMAGSPLLWGPRAGGVGLLVLLLLGLFRPPPALCARPVKEPRGLSAASPPLAETGAPRRFRRSVPRGEAAGAVQELARALAHLLEAERQERARAEAQEAEDQQARVLAQLLRVWGAPRNSDPALGLDDDPDAPAAQLARALLRARLDPAALAAQLVPAPVPAAALRPRPPVYDDGPAGPDAEEAGDETPDVDPELLSEGVLGALLRVKRLETPAPQVPARRLLPP

SEQ ID NO: 882995 - protein, 84 aa, Homo sapiens
ACAAAERRSLASSPRHCALASQSARPEPGSLGQHGGVAAALGAAGRGRRPFGAAAARPVSAAPRALRAAGKGAPRPKRSVSALG

SEQ ID NO: 882996 - protein, 162 aa, Homo sapiens
RAQPQSAAASPARPGTAHLPASPPVRSPARWGSMAGSPLLWGPRAGGVGLLVLLLLGLFRPPPALCARPVKEPRGLSAASPPLAETGAPRRFRRSVPRGEAAGAVQELARALAHLLEAERQERARAEAQEAEDQQARVLAQLLRVWGAPRNSDPALGLDDDP

SEQ ID NO: 882997 - protein, 96 aa, Homo sapiens
RAQPQSAAASPARPGTAHLPASPPVRSPARWGSMAGSPLLWGPRAGGVGLLVLLLLGLFRPPPALCARPVKEPRGLSAASPPLAETGAPRRPRCGL

SEQ ID NO: 882998 - protein, 174 aa, Homo sapiens
EKPFECKECGKAFSIRKDLIRHFNIHTGEKPYECLQCGKAFTRMSGLTRHQWIHTGEKPYVCIQCGKAFCRTTNLIRHFSIHTGEKPYECVECGKAFNRRSPLTRHQRIHTAEKSHEPIQSGNVSCESTDLIQHSIIHTESSPVSAVNMETPSIAAHSSSLDINGFIVEETLPL

SEQ ID NO: 882999 - protein, 83 aa, Homo sapiens
GIAELVGTKETEAIGCKTTDSSEAGTTDGGGQVTIDPISGMDDPGVTTTRNTDKNLTIPSNMDIMVTTSGLLTVTTDRNVGSF

SEQ ID NO: 883000 - protein, 75 aa, Homo sapiens
NSRAGGNQRNRGNRLQDNRQFRGRDNRWGWPSDNRSNQWHGRSWGNNYPQHRQEPYYPQQYGHYGYNQRPPYGYY

SEQ ID NO: 883001 - protein, 97 aa, Homo sapiens
ERRLLGGGWANGDLRLGVSRCPGWVPPAGGGARPHSPVPVAPLSRGAQHSASSSQSAQSADVPMVPAWMVPPPPPPPPFAPHDKLPALPKGGRRLQA

SEQ ID NO: 883002 - protein, 251 aa, Homo sapiens
LSWEAGRIIGWGKPTRGRGRGGSLSTRGRGSEVPDSAHLAPTPLFSESGCCGLRSRFLTDCKMEEGGNLGGLIKMVHLLVLSGAWGMQMWVTFVSGFLLFRSLPRHTFGLVQSKLFPFYFHISMGCAFINLCILASQHAWAQLTFWEASQLYLLFLSLTLATVNARWLEPRTTAAMWALQTVEKERGLGGEVPGSHQGPDPYRQLREKDPKYSALRQNFFRYHGLSSLCNLGCVLSNGLCLAGLALEIRSL

SEQ ID NO: 883003 - protein, 189 aa, Homo sapiens
MEEGGNLGGLIKMVHLLVLSGAWGMQMWVTFVSGFLLFRSLPRHTFGLVQSKLFPFYFHISMGCAFINLCILASQHAWAQLTFWEASQLYLLFLSLTLATVNARWLEPRTTAAMWALQTVEKERGLGGEVPGSHQGPDPYRQLREKDPKYSALRQNFFRYHGLSSLCNLGCVLSNGLCLAGLALEIRSL

SEQ ID NO: 883004 - protein, 189 aa, Homo sapiens; identical to SEQ ID NO: 883003

SEQ ID NO: 883005 - protein, 189 aa, Homo sapiens; identical to SEQ ID NO: 883003

SEQ ID NO: 883006 - protein, 251 aa, Homo sapiens; identical to SEQ ID NO: 883002

SEQ ID NO: 883007 - protein, 172 aa, Homo sapiens
MEEGGNLGGLIKMVHLLVLSGAWGMQMWVTFVSGFLLFRSLPRHTFGLVQSKLFPFYFHISMGCAFINLCILASQHAWAQLTFWEASQLYLLFLSLTLATVNARWLEPRTTAAMWALQTVEKERGLGGEVPGSHQGPDPYRQLREKDPKYRGPGIFRNKGGPLGRGARPGPS

SEQ ID NO: 883008 - protein, 221 aa, Homo sapiens
LSWEAGRIIGWGKPTRGRGRGGSLSTRGRGSEVPDSAHLAPTPLFSESGCCGLRSRFLTDCKMEEGGNLGGLIKMVHLLVLSGAWGMQMWVTFVSGFLLFRSLPRHTFGLVQSKLFPFYFHISMGCAFINLCILASQHAWAQLTFWEASQLYLLFLSLTLATVNARWLEPRTTAAMWALQTVEKERGLGGEVPGHPHPGGCGNPPTPPSFVKKKGNPPISQ

SEQ ID NO: 883009 - protein, 184 aa, Homo sapiens
MSWVPGVGMEIRGEPGSALTPLWSPYPAGFLLFRSLPRHTFGLVQSKLFPFYFHISMGCAFINLCILASQHAWAQLTFWEASQLYLLFLSLTLATVNARWLEPRTTAAMWALQTVEKERGLGGEVPGSHQGPDPYRQLREKDPKYSALRQNFFRYHGLSSLCNLGCVLSNGLCLAGLALEIRSL

SEQ ID NO: 883010 - protein, 251 aa, Homo sapiens; identical to SEQ ID NO: 883002

SEQ ID NO: 883011 - protein, 151 aa, Homo sapiens
MEEGGNLGGLIKMVHLLVLSGAWGMQMWVTFVSGFLLFRSLPRHTFGLVQSKLFPFYFHISMGCAFINLCILASQHAWAQLTFWEASQLYLLFLSLTLATVNARWVGRYQAATRVPIPTASCERRTPSTVLSARISSATMGCPLFAIWAAS

SEQ ID NO: 883012 - protein, 337 aa, Homo sapiens
QSPGARGRQAGVALPWEGLHPHTQVSGLLTPQLQEPDVWSPSRGQPVSLHLREKGAPEVKEMAWWKAWIEQEGVTVKSSSHFNPDPDAETLYKAMKGIGVGSQLLSHQAAAFAFPSSALTSVSPWGQQGHLCCNPAGTNEQAIIDVLTKRSNTQRQQIAKSFKAQFGKDLTETLKSELSGKFERLIVALMYPPYRYEAKELHDAMKGSRDDVSSFVDPALALQDAQDLYAAGEKIRGTDEMKFITILCTRSATHLLRVKCTQNLHSYFAERLYYAMKGAGTRDGTLIRNIVSRSEIDLNLIKCHFKKMYGKTLSSMIMEDTSGDYKNALLSLVGSDP

SEQ ID NO: 883013 - protein, 364 aa, Homo sapiens [sequence omitted]

SEQ ID NO: 883014 - protein, 270 aa, Homo sapiens
MASRGVVGIFFLSAVPLVCLELRRGIPDIGIKDFLLLCGRILLLLALLTLIISVTTSWLNSFKSPQVYLKEEEEKNEKRQKLVRKKQQEAQGEKASRYIENVLKPHQEMKLRKLEERFYQMTGEAWKLSSGHKLGGDEGTSQTSFETSNREAAKSQNLPKPLTEFPSPAEQPTCKEIPDLPEEPSQTAEEVVTVALRCPSGNVLRRRFLKSYSSQVLFDWMTRIGYHISLYSLSTSFPRRPLAVEGGQSLEDIGITVDTVLILEEKEQTN

SEQ ID NO: 883015 - protein, 162 aa, Homo sapiens
MKLRKLEERFYQMTGEAWKLSSGHKLGGDEGTSQTSFETSNREAAKSQNLPKPLTEFPSPAEQPTCKEIPDLPEEPSQTAEEVVTVALRCPSGNVLRRRFLKSYSSQVLFDWMTRIGYHISLYSLSTSFPRRPLAVEGGQSLEDIGITVDTVLILEEKEQTN

SEQ ID NO: 883016 - protein, 238 aa, Homo sapiens
PPAPGASATMASRGVVGIFFLSAVPLVCLELRRGIPDIGIKDFLLLCGRILLLLALLTLIISVTTSWLNSFKSPQVYLKEEEEKNEKRQKLVRKKQQEAQGEKGDEGTSQTSFETSNREAAKSQNLPKPLTEFPSPAEQPTCKEIPDLPEEPSQTAEEVVTVALRCPSGNVLRRRFLKSYSSQVLFDWMTRIGYHISLYSLSTSFPRRPLAVEGGQSLEDIGITVDTVLILEEKEQTN

SEQ ID NO: 883017 - protein, 238 aa, Homo sapiens
PPAPGASATMASRGVVGIFFLSAVPLVCLELRRGIPDIEEEEKNEKRQKLVRKKQQEAQGEKASRYIENVLKPHQEMKLRKLEERFYQMTGEAWKLSSGHKLGGDEGTSQTSFETSNREAAKSQNLPKPLTEFPSPAEQPTCKEIPDLPEEPSQTAEEVVTVALRCPSGNVLRRRFLKSYSSQVLFDWMTRIGYHISLYSLSTSFPRRPLAVEGGQSLEDIGITVDTVLILEEKEQTN

SEQ ID NO: 883018 - protein, 162 aa, Homo sapiens; identical to SEQ ID NO: 883015

SEQ ID NO: 883019 - protein, 162 aa, Homo sapiens; identical to SEQ ID NO: 883015

SEQ ID NO: 883020 - protein, 162 aa, Homo sapiens; identical to SEQ ID NO: 883015

SEQ ID NO: 883021 - protein, 241 aa, Homo sapiens [sequence omitted]

SEQ ID NO: 883022 - protein, 304 aa, Homo sapiens
LELHLLLGGRTWRAARAADGCEALGTGVLMANFKGHALPGSFFLIIGLCWSVKYPLKYFSHTRKNSPLHYYQRLEIVEAAIRTLFSVTGILAEQFVPDGPHLHLYHENHWIKLMNWQHSTMYLFFAVSGIVDMLTYLVSHVPLGVDRLVMAVAVFMEGFLFYYHVHNRPPLDQHIHSLLLYALFGGCVSISLEVIFRDHIVLELFRTSLIILQGTWFWQIGFVLFPPFGTPEWDQKDDANLMFITMCFCWHYLAALSIVAVNYSLVYCLLTRMKRHGRGEIIGIQKLNSDDTYQTALLSGSDEE

SEQ ID NO: 883023 - protein, 304 aa, Homo sapiens; identical to SEQ ID NO: 883022

SEQ ID NO: 883024 - protein, 275 aa, Homo sapiens
MANFKGHALPGSFFLIIGLCWSVKYPLKYFSHTRKNSPLHYYQRLEIVEAAIRTLFSVTGILAEQFVPDGPHLHLYHENHWIKLMNWQHSTMYLFFAVSGIVDMLTYLVSHVPLGVDRLVMAVAVFMEGFLFYYHVHNRPPLDQHIHSLLLYALFGGCVSISLEVIFRDHIVLELFRTSLIILQGTWFWQIGFVLFPPFGTPEWDQKDDANLMFITMCFCWHYLAALSIVAVNYSLVYCLLTRMKRHGRGEIIGIQKLNSDDTYQTALLSGSDEE

SEQ ID NO: 883025 - protein, 304 aa, Homo sapiens; identical to SEQ ID NO: 883022

SEQ ID NO: 883026 - protein, 266 aa, Homo sapiens
MANFKGHALPGSFFLIIGLCWSVKYPLKYFSHTRKNSPLHYYQRLEIVEAAIRTLFSVTGILAEQFVPDGPHLHLYHENHWIKLMNWQHSTMYLFFAVSGIVDMLTYLVSHVPLGVDRLVMAVAVFMEGFLFYYHVHNRPPLDQHIHSLLLYALFGGCVSISLEVIFRDHIVLELFRTSLIILQGTWFWQIGFVLFPPFGTPEWDQKDDANLMFITMCFCWHYLAALSIVAVNYSLVYCFLTSDEETRKVGHSSLFHLSWFEFRGC

SEQ ID NO: 883027 - protein, 66 aa, Homo sapiens
TLTQQHSLGNPGDRAQPWGHGSSRVFLRGLPISLLSPLPGGACSSCLLEGSLEGLLGALKPFPSTL

SEQ ID NO: 883028 - protein, 241 aa, Homo sapiens
MFARGLKRKCVGHEEDVEGALAGLKTVSSYSLQRQSLLDMSLVKLQLCHMLVEPNLCRSVLIANTVRQIQEEMTQDGTWRTVAPQAAERAPLDRLVSTEILCRAAWGQEGAHPAPGLGDGHTQGPVSDLCPVTSAQAPRHLQSSAWEMDGPRENRGSFHKSLDQIFETLETKNPSCMEELFSDVDSPYYDLDTVLTGMMGGARPGPCEGLEGLAPATPGPSSSCKSDLGELDHVVEILVET

SEQ ID NO: 883029 - protein, 241 aa, Homo sapiens; identical to SEQ ID NO: 883028

SEQ ID NO: 883030 - protein, 241 aa, Homo sapiens; identical to SEQ ID NO: 883028

SEQ ID NO: 883031 - protein, 241 aa, Homo sapiens; identical to SEQ ID NO: 883028

SEQ ID NO: 883032 - protein, 260 aa, Homo sapiens
ARTAGRGARLATQAGPWDTMFARGLKRKCVGHEEDVEGALAGLKTVSSYSLQRQSLLDMSLVKLQLCHMLVEPNLCRSVLIANTVRQIQEEMTQDGTWRTVAPQAAERAPLDRLVSTEILCRAAWGQEGAHPAPGLGDGHTQGPVSDLCPVTSAQAPRHLQSSAWEMDGPRENRGSFHKSLDQIFETLETKNPSCMEELFSDVDSPYYDLDTVLTGMMGGARPGPCEGLEGLAPATPGPSSSCKSDLGELDHVVEILVET

SEQ ID NO: 883033 - protein, 254 aa, Homo sapiens
NLRLQYRPGGNDTMFARGLKRKCVGHEEDVEGALAGLKTVSSYSLQRQSLLDMSLVKLQLCHMLVEPNLCRSVLIANTVRQIQEEMTQDGTWRTVAPQAAERAPLDRLVSTEILCRAAWGQEGAHPAPGLGDGHTQGPVSDLCPVTSAQAPRHLQSSAWEMDGPRENRGSFHKSLDQIFETLETKNPSCMEELFSDVDSPYYDLDTVLTGMMGGARPGPCEGLEGLAPATPGPSSSCKSDLGELDHVVEILVET

SEQ ID NO: 883034 - protein, 212 aa, Homo sapiens
HPAPGLDGGRLAGSGHNVCTRTEEEMCWPRGRRGGSPGRLEDSVLIQPAAAVAPGHVSGEVAALPHACGAQSVPLSPHCQHGPADPGLGDGHTQGPVSDLCPVTSAQAPRHLQSSAWEMDGPRENRGSFHKSLDQIFETLETKNPSCMEELFSDVDSPYYDLDTVLTGMMGGARPGPCEGLEGLAPATPGPSSSCKSDLGELDHVVEILVET

SEQ ID NO: 883035 - protein, 77 aa, Homo sapiens
IAARLQMSERSILSRLASKGTEPHPTEESVDALSVGGARPGPCEGLEGLAPATPGPSSSCKSDLGELDHVVEILVET

SEQ ID NO: 883036 - protein, 81 aa, Homo sapiens
HLVSKMKIKRENMILQKLRWLPGDHLLLKAQFWTTDPGLPALPGGAQGSDPHPLQGAFLGGAAPAPSLRPPPNLLPCVLLL

SEQ ID NO: 883037 - protein, 181 aa, Homo sapiens
GGVCVCARTPAIKAAGLRGCSLLVFTGGGPVGTHGRESGSHVVRSPLCSGDPRRSCSTAQKPLPTGSGPPDTDPTGRPGSQRTQAGAPHHLTVSRTQAVCPGATSHQLWSVQGERGGLLGAWRGEGLLQSRERGCSLGDVGGHGCGGGRRRTLRGVVGGGGSRVREQVESLEGQDQDAAGL

SEQ ID NO: 883038 - protein, 181 aa, Homo sapiens; identical to SEQ ID NO: 883037

SEQ ID NO: 883039 - protein, 206 aa, Homo sapiens
GGVCVCARTPAIKAAGLRGCSLLVFTGGGPVGTHGRESGSHVVRSPLCSGDPRRSCSTAQKPLPTGSGPPDTDPTGRPGSQRTQAGAPHHLTFDTVNLSEQSRGHGHRWELGAKRRPGLPAVPLHLPTDCTRQLGPAGQAAAGGRFCPVLGFLVSTSCGPWASTCPWPAVLCWRRDSLVPRVDGAAVTAQSWAGEARCVLLFFSDC

SEQ ID NO: 883040 - protein, 181 aa, Homo sapiens; identical to SEQ ID NO: 883037

SEQ ID NO: 883041 - protein, 181 aa, Homo sapiens; identical to SEQ ID NO: 883037

SEQ ID NO: 883042 - protein, 583 aa, Homo sapiens [sequence omitted]

SEQ ID NO: 883043 - protein, 583 aa, Homo sapiens [sequence omitted]

SEQ ID NO: 883044 - protein, 583 aa, Homo sapiens [sequence omitted]

SEQ ID NO: 883045 - protein, 614 aa, Homo sapiens
MEVAANCSLRVKRPLLDPRFEGYKLSLEPLPCYQLELDAAVAEVKLRDDQYTLEHMHAFGMYNYLHCDSWYQDSVYYIDTLGRIMNLTVMLILKYLNHSIGYCTHLSDVIIRLLATSVMYNQDTALGKPREVFRLPTDLTACDNRLCASIHFSSSTWVTLSDGTGRLYVIGTGERGNSASEKWEIMFNEELGDPFIIIHSISLLNAEEHSIATLLLRIEKEELDMKGSGFYVSLEWVTISKKNQDNKKYEIIKRDILRGKSVPHYAAIEPDGNGLMIVSYKSFTFVQAGQDLEENMDEDISEKIKEPLYYWQQTEDDLTVTIRLPEDSTKEDIQIQFLPDHINIVLKDHQFLEGKLYSSIDHESSTWIIKESNSLEISLIKKNEGLTWPELVIGDKQGELIRDSAQCAAIAERLMHLTSEELNPNPDKEKPPCNAQELEECDIFFEESSSLCRFDGNTLKTTHVVNLGSNQYLFSVIVDPKEMPCFCLRHDVDALLWQPHSSKQDDMWEHIATFNALGYVQASKRDKKFFACAPNYSYAALCECLRRVFIYRQPAPMSTVLYNRKEGRQVGQVAKQQVASLETNDPILGFQATNERLFVLTTKNLFLIKVNTEN

SEQ ID NO: 883046 - protein, 583 aa, Homo sapiens [sequence omitted]

SEQ ID NO: 883047 - protein, 236 aa, Homo sapiens
MILLVIGLQFIFNYCCNLKIFKDEETHSLVYLFYLFTYFIFWTKNPNPDKEKPPCNAQELEECDIFFEESSSLCRFDGNTLKTTHVVNLGSNQYLFSVIVDPKEMPCFCLRHDVDALLWQPHSSKQDDMWEHIATFNALGYVQASKRDKKFFACAPNYSYAALCECLRRVFIYRQPAPMSTVLYNRKEGRQVGQVAKQQVASLETNDPILGFQATNERLFVLTTKNLFLIKVNTEN

SEQ ID NO: 883048 - protein, 470 aa, Homo sapiens
MEVAANCSLRVKRPLLDPRFEGYKLSLEPLPCYQLELDAAVAEVKLRDDQYTLEHMHAFGMYNYLHCDSWYQDSVYYIDTLGRIMNLTVMLDTALGKPREVFRLPTDLTACDNRLCASIHFSSSTWVTLSDGTGRLYVIGTGERGNSASEKWEIMFNEELGDPFIIIHSISLLNAEEHSIATLLLRIEKEELDMKGSGFYVSLEWVTISKKNQDNKKYEIIKRDILRGKSVPHYAAIEPDGNGLMIVSYKSFTFVQAGQDLEENMDEDISEKIKEPLYYWQQTEDDLTVTIRLPEDSTKEDIQIQFLPDHINIVLKDHQFLEGKLYSSIDHESSTWIIKESNSLEISLIKKNEGLTWPELVIGDKQGELIRDSAQCAAIAERLMHLTSEELNPNPDKEKPPCNAQELEECDIFFEESSSLCRFDGNTLKTTHVVNLGSNQYFFILFMISSCFSLASSYLSAKRSAISGGF

SEQ ID NO: 883049 - protein, 164 aa, Homo sapiens
MEVAANCSLRVKRPLLDPRFEGYKLSLEPLPCYQLELDAAVAEVKLRDDQYTLEHMHAFGMYNYLHCDSWYQDSVYYIDTLGRIMNLTVMLDTALGKPREVFRLPTDLTACETNLVFLVAISLIFPPPKNFFLFPPFSPKIFFSPPFFFFPPFKPLGLPCQMEL

SEQ ID NO: 883050 - protein, 620 aa, Homo sapiens
RCESPLLGRRRAPAPLGRLARLARPGLAGREQLGGPRAPRRTMRPALGHPRSVSSASGSFPPPPAAARLQPLFLRGGSFRGRRGSGDSSTSTSTSRGGGGGRRGGGGGSPSSSTGAEREDDDESLSVSKPLVPNAALLGPPAQVGAPAGPAPVAFSSSAATSSSTSTPTSSCSMTAADFGGGAAAGAVGGPGSRSAGGAGGTGTGSGASCCPCCCCCGCPDRPGRRGRRRGCAPSPRCRWGYQALSVVLLLAQGGLLDLYLIAVTDLYWCSWIATDLVVVVGWAIFFAKNSRGRRGGAASGAHNHHLHHHHAAPPLHLPAPSAATAGAKARGARGGAGGAGGGLGAAAAAGEFAFAYLAWLIYSIAFTPKVVLILGTSILDLIELRAPFGTTGFRLTMALSVPLLYSLVRAISEAGAPPGSAGPLLLQPQRHRAAGCFLGTCLDLLDSFTLVELMLEGRVPLPAHLRYLLIAVYFLTLASPVLWLYELNAAAAAAASWGQASGPGSCSRLLRLLGGCLVDVPLLALRCLLVVSYQQPLSIFMLKNLFFLGCRGLEALEGCWDRGNRASPSRARGGYGAPPSAPPPPPPPPQGGSQLGHCISENEGGAHGYVNTLAVASQN

SEQ ID NO: 883051 - protein, 214 aa, Homo sapiens
MASHEVDNAELGSASAHGTPGSEAGPEELNTSVYQPIDGSPDYQKAKLQVLGAIQILNAAMILALGVFLGSLQYPYHFQKHFFFFTFYTGYPIWGAVFFCSSGTLSVVAGIKPTRTWIQNSFGMNIASATIALVGTAFLSLNIAVNIQSLRSCHSSSESPDLCNYMGSISNGMVSLLLILTLLELCVTISTIAMWCNANCCNSREEISSPPNSV

SEQ ID NO: 883052 - protein, 167 aa, Homo sapiens
SKVLHKAKITLSLWRLPLSGKDAVVIFSECLLLATRWTWEESRLPKPEASKFCSSGTLSVVAGIKPTRTWIQNSFGMNIASATIALVGTAFLSLNIAVNIQSLRSCHSSSESPDLCNYMGSISNGMVSLLLILTLLELCVTISTIAMWCNANCCNSREEISSPPNSV

SEQ ID NO: 883053 - protein, 168 aa, Homo sapiens
MASHEVDNAELGSASAHGTPGSEAGPEELNTSVYQPIDGSPDYQKAKLQVLGFCSSGTLSVVAGIKPTRTWIQNSFGMNIASATIALVGTAFLSLNIAVNIQSLRSCHSSSESPDLCNYMGSISNGMVSLLLILTLLELCVTISTIAMWCNANCCNSREEISSPPNSV

SEQ ID NO: 883054 - protein, 149 aa, Homo sapiens
MASHEVDNAELGSASAHGTPGSEAGPEELNTSVYQPIDGSPDYQKAKLQVLGIQNSFGMNIASATIALVGTAFLSLNIAVNIQSLRSCHSSSESPDLCNYMGSISNGMVSLLLILTLLELCVTISTIAMWCNANCCNSREEISSPPNSV

SEQ ID NO: 883055 - protein, 165 aa, Homo sapiens
MASHEVDNAELGSASAHGTPGSEAGPEELNTSVYQPIDGSPDYQKAKLQVLGAIQILNAAMILALGVFLGSLQYPYHFQKHFFFFTFYTGYPIWGAVFFCSSGTLSVVAGIKPTRTWIQNSFGMNIASATIALVGRHGVSTADSHLAGIMRNHLYHSHVVQCKLL

SEQ ID NO: 883056 - protein, 119 aa, Homo sapiens
MASHEVDNAELGSASAHGTPGSEAGPEELNTSVYQPIDGSPDYQKAKLQVLGAIQILNAAMILALGVFLGSLQYPYHFQKHFFFFTFYTGYPIWGAVFVSIRTPLAICYFLDTTAGDVF

SEQ ID NO: 883057 - protein, 133 aa, Homo sapiens
MQRHKNDTMDFGDSGGKFCSSGTLSVVAGIKPTRTWIQNSFGMNIASATIALVGTAFLSLNIAVNIQSLRSCHSSSESPDLCNYMGSISNGMVSLLLILTLLELCVTISTIAMWCNANCCNSREEISSPPNSV

SEQ ID NO: 883058 - protein, 213 aa, Homo sapiens
SKVLHKAKITLSLWRLPLSGKDAVVIFSECLLLATRWTWEESRLPKPEASKAIQILNAAMILALGVFLGSLQYPYHFQKHFFFFTFYTGYPIWGAVFFCSSGTLSVVAGIKPTRTWIQNSFGMNIASATIALVGTAFLSLNIAVNIQSLRSCHSSSESPDLCNYMGSISNGMVSLLLILTLLELCVTISTIAMWCNANCCNSREEISSPPNSV

SEQ ID NO: 883059 - protein, 133 aa, Homo sapiens
SKVLHKAKITLSLWRLPLSGKDAVVIFSECLLLATRWTWEESRLPKPEASKFCSSGTLSVVAGIKPTRTWIQNSFGMNIASATIALVGTAFLSLNIAVNIQSLRSCHSSSESPDLCNYMGSISNEISSPPNSV

SEQ ID NO: 883060 - protein, 151 aa, Homo sapiens
MFSTKALLLAGLISTALAGPWANICAGKSSNEIRTCDRHGCGQYSAQRSQRPHQGVDVLCSAGSTVYAPFTGMIVGQEKPYQNKNAINNGVRISGRGFCVKMFYIKPIKYKGPIKKGEKLGTLLPLQKVYPGIQSHVHIENCDSSDPTAYL

SEQ ID NO: 883061 - protein, 192 aa, Homo sapiens
ESGNKILEGRSSHKYIKSRENYSENRIVRINCVTDKANGDRKCLRPGALLSLFSFLALAGPWANICAGKSSNEIRTCDRHGCGQYSAQRSQRPHQGVDVLCSAGSTVYAPFTGMIVGQEKPYQNKNAINNGVRISGRGFCVKMFYIKPIKYKGPIKKGEKLGTLLPLQKVYPGIQSHVHIENCDSSDPTAYL

SEQ ID NO: 883062 - protein, 181 aa, Homo sapiens
ESGNKILEGRSSHKYIKSRENYSENRIVRINCVTDKANGDRKCLRPGALLSLFSFLALAGPWANICAGKSSNEIRTCDRHGCGQYSAQRSQRPHQGVDVLCSAGSTVYAPFTGMIVGQEKPYQNKNAINNGVRISGRALKNVTHHQMKHEDSYSSLGVLECHYYWPQESSMKDHPLVYLQF

SEQ ID NO: 883063 - protein, 473 aa, Homo sapiens
MAQLEGYYFSAALSCTFLVSCLLFSAFSRALREPYMDEIFHLPQAQRYCEGHFSLSQWDPMITTLPGLYLVSIGVIKPAIWIFGWSEHVVCSIGMLRFVNLLFSVGNFYLLYLLFCKVQPRNKAASSIQRVLSTLTLAVFPTLYFFNFLYYTEAGSMFFTLFAYLMCLYGNHKTSAFLGFCGFMFRQTNIIWAVFCAGNVIAQKLTEAWKTELQKKEDRLPPIKGPFAEFRKILQFLLAYSMSFKNLSMLLLLTWPYILLGFLFCAFVVVNGGIVIGDRSSHEACLHFPQLFYFFSFTLFFSFPHLLSPSKIKTFLSLVWKRRILFFVVTLVSVFLVWKFTYAHKYLLADNRHYTFYVWKRVFQRYETVKYLLVPAYIFAGWSIADSLKSKSIFWNLMFFICLFTVIVPQKLLEFRYFILPYVIYRLNIPLPPTSRLICELSCYAVVNFITFFIFLNKTFQWPNSQDIQRFMW

SEQ ID NO: 883064 - protein, 473 aa, Homo sapiens; identical to SEQ ID NO: 883063

SEQ ID NO: 883065 - protein, 538 aa, Homo sapiens
LLPGAEPAAHCYCGHQFGQFAGQLGDGAAMYLGEVCTANGERWELQLKGAGPTPFSRQADGRKVLRSSIREFLCSEAMFHLGVPTTRAGACVTSESTVVRDVFYDGNPKYEQCTVVLRVASTFIRFGSFEIFKSADEHTGRAGPSVGRNDIRVQLLDYVISSFYPEIQAAHASDSVQRNAAFFREVTRRTARMVAEWQCVGFCHGVLNTDNMSILGLTIDYGPFGFLDRYDPDHVCNASDNTGRYAYSKQPEVCRWNLRKLAEALQPELPLELGEAILAEEFDAEFQRHYLQKMRRKLGLVQVELEEDGALVSKLLETMHLTGADFTNTFYLLSSFPVELESPGLAEFLARLMEQCASLEELRLAFRPQMDPRQLSMMLMLAQSNPQLFALMGTRAGIARELERVEQQSRLEQLSAAELQSRNQGHWADWLQAYRARLDKDLEGAGDAAAWQAEHVRVMHANNPKYVLRNYIAQNAIEAAERGDFSEVRRVLKLLETPYHCEAGAATDAEATEADGADGRQRSYSSKPPLWAAELCVT

SEQ ID NO: 883066 - protein, 483 aa, Homo sapiens [sequence omitted]

SEQ ID NO: 883067 - protein, 346 aa, Homo sapiens [sequence omitted]

SEQ ID NO: 883068 - protein, 375 aa, Homo sapiens [sequence omitted]

SEQ ID NO: 883069 - protein, 160 aa, Homo sapiens
LLPGAEPAAHCYCGHQFGQFAGQLGDGAAMYLGEVCTANGERWELQLKGAGPTPFSRKKMLICYNTDEPGGRGAVKKLVTERQILGDPTYMRQADGRKVLRSSIREFLCSEAMFHLGVPTTRAGACVTSESTVVRDVFYDGNPKYEQCTVVLRVASTFIR

SEQ ID NO: 883070 - protein, 499 aa, Homo sapiens
MRQADGRKVLRSSIREFLCSEAMFHLGVPTTRAGACVTSESTVVRDVFYDGNPKYEQCTVVLRVASTFIRGWGQVWPVDASGLPSRFGSFEIFKSADEHTGRAGPSVGRNDIRVQLLDYVISSFYPEIQAAHASDSVQRNAAFFREVTRRTARMVAEWQCVGFCHGVLNTDNMSILGLTIDYGPFGFLDRYDPDHVCNASDNTGRYAYSKQPEVCRWNLRKLAEALQPELPLELGEAILAEEFDAEFQRHYLQKMRRKLGLVQVELEEDGALVSKLLETMHLTGADFTNTFYLLSSFPVELESPGLAEFLARLMEQCASLEELRLAFRPQMDPRQLSMMLMLAQSNPQLFALMGTRAGIARELERVEQQSRLEQLSAAELQSRNQGHWADWLQAYRARLDKDLEGAGDAAAWQAEHVRVMHANNPKYVLRNYIAQNAIEAAERGDFSEVRRVLKLLETPYHCEAGAATDAEATEADGADGRQRSYSSKPPLWAAELCVT

SEQ ID NO: 883071 - protein, 610 aa, Homo sapiens
LLPGAEPAAHCYCGHQFGQFAGQLGDGAAMYLGEVCTANGERWELQLKGAGPTPFSRQADGRKVLRSSIREFLCSEAMFHLGVPTTRAGACVTSESTVVRDVFYDGNPKYEQCTVVLRVASTFIRFGSFEIFKSADEHTGRAGPSVGRNDIRVQLLDYVISSFYPEIQAAHASDSVQRNAAFFREVTRRTARMVAEWQCVGFCHGVLNTDNMSILGLTIDYGPFGFLDRYDPDHVCNASDNTGRYAYSKQPEVCRWNLRKLAEALQPELPLELGEAILAEEFDAEFQRHYLQKMRRKLGLVQVELEEDGALVSKLLETMHLTGTQHGSILLNCGGHRTSQLTQEQCCTAEPWSLFTSATQTLCEPVTSSPFPSLQPLVATTPLRVCEPDCSKPFSADFTNTFYLLSSFPVELESPGLAEFLARLMEQCASLEELRLAFRPQMDPRQLSMMLMLAQSNPQLFALMGTRAGIARELERVEQQSRLEQLSAAELQSRNQGHWADWLQAYRARLDKDLEGAGDAAAWQAEHVRVMHANNPKYVLRNYIAQNAIEAAERGDFSEVRRVLKLLETPYHCEAGAATDAEATEADGADGRQRSYSSKPPLWAAELCVT

SEQ ID NO: 883072 - protein, 642 aa, Homo sapiens
LLPGAEPAAHCYCGHQFGQFAGQLGDGAAMYLGEVCTANGERWELQLKGAGPTPFSRQADGRKVLRSSIREFLCSEAMFHLGVPTTRAGACVTSESTVVRDVFYDGNPKYEQCTVVLRVASTFIRFGSFEIFKSADEHTGRAGPSVGRNDIRVQLLDYVISSFYPEIQAAHASDSVQRNAAFFREVTRRTARMVAEWQCVGFCHGVLNTDNMSILGLTIDYGPFGFLDRYDPDHVCNASDNTGRYAYSKQPEVCRWNLRKLAEALQPELPLELGEAILAEEFDAEFQRHYLQKMRRKLGLVQVELEEDGALVSKLLETMHLTGTQHGSILLNCGGHRTSQLTQEQCCTAEPWSLFTSATQTLCEPVTSSPFPSLQPLVATTPLRVCEPDCSKPFSADFTNTFYLLSSFPVELESPGLAEFLARLMEQCASLEELRLAFRPQMDPRQLSMMLMLAQSNPQLFALMGTRAGIARELERVEQQSRLEQLSAAELQSRNQGHWADWLQAYSVSPASMVTGGRRVACWKKSSPAVTPEPGCHSRARLDKDLEGAGDAAAWQAEHVRVMHANNPKYVLRNYIAQNAIEAAERGDFSEVRRVLKLLETPYHCEAGAATDAEATEADGADGRQRSYSSKPPLWAAELCVT

SEQ ID NO: 883073 - protein, 75 aa, Homo sapiens
NSVFGFRQADGRKVLRSSIREFLCSEAMFHLGVPTTRAGACVTSESTVVRDVFYDGNPKYEQCTVVLRVASTFIR

SEQ ID NO: 883074 - protein, 89 aa, Homo sapiens
VLDSPSSLFPTPIRPRVCNKTNDDTIDFDYTVLLHELSTQEIIPCRIHLVWYPGKPLKVKYHCQELQTPEEASGTEEGSAVVPTELSNF

SEQ ID NO: 883075 - protein, 240 aa, Homo sapiens
PRPGCRANFPASMQPRRQRLPAPWSGPRGPRPTAPLLALLLLLAPVAAPAGSGDPDDPGQPQDAGVPRRLLQQAARAALHFFNFRSGSPSALRVLAEVQEGRAWINPKEGCKVHVVFSTERYNPESLLQEGEGRLGKCSARVFFKNQKPRPTINVTCTRLIEKKKRQQEDYLLYKQMKQLKNPLEIVSIPDNHGHIDPSLRLIWDLAFLGSSYVMWEMTTQVSHYYLAQLTSVRQWVRKT

SEQ ID NO: 883076 - protein, 306 aa, Homo sapiens
PRPGCRANFPASMQPRRQRLPAPWSGPRGPRPTAPLLALLLLLAPVAAPAGSGDPDDPGQPQDAGVPRRLLQQAARAALHFFNFRSGSPSALRVLAEVQEGRAWINPKEGCKVHVVFSTERYNPESLLQEGEGRLGKCSARVFFKNQKPRPTINVTCTRLIEKKKRQQEDYLLYKQMKQLKNPLEIVSIPDNHGHIDPSLRLIWDLAFLGSSYVMWEMTTQVSHYYLAQLTSVRQWKTNDDTIDFDYTVLLHELSTQEIIPCRIHLVWYPGKPLKVKYHCQELQTPEEASGTEEGSAVVPTELSNF

SEQ ID NO: 883077 - protein, 198 aa, Homo sapiens
MTHRNLFINLVIETLGMVYFWPFQMKANYFCWVLWTGFDDPSIGINVTCTRLIEKKKRQQEDYLLYKQMKQLKNPLEIVSIPDNHGHIDPSLRLIWDLAFLGSSYVMWEMTTQVSHYYLAQLTSVRQWKTNDDTIDFDYTVLLHELSTQEIIPCRIHLVWYPGKPLKVKYHCQELQTPEEASGTEEGSAVVPTELSNF

SEQ ID NO: 883078 - protein, 88 aa, Homo sapiens
NVVLTYIERDATIRIIMNKTNDDTIDFDYTVLLHELSTQEIIPCRIHLVWYPGKPLKVKYHCQELQTPEEASGTEEGSAVVPTELSNF

SEQ ID NO: 883079 - protein, 87 aa, Homo sapiens
MGAEGLGTTARGRLNCSKTNDDTIDFDYTVLLHELSTQEIIPCRIHLVWYPGKPLKVKYHCQELQTPEEASGTEEGSAVVPTELSNF

SEQ ID NO: 883080 - protein, 260 aa, Homo sapiens
PRPGCRANFPASMQPRRQRLPAPWSGPRGPRPTAPLLALLLLLAPVAAPAGSGDPDDPGQPQDAGVPRRLLQQAARAALHFFNFRSGSPSALRVLAEVQEGRAWINPKEGCKVHVVFSTERYNPESLLQEGEGRLGKCSARVFFKNQKPRPTINVTCTRLIEKKKRQQEDYLLYKQMKQLKNPLEIVSIPDNHGHIDPSLRLIWDLAFLGSSYVMWEMTTQVSHYYLAQLTSVRQWTLVSIRKSDRHSTRLSYNSVTRQK

SEQ ID NO: 883081 - protein, 32 aa, Homo sapiens
MWEMTTQVSHYYLAQLTSVRQWNLPIPMTLGE

SEQ ID NO: 883082 - protein, 306 aa, Homo sapiens; identical to SEQ ID NO: 883076

SEQ ID NO: 883083 - protein, 190 aa, Homo sapiens
EDPHRGHVKTASRTFFQVEDVHRNRYKQITYMAQGLAVREMTGMTKFKPYFISATSEILSQKCINTNVLFLSLSDNHGHIDPSLRLIWDLAFLGSSYVMWEMTTQVSHYYLAQLTSVRQWKTNDDTIDFDYTVLLHELSTQEIIPCRIHLVWYPGKPLKVKYHCQELQTPEEASGTEEGSAVVPTELSNF

SEQ ID NO: 883084 - protein, 306 aa, Homo sapiens; identical to SEQ ID NO: 883076

SEQ ID NO: 883085 - protein, 249 aa, Homo sapiens
PRPGCRANFPASMQPRRQRLPAPWSGPRGPRPTAPLLALLLLLAPVAAPAGSGDPDDPGQPQDAGVPRRLLQQAARAALHFFNFRSGSPSALRVLAEVQEGRAWINPKEGCKVHVVFSTERYNPESLLQEGEGRLGKCSARVFFKNQKPRPTINVTCTRLIEKKKRQQEDYLLYKQMKQLKNPLEIVSIPGMNQHLEFLYSGMYVITKSLKERSFKFLSLKWHFHSTKYCGIPHNLNKTQRYHLSVLHL

SEQ ID NO: 883086 - protein, 242 aa, Homo sapiens
SPVYWDIETLGGVFDHNLLIGIPSYSNQEEPGILYCRLMVKRKGKIKVCQGEYERWLDDNKLLGQFTLIGIPPAPRGVPQIEVTFDIDANGIVHVSAKDKGTGREQQIVIQSSGGLSKDDIENMVKNAEKYAEEDRRKKERVEAVNMAEGIIHDTETKMEEFKDQLPADECNKLKEEISKMRELLARKDSETGENIRQAASSLQQASLKLFEMAYKKMASEREGSGSSGTGEQKEDQKEEKQ

SEQ ID NO: 883087 - protein, 129 aa, Homo sapiens
QAPYVLRNEVLHISRGERATITTQMLDIRDDDNPQDVVIEIIDPPLHGQLLQTLQSPATPIYQFQLDELSRGLLHYAHDGSDSTSDVAVLQANDGHSFHNILFQVKTVPQVGVIPRVTVSLHLDVNFYG

SEQ ID NO: 883088 - protein, 78 aa, Homo sapiens
VCPGLETQLADSSSVGGSQTCSWLSWYDSKPGILTSRTGVLLIVHISQQMCEPRPQATQMAGVIRSHVYWFSSAIPGS

SEQ ID NO: 883089 - protein, 100 aa, Homo sapiens
NLAGGSRAGLGLGSMSLRVGARAKRNPWASGDPGGPDQCSLVVGADAWAHCGRLCFQCPLGVSKSNKKRINLWFHRSLQSSNLQCMKAQIPERMASNDQE

SEQ ID NO: 883090 - protein, 93 aa, Homo sapiens
NLAGGSRAGLGLGSMSLRVGARAKRNPWASGDPGGPDQCSLVVGADAWAHCGRAGPEVQLCFQCPLGVSKSNKKRINLWLHKGSEHKVHLTTK

SEQ ID NO: 883091 - protein, 618 aa, Homo sapiens
APHQDPPEAVRNILHPGPLYLFIIVYFVFCIQNQEPEDDPGALAMAVFIILSLFSVLVTGMGEGGAGSEKGGERECKLNQLPHCPSVSPSAQPWTHPGQSQLFADLSREELTAVMRFLTQQLGPGLVDAAQAQPSDNCVFSVELQLPPKAAALAHLDRGSPPPAREALAIVFFGRQPQPNVSELVVGPLPHPSYMRDVTVERHGGPLPYHRRPMLFQEYLDIDQMIFDRELPQASGLLHHCCFYKRRGRNLVTMTTAPRGLQSGDRATYFGLYYNISGAGFFLHHVGLELLVNHKALDPARWTIQKVFYQGRYYDSLAQLEAQFEAGLVNVVLIPDNGTGGSWSLKSPVPPGPAPPLQFHPQGPRFSVQGSRVASSLWTFSFGLGAFSGPRIFDVPFQGERVAYEVSVQAALAIYGGNSPSALRSRYIDSGFGLGHFSTPLTHGVDCPYLATYVDWHFLFESQAAKTIRDAFCIFEQNQGLPLRRHHSDLYSHYFGGLAETVLVIRSVSTMLNYDYVWDMVFHPNGAIEIRLHTTGYISSAFPFGAAQRYGNKVSEHTLGTVHTHSAHFKVDLDVAGKASWQRQKCWRGELKSPCLALKVFVGLGAVAYACKPNTLGD

SEQ ID NO: 883092 - protein, 667 aa, Homo sapiens
APHQDPPEAVRNILHPGPLYLFIIVYFVFCIQNQEPEDDPGALAMAVFIILSLFSVLVTGMGEGGAGSEKGGERECKLNQLPHCPSVSPSAQPWTHPGQSQLFADLSREELTAVMRFLTQQLGPGLVDAAQAQPSDNCVFSVELQLPPKAAALAHLDRGSPPPAREALAIVFFGRQPQPNVSELVVGPLPHPSYMRDVTVERHGGPLPYHRRPMLFQEYLDIDQMIFDRELPQASGLLHHCCFYKRRGRNLVTMTTAPRGLQSGDRATYFGLYYNISGAGFFLHHVGLELLVNHKALDPARWTIQKVFYQGRYYDSLAQLEAQFEAGLVNVVLIPDNGTGGSWSLKSPVPPGPAPPLQFHPQGPRFSVQGSRVASSLWTFSFGLGAFSGPRIFDVPFQGERVAYEVSVQAALAIYGGNSPSALRSRYIDSGFGLGHFSTPLTHGVDCPYLATYVDWHFLFESQAAKTIRDAFCIFEQNQGLPLRRHHSDLYSHYFGGLAETVLVIRSVSTMLNYDYVWDMVFHPNGAIEIRLHTTGYISSAFPFGAAQRYGNKVSEHTLGTVHTHSAHFKVDLDVAGLVAWVTAGFLHIPHAEDIPNTVTVGNSVGFFLRPYNFFDEDPSFYSADSIYFRGDQDAGACEVNPLACLPQAAACAPDLPAFSHGGFSHN

SEQ ID NO: 883093 - protein, 480 aa, Homo sapiens
APHQDPPEAVRNILHPGPLYLFIIVYFVFCIQNQEPEDDPGALAMAVFIILSLFSVLVTGMGEGGAGSEKGGERECKLNQLPHCPSVSPSAQPWTHPGQSQLFADLSREELTAVMRFLTQQLGPGLVDAAQAQPSDNCVFSVELQLPPKAAALAHLDRGSPPPAREALAIVFFGRQPQPNVSELVVGPLPHPSYMRDVTVERHGGPLPYHRRPMLFQEYLDIDQMIFDRELPQASGLLHHCCFYKRRGRNLVTMTTAPRGLQSGDRATYFGLYYNISGAGFFLHHVGLELLVNHKALDPARWTIQKVFYQGRYYDSLAQLEAQFEAGLVNVVLIPDNGTEPGPPLRRHHSDLYSHYFGGLAETVLVIRSVSTMLNYDYVWDMVFHPNGAIEIRLHTTGYISSAFPFGAAQRYGNKVSEHTLGTVHTHSAHFKVDLDVAGKASWQRQKCWRGELKSPCLALKVFVGLGAVAYACKPNTLGD

SEQ ID NO: 883094 - protein, 310 aa, Homo sapiens
ASGKRSRNSDARSPSSSTSPRAAAVAVATDGIVAAVAIFPATTSLPFRTTRGADSELRTGRNRHISGLYAFSSGRLAFPCGRPDYWALARRTIGTGLERKALGLPGSSERPTSVSSYQGTRIRCSNPGGKMRPLTEEETRVMFEKIAKYIGENLQLLVDRPDGTYCFRLHNDRVYYVSEKIMKLAANISGDKLVSLGTCFGKFTKTHKFRLHVTALDYLAPYAKYKVWIKPGAEQSFLYGNHVLKSGLGRITENTSQYQGVVVYSMADIPLGFGVAAKSTQDCRKVDPMAIVVFHQADIGEYVRHEETLT

SEQ ID NO: 883095 - protein, 310 aa, Homo sapiens; identical to SEQ ID NO: 883094

SEQ ID NO: 883096 - protein, 263 aa, Homo sapiens
ASGKRSRNSDARSPSSSTSPRAAAVAVATDGIVAAVAIFPATTSLPFRTTRGADSELRTGRNRHISGLYAFSSGRLAFPCGRPDYWALARRTIGTGLERKALGLPGSSERPTSVSSYQGTRIRCSNPGGKMRPLTEEETRVMFEKIAKYIGENLQLLVDRPDGTYCFRLHNDRVYYVSEKIMKLAANISGDKLVSLGTCFGKFTKTHKFRLHVTALDYLAPYAKGFGVAAKSTQDCRKVDPMAIVVFHQADIGEYVRHEETLT

SEQ ID NO: 883097 - protein, 327 aa, Homo sapiens
ASGKRSRNSDARSPSSSTSPRAAAVAVATDGIVAAVAIFPATTSLPFRTTRGADSELRTGRNRHISGLYAFSSGRLAFPCGRPDYWALARRTIGTGLERKALGLPGSSERPTSVSSYQGTRIRCSNPGGKMRPLTEEETRVMFEKIAKYIGENLQLLVDRPDGTYCFRLHNDRVYYVRLRRGRAGSMDPGERGPGSHEPPSSATLLPLYPFSEKIMKLAANISGDKLVSLGTCFGKFTKTHKFRLHVTALDYLAPYAKYKVWIKPGAEQSFLYGNHVLKSGLGRITENTSQYQGVVVYSMADIPLVSRDGSCYRTQVLLFKKGMSSI

SEQ ID NO: 883098 - protein, 240 aa, Homo sapiens
ASGKRSRNSDARSPSSSTSPRAAAVAVATDGIVAAVAIFPATTSLPFRTTRGADSELRTGRNRHISGLYAFSSGRLAFPCGRPDYWALARRTIGTGLERKALGLPGSSERPTSVSSYQGTRIRCSNPGGKMRPLTEEETRVMFEKIAKYIGENLQLLVDRPDGTYCFRLHNDRVYYVSEKIMKLAANISGDKLVSLGTCFGKFTKTHKFRLHVTALDYLAPYAKVCGAVSNSATGDEVKD

SEQ ID NO: 883099 - protein, 310 aa, Homo sapiens; identical to SEQ ID NO: 883094

SEQ ID NO: 883100 - protein, 275 aa, Homo sapiens
ASGKRSRNSDARSPSSSTSPRAAAVAVATDGIVAAVAIFPATTSLPFRTTRGADSELRTGRNRHISGLYAFSSGRLAFPCGRPDYWALARRTIGTGLERKALGLPGSSERPTSVSSYQGTRIRCSNPGGKMRPLTEEETRVMFEKIAKYIGENLQLLVDRPDGTYCFRLHNDRVYYVSEKIMKLAANISGDKLVSLGTCFGKFTKTHKFRLHVTALDYLAPYAKYKVWIKPGAEQSFLYGNHVLKSGLGRITENTSQYQGVVVYSMADIPLCLFF

SEQ ID NO: 883101 - protein, 699 aa, Homo sapiens
MGIRGLMSFVEDHSNEFFTDLKLRDTKIVIDGYALFHRLCFSSNLDLRYGGDYDSFADVVQKFFESLFACNICPYVVLDGGCDISDKKLTTLKDRAREKIQMAHSLSVGGSGYVCPLLIREVFIQVLIKLRVCFVQCFSEADRDIMTLANHWNCPVLSSDSDFCIFDLKTGFCPLNSFQWRNMNTIKGTQNYIPAKCFSLDAFCHHFSNMNKALLPLFAVLCGNDHVNLPIMETFLSKARLPLGATSSKGRRHHRILGLLNWLSHFANPTEALDNVLKYLPKKDRENVKELLCCSMEEYQQSQVKLQDFFQCGTYVCPDALNLGLPEWVLVALAKGQLSPFISDALVLRRTILPTQVENMQQPNAHRISQPIRQIIYGLLLNASPHLDKTSWNALPPQPLAFSEVERINKNIRTSIIDAVELAKDHSDLSRLTELSLRRRQMLLLETLKVKQTILEPIPTSLKLPIAVSCYWLQHTETKAKLHHLQSLLLTMLVGPLIAIINSPGNVDPVPRQAQCLAPRKLVKGKEELQEDGAKMLYAEFQRVKAQTRLGTRLDLDTAHIFCQWQSCLQMGMYLNQLLSTPLPEPDLTRLYSGSLVHGLCQQLLASTSVESLLSICPEAKQLYEYLFNATRSYAPAEIFLPKGRSNSKKKRQKKQNTSCSKNRGRTTAHTKCWYEGNNRFGLLMVENLEEHSEASNIE

SEQ ID NO: 883102 - protein, 541 aa, Homo sapiens
MGIRGLMSFVEDHSNEFFTDLKLRDTKIVIDGYALFHRLCFSSNLDLRYGGDYDSFADVVQKFFESLFACNICPYVVLDGGCDISDKKLTTLKDRAREKIQMAHSLSVGGSGYVCPLLIREVFIQVLIKLRVCFVQCFSEADRDIMTLANHWNCPVLSSDSDFCIFDLKTGFCPLNSFQWRNMNTIKGTQNYIPAKCFSLDAFCHHFSNMNKALLPLFAVLCGNDHVNLPIMETFLSKARLPLGATSSKGRRHHRILGLLNWLSHFANPTEALDNVLKYLPKKDRENVKELLCCSMEEYQQSQMLLLETLKVKQTILEPIPTSLKLPIAVSCYWLQHTETKAKLHHLQSLLLTMLVGPLIAIINSPGKEELQEDGAKMLYAEFQRVKAQTRLGTRLDLDTAHIFCQWQSCLQMGMYLNQLLSTPLPEPDLTRLYSGSLVHGLCQQLLASTSVESLLSICPEAKQLYEYLFNATRSYAPAEIFLPKGRSNSKKKRQKKQNTSCSKNRGRTTAHTKCWYEGNNRFGLLMVENLEEHSEASNIE

SEQ ID NO: 883103 - protein, 679 aa, Homo sapiens
MGIRGLMSFVEDHSNEFFTDLKLRDTKIVIDGYALFHRLCFSSNLDLRYGGDYDSFADVVQKFFESLFACNICPYVVLDGGCDISDKKLTTLKDRAREKIQMAHSLSVGGSGYVCPLLIREVFIQVLIKLRVCFVQCFSEADRDIMTLANHWNCPVLSSDSDFCIFDLKTGFCPLNSFQWRNMNTIKGTQNYIPAKCFSLDAFCHHFSNMNKALLPLFAVLCGNDHVNLPIMETFLSKARLPLGATSSKGRRHHRILGLLNWLSHFANPTEALDNVLKYLPKKDRENVKELLCCSMEEYQQSQVKLQDFFQCGTYVCPDALNLGLPEWVLVALAKGQLSPFISDALVLRRTILPTQVENMQQPNAHRISQPIRQIIYGLLLNASPHLDKTSWNALPPQPLAFSEVERINKNIRTSIIDAVELAKDHSDLSRLTELSLRRRQMLLLETLKVKQTILEPIPTSLKLPIAVSCYWLQHTETKAKLHHLQSLLLTMLVGPLIAIINSPGKEELQEDGAKMLYAEFQRVKAQTRLGTRLDLDTAHIFCQWQSCLQMGMYLNQLLSTPLPEPDLTRLYSGSLVHGLCQQLLASTSVESLLSICPEAKQLYEYLFNATRSYAPAEIFLPKGRSNSKKKRQKKQNTSCSKNRGRTTAHTKCWYEGNNRFGLLMVENLEEHSEASNIE

SEQ ID NO: 883104 - protein, 570 aa, Homo sapiens [sequence omitted]

SEQ ID NO: 883105 - protein, 87 aa, Homo sapiens
LVLNSQPQVICPPRTPKVLGLQATTSGLPNPSKTRVKKLLKRKEKQQRSFSALKQVDRCGELNLKLVLGKTEKKPNLHPHTCLGLKS

SEQ ID NO: 883106 - protein, 450 aa, Homo sapiens
MCQNFFIDSCAAHGPPTFVKDSAVDKGHPNRSALSLPPGLRIGPSGIPQAGLGVWNEASDLPLGLHFGPYEGRITEDEEAANSGYSWLITKGRNCYEYVDGKDKSSANWMRYVNCARDDEEQNLVAFQYHRQIFYRTCRVIRPGCELLVWYGDEYGQELGIKWGSKWKKELMAGREPKPEIHPCPSCCLAFSSQKFLSQHVERNHSSQNFPGPSARKLLQPENPCPGDQNQERQYSDPRCCNDKTKGQEIKERSKLLNKRTWQREISRAFSSPPKGQMGSSRVGERMMEEESRTGQKVNPGNTGKLFVGVGISRIAKVKYGECGQGFSDKSDVITHQRTHTGGKPYVCRECGRALAGSQTSSVTRGHTQGRSLMSAESVSGALAGSQSSSFTRGHTGEKPQSAGRMSKSLVIKPYLNSHKKTNVITTHLHTPALRWLQRKSANPLHSPRV

SEQ ID NO: 883107 - protein, 159 aa, Homo sapiens
SSKIAGGRSRSRTKGHPNRSALSLPPGLRIGPSGIPQAGLGVWNEASDLPLGLHFGPYEGRITEDEEAANSGYSWLITKGRNCYEYVDGKDKSSANWMRTKARDPSMSLMLSGLFKSKISQSTCGTQSLLSELPRTICKKTSPTRESLPRGSESGAAIF

SEQ ID NO: 883108 - protein, 171 aa, Homo sapiens
MCQNFFIDSCAAHGPPTFVKDSAVDKGHPNRSALSLPPGLRIGPSGIPQAGLGVWNEASDLPLGLHFGPYEGRITEDEEAANSGYSWLITKGRNCYEYVDGKDKSSANWMRTKARDPSMSLMLSGLFKSKISQSTCGTQSLLSELPRTICKKTSPTRESLPRGSESGAAIF

SEQ ID NO: 883109 - protein, 438 aa, Homo sapiens
SSKIAGGRSRSRTKGHPNRSALSLPPGLRIGPSGIPQAGLGVWNEASDLPLGLHFGPYEGRITEDEEAANSGYSWLITKGRNCYEYVDGKDKSSANWMRYVNCARDDEEQNLVAFQYHRQIFYRTCRVIRPGCELLVWYGDEYGQELGIKWGSKWKKELMAGREPKPEIHPCPSCCLAFSSQKFLSQHVERNHSSQNFPGPSARKLLQPENPCPGDQNQERQYSDPRCCNDKTKGQEIKERSKLLNKRTWQREISRAFSSPPKGQMGSSRVGERMMEEESRTGQKVNPGNTGKLFVGVGISRIAKVKYGECGQGFSDKSDVITHQRTHTGGKPYVCRECGRALAGSQTSSVTRGHTQGRSLMSAESVSGALAGSQSSSFTRGHTGEKPQSAGRMSKSLVIKPYLNSHKKTNVITTHLHTPALRWLQRKSANPLHSPRV

SEQ ID NO: 883110 - protein, 563 aa, Homo sapiens
MLLPAPALRRALLSRPWTGAGLRWKHTSSLKVANEPVLAFTQGSPERDALQKALKDLKGRMEAIPCVVGDEEVWTSDVQYQVSPFNHGHKVAKFCYADKSLLNKAIEAALAARKEWDLKPIADRAQIFLKAADMLSGPRRAEILAKTMVGQGKTVIQAEIDAAAELIDFFRFNAKYAVELEGQQPISVPPSTNSTVYRGLEGFVAAISPFNFTAIGGNLAGAPALMGNVVLWKPSDTAMLASYAVYRILREAGLPPNIIQFVPADGPLFGDTVTSSEHLCGINFTGSVPTFKHLWKQVAQNLDRFHTFPRLAGECGGKNFHFVHRSADVESVVSGTLRSAFEYGGQKCSACSRLYVPHSLWPQIKGRLLEEHSRIKVGDPAEDFGTFFSAVIDAKSFARIKKWLEHARSSPSLTILAGGKCDDSVGYFVEPCIVESKDPQEPIMKEEIFGPVLSVYVYPDDKYKETLQLVDSTTSYGLTGAVFSQDKDVVQEATKVLRNAAGNFYINDKSTGSIVGQQPFGGARASGTNDKPGGPHYILRWTSPQVIKETHKPLGDWSYAYMQ

SEQ ID NO: 883111 - protein, 563 aa, Homo sapiens; identical to SEQ ID NO: 883110

SEQ ID NO: 883112 - protein, 254 aa, Homo sapiens
MLLPAPALRRALLSRPWTGAGLRWKHTSSLKVANEPVLAFTQGSPERDALQKALKDLKGRMEAIPCVVGDEEVWTSDVQYQVSPFNHGHKVAKFCYADKSLLNKAIEAALAARKEWDLKPIADRAQIFLKAADMLSGPRRAEILAKTMVGQGKTVIQAEIDAAAELIDFFRFNAKYAVELEGQQPISVPPSTNSTVYRGLEGFVAAISPFNFTAIGGNLAGAPALMASRGSCDSASLPDDKTETHSRDLLGKTE

SEQ ID NO: 883113 - protein, 98 aa, Homo sapiens
EPQASAWLSAHGGMTEIVTGSLYRPRGPGFPSEAEGAVGGEWWEVNRQVLWETQTRGQNSRERPARENHVWPCFFSNPVWFPASQLMGRFGPKDILTL

SEQ ID NO: 883114 - protein, 612 aa, Homo sapiens
MSHPSWLPPKSTGEPLGHVPARMETTHSFGNPSISVSTQQPPKKFAPVVAPKPKYNPYKQPGGEGDFLPPPPPPLDDSSALPSISGNFPPPPPLDEEAFKVQGNPGGKTLEERRSSLDAEIDSLTSILADLECSSPYKPRPPQSSTGSTASPPVSTPVTGHKRMVIPNQPPLTATKKSTLKPQPAPQAGPIPVAPIGTLKPQPQPVPASYTTASTSSRPTFNVQVKSAQPSPHYMAAPSSGQIYGSGPQGYNTQPVPVSGQCPPPSTRGGMDYAYIPPPGLQPEPGYGYAPNQGRYYEGYYAAGPGYGGRNDSDPTYGQQGHPNTWKREPGYTPPGAGNQNPPGMYPVTGPKKTYITDPVSAPCAPPLQPKGGHSGQLGPSSVAPSFRPEDELEHLTKKMLYDMENPPADEYFGRCARCGENVVGEGTGCTAMDQVFHVDCFTCIICNNKLRGQPFYAVEKKAYCEPCYINTLEQCNVCSKPIMERILRATGKAYHPHCFTCVMCHRSLDGIPFTVDAGGLIHCIEDFHKKFAPRCSVCKEPIMPAPGQEETVRIVALDRDFHVHCYRCEDCGGLLSEGDNQGCYPLDGHILCKTCNSARIRVLTAKASTDL

SEQ ID NO: 883115 - protein, 449 aa, Homo sapiens
MVIPNQPPLTATKKSTLKPQPAPQAGPIPVAPIGTLKPQPQPVPASYTTASTSSRPTFNVQVKSAQPSPHYMAAPSSGQIYGSGPQGYNTQPVPVSGQCPPPSTRGGMDYAYIPPPGLQPEPGYGYAPNQGRYYEGYYAAGPGYGGRNDSDPTYGQQGHPNTWKREPGYTPPGAGNQNPPGMYPVTGPKKTYITDPVSAPCAPPLQPKGGHSGQLGPSSVAPSFRPEDELEHLTKKMLYDMENPPADEYFGRCARCGENVVGEGTGCTAMDQVFHVDCFTCIICNNKLRGQPFYAVEKKAYCEPCYINTLEQCNVCSKPIMERILRATGKAYHPHCFTCVMCHRSLDGIPFTVDAGGLIHCIEDFHKKFAPRCSVCKEPIMPAPGQEETVRIVALDRDFHVHCYRCEDCGGLLSEGDNQGCYPLDGHILCKTCNSARIRVLTAKASTDL

SEQ ID NO: 883116 - protein, 252 aa, Homo sapiens
MVIPNQPPLTATKKSTLKPQPAPQAGPIPVAPIGTLKPQPQPVPASYTTASTSSRPTFNVQVKSAQPSPHYMAAPSSGQIYGSGPQGYNTQPVPVSGQCPPPSTRGGMDYAYIPPPGLQPEPGYGYAPNQGRYYEGYYAAGPGYGGRNDSDPTYGQQGHPNTWKREPGYTPPGAGNQNPPGMYPVTGPKKTYITDPVSAPCAPPLQPKGGHSGQLGPSSVAPSFRPEDELEHLTKKMLYDMENPPADEYFEC

SEQ ID NO: 883117 - protein, 178 aa, Homo sapiens
MDTSVTWDDGETAGPFRGSHLKIPTMSHPSWLPPKSTGEPLGHVPARMETTHSFGNPSISVSTQQPPKKFAPVVAPKPKYNPYKQPGGEGDFLPPPPPPLDDSSALPSISGNFPPPPPLDEEAFKVQGNPGGKTLEERRSSLDAEIDSLTSILADLECSSPYKPRPPQRKAAKQDVGW

SEQ ID NO: 883118 - protein, 139 aa, Homo sapiens
MDTSVTWDDGETAGPFRGSHLKIPTMSHPSWLPPKSTGEPLGHVPARMETTHSFGNPSISVSTQQPPKKFAPVVAPKPKYNPYKQPGGEGDFLPPPPPPLDDSSALPSISGNFPPPPPLDEEAFKVQVRAEVKVMLGKS

SEQ ID NO: 883119 - protein, 449 aa, Homo sapiens; identical to SEQ ID NO: 883115

SEQ ID NO: 883120 - protein, 449 aa, Homo sapiens; identical to SEQ ID NO: 883115

SEQ ID NO: 883121 - protein, 288 aa, Homo sapiens
MVIPNQPPLTATKKSTLKPQPAPQAGPIPVAPIGTLKPQPQPVPASYTTASTSSRPTFNVQVKSAQPSPHYMAAPSSGQIYGSGPQGYNTQPVPVSGQCPPPSTRGGMDYAYIPPPGLQPEPGYGYAPNQGRYYEGYYAAGPGYGGRNDSDPTYGQQGHPNTWKREPGYTPPGAGNQNPPGMYPVTGPKKTYITDPVSAPCAPPLQPKLLLSLLITMLAHLPSWARHQHLQPDTPQFLKQYLEMMKLQGNLEKLFFIVAQQDLGFNIVGGEDGEGILFPYLSKELTEL

SEQ ID NO: 883122 - protein, 322 aa, Homo sapiens
MARCFSLVLLLTSIWTTRLLVQGSLRAEELSIQVSCRIMGITLVSKKANQQLNFTEAKEACRLLGLSLAGKDQVETALKASFETCSYGWVGDGFVVISRISPNPKCGKNGVGVLIWKVPVSRQFAAYCYNSSDTWTNSCIPEIITTKDPIFNTQTATQTTEFIVSDSTYSVASPYSTIPAPTTTPPAPASTSIPRRKKLICVTEVFMETSTMSTETEPFVENKAAFKNEAAGFGGVPTALLVLALLFFGAAAGLGFCYVKRYVKAFPFTNKNQQKEMIETKVVKEEKANDSNPNEESKKTDKNPEESKSPSKTTVRCLEAEV

SEQ ID NO: 883123 - protein, 110 aa, Homo sapiens
MARCFSLVLLLTSIWTTRLLVQGSLRAEELSIQVSCRIMGITLVSKKANQQLNFTEAKEFCKVQGPKTSHQYPVVKRPPGCLRLGGLKAKESLRPRLSLLIPQLRPFLQL

SEQ ID NO: 883124 - protein, 322 aa, Homo sapiens; identical to SEQ ID NO: 883122

SEQ ID NO: 883125 - protein, 289 aa, Homo sapiens
MARLCRRVPCTLLLGLAVVLLKARLVPAAARAELSRSDLSLIQQQQQQQQQQQQQQQKQLEEAEEERTEVPGATSTLTVPVSVFMLKVQVNDIISRQYLSQAVVEVFVNYTKTNSTVTKSNGAVLIKVPYKLGLSLTIIAYKDGYVLTPLPWKTRRMPIYSSVTLSLFPQSQANIWLFEDTVLITGKLADAKSQPSVQFSKALIKLPDNHHISNVTGYLTVLQQFLKVDNFLHTTGITLNKPGFENIELTPLAAICVKIYSGGKELKVNGSIQVSLPLLRLNDISAGDR

SEQ ID NO: 883126 - protein, 217 aa, Homo sapiens
CVRCSRGSRVAHLTDAIHKLMAHSYQSTIHQTSSSSLALEGCIELFSKLDYSGIALLIMGSFVPWLYYSFYCNPQPCFIYLIVICVLGIAAIIVSQWDMFATPQYRGVRAGVFLGLGLSGIIPTLHYVISEGFLKAATIGQIGWLMLMASLYITGAALYAARIPERFFPGKCDIWFHSHQLFHIFVVAGAFVHFHGVSNLQEFRFMIGGGCSEEDAL

SEQ ID NO: 883127 - protein, 148 aa, Homo sapiens
MHSEKACSCGWQVRTSCWQETTNPCHVDLSTGLLEYPRSMATGFSRANNSREGKVEASLSFLFLRWSLTVSPRLECSGVILAHCNLRLPGSIIFLPCPCNLQQKVGSRKKESSVEVEKNLNVLVLDKVTVLGARWTEQKTQWMNWCSA

SEQ ID NO: 883128 - protein, 385 aa, Homo sapiens
MNEPTENRLGCSRTPEPDIRLRKGHQLDGTRRGDNDSHQGDLEPILEASVLSSHHKSSEEHEYSDEAPQEDEGFMGMSPLLQAHHAMEKMEEFVCKVWEGRWRVIPHDVLPDWLKDNDFLLHGHRPPMPSFRACFKSIFRIHTETGNIWTHLLGCVSFLCLGIFYMFRPNISFVAPLQEKVVFGLFFLGAILCLSFSWLFHTVYCHSEGVSRLFSKLDYSGIALLIMGSFVPWLYYSFYCNPQPCFIYLIVICVLGIAAIIVSQWDMFATPQYRGVRAGVFLGLGLSGIIPTLHYVISEGFLKAATIGQIGWLMLMASLYITGAALYAARIPERFFPGKCDIWFHSHQLFHIFVVAGAFVHFHGVSNLQEFRFMIGGGCSEEDAL

SEQ ID NO: 883129 - protein, 385 aa, Homo sapiens; identical to SEQ ID NO: 883128

SEQ ID NO: 883130 - protein, 155 aa, Homo sapiens
MNEPTENRLGCSRTPEPDIRLRKGHQLDGTRRGDNDSHQGDLEPILEASVLSSHHKSSEEHEYSDEAPQEDEGFMGMSPLLQAHHAMEKMEEFVCKVWEGRWRVIPHDVLPDWLKDNDFLLHGHRPPMPSFRACFKSIFRIHTETGNIWTHLLGM

SEQ ID NO: 883131 - protein, 368 aa, Homo sapiens [sequence omitted]

SEQ ID NO: 883132 - protein, 368 aa, Homo sapiens [sequence omitted]

SEQ ID NO: 883133 - protein, 222 aa, Homo sapiens [sequence omitted]

SEQ ID NO: 883134 - protein, 368 aa, Homo sapiens [sequence omitted]

SEQ ID NO: 883135 - protein, 368 aa, Homo sapiens [sequence omitted]

SEQ ID NO: 883136 - protein, 368 aa, Homo sapiens [sequence omitted]

SEQ ID NO: 883137 - protein, 368 aa, Homo sapiens [sequence omitted]

SEQ ID NO: 883138 - protein, 368 aa, Homo sapiens [sequence omitted]

SEQ ID NO: 883139 - protein, 368 aa, Homo sapiens [sequence omitted]

SEQ ID NO: 883140 - protein, 368 aa, Homo sapiens [sequence omitted]

SEQ ID NO: 883141 - protein, 89 aa, Homo sapiens
SARRWTKGGGGGRRGLGRPPLTCLPANCNQSSSPPAEPPQPAGLAGGLPHASPMAGTAGPARRVPAHLAQAAPPDRLPRQKPSSLPRNH

SEQ ID NO: 883142 - protein, 181 aa, Homo sapiens
MLVVFLAPGCGSYKLRKLLRLLRLDDCFSRSGGFSKFQAEFSLHCETNLDGSCSSSSPPLPVLGLGGLRISSDSSSDIESDLDRDPNSATDSDGSPLSNSQPSFPVEILPFLYLGCAKDSTNLDVLEEFGIKYILNVTPNLPNLFENAGEFKYKQIPISDHWSQNLSQFFPEAISFIGETN

SEQ ID NO: 883143 - protein, 491 aa, Homo sapiens
MELSVLLFLALLTGLLLLLVQRHPNTHDRLPPGPRPLPLLGNLLQMDRRGLLKSFLRFREKYGDVFTVHLGPRPVVMLCGVEAIREALVDKAEAFSGRGKIAMVDPFFRGYGVIFANGNRWKVLRRFSVTTMRDFGMGKRSVEERIQEEAQCLIEELRKSKGALMDPTFLFQSITANIICSIVFGKRFHYQDQEFLKMLNLFYQTFSLISSVFGQLFELFSGFLKYFPGAHRQVYKNLQEINAYIGHSVEKHRETLDPSAPKDLIDTYLLHMEKEKSNAHSEFSHQNLNLNTLSLFFAGTETTSTTLRYGFLLMLKYPHVAERVYREIEQVIGPHRPPELHDRAKMPYTEAVIYEIQRFSDLLPMGVPHIVTQHTSFRGYIIPKDTEVFLILSTALHDPHYFEKPDAFNPDHFLDANGALKKTEAFIPFSLGKRICLGEGIARAELFLFFTTILQNFSMASPVAPEDIDLTPQECGVGKIPPTYQIRFLPR

SEQ ID NO: 883144 - protein, 491 aa, Homo sapiens; identical to SEQ ID NO: 883143

SEQ ID NO: 883145 - protein, 491 aa, Homo sapiens; identical to SEQ ID NO: 883143

SEQ ID NO: 883146 - protein, 491 aa, Homo sapiens; identical to SEQ ID NO: 883143

SEQ ID NO: 883147 - protein, 171 aa, Homo sapiens
MGVYTARLQPPLTLLLPSLLWTQEKSNAHSEFSHQNLNLNTLSLFFAGTETTSTTLRYGFLLMLKYPHVAERVYREIEQVIGPHRPPELHDRAKMPYTEAVIYEIQRFSDLLPMGVPHIVTQHTSFRGYIIPKGSGFVLVKASPVRNCSSSSPPSSRTSPWPAPWPQKTSI

SEQ ID NO: 883148 - protein, 125 aa, Homo sapiens
MAGPSLACCLLGLLALTSACYIQNCPLGGKRAAPDLDVRKCLPCGPGGKGRCFGPNICCAEELGCFVGTAEALRCQEENYLPSPCQSGQKACGSGGRCAVLGLCCSPDGCHADPACDAEATFSQR

SEQ ID NO: 883149 - protein, 998 aa, Homo sapiens
AGSSRRRRRRRSASPGASRTRCARRAVPGPGVRPYEERDPAARAASASPTARGPRASRARPRPRPRSLPALRAMNAPERQPQPDGGDAPGHEPGGSPQDELDFSILFDYEYLNPNEEEPNAHKVASPPSGPAYPDDVMDYGLKPYSPLASLSGEPPGRFGEPDRVGPQKFLSAAKPAGASGLSPRIEITPSHELIQAVGPLRMRDAGLLVEQPPLAGVAASPRFTLPVPGFEGYREPLCLSPASSGSSASFISDTFSPYTSPCVSPNNGGPDDLCPQFQNIPAHYSPRTSPIMSPRTSLAEDSCLGRHSPVPRPASRSSSPGAKRRHSCAEALVALPPGASPQRSRSPSPQPSSHVAPQDHGSPAGYPPVAGSAVIMDALNSLATDSPCGIPPKMWKTSPDPSPVSAAPSKAGLPRHIYPAVEFLGPCEQGERRNSAPESILLVPPTWPKPLVPAIPICSIPVTASLPPLEWPLSSQSGSYELRIEVQPKPHHRAHYETEGSRGAVKAPTGGHPVVQLHGYMENKPLGLQIFIGTADERILKPHAFYQVHRITGKTVTTTSYEKIVGNTKVLEIPLEPKNNMRATIDCAGILKLRNADIELRKGETDIGRKNTRVRLVFRVHIPESSGRIVSLQTASNPIECSQRSAHELPMVERQDTDSCLVYGGQQMILTGQNFTSESKVVFTEKTTDGQQIWEMEATVDKDKSQPNMLFVEIPEYRNKHIRTPVKVNFYVINGKRKRSQPQHFTYHPVPAIKTEPTDEYDPTLICSPTHGGLGSQPYYPQHPMVAESPSCLVATMAPCQQFRTGLSSPDARYQQQNPAAVLYQRSKSLSPSLLGYQQPALMAAPLSLADAHRSVLVHAGSQGQSSALLHPSPTNQQASPVIHYSPTNQQLRCGSHQEFQHIMYCENFAPGTTRPGPPPVSQGQRLSPGSYPTVIQQQNATSQRAAKNGPPVSDQKEVLPAGVTIKQEQNLDQTYLDDVNEIIRKEFSGPPARNQT

SEQ ID NO: 883150 - protein, 81 aa, Homo sapiens
MRQKAAEGLSKLQLEATLWFRYGLECSSFCVWCLSLRDSLLLTHCLLLVKVRYVSQPLTPLRNEKYEIKLALEANPATHKP

SEQ ID NO: 883151 - protein, 994 aa, Homo sapiens
AGSSRRRRRRRSASPGASRTRCARRAVPGPGVRPYEERDPAARAASASPTARGPRASRARPRPRPRSLPALRAMNAPERQPQPDGGDAPGHEPGGSPQDELDFSILFDYEYLNPNEEEPNAHKVASPPSGPAYPDDVMDYGLKPYSPLASLSGEPPGRFGEPDRVGPQKFLSAAKPAGASGLSPRIEITPSHELIQAVGPLRMRDAGLLVEQPPLAGVAASPRFTLPVPGFEGYREPLCLSPASSGSSASFISDTFSPYTSPCVSPNNGGPDDLCPQFQNIPAHYSPRTSPIMSPRTSLAEDSCLGRHSPVPRPASRSSSPGAKRRHSCAEALVALPPGASPQRSRSPSPQPSSHVAPQDHGSPAGYPPVAGSAVIMDALNSLATDSPCGIPPKMWKTSPDPSPVSAAPSKAGLPRHIYPAVEFLGPCEQGERRNSAPESILLVPPTWPKPLVPAIPICSIPVTASLPPLEWPLSSQSGSYELRIEVQPKPHHRAHYETEGSRGAVKAPTGGHPVVQLHGYMENKPLGLQIFIGTADERILKPHAFYQVHRITGKTVTTTSYEKIVGNTKVLEIPLEPKNNMRATIDCAGILKLRNADIELRKGETDIGRKNTRVRLVFRVHIPESSGRIVSLQTASNPIECSQRSAHELPMVERQDTDSCLVYGGQQMILTGQNFTSESKVVFTEKTTDGQQIWEMEATVDKDKSQPNMLFVEIPEYRNKHIRTPVKVNFYVINGKRKRSQPQHFTYHPVPAIKTEPTDEYDPTLICSPTHGGLGSQPYYPQHPMVAESPSCLVATMAPCQQFRTGLSSPDARYQQQNPAAVLYQRSKSLSPSLLGYQQPALMAAPLSLADAHRSVLVHAGSQGQSSALLHPSPTNQQASPVIHYSPTNQQLRCGSHQEFQHIMYCENFAPGTTRPGPPPVSQGQRLSPGSYPTVIQQQNATSQRAAKNGPPVSDQKEVLPAGVTIKQEQNLDQTYLDDELIDTHLSWIQNIL

SEQ ID NO: 883152 - protein, 180 aa, Homo sapiens; identical to SEQ ID NO: 875166

SEQ ID NO: 883153 - protein, 395 aa, Homo sapiens
MLPAVGSVDEEEDPAEEDCPELVPIETTQSEEEEKSGLGAKIPVTIITGYLGAGKTTLLNYILTEQHSKRVAVILNESGEGSALEKSLAVSQGGELYEEWLELRNGCLCCSVKDNGLRAIENLMQKKGKFDDILLETTGLADPGAVASMFWVDAELGSDIYLDGIITIVDSKYGLKHLTEEKPDGLINEATRQVALADIILINKTDLVPEEDVKKLRTTIRSINGLGQILETQRSRVDLSNVLDLHAFDSLSGISLQKKLQHVPGTQPHLDQSIVTITFEVPGNAKEEHLNMFIQNLLWEKNVRNKDNHCMEVIRLKGLVSIKDKSQQVIVQGVHELYDLEETPVSWKDDTERTNRLVLIGRNLDKDILKQLFIATVTETEKQWTTHFKEDQVCT

SEQ ID NO: 883154 - protein, 180 aa, Homo sapiens; identical to SEQ ID NO: 875166

SEQ ID NO: 883155 - protein, 372 aa, Homo sapiens
MLPAVGSVDEEEDPAEEDCPELVPIETTQSEEEEKSGLGAKIPVTIITGYLGAGKTTLLNYILTEQHSKRVAVILNESGEGSALEKSLAVSQGGELYEEWLELRNGCLCCSVKDNGLRAIENLMQKKGKFDDILLETTGLADPGAVASMFWVDAELGSDIYLDGIITIVDSKYGLKHLTEEKPDGLINEATRQVALADIILINKTDLVPEEDVKKLRTTIRSINGLGQILETQRSRVDLSNVLDLHAFDSLSGISLQKKLQHVPGTQPHLDQSIVTITFEVPGNAKEEHLNMFIQNLLWEKNVRNKDNHCMEVIRLKGLVSIKDKSQQVIVQGVHELYDLEETPVSWKDDTERTNRLVLIGKSQRIHSFKTK

SEQ ID NO: 883156 - protein, 347 aa, Homo sapiens
MLPAVGSVDEEEDPAEEDCPELVPIETTQSEEEEKSGLGAKIPVTIITGYLGAGKTTLLNYILTEQHSKRVAVILNESGEGSALEKSLAVSQGGELYEEWLELRNGCLCCSVKDNGLRAIENLMQKKGKFDDILLETTGLADPGAVASMFWVDAELGSDIYLDGIITIVDSKYGLKHLTEEKPDGLINEATRSINGLGQILETQRSSLQKKLQHVPGTQPHLDQSIVTITFEVPGNAKEEHLNMFIQNLLWEKNVRNKDNHCMEVIRLKGLVSIKDKSQQVIVQGVHELYDLEETPVSWKDDTERTNRLVLIGRNLDKDILKQLFIATVTETEKQWTTHFKEDQVCT

SEQ ID NO: 883157 - protein, 342 aa, Homo sapiens
MLPAVGSVDEEEDPAEEDCPELVPIETTQSEEEEKSGLGAKIPVTIITGYLGAGKTTLLNYILTEQHSKRVAVILNESGEGSALEKSLAVSQGGELYEEWLELRNGCLCCSVKDNGLRAIENLMQKKGKFDDILLETTGLADPGAVASMFWVDAELGSDIYLDGIITIVDSKYGLKHLTEEKPDGLINEATRQVALADIILINKTDLVPEEDVKKLRTTIRSINGLGQILETQRSRVDLSNVLDLHAFDSLSGISLQKKLQHVPGTQPHLDQSIVTITFEVPGNAKEEHLNMFIQNLLWEKNVRNKDNHCMEVIRLKFELRLINVQSILLWDWCQSKTNHNK

SEQ ID NO: 883158 - protein, 334 aa, Homo sapiens
MLPAVGSVDEEEDPAEEDCPELVPIETTQSEEEEKSGLGAKIPVTIITGYLGAGKTTLLNYILTEQHSKRVAVILNESGEGSALEKSLAVSQGGELYEEWLELRNGCLCCSVKDNGLRAIENLMQKKGKFDDILLETTGLADPGAVASMFWVDAELGSDIYLDGIITIVDSKYGLKHLTEEKPDGLINEATRQVALADIILINKTDLVPEEDVKKLRTTIRSINGLGQILETQRSRVDLSNVLDLHAFDSLSGISLQKKLQHVPGTQPHLDQSIVTITFEVPGNAKEEHLNMFIQNLLWEKNVRNKDNHCMEVIRLKVQFTVADFWTKSFSWLL

SEQ ID NO: 883159 - protein, 180 aa, Homo sapiens; identical to SEQ ID NO: 875166

SEQ ID NO: 883160 - protein, 376 aa, Homo sapiens
MLPAVGSVDEEEDPAEEDCPELVPIETTQSEEEEKSGLGAKIPVTIITGYLGAGKTTLLNYILTEQHSKRVAVILNESGEGSALEKSLAVSQGGELYEEWLELRNGCLCCSVKDNGLRAIENLMQKKGKFDDILLETTGLADPGAVASMFWVDAELGSDIYLDGIITIVDSKYGLKHLTEEKPDGLINEATRQVALADIILINKTDLVPEEDVKKLRTTIRSINGLGQILETQRSSLQKKLQHVPGTQPHLDQSIVTITFEVPGNAKEEHLNMFIQNLLWEKNVRNKDNHCMEVIRLKGLVSIKDKSQQVIVQGVHELYDLEETPVSWKDDTERTNRLVLIGRNLDKDILKQLFIATVTETEKQWTTHFKEDQVCT

SEQ ID NO: 883161 - protein, 395 aa, Homo sapiens; identical to SEQ ID NO: 883153

SEQ ID NO: 883162 - protein, 372 aa, Homo sapiens; identical to SEQ ID NO: 883155

SEQ ID NO: 883163 - protein, 176 aa, Homo sapiens
MYFTEFPTAHVSFLPFRVDLSNVLDLHAFDSLSGISLQKKLQHVPGTQPHLDQSIVTITFEVPGNAKEEHLNMFIQNLLWEKNVRNKDNHCMEVIRLKGLVSIKDKSQQVIVQGVHELYDLEETPVSWKDDTERTNRLVLIGRNLDKDILKQLFIATVTETEKQWTTHFKEDQVCT

SEQ ID NO: 883164 - protein, 320 aa, Homo sapiens
MLPAVGSVDEEEDPAEEDCPELVPIETTQSEEEEKSGLGAKIPVTIITGYLGAGKTTLLNYILTEQHSKRVAVILNESGEGSALEKSLAVSQGGELYEEWLELRNGCLCCSVKDNGLRAIENLMQKKGKFDDILLETTGLADPGAVASMFWVDAELGSDIYLDGIITIVDSKYGLKHLTEEKPDGLINEATRQVALADIILINKTDLVPEEDVKKLRTTIRSINGLGQILETQRSRVDLSNVLDLHAFDSLSGISLQKKLQHVPGTQPHLDQSIVTITFEVPGNAKEEHLNMFIQNLLWEKNVRNKDNHCMEVIRLKAEI

SEQ ID NO: 883165 - protein, 152 aa, Homo sapiens
RSISVTIAVQRGKEENLAATTLLIFPPLHSIVTITFEVPGNAKEEHLNMFIQNLLWEKNVRNKDNHCMEVIRLKGLVSIKDKSQQVIVQGVHELYDLEETPVSWKDDTERTNRLVLIGRNLDKDILKQLFIATVTETEKQWTTHFKEDQVCT

SEQ ID NO: 883166 - protein, 180 aa, Homo sapiens; identical to SEQ ID NO: 875166

SEQ ID NO: 883167 - protein, 908 aa, Homo sapiens [sequence omitted]

SEQ ID NO: 883168 - protein, 440 aa, Homo sapiens
MKSSVAQIKPSSGHDRRENLNSYQRNSSPEDRYEEQERSPRDRDYFDYSRSDYEHSRRGRSYDSSMESRNRDREKRRERERDTDRKRSRKSPSPGRRNPETSVTQSSSAQDEPATKKKKDELDPLLTRTGGAYIPPAKLRMMQEQITDKNSLAYQRMSWEALKKSINGLINKVNISNISIIIQELLQENIVRGRGLLSRSVLQAQSASPIFTHVYAALVAIINSKFPQIGELILKRLILNFRKGYRRNDKQLCLTASKFVAHLINQNVAHEVLCLEMLTLLLERPTDDSVEVAIGFLKECGLKLTQVSPRGINAIFERLRNILHESEIDKRVQYMIEVMFAVRKDGFKDHPIILEGLDLVEEDDQFTHMLPLEDDYNPEDVLNVFKMDPNFMENEEKYKAIKKEILDEGDTDSNTDQDAGSMKRATLHPSVVIALPQLMM

SEQ ID NO: 883169 - protein, 219 aa, Homo sapiens
MKSSVAQIKPSSGHDRRENLNSYQRNSSPEDRYEEQERSPRDRDYFDYSRSDYEHSRRGRSYDSSMESRNRDREKRRERERDTDRKRSRKSPSPGRRNPETSVTQSSSAQDEPATKKKKDELDPLLTRTGGAYIPPAKLRMMQEQITDKNSLAYQRMSWEALKKSINGLINKVNISNISIIIQELLQENIVRGRRDCCPRWFLARAQEVAFFPILLTPW

SEQ ID NO: 883170 - protein, 908 aa, Homo sapiens [sequence omitted]

SEQ ID NO: 883171 - protein, 68 aa, Homo sapiens
AAAYYYYYCSEFKLLTMYGDMDRSGVKVVLIMYLLIDPHKKKCEVFFYYLFIYQAETFVGRRFGRTHF

SEQ ID NO: 883172 - protein, 137 aa, Homo sapiens
FDAAERYQQAGLPLIVLAGKEYGAGSSRDWAAKGPFLLGIKAVLAESYERIHRSNLVGMGVIPLEYLPGENADALGLTGQERYTIIIPENLKPQMKVQVKLDTGKTFQAVMRFDTDVELTYFLNGGILNYMIRKMAK

SEQ ID NO: 883173 - protein, 251 aa, Homo sapiens
KAGRFRWKGAVAGLAGIMAENHCELLSPARGGIGAGLGGGLCRRCSAGLGALAQRPGSVSKWVRLNVGGTYFLTTRQTLCRDPKSFLYRLCQADPDLDSDKDETGAYLIDRDPTYFGPVLNYLRHGKLVINKDLAEEGVLEEAEFYNITSLIKLVKDKIRERDSKTSQVPVKHVYRVLQCQEEELTQMVSTMSDGWKFEQLVSIGSSYNYGNEDQAEFLCVVSKELHNTPYGTASEPSEKAKILQERGSRM

SEQ ID NO: 883174 - protein, 263 aa, Homo sapiens
KAGRFRWKGAVAGLAGIMAENHCELLSPARGGIGAGLGGGLCRRCSAGLGALAQRPGSVSKWVRLNVGGTYFLTTRQTLCRDPKSFLYRLCQADPDLDSDKDETGAYLIDRDPTYFGPVLNYLRHGKLVINKDLAEEGACEACVPCAAVPGGGAHADGVHHVRRLEVRAVGQHRLLLQLWERRPSRVPLCGVQGAAQHPVRYGQRAQREGQDFARTRLKDVRDTVLTAEEMIYVFPRCNELPCPGSLAVRRNLLLIIFLEIWV

SEQ ID NO: 883175 - protein, 251 aa, Homo sapiens; identical to SEQ ID NO: 883173

SEQ ID NO: 883176 - protein, 251 aa, Homo sapiens; identical to SEQ ID NO: 883173

SEQ ID NO: 883177 - protein, 251 aa, Homo sapiens; identical to SEQ ID NO: 883173

SEQ ID NO: 883178 - protein, 251 aa, Homo sapiens; identical to SEQ ID NO: 883173

SEQ ID NO: 883179 - protein, 155 aa, Homo sapiens
MTVAVDETGAYLIDRDPTYFGPVLNYLRHGKLVINKDLAEEGVLEEAEFYNITSLIKLVKDKIRERDSKTSQVPVKHVYRVLQCQEEELTQMVSTMSDGWKFEQLVSIGSSYNYGNEDQAEFLCVVSKELHNTPYGTASEPSEKAKILQERGSRM

SEQ ID NO: 883180 - protein, 127 aa, Homo sapiens
KAGRFRWKGAVAGLAGIMAENHCELLSPARGGIGAGLGGGLCRRCSAGLGALAQRPGSVSKWVRLNVGGTYFLTTRQTLCRDPKSFLYRLCQADPDLDSDKDETGAYLIDRDPTYFGPILQERGSRM

SEQ ID NO: 883181 - protein, 152 aa, Homo sapiens
QCGTCPGRHCIHQRRDPRQTLRRPGGSARALVPTWGEDLGYCLLGLARGLGGSWGHCTSLSREHGVRRGRAAARGWRLEGGLGCLWWVKLGAETVALGVSEPFEGGGAQHTAVPGTLNWLSMEWKSGPRCLEGPESWGPLQTSSAAPSTVGP

SEQ ID NO: 883182 - protein, 319 aa, Homo sapiens
RIHTGEKPYKCNECEKTFSHRSSLLSHQRIHTGEKPYKCNECEKAFSNSSTLIKHLRVHTGEKPYRCRECGKAFSQCSTLTVHQRIHTGEKLYKCGECEKAFNCRAKLHRHQRIHTGEKPYKCSECGKGYSQFTSLAEHHRFHTGEQLYTCLECGRTFTRIVTLIEHQRIHTGQKPYQCTECEKAFNQYSSFNEHRKIHTGEKLYTCEECGKAFGCKSNLYRHQRIHTGEKPYQCNQCGKAFSQYSFLTEHERIHTGEKLYKCMECGKAYSYRSNLCRHKKVHTKEKLYKWKEYGKPFICSSSLTQYQRFFKGDKAYEV

SEQ ID NO: 883183 - protein, 1836 aa, Homo sapiens
MARPSLCTLARLGPECLRPFTRESLAAIEQRAVEEEARLQRNKQMEIEEPERKPRSDLEAGKNLPMIYGDPPPEVIGIPLEDLDPYYSNKKTFIVLNKGKAIFRFSATPALYLLSPFSVVRRGAIKVLIHALFSMFIMITILTNCVFMTMSDPPPWSKNVEYTFTGIYTFESLIKILARGFCVDDFTFLRDPWNWLDFSVIMMAYLTEFVDLGNISALRTFRVLRALKTITVIPGLKTIVGALIQSVKKLSDVMILTVFCLSVFALVGLQLFMGNLRQKCVRWPPPFNDTNTTWYSNDTWYGNDTWYGNEMWYGNDSWYANDTWNSHASWATNDTFDWDAYISDEGNFYFLEGSNDALLCGNSSDAGHCPKGYECIKTGRNPNYGYTSYDTFSWAFLALFRLMTQDYWENLFQLTLRAAGKTYMIFFVVIIFLGSFYLINLILAVVAMAYAEQNEATLAEDKEKEEEFQQMLEKFKKHQEELEKAKAAQALEGGEADGDPAHGKDCNGSLDTSQGEKGAPRQSGSGDSGISDAMEELEEAHQKCPPWWYKCAHKVLIWDCCAPWLKFKNIIHLIVMDPFVDLGITICIVLNTLFMAMEHYPMTEHFDNVLTVGNLVFTGIFTAEMVLKLIAMDPYEYFQQGWNIFDSIIVTLSLVELGLANVQGLSVLRSFRLLRVFKLAKSWPTLNMLIKIIGNSVGALGNLTLVLAIIVFIFAVVGMQLFGKSYKECVCKIALDCNLPRWHMHDFFHSFLIVFRILCGEWIETMWDCMEVAGQAMCLTVFLMVMVIGNLVVLNLFLALLLSSFSADSLAASDEDGEMNNLQIAIGRIKLGIGFAKAFLLGLLHGKILSPKDIMLSLGEADGAGEAGEAGETAPEDEKKEPPEEDLKKDNHILNHMGLADGPPSSLELDHLNFINNPYLTIQVPIASEESDLEMPTEEETDTFSEPEDSKKPPQPLYDGNSSVCSTADYKPPEEDPEEQAEENPEGEQPEECFTEACVQRWPCLYVDISQGRGKKWWTLRRACFKIVEHNWFETFIVFMILLSSGALAFEDIYIEQRRVIRTILEYADKVFTYIFIMEMLLKWVAYGFKVYFTNAWCWLDFLIVDVSIISLVANWLGYSELGPIKSLRTLRALRPLRALSRFEGMRVVVNALLGAIPSIMNVLLVCLIFWLIFSIMGVNLFAGKFYYCINTTTSERFDISEVNNKSECESLMHTGQVRWLNVKVNYDNVGLGYLSLLQVATFKGWMDIMYAAVDSREKEEQPQYEVNLYMYLYFVIFIIFGSFFTLNLFIGVIIDNFNQQKKKLGGKDIFMTEEQKKYYNAMKKLGSKKPQKPIPRPQNKIQGMVYDLVTKQAFDITIMILICLNMVTMMVETDDQSQLKVDILYNINMIFIIIFTGECVLKMLALRQYYFTVGWNIFDFVVVILSIVGLALSDLIQKYFVSPTLFRVIRLARIGRVLRLIRGAKGIRTLLFALMMSLPALFNIGLLLFLVMFIYSIFGMSNFAYVKKESGIDDMFNFETFGNSIICLFEITTSAGWDGLLNPILNSGPPDCDPNLENPGTSVKGDCGNPSIGICFFCSYIIISFLIVVNMYIAIILENFNVATEESSEPLGEDDFEMFYETWEKFDPDATQFIAYSRLSDFVDTLQEPLRIAKPNKIKLITLDLPMVPGDKIHCLDILFALTKEVLGDSGEMDALKQTMEEKFMAANPSKVSYEPITTTLKRKHEEVCAIKIQRAYRRHLLQRSMKQASYMYRHSHDGSGDDAPEKEGLLANTMSKMYGHENGNSSSPSPEEKGEAGDAGPTMGLMPISPSDTAWPPAPPPGQTVRPGVKESLV

SEQ ID NO: 883184 - protein, 465 aa, Homo sapiens
MFRQEQPLAEGSFAPMGSLQPDAGNASWNGTEAPGGGARATPYSLQVTLTLVCLAGLLMLLTVFGNVLVIIAVFTSRALKAPQNLFLVSLASADILVATLVIPFSLANEVMGYWYFGKAWCEIYLALDVLFCTSSIVHLCAISLDRYWSITQAIEYNLKRTPRRIKAIIITVWVISAVISFPPLISIEKKGGGGGPQPAEPRCEINDQKWYVISSCIGSFFAPCLIMILVYVRIYQIAKRRTRVPPSRRGPDAVAAPPGGTERRPNGLGPERSAGPGGAEAEPLPTQLNGAPGEPAPAGPRDTDALDLEESSSSDHAERPPGPRRPERGPRGKGKARASQVKPGDSLPRRGPGATGIGTPAAGPGEERVGAAKASRWRGRQNREKRFTFVLAVVIGVFVVCWFPFFFTYTLTAVGCSVPRTLFKFFFWFGYCNSSLNPVIYTIFNHDFRRAFKKILCRGDRKRIV

SEQ ID NO: 883185 - protein, 465 aa, Homo sapiens; identical to SEQ ID NO: 883184

SEQ ID NO: 883186 - protein, 465 aa, Homo sapiens; identical to SEQ ID NO: 883184

SEQ ID NO: 883187 - protein, 618 aa, Homo sapiens
MHKTASQRLFPGPSYQNIKSIMEDSTILSDWTNSNKQKMKYDFSCELYRMSTYSTFPAGVPVSERSLARAGFYYTGVNDKVKCFCCGLMLDNWKLGDSPIQKHKQLYPSCSFIQNLVSASLGSTSKNTSPMRNSFAHSLSPTLEHSSLFSGSYSSLSPNPLNSRAVEDISSSRTNPYSYAMSTEEARFLTYHMWPLTFLSPSELARAGFYYIGPGDRVACFACGGKLSNWEPKDDAMSEHRRHFPNCPFLENSLETLRFSISNLSMQTHAARMRTFMYWPSSVPVQPEQLASAGFYYVGRNDDVKCFCCDGGLRCWESGDDPWVEHAKWFPRCEFLIRMKGQEFVDEIQGRYPHLLEQLLSTSDTTGEENADPPIIHFGPGESSSEDAVMMNTPVVKSALEMGFNRDLVKQTVQSKILTTGENYKTVNDIVSALLNAEDEKREEEKEKQAEEMASDDLSLIRKNRMALFQQLTCVLPILDNLLKANVINKQEHDIIKQKTQIPLQARELIDTILVKGNAAANIFKNCLKEIDSTLYKNLFVDKNMKYIPTEDVSGLSLEEQLRRLQEERTCKVCMDKEVSVVFIPCGHLVVCQECAPSLRKCPICRGIIKGTVRTFLS

SEQ ID NO: 883188 - protein, 618 aa, Homo sapiens; identical to SEQ ID NO: 883187

SEQ ID NO: 883189 - protein, 618 aa, Homo sapiens; identical to SEQ ID NO: 883187

SEQ ID NO: 883190 - protein, 600 aa, Homo sapiens
MHKTASQRLFPGPSYQNIKSIMEDSTILSDWTNSNKQKMKYDFSCELYRMSTYSTFPAGVPVSERSLARAGFYYTGVNDKVKCFCCGLMLDNWKLGDSPIPSLGSTSKNTSPMRNSFAHSLSPTLEHSSLFSGSYSSLSPNPLNSRAVEDISSSRTNPYSYAMSTEEARFLTYHMWPLTFLSPSELARAGFYYIGPGDRVACFACGGKLSNWEPKDDAMSEHRRHFPNCPFLENSLETLRFSISNLSMQTHAARMRTFMYWPSSVPVQPEQLASAGFYYVGRNDDVKCFCCDGGLRCWESGDDPWVEHAKWFPRCEFLIRMKGQEFVDEIQGRYPHLLEQLLSTSDTTGEENADPPIIHFGPGESSSEDAVMMNTPVVKSALEMGFNRDLVKQTVQSKILTTGENYKTVNDIVSALLNAEDEKREEEKEKQAEEMASDDLSLIRKNRMALFQQLTCVLPILDNLLKANVINKQEHDIIKQKTQIPLQARELIDTILVKGNAAANIFKNCLKEIDSTLYKNLFVDKNMKYIPTEDVSGLSLEEQLRRLQEERTCKVCMDKEVSVVFIPCGHLVVCQECAPSLRKCPICRGIIKGTVRTFLS

SEQ ID NO: 883191 - protein, 70 aa, Homo sapiens
SVVRVSPDGAAGFGSARADPSRAGRISLSAPLIPGSAEASRQPRSFRVCCARTAIYNPEESPYPYFVPLQ

SEQ ID NO: 883192 - protein, 280 aa, Homo sapiens [sequence omitted]

SEQ ID NO: 883193 - protein, 280 aa, Homo sapiens [sequence omitted]

SEQ ID NO: 883194 - protein, 618 aa, Homo sapiens; identical to SEQ ID NO: 883187

SEQ ID NO: 883195 - protein, 79 aa, Homo sapiens
SVVRVSPDGAAGFGSARADPSRAGRISLSAPLIPGSAEASRQPRSFRVCCARTAVSAAPSGLGRRGAGGDARARGGPLP

SEQ ID NO: 883196 - protein, 530 aa, Homo sapiens [sequence omitted]

SEQ ID NO: 883197 - protein, 600 aa, Homo sapiens
MHKTASQRLFPGPSYQNIKSIMEDSTILSDWTNSNKQKMKYDFSCELYRMSTYSTFPAGVPVSERSLARAGFYYTGVNDKVKCFCCGLMLDNWKLGDSPIQKHKQLYPSCSFIQNLVSASLGSTSKNTSPMSGSYSSLSPNPLNSRAVEDISSSRTNPYSYAMSTEEARFLTYHMWPLTFLSPSELARAGFYYIGPGDRVACFACGGKLSNWEPKDDAMSEHRRHFPNCPFLENSLETLRFSISNLSMQTHAARMRTFMYWPSSVPVQPEQLASAGFYYVGRNDDVKCFCCDGGLRCWESGDDPWVEHAKWFPRCEFLIRMKGQEFVDEIQGRYPHLLEQLLSTSDTTGEENADPPIIHFGPGESSSEDAVMMNTPVVKSALEMGFNRDLVKQTVQSKILTTGENYKTVNDIVSALLNAEDEKREEEKEKQAEEMASDDLSLIRKNRMALFQQLTCVLPILDNLLKANVINKQEHDIIKQKTQIPLQARELIDTILVKGNAAANIFKNCLKEIDSTLYKNLFVDKNMKYIPTEDVSGLSLEEQLRRLQEERTCKVCMDKEVSVVFIPCGHLVVCQECAPSLRKCPICRGIIKGTVRTFLS

SEQ ID NO: 883198 - protein, 600 aa, Homo sapiens
MHKTASQRLFPGPSYQNIKSIMEDSTILSDWTNSNKQKMKYDFSCELYRMSTYSTFPAGVPVSERSLARAGFYYTGVNDKVKCFCCGLMLDNWKLGDSPIQKHKQLYPSCSFIQNLVSASLGSTSKNTSPMRNSFAHSLSPTLEHSSLFSGSYSSLSPNPLNSRAVEDISSSRTNPYSYAMSTEEARFLTYHMWPLTFLSPSELARAGFYYIGPGDRVACFACGGKLSNWEPKDDAMSEHRRHFPNCPFLENSLETLRFSISNLSMQTHAARMRTFMYWPSSVPVQPEQLASAGFYYVGRNDDVKCFCCDGGLRCWESGDDPWVEHAKWFPRCEFLIRMKGQEFVDEIQGRYPHLLEQLLSTSDTTGEENADPPIIHFGPGESSSEDAVMMNTPVVKSALEMGFNRDLVKQTVQTLLNAEDEKREEEKEKQAEEMASDDLSLIRKNRMALFQQLTCVLPILDNLLKANVINKQEHDIIKQKTQIPLQARELIDTILVKGNAAANIFKNCLKEIDSTLYKNLFVDKNMKYIPTEDVSGLSLEEQLRRLQEERTCKVCMDKEVSVVFIPCGHLVVCQECAPSLRKCPICRGIIKGTVRTFLS

SEQ ID NO: 883199 - protein, 280 aa, Homo sapiens [sequence omitted]

SEQ ID NO: 883200 - protein, 70 aa, Homo sapiens; identical to SEQ ID NO: 883191

SEQ ID NO: 883201 - protein, 202 aa, Homo sapiens
MSDIEEVVEEYEEEEQEEAAVEEQEEAAEEDAEAEAETEETRAEEDEEEEEAKEAEDGPMEESKPKPRSFMPNLVPPKIPDGERVDFDDIHRKRMEKDLNELQALIEAHFENRKKEEEELVSLKDRIERRRAERAEQQRIRNEREKERQNRLAEERARREEEENRRKAEDEARKKKALSNMMHFGGYIQRSPDRAEKWEEAD

SEQ ID NO: 883202 - protein, 202 aa, Homo sapiens; identical to SEQ ID NO: 883201

SEQ ID NO: 883203 - protein, 143 aa, Homo sapiens
MEESKPKPRSFMPNLVPPKIPDGERVDFDDIHRKRMEKDLNELQALIEAHFENRKKEEEELVSLKDRIERRRAERAEQQRIRNEREKERQNRLAEERARREEEENRRKAEDEARKKKALSNMMHFGGYIQRSPDRAEKWEEAD

SEQ ID NO: 883204 - protein, 143 aa, Homo sapiens; identical to SEQ ID NO: 883203

SEQ ID NO: 883205 - protein, 195 aa, Homo sapiens
MSDIEEVVEEYEEEEEQEEAAEEDAEAEAETEETRAEEDEEEEEAKEAEDGPMEESKPKPRSFMPNLVPPKIPDGERVDFDDIHRKRMEKDLNELQALIEAHFENRKKEEEELVSLKDRIERRRAERAEQQRIRNEREKERQNRLAEERARREEEENRRKAEDEARKKKALSNMMHFGGYIQRSPDRAEKWEEAD

SEQ ID NO: 883206 - protein, 104 aa, Homo sapiens
MEESKPKPRSFMPNLVPPKIPDGERVDFDERRRAERAEQQRIRNEREKERQNRLAEERARREEEENRRKAEDEARKKKALSNMMHFGGYIQRSPDRAEKWEEAD

SEQ ID NO: 883207 - protein, 143 aa, Homo sapiens; identical to SEQ ID NO: 883203

SEQ ID NO: 883208 - protein, 143 aa, Homo sapiens; identical to SEQ ID NO: 883203

SEQ ID NO: 883209 - protein, 189 aa, Homo sapiens
PQHSHLVLLLEHLIVGGLATVDRREEGLDSVIHGVQLKTKEAEDGPMEESKPKPRSFMPNLVPPKIPDGERVDFDDIHRKRMEKDLNELQALIEAHFENRKKEEEELVSLKDRIERRRAERAEQQRIRNEREKERQNRLAEERARREEEENRRKAEDEARKKKALSNMMHFGGYIQRSPDRAEKWEEAD

SEQ ID NO: 883210 - protein, 115 aa, Homo sapiens
VLDRARRRSSLLSKTGSRDVGQSGPSSSASGMSGRRSGRTAWLLRGNRRPRSSLPVQLLKAFPEQQEERARREEEENRRKAEDEARKKKALSNMMHFGGYIQRSPDRAEKWEEAD

SEQ ID NO: 883211 - protein, 135 aa, Homo sapiens
MEESKPKPRSFMPNLVPPKIPDGERVDFDDIHRKRMEKDLNELQALIEAHFENRKKEEEELVSLKDRIERRRAERAEQQRIRNEREKERQNRLAEERARREEEENRRKAEDEARKKKALSNMMHFGGYIQRRDSG

SEQ ID NO: 883212 - protein, 143 aa, Homo sapiens; identical to SEQ ID NO: 883203

SEQ ID NO: 883213 - protein, 143 aa, Homo sapiens; identical to SEQ ID NO: 883203

SEQ ID NO: 883214 - protein, 143 aa, Homo sapiens; identical to SEQ ID NO: 883203

SEQ ID NO: 883215 - protein, 213 aa, Homo sapiens
MSDIEEVVEEYEEEEQEEAAVEEQEEAAEEDAEAEAETEETRAEEDEEEEEAKEAEDGPMEESKPKPRSFMPNLVPPKIPDGERVDFDDIHRKRMEKDLNELQALIEAHFENRKKEEEELVSLKDRIERRRAERAEQQRIRNEREKERQNRLARKAPRKRERQEKLGEARRELFPHDAFGLQPEAANKPKSGGATYRKEEKFCLRRSPAIPPY

SEQ ID NO: 883216 - protein, 86 aa, Homo sapiens
IRAGAKGKILAERRKVLAIDHLNEDQLREKAKELWQSIYNLEAEKFDLQEKFKQQKYEINVLRNRINDNQKVSKTRGKAKVTGRWK

SEQ ID NO: 883217 - protein, 140 aa, Homo sapiens
MSDIEEVVEEYEEEEQEEAAVEEEEDWREDEDESRRRQRKRMLKQRLRPRRPGQKKMKKKRKQRRLKMAQWRSPNQSPGEWGGTWVEPGAEAQGERMMMEQGAVWCSGHGLGVWWAQSTTVQLYKLCTAQASLPKGVSEG

SEQ ID NO: 883218 - protein, 130 aa, Homo sapiens
MAPKVKKEAPGPPKAEAKAKALKAKKVVLKGVHGHKKKKIRMSPTFQRPKTLRLWRPPRYPRKTTPRRNKLDHYAIIKFPLTTEFAMKKIKDNNTLVFTVDVKANKHQIKQAVKKLCDIDGAKVNTLMER

SEQ ID NO: 883219 - protein, 735 aa, Homo sapiens
DKTIKLWKISERDKRAEGYNLKDEDGRLRDPFRITALTDDLRINLWHLEITDRSFNIVDIKPANMEELTEVITAAEFHPHQCNVFVYSSSKGTIRLCDMRSSALCDRHSKFFEEPEDPSSRSFFSEIISSISDVKFSHSGRYMMTRDYLSVKVWDLNMESRPVETHQVHEYLRSKLCSLYENDCIFDKFECCWNGSDSAIMTGSYNNFFRMFDRDTRRDVTLEASRESSKPRASLKPLEENNGRWIEYDRTETAINNLNPAFSKKFVLDYHFEEVQKLKFALFDQDKSSMRLDEHDFLGQFSCSLGTIVSSKKITRPLLLLNDKPAGKGLITIAAQELSDNRVITLSLAGRRLDKKDLFGKSDPFLEFYKPGDDGKWMLVHRTEVIKYTLDPVWKPFTVPLVSLCDGDMEKPIQVMCYDYDNDGGHDFIGEFQTSVSQMCEARDSVPLEFECINPKKQRKKKNYKNSGIIILRSCKINRDYSFLDYILGGCQLMFTVGIDFTASNGNPLDPSSLHYINPMGTNEYLSAIWAVGQIIQDYDSDKMFPALGFGAQLPPDWKVSHEFAINFNPTNPFCSGVDGIAQAYSACLPHIRFYGPTNFSPIVNHVARFAAQATQQRTATQYFILLIITDGVISDMEETRHAVVQASKLPMSIIIVGVGNADFAAMEFLDGDSRMLRSHTGEEAARDIVQFVPFREFRNAAKETLAKAVLAELPQQVVQYFKHKNLPPTNSEPA

SEQ ID NO: 883220 - protein, 243 aa, Homo sapiens
GLQFLPVRKDKRNKAYFTKRLPPVNDIIINLVLYPHPPDRGQIIQDYDSDKMFPALGFGAQLPPDWKVSHEFAINFNPTNPFCSGVDGIAQAYSACLPHIRFYGPTNFSPIVNHVARFAAQATQQRTATQYFILLIITDGVISDMEETRHAVVQASKLPMSIIIVGVGNADFAAMEFLDGDSRMLRSHTGEEAARDIVQFVPFREFRNAAKETLAKAVLAELPQQVVQYFKHKNLPPTNSEPA

SEQ ID NO: 883221 - protein, 601 aa, Homo sapiens
QGPVRLAAAGLAQRDPLFPPPAPTPDIMCSPFRGSRSFQPEDCQELLPPPPAPMAHIPSGGAPAAGAAPMGPQYCVCKVELSVSGQNLLDRDVTSKSDPFCVLFTENNGRWIEYDRTETAINNLNPAFSKKFVLDYHFEEVQKLKFALFDQDKSSMRLDEHDFLGQFSCSLGTIVSSKKITRPLLLLNDKPAGKGLITIAAQELSDNRVITLSLAGRRLDKKDLFGKSDPFLEFYKPGDDGKWMLVHRTEVIKYTLDPVWKPFTVPLVSLCDGDMEKPIQVMCYDYDNDGGHDFIGEFQTSVSQMCEARDSVPLEFECINPKKQRKKKNYKNSGIIILRSCKINRDYSFLDYILGGCQLMFTVGIDFTASNGNPLDPSSLHYINPMGTNEYLSAIWAVGQIIQDYDSDKMFPALGFGAQLPPDWKVSHEFAINFNPTNPFCSGVDGIAQAYSACLPHIRFYGPTNFSPIVNHVARFAAQATQQRTATQYFILLIITDGVISDMEETRHAVVQASKLPMSIIIVGVGNADFAAMEFLDGDSRMLRSHTGEEAARDIVQFVPFREFRNAAKETLAKAVLAELPQQVVQYFKHKNLPPTNSEPA

SEQ ID NO: 883222 - protein, 713 aa, Homo sapiens
QGLSGLGLLDLPPARAGGGPDPERLGAHASGPWPRGQRPEPVPRPRARPSRSSSRGCPGGSERGQRQPCGEGGGARGTCDCQELLPPPPAPMAHIPSGGAPAAGAAPMGPQYCVCKVELSVSGQNLLDRDVTSKSDPFCVLFTENNGRWIEYDRTETAINNLNPAFSKKFVLDYHFEEVQKLKFALFDQDKSSMRLDEHDFLGQFSCSLGTIVSSKKITRPLLLLNDKPAGKGLITIAAQELSDNRVITLSLAGRRLDKKDLFGKSDPFLEFYKPGDDGKWMLVHRTEVIKYTLDPVWKPFTVPLVSLCDGDMEKPIQVMCYDYDNDGGHDFIGEFQTSVSQMCEARDSVPLEFECINPKKQRKKKNYKNSGIIILRSCKINRDYSFLDYILGGCQLMFTVGIDFTASNGNPLDPSSLHYINPMGTNEYLSAIWAVGQIIQDYDSDKMFPALGFGAQLPPDWKVSHEFAINFNPTNPFCSGVDGIAQAYSACLPHIRFYGPTNFSPIVNHVARFAAQATQQRTATQYFILLIITDGVISDMEETRHAVVQASKLPMSIIIVGVGNADFAAMEFLDGDSRMLRSHTGEEAARDIVQFVPFREFRNAAKETLAKAELQCPAAACQLSLLPSPRNMHAHSASLWVAFFYRSPFLFFTTGPPPPTSSSPAGLPLLESTVDASRPNWLPLLLSPPLPFLSIECTLYNFSGIVIENKIF

SEQ ID NO: 883223 - protein, 468 aa, Homo sapiens
QGLSGLGLLDLPPARAGGGPDPERLGAHASGPWPRGQRPEPVPRPRARPSRSSSRGCPGGSERGQRQPCGEGGGARGTCDCQELLPPPPAPMAHIPSGGAPAAGAAPMGPQYCVCKVELSVSGQNLLDRDVTSKSDPFCVLFTENNGRWIEYDRTETAINNLNPAFSKKFVLDYHFEEVQKLKFALFDQDKSSMRLDEHDFLGQFSCSLGTIVSSKKITRPLLLLNDKPAGKGLITIAAQELSDNRVITLSLAGRRLDKKDLFGKSDPFLEFYKPGDDGKWMLVHRTEVIKYTLDPVWKPFTVPLVSLCDGDMEKPIQVMCYDYDNDGGHDFIGEFQTSVSQMCEARDSVPLEFECINPKKQRKKKNYKNSGIIILRSCKINRDYSFLDYILGGCQLMFTVGIDFQLQGIPRPSSLGIEPLGRTISRGNGVWGRPPGLHGLDVPLVGAVPDGGPGWLFPTFVVGCRVC

SEQ ID NO: 883224 - protein, 389 aa, Homo sapiens
QGLSGLGLLDLPPARAGGGPDPERLGAHASGPWPRGQRPEPVPRPRARPSRSSSRGCPGGSERGQRQPCGEGGGARGTCDCQELLPPPPAPMAHIPSGGAPAAGAAPMGPQYCVCKVELSVSGQNLLDRDVTSKSDPFCVLFTENNGRWIEYDRTETAINNLNPAFSKKFVLDYHFEEVQKLKFALFDQDKSSMRLDEHDFLGQFSCSLGTIVSSKKITRPLLLLNDKPAGKGLITIAAQELSDNRVITLSLAGRRLDKKDLFGKSDPFLEFYKPGDDGKWMLVHRTEVIKYTLDPVWKPFTVPLVSLCDGDMEKPIQVMCYDYDNDGGHDFIGEFQTSVSQMCEARDSVPLEFECINPKKQRKGRGDSLLEAVKSIPTVNMSWQPPRM

SEQ ID NO: 883225 - protein, 639 aa, Homo sapiens
QGLSGLGLLDLPPARAGGGPDPERLGAHASGPWPRGQRPEPVPRPRARPSRSSSRGCPGGSERGQRQPCGEGGGARGTCDCQELLPPPPAPMAHIPSGGAPAAGAAPMGPQYCVCKVELSVSGQNLLDRDVTSKSDPFCVLFTENNGRWIEYDRTETAINNLNPAFSKKFVLDYHFEEVQKLKFALFDQDKSSMRLDEHDFLGQFSCSLGTIVSSKKITRPLLLLNDKPAGKGLITIAAQELSDNRVITLSLAGRRLDKKDLFGKSDPFLEFYKPGDDGKWMLVHRTEVIKYTLDPVWKPFTVPLVSLCDGDMEKPIQVMCYDYDNDGGHDFIGEFQTSVSQMCEARDSVPLEFECINPKKQRKKKNYKNSGIIILRSCKINRDYSFLDYILGGCQLMFTVGIDFTASNGNPLDPSSLHYINPMGTNEYLSAIWAVGQIIQDYDSDKMFPALGFGAQLPPDWKVSHEFAINFNPTNPFCSGVDGIAQAYSACLPHIRFYGPTNFSPIVNHVARFAAQATQQRTATQYFILLIITDGVISDMEETRHAVVQASKLPMSIIIVGVGNADFAAMEFLDGDSRMLRSHTGEEAARDIVQFVPFREFRNAAKETLAKAVLAELPQQVVQYFKHKNLPPTNSEPA

SEQ ID NO: 883226 - protein, 542 aa, Homo sapiens
LRSCKINRDYSFLDYILGGCQLMFTVGIDFTASKGIPSDPFCVLFTENNGRWIEYDRTETAINNLNPAFSKKFVLDYHFEEVQKLKFALFDQDKSSMRLDEHDFLGQFSCSLGTIVSSKKITRPLLLLNDKPAGKGLITIAAQELSDNRVITLSLAGRRLDKKDLFGKSDPFLEFYKPGDDGKWMLVHRTEVIKYTLDPVWKPFTVPLVSLCDGDMEKPIQVMCYDYDNDGGHDFIGEFQTSVSQMCEARDSVPLEFECINPKKQRKKKNYKNSGIIILRSCKINRDYSFLDYILGGCQLMFTVGIDFTASNGNPLDPSSLHYINPMGTNEYLSAIWAVGQIIQDYDSDKMFPALGFGAQLPPDWKVSHEFAINFNPTNPFCSGVDGIAQAYSACLPHIRFYGPTNFSPIVNHVARFAAQATQQRTATQYFILLIITDGVISDMEETRHAVVQASKLPMSIIIVGVGNADFAAMEFLDGDSRMLRSHTGEEAARDIVQFVPFREFRNAAKETLAKAVLAELPQQVVQYFKHKNLPPTNSEPA

SEQ ID NO: 883227 - protein, 243 aa, Homo sapiens; identical to SEQ ID NO: 883220

SEQ ID NO: 883228 - protein, 814 aa, Homo sapiens
MHLEGRDGRRYPGAPAVELLQTSVPSGLAELVAGKRRLPRGAGGADPSHSCPRGAAGQSSWAPAGQEFASFLTKGRSHSSLPQMSSSRSKDSCFTENTPLLRNSLQEKGSRCIPVYHPEFITAEESWEDSSADWERRYLLSREVSGLSASASSEKGDLLDSPHIRLRLSKLRRCVQWLKVMGLFAFVVLCSILFSLYPDQGKLWQLLALSPLENYSVNLSSHVDSTLLQVDLAGALVASGPSRPGREEHIVVELTQADALGSRWRRPQQVTHNWTVYLNPRRSEHSVMSRTFEVLTRETVSISIRASLQQTQAVPLLMAHQYLRGSVETQVTIATAILAGVYALIIFERPSLTHVVEWIDFETLALLFGMMILVAIFSETGFFDYCAVKAYRLSRGRVWAMIIMLCLIAAVLSAFLDNVTTMLLFTPVTIRLCEVLNLDPRQVLIAEVIFTNIGGAATAIGDPPNVIIVSNQELRKMGLDFAGFTAHMFIGICLVLLVCFPLLRLLYWNRKLYNKEPSEIVELKHEIHVWRLTAQRISPASREETAVRRLLLGKVLALEHLLARRLHTFHRQISQEDKNWETNIQELQKKHRISDGILLAKCLTVLGFVIFMFFLNSFVPGIHLDLGWIAILGAIWLLILADIHDFEIILHRVEWATLLFFAALFVLMEALAHLHLIEYVGEQTALLIKMVPEEQRLIAAIVLVVWVSALASSLIDNIPFTATMIPVLLNLSHDPEVGLPAPPLMYALAFGACLGGNGTLIGASANVVCAGIAEQHGYGFSFMEFFRLGFPMMVVSCTVGMCYLLVAHVVVGWN

SEQ ID NO: 883229 - protein, 760 aa, Homo sapiens
MHLEGRDGRRYPGAPAVELLQTSVPSGLAELVAGKRRLPRGAGGADPSHSCPRGAAGQSSWAPAGQEFASFLTKGRSHSSLPQMSSSRSKDSCFTENTPLLRNSLQEKGSRCIPVYHPEFITAEESWEDSSADWERRYLLSREVSGLSASASSEKGDLLDSPHIRLRLSKLRRCVQWLKVMGLFAFVVLCSVTHNWTVYLNPRRSEHSVMSRTFEVLTRETVSISIRASLQQTQAVPLLMAHQYLRGSVETQVTIATAILAGVYALIIFEIVHRTLAAMLGSLAALAALAVIGDRPSLTHVVEWIDFETLALLFGMMILVAIFSETGFFDYCAVKAYRLSRGRVWAMIIMLCLIAAVLSAFLDNVTTMLLFTPVTIRLCEVLNLDPRQVLIAEVIFTNIGGAATAIGDPPNVIIVSNQELRKMGLDFAGFTAHMFIGICLVLLVCFPLLRLLYWNRKLYNKEPSEIVELKHEIHVWRLTAQRISPASREETAVRRLLLGKVLALEHLLARRLHTFHRQISQEDKNWETNIQELQKKHRISDGILLAKCLTVLGFVIFMFFLNSFVPGIHLDLGWIAILGAIWLLILADIHDFEIILHRVEWATLLFFAALFVLMEALAHLHLIEYVGEQTALLIKMVPEEQRLIAAIVLVVWVSALASSLIDNIPFTATMIPVLLNLSHDPEVGLPAPPLMYALAFGACLGGNGTLIGASANVVCAGIAEQHGYGFSFMEFFRLGFPMMVVSCTVGMCYLLVAHVVVGWN

SEQ ID NO: 883230 - protein, 813 aa, Homo sapiens
MHLEGRDGRRYPGAPAVELLQTSVPSGLAELVAGKRRLPRGAGGADPSHSCPRGAAGQSSWAPAGQEFASFLTKGRSHSSLPQMSSSRSKDSCFTENTPLLRNSLQEKGSRCIPVYHPEFITAEESWEDSSADWERRYLLSREVSGLSASASSEKGDLLDSPHIRLRLSKLRRCVQWLKVMGLFAFVVLCSILFSLYPDQGKLWQLLALSPLENYSVNLSSHVDSTLLQVDLAGALVASGPSRPGREEHIVVELTQADALGSRWRRPQQVTHNWTVYLNPRRSEHSVMSRTFEVLTRETVSISIRASLQQTQAVPLLMAHQYLRGSVETQVTIATAILAGVYALIIFEIVHRTLAAMLGSLAALAALAVIGDRPSLTHVVEWIDFETLALLFGMMILVAIFSETGFFDYCAVKAYRLSRGRVWAMIIMLCLIAAVLSAFLDNVTTMLLFTPVTIRLCEVLNLDPRQVLIAEVIFTNIGGAATAIGDPPNVIIVSNQELRKMGLDFAGFTAHMFIGICLVLLVCFPLLRLLYWNRKLYNKEPSEIVELKHEIHVWRLTAQRISPASREETAVRRLLLGKVLALEHLLARRLHTFHRQISQEDKNWETNIQELQKKHRISDGILLAKCLTVLGFVIFMFFLNSFVPGIHLDLGWIAILGAIWLLILADIHDFEIILHRVEWATLLFFAALFVLMEALAHLHLIEYVGEQTALLIKMVPEEQRLIAAIVLVVWVSALASSLIDNIPFTATMIPVLLNLSHDPEVGLPAPPLMYALAFGACLGGNGTLIGASANVVCAGIAEQHGYGFSFMEFFSQD

SEQ ID NO: 883231 - protein, 346 aa, Homo sapiens
MHLEGRDGRRYPGAPAVELLQTSVPSGLAELVAGKRRLPRGAGGADPSHSCPRGAAGQSSWAPAGQEFASFLTKGRSHSSLPQMSSSRSKDSCFTENTPLLRNSLQEKGSRCIPVYHPEFITAEESWEDSSADWERRYLLSREVSGLSASASSEKGDLLDSPHIRLRLSKLRRCVQWLKVMGLFAFVVLCSILFSLYPDQGKLWQLLALSPLENYSVNLSSHVDSTLLQVDLAGALVASGPSRPGREEHIVVELTQADALGSRWRRPQQVTHNWTVYLNPRRSEHSVMSRTFEVLTRETVSISIRASLAALAALAVIGDGPAWFHLHIPLPIPDLHTHGLSDSPSL

SEQ ID NO: 883232 - protein, 838 aa, Homo sapiens
MHLEGRDGRRYPGAPAVELLQTSVPSGLAELVAGKRRLPRGAGGADPSHSCPRGAAGQSSWAPAGQEFASFLTKGRSHSSLPQMSSSRSKDSCFTENTPLLRNSLQEKGSRCIPVYHPEFITAEESWEDSSADWERRYLLSREVSGLSASASSEKGDLLDSPHIRLRLSKLRRCVQWLKVMGLFAFVVLCSILFSLYPDQGKLWQLLALSPLENYSVNLSSHVDSTLLQVDLAGALVASGPSRPGREEHIVVELTQADALGSRWRRPQQVTHNWTVYLNPRRSEHSVMSRTFEVLTRETVSISIRASLQQTQAVPLLMAHQYLRGSVETQVTIATAILAGVYALIIFEIVHRTLAAMLGSLAALAALAVIGDRPSLTHVVEWIDFETLALLFGMMILVAIFSETGFFDYCAVKAYRLSRGRVWAMIIMLCLIAAVLSAFLDNVTTMLLFTPVTIRLCEVLNLDPRQVLIAEVIFTNIGGAATAIGDPPNVIIVSNQELRKMGLDFAGFTAHMFIGICLVLLVCFPLLRLLYWNRKLYNKEPSEIVELKHEIHVWRLTAQRISPASREETAVRRLLLGKVLALEHLLARRLHTFHRQISQEDKNWETNIQELQKKHRISDGILLAKCLTVLGFVIFMFFLNSFVPGIHLDLGWIAILGAIWLLILADIHDFEIILHRVEWATLLFFAALFVLMEALAHLHLIEYVGEQTALLIKMVPEEQRLIAAIVLVVWVSALASSLIDNIPFTATMIPVLLNLSHDPEVGLPAPPLMYALAFGACLGGNGTLIGASANVVCAGIAEQHGYGFSFMEFFRLGFPMMVVSCTVGMCYLLVAHVVVGWN

SEQ ID NO: 883233 - protein, 795 aa, Homo sapiens
SELLTSKAVLRSPSRAEVRTLNSLLEKDLQVRRSHSSLPQMSSSRSKDSCFTENTPLLRNSLQEKGSRCIPVYHPEFITAEESWEDSSADWERRYLLSREVSGLSASASSEKGDLLDSPHIRLRLSKLRRCVQWLKVMGLFAFVVLCSILFSLYPDQGKLWQLLALSPLENYSVNLSSHVDSTLLQVDLAGALVASGPSRPGREEHIVVELTQADALGSRWRRPQQVTHNWTVYLNPRRSEHSVMSRTFEVLTRETVSISIRASLQQTQAVPLLMAHQYLRGSVETQVTIATAILAGVYALIIFEIVHRTLAAMLGSLAALAALAVIGDRPSLTHVVEWIDFETLALLFGMMILVAIFSETGFFDYCAVKAYRLSRGRVWAMIIMLCLIAAVLSAFLDNVTTMLLFTPVTIRLCEVLNLDPRQVLIAEVIFTNIGGAATAIGDPPNVIIVSNQELRKMGLDFAGFTAHMFIGICLVLLVCFPLLRLLYWNRKLYNKEPSEIVELKHEIHVWRLTAQRISPASREETAVRRLLLGKVLALEHLLARRLHTFHRQISQEDKNWETNIQELQKKHRISDGILLAKCLTVLGFVIFMFFLNSFVPGIHLDLGWIAILGAIWLLILADIHDFEIILHRVEWATLLFFAALFVLMEALAHLHLIEYVGEQTALLIKMVPEEQRLIAAIVLVVWVSALASSLIDNIPFTATMIPVLLNLSHDPEVGLPAPPLMYALAFGACLGGNGTLIGASANVVCAGIAEQHGYGFSFMEFFRLGFPMMVVSCTVGMCYLLVAHVVVGWN

SEQ ID NO: 883234 - protein, 251 aa, Homo sapiens
NNYSVESAVADALGAAGVTMYRDAILAQWNDGLHPDPIYSASFTTPTKPFRLQCSGAFFLGLTIICILPSLPFQTPLEVQMAQPNYGLELVTGSAKNGTYFRIHINKYKMVETITCLSREPFPASNYIRLFGQHEQLLNNLCARYDENLITDLYSYFTEPWCLALFHDRFIDLRKELRQILASKEEEDLPSIEQLAHQIEDEEINPTEKPRQYLKRVFEESIYKTLVERSTLDYLHYNRYHLPMYAWPGIV

SEQ ID NO: 883235 - protein, 82 aa, Homo sapiens
SGVIFDEGRAHVALKTKPRGGQALSFLPSLLGGSTTVATCRGPENTTLPRSPGPEPNPSLTPQPRRPATPHRYHGRRRRHAQ

SEQ ID NO: 883236 - protein, 82 aa, Homo sapiens; identical to SEQ ID NO: 883235

SEQ ID NO: 883237 - protein, 102 aa, Homo sapiens
SGVIFDEGRAHVALKTKPRGGQALSFLPSLLGGSTTVATCRGPENTTLPRSPGLCRPLSSLGLRQHFLTVTLGPEPNPSLTPQPRRPATPHRYHGRRRRHAQ

SEQ ID NO: 883238 - protein, 109 aa, Homo sapiens
MAEDADMRNELEEMQRRADQLADESLESTRRMLQLVEESKDAGIRTLVMLDEQGEQLDRVEEGMNHINQDMKEAEKNLKDLGKCCGLFICLVTSRYWVPALICGVQFSF

SEQ ID NO: 883239 - protein, 303 aa, Homo sapiens
MAEDADMRNELEEMQRRADQLADESLESTLVCCNLVDPRRTHDAGTHRTSALLLGLTPRDEQPRPRCRTRTALTPNYSYRNATLHTRKRLTDTHTSTPTTLHRDTLPAERLSPPPAPFAYTHTDLSPSHLHCPLTPPPQPLARPPSPPRTRTLPCAHALPLASACSPCALHHAAHAPTRGPPPPAPAPFPSLPPPHTQQLDSPPRTQNNWTNLGTSNTHPLTTPTRWHPAPNTNIRRDTPLPPTPNTMAPPHAAFMGAQTARTHGLTNQQHFRLHMHFRTRATSTGYQSGSRQPPTQPNTPVN

SEQ ID NO: 883240 - protein, 82 aa, Homo sapiens; identical to SEQ ID NO: 883235

SEQ ID NO: 883241 - protein, 82 aa, Homo sapiens; identical to SEQ ID NO: 883235

SEQ ID NO: 883242 - protein, 82 aa, Homo sapiens; identical to SEQ ID NO: 883235

SEQ ID NO: 883243 - protein, 82 aa, Homo sapiens; identical to SEQ ID NO: 883235

SEQ ID NO: 883244 - protein, 82 aa, Homo sapiens; identical to SEQ ID NO: 883235

SEQ ID NO: 883245 - protein, 110 aa, Homo sapiens
SGVIFDEGRAHVALKTKPRGGQALSFLPSLLGGSTTVATCRGPENTTLPRSPGPEPNPSLTPQPRRPATPHRYHGRRSKDAGIRTLVMLDEQGEQLERIEEGMDQINSRT

SEQ ID NO: 883246 - protein, 82 aa, Homo sapiens; identical to SEQ ID NO: 883235

SEQ ID NO: 883247 - protein, 69 aa, Homo sapiens
SPGLQNSARGENRQIDRIMEKADSNKTRIDEANQRATKMLGKWLSVPTRVLLQMLSGKIAPSCFSHGII

SEQ ID NO: 883248 - protein, 82 aa, Homo sapiens; identical to SEQ ID NO: 883235

SEQ ID NO: 883249 - protein, 82 aa, Homo sapiens; identical to SEQ ID NO: 883235

SEQ ID NO: 883250 - protein, 82 aa, Homo sapiens; identical to SEQ ID NO: 883235

SEQ ID NO: 883251 - protein, 124 aa, Homo sapiens
SGVIFDEGRAHVALKTKPRGGQALSFLPSLLGGSTTVATCRGPENTTLPRSPGPEPNPSLTPQPRRPATPHRYHGRRSLESTRRMLQLVEESKDAGIRTLVMLDEQGEQLERIEEGMDQINSRT

SEQ ID NO: 883252 - protein, 82 aa, Homo sapiens; identical to SEQ ID NO: 883235

SEQ ID NO: 883253 - protein, 101 aa, Homo sapiens
SGVIFDEGRAHVALKTKPRGGQALSFLPSLLGGSTTVATCRGPENTTLPRSPGPEPNPSLTPQPRRPATPHRYHGRRNNWNALRKGWTKSTQGHERSRERI

SEQ ID NO: 883254 - protein, 425 aa, Homo sapiens
MGEEANDDKKPTTKFELERETELRFEVEASQSVQLELLTGMAEIFGTELTRNKKFTFDAGAKVAVFTWHGCSVQLSGRTEVAYVSKDTPMLLYLNTHTALEQMRRQAEKEEERGPRVMVVGPTDVGKSTVCRLLLNYAVRLGRRPTYVELDVGQGSVSIPGTMGALYIERPADVEEGFSIQAPLVYHFGSTTPGTNIKLYNKITSRLADVFNQRCEVNRRASVSGCVINTCGWVKGSGYQALVHAASAFEVDVVVVLDQERLYNELKRDLPHFVRTVLLPKSGGVVERSKDFRRECRDERIREYFYGFRGCFYPHAFNVKFSDVKIYKVGAPTIPDSCLPLGMSQEDNQLKLVPVTPGRDMVHHLLSVSTAEGTEENLSETSVAGFIVVTSVDLEHQVFTVLSPAPRPLPKNFLLIMDIRFMDLK

SEQ ID NO: 883255 - protein, 425 aa, Homo sapiens; identical to SEQ ID NO: 883254

SEQ ID NO: 883256 - protein, 361 aa, Homo sapiens
MGEEANDDKKPTTKFELERETELRFEVEASQSVQLELLTGMAEIFGTELTRNKKFTFDAGAKVAVFTWHGCSVQLSGRTEVAYVSKDTPMLLYLNTHTALEQMRRQAEKEEERGPRVMVVGPTDVGKSTVCRLLLNYAITSRLADVFNQRCEVNRRASVSGCVINTCGWVKGSGYQALVHAASAFEVDVVVVLDQERLYNELKRDLPHFVRTVLLPKSGGVVERSKDFRRECRDERIREYFYGFRGCFYPHAFNVKFSDVKIYKVGAPTIPDSCLPLGMSQEDNQLKLVPVTPGRDMVHHLLSVSTAEGTEENLSETSVAGFIVVTSVDLEHQVFTVLSPAPRPLPKNFLLIMDIRFMDLK

SEQ ID NO: 883257 - protein, 100 aa, Homo sapiens
GHVQPVRCTNCARCVPKDKAIKKFVIRNIVEAVAVRDISEASVFDAYVLPKLYVKLHYCVSCAIHSKVVRNRSREARKDRTPPPRFRPAGAAPRPPPKPM

SEQ ID NO: 883258 - protein, 749 aa, Homo sapiens
MEAETGSSVETGKKANRGTRIALVVFVGGTLVLGTILFLVSQGLLSLQAKQEYCLKPECIEAAAAILSKVNLSVDPCDNFFRFACDGWISNNPIPEDMPSYGVYPWLRHNVDLKLKELLEKSISRRRDTEAIQKAKILYSSCMNEKAIEKADAKPLLHILRHSPFRWPVLESNIGPEGVWSERKFSLLQTLATFRGQYSNSVFIRLYVSPDDKASNEHILKLDQATLSLAVREDYLDNSTEAKSYRDALYKFMVDTAVLLGANSSRAEHDMKSVLRLEIKIAEIMIPHENRTSEAMYNKMNISELSAMIPQFDWLGYIKKVIDTRLYPHLKDISPSENVVVRVPQYFKDLFRILGSERKKTIANYLVWRMVYSRIPNLSRRFQYRWLEFSRVIQGTTTLLPQWDKCVNFIESALPYVVGKMFVDVYFQEDKKEMMEELVEGVRWAFIDMLEKENEWMDAGTKRKAKEKARAVLAKVGYPEFIMNDTHVNEDLKAIKFSEADYFGNVLQTRKYLAQSDFFWLRKAVPKTEWFTNPTTVNAFYSASTNQIRFPAGELQKPFFWGTEYPRSLSYGAIGVIVGHEFTHGFDNNGRKYDKNGNLDPWWSTESEEKFKEKTKCMINQYSNYYWKKAGLNVKGKRTLGENIADNGGLREAFRAYRKWINDRRQGLEEPLLPGITFTNNQLFFLSYAHVRCNSYRPEAAREQVQIGAHSPPQFRVNGAISNFEEFQKAFNCPPNSTMNRGMDSCRLW

SEQ ID NO: 883259 - protein, 749 aa, Homo sapiens; identical to SEQ ID NO: 883258

SEQ ID NO: 883260 - protein, 203 aa, Homo sapiens
MNDTHVNEDLKAIKFSEADYFGNVLQTRKYLAQSDFFWLRKAVPKTEWFTNPTTVNAFYSASTNQIRFPAGELQKPFFWGTEYPRSLSYGAIGVIVGHEFTHGFDNNGRKYDKNGNLDPWWSTESEEKFKEKTKCMINQYSNYYWKKAGLNVKGKRTLGENIADNGGLREAFRLQEMLMTKPGWEPLYRVIPNLLRFLLGASQ

SEQ ID NO: 883261 - protein, 729 aa, Homo sapiens
MEAETGSSVETGKKANRGTRIALVVFVGGTLVLGTILFLVSQGLLSLQAKQEYCLKPECIEAAAAILSKVNLSVDPCDNFFRFACDGWISNNPIPEDMPSYGVYPWLRHNVDLKLKELLEKSISRRRDTEAIQKAKILYSSCMNEKAIEKADAKPLLHILRHSPFRWPVLESNIGPEGVWSERKFSLLQTLATFRGQYSNSVFIRLYVSPDDKASNEHILKLDQATLSLAVREDYLDNSTEAKSYRDALYKFMVDTAVLLGANSSRAEHDMKSVLRLEIKIAEIMIPHENRTSEAMYNKMNISELSAMIPQFDWLGYIKKVIDTRLYPHLKDISPSENVVVRVPQYFKDLFRILGSERKKTIANYLVWRMVYSRIPNLSRRFQYRWLEFSRVIQGTTTLLPQWDKCVNFIESALPYVVGKMFVDVYFQEDKKEMMEELVEGVRWAFIDMLEKENEWMDAGTKRKAKEKARAVLAKVGYPEFIMNDTHVNEDLKAIKFSEADYFGNVLQTRKYLAQSDFFWLRKAVPKTEWFTNPTTVNAFYSASTNQIRFPAGELQKPFFWGTEYPRSLSYGAIGVIVGHEFTHGFDNNGRKYDKNGNLDPWWSTESEEKFKEKTKCMINQYSNYYWKKAGLNVKGKRTLGENIADNGGLREAFRAYRKWINDRRQGLEEPLLPGITFTNNQLFFLSYAHVRCNSYRPEAAREQVQIGAHSPPQFRISSRRAPEAFLMG

SEQ ID NO: 883262 - protein, 323 aa, Homo sapiens
MGSRVSREDFEWVYTDQPHADRRREILAKYPEIKSLMKPDPNLIWIIIMMVLTQLGAFYIVKDLDWKWVIFGAYAFGSCINHSMTLAIHEIAHNAAFGNCKAMWNRWFGMFANLPIGIPYSISFKRYHMDHHRYLGADGVDVDIPTDFEGWFFCTAFRKFIWVILQPLFYAFRPLFINPKPITYLEVINTVAQVTFDILIYYFLGIKSLVYMLAASLLGLGLHPISGHFIAEHYMFLKGHETYSYYGPLNLLTFNVGYHNEHHDFPNIPGKSLPLVRKIAAEYYDNLPHYNSWIKVLYDFVMDDTISPYSRMKRHQKGEMVLE

SEQ ID NO: 883263 - protein, 137 aa, Homo sapiens
PPDGVGPWLHLNCHLESGWKVEELGLISFSPCSLGSVLLQTPLPHPNHPAHPVGWSRWFGMFANLPIGIPYSISFKRYHMDHHRYLGADGVDVDIPTDFEGWFFCTAFRKFIWVILQPLFYAFRPLFINRRIERAEL

SEQ ID NO: 883264 - protein, 323 aa, Homo sapiens; identical to SEQ ID NO: 883262

SEQ ID NO: 883265 - protein, 323 aa, Homo sapiens; identical to SEQ ID NO: 883262

SEQ ID NO: 883266 - protein, 288 aa, Homo sapiens
MGSRVSREDFEWVYTDQPHADRRREILAKYPEIKSLMKPDPNLIWIIIMMVLTQLGAFYIVKDLDWKWVIFGAYAFGSCINHSMTLAIHEIAHNAAFGNCKAMWNRWFGMFANLPIGIPYSISFKRYHMDHHRYLGADGVDVDIPTDFEGWFFCTAFRKFIWVILQPLFYAFRPLFINPKPITYLEVINTVAQVTFDILIYYFLGIKSLVYMLAASLLGLGLHPISGHFIAEHYMFLKGHETYSYYGPLNLLTFNVGYHNEHHDFPNIPGKSLPLSWSFLDGCSGSHL

SEQ ID NO: 883267 - protein, 323 aa, Homo sapiens; identical to SEQ ID NO: 883262

SEQ ID NO: 883268 - protein, 302 aa, Homo sapiens [sequence omitted]

SEQ ID NO: 883269 - protein, 323 aa, Homo sapiens; identical to SEQ ID NO: 883262

SEQ ID NO: 883270 - protein, 288 aa, Homo sapiens; identical to SEQ ID NO: 883266

SEQ ID NO: 883271 - protein, 368 aa, Homo sapiens
MGSRVSREDFEWVYTDQPHADRRREILAKYPEIKSLMKPDPNLIWIIIMMVLTQLGAFYIVKDLDWKWVIFGAYAFGSCINHSMTLAIHEIAHNAAFGNCKAMWNRWFGMFANLPIGIPYSISFKRYHMDHHRYLGADGVDVDIPTDFEGWFFCTAFRKFIWVILQPLFYAFRPLFINPKPITYLEVINTVAQVTFDILIYYFLGIKSLVYMLAASLLGLGLHPISGHFIAEHYMFLKGHETYSYYGPLNLLTFNVGYHNEHHDFPNIPGKSLPLVSKGFDTYSNFVFSFVCFLRRCLTQSPRLAGSGTISAHCNLHLPGSNDSHASVSQVVGITGACYHAQLIFVFLVEMGFCHVGQASILSVQAVH

SEQ ID NO: 883272 - protein, 327 aa, Homo sapiens
MGSRVSREDFEWVYTDQPHADRRREILAKYPEIKSLMKPDPNLIWIIIMMVLTQLGAFYIVKDLDWKWVIFGAYAFGSCINHSMTLAIHEIAHNAAFGNCKAMWNRWFGMFANLPIGIPYSISFKRYHMDHHRYLGADGVDVDIPTDFEGWFFCTAFRKFIWVILQPLFYAFRPLFINPKPITYLEVINTVAQVTFDILIYYFLGIKSLVYMLAASLLGLGLHPISGHFIAEHYMFLKGHETYSYYGPLNLLTFNVGYHNEHHDFPNIPGKSLPLTGSWWRIPVLVARTCHPSYSGGLKCKNRLNPGGRGCSEQRLRHNYIPAWETE

SEQ ID NO: 883273 - protein, 120 aa, Homo sapiens
DTIEKLEKKQGTVRNSRGAAAAAATSEQPAGSESRQLVCKPPLSPWGAASRGKTSSGSTPTSRTPTGAGRSWVRKIAAEYYDNLPHYNSWIKVLYDFVMDDTISPYSRMKRHQKGEMVLE

SEQ ID NO: 883274 - protein, 157 aa, Homo sapiens [sequence omitted]

SEQ ID NO: 883275 - protein, 323 aa, Homo sapiens; identical to SEQ ID NO: 883262

SEQ ID NO: 883276 - protein, 323 aa, Homo sapiens; identical to SEQ ID NO: 883262

SEQ ID NO: 883277 - protein, 323 aa, Homo sapiens; identical to SEQ ID NO: 883262

SEQ ID NO: 883278 - protein, 287 aa, Homo sapiens
MKPDPNLIWIIIMMVLTQLGAFYIVKDLDWKWVIFGAYAFGSCINHSMTLAIHEIAHNAAFGNCKAMWNRWFGMFANLPIGIPYSISFKRYHMDHHRYLGADGVDVDIPTDFEGWFFCTAFRKFIWVILQPLFYAFRPLFINPKPITYLEVINTVAQVTFDILIYYFLGIKSLVYMLAASLLGLGLHPISGHFIAEHYMFLKGHETYSYYGPLNLLTFNVGYHNEHHDFPNIPGKSLPLVRKIAAEYYDNLPHYNSWIKVLYDFVMDDTISPYSRMKRHQKGEMVLE

SEQ ID NO: 883279 - protein, 112 aa, Homo sapiens [sequence omitted]

SEQ ID NO: 883280 - protein, 327 aa, Homo sapiens; identical to SEQ ID NO: 883272

SEQ ID NO: 883281 - protein, 120 aa, Homo sapiens; identical to SEQ ID NO: 883273

SEQ ID NO: 883282 - protein, 89 aa, Homo sapiens
LSMSGVTHIRHEARMALEKKLNQAVLDRHALGYARTDPHLCDFLETHFLDEQVQLIKKMGDYLTNLHRMGGPEAGLGEYLFERLTLKHD

SEQ ID NO: 883283 - protein, 1193 aa, Homo sapiens
MLCKQTNKQKTTLALRNKNKKQEASCTARNFSKIRGQASQFGPANMWVLLHLGKPLKMSLTCGDLTERTFRSSDCTLMPWFRKAVLYTFCPWKLLILSVISRYQKEKLFRIGNVKSIEGTTNNNSRNNSVNKVPFHLFFFGLQHQPVDFQFFLNEELQTLLSRVCEVALNAFLWLFVKTYFPSLSTVNSFSTIEDLRQKRSLGLLSQGLNLFFKVKNISLEVFALLVKAYFAELPKVKGKLNFSNFAPGFLEPHCLLIRVFPPVNYFAFDQVVLESRAASVSSQPRLWPLRRGWGDRQECEGEWVTLSVTLNVGRHGLLSLGLKPLFWSKEYWENWITFSIFLETGSSLKCIWGSFLGSKGQFLYPVLQVSVSCGMREKTMAAQEGSGESLSTRRSKSVAPAKDEDLERTPLWGCEEDLFPLLLACRSRTEPDVMPSLVDILQIDTLSPAFKGVFCFKEFLVLPQQLKSQNRIKGLERLLKYRITKTPGSVRKRLCLESDFNVKPMPYIYTALCSLQIGVFSAPSRCPSSEMIVDYYSEVPGPEPPVMKQELESQDSQRLSAHFLLSSPPPRFTCYLVKLLLAHSPLGNKKFDWERVFHCTGLSIRLALVAVWLNSPFETYRALSVLEHSLLLVACLNLLAGCLWIGVSPNHAVFPFFSFCTLDYLGGAVCSLDEKHIFKEMESVYFVCFLRHVLSNVRDQTSVIRGWSFDLLLLIAFHVIMIIYSGSTPVTNNVTEMKQIQRKNIFKSFEKKCYSNLRQFKFIGTLSLSKKYFFFSFFRQSLALLPRLECSGTILAHCNLCLPGSSDSPASASRVSWDYARLIFIFLVETGVYHVAQAGFKLLTSGDLPASASQSAGITGVSHHTWPKDSILNSHIHDLMSNVKYRKAAIIHIVLGGISSSVYQEYDIQLWFSNLFLFQFLFVYLTGEIESSELGDDCPAQGFVIHNLKIKVPETKCLQPVRNGLWKGDNFSPHRKPLVSLNEALSRHTFLCVVGQEAIPLPLQHISVLSHMTPEPHEKTLKIMDSSLYLNFFFLTFSPKGSVPRGKSKCRKIETRSFNRHDILMCLHDGNVTFSTAWCLGARYYCGNLSLSFTVLSSCVSYPSKLKKRHGSFLSCFMFLRLTCKIKIKIRKKYIKANDMKKKLKILLVFIFVLQCCFLKEINMWLEVFNGCVLIVYNKVTVPSGGSHQNRF

SEQ ID NO: 883284 - protein, 1101 aa, Homo sapiens
MQIPEGKLFRIGNVKSIEGTTNNNSRNNSVNKVPFHLFFFGLQHQPVDFQFFLNEELQTLLSRVCEVALNAFLWLFVKTYFPSLSTVNSFSTIEDLRQKRSLGLLSQGLNLFFKVKNISLEVFALLVKAYFAELPKVKGKLNFSNFAPGFLEPHCLLIRVFPPVNYFAFDQVVLESRAASVSSQPRLWPLRRGWGDRQECEGEWVTLSVTLNVGRHGLLSLGLKPLFWSKEYWENWITFSIFLETGSSLKCIWGSFLGSKGQFLYPVLQVSVSCGMREKTMAAQEGSGESLSTRRSKSVAPAKDEDLERTPLWGCEEDLFPLLLACRSRTEPDVMPSLVDILQIDTLSPAFKGVFCFKEFLVLPQQLKSQNRIKGLERLLKYRITKTPGSVRKRLCLESDFNVKPMPYIYTALCSLQIGVFSAPSRCPMPEMIVDYYSEVPGPEPPVMKQELESQDSQRLSAHFLLSSPPPRFTCYLVKLLLAHSPLGNQEVDWERVFHCTGLSIRLALVAVWLNSPFETYRALSVLEHSLLLVACLNLLAGCLWIGVSPNHAVFPFFSFCTLDYLGGAVCSLDEKHIFKEMESVYFVCFLRHVLSNVRDQTSVIRGWSFDLLLLIAFHVIMIIYSGSTPVTNNVTEMKQIQRKNIFKSFEKKCYFKFKTCLKFIGTLSLSKKYFFFSFFRQSLALLPRLECSGTILAHCNLCLPGGSDSPASASRVSWDYARLIFIFLVETGVYHVAQAGFKLLTSGDLPASASQSAGITGVSHHTWPKDSILIYHIHDLMSNVKYRKAAIIHIVLGGISSSVYQEYDIQLWFSNLFLFQFLFVYLTGEIDILELGDDCPAQGFVIHNLKIKVPETKCLQPVRNGLWKGDNFSPHRKPLVSLNEALSRHTFLCVVGQEAIPLPLQHISVLSHMTPEPHKKTLKIMDSSLYLNFFFLTFSPKGSVPRGKSKCRKIETRSFNRHDILMCLHDGNVTFSTAWCLGARYECGNLSLSFTVLSSCVSYPSKLKKRHGSFLSCFMFLRLTCKIKIKIRKKYIKANDMKKKLKYTTGVHFCPAVLLSQRNKHVAGSVYWLRFDRLQQGYSALWWQSSKSLLDIVFIF

SEQ ID NO: 883285 - protein, 319 aa, Homo sapiens
LWSTFAFYLNFRWLNKLGSAVIHQESTTKDEECYSESEQEDPEIAAETPPPPHASQTQSLTAQQASSSSPSLSGTSYSFSSLENTVKTPSSFPSSLSKERQSLPDTVNSLSAAEDEGQPITFAVQVHSPVPSEAGIHKALENSFVTSESGFLNSLSSDDTSSLSSNHDHLTVPDKPAGSKIMDKEETKVSEDDEMEKLYKSLEQASLSPLGDRRPSTKKELRKSFVKRCKNPSINEKLHKIRTLNSTLKCKEHDLAMINQLLDDPKLTARKYREWKVMNTLLIQDIYQQQRASPAPDDTDDTPQELKKSPSSPSVENSI

SEQ ID NO: 883286 - protein, 1264 aa, Homo sapiens
TSPAGPKTPKAQAGPAATVSKAPAASKAPAAPKVPVTPRVSRAPKTPAAQKVPTDAGPTLDVARLLSEVQPTSRASVSLLKGQGQAGRQGPQSSGTLALSSKHQFQMEGLLGAWEGAPRQPPRHLQANSTVTSFQRYHEALNTPFELNLSGEPGNQGLRRVVIDGSSVAMVHGLQHFFSCRGIAMAVQFFWNRGHREVTVFVPTWQLKKNRRVRESHFLTKLHSLKMLSITPSQLENGKKITTYDYRFMVKLAEETDGIIVTNEQIHILMNSSKKLMVKDRLLPFTFAGNLFMVPDDPLGRDGPTLDEFLKKPNRLDTDIGNFLKVWKTLPPSSASVTELSDDADSGPLESLPNMEEVREEKEERQDEEQRQGQGTQKAAEEDDLDSSLASVFRVECPSLSEEILRCLSLHDPPDGALDIDLLPGAASPYLGIPWDGKAPCQQVLAHLAQLTIPSNFTALSFFMGFMDSHRDAIPDYEALVGPLHSLLKQKPDWQWDQEHEEAFLALKRALVSALCLMAPNSQLPFRLEVTVSHVALTAILHQEHSGRKHPIAYTSKPLLPDEESQGPQSGGDSPYAVAWALKHFSRCIGDTPVVLDLSYASRTTADPEVREGRRVSKAWLIRWSLLVQDKGKRALELALLQGLLGENRLLTPAASMPRFFQVLPPFSDLSTFVCIHMSGYCFYREDEWCAGFGLYVLSPTSPPVSLSFSCSPYTPTYAHLAAVACGLERFGQSPLPVVFLTHCNWIFSLLWELLPLWRARGFLSSDGAPLPHPSLLSYIISLTSGLSSLPFIYRTSYRGSLFAVTVDTLAKQGAQGGGQWWSLPKDVPAPTVSPHAMGKGPNLLALQLSDSTLADIIARLQAGQKLSGSSPFSSAFNSLSLDKESGLLMFKGDKKPRVWVVPTQLRRDLIFSVHDIPLGAHQRPEETYKKLRLLGWWPGMQEHVKDYCRSCLFCIPRNLIGSELKVIESPWPLRSTAPWSNLQIEVVGPVTISEEGHKHVLIVADPNTRWVEAFPLKPYTHTAVAQVLLQHVFARWGVPVRLEAAQGPQFARHVLVSCGLALGAQVASLSRDLQFPCLTSSGAYWEFKRALKEFIFLHGKKWAASLPLLHLAFRASSTDATPFKVLTGGESRLTEPLWWEMSSANIEGLKMDVFLLQLVGELLELHWRVADKASEKAENRRFKRESQEKEWNVGDQVLLLSLPRNGSSAKWVGPFYIGDRLSLSLYRIWGFPTPEKLGCIYPSSLMKAFAKSGTPLSFKVLEQ

SEQ ID NO: 883287 - protein, 128 aa, Homo sapiens
PPQQQKEAPAMVSVGESPGPFVDMGTLQNRGPENSKRLSSLGATGSLITAQSTPQEAANQLVRVGSNNQDGMDSAQEEGTVQATSSQDSTNHTQALLKQRQVQPHSPSLVLYAFPLLATFVITYPSFK

SEQ ID NO: 883288 - protein, 461 aa, Homo sapiens
CYNPGQEELVAVAAVEGDQAPEGGRPSRAGSGRGSHAPVWGRSFSCSPYTPTYAHLAAVACGLERFGQSPLPVVFLTHCNWIFSLLWELLPLWRARGFLSSDGAPLPHPSLLSYIISLTSGLSSLPFIYRTSYRGSLFAVTVDTLAKQGAQGGGQWWSLPKDVPAPTVSPHAMGKGPNLLALQLSDSTLADIIARLQAGQKLSGSSPFSSAFNSLSLDKESGLLMFKGDKKPRVWVVPTQLRRDLIFSVHDIPLGAHQRPEETYKKLRLLGWWPGMQEHVKDYCRSCLFCIPRNLIGSELKVIEGPGLCFKGAGRLQQEWHTVKCWHGSTSQPLPTPSQSLQSSAPSTSTVSCIPDPTDCVIASSVSPPESCGPAFCVEQNPGSLTAILCRDHPCSECEFLPGVCAYTHPLNCCRCQGSGLQVKASATSLWLAFLVVSFLRKLSQSPGLAQVARTLGIAEC

SEQ ID NO: 883289 - protein, 1235 aa, Homo sapiens
TSPAGPKTPKAQAGPAATVSKAPAASKAPAAPKVPVTPRVSRAPKTPAAQKVPTDAGPTLDVARLLSEVQPTSRASVSLLKGQGQAGRQGPQSSGTLALSSKHQFQMEGLLGAWEGAPRQPPRHLQANSTVTSFQRYHEALNTPFELNLSGEPGNQGLRRVVIDGSSVAMVHGLQHFFSCRGIAMAVQFFWNRGHREVTVFVPTWQLKKNRRVRESHFLTKLHSLKMLSITPSQLENGKKITTYDYRFMVKLAEETDGIIVTNEQIHILMNSSKKLMVKDRLLPFTFAGNLFMVPDDPLGRDGPTLDEFLKKPNRLDTDIGNFLKVWKTLPPSSASVTELSDDADSGPLESLPNMEEVREEKEERQDEEQRQGQGTQKAAEEDDLDSSLAIDLLPGAASPYLGIPWDGKAPCQQVLAHLAQLTIPSNFTALSFFMGFMDSHRDAIPDYEALVGPLHSLLKQKPDWQWDQEHEEAFLALKRALVSALCLMAPNSQLPFRLEVTVSHVALTAILHQEHSGRKHPIAYTSKPLLPDEESQGPQSGGDSPYAVAWALKHFSRCIGDTPVVLDLSYASRTTADPEVREGRRVSKAWLIRWSLLVQDKGKRALELALLQGLLGENRLLTPAASMPRFFQVLPPFSDLSTFVCIHMSGYCFYREDEWCAGFGLYVLSPTSPPVSLSFSCSPYTPTYAHLAAVACGLERFGQSPLPVVFLTHCNWIFSLLWELLPLWRARGFLSSDGAPLPHPSLLSYIISLTSGLSSLPFIYRTSYRGSLFAVTVDTLAKQGAQGGGQWWSLPKDVPAPTVSPHAMGKGPNLLALQLSDSTLADIIARLQAGQKLSGSSPFSSAFNSLSLDKESGLLMFKGDKKPRVWVVPTQLRRDLIFSVHDIPLGAHQRPEETYKKLRLLGWWPGMQEHVKDYCRSCLFCIPRNLIGSELKVIESPWPLRSTAPWSNLQIEVVGPVTISEEGHKHVLIVADPNTRWVEAFPLKPYTHTAVAQVLLQHVFARWGVPVRLEAAQGPQFARHVLVSCGLALGAQVASLSRDLQFPCLTSSGAYWEFKRALKEFIFLHGKKWAASLPLLHLAFRASSTDATPFKVLTGGESRLTEPLWWEMSSANIEGLKMDVFLLQLVGELLELHWRVADKASEKAENRRFKRESQEKEWNVGDQVLLLSLPRNGSSAKWVGPFYIGDRLSLSLYRIWGFPTPEKLGCIYPSSLMKAFAKSGTPLSFKVLEQ

SEQ ID NO: 883290 - protein, 217 aa, Homo sapiens
METIWIYQFRLIVIGDSTVGKSCLLHRFTQGRFPGLRSPACDPTVGVDFFSRLLEIEPGKRIKLQLWDTAGQERFRSITRSYYRNSVGGFLVFDITNRRSFEHVKDWLEEAKMYVQPFRIVFLLVGHKCDLASQRQVTREEAEKLSADCGMKYIETSAKDATNVEESFTILTRDIYELIKKGEICIQDGWEGVKSGFVPNTVHSSEEAVKPRKECFC

SEQ ID NO: 883291 - protein, 137 aa, Homo sapiens [sequence omitted]

SEQ ID NO: 883292 - protein, 137 aa, Homo sapiens [sequence omitted]

SEQ ID NO: 883293 - protein, 137 aa, Homo sapiens [sequence omitted]

SEQ ID NO: 883294 - protein, 137 aa, Homo sapiens [sequence omitted]

SEQ ID NO: 883295 - protein, 137 aa, Homo sapiens [sequence omitted]

SEQ ID NO: 883296 - protein, 137 aa, Homo sapiens [sequence omitted]

SEQ ID NO: 883297 - protein, 95 aa, Homo sapiens
MTAPCWAQPGSLAKCLLEAVPARGLQQGDSLPSGHYQYCLYLEVGKRSPLRQQDNGQFREGEGSKRFRGHRSQRTPPRPTAGSAWKIHLLGTFWQ

SEQ ID NO: 883298 - protein, 358 aa, Homo sapiens
MAGCGEIDHSINMLPTNRKANESCSNTAPSLTVPECAICLQTCVHPVSLPCKHVFCYLCVKGASWLGKRCALCRQEIPEDFLDKPTLLSPEELKAASRGNGEYAWYYEGRNGWWQYDERTSRELEDAFSKGKKNTEMLIAGFLYVADLENMVQYRRNEHGRRRKIKRDIIDIPKKGVAGLRLDCDANTVNLARESSADGADSVSAQSGASVQPLVSSVRPLTSVDGQLTSPATPSPDASTSLEDSFAHLQLSGDNTAERSHRGEGEEDHESPSSGRVPAPDTSIEETESDASSDSEDVSAVVAQHSLTQQRLLVSNANQTVPDRSDRSGTDRSVAGGGTVSVSVRSRRPDGQCTVTEV

SEQ ID NO: 883299 - protein, 358 aa, Homo sapiens; identical to SEQ ID NO: 883298

SEQ ID NO: 883300 - protein, 358 aa, Homo sapiens; identical to SEQ ID NO: 883298

SEQ ID NO: 883301 - protein, 358 aa, Homo sapiens; identical to SEQ ID NO: 883298

SEQ ID NO: 883302 - protein, 358 aa, Homo sapiens; identical to SEQ ID NO: 883298

SEQ ID NO: 883303 - protein, 358 aa, Homo sapiens; identical to SEQ ID NO: 883298

SEQ ID NO: 883304 - protein, 340 aa, Homo sapiens
MAGCGEIDHSINMLPTNRKANESCSNTAPSLTVPECAICLQTCVHPVSLPCKHVFCYLCVKGASWLGKRCALCRQEIPEDFLDKPTLLSPEELKAASRGNGEYAWYYEGRNGWWQYDERTSRELEDAFSKGKKNTEMLIAGFLYVADLGDIIDIPKKGVAGLRLDCDANTVNLARESSADGADSVSAQSGASVQPLVSSVRPLTSVDGQLTSPATPSPDASTSLEDSFAHLQLSGDNTAERSHRGEGEEDHESPSSGRVPAPDTSIEETESDASSDSEDVSAVVAQHSLTQQRLLVSNANQTVPDRSDRSGTDRSVAGGGTVSVSVRSRRPDGQCTVTEV

SEQ ID NO: 883305 - protein, 79 aa, Homo sapiens
FCWNCTLSEPLGPNTKQAHSKEARRMQAAKSPLPTGKRVPADSGARQGQNDEAPELARRCGCGCAARRGPSSATRRVVT

SEQ ID NO: 883306 - protein, 358 aa, Homo sapiens; identical to SEQ ID NO: 883298

SEQ ID NO: 883307 - protein, 358 aa, Homo sapiens; identical to SEQ ID NO: 883298

SEQ ID NO: 883308 - protein, 358 aa, Homo sapiens; identical to SEQ ID NO: 883298

SEQ ID NO: 883309 - protein, 358 aa, Homo sapiens; identical to SEQ ID NO: 883298

SEQ ID NO: 883310 - protein, 358 aa, Homo sapiens; identical to SEQ ID NO: 883298

SEQ ID NO: 883311 - protein, 82 aa, Homo sapiens
NACLSIGPELGTRTEGLNVRRYTGLEAYTSMWSVELADSREFINATIHISSRAGVTCGYGVIDSIIPDRLFAQFALSGILIK

SEQ ID NO: 883312 - protein, 1352 aa, Homo sapiens [sequence omitted]

SEQ ID NO: 883313 - protein, 1176 aa, Homo sapiens
METRRRLEQERATMQMTPGEFRRPRLASFGGMGTTSSLPSFVGSGNHNPAKHQLQNGYQGNGDYGSYAPAAPTTSSMGSSIRHSPLSSGISTPVTNVSPMHLQHIREQMAIALKRLKELEEQVRTIPVLQVKISVLQEEKRQLVSQLKNQRAASQINVCGVRKRSYSAGNASQLEQLSRARRSGGELYIDYEEEEMETVEQSTQRIKEFRQLTADMQALEQKIQDSSCEASSELRENGECRSVAVGAEENMNDIVVYHRGSRSCKDAAVGTLVEMRNCGVSVTEAMLGVMTEADKEIELQQQTIEALKEKIYRLEVQLRETTHDREMTKLKQELQAAGSRKKVDKATMAQPLVFSKVVEAVVQTRDQMVGSHMDLVDTCVGTSVETNSVGISCQPECKNKVVGPELPMNWWIVKERVEMHDRCAGRSVEMCDKSVSVEVSVCETGSNTEESVNDLTLLKTNLNLKEVRSIGCGDCSVDVTVCSPKECASRGVNTEAVSQVEAAVMAVPRTADQDTSTDLEQVHQFTNTETATLIESCTNTCLSTLDKQTSTQTVETRTVAVGEGRVKDINSSTKTRSIGVGTLLSGHSGFDRPSAVKTKESGVGQININDNYLVGLKMRTIACGPPQLTVGLTASRRSVGVGDDPVGESLENPQPQAPLGMMTGLDHYIERIQKLLAEQQTLLAENYSELAEAFGEPHSQMGSLNSQLISTLSSINSVMKSASTEELRNPDFQKTSLGKITGNYLGYTCKCGGLQSGSPLSSQTSQPEQEVGTSEGKPISSLDAFPTQEGTLSPVNLTDDQIAAGLYACTNNESTLKSIMKKKDGNKDSNGAKKNLQFVGINGGYETTSSDDSSSDESSSSESDDECDVIEYPLEEEEEEEDEDTRGMAEGHHAVNIEGLKSARVEDEMQVQECEPEKVEIRERYELSEKMLSACNLLKNTINDPKALTSKDMRFCLNTLQHEWFRVSSQKSAIPAMVGDYIAAFEAISPDVLRYVINLADGNGNTALHYSVSHSNFEIVKLLLDADVCNVDHQNKAGYTPIMLAALAAVEAEKDMRIVEELFGCGDVNAKASQAGQTALMLAVSHGRIDMVKGLLACGADVNIQDDEGSTALMCASEHGHVEIVKLLLAQPGCNGHLEDNDGSTALSIALEAGHKDIAVLLYAHVNFPTHRGSFD

SEQ ID NO: 883314 - protein, 1194 aa, Homo sapiens
METRRRLEQERATMQMTPGEFRRPRLASFGGMGTTSSLPSFVGSGNHNPAKHQLQNGYQGNGDYGSYAPAAPTTSSMGSSIRHSPLSSGISTPVTNVSPMHLQHIREQMAIALKRLKELEEQVRTIPVLQVKISVLQEEKRQLVSQLKNQRAASQINVCGVRKRSYSAGNASQLEQLSRARRSGGELYIDYEEEEMETVEQSTQRIKEFRQLTADMQALEQKIQDSSCEASSELRENGECRSVAVGAEENMNDIVVYHRGSRSCKDAAVGTLVEMRNCGVSVTEAMLGVMTEADKEIELQQQTIEALKEKIYRLEVQLRETTHDREMTKLKQELQAAGSRKKVDKATMAQPLVFSKVVEAVVQTRDQMVGSHMDLVDTCVGTSVETNSVGISCQPECKNKVVGPELPMNWWIVKERVEMHDRCAGRSVEMCDKSVSVEVSVCETGSNTEESVNDLTLLKTNLNLKEVRSIGCGDCSVDVTVCSPKECASRGVNTEAVSQVEAAVMAVPRTADQDTSTDLEQVHQFTNTETATLIESCTNTCLSTLDKQTSTQTVETRTVAVGEGRVKDINSSTKTRSIGVGTLLSGHSGFDRPSAVKTKESGVGQININDNYLVGLKMRTIACGPPQLTVGLTASRRSVGVGDDPVGESLENPQPQAPLGMMTGLDHYIERIQKLLAEQQTLLAENYSELAEAFGEPHSQMGSLNSQLISTLSSINSVMKSASTEELRNPDFQKTSLGKITGNYLGYTCKCGGLQSGSPLSSQTSQPEQEVGTSEGKPISSLDAFPTQEGTLSPVNLTDDQIAAGLYACTNNESTLKSIMKKKDGNKDSNGAKKNLQFVGINGGYETTSSDDSSSDESSSSESDDECDVIEYPLEEEEEEEDEDTRGMAEGHHAVNIEGLKSARVEDEMQVQECEPEKVEIRERYELSEKMLSACNLLKNTINDPKALTSKDMRFCLNTLQHEWFRVSSQKSAIPAMVGDYIAAFEAISPDVLRYVINLADGNGNTALHYSVSHSNFEIVKLLLDADVCNVDHQNKAGYTPIMLAALAAVEAEKDMRIVEELFGCGDVNAKASQAGQTALMLAVSHGRIDMVKGLLACGADVNIQDDEGSTALMCASEHGHVEIVKLLLAQPGCNGHLEDNDGSTALSIALEAGHKDIAVLLYAHVNFAKAQSPGTPRLGRKTSPGPTHRGSFD

SEQ ID NO: 883315 - protein, 1206 aa, Homo sapiens
METRRRLEQERATMQMTPGEFRRPRLASFGGMGTTSSLPSFVGSGNHNPAKHQLQNGYQGNGDYGSYAPAAPTTSSMGSSIRHSPLSSGISTPVTNVSPMHLQHIREQMAIALKRLKELEEQVRTIPVLQVKISVLQEEKRQLVSQLKNQRAASQINVCGVRKRSYSAGNASQLEQLSRARRSGGELYIDYEEEEMETVEQSTQRIKEFRQLTADMQALEQKIQDSSCEASSELRENGECRSVAVGAEENMNDIVVYHRGSRSCKDAAVGTLVEMRNCGVSVTEAMLGVMTEADKEIELQQQTIEALKEKIYRLEVQLRETTHDREMTKLKQELQAAGSRKKVDKATMAQPLVFSKVVEAVVQTRDQMVGSHMDLVDTCVGTSVETNSVGISCQPECKNKVVGPELPMNWWIVKERVEMHDRCAGRSVEMCDKSVSVEVSVCETGSNTEESVNDLTLLKTNLNLKEVRSIGCGDCSVDVTVCSPKECASRGVNTEAVSQVEAAVMAVPRTADQDTSTDLEQVHQFTNTETATLIESCTNTCLSTLDKQTSTQTVETRTVAVGEGRVKDINSSTKTRSIGVGTLLSGHSGFDRPSAVKTKESGVGQININDNYLVGLKMRTIACGPPQLTVGLTASRRSVGVGDDPVGESLENPQPQAPLGMMTGLDHYIERIQKLLAEQQTLLAENYSELAEAFGEPHSQMGSLNSQLISTLSSINSVMKSASTEELRNPDFQKTSLGKITGNYLGYTCKCGGLQSGSPLSSQTSQPEQEVGTSEGKPISSLDAFPTQEGTLSPVNLTDDQIAAGLYACTNNESTLKSIMKKKDGNKDSNGAKKNLQFVGINGGYETTSSDDSSSDESSSSESDDECDVIEYPLEEEEEEEDEDTRGMAEGHHAVNIEGLKSARVEDEMQVQECEPEKVEIRERYELSEKMLSACNLLKNTINDPKALTSKDMRFCLNTLQHEWFRVSSQKSAIPAMVGDYIAAFEAISPDVLRYVINLADGNGNTALHYSVSHSNFEIVKLLLDADVCNVDHQNKAGYTPIMLAALAAVEAEKDMRIVEELFGCGDVNAKASQAGQTALMLAVSHGRIDMVKGLLACGADVNIQDDEGSTALMCASEHGHVEIVKLLLAQPGCNGHLEDNDGSTALSIALEAGHKDIAVLLYAHVNFAKAQSPVSVVHLAFVNRLKSTRLVDPLPPGIDGRQILC

SEQ ID NO: 883316 - protein, 196 aa, Homo sapiens
TDYGGLICNSYILPPIIPRTRRRWIKSADVCNVDHQNKAGYTPIMLAALAAVEAEKDMRIVEELFGCGDVNAKASQAGQTALMLAVSHGRIDMVKGLLACGADVNIQDDEGSTALMCASEHGHVEIVKLLLAQPGCNGHLEDNDGSTALSIALEAGHKDIAVLLYAHVNFAKAQSPGTPRLGRKTSPGPTHRGSFD

SEQ ID NO: 883317 - protein, 689 aa, Homo sapiens
GNRLVSDKPACRSSADTRPSGQAWPTVGLRAAAGAFRTGSPLALGPETPQVACLPGHPPVRPQVSGGPGAMPDPAAHLPFFYGSISRAEAEEHLKLAGMADGLFLVRQCLRSLGGYVLSLVHDVRFHHFPIERQLNGTYAIAGGKAHCGPAELCEFYSRDPDGLPCNLRKPCIPPSGLEPQPGVFDCLRDAMVRDYVRQTWKLEGEALEQAIISQAPQVEKLIATTAHERMPWYHSSLTREEAERKLYSGAQTDGKFLLRPRKEQGTYALSLIYGKTVYHYLISQDKAGKYCIPEGTKFDTLWQLVEYLKLKADGLIYCLKEACPNSSASNASGAAAPTLPAHPSTLTHPQRRIDTLNSDGYTPEPARITSPDKPRPMPMDTSVYESPYSDPEELKDKKLFLKRDNLLIADIELGCGNFGSVRQGVYRMRKKQIDVAIKVLKQGTEKADTEEMMREAQIMHQLDNPYIVRLIGVCQAEALMLVMEMAGGGPLHKFLVGKREEIPVSNVAELLHQVSMGMKYLEEKNFVHRDLAARNVLLVNRHYAKISDFGLSKALGADDSYYTARSAGKWPLKWYAPECINFRKFSSRSDVWSYGVTMWEALSYGQKPYKKMKGPEVMAFIEQGKRMECPPECPPELYALMSDCWIYKWEDRPDFLTVEQRMRACYYSLASKVEGPPGSTQKAEAACA

SEQ ID NO: 883318 - protein, 469 aa, Homo sapiens
MLWCSTMPDGKVFKLEMRLGPRWKGEALEQAIISQAPQVEKLIATTAHERMPWYHSSLTREEAERKLYSGAQTDGKFLLRPRKEQGTYALSLIYGKTVYHYLISQDKAGKYCIPEGTKFDTLWQLVEYLKLKADGLIYCLKEACPNSSASNASGAAAPTLPAHPSTLTHPQRRIDTLNSDGYTPEPARITSPDKPRPMPMDTSVYESPYSDPEELKDKKLFLKRDNLLIADIELGCGNFGSVRQGVYRMRKKQIDVAIKVLKQGTEKADTEEMMREAQIMHQLDNPYIVRLIGVCQAEALMLVMEMAGGGPLHKFLVGKREEIPVSNVAELLHQVSMGMKYLEEKNFVHRDLAARNVLLVNRHYAKISDFGLSKALGADDSYYTARSAGKWPLKWYAPECINFRKFSSRSDVWSYGVTMWEALSYGQKPYKKMKGPEVMAFIEQGKRMECPPECPPELYALMSDCWIYK

SEQ ID NO: 883319 - protein, 509 aa, Homo sapiens
MLWCSTMPDGKVFKLEMRLGPRWKGEALEQAIISQAPQVEKLIATTAHERMPWYHSSLTREEAERKLYSGAQTDGKFLLRPRKEQGTYALSLIYGKTVYHYLISQDKAGKYCIPEGTKFDTLWQLVEYLKLKADGLIYCLKEACPNSSASNASGAAAPTLPAHPSTLTHPQRRIDTLNSDGYTPEPARITSPDKPRPMPMDTSVYESPYSDPEELKDKKLFLKRDNLLIADIELGCGNFGSVRQGVYRMRKKQIDVAIKVLKQGTEKADTEEMMREAQIMHQLDNPYIVRLIGVCQAEALMLVMEMAGGGPLHKFLVGKREEIPVSNVAELLHQVSMGMKYLEEKNFVHRDLAARNVLLVNRHYAKISDFGLSKALGADDSYYTARSAGKWPLKWYAPECINFRKFSSRSDVWSYGVTMWEALSYGQKPYKKMKGPEVMAFIEQGKRMECPPECPPELYALMSDCWIYKWEDRPDFLTVEQRMRACYYSLASKVEGPPGSTQKAEAACA

SEQ ID NO: 883320 - protein, 509 aa, Homo sapiens; identical to SEQ ID NO: 883319

SEQ ID NO: 883321 - protein, 213 aa, Homo sapiens
MVQSCSAYGCKNRYDKDKPVSFHKFPLTRPSLCKEWEAAVRRKNFKPTKYSSICSEHFTPDCFKRECNNKLLKENAVPTIFLCTEPHDKKEDLLEPQEQLPPPPLPPPVSQVDAAIGLLMPPLQTPVNLSVFCDHNYTVEDTMHQRKRIHQLEQQVEKLRKKLKTAQQRCRRQERQLEKLKEVVHFQKEKDDVSERGYVILPNDYFEIVEVPA

SEQ ID NO: 883322 - protein, 213 aa, Homo sapiens; identical to SEQ ID NO: 883321

SEQ ID NO: 883323 - protein, 73 aa, Homo sapiens
EVRLKLPPPSWRWETGDGCGPSANANNKTGTLVTPEGGHHHCNCWPKLQKKRGNPTERSDTENSFPCLLRRQK

SEQ ID NO: 883324 - protein, 547 aa, Homo sapiens
MAGTKNKTRAQAKTEKKAAIQAKAGAEREATGVVRPVAKTRAKAKAKTGSKTDAVAEMKAVSKNKVVAETKEGALSEPKTLGKAMGDFTPKAGNESTSSTCKNEAGTDAWFWAGEEATINSWFWNGEEAGNSFSTKNDKPEIGAQVCAEELEPAAGADCKPRSGAEEEEEENVIGNWFWEGDDTSFDPNPKPVSRIVKPQPVYEINEKNRPKDWSEVTIWPNAPAVTPAVLGFRSQAPSEASPPSYIVLASAEENACSLPVATACRPSRNTRSCSQPIPECRFDSDPCIQTIDEIRRQIRIREVNGIKPFACPCKMECYMDSEEFEKLVSLLKSTTDPLIHKIARIAMGVHNVHPFAQEFINEVGVVTLIESLLSFPSPEMRKKTVITLNPPSGDERQRKIELHVKHMCKETMSFPLNSPGQQSGLKILGQLTTDFVHHYIVANYFSELFHLLSSGNCKTRNLVLKLLLNMSENPTAARDMINMKALAALKLIFNQKEAKANLVSGVAIFINIKEHIRKGSIVVVDHLSYNTLMAIFREVKEIIETM

SEQ ID NO: 883325 - protein, 547 aa, Homo sapiens; identical to SEQ ID NO: 883324

SEQ ID NO: 883326 - protein, 547 aa, Homo sapiens; identical to SEQ ID NO: 883324

SEQ ID NO: 883327 - protein, 347 aa, Homo sapiens
SLWGVPAWRGGSGSGGWESGRRGFFVALPERSGVCQVVSIMFSFNMFDHPIPRVFQNRFSTQYRCFSVSMLAGPNDRSDVEKGGKIIMPPSALDQLSRLNITYPMLFKLTNKNSDRMTHCGVLEFVADEGICYLPHWMMQNLLLEEGGLVQVESVNLQVATYSKFQPQSPDFLDITNPKAVLENALRNFACLTTGDVIAINYNEKIYELRVMETKPDKAVSIIECDMNVDFDAPLGYKEPERQVQHEESTEGEADHSGYAGELGFRAFSGSGNRLDGKKKGVEPSPSPIKPGDIKRGIPNYEFKLGKITFIRNSRPLVKKVEEDEAGGRFVAFSGEGQSLRKKGRKP

SEQ ID NO: 883328 - protein, 382 aa, Homo sapiens
SLWGVPAWRGGSGSGGWESGRRGFFVALPERSGVCQVVSIMFSFNMFDHPIPRVFQNRFSTQYRCFSVSMLAGPNDRSDVEKGGKIIMPPSALDQLSRLNITYPMLFKLTNKNSDRMTHCGVLEFVADEGICYLPHWCRTYSWKKAAWSRWRASTFKWPPTPRVKFCYLPHWMMQNLLLEEGGLVQVESVNLQVATYSKFQPQSPDFLDITNPKAVLENALRNFACLTTGDVIAINYNEKIYELRVMETKPDKAVSIIECDMNVDFDAPLGYKEPERQVQHEESTEGEADHSGYAGELGFRAFSGSGNRLDGKKKGVEPSPSPIKPGDIKRGIPNYEFKLGKITFIRNSRPLVKKVEEDEAGGRFVAFSGEGQSLRKKGRKP

SEQ ID NO: 883329 - protein, 306 aa, Homo sapiens
SLWGVPAWRGGSGSGGWESGRRGFFVALPERSGVCQVVSIMFSFNMFDHPIPRVFQNRFSTQYRCFSVSMLAGPNDRSDVEKGGKIIMPPSALDQLSRLNITYPMLFKLTNKNSDRMTHCGVLEFVADEGICYLPHWMMQNLLLEEGGLVQVESVNLQVATYSKFQPQSPDFLDITNPKAVLENALRNFACLTTGDVIAINYNEKIYELRVMETKPDKAVSIIECDMNVDFDAPLGYKEPERQVQHEESTEGEADHSGYAGELGFRAFSGSGNRLDGKKKGVEPSPSPIKPGDIKRGIPNYEFKLG

SEQ ID NO: 883330 - protein, 306 aa, Homo sapiens; identical to SEQ ID NO: 883329

SEQ ID NO: 883331 - protein, 355 aa, Homo sapiens
SLWGVPAWRGGSGSGGWESGRRGFFVALPERSGVCQVVSIMFSFNMFDHPIPRVFQNRFSTQYRCFSVSMLAGPNDRSDVEKGGKIIMPPSALDQLSRLNITYPMLFKLTNKNSDRMTHCGVLEFVADEGICYLPHWMMQNLLLEEGGLVQVESVNLQVATYSKFQPQSPDFLDITNPKAVLENALRNFACLTTGDVIAINYNEKIYELRVMETKPDKAVSIIECDMNVDFDAPLGYKEPERQVQHEESTEGEADHSGYAGELGFRAFSGSGNRLDGKKKGVEPSPSPIKPGDIKRGIPNYEFKLGKITFIRNSRPLVKKVEEVSVFPCISLVGNEEIYLLVMTEVLGILSRGVH

SEQ ID NO: 883332 - protein, 302 aa, Homo sapiens
MFDHPIPRVFQNRFSTQYRCFSVSMLAGPNDRSDVEKGGKIIMPPSALDQLSRLNITYPMLFKLTNKNSDRMTHCGVLEFVADEGICYLPHWMMQNLLLEEGGLVQVESVNLQVATYSKFQPQSPDFLDITNPKAVLENALRNFACLTTGDVIAINYNEKIYELRVMETKPDKAVSIIECDMNVDFDAPLGYKEPERQVQHEESTEGEADHSGYAGELGFRAFSGSGNRLDGKKKGVEPSPSPIKPGDIKRGIPNYEFKLGKITFIRNSRPLVKKVEEDEAGGRFVAFSGEGQSLRKKGRKP

SEQ ID NO: 883333 - protein, 260 aa, Homo sapiens
MPPSALDQLSRLNITYPMLFKLTNKNSDRMTHCGVLEFVADEGICYLPHWMMQNLLLEEGGLVQVESVNLQVATYSKFQPQSPDFLDITNPKAVLENALRNFACLTTGDVIAINYNEKIYELRVMETKPDKAVSIIECDMNVDFDAPLGYKEPERQVQHEESTEGEADHSGYAGELGFRAFSGSGNRLDGKKKGVEPSPSPIKPGDIKRGIPNYEFKLGKITFIRNSRPLVKKVEEDEAGGRFVAFSGEGQSLRKKGRKP

SEQ ID NO: 883334 - protein, 260 aa, Homo sapiens; identical to SEQ ID NO: 883333

SEQ ID NO: 883335 - protein, 243 aa, Homo sapiens
MLFKLTNKNSDRMTHCGVLEFVADEGICYLPHWMMQNLLLEEGGLVQVESVNLQVATYSKFQPQSPDFLDITNPKAVLENALRNFACLTTGDVIAINYNEKIYELRVMETKPDKAVSIIECDMNVDFDAPLGYKEPERQVQHEESTEGEADHSGYAGELGFRAFSGSGNRLDGKKKGVEPSPSPIKPGDIKRGIPNYEFKLGKITFIRNSRPLVKKVEEDEAGGRFVAFSGEGQSLRKKGRKP

SEQ ID NO: 883336 - protein, 180 aa, Homo sapiens
SLWGVPAWRGGSGSGGWESGRRGFFVALPERSGVCQVVSIMFSFNMFDHPIPRVFQNRFSTQYRCFSVSMLAGPNDRSDVEKGGKITYATPRPWNRTSSRLNITYPMLFKLTNKNSDRMTHCGVLEFVADEGICYLPHWCRTYSWKKAAWSRWRASNRIAHVGRYPLHSQIVAQPLQEAP

SEQ ID NO: 883337 - protein, 347 aa, Homo sapiens; identical to SEQ ID NO: 883327

SEQ ID NO: 883338 - protein, 347 aa, Homo sapiens; identical to SEQ ID NO: 883327

SEQ ID NO: 883339 - protein, 377 aa, Homo sapiens
MAEEVVVVAKFDYVAQQEQELDIKKNERLWLLDDSKSWWRVRNSMNKTGFVPSNYVERKNSARKASIVKNLKDTLGIGKVKRKPSVPDSASPADDSFVDPGERLYDLNMPAYVKFNYMAEREDELSLIKGTKVIVMEKCSDGWWRGSYNGQVGWFPSNYVTEEGDSPLGDHVGSLSEKLAAVVNNLNTGQVLHVVQALYPFSSSNDEELNFEKGDVMDVIEKPENDPEWWKCRKINGMVGLVPKNYVTVMQNNPLTSGLEPSPPQCDYIRPSLTGKFAGNPWYYGKVTRHQAEMALNERGHEGDFLIRDSESSPNDFSVSLKAQGKNKHFKVQLKETVYCIGQRKFSTMEELVEHYKKAPIFTSEQGEKLYLVKHLS

SEQ ID NO: 883340 - protein, 377 aa, Homo sapiens; identical to SEQ ID NO: 883339

SEQ ID NO: 883341 - protein, 377 aa, Homo sapiens; identical to SEQ ID NO: 883339

SEQ ID NO: 883342 - protein, 244 aa, Homo sapiens
MAEEVVVVAKFDYVAQQEQELDIKKNERLWLLDDSKSWWRVRNSMNKTGFVPSNYVERKNSARKASIVKNLKDTLGIGKVKRKPSVPDSASPADDSFVDPGERLYDLNMPAYVKFNYMAEREDELSLIKGTKCDYIRPSLTGKFAGNPWYYGKVTRHQAEMALNERGHEGDFLIRDSESSPNDFSVSLKAQGKNKHFKVQLKETVYCIGQRKFSTMEELVEHYKKAPIFTSEQGEKLYLVKHLS

SEQ ID NO: 883343 - protein, 244 aa, Homo sapiens; identical to SEQ ID NO: 883342

SEQ ID NO: 883344 - protein, 315 aa, Homo sapiens
MAEEVVVVAKFDYVAQQEQELDIKKNERLWLLDDSKSWWRVRNSMNKTGFVPSNYVERKNSARKASIVKNLKDTLGIGKVKRKPSVPDSASPADDSFVDPGERLYDLNMPAYVKFNYMAEREDELSLIKGTKVIVMEKCSDGWWRGSYNGQVGWFPSNYVTEEGDSPLGDHVGSLSEKLAAVVNNLNTGQVLHVVQALYPFSSSNDEELNFEKGDVMDVIEKPENDPEWWKCRKINGMVGLVPKNYVTVMQNNPLTSGLEPSPPQCDYIRPSLTGKFAGNPWYYGKVTRHQAEMALNERGHEGDFLIRDSESSVS

SEQ ID NO: 883345 - protein, 694 aa, Homo sapiens
MAEEVVVVAKFDYVAQQEQELDIKKNERLWLLDDSKSWWRVRNSMNKTGFVPSNYVERKNSARKASIVKNLKDTLGIGKVKRKPSVPDSASPADDSFVDPGERLYDLNMPAYVKFNYMAEREDELSLIKGTKVIVMEKCSDGWWRGSYNGQVGWFPSNYVTEEGDSPLGDHVGSLSEKLAAVVNNLNTGQVLHVVQALYPFSSSNDEELNFEKGDVMDVIEKPENDPEWWKCRKINGMVGLVPKNYVTVMQNNPLTSGLEPSPPQCDYIRPSLTGKFAGNPWYYGKVTRHQAEMALNERGHEGDFLIRDSESSATALLMQHLGLGRKEGASEPALSELSWAGSRTIQASLRLRPQLQHMHSEERWLRWTECFILERNNVLGQTEIYQMQTFTMVLEEIWTSLFMWFFYALIPCLLTDEVAILPAPQNLSVLSTNMKHLLMWSPVIAPGETVYYSVEYQGEYESLYTSHIWIPSSWCSLTEGPECDVTDDITATVPYNLRVRATLGSQTSAWSILKHPFNRNSTILTRPGMEITKDGFHLVIELEDLGPQFEFLVAYWRREPGAEEHVKMVRSGGIPVHLETMEPGAAYCVKAQTFVKAIGRYSAFSQTECVEVQGEAIPLVLALFAFVGFMLILVVVPLFVWKMGRLLQYSCCPVVVLPDTKITNSPQKLISCRREEVDACATAVMSFRGRKPS

SEQ ID NO: 883346 - protein, 588 aa, Homo sapiens
MAEEVVVVAKFDYVAQQEQELDIKKNERLWLLDDSKSWWRVRNSMNKTGFVPSNYVERKNSARKASIVKNLKDTLGIGKVKRKPSVPDSASPADDSFVDPGERLYDLNMPAYVKFNYMAEREDELSLIKGTKVIVMEKCSDGWWRGSYNGQVGWFPSNYVTEEGDSPLGDHVGSLSEKLAAVVNNLNTGQVLHVVQALYPFSSSNDEELNFEKGDVMDVIEKPENDPEWWKCRKINGMVGLVPKNYVTVMQNNPLTSGLEPSPPQCDYIRPSLTGKFAGNPWYYGKVTRHQAEMALNERGHEGDFLIRDSESSATALLMQHLGLGRKEGASEPALSELSWAGSRTIQASLRLRPQLQHMHSEERWLRWTECFILERNNVLGQTEIYQMQTFTMVLEEIWTSLFMWFFYALIPCLLTAILTRPGMEITKDGFHLVIELEDLGPQFEFLVAYWRREPGAEEHVKMVRSGGIPVHLETMEPGAAYCVKAQTFVKAIGRYSAFSQTECVEVQGEAIPLVLALFAFVGFMLILVVVPLFVWKMGRLLQYSCCPVVVLPDTKITNSPQKLISCRREEVDACATAVMSFRGRKPS

SEQ ID NO: 883347 - protein, 317 aa, Homo sapiens [sequence omitted]

SEQ ID NO: 883348 - protein, 698 aa, Homo sapiens
MAEEVVVVAKFDYVAQQEQELDIKKNERLWLLDDSKSWWRVRNSMNKTGFVPSNYVERKNSARKASIVKNLKDTLGIGKVKRKPSVPDSASPADDSFVDPGERLYDLNMPAYVKFNYMAEREDELSLIKGTKVIVMEKCSDGWWRGSYNGQVGWFPSNYVTEEGDSPLGDHVGSLSEKLAAVVNNLNTGQVLHVVQALYPFSSSNDEELNFEKGDVMDVIEKPENDPEWWKCRKINGMVGLVPKNYVTVMQNNPLTSGLEPSPPQCDYIRPSLTGKFAGNPWYYGKVTRHQAEMALNERGHEGDFLIRDSESSATALLMQHLGLGRKEGASEPALSELSWAGSRTIQASLRLRPQLQHMHSEERWLRWTECFILERNNVLGQTEIYQMQTFTMVLEEIWTSLFMWFFYALIPCLLTDEVAILPAPQNLSVLSTNMKHLLMWSPVIAPGETVYYSVEYQGEYESLYTSHIWIPSSWCSLTEGPECDVTDDITATVPYNLRVRATLGSQTSAWSILKHPFNRNSRTAFLLSVHLCPELVGFDLTDFKNEAADPRAILTRPGMEITKDGFHLVIELEDLGPQFEFLVAYWRREPGAEEHVKMVRSGGIPVHLETMEPGAAYCVKAQTFVKAIGRYSAFSQTECVEVQGEAIPLVLALFAFVGFMLILVVVPLFVWKMGRLLQYSCCPVVVLPDTLGNRVVL

SEQ ID NO: 883349 - protein, 327 aa, Homo sapiens
MAEEVVVVAKFDYVAQQEQELDIKKNERLWLLDDSKSWWRVRNSMNKTGFVPSNYVERKNSARKASIVKNLKDTLGIGKVKRKPSVPDSASPADDSFVDPGERLYDLNMPAYVKFNYMAEREDELSLIKGTKVIVMEKCSDGWWRGSYNGQVGWFPSNYVTEEGDSPLGDHVGSLSEKLAAVVNNLNTGQVLHVVQALYPFSSSNDEELNFEKGDVMDVIEKPENDPEWWKCRKINGMVGLVPKNYVTVMQNNPLTSGLEPSPPQCDYIRPSLTGKFAGNPWYYGKVTRHQAEMALNERGHEGDFLIRDSESSILLRILEFDDTHFP

SEQ ID NO: 883350 - protein, 199 aa, Homo sapiens
RAAYIAAAAVAAATPGGGHVEGPGPRLLPLLPAAPCGERPRPPEPTRPGPTPGPAAQTRHRTRTPTLRTRAQPQLKMARGSALLLASLLLAAALSASAGLWSPAKEKRGWTLNSAGYLLGPHAVGNHRSFSDKNGLTSKRELRPEDDMKPGSFDRSIPENNIMRTIIEFLSFLHLKEAGALDRLLDLPAAASSEDIERS

SEQ ID NO: 883351 - protein, 106 aa, Homo sapiens
MCRGCNSLMCILRSCCSDVALPFAEAGALDRLLDLPAEPPQKTSSGPESLLGTFAVCCNLKSNLKIMDNLRPIYAESAIPGLFALMLGWYHLRFFFGNNFEWQNKE

SEQ ID NO: 883352 - protein, 199 aa, Homo sapiens; identical to SEQ ID NO: 883350

SEQ ID NO: 883353 - protein, 123 aa, Homo sapiens
MARGSALLLASLLLAAALSASAGLWSPAKEKRGWTLNSAGYLLGPHAVGNHRSFSDKNGLTSKRELRPEDDMKPGSFDRSIPENNIMRTIIEFLSFLHLKEAGALDRLLDLPAAASSEDIERS

SEQ ID NO: 883354 - protein, 106 aa, Homo sapiens; identical to SEQ ID NO: 883351

SEQ ID NO: 883355 - protein, 492 aa, Homo sapiens
AGAPPPASLPTCSLISDCCASNQRDSVGVGPSEPGVGYSLVVRRFLSRSEKRNIRVGVTRFPVTADEWNSNHTIEIEINQTLEIPCFQNSSSKISSEFTYAWSVEDNGTQETLISQNHLISNSTLLKDRVKLGTDYRLHLSPVQIFDDGRKFSCHIRVGPNKILRSSTTVKVFAKPEIPVIVENNSTDVLVERRFTCLLKNVFPKANITWFIDGSFLHDEKEGIYITNEERKGKDGFLELKSVLTRVHSNKPAQSDNLTIWCMALSPVPGNKVWNISSEKITFLLGSEISSTDPPLSVTESTLDTQPSPASSVSPARYPATSSVTLVDVSALRPNTTPQPSNSSMTTRGFNYPWTSSGTDTKKSVSRIPSETYSSSPSGAGSTLHDNVFTSTARAFSEVPTTANGSTKTNHVHITGIVVNKPKDGMSWPVIVAALLFCCMILFGLGVRKWCQYQKEIMERPPPFKPPPPPIKYTCIQEPNESDLPYHEMETL

SEQ ID NO: 883356 - protein, 569 aa, Homo sapiens
MEKKWKYCAVYYIIQIHFVKGVWEKTVNTEENVYATLGSDVNLTCQTQTVGFFVQMQWSKVTNKIDLIAVYHPQYGFYCAYGRPCESLVTFTETPENGSKWTLHLRNMSCSVSGRYECMLVLYPEGIQTKIYNLLIQTHVTADEWNSNHTIEIEINQTLEIPCFQNSSSKISSEFTYAWSVEDNGTQETLISQNHLISNSTLLKDRVKLGTDYRLHLSPVQIFDDGRKFSCHIRVGPNKILRSSTTVKVFAKPEIPVIVENNSTDVLVERRFTCLLKNVFPKANITWFIDGSFLHDEKEGIYITNEERKGKDGFLELKSVLTRVHSNKPAQSDNLTIWCMALSPVPGNKVWNISSEKITFLLGSEISSTDPPLSVTESTLDTQPSPASSVSPARYPATSSVTLVDVSALRPNTTPQPSNSSMTTRGFNYPWTSSGTDTKKSVSRIPSETYSSSPSGAGSTLHDNVFTSTARAFSEVPTTANGSTKTNHVHITGIVVNKPKDGMSWPVIVAALLFCCMILFGLGVRKWCQYQKEIMERPPPFKPPPPPIKYTCIQEPNESDLPYHEMETL

SEQ ID NO: 883357 - protein, 474 aa, Homo sapiens
AGAPPPASLPTCSLISDCCASNQRDSVGVGPSEPGVGYSLVVRRFLSRSEKRNIRVGVTRFPVTADEWNSNHTIEIEINQTLEIPCFQNSSSKISSEFTYAWSVEDNGTQETLISQDYRLHLSPVQIFDDGRKFSCHIRVGPNKILRSSTTVKVFAKPEIPVIVENNSTDVLVERRFTCLLKNVFPKANITWFIDGSFLHDEKEGIYITNEERKGKDGFLELKSVLTRVHSNKPAQSDNLTIWCMALSPVPGNKVWNISSEKITFLLGSEISSTDPPLSVTESTLDTQPSPASSVSPARYPATSSVTLVDVSALRPNTTPQPSNSSMTTRGFNYPWTSSGTDTKKSVSRIPSETYSSSPSGAGSTLHDNVFTSTARAFSEVPTTANGSTKTNHVHITGIVVNKPKDGMSWPVIVAALLFCCMILFGLGVRKWCQYQKEIMERPPPFKPPPPPIKYTCIQEPNESDLPYHEMETL

SEQ ID NO: 883358 - protein, 78 aa, Homo sapiens
GSGTNQLWEMGPYLQNEVDLRGLHGPHTAQGRHLCFSMEAYIHRSLSGRGKSPPRHGNGKTKCFQNYWLPWETSTQMS

SEQ ID NO: 883359 - protein, 1210 aa, Homo sapiens
MTLSGSRGQEEPPPSRVPRAVRVASLLSEGEELSGDDQGDEEEDDHAYEGVPNGGWHTSSLSLSLPSTIAAPHPMDGPPGGSTPVTPVIKAGWLDKNPPQGSYIYQKRWVRLDTDHLRYFDSNKDAYSKRFISVACISHVAAIGDQKFEVITNNRTFAFRAESDVERKEWMQALQQAMAEQRARARLSSAYLLGVPGSEQPDRAGSLELRGFKNKLYVAVVGDKVQLYKNLEEYHLGIGITFIDMSVGNVKEVDRRSFDLTTPYRIFSFSADSELEKEQWLEAMQGAIAEALSTSEVAERIWAAAPNRFCADCGAPQPDWASINLCVVICKRCAGEHRGLGAGVSKVRSLKMDRKVWTETLIELFLQLGNGAGNRFWAANVPPSEALQPSSSPSTRRCHLEAKYREGKYRRYHPLFGNQEELDKALCAAVTTTDLAETQALLGCGAGINCFSGDPEAPTPLALAEQAGQTLQMEFLRNNRTTEVPRLDSMKPLEKHYSVVLPTVSHSGFLYKTASAGKLLQDRRAREEFSRRWCVLGDGVLSYFENERAVTPNGEIRASEIVCLAVPPPDTHGFEHTFEVYTEGERLYLFGLESAEQAHEWVKCIAKAFVPPLAEDLLARDFERLGRLPYKAGLSLQRAQEGWFSLSGSELRAVFPEGPCEEPLQLRKLQELSIQGDSENQVLVLVERRRTLYIQGERRLDFMGWLGAIQKAAASMGDTLSEQQLGDSDIPVIVYRCVDYITQCGLTSEGIYRKCGQTSKTQRLLESLRQDARSVHLKEGEQHVDDVSSALKRFLRDLPDGLFTRAQRLTWLEASEIEDEEEKVSRYRELLVRLPPVNRATVKALISHLYCVQCFSDTNQMNVHNLAIVFGPTLFQTDGQDYKAGRVVEDLINHYVVVFSVDEEELRKQREEITAIVKMRVAGTASGTQHAGDFICTVYLEEKKAETEQHIKVPASMTAEELTLEILDRRNVGIREKDYWTCFEVNEREEAERPLHFAEKVLPILHGLGTDSHLVVKKHQAMEAMLLYLASRVGDTKHGMMKFREDRSLLGLGLPSGGFHDRYFILNSSCLRLYKEVRSQRPWSGAPETSHRPEKEWPIKSLKVYLGVKKKLRPPTCWGFTVVHETEKHEKQQWYLCCDTQMELREWFATFLFVQHDGLVWPSEPSRVSRAVPEVRLGSVSLIPLRGSENEMRRSVAAFTADPLSLLRNV

SEQ ID NO: 883360 - protein, 72 aa, Homo sapiens
ESSWYHLDKLCMHALSYRMSYASRATLLPHSVHMQVFSQPRLHLTPSTFCTYMPYTHPNPTHHCTLSSPGSR

SEQ ID NO: 883361 - protein, 1162 aa, Homo sapiens
MCYFESDFSHSCCKVHLLASGHLGFFLPRTWLILTLSVASEGWGGPGTCPPTPGHLLVVPLPLRSYIYQKRWVRLDTDHLRYFDSNKDAYSKRFISVACISHVAAIGDQKFEVITNNRTFAFRAESDVERKEWMQALQQAMAEQRARARLSSAYLLGVPGSEQPDRAGSLELRGFKNKLYVAVVGDKVQLYKNLEEYHLGIGITFIDMSVGNVKEVDRRSFDLTTPYRIFSFSADSELEKEQWLEAMQGAIAEALSTSEVAERIWAAAPNRFCADCGAPQPDWASINLCVVICKRCAGEHRGLGAGVSKVRSLKMDRKVWTETLIELFLQLGNGAGNRFWAANVPPSEALQPSSSPSTRRCHLEAKYREGKYRRYHPLFGNQEELDKALCAAVTTTDLAETQALLGCGAGINCFSGDPEAPTPLALAEQAGQTLQMEFLRNNRTTEVPRLDSMKPLEKHYSVVLPTVSHSGFLYKTASAGKLLQDRRAREEFSRRWCVLGDGVLSYFENERAVTPNGEIRASEIVCLAVPPPDTHGFEHTFEVYTEGERLYLFGLESAEQAHEWVKCIAKAFVPPLAEDLLARDFERLGRLPYKAGLSLQRAQEGWFSLSGSELRAVFPEGPCEEPLQLRKLQELSIQGDSENQVLVLVERRRTLYIQGERRLDFMGWLGAIQKAAASMGDTLSEQQLGDSDIPVIVYRCVDYITQCGLTSEGIYRKCGQTSKTQRLLESLRQDARSVHLKEGEQHVDDVSSALKRFLRDLPDGLFTRAQRLTWLEASEIEDEEEKVSRYRELLVRLPPVNRATVKALISHLYCVQCFSDTNQMNVHNLAIVFGPTLFQTDGQDYKAGRVVEDLINHYVVVFSVDEEELRKQREEITAIVKMRVAGTASGTQHAGDFICTVYLEEKKAETEQHIKVPASMTAEELTLEILDRRNVGIREKDYWTCFEVNEREEAERPLHFAEKVLPILHGLGTDSHLVVKKHQAMEAMLLYLASRVGDTKHGMMKFREDRSLLGLGLPSGGFHDRYFILNSSCLRLYKEVRSHRPEKEWPIKSLKVYLGVKKKLRPPTCWGFTVVHETEKHEKQQWYLCCDTQMELREWFATFLFVQHDGLVWPSEPSRVSRAVPEVRLGSVSLIPLRGSENEMRRSVAAFTADPLSLLRNV

SEQ ID NO: 883362 - protein, 955 aa, Homo sapiens [sequence omitted]

SEQ ID NO: 883363 - protein, 955 aa, Homo sapiens [sequence omitted]

SEQ ID NO: 883364 - protein, 1101 aa, Homo sapiens
MCYFESDFSHSCCKVHLLASGHLGFFLPRTWLILTLSVASEGWGGPGTCPPTPGHLLVVPLPLRSYIYQKRWVRLDTDHLRYFDSNKDAYSKRFISVACISHVAAIGDQKFEVITNNRTFAFRAESDVERKEWMQALQQAMAEQRARARLSSAYLLGVPGSEQPDRAGSLELRGFKNKLYVAVVGDKVQLYKNLEEYHLGIGITFIDMSVGNVKEVDRRSFDLTTPYRIFSFSADSELEKEQWLEAMQGAIAEALSTSEVAERIWAAAPNRFCADCGAPQPDWASINLCVVICKRCAGEHRGLGAGVSKVRSLKMDRKVWTETLIEALCAAVTTTDLAETQALLGCGAGINCFSGDPEAPTPLALAEQAGQTLQMEFLRNNRTTEVPRLDSMKPLEKHYSVVLPTVSHSGFLYKTASAGKLLQDRRAREEFSRRWCVLGDGVLSYFENERAVTPNGEIRASEIVCLAVPPPDTHGFEHTFEVYTEGERLYLFGLESAEQAHEWVKCIAKAFVPPLAEDLLARDFERLGRLPYKAGLSLQRAQEGWFSLSGSELRAVFPEGPCEEPLQLRKLQELSIQGDSENQVLVLVERRRTLYIQGERRLDFMGWLGAIQKAAASMGDTLSEQQLGDSDIPVIVYRCVDYITQCGLTSEGIYRKCGQTSKTQRLLESLRQDARSVHLKEGEQHVDDVSSALKRFLRDLPDGLFTRAQRLTWLEASEIEDEEEKVSRYRELLVRLPPVNRATVKALISHLYCVQCFSDTNQMNVHNLAIVFGPTLFQTDGQDYKAGRVVEDLINHYVVVFSVDEEELRKQREEITAIVKMRVAGTASGTQHAGDFICTVYLEEKKAETEQHIKVPASMTAEELTLEILDRRNVGIREKDYWTCFEVNEREEAERPLHFAEKVLPILHGLGTDSHLVVKKHQAMEAMLLYLASRVGDTKHGMMKFREDRSLLGLGLPSGGFHDRYFILNSSCLRLYKEVRSHRPEKEWPIKSLKVYLGVKKKLRPPTCWGFTVVHETEKHEKQQWYLCCDTQMELREWFATFLFVQHDGLVWPSEPSRVSRAVPEVRLGSVSLIPLRGSENEMRRSVAAFTADPLSLLRNV

SEQ ID NO: 883365 - protein, 783 aa, Homo sapiens
EDGLLQAWALCAAVTTTDLAETQALLGCGAGINCFSGDPEAPTPLALAEQAGQTLQMEFLRNNRTTEVPRLDSMKPLEKHYSVVLPTVSHSGFLYKTASAGKLLQDRRAREEFSRRWCVLGDGVLSYFENERAVTPNGEIRASEIVCLAVPPPDTHGFEHTFEVYTEGERLYLFGLESAEQAHEWVKCIAKAFVPPLAEDLLARDFERLGRLPYKAGLSLQRAQEGWFSLSGSELRAVFPEGPCEEPLQLRKLQELSIQGDSENQVLVLVERRRTLYIQGERRLDFMGWLGAIQKAAASMGDTLSEQQLGDSDIPVIVYRCVDYITQCGLTSEGIYRKCGQTSKTQRLLESLRQDARSVHLKEGEQHVDDVSSALKRFLRDLPDGLFTRAQRLTWLEASEIEDEEEKVSRYRELLVRLPPVNRATVKALISHLYCVQCFSDTNQMNVHNLAIVFGPTLFQTDGQDYKAGRVVEDLINHYVVVFSVDEEELRKQREEITAIVKMRVAGTASGTQHAGDFICTVYLEEKKAETEQHIKVPASMTAEELTLEILDRRNVGIREKDYWTCFEVNEREEAERPLHFAEKVLPILHGLGTDSHLVVKKHQAMEAMLLYLASRVGDTKHGMMKFREDRSLLGLGLPSGGFHDRYFILNSSCLRLYKEVRSHRPEKEWPIKSLKVYLGVKKKLRPPTCWGFTVVHETEKHEKQQWYLCCDTQMELREWFATFLFVQHDGLVWPSEPSRVSRAVPEVRLGSVSLIPLRGSENEMRRSVAAFTADPLSLLRNV

SEQ ID NO: 883366 - protein, 590 aa, Homo sapiens
RGRAVFPEGPCEEPLRENQPSWARCEAQASFVGWFSLSGSELRAVFPEGPCEEPLQLRKLQELSIQGDSENQVLVLVERRRTLYIQGERRLDFMGWLGAIQKAAASMGDTLSEQQLGDSDIPVIVYRCVDYITQCGLTSEGIYRKCGQTSKTQRLLESLRQDARSVHLKEGEQHVDDVSSALKRFLRDLPDGLFTRAQRLTWLEASEIEDEEEKVSRYRELLVRLPPVNRATVKALISHLYCVQCFSDTNQMNVHNLAIVFGPTLFQTDGQDYKAGRVVEDLINHYVVVFSVDEEELRKQREEITAIVKMRVAGTASGTQHAGDFICTVYLEEKKAETEQHIKVPASMTAEELTLEILDRRNVGIREKDYWTCFEVNEREEAERPLHFAEKVLPILHGLGTDSHLVVKKHQAMEAMLLYLASRVGDTKHGMMKFREDRSLLGLGLPSGGFHDRYFILNSSCLRLYKEVRSHRPEKEWPIKSLKVYLGVKKKLRPPTCWGFTVVHETEKHEKQQWYLCCDTQMELREWFATFLFVQHDGLVWPSEPSRVSRAVPEVRLGSVSLIPLRGSENEMRRSVAAFTADPLSLLRNV

SEQ ID NO: 883367 - protein, 1192 aa, Homo sapiens
MCYFESDFSHSCCKVHLLASGHLGFFLPRTWLILTLSVASEGWGGPGTCPPTPGHLLVVPLPLRSYIYQKRWVRLDTDHLRYFDSNKDAYSKRFISVACISHVAAIGDQKFEVITNNRTFAFRAESDVERKEWMQALQQAMAEQRARARLSSAYLLGVPGSEQPDRAGSLELRGFKNKLYVAVVGDKVQLYKNLEEYHLGIGITFIDMSVGNVKEVDRRSFDLTTPYRIFSFSADSELEKEQWLEAMQGAIAEALSTSEVAERIWAAAPNRFCADCGAPQPDWASINLCVVICKRCAGEHRGLGAGVSKVRSLKMDRKVWTETLIELFLQLGNGAGNRFWAANVPPSEALQPSSSPSTRRCHLEAKYREGKYRRYHPLFGNQEELDKALCAAVTTTDLAETQALLGCGAGINCFSGDPEAPTPLALAEQAGQTLQMEFLRNNRTTEVPRLDSMKPLEKHYSVVLPTVSHSGFLYKTASAGKLLQDRRAREEFSRRWCVLGDGVLSYFENERAVTPNGEIRASEIVCLAVPPPDTHGFEHTFEVYTEGERLYLFGLESAEQAHEWVKCIAKAFVPPLAEDLLARDFERLGRLPYKAGLSLQRAQEGWFSLSGSELRAVFPEGPCEEPLQLRKLQELSIQGDSENQVLVLVERRRTLYIQGERRLDFMGWLGAIQKAAASMGDTLSEQQLGDSDIPVIVYRCVDYITQCGLTSEGIYRKCGQTSKTQRLLESLRQDARSVHLKEGEQHVDDVSSALKRFLRDLPDGLFTRAQRLTWLEASEIEDEEEKVSRYRELLVRLPPVNRATVKALISHLYCVQCFSDTNQMNVHNLAIVFGPTLFQTDGQDYKAGRVVEDLINHYVVVFSVLSLASGQWRAGVILADDGDHLSLPLAPSQVDEEELRKQREEITAIVKMRVAGTASGTQHAGDFICTVYLEEKKAETEQHIKVPASMTAEELTLEILDRRNVGIREKDYWTCFEVNEREEAERPLHFAEKVLPILHGLGTDSHLVVKKHQAMEAMLLYLASRVGDTKHGMMKFREDRSLLGLGLPSGGFHDRYFILNSSCLRLYKEVRSHRPEKEWPIKSLKVYLGVKKKLRPPTCWGFTVVHETEKHEKQQWYLCCDTQMELREWFATFLFVQHDGLVWPSEPSRVSRAVPEVRLGSVSLIPLRGSENEMRRSVAAFTADPLSLLRNV

SEQ ID NO: 883368 - protein, 1210 aa, Homo sapiens; identical to SEQ ID NO: 883359

SEQ ID NO: 883369 - protein, 493 aa, Homo sapiens
MPCKTCNRCMGDTLSEQQLGDSDIPVIVYRCVDYITQCGLTSEGIYRKCGQTSKTQRLLESLRQDARSVHLKEGEQHVDDVSSALKRFLRDLPDGLFTRAQRLTWLEASEIEDEEEKVSRYRELLVRLPPVNRATVKALISHLYCVQCFSDTNQMNVHNLAIVFGPTLFQTDGQDYKAGRVVEDLINHYVVVFSVDEEELRKQREEITAIVKMRVAGTASGTQHAGDFICTVYLEEKKAETEQHIKVPASMTAEELTLEILDRRNVGIREKDYWTCFEVNEREEAERPLHFAEKVLPILHGLGTDSHLVVKKHQAMEAMLLYLASRVGDTKHGMMKFREDRSLLGLGLPSGGFHDRYFILNSSCLRLYKEVRSHRPEKEWPIKSLKVYLGVKKKLRPPTCWGFTVVHETEKHEKQQWYLCCDTQMELREWFATFLFVQHDGLVWPSEPSRVSRAVPEVRLGSVSLIPLRGSENEMRRSVAAFTADPLSLLRNV

SEQ ID NO: 883370 - protein, 1210 aa, Homo sapiens; identical to SEQ ID NO: 883359

SEQ ID NO: 883371 - protein, 1086 aa, Homo sapiens
MCYFESDFSHSCCKVHLLASGHLGFFLPRTWLILTLSVASEGWGGPGTCPPTPGHLLVVPLPLRSYIYQKRWVRLDTDHLRYFDSNKDAYSKRFISVACISHVAAIGDQKFEVITNNRTFAFRAESDVERKEWMQALQQAMAEQRARARLSSAYLLGVPGSEQPDRAGSLELRGFKNKLYVAVVGDKVQLYKNLEEYHLGIGITFIDMSVGNVKEVDRRSFDLTTPYRIFSFSADSELEKEQWLEAMQGAIAEALSTSEVAERIWAAAPNRFCADCGAPQPDWASINLCVVICKRCAGEHRGLGAGVSKVRSLKMDRKVWTETLIELFLQLGNGAGNRFWAANVPPSEALQPSSSPSTRRCHLEAKYREGKYRRYHPLFGNQEELDKALCAAVTTTDLAETQALLGCGAGINCFSGDPEAPTPLALAEQAGQTLQMEFLRNNRTTEVPRLDSMKPLEKHYSVVLPTVSHSGFLYKTASAGKLLQDRRAREEFSRRWCVLGDGVLSYFENERAVTPNGEIRASEIVCLAVPPPDTHGFEHTFEVYTEGERLYLFGLESAEQAHEWVKCIAKAFVPPLAEDLLARDFERLGRLPYKAGLSLQRAQEGWFSLSGSELRAVFPEGPCEEPLQLRKLQELSIQGDSENQVLVLVERRRTLYIQGERRLDFMGWLGAIQKAAASMGDTLSEQQLGDSDIPVIVYRCVDYITQCGLTSEGIYRKCGQTSKTQRLLESLRQDARSVHLKEGEQHVDDVSSALKRFLRDLPDGLFTRAQRLTWLEASEIEDEEEKVSRYRELLVRLPPVNRATVKALISHLYCVQCFSDTNQMNVHNLAIVFGPTLFQTDGQDYKAGRVVEDLINHYVVVFSVDEEELRKQREEITAIVKMRVAGTASGTQHAGDFICTVYLEEKKAETEQHIKVPASMTAEELTLEILDRRNVGIREKDYWTCFEVNEREEAERPLHFAEKVLPILHGLGTDSHLVVKKHQAMEAMLLYLASRVGDTKHGMMKFREDRSLLGLGLPSGGFHDRYFILNSSCLRLYKEVRSHRPEKEWPIKSLKVYLGVKKKLRPPTCWGFTVVHETEKHEKQQW

SEQ ID NO: 883372 - protein, 411 aa, Homo sapiens
PYPFQHLISLGGVIVTGVSDLIYLSHPEIEDEEEKVSRYRELLVRLPPVNRATVKALISHLYCVQCFSDTNQMNVHNLAIVFGPTLFQTDGQDYKAGRVVEDLINHYVVVFSVDEEELRKQREEITAIVKMRVAGTASGTQHAGDFICTVYLEEKKAETEQHIKVPASMTAEELTLEILDRRNVGIREKDYWTCFEVNEREEAERPLHFAEKVLPILHGLGTDSHLVVKKHQAMEAMLLYLASRVGDTKHGMMKFREDRSLLGLGLPSGGFHDRYFILNSSCLRLYKEVRSHRPEKEWPIKSLKVYLGVKKKLRPPTCWGFTVVHETEKHEKQQWYLCCDTQMELREWFATFLFVQHDGLVWPSEPSRVSRAVPEVRLGSVSLIPLRGSENEMRRSVAAFTADPLSLLRNV

SEQ ID NO: 883373 - protein, 1210 aa, Homo sapiens; identical to SEQ ID NO: 883359

SEQ ID NO: 883374 - protein, 1153 aa, Homo sapiens
MCYFESDFSHSCCKVHLLASGHLGFFLPRTWLILTLSVASEGWGGPGTCPPTPGHLLVVPLPLRSYIYQKRWVRLDTDHLRYFDSNKDAYSKRFISVACISHVAAIGDQKFEVITNNRTFAFRAESDVERKEWMQALQQAMAEQRARARLSSAYLLGVPGSEQPDRAGSLELRGFKNKLYVAVVGDKVQLYKNLEEYHLGIGITFIDMSVGNVKEVDRRSFDLTTPYRIFSFSADSELEKEQWLEAMQGAIAEALSTSEVAERIWAAAPNRFCADCGAPQPDWASINLCVVICKRCAGEHRGLGAGVSKVRSLKMDRKVWTETLIELFLQLGNGAGNRFWAANVPPSEALQPSSSPSTRRCHLEAKYREGKYRRYHPLFGNQEELDKALCAAVTTTDLAETQALLGCGAGINCFSGDPEAPTPLALAEQAGQTLQMEFLRNNRTTEVPRLDSMKPLEKHYSVVLPTVSHSGFLYKTASAGKLLQDRRAREEFSRRWCVLGDGVLSYFENERAVTPNGEIRASEIVCLAVPPPDTHGFEHTFEVYTEGERLYLFGLESAEQAHEWVKCIAKAFVPPLAEDLLARDFERLGRLPYKAGLSLQRAQEGWFSLSGSELRAVFPEGPCEEPLQLRKLQELSIQGDSENQVLVLVERRRTLYIQGERRLDFMGWLGAIQKAAASMGDTLSEQQLGDSDIPVIVYRCVDYITQCGLTSEGIYRKCGQTSKTQRLLESLRQDARSVHLKEGEQHVDDVSSALKRFLRDLPDGLFTRAQRLTWLEASEIEDEEEKVSRYRELLVRLPPVNRATVKALISHLYCVQCFSDTNQMNVHNLAIVFGPTLFQTDGQDYKAGRVVEDLINHYVVVFSVDEEELRKQREEITAIVKMRVAGTASGTQHAGDFICTVYLEEKKAETEQHIKVPASMTAEELTLEILDRRNVGIREKDYWTCFEVNEREEAERPLHFAEKVLPILHGLGTDSHLVVKKHQAMEAMLLYLASRVGDTKHGMMKFREDRSLLGLGLPSGGFHDRYFILNSSCLRLYKEVRSHRPEKEWPIKSLKVYLGVKKKLRPPTCWGFTVVHETEKHEKQQWYLCCDTQMELREWFATFLFVQHDGLVWPSEPSRVSRAVPEVRLGSVSLIPLRGTSAQRLSTGAHPWL

SEQ ID NO: 883375 - protein, 345 aa, Homo sapiens
LYRTEVTASGTLAIVFGPTLFQTDGQDYKAGRVVEDLINHYVVVFSVDEEELRKQREEITAIVKMRVAGTASGTQHAGDFICTVYLEEKKAETEQHIKVPASMTAEELTLEILDRRNVGIREKDYWTCFEVNEREEAERPLHFAEKVLPILHGLGTDSHLVVKKHQAMEAMLLYLASRVGDTKHGMMKFREDRSLLGLGLPSGGFHDRYFILNSSCLRLYKEVRSHRPEKEWPIKSLKVYLGVKKKLRPPTCWGFTVVHETEKHEKQQWYLCCDTQMELREWFATFLFVQHDGLVWPSEPSRVSRAVPEVRLGSVSLIPLRGSENEMRRSVAAFTADPLSLLRNV

SEQ ID NO: 883376 - protein, 245 aa, Homo sapiens
MYSSPSTYNLIQGDTSSPPVCRASGWCWDSLLQMSQLGRLPRRLRVDCLILLQGDRPWGPRAGRLVGLDCEQGGLYQEGFLEEAPCAGMQRGLGSWKRELPSRESGPSALSADYKCPLLLALPQSHRPEKEWPIKSLKVYLGVKKKLRPPTCWGFTVVHETEKHEKQQWYLCCDTQMELREWFATFLFVQHDGLVWPSEPSRVSRAVPEVRLGSVSLIPLRGSENEMRRSVAAFTADPLSLLRNV

SEQ ID NO: 883377 - protein, 245 aa, Homo sapiens; identical to SEQ ID NO: 883376

SEQ ID NO: 883378 - protein, 1023 aa, Homo sapiens
MCYFESDFSHSCCKVHLLASGHLGFFLPRTWLILTLSVASEGWGGPGTCPPTPGHLLVVPLPLRSYIYQKRWVRLDTDHLRYFDSNKDAYSKRFISVACISHVAAIGDQKFEVITNNRTFAFRAESDVERKEWMQALQQAMAEQRARARLSSAYLLGVPGSEQPDRAGSLELRGFKNKLYVAVVGDKVQLYKNLEEYHLGIGITFIDMSVGNVKEVDRRSFDLTTPYRIFSFSADSELEKEQWLEAMQGAIAEALSTSEVAERIWAAAPNRFCADCGAPQPDWASINLCVVICKRCAGEHRGLGAGVSKVRSLKMDRKVWTETLIELFLQLGNGAGNRFWAANVPPSEALQPSSSPSTRRCHLEAKYREGKYRRYHPLFGNQEELDKALCAAVTTTDLAETQALLGCGAGINCFSGDPEAPTPLALAEQAGQTLQMEFLRNNRTTEVPRLDSMKPLEKHYSVVLPTVSHSGFLYKTASAGKLLQDRRAREEFSRRWCVLGDGVLSYFENERAVTPNGEIRASEIVCLAVPPPDTHGFEHTFEVYTEGERLYLFGLESAEQAHEWVKCIAKAFVPPLAEDLLARDFERLGRLPYKAGLSLQRAQEGWFSLSGSELRAVFPEGPCEEPLQLRKLQELSIQGDSENQVLVLVERRRTLYIQGERRLDFMGWLGAIQKAAASMGDTLSEQQLGDSDIPVIVYRCVDYITQCGLTSEGIYRKCGQTSKTQRLLESLRQDARSVHLKEGEQHVDDVSSALKRFLRDLPDGLFTRAQRLTWLEASEIEDEEEKVSRYRELLVRLPPVNRATVKALISHLYCVQCFSDTNQMNVHNLAIVFGPTLFQTDGQDYKAGRVVEDLINHYVVVFSVDEEELRKQREEITAIVKMRVAGTASGTQHAGDFICTVYLEEKKAETEQHIKVPASMTAEELTLEILDRRNVGIREKDYWTCFEVNEREEAERPLHFAEKVLPILLTPPGSLSLWGWRDGHKSGTWEDHHPFRGVRPWGPAGREPPAPPNKLQNSRKRVL

SEQ ID NO: 883379 - protein, 1067 aa, Homo sapiens
MCYFESDFSHSCCKVHLLASGHLGFFLPRTWLILTLSVASEGWGGPGTCPPTPGHLLVVPLPLRSYIYQKRWVRLDTDHLRYFDSNKDAYSKRFISVACISHVAAIGDQKFEVITNNRTFAFRAESDVERKEWMQALQQAMAEQRARARLSSAYLLGVPGSEQPDRAGSLELRGFKNKLYVAVVGDKVQLYKNLEEYHLGIGITFIDMSVGNVKEVDRRSFDLTTPYRIFSFSADSELEKEQWLEAMQGAIAEALSTSEVAERIWAAAPNRFCADCGAPQPDWASINLCVVICKRCAGEHRGLGAGVSKVRSLKMDRKVWTETLIELFLQLGNGAGNRFWAANVPPSEALQPSSSPSTRRCHLEAKYREGKYRRYHPLFGNQEELDKALCAAVTTTDLAETQALLGCGAGINCFSGDPEAPTPLALAEQAGQTLQMEFLRNNRTTEVPRLDSMKPLEKHYSVVLPTVSHSGFLYKTASAGKLLQDRRAREEFSRRWCVLGDGVLSYFENERAVTPNGEIRASEIVCLAVPPPDTHGFEHTFEVYTEGERLYLFGLESAEQAHEWVKCIAKAFVPPLAEDLLARDFERLGRLPYKAGLSLQRAQEGWFSLSGSELRAVFPEGPCEEPLQLRKLQELSIQGDSENQVLVLVERRRTLYIQGERRLDFMGWLGAIQKAAASMGDTLSEQQLGDSDIPVIVYRCVDYITQCGLTSEGIYRKCGQTSKTQRLLESLRQDARSVHLKEGEQHVDDVSSALKRFLRDLPDGLFTRAQRLTWLEASEIEDEEEKVSRYRELLVRLPPVNRATVKALISHLYCVQCFSDTNQMNVHNLAIVFGPTLFQTDGQDYKAGRVVEDLINHYVVVFSVDEEELRKQREEITAIVKMRVAGTASGTQHAGDFICTVYLEEKKAETEQHIKVPASMTAEELTLEILDRRNVGIREKDYWTCFEVNEREEAERPLHFAEKVLPILHGLGTDSHLVVKKHQAMEAMLLYLASRVGDTKHGMMKFREDRSLLGLGLPSGGFHDRYFILNSSCLRLYKEVRALRMAQQWGRTVDSQDPSCCGPGRPL

SEQ ID NO: 883380 - protein, 956 aa, Homo sapiens
MCYFESDFSHSCCKVHLLASGHLGFFLPRTWLILTLSVASEGWGGPGTCPPTPGHLLVVPLPLRSYIYQKRWVRLDTDHLRYFDSNKDAYSKRFISVACISHVAAIGDQKFEVITNNRTFAFRAESDVERKEWMQALQQAMAEQRARARLSSAYLLGVPGSEQPDRAGSLELRGFKNKLYVAVVGDKVQLYKNLEEYHLGIGITFIDMSVGNVKEVDRRSFDLTTPYRIFSFSADSELEKEQWLEAMQGAIAEALSTSEVAERIWAAAPNRFCADCGAPQPDWASINLCVVICKRCAGEHRGLGAGVSKVRSLKMDRKVWTETLIELFLQLGNGAGNRFWAANVPPSEALQPSSSPSTRRCHLEAKYREGKYRRYHPLFGNQEELDKALCAAVTTTDLAETQALLGCGAGINCFSGDPEAPTPLALAEQAGQTLQMEFLRNNRTTEVPRLDSMKPLEKHYSVVLPTVSHSGFLYKTASAGKLLQDRRAREEFSRRWCVLGDGVLSYFENERAVTPNGEIRASEIVCLAVPPPDTHGFEHTFEVYTEGERLYLFGLESAEQAHEWVKCIAKAFVPPLAEDLLARDFERLGRLPYKAGLSLQRAQEGWFSLSGSELRAVFPEGPCEEPLQLRKLQELSIQGDSENQVLVLVERRRTLYIQGERRLDFMGWLGAIQKAAASMGDTLSEQQLGDSDIPVIVYRCVDYITQCGLTSEGIYRKCGQTSKTQRLLESLRQDARSVHLKEGEQHVDDVSSALKRFLRDLPDGLFTRAQRLTWLEASEIEDEEEKVSRYRELLVRLPPVNRATVKALISHLYCVQCFSDTNQMNVHNLAIVFGPTLFQTDGQDYKAGRVVEDLINHYVVVFSVDEEELRKQREEITAIVKMRVAGTASGTQHAGDFICTVYLEEKKAETEQHIKVPASMTAEELTLEILDRRNVGIREKDYWTCFEVNEREEAGG

SEQ ID NO: 883381 - protein, 394 aa, Homo sapiens
MCYFESDFSHSCCKVHLLASGHLGFFLPRTWLILTLSVASEGWGGPGTCPPTPGHLLVVPLPLRSYIYQKRWVRLDTDHLRYFDSNKDAYSKRFISVACISHVAAIGDQKFEVITNNRTFAFRAESDVERKEWMQALQQAMAEQRARARLSSAYLLGVPGSEQPDRAGSLELRGFKNKLYVAVVGDKVQLYKNLEEYHLGIGITFIDMSVGNVKEVDRRSFDLTTPYRIFSFSADSELEKEQWLEAMQGAIAEALSTSEVAERIWAAAPNRFCADCGAPQPDWASINLCVVICKRCAGEHRGLGAGVSKVRSLKMDRKVWTETLIEVGMPLLATDTWGLPHSTAVWVSQPPPYLSDHSTLELEETLCDNLVGGDFGKAIFGKVSKLASELRMFL

SEQ ID NO: 883382 - protein, 430 aa, Homo sapiens
MCYFESDFSHSCCKVHLLASGHLGFFLPRTWLILTLSVASEGWGGPGTCPPTPGHLLVVPLPLRSYIYQKRWVRLDTDHLRYFDSNKDAYSKRFISVACISHVAAIGDQKFEVITNNRTFAFRAESDVERKEWMQALQQAMAEQRARARLSSAYLLGVPGSEQPDRAGSLELRGFKNKLYVAVVGDKVQLYKNLEEYHLGIGITFIDMSVGNVKEVDRRSFDLTTPYRIFSFSADSELEKEQWLEAMQGAIAEALSTSEVAERIWAAAPNRFCADCGAPQPDWASINLCVVICKRCAGEHRGLGAGVSKVRSLKMDRKVWTETLIELFLQLGNGAGNRFWAANVPPSEALQPSSSPSTRRCHLEAKYREGKYRRYHPLFGNQEELDKPCLPSVIMGLPILGKDNTIEHLLPLFLAQLKDECPEVRLNIIS

SEQ ID NO: 883383 - protein, 187 aa, Homo sapiens
APGRGWCSLCPLQSHPPASRVGDTKHGMMKFREDRSLLGLGLPSGGFHDRYFILNSSCLRLYKEVRSHRPEKEWPIKSLKVYLGVKKKLRPPTCWGFTVVHETEKHEKQQWYLCCDTQMELREWFATFLFVQHDGLVWPSEPSRVSRAVPEVRLGSVSLIPLRGSENEMRRSVAAFTADPLSLLRNV

SEQ ID NO: 883384 - protein, 1237 aa, Homo sapiens
MCYFESDFSHSCCKVHLLASGHLGFFLPRTWLILTLSVASEGWGGPGTCPPTPGHLLVVPLPLRSYIYQKRWVRLDTDHLRYFDSNKDAYSKRFISVACISHVAAIGDQKFEVITNNRTFAFRAESDVERKEWMQALQQAMAEQRARARLSSAYLLGVPGSEQPDRAGSLELRGFKNKLYVAVVGDKVQLYKNLEEYHLGIGITFIDMSVGNVKEVDRRSFDLTTPYRIFSFSADSELEKEQWLEAMQGAIAEALSTSEVAERIWAAAPNRFCADCGAPQPDWASINLCVVICKRCAGEHRGLGAGVSKVRSLKMDRKVWTETLIELFLQLGNGAGNRFWAANVPPSEALQPSSSPSTRRCHLEAKYREGKYRRYHPLFGNQEELDKALCAAVTTTDLAETQALLGCGAGINCFSGDPEAPTPLALAEQAGQTLQMEFLRNNRTTEVPRLDSMKPLEKHYSVVLPTVSHSGFLYKTASAGKLLQDRRAREEFSRRWCVLGDGVLSYFENERAVTPNGEIRASEIVCLAVPPPDTHGFEHTFEVYTEGERLYLFGLESAEQAHEWVKCIAKAFVPPLAEDLLARDFERLGRLPYKAGLSLQRAQEGWFSLSGSELRAVFPEGPCEEPLQLRKLQELSIQGDSENQVLVLVERRRTLYIQGERRLDFMGWLGAIQKAAASMGDTLSEQQLGDSDIPVIVYRCVDYITQCGLTSEGIYRKCGQTSKTQRLLESLRQDARSVHLKEGEQHVDDVSSALKRFLRDLPDGLFTRAQRLTWLEASEIEDEEEKVSRYRELLVRLPPVNRATVKALISHLYCVQCFSDTNQMNVHNLAIVFGPTLFQTDGQDYKAGRVVEDLINHYVVVFSVDEEELRKQREEITAIVKMRVAGTASGTQHAGDFICTVYLEEKKAETEQHIKVPASMTAEELTLEILDRRNVGIREKDYWTCFEVNEREEAERPLHFAEKVLPILHGLGTDSHLVVKKHQAMEAMLLYLASRVGDTKHGMMKFREDRSLLGLGLPSGGFHDRYFILNSSCLRLYKEVRSHRPEKEWPIKSLKVYLGVKKKLRPPTCWGFTVVHETEKHEKQQWYLCCDTQMELREWFATFLFVQHDGLVWPSEPSRVSRAVPEVRLGSVSLIPLRGSENEMRRSVAAFTADPLSVSGSPCLWAGGWGPGWVPAFYSTVDDCPDCPPRLPSGPLPPALVGALIGLFGSHHSKEPLLPGPGSWESPLPGPGSWEPG

SEQ ID NO: 883385 - protein, 1086 aa, Homo sapiens
MCYFESDFSHSCCKVHLLASGHLGFFLPRTWLILTLSVASEGWGGPGTCPPTPGHLLVVPLPLRSYIYQKRWVRLDTDHLRYFDSNKDAYSKRFISVACISHVAAIGDQKFEVITNNRTFAFRAESDVERKEWMQALQQAMAEQRARARLSSAYLLGVPGSEQPDRAGSLELRGFKNKLYVAVVGDKVQLYKNLEEYHLGIGITFIDMSVGNVKEVDRRSFDLTTPYRIFSFSADSELEKEQWLEAMQGAIAEALSTSEVAERIWAAAPNRFCADCGAPQPDWASINLCVVICKRCAGEHRGLGAGVSKVRSLKMDRKVWTETLIELFLQLGNGAGNRFWAANVPPSEALQPSSSPSTRRCHLEAKYREGKYRRYHPLFGNQEELDKALCAAVTTTDLAETQALLGCGAGINCFSGDPEAPTPLALAEQAGQTLQMEFLRNNRTTEVPRLDSMKPLEKHYSVVLPTVSHSGFLYKTASAGKLLQDRRAREEFSRRWCVLGDGVLSYFENERAVTPNGEIRASEIVCLAVPPPDTHGFEHTFEVYTEGERLYLFGLESAEQAHEWVKCIAKAFVPPLAEDLLARDFERLGRLPYKAGLSLQRAQEGWFSLSGSELRAVFPEGPCEEPLQLRKLQELSIQGDSENQVLVLVERRRTLYIQGERRLDFMGWLGAIQKAAASMGDTLSEQQLGDSDIPVIVYRCVDYITQCGLTSEGIYRKCGQTSKTQRLLESLRQDARSVHLKEGEQHVDDVSSALKRFLRDLPDGLFTRAQRLTWLEASEIEDEEEKVSRYRELLVRLPPVNRATVKALISHLYCVQCFSDTNQMNVHNLAIVFGPTLFQTDGQDYKAGRVVEDLINHYVVVFSVDEEELRKQREEITAIVKMRVAGTASGTQHAGDFICTVYLEEKKAETEQHIKVPASMTAEELTLEILDRRNVGIREKDYWTCFEVNEREEAERPLHFAEKVLPILHGLGTDSHLVVKKHQAMEAMLLYLASRVGDTKHGMMKFREDRSLLGLGLPSGGFHDRYFILNSSCLRLYKEVRVSGPAGFCPRVGTCTPECAQRFPLVCKWKYSRYRLSGWHSSGGEL

SEQ ID NO: 883386 - protein, 999 aa, Homo sapiens
MCYFESDFSHSCCKVHLLASGHLGFFLPRTWLILTLSVASEGWGGPGTCPPTPGHLLVVPLPLRSYIYQKRWVRLDTDHLRYFDSNKDAYSKRFISVACISHVAAIGDQKFEVITNNRTFAFRAESDVERKEWMQALQQAMAEQRARARLSSAYLLGVPGSEQPDRAGSLELRGFKNKLYVAVVGDKVQLYKNLEEYHLGIGITFIDMSVGNVKEVDRRSFDLTTPYRIFSFSADSELEKEQWLEAMQGAIAEALSTSEVAERIWAAAPNRFCADCGAPQPDWASINLCVVICKRCAGEHRGLGAGVSKVRSLKMDRKVWTETLIELFLQLGNGAGNRFWAANVPPSEALQPSSSPSTRRCHLEAKYREGKYRRYHPLFGNQEELDKALCAAVTTTDLAETQALLGCGAGINCFSGDPEAPTPLALAEQAGQTLQMEFLRNNRTTEVPRLDSMKPLEKHYSVVLPTVSHSGFLYKTASAGKLLQDRRAREEFSRRWCVLGDGVLSYFENERAVTPNGEIRASEIVCLAVPPPDTHGFEHTFEVYTEGERLYLFGLESAEQAHEWVKCIAKAFVPPLAEDLLARDFERLGRLPYKAGLSLQRAQEGWFSLSGSELRAVFPEGPCEEPLQLRKLQELSIQGDSENQVLVLVERRRTLYIQGERRLDFMGWLGAIQKAAASMGDTLSEQQLGDSDIPVIVYRCVDYITQCGLTSEGIYRKCGQTSKTQRLLESLRQDARSVHLKEGEQHVDDVSSALKRFLRDLPDGLFTRAQRLTWLEASEIEDEEEKVSRYRELLVRLPPVNRATVKALISHLYCVQCFSDTNQMNVHNLAIVFGPTLFQTDGQDYKAGRVVEDLINHYVVVFSVDEEELRKQREEITAIVKMRVAGTASGTQHAGDFICTVYLEEKKAETEQHIKVPASMTAEELTLEILDRRNVGIREKDYWTCFEVNEREEAERPLHFAEKVLPILHGLGTDSHLVVKKHQAMEAMLLYLGRWCLQG

SEQ ID NO: 883387 - protein, 191 aa, Homo sapiens
MCYFESDFSHSCCKVHLLASGHLGFFLPRTWLILTLSVASEGWGGPGTCPPTPGHLLVVPLPLRSYIYQKRWVRLDTDHLRYFDSNKDAYSKRFISVACISHVAAIGDQKFEVITNNRTFAFRAESDVERKEWMQALQQAMAEQRARARLSSAYLLGVPGSEQPDRAGSLELRGFKNKLSTTWALASPSST

SEQ ID NO: 883388 - protein, 135 aa, Homo sapiens [sequence omitted]

SEQ ID NO: 883389 - protein, 135 aa, Homo sapiens [sequence omitted]

SEQ ID NO: 883390 - protein, 237 aa, Homo sapiens
MVGVLARGRHPPQSSPICSFPRSSAHREALGREGAEPCQAGAQRAGGFRIKPGARHCLAGPSPAQRSRRSPTTPAGARRRTLPRRLRWLVSDPVLSTRRPANMGRVRTKTVKKAARVIIEKYYTRLGNDFHTNKRVCEEIAIIPSKKLRNKIAGYVTHLMKRIQRGPVRGISIKLQEEERERRDNYVPEVSALDQEIIEVDPDTKEMLKLLDFGSLSNLQVTQPTVGMNFKTPRGPV

SEQ ID NO: 883391 - protein, 135 aa, Homo sapiens [sequence omitted]

SEQ ID NO: 883392 - protein, 135 aa, Homo sapiens [sequence omitted]

SEQ ID NO: 883393 - protein, 201 aa, Homo sapiens
MVGVLARGRHPPQSSPICSFPRSSAHREALGREGAEPCQAGAQRAGGFRIKPGARHCLAGPSPAQRSRRSPTTPAGARRRTLPRRLRWLVSDPVLSTRRPANMGRVRTKTVKKAARVIIEKYYTRLGNDFHTNKRVCEEIAIIRGPVRGISIKLQEEERERRDNYVPEVSALDQEIIEVDPDTKEMLKLLVLALGLRSLSP

SEQ ID NO: 883394 - protein, 268 aa, Homo sapiens
MEAGKPEKEGYTTARKRAHTKTQHTRTPTETHQRAHKGDNTHGRDTHKTTRDKTTRQRKKDKEHTREHTKKKRTKENSKATTTHRRKRNRAKDQHATGPPNKAERGSRQSGRSRPPRRTRDEGEKKQTKEEDTNADSTGSQRPTKRPKGEKQKRGRKEEATSEGKNGRRTEEKGGEQGRKRGDGQGGRDGSRRGRRTTQATKPENKQRKQRTTEAHRSNETERNRDKKGKTGDKGEREQKQRIKGERGGKRRERRKEGKKTEEERIRK

SEQ ID NO: 883395 - protein, 137 aa, Homo sapiens
MGRVRTKTVKKAARVIIEKYYTRLGNDFHTNKRVCEEIAIIPSKKLRNKIAGYVTHLMKRIQRGPVRGISIKLQEEERERRDNYVPEVSALDQEIIEVDPDTKEMLKLLVVSVCWIPKVVFSWSKTISRSYYPRSPS

SEQ ID NO: 883396 - protein, 135 aa, Homo sapiens [sequence omitted]

SEQ ID NO: 883397 - protein, 268 aa, Homo sapiens; identical to SEQ ID NO: 883394

SEQ ID NO: 883398 - protein, 135 aa, Homo sapiens [sequence omitted]

SEQ ID NO: 883399 - protein, 135 aa, Homo sapiens [sequence omitted]

SEQ ID NO: 883400 - protein, 135 aa, Homo sapiens [sequence omitted]

SEQ ID NO: 883401 - protein, 424 aa, Homo sapiens
MTQAGRRGPGTPEPRPRTQPMASPRLGTFCCPTRDAATQLVLSFQPRAFHALCLGSGGLRLALGLLQLLPGRRPAGPGSPATSPPASVRILRAAAACDLLGCLGMVIRSTVWLGFPNFVDSVSDMNHTEIWPAAFCVGSAMWIQLLYSACFWWLFCYAVDAYLVIRRSAGLSTILLYHIMAWGLATLLCVEGAAMLYYPSVSRCERGLDHAIPHYVTMYLPLLLVLVANPILFQKTVTAVASLLKGRQGIYTENERRMGAVIKIRFFKIMLVLIICWLSNIINESLLFYLEMQTDINGGSLKPVRTAAKTTWFIMGILNPAQGFLLSLAFYGWTGCSLGFQSPRKEIQWESLTTSAAEGAHPSPLMPHENPASGKVSQVGGQTSDEALSMLSEGSDASTIEIHTASESCNKNEGDPALPTHGDL

SEQ ID NO: 883402 - protein, 424 aa, Homo sapiens; identical to SEQ ID NO: 883401

SEQ ID NO: 883403 - protein, 238 aa, Homo sapiens
MTQAGRRGPGTPEPRPRTQPMASPRLGTFCCPTRDAATQLVLSFQPRAFHALCLGSGGLRLALGLLQLLPGRRPAGPGSPATSPPASVRILRAAAACDLLGCLGMVIRSTVWLGFPNFVDSVSDMNHTEIWPAAFCVGSAMWIQLLYSACFWWLFCYAVDAYLVIRRSAGLSTILLYHIMAWGLATLLCVEGAAMLYYPSVSRGRCGRWNCLKHFLKFTFLSMQPSVAKPRSFQGYIL

SEQ ID NO: 883404 - protein, 241 aa, Homo sapiens
GLLELGGWWQEQALSDPMELYETSPYFYQEPRFYDGENYLPVHLQGFEPPGYERTELTLSPEAPGPLEDKGLGTPEHCPGQCLPWACKVCKRKSVSVDRRRAATLREKRRLKKVNEAFEALKRSTLLNPNQRLPKVEILRSAIQYIERLQALLSSLNQEERDLRYRGGGGPQPGVPSECSSHSASCSPEWGSALEFSANPGDHLLTADPTDAHNLHSLTSIVDSITVEDVSVAFPDETMPN

SEQ ID NO: 883405 - protein, 210 aa, Homo sapiens
MGKILPGFASSLPRGFEPPGYERTELTLSPEAPGPLEDKGLGTPEHCPGQCLPWACKVCKRKSVSVDRRRAATLREKRRLKKVNEAFEALKRSTLLNPNQRLPKVEILRSAIQYIERLQALLSSLNQEERDLRYRGGGGPQPGVPSECSSHSASCSPEWGSALEFSANPGDHLLTADPTDAHNLHSLTSIVDSITVEDVSVAFPDETMPN

SEQ ID NO: 883406 - protein, 291 aa, Homo sapiens
MSCQAFTSADTFIPLNSDASATLPLIMHHSAAECLPVSNHATNVMSTATGLHYSVPSCHYGNQPSTYGVMAGSLTPCLYKFPDHTLSHGFPPIHQPLLAEDPTAADFKQELRRKSKLVEEPIDMDSPEIRELEKFANEFKVRRIKLGYTQTNVGEALAAVHGSEFSQTTICRFENLQLSFKNACKLKAILSKWLEEAEQVGALYNEKVGANERKRKRRTTISIAAKDALERHFGEQNKPSSQEIMRMAEELNLEKEVVRVWFCNRRQREKRVKTSLNQSLFSISKEHLECR

SEQ ID NO: 883407 - protein, 220 aa, Homo sapiens
LPVPSILSLIQTPKCLCTHFSVTTLGNTATGLHYSVPSCHYGNQPSTYGVMAGSLTPCLYKFPDHTLSHGFPPIHQPLLAEDPTAADFKQELRRKSKLVEEPIDMDSPEIRELEKFANEFKVRRIKLGYTQTNVGEALAAVHGSEFSQTTICRFENLQLSFKNACKLKAILSKWLEEAEQVGALYNEKVGANERKRKRRTTISIAAKRLLWTTTPLDNPN

SEQ ID NO: 883408 - protein, 272 aa, Homo sapiens
LPVPSILSLIQTPKCLCTHFSVTTLGNTATGLHYSVPSCHYGNQPSTYGVMAGSLTPCLYKFPDHTLSHGFPPIHQPLLAEDPTAADFKQELRRKSKLVEEPIDMDSPEIRELEKFANEFKVRRIKLGYTQTNVGEALAAVHGSEFSQTTICRFENLQLSFKNACKLKAILSKWLEEAEQVGALYNEKVGANERKRKRRTTISIAAKDALERHFGEQNKPSSQEIMRMAEELNLEKEVVRVWFCNRRQREKRVKTSLNQSLFSISKEHLECR

SEQ ID NO: 883409 - protein, 703 aa, Homo sapiens
MRLPDLRPWTSLLLVDAALLWLLQGPLGTLLPQGLPGLWLEGTLRLGGLWGLLKLRGLLGFVGTLLLPLCLATPLTVSLRALVAGASRAPPARVASAPWSWLLVGYGAAGLSWSLWAVLSPPGAQEKEQDQVNNKVLMWRLLKLSRPDLPLLVAAFFFLVLAVLGETLIPHYSGRVIDILGGDFDPHAFASAIFFMCLFSFGSSLSAGCRGGCFTYTMSRINLRIREQLFSSLLRQDLGFFQETKTGELNSRLSSDTTLMSNWLPLNANVLLRSLVKVVGLYGFMLSISPRLTLLSLLHMPFTIAAEKVYNTRHQEVLREIQDAVARAGQVVREAVGGLQTVRSFGAEEHEVCRYKEALEQCRQLYWRRDLERALYLLVRRVLHLGVQMLMLSCGLQQMQDGELTQGSLLSFMIYQESVGSYVQTLVYIYGDMLSNVGAAEKVFSYMDRQPNLPSPGTLAPTTLQGVVKFQDVSFAYPNRPDRPVLKGLTFTLRPGEVTALVGPNGSGKSTVAALLQNLYQPTGGQVLLDEKPISQYEHCYLHSQVVSVGQEPVLFSGSVRNNIAYGLQSCEDDKVMAAAQAAHADDFIQEMEHGIYTDVGEKGSQLAAGQKQRLAIARALVRDPRVLILDEATSALDVQCEQALQDWNSRGDRTVLVIAHRLQAVQRAHQILVLQEGKLQKLAQLQEGQDLYSRLVQQRLMD

SEQ ID NO: 883410 - protein, 300 aa, Homo sapiens
SALVNYRSDRLGSSARDLPIGGGARLPFLPIPLAAVQVHRLPLSRMDVMDGCQFSPSEYFYDGSCIPSPEGEFGDEFVPRVAAFGAHKAELQGSDEDEHVRAPTGHHQAGHCLMWACKACKRKSTTMDRRKAATMRERRRLKKVNQAFETLKRCTTTNPNQRLPKVEILRNAIRYIESLQELLREQVENYYSLPGQSCSEPTSPTSNCSDGMPECNSPVWSRKSSTFDSIYCPDVSNVYATDKNSLSSLDCLSNIVDRITSSEQPGLPLQDLASLSPVASTDSQPGTPGASSSRLIYHVL

SEQ ID NO: 883411 - protein, 184 aa, Homo sapiens
GVCAAASAFKPGLALSDRAFAAWEPSGAAVSRSPLSPPSRPFASREPAGFRAALADPPGMPRYELALILKAMQRPETAATLKRTIEALMDRGAIVRDLENLGERALPYRISAHSQQHNRGGYFLVDFYAPTAAVESMVEHLSRDIDVIRGNIVKHPLTQELKECEGIVPVPLAEKLYSTKKRKK

SEQ ID NO: 883412 - protein, 184 aa, Homo sapiens; identical to SEQ ID NO: 883411

SEQ ID NO: 883413 - protein, 805 aa, Homo sapiens
MRAVLDTADIAIVALYFILVMCIGFFAMWKSNRSTVSGYFLAGRSMTWVTIGASLFVSNIGSEHFIGLAGSGAASGFAVGAWEFNALLLLQLLGWVFIPIYIRSGVYTMPEYLSKRFGGHRIQVYFAALSLILYIFTKLSVDLYSGALFIQESLGWNLYVSVILLIGMTALLTVTGGLVAVIYTDTLQALLMIIGALTLMIISIMEIGGFEEVKRRYMLASPDVTSILLTYNLSNTNSCNVSPKKEALKMLRNPTDEDVPWPGFILGQTPASVWYWCADQVIVQRVLAAKNIAHAKGSTLMAGFLKLLPMFIIVVPGMISRILFTDDIACINPEHCMLVCGSRAGCSNIAYPRLVMKLVPVGLRGLMMAVMIAALMSDLDSIFNSASTIFTLDVYKLIRKSASSRELMIVGRIFVAFMVVISIAWVPIIVEMQGGQMYLYIQEVADYLTPPVAALFLLAIFWKRCNEQGAFYGGMAGFVLGAVRLILAFAYRAPECDQPDNRPGFIKDIHYMYVATGLFWVTGLITVIVSLLTPPPTKEQIRTTTFWSKKNLVVKENCSPKEEPYQMQEKSILRCSENNETINHIIPNGKSEDSIKGLQPEDVNLLVTCREEGNPVASLGHSEAETPVDAYSNGQAALMGEKERKKETDDGGRYWKFIDWFCGFKSKSLSKRSLRDLMEEEAVCLQMLEETRQVKPETAATLKRTIEALMDRGAIVRDLENLGERALPYRISAHSQQHNRGGYFLVDFYAPTAAVESMVEHLSRDIDVIRGNIVKHPLTQELKECEGIVPVPLAEKLYSTKKRKK

SEQ ID NO: 883414 - protein, 184 aa, Homo sapiens; identical to SEQ ID NO: 883411

SEQ ID NO: 883415 - protein, 718 aa, Homo sapiens
MRAVLDTADIAIVALYFILVMCIGFFAMWKSNRSTVSGYFLAGRSMTWVTIGASLFVSNIGSEHFIGLAGSGAASGFAVGAWEFNALLLLQLLGWVFIPIYIRSGVYTMPEYLSKRFGGHRIQVYFAALSLILYIFTKLSVDLYSGALFIQESLGWNLYVSVILLIGMTALLTVTGGLVAVIYTDTLQALLMIIGALTLMIISIMEIGGFEEVKRRYMLASPDVTSILLTYNLSNTNSCNVSPKKEALKMLRNPTDEDVPWPGFILGQTPASVWYWCADQVIVQRVLAAKNIAHAKGSTLMAGFLKLLPMFIIVVPGMISRILFTDDIACINPEHCMLVCGSRAGCSNIAYPRLVMKLVPVGLRGLMMAVMIAALMSDLDSIFNSASTIFTLDVYKLIRKSASSRELMIVGRIFVAFMVVISIAWVPIIVEMQGGQMYLYIQEVADYLTPPVAALFLLAIFWKRCNEQGAFYGGMAGFVLGAVRLILAFAYRAPECDQPDNRPGFIKDIHYMYVATGLFWVTGLITVIVSLLTPPPTKEQIRTTTFWSKKNLVVKENCSPKEEPYQMQEKSILRCSENNETINHIIPNGKSEDSIKGLQPEDVNLLVTCREEGNPVASLGHSEAETPVDAYSNGQAALMGEKERKKETDDGGRYWKFIDWFCGFKSKSLSKRSLRDLMEEEAVCLQMLEETRQVKVILNIGLFAVCSLGIFMFVYFSL

SEQ ID NO: 883416 - protein, 184 aa, Homo sapiens; identical to SEQ ID NO: 883411

SEQ ID NO: 883417 - protein, 99 aa, Homo sapiens
GVCAAASAFKPGLALSDRAFAAWEPSGAAVSRSPLSPPSRPFASREPAGFRAALADPPGMPRYELALILKAMQRVVYIQSSINKRNTYYSEFDNRTSWQ

SEQ ID NO: 883418 - protein, 249 aa, Homo sapiens
MVDRLANSEANTRRISIVENCFGAAGQPLTIPGRVLIGEGVLTKLCRKKPKARQFFLFNDILVYGNIVIQKKKYNKQHIIPLENVTIDSIKDEGDLRNGWLIKTPTKSFAVYAATATEKSEWMNHINKCVTDLLSKSGKTPSNEHAAVWVPDSEATVCMRCQKAKFTPVNRRHHCRKCGFVVCGPCSEKRFLLPSQSSKPVRICDFCYDLLSAGDMATCQPARSDSYSQSLKSPLNDMSDDDDDDDSSD

SEQ ID NO: 883419 - protein, 249 aa, Homo sapiens; identical to SEQ ID NO: 883418

SEQ ID NO: 883420 - protein, 249 aa, Homo sapiens; identical to SEQ ID NO: 883418

SEQ ID NO: 883421 - protein, 249 aa, Homo sapiens; identical to SEQ ID NO: 883418

SEQ ID NO: 883422 - protein, 249 aa, Homo sapiens; identical to SEQ ID NO: 883418

SEQ ID NO: 883423 - protein, 249 aa, Homo sapiens; identical to SEQ ID NO: 883418

SEQ ID NO: 883424 - protein, 71 aa, Homo sapiens
MHGACQGSQQGDLRAVDGPGQRLWTGLRPPGCSCNKRDTALPQGLCTGCALCLEHLPADPVIAGPVQLAQP

SEQ ID NO: 883425 - protein, 263 aa, Homo sapiens
MTTYSDKGAKPERGRFLHFHSVTFWVGNAKQAASFYCSKMGFEPLAYRGLETGSREVVSHVIKQGKIVFVLSSALNPWNKEMGDHLVKHGDGVKDIAFEVEDCDYIVQKARERGAKIMREPWVEQDKFGKVKFAVLQTYGDTTHTLVEKMNYIGQFLPGYEAPAFMDPLLPKLPKCSLEMIDHIVGNQPDQEMVSASEWCTRNIALCDPLWWPTMKSPSRCPSMSQRLARRSPRSRNMWTITGALGSSTSLSRPKTSSQRFAT

SEQ ID NO: 883426 - protein, 263 aa, Homo sapiens; identical to SEQ ID NO: 883425

SEQ ID NO: 883427 - protein, 393 aa, Homo sapiens
MTTYSDKGAKPERGRFLHFHSVTFWVGNAKQAASFYCSKMGFEPLAYRGLETGSREVVSHVIKQGKIVFVLSSALNPWNKEMGDHLVKHGDGVKDIAFEVEDCDYIVQKARERGAKIMREPWVEQDKFGKVKFAVLQTYGDTTHTLVEKMNYIGQFLPGYEAPAFMDPLLPKLPKCSLEMIDHIVGNQPDQEMVSASEWYLKNLQFHRFWSVDDTQVHTEYSSLRSIVVANYEESIKMPINEPAPGKKKSQIQEYVDYNGGAGVQHIALKTEDIITAIRHLRERGLEFLSVPSTYYKQLREKLKTAKIKVKENIDALEELKILVDYDEKGYLLQIFTKPVQDRPTLFLEVIQRHNHQGFGAGNFNSLFKAFEEEQNLRGNLTNMETNGVVPGM

SEQ ID NO: 883428 - protein, 37 aa, Homo sapiens
TPNSTIIRPYFKASETEKNRHISYTLKVGSLKPGYDR

SEQ ID NO: 883429 - protein, 590 aa, Homo sapiens
TRNTSKYKTFNSKRSSSETSFRIVSWIFLYVLQSSLHKELQTRSLFCTLISSRMSAPKLLSLGCIFFPLLLFQQARAQFPRQCATVEALRSGMCCPDLSPVSGPGTDRCGSSSGRGRCEAVTADSRPHSPQYPHDGRDDREVWPLRFFNRTCHCNGNFSGHNCGTCRPGWRGAACDQRVLIVRRNLLDLSKEEKNHFVRALDMAKRTTHPLFVIATRRSEEILGPDGNTPQFENISIYNYFVWTHYYSVKKTFLGVGQESFGEVDFSHEGPAFLTWHRYHLLRLEKDMQEMLQEPSFSLPYWNFATGKNVCDICTDDLMGSRSNFDSTLISPNSVFSQWRVVCDSLEDYDTLGTLCNSTEDGPIRRNPAGNVARPMVQRLPEPQDVAQCLEVGLFDTPPFYSNSTNSFRNTVEGYSDPTGKYDPAVRSLHNLAHLFLNGTGGQTHLSPNDPIFVLLHTFTDAVFDEWLRRYNADISTFPLENAPIGHNRQYNMVPFWPPVTNTEMFVTAPDNLGYTYEIQWPSREFSVPEIIAIAVVGALLLVALIFGTASYLIRARRSMDEANQPLLTDQYQCYAEEYEKLQNPNQSVV

SEQ ID NO: 883430 - protein, 590 aa, Homo sapiens; identical to SEQ ID NO: 883429

SEQ ID NO: 883431 - protein, 248 aa, Homo sapiens
TRNTSKYKTFNSKRSSSETSFRIVSWIFLYVLQSSLHKELQTRSLFCTLISSRMSAPKLLSLGCIFFPLLLFQQARAQFPRQCATVEALRSGMCCPDLSPVSGPGTDRCGSSSGRGRCEAVTADSRPHSPQYPHDGRDDREVWPLRFFNRTCHCNGNFSGHNCGTCRPGWRGAACDQRVLIVRRNLLDLSKEEKNHFVRALDMAKRTTHPLFVIATRRSEEILGPDGNTPQFENISIYNYFVWTHYWT

SEQ ID NO: 883432 - protein, 590 aa, Homo sapiens; identical to SEQ ID NO: 883429

SEQ ID NO: 883433 - protein, 368 aa, Homo sapiens
TRNTSKYKTFNSKRSSSETSFRIVSWIFLYVLQSSLHKELQTRSLFCTLISSRMSAPKLLSLGCIFFPLLLFQQARAQFPRQCATVEALRSGMCCPDLSPVSGPGTDRCGSSSGRGRCEAVTADSRPHSPQYPHDGRDDREVWPLRFFNRTCHCNGNFSGHNCGTCRPGWRGAACDQRVLIVRRNLLDLSKEEKNHFVRALDMAKRTTHPLFVIATRRSEEILGPDGNTPQFENISIYNYFVWTHYYSVKKTFLGVGQESFGEVDFSHEGPAFLTWHRYHLLRLEKDMQAPRMGQLGEIQLEMWPDQWCNVFLNHRMSLSAWKLVYLTRLLFIPTLQTVSETQWKVTVTPRESMTLLFEVFTIWLIYS

SEQ ID NO: 883434 - protein, 541 aa, Homo sapiens
TRNTSKYKTFNSKRSSSETSFRIVSWIFLYVLQSSLHKELQTRSLFCTLISSRMSAPKLLSLGCIFFPLLLFQQARAQFPRQCATVEALRSGMCCPDLSPVSGPGTDRCGSSSGRGRCEAVTADSRPHSPQYPHDGRDDREVWPLRFFNRTCHCNGNFSGHNCGTCRPGWRGAACDQRVLIVRRNLLDLSKEEKNHFVRALDMAKRTTHPLFVIATRRSEEILGPDGNTPQFENISIYNYFVWTHYYSVKKTFLGVGQESFGEVDFSHEGPAFLTWHRYHLLRLEKDMQEMLQEPSFSLPYWNFATGKNVCDICTDDLMGSRSNFDSTLISPNSVFSQWRVVCDSLEDYDTLGTLCNSTEDGPIRRNPAGNVARPMVQRLPEPQDVAQCLEVGLFDTPPFYSNSTNSFRNTVEGYSDPTGKYDPAVRSLHNLAHLFLNGTGGQTHLSPNDPIFVLLHTFTDAVFDEWLRRYNAGREFSVPEIIAIAVVGALLLVALIFGTASYLIRARRSMDEANQPLLTDQYQCYAEEYEKLQNPNQSVV

SEQ ID NO: 883435 - protein, 240 aa, Homo sapiens [sequence omitted]

SEQ ID NO: 883436 - protein, 379 aa, Homo sapiens
TRNTSKYKTFNSKRSSSETSFRIVSWIFLYVLQSSLHKELQTRSLFCTLISSRMSAPKLLSLGCIFFPLLLFQQARAQFPRQCATVEALRSGMCCPDLSPVSGPGTDRCGSSSGRGRCEAVTADSRPHSPQYPHDGRDDREVWPLRFFNRTCHCNGNFSGHNCGTCRPGWRGAACDQRVLIVRRNLLDLSKEEKNHFVRALDMAKRTTHPLFVIATRRSEEILGPDGNTPQFENISIYNYFVWTHYYSVKKTFLGVGQESFGEVDFSHEGPAFLTWHRYHLLRLEKDMQEMLQEPSFSLPYWNFATGKNVCDICTDDLMGSRSNFDSTLISPNSVFSQWRVVCDSLEDYDTLGTLCNSKFQMIAWSQNFFLDKEIKYVA

SEQ ID NO: 883437 - protein, 1117 aa, Homo sapiens
HEGGVESGIRGWRVLAVAVAAAAGPGDAGGRGRRRSLLVSPAMAALGRPFSGLPLSGGSDFLQPPQPAFPGRAFPPGADGAELAPRPGPRAVPSSPAGSAARGRVSVHCKKKHKREEEEDDDCPVRKKRITEAELCAGPNDWILCAHQDVEGHGVNPSVSGLSIPGILDVICEEMDQTTGEPQCEVARRKLQEIEDRIIDEDEEVEADRNVNHLPSLVLSDTMKTGLKREFDEVFTKKMIESMSRPSMELVLWKPLPELLSDKPKPSSNTKNYTGESQAKHVAAGTAFPQRTELFSEPRPTGMSLYNSLETATSTEEEMELKKPISTLKLSNVRRILCSVMRLFALYRDLKVFETGVIISPPVIWGWDSYFGEPFIDFTFLPRTFVSREKQFSVGLIKGMLVYIVFKDKYRSCMCKGDLNQYVTLSKLFRHLENILLELKKMIKKDAPTTVSCQLSHSLMCRYELFTVVTIYNWGEEGKRAAELKPVAKKFNFLATCNLVINSNSSVDEIADSIVALLFDYENIEKVFSLRLFCLVPLLLLGFPCVIDKPSYSVMFTNELTLIVKRLGGNPSAICLWEKHPLVHLKEVLYQLNPTLITLVIFLKGLSSPPPPPPPPPSRFPFSGAPGARDRSGPLGSEPQRNPGARPRTLEATVTPPGSVGAMSSSGLNSEKVAALIQKLNSDPQFVLAQNVGTTHDLLDICLKRATVQRAQHVFQHAVPQEGKPITNQKSSGRCWIFSCLNVMRLPFMKKLNIEEFEFSQSYLFFWDKVERCYFFLSAFVDTAQRKEPEDGRLVQFLLMNPANDGGQWDMLVNIVEKYGVIPKKCFPESYTTEATRRMNDILNHKMREFCIRLRNLVHSGATKGEISATQDVMMEEIFRVVCICLGNPPETFTWEYRDKDKNYQKIGPITPLEFYREHVKPLFNMEDKICLVNDPRPQHKYNKLYTVEYLSNMVGGRKTLYNNQPIDFLKKMVAASIKDGEAVWFGCDVGKHFNSKLGLSDMNLYDHELVFGVSLKNMNKAERLTFGESLMTHAMTFTAVSEKDDQDGAFTKWRVENSWGEDHGHKGYLCMTDEWFSEYVYEVVVDRKHVPEEVLAVLEQEPIILPAWDPMGALAE

SEQ ID NO: 883438 - protein, 534 aa, Homo sapiens
SPDGADSATRGGSFVPPRTPFRLSSPPPPPPPPPSRFPFSGAPGARDRSGPLGSEPQRNPGARPRTLEATVTPPGSVGAMSSSGLNSEKVAALIQKLNSDPQFVLAQNVGTTHDLLDICLKRATVQRAQHVFQHAVPQEGKPITNQKSSGRCWIFSCLNVMRLPFMKKLNIEEFEFSQSYLFFWDKVERCYFFLSAFVDTAQRKEPEDGRLVQFLLMNPANDGGQWDMLVNIVEKYGVIPKKCFPESYTTEATRRMNDILNHKMREFCIRLRNLVHSGATKGEISATQDVMMEEIFRVVCICLGNPPETFTWEYRDKDKNYQKIGPITPLEFYREHVKPLFNMEDKICLVNDPRPQHKYNKLYTVEYLSNMVGGRKTLYNNQPIDFLKKMVAASIKDGEAVWFGCDVGKHFNSKLGLSDMNLYDHELVFGVSLKNMNKAERLTFGESLMTHAMTFTAVSEKDDQDGAFTKWRVENSWGEDHGHKGYLCMTDEWFSEYVYEVVVDRKHVPEEVLAVLEQEPIILPAWDPMGALAE

SEQ ID NO: 883439 - protein, 1101 aa, Homo sapiens
HEGGVESGIRGWRVLAVAVAAAAGPGDAGGRGRRRSLLVSPAMAALGRPFSGLPLSGGSDFLQPPQPAFPGRAFPPGADGAELAPRPGPRAVPSSPAGSAARGRVSVHCKKKHKREEEEDDDCPVRKKRITEAELCAGPNDWILCAHQDVEGHGVNPSVSGLSIPGILDVICEEMDQTTGEPQCEVARRKLQEIEDRIIDEDEEVEADRNVNHLPSLVLSDTMKTGLKREFDEVFTKKMIESMSRPSMELVLWKPLPELLSDKPKPSSNTKNYTGESQAKHVAAGTAFPQRTELFSEPRPTGMSLYNSLETATSTEEEMELKKPISTLKLSNVRRILCSVMRLFALYRDLKVFETGVIISPPVIWGWDSYFGEPFIDFTFLPRTFVSREKQFSVGLIKGMLVYIVFKDKYRSCMCKGDLNQYVTLSKLFRHLENILLELKKMIKKDAPTTVSCQLSHSLMCRYELFTVVTIYNWGEEGKRAAELKPVAKKFNFLATCNLVINSNSSVDEIADSIVALLFDYENIEKVFSLRLFCLVPLLLLGFPCVIDKPSYSVMFTNELTLIVKRLGGNPSAICLWEKHPLVHLKEVLYQLNPTLITLVIFLKRPQLPAAAAAAAAEPVSFFRRSGCERQVGPPRQRAAAQSRRSPKDPGSYRYPAGQRGRHEQLGTEFGEGSCSDTETEFRPPVRTCPECRDHPRPAGHLSEAGHGAARAACVPARRAPGGQANHQPEELRAMLDLFLSECYEASIHEKVKVERCYFFLSAFVDTAQRKEPEDGRLVQFLLMNPANDGGQWDMLVNIVEKYGVIPKKCFPESYTTEATRRMNDILNHKMREFCIRLRNLVHSGATKGEISATQDVMMEEIFRVVCICLGNPPETFTWEYRDKDKNYQKIGPITPLEFYREHVKPLFNMEDKICLVNDPRPQHKYNKLYTVEYLSNMVGGRKTLYNNQPIDFLKKMVAASIKDGEAVWFGCDVGKHFNSKLGLSDMNLYDHELVFGVSLKNMNKAERLTFGESLMTHAMTFTAVSEKDDQDGAFTKWRVENSWGEDHGHKGYLCMTDEWFSEYVYEVVVDRKHVPEEVLAVLEQEPIILPAWDPMGALAE

SEQ ID NO: 883440 - protein, 321 aa, Homo sapiens
HEGGVESGIRGWRVLAVAVAAAAGPGDAGGRGRRRSLLVSPAMAALGRPFSGLPLSGGSDFLQPPQPAFPGRAFPPGADGAELAPRPGPRAVPSSPAGSAARGRVSVHCKKKHKREEEEDDDCPVRKKRITEAELCAGPNDWILCAHQDVEGHGVNPSVSGLSIPGILDVICEEMDQTTGEPQCEVARRKLQEIEDRIIDEDEEVEADRNVNHLPSLVLSDTMKTGLKREFDEVFTKKMIESMSRPSMELVLWKPLPELLSDKPKPSSNTKNYTGESQAKHVAAGTAFPQRTELFSEPRPTGMSLYNSLETATSTEEEMEL

SEQ ID NO: 883441 - protein, 271 aa, Homo sapiens [sequence omitted]

SEQ ID NO: 883442 - protein, 164 aa, Homo sapiens
MVGGRKTLYNNQPIDFLKKMVAASIKDGEAVWFGCDVGKHFNSKLGLSDMNLYDHELVFGVSLKNMNKAERLTFGESLMTHAMTFTAVSEKDDQDGAFTKWRVENSWGEDHGHKGYLCMTDEWFSEYVYEVVVDRKHVPEEVLAVLEQEPIILPAWDPMGALAE

SEQ ID NO: 883443 - protein, 321 aa, Homo sapiens; identical to SEQ ID NO: 883440

SEQ ID NO: 883444 - protein, 321 aa, Homo sapiens; identical to SEQ ID NO: 883440

SEQ ID NO: 883445 - protein, 359 aa, Homo sapiens
MVRGRGLNRPRVERCYFFLSAFVDTAQRKEPEDGRLVQFLLMNPANDGGQWDMLVNIVEKYGVIPKKCFPESYTTEATRRMNDILNHKMREFCIRLRNLVHSGATKGEISATQDVMMEEIFRVVCICLGNPPETFTWEYRDKDKNYQKIGPITPLEFYREHVKPLFNMEDKICLVNDPRPQHKYNKLYTVEYLSNMVGGRKTLYNNQPIDFLKKMVAASIKDGEAVWFGCDVGKHFNSKLGLSDMNLYDHELVFGVSLKNMNKAERLTFGESLMTHAMTFTAVSEKDDQDGAFTKWRVENSWGEDHGHKGYLCMTDEWFSEYVYEVVVDRKHVPEEVLAVLEQEPIILPAWDPMGALAE

SEQ ID NO: 883446 - protein, 271 aa, Homo sapiens [sequence omitted]

SEQ ID NO: 883447 - protein, 321 aa, Homo sapiens; identical to SEQ ID NO: 883440

SEQ ID NO: 883448 - protein, 321 aa, Homo sapiens; identical to SEQ ID NO: 883440

SEQ ID NO: 883449 - protein, 321 aa, Homo sapiens; identical to SEQ ID NO: 883440

SEQ ID NO: 883450 - protein, 346 aa, Homo sapiens
MQNKARLELADYEAENLARLQRAFARKWEFIFMQAEAQVKIDRKKDKTERKILDSQERAFWDVHRPVPGCVNTTEMDIRKCRRLKNPQKVKKSVYGVTEESQAQSPVHVLSQPIRKTTKEDIRKQITFLNAQIDRHCLKMSKVAESLIAYTEQYVEYDPLITPAEPSNPWISDDVALWDIEMSKEPSQQRVKRWGFSFDEILKDQVGRDQFLRFLESEFSSENLRFWLAVQDLKKQPLQDVAKRVEEIWQEFLAPGAPSAINLDSHSYEITSQNVKDGGRYTFEDAQEHIYKLMKSDSYARFLRSNAYQDLLLAKKKPESEQGRRTSLEKFTRSVLYSNTPLAKRP

SEQ ID NO: 883451 - protein, 443 aa, Homo sapiens
SGRHDLHLLAFCHDCEASPATWNCTDIVQWLMKNLSIEDPVEAIHLGSLIAAQGYIFPISDHVLTMKDDGTFYRFQAPYFWPSNCWEPENTDYEEEDIEEEKAIYLCKRTMQNKARLELADYEAENLARLQRAFARKWEFIFMQAEAQVKIDRKKDKTERKILDSQERAFWDVHRPVPGCVNTTEMDIRKCRRLKNPQKVKKSVYGVTEESQAQSPVHVLSQPIRKTTKEDIRKQITFLNAQIDRHCLKMSKVAESLIAYTEQYVEYDPLITPAEPSNPWISDDVALWDIEMSKEPSQQRVKRWGFSFDEILKDQVGRDQFLRFLESEFSSENLRFWLAVQDLKKQPLQDVAKRVEEIWQEFLAPGAPSAINLDSHSYEITSQNVKDGGRYTFEDAQEHIYKLMKSDSYARFLRSNAYQDLLLAKKKGKSLAGKRLTGLMQSS

SEQ ID NO: 883452 - protein, 446 aa, Homo sapiens
SGRHDLHLLAFCHDCEASPATWNCTDIVQWLMKNLSIEDPVEAIHLGSLIAAQGYIFPISDHVLTMKDDGTFYRFQAPYFWPSNCWEPENTDYEEEDIEEEKAIYLCKRTMQNKARLELADYEAENLARLQRAFARKWEFIFMQAEAQVKIDRKKDKTERKILDSQERAFWDVHRPVPGCVNTTEMDIRKCRRLKNPQKVKKSVYGVTEESQAQSPVHVLSQPIRKTTKEDIRKQITFLNAQIDRHCLKMSKVAESLIAYTEQYVEYDPLITPAEPSNPWISDDVALWDIEMSKEPSQQRVKRWGFSFDEILKDQVGRDQFLRFLESEFSSENLRFWLAVQDLKKQPLQDVAKRVEEIWQEFLAPGAPSAINLDSHSYEITSQNVKDGGRYTFEDAQEHIYKLMKSDSYARFLRSNAYQDLLLAKKKPESEQGRRTSLEKFTRSVG

SEQ ID NO: 883453 - protein, 493 aa, Homo sapiens
SGRHDLHLLAFCHDCEASPATWNCTDIVQWLMKNLSIEDPVEAIHLGSLIAAQGYIFPISDHVLTMKDDGTFYRFQAPYFWPSNCWEPENTDYEEEDIEEEKAIYLCKRTMQNKARLELADYEAENLARLQRAFARKWEFIFMQAEAQVKIDRKKDKTERKILDSQERAFWDVHRPVPGCVNTTEMDIRKCRRLKNPQKVKKSVYGVTEESQAQSPVHVLSQPIRKTTKEDIRKQITFLNAQIDRHCLKMSKVAESLIAYTEQYVEYDPLITPAEPSNPWISDDVALWDIEMSKEPSQQRVKRWGFSFDEILKDQVGRDQFLRFLESEFSSENLRFWLAVQDLKKQPLQDVAKRVEEIWQEFLAPGAPSAINLDSHSYEITSQNVKDGGRYTFEDAQEHIYKLMKSDSYARFLRSNAYQDLLLAKKKPESEQGRRTSLEKFTRSVVSSVGFLPSAFLLVLVFSFFFFFFFFPLVVVSFGVGGSPVLSPSTQPF

SEQ ID NO: 883454 - protein, 472 aa, Homo sapiens
MAQGSGDQRAVGVADPEESSPNMIVYCKIEDIITKMQDDKTGGVPIRTVKSFLSKIPSVVTGTDIVQWLMKNLSIEDPVEAIHLGSLIAAQGYIFPISDHVLTMKDDGTFYRFQAPYFWPSNCWEPENTDYAIYLCKRTMQNKARLELADYEAENLARLQRAFARKWEFIFMQAEAQVKIDRKKDKTERKILDSQERAFWDVHRPVPGCVNTTEMDIRKCRRLKNPQKVKKSVYGVTEESQAQSPVHVLSQPIRKTTKEDIRKQITFLNAQIDRHCLKMSKVAESLIAYTEQYVEYDPLITPAEPSNPWISDDVALWDIEMSKEPSQQRVKRWGFSFDEILKDQVGRDQFLRFLESEFSSENLRFWLAVQDLKKQPLQDVAKRVEEIWQEFLAPGAPSAINLDSHSYEITSQNVKDGGRYTFEDAQEHIYKLMKSDSYARFLRSNAYQDLLLAKKKGKSLAGKRLTGLMQSS

SEQ ID NO: 883455 - protein, 162 aa, Homo sapiens
SGRHDLHLLAFCHDCEASPATWNCTDIVQWLMKNLSIEDPVEAIHLGSLIAAQGYIFPISDHVLTMKDDGTFYRFQAPYFWPSNCWEPENTDYAIYLCKRTMQNKARLELADYEALPTGRGVLRNPAFGFAPGDTSRWQRLVNSPITTDNFPDFQQPLKQVL

SEQ ID NO: 883456 - protein, 490 aa, Homo sapiens
MAQGSGDQRAVGVADPEESSPNMIVYCKIEDIITKMQDDKTGGVPIRTVKSFLSKIPSVVTGTDIVQWLMKNLSIEDPVEAIHLGSLIAAQGYIFPISDHVLTMKDDGTFYRFQAPYFWPSNCWEPENTDYAIYLCKRTMQNKARLELADYEAENLARLQRAFARKWEFIFMQAEAQVKIDRKKDKTERKILDSQERAFWDVHRPVPGCVNTTEMDIRKCRRLKNPQKVKKSVYGVTEESQAQSPVHVLSQPIRKTTKEDIRKQITFLNAQIDRHCLKMSKVAESLIAYTEQYVEYDPLITPAEPSNPWISDDVALWDIEMSKEPSQQRVKRWGFSFDEILKDQVGRDQFLRFLESEFSSENLRFWLAVQDLKKQPLQDVAKRVEEIWQEFLAPGAPSAINLDSHSYEITSQNVKDGGRYTFEDAQEHIYKLMKSDSYARFLRSNAYQDLLLAKKKPESEQGRRTSLEKFTRSVGKSLAGKRLTGLMQSS

SEQ ID NO: 883457 - protein, 279 aa, Homo sapiens
SGRHDLHLLAFCHDCEASPATWNCTDIVQWLMKNLSIEDPVEAIHLGSLIAAQGYIFPISDHVLTMKDDGTFYRFQAPYFWPSNCWEPENTDYEEEDIEEEKAIYLCKRTMQNKARLELADYEAENLARLQRAFARKWEFIFMQAEAQVKIDRKKDKTERKILDSQERAFWDVHRPVPGCVNTTEMDIRKCRRLKNPQKVKKSVYGVTEESQAQSPVHVLSQPIRKTTKEDIRKQVNELTACTLRRRRGQFKNPFKCSTLKIEQALSSWKPQWNPAVGD

SEQ ID NO: 883458 - protein, 148 aa, Homo sapiens
DPGARILAGAWAGCPAVRECGTSLGAGKGVGAGRGWVRGRARGCGRARGRVWVRGWVQAVGGRGAGAGGAGRRLLQGGLVDSGPGRTKRVLLFKKTALPFPSSTLASCPGSPAHVAFLPATVHLAQNGLTPTLCFHRARRLCNAERVL

SEQ ID NO: 883459 - protein, 404 aa, Homo sapiens
TVVAKCSALREPAHSTARKASEPSQPSQPSQPGGHLIARLRTMDLHLFDYSEPGNFSDISWPCNSSDCIVVDTVMCPNMPNKSVLLYTLSFIYIFIFVIGMIANSVVVWVNIQAKTTGYDTHCYILNLAIADLWVVLTIPVWVVSLVQHNQWPMGELTCKVTHLIFSINLFGSIFFLTCMSVDRYLSITYFTNTPSSRKKMVRRVVCILVWLLAFCVSLPDTYYLKTVTSASNNETYCRSFYPEHSIKEWLIGMELVSVVLGFAVPFSIIAVFYFLLARAISASSDQEKHSSRKIIFSYVVVFLVCWLPYHVAVLLDIFSILHYIPFTCRLEHALFTALHVTQCLSLVHCCVNPVLYSFINRNYRYELMKAFIFKYSAKTGLTKLIDASRVSETEYSALEQSTK

SEQ ID NO: 883460 - protein, 362 aa, Homo sapiens
MDLHLFDYSEPGNFSDISWPCNSSDCIVVDTVMCPNMPNKSVLLYTLSFIYIFIFVIGMIANSVVVWVNIQAKTTGYDTHCYILNLAIADLWVVLTIPVWVVSLVQHNQWPMGELTCKVTHLIFSINLFGSIFFLTCMSVDRYLSITYFTNTPSSRKKMVRRVVCILVWLLAFCVSLPDTYYLKTVTSASNNETYCRSFYPEHSIKEWLIGMELVSVVLGFAVPFSIIAVFYFLLARAISASSDQEKHSSRKIIFSYVVVFLVCWLPYHVAVLLDIFSILHYIPFTCRLEHALFTALHVTQCLSLVHCCVNPVLYSFINRNYRYELMKAFIFKYSAKTGLTKLIDASRVSETEYSALEQSTK

SEQ ID NO: 883461 - protein, 386 aa, Homo sapiens
TVVAKCSALREPAHSTARKASEPSQPSQPSQPGGHLIARLRTMDLHLFDYSEPGNFSDISWPCNSSDCIVVDTVMCPNMPNGMIANSVVVWVNIQAKTTGYDTHCYILNLAIADLWVVLTIPVWVVSLVQHNQWPMGELTCKVTHLIFSINLFGSIFFLTCMSVDRYLSITYFTNTPSSRKKMVRRVVCILVWLLAFCVSLPDTYYLKTVTSASNNETYCRSFYPEHSIKEWLIGMELVSVVLGFAVPFSIIAVFYFLLARAISASSDQEKHSSRKIIFSYVVVFLVCWLPYHVAVLLDIFSILHYIPFTCRLEHALFTALHVTQCLSLVHCCVNPVLYSFINRNYRYELMKAFIFKYSAKTGLTKLIDASRVSETEYSALEQSTK

SEQ ID NO: 883462 - protein, 388 aa, Homo sapiens
DPGARILAGAWAGCPAVRHLIARLRTMDLHLFDYSEPGNFSDISWPCNSSDCIVVDTVMCPNMPNKSVLLYTLSFIYIFIFVIGMIANSVVVWVNIQAKTTGYDTHCYILNLAIADLWVVLTIPVWVVSLVQHNQWPMGELTCKVTHLIFSINLFGSIFFLTCMSVDRYLSITYFTNTPSSRKKMVRRVVCILVWLLAFCVSLPDTYYLKTVTSASNNETYCRSFYPEHSIKEWLIGMELVSVVLGFAVPFSIIAVFYFLLARAISASSDQEKHSSRKIIFSYVVVFLVCWLPYHVAVLLDIFSILHYIPFTCRLEHALFTALHVTQCLSLVHCCVNPVLYSFINRNYRYELMKAFIFKYSAKTGLTKLIDASRVSETEYSALEQSTK

SEQ ID NO: 883463 - protein, 362 aa, Homo sapiens; identical to SEQ ID NO: 883460

SEQ ID NO: 883464 - protein, 90 aa, Homo sapiens
VCLCVFVLRFKKTWKLRALKEGKTSMHPPYSLGQLVPERPRPTPVLVPLISPPVSPSSLGSDNTSSHNRPDARDPRSPYDISNTDYFFPR

SEQ ID NO: 883465 - protein, 142 aa, Homo sapiens
CNQLGVSLQDAVSWRASGMADEEEDPTFEEENEEIGGGAEGGQGKRKRLFSKELRCMMYGFGDDQNPYTESVDILEDLVIEFITEMTHKAMSIGRQGRVQVEDIVFLIRKDPRKFARVKDLLTMNEELKRARKAFDEANYGS

SEQ ID NO: 883466 - protein, 142 aa, Homo sapiens; identical to SEQ ID NO: 883465

SEQ ID NO: 883467 - protein, 142 aa, Homo sapiens; identical to SEQ ID NO: 883465

SEQ ID NO: 883468 - protein, 142 aa, Homo sapiens; identical to SEQ ID NO: 883465

SEQ ID NO: 883469 - protein, 117 aa, Homo sapiens
MCRCSLVLLSVDHEVPFSSFFIGWRTEGRAWRAGRPDMADGSGWQPPRPCEAYRAEWKLCRSARHFLHHYYVHGERPACEQWQRDLASCRDWEERRNAEAQVLSVVAHTCNLSYLGG

SEQ ID NO: 883470 - protein, 142 aa, Homo sapiens
MCRCSLVLLSVDHEVPFSSFFIGWRTEGRAWRAGRPDMADGSGWQPPRPCEAYRAEWKLCRSARHFLHHYYVHGERPACEQWQRDLASCRDWEERRNAEAQQSLCESERARVRAARKHILVWAPRQSPPPDWHLPLPQEKDE

SEQ ID NO: 883471 - protein, 117 aa, Homo sapiens; identical to SEQ ID NO: 883469

SEQ ID NO: 883472 - protein, 120 aa, Homo sapiens
MADGSGWQVSVLGSEPGTTGVFRREGTGLARGVGRGRRAPLRRRLSPQPPRPCEAYRAEWKLCRSARHFLHHYYVHGERPACEQWQRDLASCRDWEERRNAEAQVLSVVAHTCNLSYLGG

SEQ ID NO: 883473 - protein, 145 aa, Homo sapiens
MADGSGWQVSVLGSEPGTTGVFRREGTGLARGVGRGRRAPLRRRLSPQPPRPCEAYRAEWKLCRSARHFLHHYYVHGERPACEQWQRDLASCRDWEERRNAEAQQSLCESERARVRAARKHILVWAPRQSPPPDWHLPLPQEKDE

SEQ ID NO: 883474 - protein, 109 aa, Homo sapiens
RTSGSPFLQEFGTRRGHGPAVGNLVSESAGRSAGQGSPGPDAMSRNLRTALIFGGFISLIGAAFYPIYFRPLMRLEEYKKEQAINRAGIVQEDVQPPGLKVWSDPFGRK

SEQ ID NO: 883475 - protein, 104 aa, Homo sapiens
SESLSTSSERGHGPAVGNLVSESAGRSAGQGSPGPDAMSRNLRTALIFGGFISLIGAAFYPIYFRPLMRLEEYKKEQAINRAGIVQEDVQPPGLKVWSDPFGRK

SEQ ID NO: 883476 - protein, 104 aa, Homo sapiens; identical to SEQ ID NO: 883475

SEQ ID NO: 883477 - protein, 104 aa, Homo sapiens; identical to SEQ ID NO: 883475

SEQ ID NO: 883478 - protein, 104 aa, Homo sapiens; identical to SEQ ID NO: 883475

SEQ ID NO: 883479 - protein, 255 aa, Homo sapiens
MGNSCYNIVATLLLVLNFERTRSLQDPCSNCPAGTFCDNNRNQICSPCPPNSFSSAGGQRTCDICRQCKGVFRTRKECSSTSNAECDCTPGFHCLGAGCSMCEQDCKQGQELTKKGCKDCCFGTFNDQKRGICRPWTNCSLDGKSVLVNGTKERDVVCGPSPADLSPGASSVTPPAPAREPGHSPQIISFFLALTSTALLFLLFFLTLRFSVVKRGRKKLLYIFKQPFMRPVQTTQEEDGCSCRFPEEEEGGCEL

SEQ ID NO: 883480 - protein, 153 aa, Homo sapiens
MGNSCYNIVATLLLVLNFERTRSLQDPCSNCPAGTFCDNNRNQICSPCPPNSFSSAGGQRTCDICRQCKGVFRTRKECSSTSNAECDCTPGFHCLGAGCSMCEQDCKQGQELTKKGCKDCCFGTFNDQKRGICRPWTNIRVADEWNHDSQEKY

SEQ ID NO: 883481 - protein, 239 aa, Homo sapiens
MGNSCYNIVATLLLVLNFERTRSLQDPCSNCPAGTFCDNNRNQICSPCPPNSFSSAGGQRTCDICRQCKGVFRTRKECSSTSNAECDCTPGFHCLGAGCSMCEQDCKQGQELTKKGCKDCCFGTFNDQKRGICRPWTNCSLDGKSVLVNGTKERDVVCGPSPADLSPGASSVTPPAPAREPGHSPQIISFFLALTSTALLFLLFFLTLRFSVVKRGRKKLLYIFKQHGSSGDTFTILES

SEQ ID NO: 883482 - protein, 126 aa, Homo sapiens
QVPALPCCPHIIFLMLDSHQCFLLYFLSQATFSSLSSVASGAESPRFSPSDQIQSRAGLSVNYEEYRFLRNNSRALTANSTEFVLLEMGQQREVGSPSVLVCKIYSLGSLLAWLNFLVPESSHTLA

SEQ ID NO: 883483 - protein, 623 aa, Homo sapiens
MSTQDERQINTEYAVSLLEQLKLFYEQQLFTDIVLIVEGTEFPCHKMVLATCSSYFRAMFMSGLSESKQTHVHLRNVDAATLQIIITYAYTGNLAMNDSTVEQLYETACFLQVEDVLQRCREYLIKKINAENCVRLLSFADLFSCEELKQSAKRMVEHKFTAVYHQDAFMQLSHDLLIDILSSDNLNVEKEETVREAAMLWLEYNTESRSQYLSSVLSQIRIDALSEVTQRAWFQGLPPNDKSVVVQGLYKSMPKFFKPRLGMTKEEMMIFIEASSENPCSLYSSVCYSPQAEKVYKLCSPPADLHKVGTVVTPDNDIYIAGGQVPLKNTKTNHSKTSKLQTAFRTVNCFYWFDAQQNTWFPKTPMLFVRIKPSLVCCEGYIYAIGGDSVGGELNRRTVERYDTEKDEWTMVSPLPCAWQWSAAVVVHDCIYVMTLNLMYCYFPRSDSWVEMAMRQTSRSFASAAAFGDKIFYIGGLHIATNSGIRLPSGTVDGSSVTVEIYDVNKNEWKMAANIPAKRYSDPCVRAVVISNSLCVFMRETHLNERAKYVTYQYDLELDRWSLRQHISERVLWDLGRDFRCTVGKLYPSCLEESPWKPPTYLFSTDGTEEFELDGEMVALPPV

SEQ ID NO: 883484 - protein, 623 aa, Homo sapiens; identical to SEQ ID NO: 883483

SEQ ID NO: 883485 - protein, 623 aa, Homo sapiens; identical to SEQ ID NO: 883483

SEQ ID NO: 883486 - protein, 623 aa, Homo sapiens; identical to SEQ ID NO: 883483

SEQ ID NO: 883487 - protein, 129 aa, Homo sapiens
GRALRSVRRRPQRTLLSALDGPSEGGCEGKPEGRGGGASLPRPEAEARPQARPRREGHAPAAAPEGPSVDGATGWSGSHTSGPRDAVTPQDPLNIGCCHKIYLVYFSLSLMSCTIADLSTMSADCVEKL

SEQ ID NO: 883488 - protein, 623 aa, Homo sapiens; identical to SEQ ID NO: 883483

SEQ ID NO: 883489 - protein, 454 aa, Homo sapiens [sequence omitted]

SEQ ID NO: 883490 - protein, 623 aa, Homo sapiens; identical to SEQ ID NO: 883483

SEQ ID NO: 883491 - protein, 623 aa, Homo sapiens; identical to SEQ ID NO: 883483

SEQ ID NO: 883492 - protein, 129 aa, Homo sapiens; identical to SEQ ID NO: 883487

SEQ ID NO: 883493 - protein, 122 aa, Homo sapiens
RPAPSPPMPLAEIGPSLLREPPGPRDPQLLQPLHPRFLDRLLQARLTSSTVPYSRHAPGDLSVPLCTGTMQIPLPHRVHVPVLIKCWPQALPSQGSQHCVPDTPVGCSDSLHGDLTITRSQE

SEQ ID NO: 883494 - protein, 304 aa, Homo sapiens
MNRAFSRKKDKTWMHTPEALSKHFIPYNAKFLGSTEVEQPKGTEVVRDAVRKLKFARHIKKSEGQKIPKVELQISIYGVKILEPKTKEVQHNCQLHRISFCADDKTDKRIFTFICKDSESNKHLCYVFDSEKCAEEITLTIGQAFDLAYRKFLESGGKDVETRKQIAGLQKRIQDLETENMELKNKVQDLENQLRITQVSAPPAGSMTPKSPSTDIFDMIPFSPISHQSSMPTRNGTQPPPVPSRSTEIKRDLFGAEPFDPFNCGAADFPPDIQSKLDEMQEGFKMGLTLEGTVFCLDPLDSRC

SEQ ID NO: 883495 - protein, 304 aa, Homo sapiens; identical to SEQ ID NO: 883494

SEQ ID NO: 883496 - protein, 124 aa, Homo sapiens [sequence omitted]

SEQ ID NO: 883497 - protein, 208 aa, Homo sapiens
DKQSGKKRGFGFVYFQNHDAADKAAGSSSIRFRAIAWAEEITLTIGQAFDLAYRKFLESGGKDVETRKQIAGLQKRIQDLETENMELKNKVQDLENQLRITQVSAPPAGSMTPKSPSTDIFDMIPFSPISHQSSMPTRNGTQPPPVPSRSTEIKRDLFGAEPFDPFNCGAADFPPDIQSKLDEMQEGFKMGLTLEGTVFCLDPLDSRC

SEQ ID NO: 883498 - protein, 311 aa, Homo sapiens
MNRAFSRKKDKTWMHTPEALSKHFIPYNAKFLGSTEVEQPKGTEVVRDAVRKLKFARHIKKSEGQKIPKVELQISIYGVKILEPKTKEVQHNCQLHRISFCADDKTDKRIFTFICKDSESNKHLCYVFDSEKCAEEITLTIGQAFDLAYRKFLESGGKDVETRKQIAGLQKRIQDLETENMELKNKVQDLENQLRITQVSAPPAGSMTPKSPSTDIFDMIPFSPISHQSSMPTRNGTQPPPVPSRSTEIKRDLFGAEPFDPFNCGAADFPPDIQSKLDEMQGFIMLSRLGLNCWAQAIYPLRPPKVLGPQA

SEQ ID NO: 883499 - protein, 232 aa, Homo sapiens
DRKYKEVTISIYGVKILEPKTKEVQHNCQLHRISFCADDKTDKRIFTFICKDSESNKHLCYVFDSEKCAEEITLTIGQAFDLAYRKFLESGGKDVETRKQIAGLQKRIQDLETENMELKNKVQDLENQLRITQVSAPPAGSMTPKSPSTDIFDMIPFSPISHQSSMPTRNGTQPPPVPSRSTEIKRDLFGAEPFDPFNCGAADFPPDIQSKLDEMQFIYGRIQTDTNYMKLI

SEQ ID NO: 883500 - protein, 304 aa, Homo sapiens; identical to SEQ ID NO: 883494

SEQ ID NO: 883501 - protein, 379 aa, Homo sapiens
MNRAFSRKKDKTWMHTPEALSKHFIPYNAKFLGSTEVEQPKGTEVVRDAVRKLKFARHIKKSEGQKIPKVELQISIYGVKILEPKTKEVQHNCQLHRISFCADDKTDKRIFTFICKDSESNKHLCYVFDSEKCAEEITLTIGQAFDLAYRKFLESGGKDVETRKQIAGLQKRIQDLETENMELKNKVQDLENQLRITQVSAPPLLHNMSDHEQHVFQRCSSSFWRSNGDSSPCLNISSISVTPINSPDSRLSLGLLIPPPSKCGFPKPVSESSIPRPHAGSMTPKSPSTDIFDMIPFSPISHQSSMPTRNGTQPPPVPSRSTEIKRDLFGAEPFDPFNCGAADFPPDIQSKLDEMQEGFKMGLTLEGTVFCLDPLDSRC

SEQ ID NO: 883502 - protein, 250 aa, Homo sapiens
MNRAFSRKKDKTWMHTPEALSKHFIPYNAKFLGSTEVEQPKGTEVVRDAVRKLKFARHIKKSEGQKIPKVELQISIYGVKILEPKTKEVQHNCQLHRISFCADDKTDKRIFTFICKDSESNKHLCYVFDSEKCAEEITLTIGQAFDLAYRKFLESGGKDVETRKQIAGLQKRIQDLETENMELKNKVQDLENQLRITQVSAPPAGSMTPKSPSTDIFDMIPFSPISHQSSMPTLSKTQNHWQAVLDRERP

SEQ ID NO: 883503 - protein, 103 aa, Homo sapiens
FGRASPIWGAPPLPGMLSEGKPIPRREGKTATTERTFAVPVWKEIGISWRGLASTAGLFKSSTSILEENNADSRKMVGRVILECVLLLFSSKVKSSSSPFNLE

SEQ ID NO: 883504 - protein, 97 aa, Homo sapiens
VHDTQEGTWPEHGGEGWTEGPGKTICSDSGEEASEALDSCSGEPQEPPSEGGTEQKPVMVEARWKAGSLTPYWPEDPLSEPLTGRVASLHPLPAPGV

SEQ ID NO: 883505 - protein, 721 aa, Homo sapiens
MAEKFESLMNIHGFDLGSRYMDLKPLGCGGNGLVFSAVDNDCDKRVAIKKIVLTDPQSVKHALREIKIIRRLDHDNIVKVFEILGPSGSQLTDDVGSLTELNSVYIVQEYMETDLANVLEQGPLLEEHARLFMYQLLRGLKYIHSANVLHRDLKPANLFINTEDLVLKIGDFGLARIMDPHYSHKGHLSEGLVTKWYRSPRLLLSPNNYTKAIDMWAAGCIFAEMLTGKTLFAGAHELEQMQLILESIPVVHEEDRQELLSVIPVYIRNDMTEPHKPLTQLLPGISREALDFLEQILTFSPMDRLTAEEALSHPYMSIYSFPMDEPISSHPFHIEDEVDDILLMDETHSHIYNWERYHDCQFSEHDWPVHNNFDIDEVQLDPRALSDVTDEEEVQVDPRKYLDGDREKYLEDPAFDTNYSTEPCWQYSDHHENKYCDLECSHTCNYKTRSSSYLDNLVWRESEVNHYYEPKLIIDLSNWKEQSKEKSDKKGKSKCERNGLVKAQIALEEASQQLAGKEREKNQGFDFDSFIAGTIQLSSQHEPTDVVDKLNDLNSSVSQLELKSLISKSVSQEKQEKGMANLAQLEALYQSSWDSQFVSGGEDCFFINQFCEVRKDEQVEKENTYTSYLDKFFSRKEDTEMLETEPVEDGKLGERGHEEGFLNNSGEFLFNKQLESIGIPQFHSPVGSPLKSIQATLTPSAMKSSPQIPHQTYSSILKHLN

SEQ ID NO: 883506 - protein, 721 aa, Homo sapiens; identical to SEQ ID NO: 883505

SEQ ID NO: 883507 - protein, 721 aa, Homo sapiens; identical to SEQ ID NO: 883505

SEQ ID NO: 883508 - protein, 721 aa, Homo sapiens; identical to SEQ ID NO: 883505

SEQ ID NO: 883509 - protein, 698 aa, Homo sapiens
MAEKFESLMNIHGFDLGSRYMDLKPLGCGGNGLVFSAVDNDCDKRVAIKKIVLTDPQSVKHALREIKIIRRLDHDNIVKVFEILGPSGSQLTDDVGSLTELNSVYIVQEYMETDLANVLEQGPLLEEHARLFMYQLLRGLKYIHSANVLHRDLKPANLFINTEDLVLKIGDFGLARIMDPHYSHKGHLSEGLVTKWYRSPRLLLSPNNYTKAIDMWAAGCIFAEMLTGKTLFAGAHELEQMQLILESIPVVHEEDRQELLSVIPVYIRNDMTEPHKPLTQLLPGISREALDFLEQILTFSPMDRLTAEEALSHPYMSIYSFPMDEPISSHPFHIEDEVDDILLMDETHSHIYNWERYHDCQFSEHDWPVHNNFDIDEVQLDPRALSDVTDEEEVQVDPRKYLDGDREKYLEDPAFDTNYSTEPCWQYSDHHENKYCDLECSHTCNYKTRSSSYLDNLVWRESEVNHYYEPKLIIDLSNWKEQSKEKSDKKGKSKCERNGLVKAQIALEEASQQLAGKEREKNQGFDFDSFIAGTIQLSSQHEPTDVVDKLNDLNSSVSQLELKSLISKSVSQEKQEKGMANLAQLEALYQSSWDSQFVSGGEDCFFINQFCEVRKDEQVEKENTYTSYLDKFFSRKEDTEMLETEPVEDGKLGERGHEEGFLNNSGEFLFNKQLESIGIPQFHSPVGSRRRGRGRRGR

SEQ ID NO: 883510 - protein, 721 aa, Homo sapiens; identical to SEQ ID NO: 883505

SEQ ID NO: 883511 - protein, 721 aa, Homo sapiens; identical to SEQ ID NO: 883505

SEQ ID NO: 883512 - protein, 199 aa, Homo sapiens
RVVVATAAAREELGEDGGPRGSSQTTRRRCPRARRVPRRQRRGLARGRAAWASASLRFPGSGPATSAGAAAEAEAPARLSPPPQPEPGEARRPGCLEGGGSAAREWEFSSLEYGDCSITRPFLCSPVVFGHHIEVLGSSGMKVIDCCPNRTTERPRVAECGKREESLDLSITPLVYEPALHCHPSLCVLGAGGVLLPPE

SEQ ID NO: 883513 - protein, 110 aa, Homo sapiens
AWSSPPQPPERSWGRTVAREARRRQRGGDVREPGECRGGSGGALRAAGRPGLRPPSGSLEAGPRPAREQQQRRRLQRVSLLPLSLSRGKSQRQAKLRSLREGETRDPEIV

SEQ ID NO: 883514 - protein, 179 aa, Homo sapiens
MGILFTRIWRLFNHQEHKVIIVGLDNAGKTTILYQFSMNEVVHTSPTIGSNVEEIVINNTRFLMWDIGGQESLRSSWNTYYTNTEFVIVVVDSTDRERISVTREELYKMLAHEDLRKAGLLIFANKQDVKECMTVAEISQFLKLTSIKDHQWHIQACCALTGEGLCQGLEWMMSRLKIR

SEQ ID NO: 883515 - protein, 179 aa, Homo sapiens; identical to SEQ ID NO: 883514

SEQ ID NO: 883516 - protein, 179 aa, Homo sapiens; identical to SEQ ID NO: 883514

SEQ ID NO: 883517 - protein, 179 aa, Homo sapiens; identical to SEQ ID NO: 883514

SEQ ID NO: 883518 - protein, 197 aa, Homo sapiens
AWSSPPQPPERSWGRTVAREARRRQRGGDVREPEHKVIIVGLDNAGKTTILYQFSMNEVVHTSPTIGSNVEEIVINNTRFLMWDIGGQESLRSSWNTYYTNTEFVIVVVDSTDRERISVTREELYKMLAHEDLRKAGLLIFANKQDVKECMTVAEISQFLKLTSIKDHQWHIQACCALTGEGLCQGLEWMMSRLKIR

SEQ ID NO: 883519 - protein, 114 aa, Homo sapiens
MGILFTRIWRLFNHQEHKVIIVGLDNAGKTTILYQFSMNEVVHTSPTIGSNVEEIVINNTRFLMWDIGGQESLRSSWNTYYTNTEFVIVVVDSTDRERISVTREELYKMLAHEK

SEQ ID NO: 883520 - protein, 179 aa, Homo sapiens; identical to SEQ ID NO: 883514

SEQ ID NO: 883521 - protein, 1620 aa, Homo sapiens [sequence omitted]

SEQ ID NO: 883522 - protein, 1874 aa, Homo sapiens
MGAIGLLWLLPLLLSTAAVGSGMGTGQRAGSPAAGPPLQPREPLSYSRLQRKSLAVDFVVPSLFRVYARDLLLPPSSSELKAGRPEARGSLALDCAPLLRLLGPAPGVSWTAGSPAPAEARTLSRVLKGGSVRKLRRAKQLVLELGEEAILEGCVGPPGEAAVGLLQFNLSELFSWWIRQGEGRLRIRLMPEKKASEVGREGRLSAAIRASQPRLLFQIFGTGHSSLESPTNMPSPSPDYFTWNLTWIMKDSFPFLSHRSRYGLECSFDFPCELEYSPPLHDLRNQSWSWRRIPSEEASQMDLLDGPGAERSKEMPRGSFLLLNTSADSKHTILSPWMRSSSEHCTLAVSVHRHLQPSGRYIAQLLPHNEAAREILLMPTPGKHGWTVLQGRIGRPDNPFRVALEYISSGNRSLSAVDFFALKNCSEGTSPGSKMALQSSFTCWNGTVLQLGQACDFHQDCAQGEDESQMCRKLPVGFYCNFEDGFCGWTQGTLSPHTPQWQVRTLKDARFQDHQDHALLLSTTDVPASESATVTSATFPAPIKSSPCELRMSWLIRGVLRGNVSLVLVENKTGKEQGRMVWHVAAYEGLSLWQWMVLPLLDVSDRFWLQMVAWWGQGSRAIVAFDNISISLDCYLTISGEDKILQNTAPKSRNLFERNPNKELKPGENSPRQTPIFDPTVHWLFTTCGASGPHGPTQAQCNNAYQNSNLSVEVGSEGPLKGIQIWKVPATDTYSISGYGAAGGKGGKNTMMRSHGVSVLGIFNLEKDDMLYILVGQQGEDACPSTNQLIQKVCIGENNVIEEEIRVNRSVHEWAGGGGGGGGATYVFKMKDGVPVPLIIAAGGGGRAYGAKTDTFHPERLENNSSVLGLNGNSGAAGGGGGWNDNTSLLWAGKSLQEGATGGHSCPQAMKKWGWETRGGFGGGGGGCSSGGGGGGYIGGNAASNNDPEMDGEDGVSFISPLGILYTPALKVMEGHGEVNIKHYLNCSHCEVDECHMDPESHKVICFCDHGTVLAEDGVSCIVSPTPEPHLPLSLILSVVTSALVAALVLAFSGIMIVYRRKHQELQAMQMELQSPEYKLSKLRTSTIMTDYNPNYCFAGKTSSISDLKEVPRKNITLIRGLGHGAFGEVYEGQVSGMPNDPSPLQVAVKTLPEVCSEQDELDFLMEALIISKFNHQNIVRCIGVSLQSLPRFILLELMAGGDLKSFLRETRPRPSQPSSLAMLDLLHVARDIACGCQYLEENHFIHRDIAARNCLLTCPGPGRVAKIGDFGMARDIYRASYYRKGGCAMLPVKWMPPEAFMEGIFTSKTDTWSFGVLLWEIFSLGYMPYPSKSNQEVLEFVTSGGRMDPPKNCPGPVYRIMTQCWQHQPEDRPNFAIILERIEYCTQDPDVINTALPIEYGPLVEEEEKVPVRPKDPEGVPPLLVSQQAKREEERSPAAPPPLPTTSSGKAAKKPTAAEVSVRVPRGPAVEGGHVNMAFSQSNPPSELHRVHGSRNKPTSLWNPTYGSWFTEKPTKKNNPIAKKEPHERGNLGLEGSCTVPPNVATGRLPGASLLLEPSSLTANMKEVPLFRLRHFPCGNVNYGYQQQGLPLEAATAPGAGHYEDTILKSKNSMNQPVALSSVAHSLLFLGIPKTVEEREAINGSFTNQRPNVTFCFVPTYFEVPPKKLYFENALERFGAWVHPILSKEENIIKMSDKYKARCGCKGFYACLLYSVRVPRGPAVEGGHVNMAFSQSNPPSELHKVHGSRNKPTSLWNPTYGSWFTEKPTKKNNPIAKKEPHDRGNLGLEGSCTVPPNVATGRLPGASLLLEPSSLTANMKEVPLFRLRHFPCGNVNYGYQQQGLPLEAATAPGAGHYEDTILKSKNSMNQPGP

SEQ ID NO: 883523 - protein, 709 aa, Homo sapiens
DSVLRGCSLEQRSFISVRLLSYLSACRHPMEDSMDMDMSPLRPQNYLFGCELKADKDYHFKVDNDENEHQLSLRTVSLGAGAKDELHIVEAEAMNYEGSPIKVTLATLKMSVQPTVSLGGFEITPPVVLRLKCGSGPVHISGQHLVVYRRKHQELQAMQMELQSPEYKLSKLRTSTIMTDYNPNYCFAGKTSSISDLKEVPRKNITLIRGLGHGAFGEVYEGQVSGMPNDPSPLQVAVKTLPEVCSEQDELDFLMEALIISKFNHQNIVRCIGVSLQSLPRFILLELMAGGDLKSFLRETRPRPSQPSSLAMLDLLHVARDIACGCQYLEENHFIHRDIAARNCLLTCPGPGRVAKIGDFGMARDIYRASYYRKGGCAMLPVKWMPPEAFMEGIFTSKTDTWSFGVLLWEIFSLGYMPYPSKSNQEVLEFVTSGGRMDPPKNCPGPVYRIMTQCWQHQPEDRPNFAIILERIEYCTQDPDVINTALPIEYGPLVEEEEKVPVRPKDPEGVPPLLVSQQAKREEERSPAAPPPLPTTSSGKAAKKPTAAEVSVRVPRGPAVEGGHVNMAFSQSNPPSELHKVHGSRNKPTSLWNPTYGSWFTEKPTKKNNPIAKKEPHDRGNLGLEGSCTVPPNVATGRLPGASLLLEPSSLTANMKEVPLFRLRHFPCGNVNYGYQQQGLPLEAATAPGAGHYEDTILKSKNSMNQPGP

SEQ ID NO: 883524 - protein, 756 aa, Homo sapiens
MNGQLDLSGKLIIKAQLGEDIRRIPIHNEDITYDELVLMMQRVFRGKLLSNDEVTIKYKDEDGDLITIFDSSDLSFAIQCSRILKLTLFVNGQPRPLESSQVKYLRRELIELRNKVNRLLDSLEPPGEPGPSTNIPENDTVDGREEKSASDSSGKQSTQVMAASMSAFDPLKNQDEINKNVMSAFGLTDDQVSVYRRKHQELQAMQMELQSPEYKLSKLRTSTIMTDYNPNYCFAGKTSSISDLKEVPRKNITLIRGLGHGAFGEVYEGQVSGMPNDPSPLQVAVKTLPEVCSEQDELDFLMEALIISKFNHQNIVRCIGVSLQSLPRFILLELMAGGDLKSFLRETRPRPSQPSSLAMLDLLHVARDIACGCQYLEENHFIHRDIAARNCLLTCPGPGRVAKIGDFGMARDIYRASYYRKGGCAMLPVKWMPPEAFMEGIFTSKTDTWSFGVLLWEIFSLGYMPYPSKSNQEVLEFVTSGGRMDPPKNCPGPVYRIMTQCWQHQPEDRPNFAIILERIEYCTQDPDVINTALPIEYGPLVEEEEKVPVRPKDPEGVPPLLVSQQAKREEERSPAAPPPLPTTSSGKAAKKPTAAEVSVRVPRGPAVEGGHVNMAFSQSNPPSELHKVHGSRNKPTSLWNPTYGSWFTEKPTKKNNPIAKKEPHDRGNLGLEGSCTVPPNVATGRLPGASLLLEPSSLTANMKEVPLFRLRHFPCGNVNYGYQQQGLPLEAATAPGAGHYEDTILKSKNSMNQPGP

SEQ ID NO: 883525 - protein, 784 aa, Homo sapiens
MAGLNSLEAVKRKIQALQQQADEAEDRAQGLQRELDGERERREKAEGDVAALNRRIQLVEEELDRAQERLATALQKLEEAEKAADESERGMKVIENRAMKDEEKMEIQEMQLKEAKHIAEEADRKYEEVARKLVILEGELERAEERAEVSELKCGDLEEELKNVTNNLKSLEAASEKYSEKEDKYEEEIKLLSDKLKEAETRAEFAERTVAKLEKTIDDLEVYRRKHQELQAMQMELQSPEYKLSKLRTSTIMTDYNPNYCFAGKTSSISDLKEVPRKNITLIRGLGHGAFGEVYEGQVSGMPNDPSPLQVAVKTLPEVCSEQDELDFLMEALIISKFNHQNIVRCIGVSLQSLPRFILLELMAGGDLKSFLRETRPRPSQPSSLAMLDLLHVARDIACGCQYLEENHFIHRDIAARNCLLTCPGPGRVAKIGDFGMARDIYRASYYRKGGCAMLPVKWMPPEAFMEGIFTSKTDTWSFGVLLWEIFSLGYMPYPSKSNQEVLEFVTSGGRMDPPKNCPGPVYRIMTQCWQHQPEDRPNFAIILERIEYCTQDPDVINTALPIEYGPLVEEEEKVPVRPKDPEGVPPLLVSQQAKREEERSPAAPPPLPTTSSGKAAKKPTAAEVSVRVPRGPAVEGGHVNMAFSQSNPPSELHKVHGSRNKPTSLWNPTYGSWFTEKPTKKNNPIAKKEPHDRGNLGLEGSCTVPPNVATGRLPGASLLLEPSSLTANMKEVPLFRLRHFPCGNVNYGYQQQGLPLEAATAPGAGHYEDTILKSKNSMNQPGP

SEQ ID NO: 883526 - protein, 675 aa, Homo sapiens
REVEGERRAREQAEAEVASLNRRIQLVEEELDRAQERAEVSELKCGDLEEELKNVTNNLKSLEAASEKYSEKEDKYEEEIKLLSDKLKEAETRAEFAERTVAKLEKTIDDLEVYRRKHQELQAMQMELQSPEYKLSKLRTSTIMTDYNPNYCFAGKTSSISDLKEVPRKNITLIRGLGHGAFGEVYEGQVSGMPNDPSPLQVAVKTLPEVCSEQDELDFLMEALIISKFNHQNIVRCIGVSLQSLPRFILLELMAGGDLKSFLRETRPRPSQPSSLAMLDLLHVARDIACGCQYLEENHFIHRDIAARNCLLTCPGPGRVAKIGDFGMARDIYRASYYRKGGCAMLPVKWMPPEAFMEGIFTSKTDTWSFGVLLWEIFSLGYMPYPSKSNQEVLEFVTSGGRMDPPKNCPGPVYRIMTQCWQHQPEDRPNFAIILERIEYCTQDPDVINTALPIEYGPLVEEEEKVPVRPKDPEGVPPLLVSQQAKREEERSPAAPPPLPTTSSGKAAKKPTAAEVSVRVPRGPAVEGGHVNMAFSQSNPPSELHKVHGSRNKPTSLWNPTYGSWFTEKPTKKNNPIAKKEPHDRGNLGLEGSCTVPPNVATGRLPGASLLLEPSSLTANMKEVPLFRLRHFPCGNVNYGYQQQGLPLEAATAPGAGHYEDTILKSKNSMNQPGP

SEQ ID NO: 883527 - protein, 701 aa, Homo sapiens
MNGQLDLSGKLIIKAQLGEDIRRIPIHNEDITYDELVLMMQRVFRGKLLSNDEVTIKYKDEDGDLITIFDSSDLSFAIQCSRILKLTLFVNGQPRPLESSQVKYLRRELIELRNKVNRLLDSLEPPGEPGPSTNIPENVYRRKHQELQAMQMELQSPEYKLSKLRTSTIMTDYNPNYCFAGKTSSISDLKEVPRKNITLIRGLGHGAFGEVYEGQVSGMPNDPSPLQVAVKTLPEVCSEQDELDFLMEALIISKFNHQNIVRCIGVSLQSLPRFILLELMAGGDLKSFLRETRPRPSQPSSLAMLDLLHVARDIACGCQYLEENHFIHRDIAARNCLLTCPGPGRVAKIGDFGMARDIYRASYYRKGGCAMLPVKWMPPEAFMEGIFTSKTDTWSFGVLLWEIFSLGYMPYPSKSNQEVLEFVTSGGRMDPPKNCPGPVYRIMTQCWQHQPEDRPNFAIILERIEYCTQDPDVINTALPIEYGPLVEEEEKVPVRPKDPEGVPPLLVSQQAKREEERSPAAPPPLPTTSSGKAAKKPTAAEVSVRVPRGPAVEGGHVNMAFSQSNPPSELHKVHGSRNKPTSLWNPTYGSWFTEKPTKKNNPIAKKEPHDRGNLGLEGSCTVPPNVATGRLPGASLLLEPSSLTANMKEVPLFRLRHFPCGNVNYGYQQQGLPLEAATAPGAGHYEDTILKSKNSMNQPGP

SEQ ID NO: 883528 - protein, 761 aa, Homo sapiens
LSARRIEGWNSNEAPPPRPTLAEGDVAALNRRIQLVEEELDRAQERLATALQKLEEAEKAADESERGMKVIENRAMKDEEKMEIQEMQLKEAKHIAEEADRKYEEVARKLVILEGELERAEERAEVSELKCGDLEEELKNVTNNLKSLEAASEKYSEKEDKYEEEIKLLSDKLKEAETRAEFAERTVAKLEKTIDDLEVYRRKHQELQAMQMELQSPEYKLSKLRTSTIMTDYNPNYCFAGKTSSISDLKEVPRKNITLIRGLGHGAFGEVYEGQVSGMPNDPSPLQVAVKTLPEVCSEQDELDFLMEALIISKFNHQNIVRCIGVSLQSLPRFILLELMAGGDLKSFLRETRPRPSQPSSLAMLDLLHVARDIACGCQYLEENHFIHRDIAARNCLLTCPGPGRVAKIGDFGMARDIYRASYYRKGGCAMLPVKWMPPEAFMEGIFTSKTDTWSFGVLLWEIFSLGYMPYPSKSNQEVLEFVTSGGRMDPPKNCPGPVYRIMTQCWQHQPEDRPNFAIILERIEYCTQDPDVINTALPIEYGPLVEEEEKVPVRPKDPEGVPPLLVSQQAKREEERSPAAPPPLPTTSSGKAAKKPTAAEVSVRVPRGPAVEGGHVNMAFSQSNPPSELHKVHGSRNKPTSLWNPTYGSWFTEKPTKKNNPIAKKEPHDRGNLGLEGSCTVPPNVATGRLPGASLLLEPSSLTANMKEVPLFRLRHFPCGNVNYGYQQQGLPLEAATAPGAGHYEDTILKSKNSMNQPGP

SEQ ID NO: 883529 - protein, 353 aa, Homo sapiens
SFWLKEPGKRRTMGELMAFLLPLIIVLMVKHSDSRTHSLRYFRLGVSDPIHGVPEFISVGYVDSHPITTYDSVTRQKEPRAPWMAENLAPDHWERYTQLLRGWQQMFKVELKRLQRHYNHSGSHTYQRMIGCELLEDGSTTGFLQYAYDGQDFLIFNKDTLSWLAVDNVAHTIKQAWEANQHELLYQKNWLEEECIAWLKRFLEYGKDTLQRTEPPLVRVNRKETFPGVTALFCKAHGFYPPEIYMTWMKNGEEIVQEIDYGDILPSGDGTYQAWASIELDPQSSNLYSCHVEHCGVHMVLQVPQESETIPLVMKAVSGSIVLVIVLAGVGVLVWRRRPREQNGAIYLPTPDR

SEQ ID NO: 883530 - protein, 308 aa, Homo sapiens
SFWLKEPGKRRTMGELMAFLLPLIIVLMVKHSDSRTHSLRYFRLGVSDPIHGVPEFISVGYVDSHPITTYDSVTRQKEPRAPWMAENLAPDHWERYTQLLRGWQQMFKVELKRLQRHYNHSDNVAHTIKQAWEANQHELLYQKNWLEEECIAWLKRFLEYGKDTLQRTEPPLVRVNRKETFPGVTALFCKAHGFYPPEIYMTWMKNGEEIVQEIDYGDILPSGDGTYQAWASIELDPQSSNLYSCHVEHCGVHMVLQVPQESETIPLVMKAVSGSIVLVIVLAGVGVLVWRRRPREQNGAIYLPTPDR

SEQ ID NO: 883531 - protein, 261 aa, Homo sapiens
SFWLKEPGKRRTMGELMAFLLPLIIVLMVKHSDSRTHSLRYFRLGVSDPIHGVPEFISVGYVDSHPITTYDSVTRQKEPRAPWMAENLAPDHWERYTQLLRGWQQMFKVELKRLQRHYNHSGSHTYQRMIGCELLEDGSTTGFLQYAYDGQDFLIFNKDTLSWLAVDNVAHTIKQAWEANQHELLYQKNWLEEECIAWLKRFLEYGKDTLQRTESETIPLVMKAVSGSIVLVIVLAGVGVLVWRRRPREQNGAIYLPTPDR

SEQ ID NO: 883532 - protein, 261 aa, Homo sapiens; identical to SEQ ID NO: 883531

SEQ ID NO: 883533 - protein, 327 aa, Homo sapiens
WQCWKEQETGRKRGTHSLRYFRLGVSDPIHGVPEFISVGYVDSHPITTYDSVTRQKEPRAPWMAENLAPDHWERYTQLLRGWQQMFKVELKRLQRHYNHSGSHTYQRMIGCELLEDGSTTGFLQYAYDGQDFLIFNKDTLSWLAVDNVAHTIKQAWEANQHELLYQKNWLEEECIAWLKRFLEYGKDTLQRTEPPLVRVNRKETFPGVTALFCKAHGFYPPEIYMTWMKNGEEIVQEIDYGDILPSGDGTYQAWASIELDPQSSNLYSCHVEHCGVHMVLQVPQGKDGDRGCLGREPGERGEQETMLAAREGRIDHCLTQCALEWVF

SEQ ID NO: 883534 - protein, 261 aa, Homo sapiens; identical to SEQ ID NO: 883531

SEQ ID NO: 883535 - protein, 232 aa, Homo sapiens
SFWLKEPGKRRTMGELMAFLLPLIIVLMVKHSDSRTHSLRYFRLGVSDPIHGVPEFISVGYVDSHPITTYDSVTRQKEPRAPWMAENLAPDHWERYTQLLRGWQQMFKVELKRLQRHYNHSGSHTYQRMIGCELLEDGSTTGFLQYAYDGQDFLIFNKDTLSWLAVDNVAHTIKQAWEANQHELLYQKNWLEEECIAWLKRFLEYGKDTLQRTGKEKEKASFPHCLNNCFYT

SEQ ID NO: 883536 - protein, 332 aa, Homo sapiens
WQCWKEQETGRKRGTHSLRYFRLGVSDPIHGVPEFISVGYVDSHPITTYDSVTRQKEPRAPWMAENLAPDHWERYTQLLRGWQQMFKVELKRLQRHYNHSGSHTYQRMIGCELLEDGSTTGFLQYAYDGQDFLIFNKDTLSWLAVDNVAHTIKQAWEANQHELLYQKNWLEEECIAWLKRFLEYGKDTLQRTEPPLVRVNRKETFPGVTALFCKAHGFYPPEIYMTWMKNGEEIVQEIDYGDILPSGDGTYQAWASIELDPQSSNLYSCHVEHCGVHMVLQVPQESETIPLVMKAVSGSIVLVIVLAGVGVLVWRRRPREQNGAIYLPTPDR

SEQ ID NO: 883537 - protein, 160 aa, Homo sapiens
SFWLKEPGKRRTMGELMAFLLPLIIVLMVKHSDSRTHSLRYFRLGVSDPIHGVPEFISVGYVDSHPITTYDSVTRQKEPRAPWMAENLAPDHWERYTQLLRGWQQMFKVELKRLQRHYNHSGVHAAETDASPIPPQPAETPGLASNKRMLNCTCCSFGKA

SEQ ID NO: 883538 - protein, 968 aa, Homo sapiens
MVNSSRVQPQQPGDAKRPPAPRAPDPGRLMAGCAAVGASLAAPGGLCEQRGLEIEMQRIRQAAARDPPAGAAASPSPPLSSCSRQAWSRDNPGFEAEEEEEEVEGEEGGMVVEMDVEWRPGSRRSAASSAVSSVGARSRGLGGYHGAGHPSGRRRRREDQGPPCPSPVGGGDPLHRHLPLEGQPPRVAWAERLVRGLRGLWGTRLMEESSTNREKYLKSVLRELVTYLLFLIVLCILTYGMMSSNVYYYTRMMSQLFLDTPVSKTEKTNFKTLSSMEDFWKFTEGSLLDGLYWKMQPSNQTEADNRSFIFYENLLLGVPRIRQLRVRNGSCSIPQDLRDEIKECYDVYSVSSEDRAPFGPRNGTAWIYTSEKDLNGSSHWGIIATYSGAGYYLDLSRTREETAAQVASLKKNVWLDRGTRATFIDFSVYNANINLFCVVRLLVEFPATGGVIPSWQFQPLKLIRYVTTFDFFLAACEIIFCFFIFYYVVEEILEIRIHKLHYFRSFWNCLDVVIVVLSVVAIGINIYRTSNVEVLLQFLEDQNTFPNFEHLAYWQIQFNNIAAVTVFFVWIKLFKFINFNRTMSQLSTTMSRCAKDLFGFAIMFFIIFLAYAQLAYLVFGTQVDDFSTFQECIFTQFRIILGDINFAEIEEANRVLGPIYFTTFVFFMFFILLNMFLAIINDTYSEVKSDLAQQKAEMELSDLIRKGYHKALVKLKLKKNTVDDISESLRQGGGKLNFDELRQDLKGKGHTDAEIEAIFTKYDQDGDQELTEHEHQQMRDDLEKEREDLDLDHSSLPRPMSSRSFPRSLDDSEEDDDEDSGHSSRRRGSISSGVSYEEFQVLVRRVDRMEHSIGSIVSKIDAVIVKLEIMERAKLKRREVLGRLLDGVAEDERLGRDSEIHREQMERLVREELERWESDDAASQISHGLGTPVGLNGQPRPRSSRPSSSQSTEGMEGAGGNGSSNVHV

SEQ ID NO: 883539 - protein, 968 aa, Homo sapiens; identical to SEQ ID NO: 883538

SEQ ID NO: 883540 - protein, 968 aa, Homo sapiens; identical to SEQ ID NO: 883538

SEQ ID NO: 883541 - protein, 459 aa, Homo sapiens
MVNSSRVQPQQPGDAKRPPAPRAPDPGRLMAGCAAVGASLAAPGGLCEQRGLEIEMQRIRQAAARDPPAGAAASPSPPLSSCSRQAWSRDNPGFEAEEEEEEVEGEEGGMVVEMDVEWRPGSRRSAASSAVSSVGARSRGLGGYHGAGHPSGRRRRREDQGPPCPSPVGGGDPLHRHLPLEGQPPRVAWAERLVRGLRGLWGTRLMEESSTNREKYLKSVLRELVTYLLFLIVLCILTYGMMSSNVYYYTRMMSQLFLDTPVSKTEKTNFKTLSSMEDFWKFTEGSLLDGLYWKMQPSNQTEADNRSFIFYENLLLGVPRIRQLRVRNGSCSIPQDLRDEIKECYDVYSVSSEDRAPFGPRNGTAWIYTSEKDLNGSSHWGIIATYSGAGYYLDLSRTREETAAQVASLKKNVWLDRGTRATFIDFSVYNANINLFCVVRQTCRYLIALFVALKRKQDH

SEQ ID NO: 883542 - protein, 386 aa, Homo sapiens
MSQLSTTMSRCAKDLFGFAIMFFIIFLAYAQLAYLVFGTQVDDFSTFQECIFTQFRIILGDINFAEIEEANRVLGPIYFTTFVFFMFFILLNMFLAIINDTYSEVKSDLAQQKAEMELSDLIRKGYHKALVKLKLKKNTVDDISESLRQGGGKLNFDELRQDLKGKGHTDAEIEAIFTKYDQDGDQELTEHEHQQMRDDLEKEREDLDLDHSSLPRPMSSRSFPRSLDDSEEDDDEDSGHSSRRRGSISSGVSYEEFQVLVRRVDRMEHSIGSIVSKIDAVIVKLEIMERAKLKRREVLGRLLDGVAEDERLGRDSEIHREQMERLVREELERWESDDAASQISHGLGTPVGLNGQPRPRSSRPSSSQSTEGMEGAGGNGSSNVHV

SEQ ID NO: 883543 - protein, 583 aa, Homo sapiens
MVNSSRVQPQQPGDAKRPPAPRAPDPGRLMAGCAAVGASLAAPGGLCEQRGLEIEMQRIRQAAARDPPAGAAASPSPPLSSCSRQAWSRDNPGFEAEEEEEEVEGEEGGMVVEMDVEWRPGSRRSAASSAVSSVGARSRGLGGYHGAGHPSGRRRRREDQGPPCPSPVGGGDPLHRHLPLEGQPPRVAWAERLVRGLRGLWGTRLMEESSTNREKYLKSVLRELVTYLLFLIVLCILTYGMMSSNVYYYTRMMSQLFLDTPVSKTEKTNFKTLSSMEDFWKFTEGSLLDGLYWKMQPSNQTEADNRSFIFYENLLLGVPRIRQLRVRNGSCSIPQDLRDEIKECYDVYSVSSEDRAPFGPRNGTAWIYTSEKDLNGSSHWGIIATYSGAGYYLDLSRTREETAAQVASLKKNVWLDRGTRATFIDFSVYNANINLFCVVRLLVEFPATGGVIPSWQFQPLKLIRYVTTFDFFLAACEIIFCFFIFYYVVEEILEIRIHKLHYFRSFWNCLDVVIVVLSVVAIGINIYRTSNVEVLLQFLEDQNTFPNFEHLAYWQIQFNNIAAVTVFFVWIKVIYKFHVLHFK

SEQ ID NO: 883544 - protein, 153 aa, Homo sapiens
LEGRPVWRRLRRVSEARLPSRTGSGSSQWPAGAEAGGGGSVRAAGLLSRGAGARAPLLLLHSALFWRLAPLRCRLLLDQASFSTSARGADPSGTLPPRLVLSPSPPRLRPWPRWLCATETPSWRMLEETLRMATTTMKELLSFWMLVLSTGKS

SEQ ID NO: 883545 - protein, 693 aa, Homo sapiens
MALCNGDSKLENAGGDLKDGHHHYEGAVVILDAGAQYGKVIDRRVRELFVQSEIFPLETPAFAIKEQGFRAIIISGGPNSVYAEDAPWFDPAIFTIGKPVLGICYGMQMMNKVFGGTVHKKSVREDGVFNISVDNTCSLFRGLQKEEVVLLTHGDSVDKVADGFKVVARSGNIVAGIANESKKLYGAQFHPEVGLTENGKVILKNFLYDIAGCSGTFTVQNRELECIREIKERVGTSKVLVLLSGGVDSTVCTALLNRALNQEQVIAVHIDNGFMRKRESQSVEEALKKLGIQVKVINAAHSFYNGTTTLPISDEDRTPRKRISKTLNMTTSPEEKRKIIGDTFVKIANEVIGEMNLKPEEVFLAQGTLRPDLIESASLVASGKAELIKTHHNDTELIRKLREEGKVIEPLKDFHKDEVRILGRELGLPEELVSRHPFPGPGLAIRVICAEEPYICKDFPETNNILKIVADFSASVKKPHTLLQRVKACTTEEDQEKLMQITSLHSLNAFLLPIKTVGVQGDCRSYSYVCGISSKDEPDWESLIFLARLIPRMCHNVNRVVYIFGPPVKEPPTDVTPTFLTTGVLSTLRQADFEAHNILRESGYAGKISQMPVILTPLHFDRDPLQKQPSCQRSVVIRTFITSDFMTGIPATPGNEIPVEVVLKMVTEIKKIPGISRIMYDLTSKPPGTTEWE

SEQ ID NO: 883546 - protein, 693 aa, Homo sapiens; identical to SEQ ID NO: 883545

SEQ ID NO: 883547 - protein, 693 aa, Homo sapiens; identical to SEQ ID NO: 883545

SEQ ID NO: 883548 - protein, 125 aa, Homo sapiens
SGRAGRFGGGCGGYLRLGCQAERALAPPSGRPGRKQEAGAACALLVFSPAALGPALRCCCSIRRFSGGWLLSAAGCSSTRPPSQPQPAAPTLPAPSRPVSYCRRHRRGSGPGPDGSVQRRLQDDE

SEQ ID NO: 883549 - protein, 144 aa, Homo sapiens
SGRAGRFGGGCGGYLRLGCQAERALAPPSGRPGRKQEAGAACALLVFSPAALGPALRCCCSIRRFSGGWLLSAAGCSSTRPPSQPQPAAPTLPAPSRPVSYCRRHRRGSGPGPDGSVQRRLQESDHDTTKRSSVGHSTKSWSDL

SEQ ID NO: 883550 - protein, 620 aa, Homo sapiens
MALCNGDSKLENAGGDLKDGHHHYEGAVVILDAGAQYGKVIDRRVRELFVQSEIFPLETPAFAIKEQGFRAIIISGGPNSVYAEDAPWFDPAIFTIGKPVLGICYGMQMMNKVFGGTVHKKSVREDGVFNISVDNTCSLFRGLQKEEVVLLTHGDSVDKVADGFKVVARSGNIVAGIANESKKLYGAQFHPEVGLTENGKVILKNFLYDIAGCSGTFTVQNRELECIREIKERVGTSKVLVLLSGGVDSTVCTALLNRALNQEQVIAVHIDNGFMRKRESQSVEEALKKLGIQVKVINAAHSFYNGTTTLPISDEDRTPRKRISKTLNMTTSPEEKRKIIGDTFVKIANEVIGEMNLKPEEVFLAQGTLRPDLIESASLVASGKAELIKTHHNDTELIRKLREEGKVIEPLKDFHKDEVRILGRELGLPEELVSRHPFPGPGLAIRVICAEEPYICKDFPETNNILKIVADFSASVKKPHTLLQRVKACTTEEDQEKLMQITSLHSLNAFLLPIKTVGVQGDCRSYSYVCGISSKDEPDWESLIFLARLIPRMCHNVNRVVYIFGPPVKEPPTDVTPTFLTTGVLSTLRQADFEAHNILRESGYAGKISQMPVILTPLYY

SEQ ID NO: 883551 - protein, 93 aa, Homo sapiens
PEQVAYSAFVAECEPGLRGGIYAEPIDEYCVQQLTFRWESLVSVTKEGLALPEDEEEKKKMEESKAKFKNLCKLMNRHLDKIKVTNRLMSHKS

SEQ ID NO: 883552 - protein, 412 aa, Homo sapiens
MALCNGDSKLENAGGDLKDGHHHYEGAVVILDAGAQYGKVIDRRVRELFVQSEIFPLETPAFAIKEQGFRAIIISGGPNSVYAEDAPWFDPAIFTIGKPVLGICYGMQMMNKVFGGTVHKKSVREDGVFNISVDNTCSLFRGLQKEEVVLLTHGDSVDKVADGFKVVARSGNIVAGIANESKKLYGAQFHPEVGLTENGKVILKNFLYDIAGCSGTFTVQNRELECIREIKERVGTSKVLVLLSGGVDSTVCTALLNRALNQEQVIAVHIDNGFMRKRESQSVEEALKKLGIQVKVINAAHSFYNGTTTLPISDEDRTPRKRISKTLNMTTSPEEKRKIIGDTFVKIANEVIGEMNLKPEEVFLAQGTLRPDLIESASLVASGKAELIKTHHNDTELIRKLREEGETWTSGR

SEQ ID NO: 883553 - protein, 1093 aa, Homo sapiens
CNLTTVHCSCLRGEPPEPWHSSLLKLGNDPPHLKPAGAEATFDQTQALGDRWGNFPLPLLRPGTQQRNFVENELKDATQGEYLLRSHHAGLPTRARQHDKVKAEYVHLNHPLTLVTRERDLAVKEKHQLQAKLENLEQVLKHMREAAERRQQLQLEHDQALAVLSAKQQEIDLLQKPQKTNLQCPHFRKCPMLSQLTMTFVSTLGFKRQKTQTGNCFCAQSLKMWLQTWLDPGLKSAGLRPSRIQGLPDITRTWLLSALLWISFSLGFPVETPSHSSPDPPGGKVAAASPPPKPKSNRKGLPSPAAFSGRGPLPSVGPTPPRSPVAEGSDCAWHRGGPDPSQSRGSSQERSSRRWRKRPEEQACYPEDPAIQEAQVEAKKEHEGAVRLLESKVRELEEKCRTQSEQFNLLSRDLEKFRQHAGKIDLLGGSAVAPLDISTAPSKPFPQFMNGLATSLGKGQESAIGGSSAIGEYIRPLPQPGDRPEPLSAKPTFLSRSGSARCRSESDMENERNSNTSKQRYSGKVHLCVARYSYNPFDGPNENPEAELPLTAGKYLYVYGDMDEDGFYEGELLDGQRGLVPSNFVDFVQDNESRLASTLGNEQDQNFINHSGIGLEGEHILDLHSPTHIDAGITDNSAGTLDVNIDDIGEDIVPYPRKITLIKQLAKSVIVGWEPPAVPPGWGTVSSYNVLVDKETRMNLTLGSRTKALIEKLNMAACTYRISVQCVTSRGSSDELQCTLLVGKDVVVAPSHLRVDNITQISAQLSWLPTNSNYSHVIFLNEEEFDIVKAARYKYQFFNLRPNMAYKVKVLAKPHQMPWQLPLEQREKKEAFVEFSTLPAGPPAPPQDVTVQAGVTPATIRVSWRPPVLTPTGLSNGANVTGYGVYAKGQRVAEVIFPTADSTAVELVRLRSLEAKGVTVRTLSAQGESVDSAVAAVPPELLVPPTPHPRPAPQSKPLASSGVPETKDEHLGPHARMDEAWEQSRAPGPVHGHMLEPPVGPGRRSPSPSRILPQPQGTPVSTTVAKAMAREAAQRVAESSRLEKRSVFLERSSAGQYAASDEEDAYDSPDFKRRGASVDDFLKGSELGKQMVS

SEQ ID NO: 883554 - protein, 1194 aa, Homo sapiens
CNLTTVHCSCLRGEPPEPWHSSLLKLGNDPPHLKPAGAEATFDQTQALGDRWGNFPLPLLRPGTQQRNFVENELKDATQGEYLLRSHHAGLPTRARQHDKVKAEYVHLNHPLTLVTRERDLAVKEKHQLQAKLENLEQVLKHMREAAERRQQLQLEHDQALAVLSAKQQEIDLLQKSKVRELEEKCRTQSEQFNLLSRDLEKFRQHAGKIDLLGGSAVAPLDISTAPSKPFPQFMNGLATSLGKGQESAIGGSSAIGEYIRPLPQPGDRPEPLSAKPTFLSRSGSARCRSESDMENERNSNTSKQRYSGKVHLCVARYSYNPFDGPNENPEAELPLTAGKYLYVYGDMDEDGFYEGELLDGQRGLVPSNFVDFVQDNESRLASTLGNEQDQNFINHSGIGLEGEHILDLHSPTHIDAGITDNSAGTLDVNIDDIGEDIVPYPRKITLIKQLAKSVIVGWEPPAVPPGWGTVSSYNVLVDKETRMNLTLGSRTKALIEKLNMAACTYRISVQCVTSRGSSDELQCTLLVGKDVVVAPSHLRVDNITQISAQLSWLPTNSNYSHVIFLNEEEFDIVKAARYKYQFFNLRPNMAYKVKVLAKPHQMPWQLPLEQREKKEAFVEFSTLPAGPPAPPQDVTVQAGVTPATIRVSWRPPVLTPTGLSNGANVTGYGVYAKGQRVAEVIFPTADSTAVELVRLRSLEAKGVTVRTLSAQGESVDSAVAAVPPELLVPPTPHPRPAPQSKPLASSGVPETKDEHLGPHARMDEAWEQSRAPGPVHGHMLEPPVGPGRRSPSPSRILPQPQGTPVSTTVAKAMAREAAQRVAESSRLEKRSVFLERSSAGQYAASDEEDAYDSPDFKRRGASVDDFLKGSELGKQPHCCHGDEYHTESSRGSDLSDIMEEDEEELYSEMQLEDGGRRRPSGTSHNALKILGNPASAGRVDHMGRRFPRGSAGPQRSRPVTVPSIDDYGRDRLSPDFYEESETDPGAEELPARIFVALFDYDPLTMSPNPDAAEEELPFKEGQIIKVYGDKDADGFYRGETCARLGLIPCNMVSEIQADDEEMMDQLLRQGFLPLNTPVEKIERSRRSGRRHSVSTRRMVALYDYDPRESSPNVDVEAELTFCTGDIITVFGEIDEDGFYYGELNGQKGLVPSNFLEEVPDDVEVYLSDAPSHYSQDTPMRSKAKRKKSVHFTP

SEQ ID NO: 883555 - protein, 1208 aa, Homo sapiens
CNLTTVHCSCLRGEPPEPWHSSLLKLGNDPPHLKPAGAEATFDQTQALGDRWGNFPLPLLRPGTQQRNFVENELKDATQGEYLLRSHHAGLPTRARQHDKVKAEYVHLNHPLTLVTRERDLAVKEKHQLQAKLENLEQVLKHMREAAERRQQLQLEHDQALAVLSAKQQEIDLLQKAQVEAKKEHEGAVRLLESKVRELEEKCRTQSEQFNLLSRDLEKFRQHAGKIDLLGGSAVAPLDISTAPSKPFPQFMNGLATSLGKGQESAIGGSSAIGEYIRPLPQPGDRPEPLSAKPTFLSRSGSARCRSESDMENERNSNTSKQRYSGKVHLCVARYSYNPFDGPNENPEAELPLTAGKYLYVYGDMDEDGFYEGELLDGQRGLVPSNFVDFVQDNESRLASTLGNEQDQNFINHSGIGLEGEHILDLHSPTHIDAGITDNSAGTLDVNIDDIGEDIVPYPRKITLIKQLAKSVIVGWEPPAVPPGWGTVSSYNVLVDKETRMNLTLGSRTKALIEKLNMAACTYRISVQCVTSRGSSDELQCTLLVGKDVVVAPSHLRVDNITQISAQLSWLPTNSNYSHVIFLNEEEFDIVKAARYKYQFFNLRPNMAYKVKVLAKPHQMPWQLPLEQREKKEAFVEFSTLPAGPPAPPQDVTVQAGVTPATIRVSWRPPVLTPTGLSNGANVTGYGVYAKGQRVAEVIFPTADSTAVELVRLRSLEAKGVTVRTLSAQGESVDSAVAAVPPELLVPPTPHPRPAPQSKPLASSGVPETKDEHLGPHARMDEAWEQSRAPGPVHGHMLEPPVGPGRRSPSPSRILPQPQGTPVSTTVAKAMAREAAQRVAESSRLEKRSVFLERSSAGQYAASDEEDAYDSPDFKRRGASVDDFLKGSELGKQPHCCHGDEYHTESSRGSDLSDIMEEDEEELYSEMQLEDGGRRRPSGTSHNALKILGNPASAGRVDHMGRRFPRGSAGPQRSRPVTVPSIDDYGRDRLSPDFYEESETDPGAEELPARIFVALFDYDPLTMSPNPDAAEEELPFKEGQIIKVYGDKDADGFYRGETCARLGLIPCNMVSEIQADDEEMMDQLLRQGFLPLNTPVEKIERSRRSGRRHSVSTRRMVALYDYDPRESSPNVDVEAELTFCTGDIITVFGEIDEDGFYYGELNGQKGLVPSNFLEEVPDDVEVYLSDAPSHYSQDTPMRSKAKRVSKPI

SEQ ID NO: 883556 - protein, 1240 aa, Homo sapiens
CVYFFPQLGNDPPHLKPAGAEATFDQTQALGDRWGNFPLPLLRPGTQQRNFVENELKDATQGEYLLRSHHAGLPTRARQHDKVKAEYVHLNHPLTLVTRERDLAVKEKHQLQAKLENLEQVLKHMREAAERRQQLQLEHDQALAVLSAKQQEIDLLQKAQVEAKKEHEGAVRLLENTLDSMQVFQRIASSLPGVLGDAFPVSGRGHESWACSDLPLLPELQLLTQSKVRELEEKCRTQSEQFNLLSRDLEKFRQHAGKIDLLGGSAVAPLDISTAPSKPFPQFMNGLATSLGKGQESAIGGSSAIGEYIRPLPQPGDRPEPLSAKPTFLSRSGSARCRSESDMENERNSNTSKQRYSGKVHLCVARYSYNPFDGPNENPEAELPLTAGKYLYVYGDMDEDGFYEGELLDGQRGLVPSNFVDFVQDNESRLASTLGNEQDQNFINHSGIGLEGEHILDLHSPTHIDAGITDNSAGTLDVNIDDIGEDIVPYPRKITLIKQLAKSVIVGWEPPAVPPGWGTVSSYNVLVDKETRMNLTLGSRTKALIEKLNMAACTYRISVQCVTSRGSSDELQCTLLVGKDVVVAPSHLRVDNITQISAQLSWLPTNSNYSHVIFLNEEEFDIVKAARYKYQFFNLRPNMAYKVKVLAKPHQMPWQLPLEQREKKEAFVEFSTLPAGPPAPPQDVTVQAGVTPATIRVSWRPPVLTPTGLSNGANVTGYGVYAKGQRVAEVIFPTADSTAVELVRLRSLEAKGVTVRTLSAQGESVDSAVAAVPPELLVPPTPHPRPAPQSKPLASSGVPETKDEHLGPHARMDEAWEQSRAPGPVHGHMLEPPVGPGRRSPSPSRILPQPQGTPVSTTVAKAMAREAAQRVAESSRLEKRSVFLERSSAGQYAASDEEDAYDSPDFKRRGASVDDFLKGSELGKQPHCCHGDEYHTESSRGSDLSDIMEEDEEELYSEMQLEDGGRRRPSGTSHNALKILGNPASAGRVDHMGRRFPRGSAGPQRSRPVTVPSIDDYGRDRLSPDFYEESETDPGAEELPARIFVALFDYDPLTMSPNPDAAEEELPFKEGQIIKVYGDKDADGFYRGETCARLGLIPCNMVSEIQADDEEMMDQLLRQGFLPLNTPVEKIERSRRSGRRHSVSTRRMVALYDYDPRESSPNVDVEAELTFCTGDIITVFGEIDEDGFYYGELNGQKGLVPSNFLEEVPDDVEVYLSDAPSHYSQDTPMRSKAKRVSKPI

SEQ ID NO: 883557 - protein, 895 aa, Homo sapiens
CNLTTVHCSCLRGEPPEPWHSSLLKLGNDPPHLKPAGAEATFDQTQALGDRWGNFPLPLLRPGTQQRNFVENELKDATQGEYLLRSHHAGLPTRARQHDKVKAEYVHLNHPLTLVTRERDLAVKEKHQLQAKLENLEQVLKHMREAAERRQQLQLEHDQALAVLSAKQQEIDLLQKAQVEAKKEHEGAVRLLESKVRELEEKCRTQSEQFNLLSRDLEKFRQHAGKIDLLGGSAVAPLDISTAPSKPFPQFMNGLATSLGKGQESAIGGSSAIGEYIRPLPQPGDRPEPLSAKPTFLSRSGSARCRSESDMENERNSNTSKQRYSGKVHLCVARYSYNPFDGPNENPEAELPLTAGKYLYVYGDMDEDGFYEGELLDGQRGLVPSNFVDFVQDNESRLASTLGNEQDQNFINHSGIGLEGEHILDLHSPTHIDAGITDNSAGTLDVNIDDIGEDIVPYPRKITLIKQLAKSVIVGWEPPAVPPGWGTVSSYNVLVDKETRMNLTLGSRTKALIEKLNMAACTYRISVQCVTSRGSSDELQCTLLVGKDVVVAPSHLRVDNITQISAQLSWLPTNSNYSHVIFLNEEEFDIVKAARYKYQFFNLRPNMAYKVKVLAKPHQMPWQLPLEQREKKEAFVEFSTLPAGPPAPPQDVTVQAGVTPATIRVSWRPPVLTPTGLSNGANVTGYGVYAKGQRVAEVIFPTADSTAVELVRLRSLEAKGVTVRTLSAQGESVDSAVAAVPPELLVPPTPHPRPAPQSKPLASSGVPETKDEHLGPHARMDEAWEQSRAPGPVHGHMLEPPVGPGRRSPSPSRILPQPQGTPVSTTVAKAMAREAAQRVAESSRLEKRSVFLERSSAGQYAASDEEDAYDSPDFKRRGASVDDFLKGSELGKQGN

SEQ ID NO: 883558 - protein, 836 aa, Homo sapiens
CNLTTVHCSCLRGEPPEPWHSSLLKLGNDPPHLKPAGAEATFDQTQALGDRWGNFPLPLLRPGTQQRNFVENELKDATQGEYLLRSHHAGLPTRARQHDKVKAEYVHLNHPLTLVTRERDLAVKEKHQLQAKLENLEQVLKHMREAAERRQQLQLEHDQALAVLSAKQQEIDLLQKAQVEAKKEHEGAVRLLESKVRELEEKCRTQSEQFNLLSRDLEKFRQHAGKIDLLGGSAVAPLDISTAPSKPFPQFMNGLATSLGKGQESAIGGSSAIGEYIRPLPQPGDRPEPLSAKPTFLSRSGSARCRSESDMENERNSNTSKQRYSGKVHLCVARYSYNPFDGPNENPEAELPLTAGKYLYVYGDMDEDGFYEGELLDGQRGLVPSNFVDFVQDNESRLASTLGNEQDQNFINHSGIGLEGEHILDLHSPTHIDAGITDNSAGTLDVNIDDIGEDIVPYPRKITLIKQLAKSVIVGWEPPAVPPGWGTVSSYNVLVDKETRMNLTLGSRTKALIEKLNMAACTYRISVQCVTSRGSSDELQCTLLVGKDVVVAPSHLRVDNITQISAQLSWLPTNSNYSHVIFLNEEEFDIVKAARYKYQFFNLRPNMAYKVKVLAKPHQMPWQLPLEQREKKEAFVEFSTLPAGPPAPPQDVTVQAGVTPATIRVSWRPPVLTPTGLSNGANVTGYGVYAKGQRVAEVIFPTADSTAVELVRLRSLEAKGVTVRTLSAQGESVDSAVAAVPPELLVPPTPHPRPAPQSKPLASSGVPETKDEHLGPHARMDEAWEQSRAPGPVHGHMLEPPVGPASCHSHRAPRCPPPSPRPWPGRPRRGWPRAAG

SEQ ID NO: 883559 - protein, 146 aa, Homo sapiens
CNLTTVHCSCLRGEPPEPWHSSLLKLGNDPPHLKPAGAEATFDQTQALGDRWGNFPLPLLRPGTQQRNFVENELKDATQGEYLLRSHHAGLPTRARQHDKVKAEYVHLNHPLTLVTRERDLAVKEKHQLQAKLENLEQVLKDVKHS

SEQ ID NO: 883560 - protein, 835 aa, Homo sapiens
RIHTGTDTSRHTRRHTHTRARILPPACPPARRRPEPALAACFLLRKLPALEDGTLPHPDTLGMNYEGARSERENHAADDSEGGALDMCCSERLPGLPQPIVMEALDEAEGLQDSQREMPPPPPPSPPSDPAQKPPPRGAGSHSLTVRSSLCLFAASQFLLACGVLWFSGYGHIWSQNATNLVSSLLTLLKQLEPTAWLDSGTWGVPSLLLVFLSVGLVLVTTLVWHLLRTPPEPPTPLPPEDRRQSVSRQPSFTYSEWMEEKIEDDFLDLDPVPETPVFDCVMDIKPEADPTSLTVKSMGLQERRGSNVSLTLDMCTPGCNEEGFGYLMSPREESAREYLLSASRVLQAEELHEKALDPFLLQAEFFEIPMNFVDPKEYDIPGLVRKNRYKTILPNPHSRVCLTSPDPDDPLSSYINANYIRGYGGEEKVYIATQGPIVSTVADFWRMVWQEHTPIIVMITNIEEMNEKCTEYWPEEQVAYDGVEITVQKVIHTEDYRLRLISLKSGTEERGLKHYWFTSWPDQKTPDRAPPLLHLVREVEEAAQQEGPHCAPIIVHCSAGIGRTGCFIATSICLPAAAAGGCGGHPEDHVPAPSGQGRHDPDMRAVPVCAPRHEPLRKAAVPPVPRMTALLLQGSLGTAQPESRPSPRALPRVLGLLPASSPSVSSLCPLSAWPDPYPPALLFLLYILGSGGQGREGTCQARPGAPGPDPHHADPGLQFLTMVPSIPDPECFRATLCVLLQCVLSVHPSLPSVPDTVSPQPGRGNELQPLSNRTCLPRPHPHFSQKADDGELGMGSSRRSPESFQLRESSLGWSGHHSQGGLWVSDALRRVPSL

SEQ ID NO: 883561 - protein, 773 aa, Homo sapiens
SQIERQPQPPQKGGTPCLWTGRSHRRKGPSTTGLPQPIVMEALDEAEGLQDSQREMPPPPPPSPPSDPAQKPPPRGAGSHSLTVRSSLCLFAASQFLLACGVLWFSGYGHIWSQNATNLVSSLLTLLKQLEPTAWLDSGTWGVPSLLLVFLSVGLVLVTTLVWHLLRTPPEPPTPLPPEDRRQSVSRQPSFTYSEWMEEKIEDDFLDLDPVPETPVFDCVMDIKPEADPTSLTVKSMGLQERRGSNVSLTLDMCTPGCNEEGFGYLMSPREESAREYLLSASRVLQAEELHEKALDPFLLQAEFFEIPMNFVDPKEYDIPGLVRKNRYKTILPNPHSRVCLTSPDPDDPLSSYINANYIRGYGGEEKVYIATQGPIVSTVADFWRMVWQEHTPIIVMITNIEEMNEKCTEYWPEEQVAYDGVEITVQKVIHTEDYRLRLISLKSGTEERGLKHYWFTSWPDQKTPDRAPPLLHLVREVEEAAQQEGPHCAPIIVHCSAGIGRTGCFIATSICLPAAAAGGCGGHPEDHVPAPSGQGRHDPDMRAVPVCAPRHEPLRKAAVPPVPRMTALLLQGSLGTAQPESRPSPRALPRVLGLLPASSPSVSSLCPLSAWPDPYPPALLFLLYILGSGGQGREGTCQARPGAPGPDPHHADPGLQFLTMVPSIPDPECFRATLCVLLQCVLSVHPSLPSVPDTVSPQPGRGNELQPLSNRTCLPRPHPHFSQKADDGELGMGSSRRSPESFQLRESSLGWSGHHSQGGLWVSDALRRVPSL

SEQ ID NO: 883562 - protein, 806 aa, Homo sapiens
VAYTLAQTQAGTHADTRTLRAHPPASLPACSPAPGARSGRSERENHAADDSEGGALDMCCSERLPGLPQPIVMEALDEAEGLQDSQREMPPPPPPSPPSDPAQKPPPRGAGSHSLTVRSSLCLFAASQFLLACGVLWFSGYGHIWSQNATNLVSSLLTLLKQLEPTAWLDSGTWGVPSLLLVFLSVGLVLVTTLVWHLLRTPPEPPTPLPPEDRRQSVSRQPSFTYSEWMEEKIEDDFLDLDPVPETPVFDCVMDIKPEADPTSLTVKSMGLQERRGSNVSLTLDMCTPGCNEEGFGYLMSPREESAREYLLSASRVLQAEELHEKALDPFLLQAEFFEIPMNFVDPKEYDIPGLVRKNRYKTILPNPHSRVCLTSPDPDDPLSSYINANYIRGYGGEEKVYIATQGPIVSTVADFWRMVWQEHTPIIVMITNIEEMNEKCTEYWPEEQVAYDGVEITVQKVIHTEDYRLRLISLKSGTEERGLKHYWFTSWPDQKTPDRAPPLLHLVREVEEAAQQEGPHCAPIIVHCSAGIGRTGCFIATSICLPAAAAGGCGGHPEDHVPAPSGQGRHDPDMRAVPVCAPRHEPLRKAAVPPVPRMTALLLQGSLGTAQPESRPSPRALPRVLGLLPASSPSVSSLCPLSAWPDPYPPALLFLLYILGSGGQGREGTCQARPGAPGPDPHHADPGLQFLTMVPSIPDPECFRATLCVLLQCVLSVHPSLPSVPDTVSPQPGRGNELQPLSNRTCLPRPHPHFSQKADDGELGMGSSRRSPESFQLRESSLGWSGHHSQGGLWVSDALRRVPSL

SEQ ID NO: 883563 - protein, 209 aa, Homo sapiens
HLSIHPSLPLCMHLSIHPCLCVCICPSIHPHLCACICPSIPASVHASVRPSIPASVHASVRPFIPASVHASVHSSIPDSVHASVHPSILASMHAFVRPSIPASVHASIPASVHASVSLSIPDPFFVMVLSAHNSLILRRSLDPFPPLTPCCSLPSLPGQVLQPVVSTQSSLPPLLSHLSPLHSKFFPNALGLQALKRSLCPWMTKHRPM

SEQ ID NO: 883564 - protein, 209 aa, Homo sapiens; identical to SEQ ID NO: 883563

SEQ ID NO: 883565 - protein, 209 aa, Homo sapiens; identical to SEQ ID NO: 883563

SEQ ID NO: 883566 - protein, 729 aa, Homo sapiens
MTEITAEGNASTTTTVIDSKNGSVPKSPGKVLKRTVTEDIVTTFSSPAAWLLVIALIITWSAVAIVMFDLVDYKNFSASSIAKIGSDPLKLVRDAMEETTDWIYGFFSLLSDIISSEDEEDDDGDEDTDKGEIDEPPLRKKEIHKDKTEKQEKPERKIQTKVTHKEKEKGKEKVREKEKPEKKATHKEKIEKKEKPETKTVAKEQKKAKTAEKSEEKTKKEVKGGKQEKVKQTAAKVKEVQKTPSKPKEKEDKEKAAVSKHEQKDQYAFCRYMIDIFVHGDLKPGQSPAIPPPLPTEQASRPTPASPALEEKEGEKKKAEKKVTSETKKKEKEDIKKKSEKETAIDVEKKEPGKASETKQGTVKIAAQAAAKKDEKKEDSKKTKKPAEVEQPKGKKQEKKEKHVEPAKSPKKEHSVPSDKQVKAKTERAKEEIGAVSSKKAVPGKKEEKTTKTVEQEIRKEKSGKTSSILKDKEPIKGKEEKVPASLKEKEPETKKDEKMSKAGKEVKPKPPQLQGKKEEKPEPQIKKEAKPAISEKVQIHKQDIVKPEKTVSHGKPEEKVLKQVKAVTIEKTAKPKPTKKAEHREREPPSIKTDKPKPTPKGTSEVTESGKKKTEISEKESKEKADMKHLREEKVSTRKESLQLHNVTKAEKPARVSKDVEDVPASKKAKEGTEDVSPTKQKSPISFFQCVYLDGYNGYGFQFPFTPADRPGESSGQANSPGQKQQGQ

SEQ ID NO: 883567 - protein, 352 aa, Homo sapiens [sequence omitted]

SEQ ID NO: 883568 - protein, 352 aa, Homo sapiens [sequence omitted]

SEQ ID NO: 883569 - protein, 254 aa, Homo sapiens
MPAKTPIYLKAANNKKGKKFKLRDILSPDMISPPLGDFRHTIHIGKEGQHDVFGDISFLQGNYELLPGNQEKAHLGQFPGHNEFFRANSTSDSVFTETPSPVLKNAISLPTIGGSQALMLPLLSPVTFNSKQESFGPAKLPRLSCEPVMEEKAQEKSSLLENGTVHQGDTSWGSSGSASQSSQGRDSHSSSLSEQYPDWPAEDMFDHPTPCELIKGKTKSEESLSDLTGSLLSLQLDLGPSLLDEVLNVMDKNK

SEQ ID NO: 883570 - protein, 254 aa, Homo sapiens; identical to SEQ ID NO: 883569

SEQ ID NO: 883571 - protein, 254 aa, Homo sapiens; identical to SEQ ID NO: 883569

SEQ ID NO: 883572 - protein, 132 aa, Homo sapiens
MPAKTPIYLKAANNKKGKKFKLRDILSPDMISPPLGDFRHTIHIGKEGQHDVFGDISFLQGNYELLPGNQEKAHLGQFPGHNEFFRANSTSDSVFTETPSPVLKNAISLPTIGGSQALMLPLLSPVTFNSKL

SEQ ID NO: 883573 - protein, 254 aa, Homo sapiens; identical to SEQ ID NO: 883569

SEQ ID NO: 883574 - protein, 254 aa, Homo sapiens; identical to SEQ ID NO: 883569

SEQ ID NO: 883575 - protein, 254 aa, Homo sapiens; identical to SEQ ID NO: 883569

SEQ ID NO: 883576 - protein, 754 aa, Homo sapiens
EETKPLLGGDVLLSTKMGAVPAAGLFCFERDEVQMLQEGDIQVCVIRHPRTFLSKILTSKFLRRWEPHHLTLADNSLASATPTGYMENSVSYSAIEDVQLLSWENAPKYCLQLTIPGGTVLLQAANSYLRDQWFHSLQWKKKIYKYKKVLSNPSRWEVVLKEIRTLVDMALTSPLQDDSINQAPLEIVSKLLSENTNLTTQEHENIIVAIAPLLENNHPPPDLCEFFCKHCRERPRSMVVIEVFTPVVQRILKHNMDFGKCPRLRLFTQEYILALNELNAGMEVVKKFIQSMHGPTGHCPHPRVLPNLVAVCLAAIYSCYEEFINSRDNSPSLKEIRNGCQQPCDRKPTLPLRLLHPSPDLVSQEATLSEARLKSVVVASSEIHVEVERTSTAKPALTASAGNDSEPNLIDCLMVSPACSTMSIELGPQADRTLGCYVEILKLLSDYDDWRPSLASLLQPIPFPKEALAHEKFTKELKYVIQRFAEDPRQEVHSCLLSVRAGKDGWFQLYSPGGVACDDDGELFASMVHILMGSCYKTKKFLLSLAENKLGPCMLLALRGNQTMVEILCLMLEYNIIDNNDTQLQIISTLESTDVGKRMYEQLCDRQRELKELQRKGGPTRLTLPSKSTDADLARLLSSGSFGNLENLSLAFTNVTSACAEHLIKLPSLKQLNLWSTQFGDAGLRLLSEHLTMLQVLNLCETPVTDAGLLALSSMKSLCSLNMNSTKLSADTYEDLKAKLPNLKEVDVRYTEAW

SEQ ID NO: 883577 - protein, 218 aa, Homo sapiens
MSRLVLISLAENKLGPCMLLALRGNQTMVEILCLMLEYNIIDNNDTQLQIISTLESTDVGKRMYEQLCDRQRELKELQRKGGPTRLTLPSKSTDADLARLLSSGSFGNLENLSLAFTNVTSACAEHLIKLPSLKQLNLWSTQFGDAGLRLLSEHLTMLQVLNLCETPVTDAGLLALSSMKSLCSLNMNSTKLSADTYEDLKAKLPNLKEVDVRYTEAW

SEQ ID NO: 883578 - protein, 631 aa, Homo sapiens
MCLPLLTVARAMASVAQKKIYKYKKVLSNPSRWEVVLKEIRTLVDMALTSPLQDDSINQAPLEIVSKLLSENTNLTTQEHENIIVAIAPLLENNHPPPDLCEFFCKHCRERPRSMVVIEVFTPVVQRILKHNMDFGKCPRLRLFTQEYILALNELNAGMEVVKKFIQSMHGPTGHCPHPRVLPNLVAVCLAAIYSCYEEFINSRDNSPSLKEIRNGCQQPCDRKPTLPLRLLHPSPDLVSQEATLSEARLKSVVVASSEIHVEVERTSTAKPALTASAGNDSEPNLIDCLMVSPACSTMSIELGPQADRTLGCYVEILKLLSDYDDWRPSLASLLQPIPFPKEALAHEKFTKELKYVIQRFAEDPRQEVHSCLLSVRAGKDGWFQLYSPGGVACDDDGELFASMVHILMGSCYKTKKFLLSLAENKLGPCMLLALRGNQTMVEILCLMLEYNIIDNNDTQLQIISTLESTDVGKRMYEQLCDRQRELKELQRKGGPTRLTLPSKSTDADLARLLSSGSFGNLENLSLAFTNVTSACAEHLIKLPSLKQLNLWSTQFGDAGLRLLSEHLTMLQVLNLCETPVTDAGLLALSSMKSLCSLNMNSTKLSADTYEDLKAKLPNLKEVDVRYTEAW

SEQ ID NO: 883579 - protein, 137 aa, Homo sapiens
ACAVGQRELKELDADLARLLSSGSFGNLENLSLAFTNVTSACAEHLIKLPSLKQLNLWSTQFGDAGLRLLSEHLTMLQVLNLCETPVTDAGLLALSSMKSLCSLNMNSTKLSADTYEDLKAKLPNLKEVDVRYTEAW

SEQ ID NO: 883580 - protein, 754 aa, Homo sapiens; identical to SEQ ID NO: 883576

SEQ ID NO: 883581 - protein, 754 aa, Homo sapiens; identical to SEQ ID NO: 883576

SEQ ID NO: 883582 - protein, 754 aa, Homo sapiens; identical to SEQ ID NO: 883576

SEQ ID NO: 883583 - protein, 171 aa, Homo sapiens
EETKPLLGGDVLLSTKMGAVPAAGLFCFERDEVQMLQEGDIQVCVIRHPRTFLSKILTSKFLRRWEPHHLTLADNSLASATPTGYMENSVSYSAIEDVQLLSWENAPKYCLQLTIPGGTVLLQAANSYLRDQWFHSLQWKKKIYKYKKVLSNPSRWEVVLKEIRTLVDMAL

SEQ ID NO: 883584 - protein, 754 aa, Homo sapiens; identical to SEQ ID NO: 883576

SEQ ID NO: 883585 - protein, 754 aa, Homo sapiens; identical to SEQ ID NO: 883576

SEQ ID NO: 883586 - protein, 73 aa, Homo sapiens
TLVDMALTSPLQDDSINQAPLEIVSKLLSEVKPLPWTPLHCLPFPPPITGSMPSSRRRQSSVWAVLLPCCRRR

SEQ ID NO: 883587 - protein, 69 aa, Homo sapiens
SWPTKEREDLRSLVPCSLCYVKFAMLDLDILDGGDDDWFLCTALGPVSCPALRSPHGMSSAPAMLLFVH

SEQ ID NO: 883588 - protein, 144 aa, Homo sapiens
WAKASLESPTLSAPYKRQADGPEEPERLRPTQKPPPLTPKLTPSASNMKVSAALLWLLLIAAAFSPQGLAGPASVPTTCCFNLANRKIPLQRLESYRRITSGKCPQKAVIFKTKLAKDICADPKKKWVQDSMKYLDQKSPTPKP

SEQ ID NO: 883589 - protein, 129 aa, Homo sapiens
IFSSFMIYLTCGTKINQKPPPLTPKLTPSASNMKVSAALLWLLLIAAAFSPQGLAGPASVPTTCCFNLANRKIPLQRLESYRRITSGKCPQKAVIFKTKLAKDICADPKKKWVQDSMKYLDQKSPTPKP

SEQ ID NO: 883590 - protein, 144 aa, Homo sapiens; identical to SEQ ID NO: 883588

SEQ ID NO: 883591 - protein, 1162 aa, Homo sapiens
MTFGTVLLLSVLASYHGFNLDVEEPTIFQEDAGGFGQSVVQFGGSRLVVGAPLEVVAANQTGRLYDCAAATGMCQPIPLHIRPEAVNMSLGLTLAASTNGSRLLACGPTLHRVCGENSYSKGSCLLLGSRWEIIQTVPDATPECPHQEMDIVFLIDGSGSIDQNDFNQMKGFVQAVMGQFEGTDTLFALMQYSNLLKIHFTFTQFRTSPSQQSLVDPIVQLKGLTFTATGILTVVTQLFHHKNGARKSAKKILIVITDGQKYKDPLEYSDVIPQAEKAGIIRYAIGVGHAFQGPTARQELNTISSAPPQDHVFKVDNFAALGSIQKQLQEKIYAVEGTQSRASSSFQHEMSQEGFSTALTMDGLFLGAVGSFSWSGGAFLYPPNMSPTFINMSQENVDMRDSYLGYSTELALWKGVQNLVLGAPRYQHTGKAVIFTQVSRQWRKKAEVTGTQIGSYFGASLCSVDVDSDGSTDLILIGAPHYYEQTRGGQVSVCPLPRGQRVQWQCDAVLRGEQGHPWGRFGAALTVLGDVNEDKLIDVAIGAPGEQENRGAVYLFHGASESGISPSHSQRIASSQLSPRLQYFGQALSGGQDLTQDGLMDLAVGARGQVLLLRSLPVLKVGVAMRFSPVEVAKAVYRCWEEKPSALEAGDATVCLTIQKSSLDQLGDIQSSVRFDLALDPGRLTSRAIFNETKNPTLTRRKTLGLGIHCETLKLLLPDCVEDVVSPIILHLNFSLVREPIPSPQNLRPVLAVGSQDLFTASLPFEKNCGQDGLCEGDLGVTLSFSGLQTLTVGSSLELNVIVTVWNAGEDSYGTVVSLYYPAGLSHRRVSGAQKQPHQSALRLACETVPTEDEGLRSSRCSVNHPIFHEGSNGTFIVTFDVSYKATLGDRMLMRASASSENNKASSSKATFQLELPVKYAVYTMISRQEESTKYFNFATSDEKKMKEAEHRYRVNNLSQRDLAISINFWVPVLLNGVAVWDVVMEAPSQSLPCVSERKPPQHSDFLTQISRSPMLDCSIADCLQFRCDVPSFSVQEELDFTLKGNLSFGWVRETLQKKVLVVSVAEITFDTSVYSQLPGQEAFMRAQMEMVLEEDEVYNAIPIIMGSSVGALLLLALITATLYKLGFFKRHYKEMLEDKPEDTATFSGDDFSCVAPNVPLS

SEQ ID NO: 883592 - protein, 113 aa, Homo sapiens
GLTTPNPQWKQQNSPLNTYFSLPTCSLPVNRTPSPYLPTRQNLNILLDALSSPVHTFSFKPHTEKHRAGVSKCLPGLTAGVVLKLHNFGLIISLRGSPLPCPWGRKQDKSTPV

SEQ ID NO: 883593 - protein, 125 aa, Homo sapiens
GVEQLPKCSLVNRLPQSKTQVPSILASGEKMSAETTAALNACVASSCDCFGTQNRMCSSQAGSWGHGSGMEGSRNRHCCCSAPPWWGGGGSHLPAGCLQAGPDHGRPSFLPSCRGTRGPPQEAAT

SEQ ID NO: 883594 - protein, 628 aa, Homo sapiens
PGGEFGTRMSPPSPGRRREQRRPRAAATMATPLPGRAGGPATPLSPTRLSRLQEKEELRELNDRLAHYIDRVRALELENDRLLLKISEKEEVTTREVSGIKALYESELADARRVLDETARERARLQIEIGKLRAELDEVNKSAKKREGELTVAQGRVKDLESLFHRSEVELAAALSDKRGLESDVAELRAQLAKAEDGHAVAKKQLEKETLMRVDLENRCQSLQEELDFRKSVFEEEVRETRRRHERRLVEVDSSRQQEYDFKMAQALEELRSQHDEQVRLYKLELEQTYQAKLDSAKLSSDQNDKAASAAREELKEARMRLESLSYQLSGLQKQASAAEDRIRELEEAMAGERDKFRKMLDAKEQEMTEMRDVMQQQLAEYQELLDVKLALDMEINAYRKLLEGEEERLKLSPSPSSRVTVSRATSSSSGSLSATGRLGRSKRKRLEVEEPLGSGPSVLGTGTGGSGGFHLAQQASASGSVSIEEIDLEGKFVQLKNNSDKDQSLGNWRIKRQVLEGEEIAYKFTPKYILRAGQMVTVWAAGAGVAHSPPSTLVWKGQSSWGTGESFRTVLVNADGEEVAMRTVKKSSVMRENENGEEEEEEAEFGEEDLFHQQGDPRTTSRGCYVM

SEQ ID NO: 883595 - protein, 145 aa, Homo sapiens [sequence omitted]

SEQ ID NO: 883596 - protein, 339 aa, Homo sapiens
MATPLPGRAGGPATPLSPTRLSRLQEKEELRELNDRLAHYIDRVRALELENDRLLLKISEKEEVTTREVSGIKALYESELADARRVLDETARERARLQIEIGKLRAELDEVNKSAKKREGELTVAQGRVKDLESLFHRSEVELAAALSDKRGLESDVAELRAQLAKAEDGHAVAKKQLEKETLMRVDLENRCQSLQEELDFRKSVFEEEVRETRRRHERRLVEVDSSRQQEYDFKMAQALEELRSQHDEQVRLYKLELEQTYQAKLDSAKLSSDQNDKAASAAREELKEARMRLESLSYQLSSLTSLPLRRCPGDFSIPPHSSSHHLVKLEAQGQDPEV

SEQ ID NO: 883597 - protein, 145 aa, Homo sapiens [sequence omitted]

SEQ ID NO: 883598 - protein, 600 aa, Homo sapiens
MATPLPGRAGGPATPLSPTRLSRLQEKEELRELNDRLAHYIDRVRALELENDRLLLKISEKEEVTTREVSGIKALYESELADARRVLDETARERARLQIEIGKLRAELDEVNKSAKKREGELTVAQGRVKDLESLFHRSEVELAAALSDKRGLESDVAELRAQLAKAEDGHAVAKKQLEKETLMRVDLENRCQSLQEELDFRKSVFEEEVRETRRRHERRLVEVDSSRQQEYDFKMAQALEELRSQHDEQVRLYKLELEQTYQAKLDSAKLSSDQNDKAASAAREELKEARMRLESLSYQLSGLQKQASAAEDRIRELEEAMAGERDKFRKMLDAKEQEMTEMRDVMQQQLAEYQELLDVKLALDMEINAYRKLLEGEEERLKLSPSPSSRVTVSRATSSSSGSLSATGRLGRSKRKRLEVEEPLGSGPSVLGTGTGGSGGFHLAQQASASGSVSIEEIDLEGKFVQLKNNSDKDQSLGNWRIKRQVLEGEEIAYKFTPKYILRAGQMVTVWAAGAGVAHSPPSTLVWKGQSSWGTGESFRTVLVNADGEEVAMRTVKKSSVMRENENGEEEEEEAEFGEEDLFHQQGDPRTTSRGCYVM

SEQ ID NO: 883599 - protein, 600 aa, Homo sapiens; identical to SEQ ID NO: 883598

SEQ ID NO: 883600 - protein, 68 aa, Homo sapiens
MAFTAGRGRHRSPVTASRLPGDLPVAGRNGGPQPQAGKEPAADKAETPAAPRSPCSLSLLSEVPVPCR

SEQ ID NO: 883601 - protein, 68 aa, Homo sapiens; identical to SEQ ID NO: 883600

SEQ ID NO: 883602 - protein, 600 aa, Homo sapiens; identical to SEQ ID NO: 883598

SEQ ID NO: 883603 - protein, 600 aa, Homo sapiens; identical to SEQ ID NO: 883598

SEQ ID NO: 883604 - protein, 600 aa, Homo sapiens; identical to SEQ ID NO: 883598

SEQ ID NO: 883605 - protein, 600 aa, Homo sapiens; identical to SEQ ID NO: 883598

SEQ ID NO: 883606 - protein, 180 aa, Homo sapiens
LGIRAGLNVRGETIPLCKPCRVTRSLAPSLRSIRRHPALGRRVSLLLLRGVVVWLGASSERAELSLHETDRSSDYMTPLELNLWSHAPLFLRSYGRFYVLGGCGCWKPVSTLVTCYRLNIILEGALPCCAWKRYGGRPSSSDAAEDPADVKAETADCSNVSPPARLSLVVIYNSRITHLV

SEQ ID NO: 883607 - protein, 600 aa, Homo sapiens; identical to SEQ ID NO: 883598

SEQ ID NO: 883608 - protein, 600 aa, Homo sapiens; identical to SEQ ID NO: 883598

SEQ ID NO: 883609 - protein, 600 aa, Homo sapiens; identical to SEQ ID NO: 883598

SEQ ID NO: 883610 - protein, 587 aa, Homo sapiens
MATPLPGRAGGPATPLSPTRLSRLQEKEELRELNDRLAHYIDRVRALELENDRLLLKISEKEEVTTREVSGIKALYESELADARRVLDETARERARLQIEIGKLRAELDEVNKSAKKREGELTVAQGRVKDLESLFHRSEVELAAALSDKRGLESDVAELRAQLAKAEDGHAVAKKQLEKETLMRVDLENRCQSLQEELDFRKSVFEEEVRETRRRHERRLVEVDSSRQQEYDFKMAQALEELRSQHDEQVRLYKLELEQTYQAKLDSAKLSSDQNDKAASAAREELKEARMRLESLSYQLSGLQKQASAAEDRIRELEEAMAGERDKFRKMLDAKEQEMTEMRDVMQQQLAEYQELLDVKLALDMEINAYRKLLEGEEERLKLSPSPSSRVTVSRATSSSSGSLSATGRLGRSKRKRLEVEEPLGSGPSVLGTGTGGSGGFHLAQQASASGSVSIEEIDLEGKFVQLKNNSDKDQSLGNWRIKRQVLEGEEIAYKFTPKYILRAGQMVTVWAAGAGVAHSPPSTLVWKGQSSWGTGESFRTVLVNADGEEVAMRTVKKSSVMRENENGEEEEEEAEFGEEDLFHQQ

SEQ ID NO: 883611 - protein, 549 aa, Homo sapiens
MATPLPGRAGGPATPLSPTRLSRLQEKEELRELNDRLAHYIDRVRALELENDRLLLKISEKEEVTTREVSGIKALYESELADARRVLDETARERARLQIEIGKLRAELDEVNKSAKKREGELTVAQGRVKDLESLFHRSEVELAAALSDKRGLESDVAELRAQLAKAEDGHAVAKKQLEKETLMRVDLENRCQSLQEELDFRKSVFEEEVRETRRRHERRLVEVDSSRQQEYDFKMAQALEELRSQHDEQVRLYKLELEQTYQAKLDSAKLSSDQNDKAASAAREELKEARMRLESLSYQLSGLQKQASAAEDRIRELEEAMAGERDKFRKMLDAKEQEMTEMRDVMQQQLAEYQELLDVKLALDMEINAYRKLLEGEEERLKLSPSPSSRVTVSRATSSSSGSLSATGRLGRSKRKRLEVEEPLGSGPSVLGTGTGGSGGFHLAQQASASGSVSIEEIDLEGKFVQLKNNSDKDQSLGNWRIKRQVLEGEEIAYKFTPKYILRAGQMVTVWAPGAGVLYTTSFLLSWICPFTLLSTSFCKFSSPFLFI

SEQ ID NO: 883612 - protein, 67 aa, Homo sapiens
PNFHHANQSKLIKRQKKTPIADTAKCAKPAVRSAKANRRYQAVKRQITSLRSRKVIMLFKGPEAFKV

SEQ ID NO: 883613 - protein, 600 aa, Homo sapiens; identical to SEQ ID NO: 883598

SEQ ID NO: 883614 - protein, 433 aa, Homo sapiens
TVLVWGSAFHYCYQTLMRVDLENRCQSLQEELDFRKSVFEEEVRETRRRHERRLVEVDSSRQQEYDFKMAQALEELRSQHDEQVRLYKLELEQTYQAKLDSAKLSSDQNDKAASAAREELKEARMRLESLSYQLSGLQKQASAAEDRIRELEEAMAGERDKFRKMLDAKEQEMTEMRDVMQQQLAEYQELLDVKLALDMEINAYRKLLEGEEERLKLSPSPSSRVTVSRATSSSSGSLSATGRLGRSKRKRLEVEEPLGSGPSVLGTGTGGSGGFHLAQQASASGSVSIEEIDLEGKFVQLKNNSDKDQSLGNWRIKRQVLEGEEIAYKFTPKYILRAGQMVTVWAAGAGVAHSPPSTLVWKGQSSWGTGESFRTVLVNADGEEVAMRTVKKSSVMRENENGEEEEEEAEFGEEDLFHQQGDPRTTSRGCYVM

SEQ ID NO: 883615 - protein, 589 aa, Homo sapiens
MATPLPGRAGGPATPLSPTRLSRLQEKEELRELNDRLAHYIDRVRALELENDRLLLKISEKEEVTTREVSGIKALYESELADARRVLDETARERARLQIEIGKLRAELDEVNKSAKKREGELTVAQGRVKDLESLFHRSEVELAAALSDKRGLESDVAELRAQLAKAEDGHAVAKKQLEKETLMRVDLENRCQSLQEELDFRKSVFEEEVRETRRRHERRLVEVDSSRQQEYDFKMAQALEELRSQHDEQVRLYKLELEQTYQAKLDSAKLSSDQNDKAASAAREELKEARMRLESLSYQLSGLQKQASAAEDRIRELEEAMAGERDKFRKMLDAKEQEMTEMRDVMQQQLAEYQELLDVKLALDMEINAYRKLLEGEEERLKLSPSPSSRVTVSRATSSSSGSLSATGRLGRSKRKRLEVEEPLGSGPSVLGTGTGGSGGFHLAQQASASGSVSIEEIDLEGKFVQLKNNSDKDQSLGNWRIKRQVLEGEEIAYKFTPKYILRAGQMVTVWAAGAGVAHSPPSTLVWKGQSSWGTGESFRTVLVNADGERTGRVSRTVDFIWGSFPAVQFLTVQGQQGRGGEDLGKEE

SEQ ID NO: 883616 - protein, 600 aa, Homo sapiens; identical to SEQ ID NO: 883598

SEQ ID NO: 883617 - protein, 600 aa, Homo sapiens; identical to SEQ ID NO: 883598

SEQ ID NO: 883618 - protein, 245 aa, Homo sapiens
PGGEFGTRMSPPSPGRRREQRRPRAAATMATPLPGRAGGPATPLSPTRLSRLQEKEELRELNDRLAHYIDRVRALELENDRLLLKISEKEEVTTREVSGIKALYESELADARRVLDETARERARLQIEIGKLRAELDEVNKSAKKREGELTVAQGRVKDLESLFHRSEVELAAALSDKRGLESDVAELRAQLAKAEDGHAVAKKQLEKGCPCSQKSRSHVDRGGRILPKHFLLEATPLCSQSGGW

SEQ ID NO: 883619 - protein, 600 aa, Homo sapiens; identical to SEQ ID NO: 883598

SEQ ID NO: 883620 - protein, 600 aa, Homo sapiens; identical to SEQ ID NO: 883598

SEQ ID NO: 883621 - protein, 600 aa, Homo sapiens; identical to SEQ ID NO: 883598

SEQ ID NO: 883622 - protein, 600 aa, Homo sapiens; identical to SEQ ID NO: 883598

SEQ ID NO: 883623 - protein, 597 aa, Homo sapiens
MATPLPGRAGGPATPLSPTRLSRLQEKEELRELNDRLAHYIDRVRALELENDRLLLKISEKEEVTTREVSGIKALYESELADARRVLDETARERARLQIEIGKLRAELDEVNKSAKKREGELTVAQGRVKDLESLFHRSEVELAAALSDKRGLESDVAELRAQLAKAEDGHAVAKKQLEKETLMRVDLENRCQSLQEELDFRKSVFEEEVRETRRRHERRLVEVDSSRQQEYDFKMAQALEELRSQHDEQVRLYKLELEQTYQAKLDSAKLSSDQNDKAASAAREELKEARMRLESLSYQLSGLQKQASAAEDRIRELEEAMAGERDKFRKMLDAKEQEMTEMRDVMQQQLAEYQELLDVKLALDMEINAYRKLLEGEEERLKLSPSPSSRVTVSRATSSSSGSLSATGRLGRSKRKRLEVEEPLGSGPSVLGTGTGGSGGFHLAQQASASGSVSIEEIDLEGKFVQLKNNSDKDQSLGNWRIKRQVLEGEEIAYKFTPKYILRAGQMVTVWAAGAGVAHSPPSTLVWKGQSSWGTGESFRTVLVNADGEEVAMRTVKKSSVMRENENGEEEEEEAEFGEEDLFHQQVGPLCPLAAG

SEQ ID NO: 883624 - protein, 68 aa, Homo sapiens; identical to SEQ ID NO: 883600

SEQ ID NO: 883625 - protein, 70 aa, Homo sapiens
RGSGGGGKRSRDRCCQRSRDRCQCSNLPGTPPLPLWACAVSMGIPIKGPGTCASYVAAAHALTPDHMHVP

SEQ ID NO: 883626 - protein, 435 aa, Homo sapiens [sequence omitted]

SEQ ID NO: 883627 - protein, 435 aa, Homo sapiens [sequence omitted]

SEQ ID NO: 883628 - protein, 435 aa, Homo sapiens [sequence omitted]

SEQ ID NO: 883629 - protein, 376 aa, Homo sapiens [sequence omitted]

SEQ ID NO: 883630 - protein, 435 aa, Homo sapiens [sequence omitted]

SEQ ID NO: 883631 - protein, 435 aa, Homo sapiens [sequence omitted]

SEQ ID NO: 883632 - protein, 375 aa, Homo sapiens
MNTSHLLALLLPKSPQGENRSKPLGTPYNFSEHCQDSVDVMVFIVTSYSIETVVGVLGNLCLMCVTVRQKEKANVTNLLIANLAFSDFLMCLLCQPLTAVYTIMDYWIFGETLCKMSAFIQCMSVTVSILSLVLVALERHQLIINPTGWKPSISQAYLGIVLIWVIACVLSLPFLANSILENVFHKNHSKALEFLADKVVCTESWPLAHHRTIYTTFLLLFQYCLPLGFILVCYARIYRRLQRQGRVFHKGTYSLRAGHMKQVNVVLVVMVVAFAVLWLPLHVFNSLEDWHHEAIPICHGNLIFLVCHLLAMASTCVNPFIYGFLNTNFKKEIKALVLTCQQSAPLEESEHLPLSTVHTEVSKGSLRLSGRSNPI

SEQ ID NO: 883633 - protein, 284 aa, Homo sapiens
AAAAAGMAEARSQPSAGPQLNALPDHSPLLQPGLAALRRRAREAGVPLAPLPLTDSFLLRFLRARDFDLDLAWRLLKNYYKWRAECPEISADLHPRSIIGLLKAGYHGVLRSRDPTGSKVLIYRIAHWDPKVFTAYDVFRVSLITSELIVQEVETQRNGIKAIFDLEGWQFSHAFQITPSVAKKIAAVLTDSFPLKVRGIHLINEPVIFHAVFSMIKPFLTEKIKERIHMHGNNYKQSLLQHFPDILPLEYGGEEFSMEDICQEWTNFIMKSEDYLSSISESIQ

SEQ ID NO: 883634 - protein, 118 aa, Homo sapiens
MTSNKDLYKRSTEGDMRFLIPPAKIRDIITRPCVCFLLSIKMKNKSGGENTQVFELKLRVPFLIFPRFEFLLRYGDLSSFISVATAWETDFSQYQRESSPPFFLQASVCSICDASDCN

SEQ ID NO: 883635 - protein, 118 aa, Homo sapiens
MSLIILTRDDEPRIFTPDSDAASPALHSTSPLPDPASASPLHREEKILPKVCNIVSCLSFSLPASPTDSGLASPTIITREGQQFWAKCLIWKYQLYLHGLHKKSDGRRDKQISASPST

SEQ ID NO: 883636 - protein, 323 aa, Homo sapiens
MSAVCGGAARMLRTPGRHGYAAEFSPYLPGRLACATAQHYGIAGCGTLLILDPDEAGLRLFRSFDWNDGLFDVTWSENNEHVLITCSGDGSLQLWDTAKAAGPLQVYKEHAQEVYSVDWSQTRGEQLVVSGSWDQTVKLWDPTVGKSLCTFRGHESIIYSTIWSPHIPGCFASASGDQTLRIWDVKAAGVRIVIPAHQAEILSCDWCKYNENLLVTGAVDCSLRGWDLRNVRQPVFELLGHTYAIRRVKFSPFHASVLASCSYDFTVRFWNFSKPDSLLETVEHHTEFTCGLDFSLQSPTQVADCSWDETIKIYDPACLTIPA

SEQ ID NO: 883637 - protein, 122 aa, Homo sapiens
MSAVCGGAARMLRTPGRHGYAAEFSPYLPGRLACATAQHYGIAGCGTLLILDPDEAGLRLFRSFDWNDGLFDVTWSENNEHVLITCSGDGSLQLWDTAKAAGPLQVYKEHAQEYVQGSCVVK

SEQ ID NO: 883638 - protein, 199 aa, Homo sapiens
MSAVCGGAARMLRTPGRHGYAAEFSPYLPGRLACATAQHYGIAGCGTLLILDPDEAGLRLFRSFDWNDGLFDVTWSENNEHVLITCSGDGSLQLWDTAKAAGPLQVYKEHAQEVYSVDWSQTRGEQLVVSGSWDQTVKLWDPTVGKSLCTFRGHESIIYSTIWSPHIPGCFASASDSGTFQSLTLFLKQWSIIQSLLVV

SEQ ID NO: 883639 - protein, 323 aa, Homo sapiens; identical to SEQ ID NO: 883636

SEQ ID NO: 883640 - protein, 122 aa, Homo sapiens; identical to SEQ ID NO: 883637

SEQ ID NO: 883641 - protein, 187 aa, Homo sapiens
MSAVCGGAARMLRTPGRHGYAAEFSPYLPGRLACATAQHYGIAGCGTLLILDPDEAGLRLFRSFDWNDGLFDVTWSENNEHVLITCSGDGSLQLWDTAKAAGPLQVYKEHAQEFSPFHASVLASCSYDFTVRFWNFSKPDSLLETVEHHTEFTCGLDFSLQSPTQVADCSWDETIKIYDPACLTIPA

SEQ ID NO: 883642 - protein, 296 aa, Homo sapiens
MLSPKDILRKDLKLVHGYPMTCAFASNWEKIEQFHSRPDDIVIATYPKSGTTWVSEIIDMILNDGDIEKCKRGFITEKVPMLEMTLPGLRTSGIEQLEKNPSPRIVKTHLPTDLLPKSFWENNCKMIYLARNAKDVSVSYYHFDLMNNLQPFPGTWEEYLEKFLTGKVAYGSWFTHVKNWWKKKEEHPILFLYYEDMKENPKEEIKKIIRFLEKNLNDEILDRIIHHTSFEVMKDNPLVNYTHLPTTVMDHSKSPFMRKGTAGDWKNYFTVAQNEKFDAIYETEMSKTALQFRTEI

SEQ ID NO: 883643 - protein, 296 aa, Homo sapiens; identical to SEQ ID NO: 883642

SEQ ID NO: 883644 - protein, 264 aa, Homo sapiens
MTKFSSFSLFFLIVGAYMTHVCFNMEIIGGKEVSPHSRPFMASIQYGGHHVCGGVLIDPQWVLTAAHCQYRFTKGQSPTVVLGAHSLSKNEASKQTLEIKKFIPFSRVTSDPQSNDIMLVKLQTAAKLNKHVKMLHIRSKTSLRSGTKCKVTGWGATDPDSLRPSDTLREVTVTVLSRKLCNSQSYYNGDPFITKDMVCAGDAKGQKDSCKGDSGGPLICKGVFHAIVSGGHECGVATKPGIYTLLTKKYQTWIKSNLVPPHTN

SEQ ID NO: 883645 - protein, 264 aa, Homo sapiens; identical to SEQ ID NO: 883644

SEQ ID NO: 883646 - protein, 219 aa, Homo sapiens
PSRPSPLPTGGFGNHSAAFIVFAFFRFTKGQSPTVVLGAHSLSKNEASKQTLEIKKFIPFSRVTSDPQSNDIMLVKLQTAAKLNKHVKMLHIRSKTSLRSGTKCKVTGWGATDPDSLRPSDTLREVTVTVLSRKLCNSQSYYNGDPFITKDMVCAGDAKGQKDSCKGDSGGPLICKGVFHAIVSGGHECGVATKPGIYTLLTKKYQTWIKSNLVPPHTN

SEQ ID NO: 883647 - protein, 119 aa, Homo sapiens
WNTRTKRLTLLSLKDKQGSCSCNRVDRGRSTLGLKWRSQPGKTGLDPEASSREGRQGCLKISHLSAQLLDSLSPSTLPELRTYSPGAQGSHSLHTRGIMDSGLLARVTAKRASLFSQAS

SEQ ID NO: 883648 - protein, 866 aa, Homo sapiens
MEEGNNNEEVIHLNNFHCHRGQEWINLRDGPITISDSSDEERIPMLVTPAPQQHEEEDLDDDVILTEDDSEDDYGEFLDLGPPGISEFTKPSGQTEREPKPGPSHNQAANDIVNPRSEQKVIILEEGSLLYTESDPLETQNQSSEDSETELLSNLGESAALADDQAIEEDCWLDHPYFQSLNQQPREITNQVVPQERQPEAELGRLLFQHEFPGPAFPRPEPQQGGISGPSSPQPAHPLGEFEDQQLASDDEEPGPAFPMQESQEPNLENIWGQEAAEVDQELVELLVKETEARFPDVANGFIEEIIHFKNYYDLNVLCNFLLENPDYPKREDRIIINPSSSLLASQDETKLPKIDFFDYSKLTPLDQRCFIQAADLLMADFKVLSSQDIKWALHELKGHYAITRKALSDAIKKWQELSPETSGKRKKRKQMNQYSYIDFKFEQGDIKIEKRMFFLENKRRHCRSYDRRALLPAVQQEQEFYEQKIKEMAEHEDFLLALQMNEEQYQKDGQLIECRCCYGEFPFEELTQCADAHLFCKECLIRYAQEAVFGSGKLELSCMEGSCTCSFPTSELEKVLPQTILYKYYERKAEEEVAAAYADELVRCPSCSFPALLDSDVKRFSCPNPHCRKETCRKCQGLWKEHNGLTCEELAEKDDIKYRTSIEEKMTAARIRKCHKCGTGLIKSEGCNRMSCRCGAQMCYLCRVSINGYDHFCQHPRSPGAPCQECSRCSLWTDPTEDDEKLIEEIQKEAEEEQKRKNGENTFKRIGPPLEKPVEKVQRVEALPRPVPQNLPQPQMPPYAFAHPPFPLPPVRPVFNNFPLNMGPIPAPYVPPLPNVRVNYDFGPIHMPLEHNLPMHFGPQPRHRF

SEQ ID NO: 883649 - protein, 923 aa, Homo sapiens
MEEGNNNEEVIHLNNFHCHRGQEWINLRDGPITISDSSDEERIPMLVTPAPQQHEEEDLDDDVILTETNKPQRSRPNLIKPAAQWQDLKRLGEERPKKSRAAFESDKSSYFSVCNNPLFDSGAQDDSEDDYGEFLDLGPPGISEFTKPSGQTEREPKPGPSHNQAANDIVNPRSEQKVIILEEGSLLYTESDPLETQNQSSEDSETELLSNLGESAALADDQAIEEDCWLDHPYFQSLNQQPREITNQVVPQERQPEAELGRLLFQHEFPGPAFPRPEPQQGGISGPSSPQPAHPLGEFEDQQLASDDEEPGPAFPMQESQEPNLENIWGQEAAEVDQELVELLVKETEARFPDVANGFIEEIIHFKNYYDLNVLCNFLLENPDYPKREDRIIINPSSSLLASQDETKLPKIDFFDYSKLTPLDQRCFIQAADLLMADFKVLSSQDIKWALHELKGHYAITRKALSDAIKKWQELSPETSGKRKKRKQMNQYSYIDFKFEQGDIKIEKRMFFLENKRRHCRSYDRRALLPAVQQEQEFYEQKIKEMAEHEDFLLALQMNEEQYQKDGQLIECRCCYGEFPFEELTQCADAHLFCKECLIRYAQEAVFGSGKLELSCMEGSCTCSFPTSELEKVLPQTILYKYYERKAEEEVAAAYADELVRCPSCSFPALLDSDVKRFSCPNPHCRKETCRKCQGLWKEHNGLTCEELAEKDDIKYRTSIEEKMTAARIRKCHKCGTGLIKSEGCNRMSCRCGAQMCYLCRVSINGYDHFCQHPRSPGAPCQECSRCSLWTDPTEDDEKLIEEIQKEAEEEQKRKNGENTFKRIGPPLEKPVEKVQRVEALPRPVPQNLPQPQMPPYAFAHPPFPLPPVRPVFNNFPLNMGPIPAPYVPPLPNVRVNYDFGPIHMPLEHNLPMHFGPQPRHRF

SEQ ID NO: 883650 - protein, 200 aa, Homo sapiens
MTAARIRKCHKCGTGLIKSEGCNRMSCRCGAQMCYLCRVSINGYDHFCQHPRSPGAPCQECSRCSLWTDPTEDDEKLIEEIQKEAEEEQKRKNGENTFKRIGPPLEKPVEKVQRVEALPRPVPQNLPQPQMPPYAFAHPPFPLPPVRPVFNNFPLNMGPIPAPYVPPLPNVRVNYDFGPIHMPLEHNLPMHFGPQPRHRF

SEQ ID NO: 883651 - protein, 209 aa, Homo sapiens
MFSYFSEEKMTAARIRKCHKCGTGLIKSEGCNRMSCRCGAQMCYLCRVSINGYDHFCQHPRSPGAPCQECSRCSLWTDPTEDDEKLIEEIQKEAEEEQKRKNGENTFKRIGPPLEKPVEKVQRVEALPRPVPQNLPQPQMPPYAFAHPPFPLPPVRPVFNNFPLNMGPIPAPYVPPLPNVRVNYDFGPIHMPLEHNLPMHFGPQPRHRF

SEQ ID NO: 883652 - protein, 54 aa, Homo sapiens
DIKIEKRMFFLENKRRHCRSYDRRALLPAVQQEQEFYEQKIKEMAEVGRCALVL

SEQ ID NO: 883653 - protein, 866 aa, Homo sapiens; identical to SEQ ID NO: 883648

SEQ ID NO: 883654 - protein, 866 aa, Homo sapiens; identical to SEQ ID NO: 883648

SEQ ID NO: 883655 - protein, 866 aa, Homo sapiens; identical to SEQ ID NO: 883648

SEQ ID NO: 883656 - protein, 79 aa, Homo sapiens
TLPLVLPCKCNVTPWLPVSWRLHGSCFCHQTNTRLSPGQSPSPFPLAAGALADEAALTGRCWGADPAGNMVRHLEDSAP

SEQ ID NO: 883657 - protein, 151 aa, Homo sapiens
MEGQRQESHATLTLAQAHFNNGEYAEAEALYSAYIRRCACAASSDESPGSKCSPEDLATAYNNRGQIKYFRVDFYEAMDDYTSAIEVQPNFEVPYYNRGLILYRLGYFDDALEDFKKVLDLNPGFQDATLSLKQTILDKEEKQRRNVAKNY

SEQ ID NO: 883658 - protein, 132 aa, Homo sapiens
MDVSEGTTMSSSHSYLISSRQCWNHSDRLISKCSPEDLATAYNNRGQIKYFRVDFYEAMDDYTSAIEVQPNFEVPYYNRGLILYRLGYFDDALEDFKKVLDLNPGFQDATLSLKQTILDKEEKQRRNVAKNY

SEQ ID NO: 883659 - protein, 118 aa, Homo sapiens
TRQRTEYYCRTDCTDFHAEKLINASPFSIRAGYSIIIPFKNVFYHMVTFSIIVDNPAFTIRAGESVRPKKINNITVSFEGNPSGSKTPITTKLTVSCPPGEGSETGVKWVYYLKGITL

SEQ ID NO: 883660 - protein, 132 aa, Homo sapiens
LFEPSHLGETKGILILSSLAGGEYIIPLFGMALPPKPQGPFSIRAGYSIIIPFKNVFYHMVTFSIIVDNPAFTIRAGESVRPKKINNITVSFEGNPSGSKTPITTKLTVSCPPGEGSETGVKWVYYLKGITL

SEQ ID NO: 883661 - protein, 280 aa, Homo sapiens
AGKAGSSWGQGLGRVDLLCLWGLCRGPEAVCPECRWSWQLPSCGPTGRAEHGRCPFLLGISWHRDVWLDLEHVEVVPAESTGHGSWECSGCGVVALAGGDLVAALGAEAPTAAWGAAGVGRGGFWEHFLPLYCIPNPGCLGRGGARGGARPAGGWASLDLKWRGLSAGPGCWSLGGPVSSPPFRSPPLCHRKGLTFVSVHDCYWTHAADVSVMNQVCREQFVRLHSEPILQDLSRFLVKRFCSEPQKILEASQLKETLQAVPKPGAFDLEQVKRSTYFFS

SEQ ID NO: 883662 - protein, 1122 aa, Homo sapiens [sequence omitted]

SEQ ID NO: 883663 - protein, 1270 aa, Homo sapiens
MSALCWGRGAAGLKRALRPCGRPGLPGKEGTAGGVCGPRRSSSASPQEQDQDRRKDWGHVELLEVLQARVRQLQAESVSEVVVNRVDVARLPECGSGDGSLQPPRKVQMGAKDATPVPCGRWAKILEKDKRTQQMRMQRLKAKLQMPFQSGEFKALTRRLQVEPRLLSKQMAGCLEDCTRQAPESPWEEQLARLLQEAPGKLSLDVEQAPSGQHSQAQLSGQQQRLLAFFKCCLLTDQLPLAHHLLVVHHGQRQKRKLLTLDMYNAVMLGWARQGAFKELVYVLFMVKDAGLTPDLLSYAAALQCMGRQDQDAGTIERCLEQMSQEGLKLQALFTAVLLSEEDRATVLKAVHKVKPTFSLPPQLPPPVNTSKLLRDVYAKDGRVSYPKLHLPLKTLQCLFEKQLHMELASRVCVVSVEKPTLPSKEVKHARKTLKTLRDQWEKALCRALRETKNRLEREVYEGRFSLYPFLCLLDEREVVRMLLQVLQALPAQGESFTTLARELSARTFSRHVVQRQRVSGQVQALQNHYRKYLCLLASDAEVPEPCLPRQYWEALGAPEALREQPWPLPVQMELGKLLAEMLVQATQMPCSLDKPHRSSRLVPVLYHVYSFRNVQQIGILKPHPAYVQLLEKAAEPTLTFEAVDVPMLCPPLPWTSPHSGAFLLSPTKLMRTVEGATQHQELLETCPPTALHGALDALTQLGNCAWRVNGRVLDLVLQLFQAKGCPQLGVPAPPSEAPQPPEAHLPHSAAPARKAELRRELAHCQKVAREMHSLRAEALYRLSLAQHLRDRVFWLPHNMDFRGRTYPCPPHFNHLGSDVARALLEFAQGRPLGPHGLDWLKIHLVNLTGLKKREPLRKRLAFAEEVMDDILDSADQPLTGRKWWMGAEEPWQTLACCMEVANAVRASDPAAYVSHLPVHQDGSCNGLQHYAALGRDSVGAASVNLEPSDVPQDVYSGVAAQVEVFRRQDAQRGMRVAQVLEGFITRKVVKQTVMTVVYGVTRYGGRLQIEKRLRELSDFPQEFVWEASHYLVRQVFKSLQEMFSGTRAIQHWLTESARLISHMGSVVEWVTPLGVPVIQPYRLDSKVKQIGGGIQSITYTHNGDISRKPNTRKQKNGFPPNFIHSLDSSHMMLTALHCYRKGLTFVSVHDCYWTHAADVSVMNQVPPYLSLSPPMGGAPTLGRWVGVVPRACLITPGDPLTPAQVCREQFVRLHSEPILQDLSRFLVKRFCSEPQKILEASQLKETLQAVPKPGAFDLEQVKRSTYFFS

SEQ ID NO: 883664 - protein, 1030 aa, Homo sapiens
VLPPQTECYLHNGDISRKPNTRKQRLLAFFKCCLLTDQLPLAHHLLVVHHGQRQKRKLLTLDMYNAVMLGWARQGAFKELVYVLFMVKDAGLTPDLLSYAAALQCMGRQDQDAGTIERCLEQMSQEGLKLQALFTAVLLSEEDRATVLKAVHKVKPTFSLPPQLPPPVNTSKLLRDVYAKDGRVSYPKLHLPLKTLQCLFEKQLHMELASRVCVVSVEKPTLPSKEVKHARKTLKTLRDQWEKALCRALRETKNRLEREVYEGRFSLYPFLCLLDEREVVRMLLQVLQALPAQGESFTTLARELSARTFSRHVVQRQRVSGQVQALQNHYRKYLCLLASDAEVPEPCLPRQYWEALGAPEALREQPWPLPVQMELGKLLAEMLVQATQMPCSLDKPHRSSRLVPVLYHVYSFRNVQQIGILKPHPAYVQLLEKAAEPTLTFEAVDVPMLCPPLPWTSPHSGAFLLSPTKLMRTVEGATQHQELLETCPPTALHGALDALTQLGNCAWRVNGRVLDLVLQLFQAKGCPQLGVPAPPSEAPQPPEAHLPHSAAPARKAELRRELAHCQKVAREMHSLRAEALYRLSLAQHLRDRVFWLPHNMDFRGRTYPCPPHFNHLGSDVARALLEFAQGRPLGPHGLDWLKIHLVNLTGLKKREPLRKRLAFAEEVMDDILDSADQPLTGRKWWMGAEEPWQTLACCMEVANAVRASDPAAYVSHLPVHQDGSCNGLQHYAALGRDSVGAASVNLEPSDVPQDVYSGVAAQVEVFRRQDAQRGMRVAQVLEGFITRKVVKQTVMTVVYGVTRYGGRLQIEKRLRELSDFPQEFVWEASHYLVRQVFKSLQEMFSGTRAIQHWLTESARLISHMGSVVEWVTPLGVPVIQPYRLDSKVKQIGGGIQSITYTHNGDISRKPNTRKQKNGFPPNFIHSLDSSHMMLTALHCYRKGLTFVSVHDCYWTHAADVSVMNQVCREQFVRLHSEPILQDLSRFLVKRFCSEPQKILEASQLKETLQAVPKPGAFDLEQVKRSTYFFS

SEQ ID NO: 883665 - protein, 965 aa, Homo sapiens
MGHIHTVLSLRRKQPTSGGAVNGLPRLCQLPASPPLPPPARCPVSLLEGSRPGGSRPLVCTAGTDFTRSPPFPASAIATSNLQETQKRVHPCCLGVLGGQVPSGKPPTSLPPSLQDGRVSYPKLHLPLKTLQCLFEKQLHMELASRVCVVSVEKPTLPSKEVKHARKTLKTLRDQWEKALCRALRETKNRLEREVYEGRFSLYPFLCLLDEREVVRMLLQVLQALPAQGESFTTLARELSARTFSRHVVQRQRVSGQVQALQNHYRKYLCLLASDAEVPEPCLPRQYWEALGAPEALREQPWPLPVQMELGKLLAEMLVQATQMPCSLDKPHRSSRLVPVLYHVYSFRNVQQIGILKPHPAYVQLLEKAAEPTLTFEAVDVPMLCPPLPWTSPHSGAFLLSPTKLMRTVEGATQHQELLETCPPTALHGALDALTQLGNCAWRVNGRVLDLVLQLFQAKGCPQLGVPAPPSEAPQPPEAHLPHSAAPARKAELRRELAHCQKVAREMHSLRAEALYRLSLAQHLRDRVFWLPHNMDFRGRTYPCPPHFNHLGSDVARALLEFAQGRPLGPHGLDWLKIHLVNLTGLKKREPLRKRLAFAEEVMDDILDSADQPLTGRKWWMGAEEPWQTLACCMEVANAVRASDPAAYVSHLPVHQDGSCNGLQHYAALGRDSVGAASVNLEPSDVPQDVYSGVAAQVEVFRRQDAQRGMRVAQVLEGFITRKVVKQTVMTVVYGVTRYGGRLQIEKRLRELSDFPQEFVWEASHYLVRQVFKSLQEMFSGTRAIQHWLTESARLISHMGSVVEWVTPLGVPVIQPYRLDSKVKQIGGGIQSITYTHNGDISRKPNTRKQKNGFPPNFIHSLDSSHMMLTALHCYRKGLTFVSVHDCYWTHAADVSVMNQVCREQFVRLHSEPILQDLSRFLVKRFCSEPQKILEASQLKETLQAVPKPGAFDLEQVKRSTYFFS

SEQ ID NO: 883666 - protein, 132 aa, Homo sapiens
AGKAGSSWGQGLGRVDLLCLWGLCRGPEAVCPECRWSWQLPSCGPTGRAEHGRCPFLLGISWHRDVWLDLEHVEVVPAESTGHGSWECSGCGVVALAGGDLVAALGAEAPTAAWGAAGVGRGGFWEHFLPLY

SEQ ID NO: 883667 - protein, 73 aa, Homo sapiens
PPTSLPPSLQDGRVSYPKLHLPLKTLQCLFEKQLHMELASRVCVVSVEKPTLPSKEVKHAVGAEPGSRVRRRG

SEQ ID NO: 883668 - protein, 1245 aa, Homo sapiens
MRRRGPVGWPGAACVMSALCWGRGAAGLKRALRPCGRPGLPGKEGTAGGVCGPRRSSSASPQEQDQDRRKDWGHVELLEVLQARVRQLQAESVSEVVVNRVDVARLPECGSGDGSLQPPRKVQMGAKDATPVPCGRWAKILEKDKRTQQMRMQRLKAKLQMPFQSGEFKALTRRLQVEPRLLSKQMAGCLEDCTRQAPESPWEEQLARLLQEAPGKLSLDVEQAPSGQHSQAQLSGQQQRLLAFFKCCLLTDQLPLAHHLLVVHHGQRQKRKLLTLDMYNAVMLGWARQGAFKELVYVLFMVKDAGLTPDLLSYAAALQCMGRQDQDAGTIERCLEQMSQEGLKLQALFTAVLLSEEDRATVLKAVHKVKPTFSLPPQLPPPVNTSKLLRDVYAKDGRVSYPKLHLPLKTLQCLFEKQLHMELASRVCVVSVEKPTLPSKEVKHARKTLKTLRDQWEKALCRALRETKNRLEREVYEGRFSLYPFLCLLDEREVVRMLLQVLQALPAQGESFTTLARELSARTFSRHVVQRQRVSGQVQALQNHYRKYLCLLASDAEVPEPCLPRQYWEALGAPEALREQPWPLPVQMELGKLLAEMLVQATQMPCSLDKPHRSSRLVPVLYHVYSFRNVQQIGILKPHPAYVQLLEKAAEPTLTFEAVDVPMLCPPLPWTSPHSGAFLLSPTKLMRTVEGATQHQELLETCPPTALHGALDALTQLGNCAWRVNGRVLDLVLQLFQAKGCPQLGVPAPPSEAPQPPEAHLPHSAAPARKAELRRELAHCQKVAREMHSLRAEALYRLSLAQHLRDRVFWLPHNMDFRGRTYPCPPHFNHLGSDVARALLEFAQGRPLGPHGLDWLKIHLVNLTGLKKREPLRKRLAFAEEVMDDILDSADQPLTGRKWWMGAEEPWQTLACCMEVANAVRASDPAAYVSHLPVHQDGSCNGLQHYAALGRDSVGAASVNLEPSDVPQDVYSGVAAQVEVFRRQDAQRGMRVAQVLEGFITRKVVKQTVMTVVYGVTRYGGRLQIEKRLRELSDFPQEFVWEASHYLVRQVFKSLQEMFSGTRAIQHWLTESARLISHMGSVVEWVTPLGVPVIQPYRLDSKVKQIGGGIQSITYTHNGDISRKPNTRKQKNGFPPNFIHSLDSSHMMLTALHCYRKGLTFVSVHDCYWTHAADVSVMNQVCREQFVRLHSEPILQDLSRFLVKRFCSEPQKILEASQLKETLQAVPKPGAFDLEQVKRSTYFFS

SEQ ID NO: 883669 - protein, 185 aa, Homo sapiens
TLMLSQQTPHDNCTQSENQLKDKRTQQMRMQRLKAKLQMPFQSGEFKALTRRLQVEPRLLSKQMAGCLEDCTRQAPESPWEEQLARLLQEAPGKLSLDVEQAPSGQHSQAQLSGQQQRLLAFFKCCLLTDQLPLAHHLLVVHHGQRQKRKLLTLDMYNAVMLGWARQVGRVRDRIGPASTRSHSR

SEQ ID NO: 883670 - protein, 1252 aa, Homo sapiens
MRRRGPVGWPGAACVMSALCWGRGAAGLKRALRPCGRPGLPGKEGTAGGVCGPRRSSSASPQEQDQDRRKDWGHVELLEVLQARVRQLQAESVSEVVVNRVDVARLPECGSGDGSLQPPRKVQMGAKDATPVPCGRWAKILEKDKRTQQMRMQRLKAKLQMPFQSGEFKALTRRLQVEPRLLSKQMAGCLEDCTRQAPESPWEEQLARLLQEAPGKLSLDVEQAPSGQHSQAQLSGQQQRLLAFFKCCLLTDQLPLAHHLLVVHHGQRQKRKLLTLDMYNAVMLGWARQGAFKELVYVLFMVKDAGLTPDLLSYAAALQCMGRQDQDAGTIERCLEQMSQEGLKLQALFTAVLLSEEDRATVLKAVHKVKPTFSLPPQLPPPVNTSKLLRDVYAKDGRVSYPKLHLPLKTLQCLFEKQLHMELASRVCVVSVEKPTLPSKEVKHARKTLKTLRDQWEKALCRALRETKNRLEREVYEGRFSLYPFLCLLDEREVVRMLLQVLQALPAQGESFTTLARELSARTFSRHVVQRQRVSGQVQALQNHYRKYLCLLASDAEVPEPCLPRQYWEALGAPEALREQPWPLPVQMELGKLLAEMLVQATQMPCSLDKPHRSSRLVPVLYHVYSFRNVQQIGILKPHPAYVQLLEKAAEPTLTFEAVDVPMLCPPLPWTSPHSGAFLLSPTKLMRTVEGATQHQELLETCPPTALHGALDALTQLGNCAWRVNGRVLDLVLQLFQAKGCPQLGVPAPPSEAPQPPEAHLPHSAAPARKAELRRELAHCQKVAREMHSLRAEALYRLSLAQHLRDRVFWLPHNMDFRGRTYPCPPHFNHLGSDVARALLEFAQGRPLGPHGLDWLKIHLVNLTGLKKREPLRKRLAFAEEVMDDILDSADQPLTGRKWWMGAEEPWQTLACCMEVANAVRASDPAAYVSHLPVHQDGSCNGLQHYAALGRDSVGAASVNLEPSDVPQDVYSGVAAQVEVFRRQDAQRGMRVAQVLEGFITRKVVKQTVMTVVYGVTRYGGRLQIEKRLRELSDFPQEFVWEASHYLVRQVFKSLQEMFSGTRAIQHWLTESARLISHMGSVVEWVTPLGVPVIQPYRLDSKVKQIGGGIQSITYTHNGDISRKPNTRKQKNGFPPNFIHSLDSSHMMLTALHCYRSPPLCHRKGLTFVSVHDCYWTHAADVSVMNQVCREQFVRLHSEPILQDLSRFLVKRFCSEPQKILEASQLKETLQAVPKPGAFDLEQVKRSTYFFS

SEQ ID NO: 883671 - protein, 1162 aa, Homo sapiens
MRRRGPVGWPGAACVMSALCWGRGAAGLKRALRPCGRPGLPGKEGTAGGVCGPRRSSSASPQEQDQDRRKDWGHVELLEVLQARVRQLQAESVSEVVVNRVDVARLPECGSGDGSLQPPRKVQMGAKDATPVPCGRWAKILEKDKRTQQMRMQRLKAKLQMPFQSGEFKALTRRLQVEPRLLSKQMAGCLEDCTRQAPESPWEEQLARLLQEAPGKLSLDVEQAPSGQHSQAQLSGQQQRLLAFFKCCLLTDQLPLAHHLLVVHHGQRQKRKLLTLDMYNAVMLGWARQGAFKELVYVLFMVKDAGLTPDLLSYAAALQCMGRQDQDAGTIERCLEQMSQEGLKLQALFTAVLLSEEDRATVLKAVHKVKPTFSLPPQLPPPVNTSKLLRDVYAKDGRVSYPKLHLPLKTLQCLFEKQLHMELASRVCVVSVEKPTLPSKEVKHARKTLKTLRDQWEKALCRALRETKNRLEREVYEGRFSLYPFLCLLDEREVVRMLLQVLQALPAQGESFTTLARELSARTFSRHVVQRQRVSGQVQALQNHYRKYLCLLASDAEVPEPCLPRQYWEALGAPEALREQPWPLPVQMELGKLLAEMLVQATQMPCSLDKPHRSSRLVPVLYHVYSFRNVQQIGILKPHPAYVQLLEKAAEPTLTFEAVDVPMLCPPLPWTSPHSGAFLLSPTKLMRTVEGATQHQELLETCPPTALHGALDALTQLGNCAWRVNGRVLDLVLQLFQAKGCPQLGVPAPPSEAPQPPEAHLPHSAAPARKAELRRELAHCQKVAREMHSLRAEALYRLSLAQHLRDRVFWLPHNMDFRGRTYPCPPHFNHLGSDVARALLEFAQGRPLGPHGLDWLKIHLVNLTGLKKREPLRKRLAFAEEVMDDILDSADQPLTGRKWWMGAEEPWQTLACCMEVANAVRASDPAAYVSHLPVHQDGSCNGLQHYAALGRDSVGAASVNLEPSDVPQDVYSGVAAQVEVFRRQDAQRGMRVAQVLEGFITRKVVKQTVMTVVYGVTRYGGRLQIEKRLRELSDFPQEFVWEASHYLVRQVFKSLQEMFSGTRAIQHWLTESARLISHMGSVVEWVTPLGVPVIQPYRLDSKVKQIGGGIQSITYTHNGDISRKPNTRKQKNGFPPNFIHSLDSSHMRPRGGLMRRGGLMRP

SEQ ID NO: 883672 - protein, 616 aa, Homo sapiens
MRRRGPVGWPGAACVMSALCWGRGAAGLKRALRPCGRPGLPGKEGTAGGVCGPRRSSSASPQEQDQDRRKDWGHVELLEVLQARVRQLQAESVSEVVVNRVDVARLPECGSGDGSLQPPRKVQMGAKDATPVPCGRWAKILEKDKRTQQMRMQRLKAKLQMPFQSGEFKALTRRLQVEPRLLSKQMAGCLEDCTRQAPESPWEEQLARLLQEAPGKLSLDVEQAPSGQHSQAQLSGQQQRLLAFFKCCLLTDQLPLAHHLLVVHHGQRQKRKLLTLDMYNAVMLGWARQGAFKELVYVLFMVKDAGLTPDLLSYAAALQCMGRQDQDAGTIERCLEQMSQEGLKLQALFTAVLLSEEDRATVLKAVHKVKPTFSLPPQLPPPVNTSKLLRDVYAKDGRVSYPKLHLPLKTLQCLFEKQLHMELASRVCVVSVEKPTLPSKEVKHARKTLKTLRDQWEKALCRALRETKNLPRARGQIGGGIQSITYTHNGDISRKPNTRKQKNGFPPNFIHSLDSSHMMLTALHCYRKGLTFVSVHDCYWTHAADVSVMNQVCREQFVRLHSEPILQDLSRFLVKRFCSEPQKILEASQLKETLQAVPKPGAFDLEQVKRSTYFFS

SEQ ID NO: 883673 - protein, 53 aa, Homo sapiens
MEAPAHTPGPAQPLSSFPQGPPVASAAPGGARPPAPRSKTKTAGRTGATWSCW

SEQ ID NO: 883674 - protein, 189 aa, Homo sapiens
ETPPSNLTLNPTSDTMTCCQTSFCGYPSFSISGTCGSSCCQPSCCETSCCQPRSCQTSFCGFPSFSTSGTCSSSCCQPSCCETSCCQPSCCETSCCQPSCCQISSCGTGCGIGGGISYGQEGSSGAVSTRIRWCRPDSRVEGTYLPPCCVVSCTPPSCCQLHHAQASCCRPSYCGQSCCRPVCCCEPTC

SEQ ID NO: 883675 - protein, 614 aa, Homo sapiens
CFFFQAKSPKEAEADLSFDSYHSTQTDLGPSLGKPGETSPPDSKSSPSVLIHSLGKSTTDNDVRIQQLQEILQDLQKRLESSEAERKQLQVELQSRRAELVCLNNTEISENSSDLSQKLKETQSKYEEAMKEVLSVQKQMKLGLVSPESMDNYSHFHELRVTEEEINVLKQDLQNALEESERNKEKVRELEEKLVEREKGTVIKPPVEEYEEMKSSYCSVIENMNKEKAFLFEKYQEAQEEIMKLKDTLKSQMTQEASDEAEDMKEAMNRMIDELNKQVSELSQLYKEAQAELEDYRKRKSLEDVTAEYIHKAEHEKLMQLTNVSRAKAEDALSEMKSQYSKVLNELTQLKQLVDAQKENSVSITEHLQVITTLRTAAKEMEEKISNLKEHLASKEVEVAKLEKQLLEEKAAMTDAMVPRSSYEKLQSSLESEVSVLASKLKESVKEKEKVHSEVVQIRSEVSQVKREKENIQTLLKSKEQEVNELLQKFQQAQEELAEMKRYAESSSKLEEDKDKKINEMSKEVTKLKEALNSLSQLSYSTSSSKRQSQQLEALQQQVKQLQNQLAECKKQHQEVISVYRMHLLYAVQGQMDEDVQKVLKQILTMCKNQSQKK

SEQ ID NO: 883676 - protein, 614 aa, Homo sapiens; identical to SEQ ID NO: 883675

SEQ ID NO: 883677 - protein, 614 aa, Homo sapiens; identical to SEQ ID NO: 883675

SEQ ID NO: 883678 - protein, 198 aa, Homo sapiens
MVPRSSYEKLQSSLESEVSVLASKLKESVKEKEKVHSEVVQIRSEVSQVKREKENIQTLLKSKEQEVNELLQKFQQAQEELAEMKRYAESSSKLEEDKDKKINEMSKEVTKLKEALNSLSQLSYSTSSSKRQSQQLEALQQQVKQLQNQLAECKKQHQEVISVYRMHLLYAVQGQMDEDVQKVLKQILTMCKNQSQKK

SEQ ID NO: 883679 - protein, 614 aa, Homo sapiens; identical to SEQ ID NO: 883675

SEQ ID NO: 883680 - protein, 614 aa, Homo sapiens; identical to SEQ ID NO: 883675

SEQ ID NO: 883681 - protein, 614 aa, Homo sapiens; identical to SEQ ID NO: 883675

SEQ ID NO: 883682 - protein, 45 aa, Homo sapiens
MSKEVTKLKEALNSLSQLSYSTSSSKRQSQQLEALQQQVKQLQNQ

SEQ ID NO: 883683 - protein, 92 aa, Homo sapiens
LEGARARVLEGGSQVAGPQQSLCDSLFRCFSSAKREKTEPGSWDWRSGKRSIGTTALGPGKTQTLQSQCLLQPAQGRDNLAPSISGRRGDPP

SEQ ID NO: 883684 - protein, 92 aa, Homo sapiens; identical to SEQ ID NO: 883683

SEQ ID NO: 883685 - protein, 92 aa, Homo sapiens; identical to SEQ ID NO: 883683

SEQ ID NO: 883686 - protein, 92 aa, Homo sapiens; identical to SEQ ID NO: 883683

SEQ ID NO: 883687 - protein, 92 aa, Homo sapiens; identical to SEQ ID NO: 883683

SEQ ID NO: 883688 - protein, 92 aa, Homo sapiens; identical to SEQ ID NO: 883683

SEQ ID NO: 883689 - protein, 218 aa, Homo sapiens
MNCRSEVLEVSVEGRQVEEAMLAVLHTVLLHRSTGKFHYKKEGTYSIGTVGTQDVDCDFIDFTYVRVSSEELDRALRKVVGEFKDALRNSGGDGLGQMSLEFYQKKKSRWPFSDECIPWEVWTVKVHVVALATEQERQICREKVGEKLCEKIINIVEVMNRHEYLPKMPTQSEVDNVFDTGLRDVQPYLYKISFQITDALGTSVTTTMRRLIKDTLAL

SEQ ID NO: 883690 - protein, 154 aa, Homo sapiens
DCLLLQLCHFLHLTPCAAPKDALRNSGGDGLGQMSLEFYQKKKSRWPFSDECIPWEVWTVKVHVVALATEQERQICREKVGEKLCEKIINIVEVMNRHEYLPKMPTQSEVDNVFDTGLRDVQPYLYKISFQITDALGTSVTTTMRRLIKDTLAL

SEQ ID NO: 883691 - protein, 218 aa, Homo sapiens; identical to SEQ ID NO: 883689

SEQ ID NO: 883692 - protein, 218 aa, Homo sapiens; identical to SEQ ID NO: 883689

SEQ ID NO: 883693 - protein, 230 aa, Homo sapiens
MNCRSEVLEVSVEGRQVEEAMLAVLHTVLLHRSTGKFHYKKEGTYSIGTVGTQDVDCDFIDFTYVRVSSEELDRALRKVVGEFKDALRNSGGDGLGQMSLEFYQKKKSRWPFSDECIPWEVWTVKVHVVALATEQERQICREKVGEKLCEKIINIVEVMNRHEYLPKMPTQSEVDNVFDTGLRDVQPYLYKISFQITDALGTSVTTTMRRLIKDTPHSVLSTSSVLRDPL

SEQ ID NO: 883694 - protein, 218 aa, Homo sapiens; identical to SEQ ID NO: 883689

SEQ ID NO: 883695 - protein, 218 aa, Homo sapiens; identical to SEQ ID NO: 883689

SEQ ID NO: 883696 - protein, 218 aa, Homo sapiens; identical to SEQ ID NO: 883689

SEQ ID NO: 883697 - protein, 218 aa, Homo sapiens; identical to SEQ ID NO: 883689

SEQ ID NO: 883698 - protein, 218 aa, Homo sapiens; identical to SEQ ID NO: 883689

SEQ ID NO: 883699 - protein, 116 aa, Homo sapiens
MKPPEDLSDALCEFDAVLADFASPFHERHFHYEEHLERMKRRSSASVSDSSGFSDSESADSLYRNSFSFSDEKLNSPTDSTPALLSATVTPQKAKLGDTKELEAFIADLDKTLASM

SEQ ID NO: 883700 - protein, 137 aa, Homo sapiens
MKPPAAQGSPAAAAAAAPALDSAAAEDLSDALCEFDAVLADFASPFHERHFHYEEHLERMKRRSSASVSDSSGFSDSESADSLYRNSFSFSDEKLNSPTDSTPALLSATVTPQKAKLGDTKELEAFIADLDKTLASM

SEQ ID NO: 883701 - protein, 126 aa, Homo sapiens
MALPAAPALDSAAAEDLSDALCEFDAVLADFASPFHERHFHYEEHLERMKRRSSASVSDSSGFSDSESADSLYRNSFSFSDEKLNSPTDSTPALLSATVTPQKAKLGDTKELEAFIADLDKTLASM

SEQ ID NO: 883702 - protein, 144 aa, Homo sapiens
MKPPAAQGSPAAAAAAAPALDSAAAEDLSDALCEFDAVLADFASPFHERHFHYEEHLERMKRRSSASVSDSSGFSDSESADSLYRNSFSFSDEKLNSPTDSTPALLSATVTPQKAKLGDTKELEAFIADLDKTLAIGNKSLGLL

SEQ ID NO: 883703 - protein, 116 aa, Homo sapiens
MAPGSPSSQDLPREGCGLSFLISKLRNGFLKLNAVGRVVAGPLTIITGKVAGGQVGSLAAHGCVTRQASLSSLSRLSQTGLPGPAPGLSAVSLLFSFPCLSPLSCNFADVEQVPVE

SEQ ID NO: 883704 - protein, 328 aa, Homo sapiens
MEIVWEVLFLLQANFIVCISAQQNSPKIHEGWWAYKEVVQGSFVPVPSFWGLVNSAWNLCSVGKRQSPVNIETSHMIFDPFLTPLRINTGGRKVSGTMYNTGRHVSLRLDKEHLVNISGGPMTYSHRLEEIRLHFGSEDSQGSEHLLNGQAFSGEVQLIHYNHELYTNVTEAAKSPNGLVVVSIFIKVSDSSNPFLNRMLNRDTITRITYKNDAYLLQGLNIEELYPETSSFITYDGSMTIPPCYETASWIIMNKPVYITRMQMHSLRLLSQNQPSQIFLSMSDNFRPVQPLNNRCIRTNINFSLQGKDCPNNRAQKLQYRVNEWLLK

SEQ ID NO: 883705 - protein, 328 aa, Homo sapiens; identical to SEQ ID NO: 883704

SEQ ID NO: 883706 - protein, 328 aa, Homo sapiens; identical to SEQ ID NO: 883704

SEQ ID NO: 883707 - protein, 231 aa, Homo sapiens
MYNTGRHVSLRLDKEHLVNISGGPMTYSHRLEEIRLHFGSEDSQGSEHLLNGQAFSGEVQLIHYNHELYTNVTEAAKSPNGLVVVSIFIKVSDSSNPFLNRMLNRDTITRITYKNDAYLLQGLNIEELYPETSSFITYDGSMTIPPCYETASWIIMNKPVYITRMQMHSLRLLSQNQPSQIFLSMSDNFRPVQPLNNRCIRTNINFSLQGKDCPNNRAQKLQYRVNEWLLK

SEQ ID NO: 883708 - protein, 159 aa, Homo sapiens
MEIVWEVLFLLQANFIVCISAQQNSPKIHEGWWAYKEVVQGSFVPVPSFWGLVNSAWNLCSVGKRQSPVNIETSHMIFDPFLTPLRINTGGRKVSGTMYNTGRHVSLRLDKEHLVNISGGPMTYSHRLEEIRLHFGSEDSQGSEHLLNGQAFSGEEKVC

SEQ ID NO: 883709 - protein, 405 aa, Homo sapiens [sequence omitted]

SEQ ID NO: 883710 - protein, 151 aa, Homo sapiens
MVTDLSREIFLKITWFGSDLLVFPLAAMLSVPGNFYHLVICHQPGGKGRVEGEFPDYLPCSVMLQPAPQDSGKSCGVDFEVKAFATDSTDAEEDKIPKKSSVRLLIRKVQHAPLEMGPQPRAEAAWQFFMSDKPLHLAVSLNKEVTTYHRY

SEQ ID NO: 883711 - protein, 405 aa, Homo sapiens [sequence omitted]

SEQ ID NO: 883712 - protein, 361 aa, Homo sapiens
ARNFWCRLTDLVMGKKVYVTLTCAFRYGQEDIDVIGLTFRRDLYFSRVQVYPPVGAASTPTKLQESLLKKLGSNTYPFLLTFPDYLPCSVMLQPAPQDSGKSCGVDFEVKAFATDSTDAEEDKIPKKSSVRLLIRKVQHAPLEMGPQPRAEAAWQFFMSDKPLHLAVSLNKEIYFHGEPIPVTVTVTNNTEKTVKKIKAFVEQVANVVLYSSDYYVKPVAMEEAQEKVPPNSTLTKTLTLLPLLANNRERRGIALDGKIKHEDTNLASSTIIKEGIDRTVLGILVSYQIKVKLTVSGFLGELTSSEVATEVPFRLMHPQPEDPAKESYQDANLVFEEFARHNLKDAGEAEEGKRDKNDIDE

SEQ ID NO: 883713 - protein, 225 aa, Homo sapiens
MAASGKTSKSEPNHVIFKKISRDKSVTIYLGNRDYIDHVSQVQPVDGVVLVDPDLVKGKKVYVTLTCAFRYGQEDIDVIGLTFRRDLYFSRVQVYPPVGAASTPTKLQESLLKKLGSNTYPFLLTFPDYLPCSVMLQPAPQDSGKSCGVDFEVKAFATDSTDAEEDKIPKKSSVRLLIRKVQHAPLEMGPQPRAEAAWQFFMSDKPLHLAVSLNKEFFHGGAIPF

SEQ ID NO: 883714 - protein, 474 aa, Homo sapiens
MSTSYGCFWRRGKCPENGWDESTLELFLHELAIMDSNNFLGNCGVGEREGRVASALVARRHYRFIHGIGRSGDISAVQPKAAGSSLLNKITNSLVLDIIKLAGVHTVANCFVVPMATGMSLTLCFLTLRHKRPKAKYIIWPRIDQKSCFKSMITAGFEPVVIENVLEGDELRTDLKAVEAKVQELGPDCILCIHSTTSCFAPRVPDRLEELAVICANYDIPHIVNNAYGVQSSKCMHLIQQGARVGRIDAFVQSLDKNFMVPVGGAIIAGFNDSFIQEISKMYPGRASASPSLDVLITLLSLGSNGYKKLLKERKEMFSYLSNQIKKLSEAYNERLLHTPHNPISLAMTLKTLDEHRDKAVTQLGSMLFTRQVSGARVVPLGSMQTVSGYTFRGFMSHTNNYPCAYLNAASAIGMKMQDVDLFIKRLDRCLKAVRKERSKESDDNYDKTEDVDIEEMALKLDNVLLDTYQDASS

SEQ ID NO: 883715 - protein, 474 aa, Homo sapiens; identical to SEQ ID NO: 883714

SEQ ID NO: 883716 - protein, 449 aa, Homo sapiens
MNRESFAAGERLVSPAYVRQGCEARRSHEHLIRLLLEKVIHGIGRSGDISAVQPKAAGSSLLNKITNSLVLDIIKLAGVHTVANCFVVPMATGMSLTLCFLTLRHKRPKAKYIIWPRIDQKSCFKSMITAGFEPVVIENVLEGDELRTDLKAVEAKVQELGPDCILCIHSTTSCFAPRVPDRLEELAVICANYDIPHIVNNAYGVQSSKCMHLIQQGARVGRIDAFVQSLDKNFMVPVGGAIIAGFNDSFIQEISKMYPGRASASPSLDVLITLLSLGSNGYKKLLKERKEMFSYLSNQIKKLSEAYNERLLHTPHNPISLAMTLKTLDEHRDKAVTQLGSMLFTRQVSGARVVPLGSMQTVSGYTFRGFMSHTNNYPCAYLNAASAIGMKMQDVDLFIKRLDRCLKAVRKERSKESDDNYDKTEDVDIEEMALKLDNVLLDTYQDASS

SEQ ID NO: 883717 - protein, 377 aa, Homo sapiens
MSTSYGCFWRRGKCPENGWDESTLELFLHELAIMDSNNFLGNCGVGEREGRVASALVARRHYRFIHGIGRSGDISAVQPKAAGSSLLNKITNSLVLDIIKLAGVHTVANCFVVPMATGMSLTLCFLTLRHKRPKAKYIIWPRIDQKSCFKSMITAGFEPVVIENVLEGDELRTDLKAVEAKVQELGPDCILCIHSTTSCFAPRVPDRLEELAVICANYDIPHIVNNAYGVQSSKCMHLIQQGARVGRIDAFVQSLDKNFMVPVGGAIIAGFNDSFIQEISKMYPGRASASPSLDVLITLLSLGSNGYKKLLKERKEMFSYLSNQIKKLSEAYNERLLHTPHNPISLAMTLKTLDEHRDKAVTQLGSMLFTRQVSGAR

SEQ ID NO: 883718 - protein, 207 aa, Homo sapiens
MSTSYGCFWRRGKCPENGWDESTLELFLHELAIMDSNNFLGNCGVGEREGRVASALVARRHYRFIHGIGRSGDISAVQPKAAGSSLLNKITNSLVLDIIKLAGVHTVANCFVVPMATGMSLTLCFLTLRHKRPKAKYIIWPRIDQKSCFKSMITAGFEPVVIENVLEGDELRTDLKAVEAKVQELGPDCILCIHSTTSCFAPRVPDR

SEQ ID NO: 883719 - protein, 312 aa, Homo sapiens
MSPQGPAVLSLGSLCLDTNQAPNWTGLQTLLQQLPPQDIDERYCLALGEEERAELQLFCARRKQEALGQGVARLVLPKLEGHTCEKCRELLKPGEYGVFAARAGEQRCWHQPCFACQACGQALINLIYFYHDGQLYCGRHHAELLRPRCPACDQLIFSWRCTEAEGQRWHENHFCCQDCAGPLGGGRYALPGGSPCCPSCFENRYSDAGSSWAGALEGQAFLGAPPPHPPDPSLGARSSHRASLAGAFQGPPEPTPRRGRGCGARLPPRRGRRTPSGGGGGPWRGLSAAAAARTAQGLGGAGGWASPPLAAV

SEQ ID NO: 883720 - protein, 80 aa, Homo sapiens
YTFDSFCPEHGGNRKSSGQPCIFSQPPDNVGDWLRGVYRFATDRNDFRRNLILNLGLFAAGVWLARNLSDIDLMAPQPGV

SEQ ID NO: 883721 - protein, 352 aa, Homo sapiens
MSVQNSGWPHQEDSPKPQDPGPPANSDSDSGHLPGEDPEDTHAQGPAVLSLGSLCLDTNQAPNWTGLQTLLQQLPPQDIDERYCLALGEEERAELQLFCARRKQEALGQGVARLVLPKLEGHTCEKCRELLKPGEYGVFAARAGEQRCWHQPCFACQACGQALINLIYFYHDGQLYCGRHHAELLRPRCPACDQLIFSWRCTEAEGQRWHENHFCCQDCAGPLGGGRYALPGGSPCCPSCFENRYSDAGSSWAGALEGQAFLGAPPPHPPDPSLGARSSHRASLAGAFQGPPEPTPRRGRGCGARLPPRRGRRTPSGGGGGPWRGLSAAAAARTAQGLGGAGGWASPPLAAV

SEQ ID NO: 883722 - protein, 312 aa, Homo sapiens; identical to SEQ ID NO: 883719

SEQ ID NO: 883723 - protein, 160 aa, Homo sapiens
LGTRLGVNRPRVAAPALPACDQLIFSWRCTEAEGQRWHENHFCCQDCAGPLGGGRYALPGGSPCCPSCFENRYSDAGSSWAGALEGQAFLGETGLDRTEGRDQTSVNSATLSRTLLCCCRRFQPANSEGAAWIQSPAGEPTWGQSGGTQRAGAMPPGDYS

SEQ ID NO: 883724 - protein, 352 aa, Homo sapiens; identical to SEQ ID NO: 883721

SEQ ID NO: 883725 - protein, 352 aa, Homo sapiens; identical to SEQ ID NO: 883721

SEQ ID NO: 883726 - protein, 352 aa, Homo sapiens; identical to SEQ ID NO: 883721

SEQ ID NO: 883727 - protein, 352 aa, Homo sapiens; identical to SEQ ID NO: 883721

SEQ ID NO: 883728 - protein, 352 aa, Homo sapiens; identical to SEQ ID NO: 883721

SEQ ID NO: 883729 - protein, 352 aa, Homo sapiens; identical to SEQ ID NO: 883721

SEQ ID NO: 883730 - protein, 352 aa, Homo sapiens; identical to SEQ ID NO: 883721

SEQ ID NO: 883731 - protein, 352 aa, Homo sapiens; identical to SEQ ID NO: 883721

SEQ ID NO: 883732 - protein, 352 aa, Homo sapiens; identical to SEQ ID NO: 883721

SEQ ID NO: 883733 - protein, 342 aa, Homo sapiens
MTFLVGQGETEVAFLSSFPFPFPLLCHYLWHLPEVLQPFSDPAAKPFFLQPMLNVFCWSSPSNCRGLFLQERYCLALGEEERAELQLFCARRKQEALGQGVARLVLPKLEGHTCEKCRELLKPGEYGVFAARAGEQRCWHQPCFACQACGQALINLIYFYHDGQLYCGRHHAELLRPRCPACDQLIFSWRCTEAEGQRWHENHFCCQDCAGPLGGGRYALPGGSPCCPSCFENRYSDAGSSWAGALEGQAFLGAPPPHPPDPSLGARSSHRASLAGAFQGPPEPTPRRGRGCGARLPPRRGRRTPSGGGGGPWRGLSAAAAARTAQGLGGAGGWASPPLAAV

SEQ ID NO: 883734 - protein, 352 aa, Homo sapiens; identical to SEQ ID NO: 883721

SEQ ID NO: 883735 - protein, 68 aa, Homo sapiens
PHLCDWIGTHYLNEQVKAIKELGDHVTNLRKMGAPESGLAEYLFDKHTLGDSDNESYSRGANFPIAVG

SEQ ID NO: 883736 - protein, 352 aa, Homo sapiens; identical to SEQ ID NO: 883721

SEQ ID NO: 883737 - protein, 352 aa, Homo sapiens; identical to SEQ ID NO: 883721

SEQ ID NO: 883738 - protein, 352 aa, Homo sapiens; identical to SEQ ID NO: 883721

SEQ ID NO: 883739 - protein, 352 aa, Homo sapiens; identical to SEQ ID NO: 883721

SEQ ID NO: 883740 - protein, 352 aa, Homo sapiens; identical to SEQ ID NO: 883721

SEQ ID NO: 883741 - protein, 352 aa, Homo sapiens; identical to SEQ ID NO: 883721

SEQ ID NO: 883742 - protein, 578 aa, Homo sapiens
SPVESCPARSRLSVSVSPPPPGIVELGPPFAWEFCSRLGSAVTSQRAGPAAAMVAKDYPFYLTVKRANCSLELPPASGPAKDAEEPSNKRVKPLSRVTSLANLIPPVKATPLKRFSQTLQRSISFRSESRPDILAPRPWSRNAAPSSTKRRDSKLWSETFDVCVNQMLTSKEIKRQEAIFELSQGEEDLIEDLKLAKKAYHDPMLKLSIMTEQELNQIFGTLDSLIPLHEELLSQLRDVRKPDGSTEHVGPILVGWLPCLSSYDSYCSNQVAAKALLDHKKQDHRVQDFLQRCLESPFSRKLDLWNFLDIPRSRLVKYPLLLREILRHTPNDNPDQQHLEEAINIIQGIVAEINTKTGESECRYYKERLLYLEEGQKDSLIDSSRVLCCHGELKNNRGVKLHVFLFQEVLVITRAVTHNEQLCYQLYRQPIPVKDLLLEDLQDGEVRLGGSLRGAFSNNERIKNFFRVSFKNGSQSQTHSLQANDTFNKQQWLNCIRQAKETVLCAAGQAGVLDSEGSFLNPTTGSRELQGETKLEQMDQSDSESDCSMDTSEVSLDCERMEQTDSSCGNSRHGESNV

SEQ ID NO: 883743 - protein, 242 aa, Homo sapiens
MDSSTAMNQCSCRGMEENKERPKRQRQNNFPMFPSPKAWNFRGRKRKQSTQDEDAVSLCSLDISEPSNKRVKPLSRVTSLANLIPPVKATPLKRFSQTLQRSISFRSESRPDILAPRPWSRNAAPSSTKRRDSKLWSETFDVCVNQMLTSKEIKRQEAIFELSQGEEDLIEDLKLAKKAYHDPMLKLSIMTEQELNQIFGTLDSLIPLHEELLSQLRDVRKPDGSTEHVGPILVGWVRKFSG

SEQ ID NO: 883744 - protein, 150 aa, Homo sapiens
SPVESCPARSRLSVSVSPPPPGIVELGPPFAWEFCSRLGSAVTSQRAGPAAAMVAKDYPFYLTVKRANCSLELPPASGPAKDAEVGPRPAPGPLWVICLSRLPPSPILGARPVSLSLFPSLTLRVCHFLSLHLSHSLLCVSPSPSLTLSP

SEQ ID NO: 883745 - protein, 547 aa, Homo sapiens
MNSWLISVLSLGQKTHEARIGYLQRGAELRPHRKRKQSTQDEDAVSLCSLDISEPSNKRVKPLSRVTSLANLIPPVKATPLKRFSQTLQRSISFRSESRPDILAPRPWSRNAAPSSTKRRDSKLWSETFDVCVNQMLTSKEIKRQEAIFELSQGEEDLIEDLKLAKKAYHDPMLKLSIMTEQELNQIFGTLDSLIPLHEELLSQLRDVRKPDGSTEHVGPILVGWLPCLSSYDSYCSNQVAAKALLDHKKQDHRVQDFLQRCLESPFSRKLDLWNFLDIPRSRLVKYPLLLREILRHTPNDNPDQQHLEEAINIIQGIVAEINTKTGESECRYYKERLLYLEEGQKDSLIDSSRVLCCHGELKNNRGVKLHVFLFQEVLVITRAVTHNEQLCYQLYRQPIPVKDLLLEDLQDGEVRLGGSLRGAFSNNERIKNFFRVSFKNGSQSQTHSLQANDTFNKQQWLNCIRQAKETVLCAAGQAGVLDSEGSFLNPTTGSRELQGETKLEQMDQSDSESDCSMDTSEVSLDCERMEQTDSSCGNSRHGESNV

SEQ ID NO: 883746 - protein, 527 aa, Homo sapiens
MFPSPKAWNFRGRKRKQSTQDEDAVSLCSLDISEPSNKRVKPLSRVTSLANLIPPVKATPLKRFSQTLQRSISFRSESRPDILAPRPWSRNAAPSSTKRRDSKLWSETFDVCVNQMLTSKEIKRQEAIFELSQGEEDLIEDLKLAKKAYHDPMLKLSIMTEQELNQIFGTLDSLIPLHEELLSQLRDVRKPDGSTEHVGPILVGWLPCLSSYDSYCSNQVAAKALLDHKKQDHRVQDFLQRCLESPFSRKLDLWNFLDIPRSRLVKYPLLLREILRHTPNDNPDQQHLEEAINIIQGIVAEINTKTGESECRYYKERLLYLEEGQKDSLIDSSRVLCCHGELKNNRGVKLHVFLFQEVLVITRAVTHNEQLCYQLYRQPIPVKDLLLEDLQDGEVRLGGSLRGAFSNNERIKNFFRVSFKNGSQSQTHSLQANDTFNKQQWLNCIRQAKETVLCAAGQAGVLDSEGSFLNPTTGSRELQGETKLEQMDQSDSESDCSMDTSEVSLDCERMEQTDSSCGNSRHGESNV

SEQ ID NO: 883747 - protein, 558 aa, Homo sapiens
MDSSTAMNQCSCRGMEENKERPKRQRQNNFPMFPSPKAWNFRGRKRKQSTQDEDAVSLCSLDISEPSNKRVKPLSRVTSLANLIPPVKATPLKRFSQTLQRSISFRSESRPDILAPRPWSRNAAPSSTKRRDSKLWSETFDVCVNQMLTSKEIKRQEAIFELSQGEEDLIEDLKLAKKAYHDPMLKLSIMTEQELNQIFGTLDSLIPLHEELLSQLRDVRKPDGSTEHVGPILVGWLPCLSSYDSYCSNQVAAKALLDHKKQDHRVQDFLQRCLESPFSRKLDLWNFLDIPRSRLVKYPLLLREILRHTPNDNPDQQHLEEAINIIQGIVAEINTKTGESECRYYKERLLYLEEGQKDSLIDSSRVLCCHGELKNNRGVKLHVFLFQEVLVITRAVTHNEQLCYQLYRQPIPVKDLLLEDLQDGEVRLGGSLRGAFSNNERIKNFFRVSFKNGSQSQTHSLQANDTFNKQQWLNCIRQAKETVLCAAGQAGVLDSEGSFLNPTTGSRELQGETKLEQMDQSDSESDCSMDTSEVSLDCERMEQTDSSCGNSRHGESNV

SEQ ID NO: 883748 - protein, 412 aa, Homo sapiens
MLTSKEIKRQEAIFELSQGEEDLIEDLKLAKKAYHDPMLKLSIMTEQELNQIFGTLDSLIPLHEELLSQLRDVRKPDGSTEHVGPILVGWLPCLSSYDSYCSNQVAAKALLDHKKQDHRVQDFLQRCLESPFSRKLDLWNFLDIPRSRLVKYPLLLREILRHTPNDNPDQQHLEEAINIIQGIVAEINTKTGESECRYYKERLLYLEEGQKDSLIDSSRVLCCHGELKNNRGVKLHVFLFQEVLVITRAVTHNEQLCYQLYRQPIPVKDLLLEDLQDGEVRLGGSLRGAFSNNERIKNFFRVSFKNGSQSQTHSLQANDTFNKQQWLNCIRQAKETVLCAAGQAGVLDSEGSFLNPTTGSRELQGETKLEQMDQSDSESDCSMDTSEVSLDCERMEQTDSSCGNSRHGESNV

SEQ ID NO: 883749 - protein, 572 aa, Homo sapiens
RRNPSGELRVSEGPKRMGLALPCALDETMFDRNIWPKRQRQNNFPMFPSPKAWNFRGRKRKQSTQDEDAVSLCSLDISEPSNKRVKPLSRVTSLANLIPPVKATPLKRFSQTLQRSISFRSESRPDILAPRPWSRNAAPSSTKRRDSKLWSETFDVCVNQMLTSKEIKRQEAIFELSQGEEDLIEDLKLAKKAYHDPMLKLSIMTEQELNQIFGTLDSLIPLHEELLSQLRDVRKPDGSTEHVGPILVGWLPCLSSYDSYCSNQVAAKALLDHKKQDHRVQDFLQRCLESPFSRKLDLWNFLDIPRSRLVKYPLLLREILRHTPNDNPDQQHLEEAINIIQGIVAEINTKTGESECRYYKERLLYLEEGQKDSLIDSSRVLCCHGELKNNRGVKLHVFLFQEVLVITRAVTHNEQLCYQLYRQPIPVKDLLLEDLQDGEVRLGGSLRGAFSNNERIKNFFRVSFKNGSQSQTHSLQANDTFNKQQWLNCIRQAKETVLCAAGQAGVLDSEGSFLNPTTGSRELQGETKLEQMDQSDSESDCSMDTSEVSLDCERMEQTDSSCGNSRHGESNV

SEQ ID NO: 883750 - protein, 578 aa, Homo sapiens; identical to SEQ ID NO: 883742

SEQ ID NO: 883751 - protein, 578 aa, Homo sapiens; identical to SEQ ID NO: 883742

SEQ ID NO: 883752 - protein, 234 aa, Homo sapiens
MNSWLISVLSLGQKTHEARIGYLQRGAELRPHRKRKQSTQDEDAVSLCSLDISEPSNKRVKPLSRVTSLANLIPPVKATPLKRFSQTLQRSISFRSESRPDILAPRPWSRNAAPSSTKRRDSKLWSETFDVCVNQMLTSKEIKRQEAIFELSQGEEDLIEDLKLAKKAYHDPMLKLSIMTEQELNQIFGTLDSLIPLHEELLSQLRDVRKPDGSTEHVGPILVGWERARVHGSK

SEQ ID NO: 883753 - protein, 113 aa, Homo sapiens
KFKSSSHLSQVTFFFLSNFTTLKWCFVRTVFMTKTGLLPHTKQWGKCFKTRGQNSSPDLAPLGVYLCMSLMHVKEYFSLNQKVSMEASPYVYFIVLEVSYVGLFAHRRECVHV

SEQ ID NO: 883754 - protein, 109 aa, Homo sapiens
GGGASLGAQTWRSDSEVRLQLAHHLRPGPDEPPVASAGAAAASRGACGPSHSRHCLPAGLEPSERPNPRPGRDLRGMTAEPPKGGEGFRHAGHSILSQPGDETPPWGRP

SEQ ID NO: 883755 - protein, 74 aa, Homo sapiens
AGAGPAWGPRRGAATRRFASSLRIICGRVPMSLLLPPLALLLLLAALVAPATAATAYRPDWNRLSGLTRARVEA

SEQ ID NO: 883756 - protein, 104 aa, Homo sapiens
MLFPSVRLRKPPPPLPTTPLLNTTSSHNLVMKHLPGADPELVLLGRRYEELERIPLSEMTREEINALVQELGFYRKAAPDAQVPPEYVWAPAKPPEETSDHADL

SEQ ID NO: 883757 - protein, 109 aa, Homo sapiens; identical to SEQ ID NO: 883754

SEQ ID NO: 883758 - protein, 89 aa, Homo sapiens
MRRRPTPTSGVVCCGRRRALHDGVGVDRCTQGRRRAARSKINSSVMGEDKTSGDADREARHSSLSWWGESTEVDTEHTARQRPHQDASN

SEQ ID NO: 883759 - protein, 74 aa, Homo sapiens
AGAGPAWGPRRGAATRRFASSLRIICGRVPMSLLLPPLALLLLLAALVAPATAATAYRPDWNRLSGLTRARVEG

SEQ ID NO: 883760 - protein, 110 aa, Homo sapiens
LLRIPHLAHDGRGQLNRLKEVKAFVTQDIPFYHNLVMKHLPGADPELVLLGRRYEELERIPLSEMTREEINALVQELGFYRKAAPDAQVPPEYVWAPAKPPEETSDHADL

SEQ ID NO: 883761 - protein, 280 aa, Homo sapiens
MNDRSSRRRTMKDDETFEISIPFDEAPHLDPQIFYSLSPSRRNFEEPPEAASSALALMNSVKTQLHMALERNSWLQKRIEDLEEERDFLRCQLDKFISSARMEAEDHCRMKPGPRRMEGDSRGGAGGEASDPESAASSLSGASEEGSASERRRQKQKGGASRRRFGKPKARERQRVKDADGVLCRYKKILGTFQKLKSMSRAFEHHRVDRNTVALTTPIAELLIVAPEKLAEVGEFDPSKERLLEYSRRCFLALDDETLKKVQALKKSKLLLPITYRFKR

SEQ ID NO: 883762 - protein, 280 aa, Homo sapiens; identical to SEQ ID NO: 883761

SEQ ID NO: 883763 - protein, 280 aa, Homo sapiens; identical to SEQ ID NO: 883761

SEQ ID NO: 883764 - protein, 280 aa, Homo sapiens; identical to SEQ ID NO: 883761

SEQ ID NO: 883765 - protein, 172 aa, Homo sapiens
MNDRSSRRRTMKDDETFEISIPFDEAPHLDPQIFYSLSPSRRNFEEPPEAASSALALMNSVKTQLHMALERNSWLQKRIEDLEEERDFLRCQLDKFISSARMEAETLRMKLASGEGNLVVLGSPPDKLSKKPKEAERGTGVSLTTKRKRDPKKSQNWSTESPDKRNNIKKTT

SEQ ID NO: 883766 - protein, 280 aa, Homo sapiens; identical to SEQ ID NO: 883761

SEQ ID NO: 883767 - protein, 280 aa, Homo sapiens; identical to SEQ ID NO: 883761

SEQ ID NO: 883768 - protein, 280 aa, Homo sapiens; identical to SEQ ID NO: 883761

SEQ ID NO: 883769 - protein, 106 aa, Homo sapiens
MQTLCFCRKRRASPGPGDSSTRGASLARLGESPRPCPFRRSVPRHAPLPPRLFAGGWALPSAPRDTLQTLPGAGHGRRRRRSPSRIPRAVPLRPSAAGVRRKPRHE

SEQ ID NO: 883770 - protein, 144 aa, Homo sapiens
MAASKVKQDMPPPGGYGPIDYKRNLPRRGLSGYSMLAIGIGTLIYGHWSIMKWNRERRRLQIEDFEARIALLPLLQAETDRRTLQMLRENLEEEAIIMKDVPDWKVGESVFHTTRWVPPLIGELYGLRTTEEALHASHGFMWYT

SEQ ID NO: 883771 - protein, 273 aa, Homo sapiens
PPSTDALKRRWRWRQRPAPGLTSAMSSAAGPDPSEAPEERHFLSTAEAAALERELLEDYRFGRQQLVELCGHASAVAVTKAFPLPALSRKQRTVLVVCGPEQNGAVGLVCARHLRVFEYEPTIFYPTRSLDLLHRDLTTQCEKMDIPFLSYLPTEVQLINEAYGLVVDAVLGPGVEPGEVGGPCTRALATLKLLSIPLVSLDIPSGWDAETGSDSEDGLRPDVLVSLAAPKRCAGRFSGRHHFVAGRFVPDDVRRKFALRLPGYTGTDCVAAL

SEQ ID NO: 883772 - protein, 80 aa, Homo sapiens
RDERLQKCLLNTVPGLEIKRIYNFPRRIRHEAIIMKDVPDWVGESVFHTTRWVPPLIGELYGLRTTEEALHASHGFMWYT

SEQ ID NO: 883773 - protein, 109 aa, Homo sapiens
MCQREKAGSDGGGEVGVGQQDSGAEGRPPSQFPIPPDPPPSGWDAETGSDSEDGLRPDVLVSLAAPKRCAGRFSGRHHFVAGRFVPDDVRRKFALRLPGYTGTDCVAAL

SEQ ID NO: 883774 - protein, 227 aa, Homo sapiens
MQEPRRVTPCLGKRGVKTPQLQPGSAFLPRVRRQSFPARSDSYTTVRDFLAVPRTISSASATLIMAVAVSHFRPGPEVWDTASMAASKVKQDMPPPGGYGPIDYKRNLPRRGLSGYSMLAIGIGTLIYGHWSIMKWNRERRRLQIEDFEARIALLPLLQAETDRRTLQMLRENLEEEAIIMKDVPDWKVGESVFHTTRWVPPLIGELYGLRTTEEALHASHGFMWYT

SEQ ID NO: 883775 - protein, 227 aa, Homo sapiens; identical to SEQ ID NO: 883774

SEQ ID NO: 883776 - protein, 279 aa, Homo sapiens
MQEPRRVTPCLGKRGVKTPQLQPGSAFLPRVRRQSFPARSDSYTTVRDFLAVPRTISSASATLIMAVAVSHFRPGPEVWDTASMAASKVKQDMPPPGGYGPIDYKRNLPRRGLSENPWHGGRGVTVQAASLLRSRQCPLIAEWAAPGAVEEGVWGRAGPLSSAFFTGYSMLAIGIGTLIYGHWSIMKWNRERRRLQIEDFEARIALLPLLQAETDRRTLQMLRENLEEEAIIMKDVPDWKVGESVFHTTRWVPPLIGELYGLRTTEEALHASHGFMWYT

SEQ ID NO: 883777 - protein, 279 aa, Homo sapiens; identical to SEQ ID NO: 883776

SEQ ID NO: 883778 - protein, 583 aa, Homo sapiens
MQEPRRVTPCLGKRGVKTPQLQPGSAFLPRVRRQSFPARSDSYTTVRDFLAVPRTISSASATLIMAVAVSHFRPGPEVWDTASMAASKVKQDMPPPGGYGPIDYKRNLPRRGLSGYSMLAIGIGTLIYGHWSIMKWNRERRRLQIEDFEARIALLPLLQAETDRRYTAGAKVGRSLAGRPQAAGPDLHPRRWPECTWGPSPCAVSCILRRGDLVETQGGEPEGFLEEEAALGLGQEKSKELAGGKGDRVGGRLEGVLLGALRQGPLRALRPHPHHRPHPHRTLQMLRENLEEEAIIMKDVPDWKGLELQPPLADMGRAELSSNATTSLVQRRKQAWGRQSWLEQIWNAGPVCQSTAEAAALERELLEDYRFGRQQLVELCGHASAVAVTKAFPLPALSRKQRTVLVVCGPEQNGAVGLVCARHLRVFEYEPTIFYPTRSLDLLHRDLTTQCEKMDIPFLSYLPTEVQLINEAYGLVVDAVLGPGVEPGEVGGPCTRALATLKLLSIPLVSLDIPSGWDAETGSDSEDGLRPDVLVSLAAPKRCAGRFSGRHHFVAGRFVPDDVRRKFALRLPGYTGTDCVAAL

SEQ ID NO: 883779 - protein, 269 aa, Homo sapiens
MGRAELSSNATTSLVQRRKQAWGRQSWLEQIWNAGPVCQSTAEAAALERELLEDYRFGRQQLVELCGHASAVAVTKAFPLPALSRKQRTVLVVCGPEQNGAVGLVCARHLRVFEYEPTIFYPTRSLDLLHRDLTTQCEKMDIPFLSYLPTEVQLINEAYGLVVDAVLGPGVEPGEVGGPCTRALATLKLLSIPLVSLDIPSGWDAETGSDSEDGLRPDVLVSLAAPKRCAGRFSGRHHFVAGRFVPDDVRRKFALRLPGYTGTDCVAAL

SEQ ID NO: 883780 - protein, 141 aa, Homo sapiens
MQEPRRVTPCLGKRGVKTPQLQPGSAFLPRVRRQSFPARSDSYTTVRDFLAVPRTISSASATLIMAVAVSHFRPGPEVWDTASMAASKVKQDMPPPGGYGPIDYKRNLPRRGLSGYSMLAIGIGTLIYGHWSIMKWNRERR

SEQ ID NO: 883781 - protein, 227 aa, Homo sapiens; identical to SEQ ID NO: 883774

SEQ ID NO: 883782 - protein, 162 aa, Homo sapiens
FSLAKKSMETGCVPSAVPHRQAKEFMSSWTDKSPSGLASCRIQHVQLINEAYGLVVDAVLGPGVEPGEVGGPCTRALATLKLLSIPLVSLDIPSGWDAETGSDSEDGLRPDVLVSLAAPKRCAGRFSGRHHFVAGRFVPDDVRRKFALRLPGYTGTDCVAAL

SEQ ID NO: 883783 - protein, 227 aa, Homo sapiens; identical to SEQ ID NO: 883774

SEQ ID NO: 883784 - protein, 227 aa, Homo sapiens; identical to SEQ ID NO: 883774

SEQ ID NO: 883785 - protein, 227 aa, Homo sapiens; identical to SEQ ID NO: 883774

SEQ ID NO: 883786 - protein, 227 aa, Homo sapiens; identical to SEQ ID NO: 883774

SEQ ID NO: 883787 - protein, 467 aa, Homo sapiens
MQEPRRVTPCLGKRGVKTPQLQPGSAFLPRVRRQSFPARSDSYTTVRDFLAVPRTISSASATLIMAVAVSHFRPGPEVWDTASMAASKVKQDMPPPGGYGPIDYKRNLPRRGLSGYSMLAIGIGTLIYGHWSIMKWNRERRRLQIEDFEARIALLPLLQAETDRRTLQMLRENLEEEAIIMKDVPDWKGLELQPPLADMGRAELSSNATTSLVQRRKQAWGRQSWLEQIWNAGPVCQSTAEAAALERELLEDYRFGRQQLVELCGHASAVAVTKAFPLPALSRKQRTVLVVCGPEQNGAVGLVCARHLRVFEYEPTIFYPTRSLDLLHRDLTTQCEKMDIPFLSYLPTEVQLINEAYGLVVDAVLGPGVEPGEVGGPCTRALATLKLLSIPLVSLDIPSGWDAETGSDSEDGLRPDVLVSLAAPKRCAGRFSGRHHFVAGRFVPDDVRRKFALRLPGYTGTDCVAAL

SEQ ID NO: 883788 - protein, 323 aa, Homo sapiens
PPSTDALKRRWRWRQRPAPGLTSAMSSAAGPDPSEAPEERHFLRALELQPPLADMGRAELSSNATTSLVQRRKQAWGRQSWLEQIWNAGPVCQSTAEAAALERELLEDYRFGRQQLVELCGHASAVAVTKAFPLPALSRKQRTVLVVCGPEQNGAVGLVCARHLRVFEYEPTIFYPTRSLDLLHRDLTTQCEKMDIPFLSYLPTEVQLINEAYGLVVDAVLGPGVEPGEVGGPCTRALATLKLLSIPLVSLDIPSGWDAETGSDSEDGLRPDVLVSLAAPKRCAGRFSGRHHFVAGRFVPDDVRRKFALRLPGYTGTDCVAAL

SEQ ID NO: 883789 - protein, 296 aa, Homo sapiens
KGGRMSATQAENKQTALRATGSGWMHVFPAPTWQSLRPGLCISSGETEAPRGPTPHPEQLTSCPILLPPGPSPIPSPTPGLSFLSRQGGIWTVPVPCCVPYHQAFPLPALSRKQRTVLVVCGPEQNGAVGLVCARHLRVFEYEPTIFYPTRSLDLLHRDLTTQCEKMDIPFLSYLPTEVQLINEAYGLVVDAVLGPGVEPGEVGGPCTRALATLKLLSIPLVSLDIPSGWDAETGSDSEDGLRPDVLVSLAAPKRCAGRFSGRHHFVAGRFVPDDVRRKFALRLPGYTGTDCVAAL

SEQ ID NO: 883790 - protein, 103 aa, Homo sapiens
MDSRLRAGHPPSSQSPRTLLPQAGTQRPAAIRRTGCGLTCWCLSRRPSAALAASPGATTSWPAGSCPMTCAASSLCACRDTRAPTASRHCDRHPRPHRRDPRQ

SEQ ID NO: 883791 - protein, 505 aa, Homo sapiens [sequence omitted]

SEQ ID NO: 883792 - protein, 505 aa, Homo sapiens [sequence omitted]

SEQ ID NO: 883793 - protein, 505 aa, Homo sapiens [sequence omitted]

SEQ ID NO: 883794 - protein, 575 aa, Homo sapiens
MFAHLETAVLITIGYKPSPHQVIAAVNLWAGYVPVTVPSPSHIASLNLYRDPELHLTDEETARQTADVLIMSDKDDIETPLLTEAAPILEDGNCEPAKNSESVDQGAKPESKSEPVVSTRKRPETKPSSDLETSKVLPIQDNVSKDVPQTRWGYWGSWGKSILSSASATVATVGQGISNVIEKAETSLGIPSPSEISTEVKYVAGETNAKENENSSPVAGAFGVFSTISTAVQSTGKSVISGGLDALEFIGKKTMDVIAEGDPGFKRTKGLMNRNATLSQVLREAKEKEEIRTSNEVTVETDKKTHYGLLFDEFQGLSHLEALEMLSQESEIKVKSILNSLSGEELETLKVELEQLKETFSLAEFCEEEEEEKKGDEDFTKDITELFSQLHVSSKPEKLARARNTAHEWIRKSLTKPLAENEEGEKQSEAENTEQVNKNSIEDIHAFAIRSLAELTACSIELFHKTAALVLHGRKQEVTAIERSQTLSQMTIVLCKELSSLSKEFTTCLTTAGVKEMADVLNPLITAVFLEASNSASYIQDAFQLLLPVLEISLIENKIESHRHELQGQKPLLEH

SEQ ID NO: 883795 - protein, 505 aa, Homo sapiens [sequence omitted]

SEQ ID NO: 883796 - protein, 575 aa, Homo sapiens; identical to SEQ ID NO: 883794

SEQ ID NO: 883797 - protein, 505 aa, Homo sapiens [sequence omitted]

SEQ ID NO: 883798 - protein, 465 aa, Homo sapiens
MSDKDDIETPLLTEAAPILEDGNCEPAKNSESVDQGAKPESKSEPVVSTRKRPETKPSSDLETSKVLPIQDNVSKDVPQTRWGYWGSWGKSILSSASATVATVGQGISNVIEKAETSLGIPSPSEISTEVKYVAGETNAKENENSSPVAGAFGVFSTISTAVQSTGKSVISGGLDALEFIGKKTMDVIAEGDPGFKRTKGLMNRNATLSQVLREAKEKEEIRTSNEVTVETDKKTHYGLLFDEFQGLSHLEALEMLSQESEIKVKSILNSLSGEELETLKVELEQLKETFSLAEFCEEEEEEKKGDEDFTKDITELFSQLHVSSKPEKLARARNTAHEWIRKSLTKPLAENEEGEKQSEAENTEQVNKNSIEDIHAFAIRSLAELTACSIELFHKTAALVLHGRKQEVTAIERSQTLSQMTIVLCKELSSLSKEFTTCLTTAGVKEMADVLNPLITAVFLEKAYS

SEQ ID NO: 883799 - protein, 309 aa, Homo sapiens
MSDKDDIETPLLTEAAPILEDGNCEPAKNSESVDQGAKPESKSEPVVSTRKRPETKPSSDLETSKVLPIQDNVSKDVPQTRWGYWGSWGKSILSSASATVATVGQGISNVIEKAETSLGIPSPSEISTEVKYVAGETNAKENENSSPVAGAFGVFSTISTAVQSTGKSVISGGLDALEFIGKKTMDVIAEGDPGFKRTKGLMNRNATLSQVLREAKEKEEIRTSNEVTVETDKKTHYGLLFDEFQGLSHLEALEMLSQESEIKVKSILNSLSGEELETLKVELEQLKETFSLAEFCEEEEEEKKGNMKI

SEQ ID NO: 883800 - protein, 551 aa, Homo sapiens
MAEGENEVRWDGLCSRDSTTRETALENIRQTILRKTEYLRSVKETPHRPSDGLSNTESSDGLNKLLAHLLMLSKRCPFKDVREKSEFILKSIQELGIRIPRPLGQGPSRFIPEKEILQVGSEDAQMHALFADSFAALGRLDNITLVMVFHPQYLESFLKTQHYLLQMDGPLPLHYRHYIGIMAAARHQCSYLVNLHVNDFLHVGGDPKWLNGLENAPQKLQNLGELNKVLAHRPWLITKEHIEGLLKAEEHSWSLAELVHAVVLLTHYHSLASFTFGCGISPEIHCDGGHTFRPPSVSNYCICDITNGNHSVDEMPVNSAENVSVSDSFFEVEALMEKMRQLQECRDEEEASQEEMASRFEIEKRESMFVFSSDDEEVTPARAVSRHFEDTSYGYKDFSRHGMHVPTFRVQDYCWEDHGYSLVNRLYPDVGQLIDEKFHIAYNLTYNTMAMHKDVDTSMLRRAIWNYIHCMFGIRYDDYDYGEINQLLDRSFKVYIKTVVCTPEKVTKRMYDSFWRQFKHSEKVHVNLLLIEARMQAELLYALRAITRYMT

SEQ ID NO: 883801 - protein, 492 aa, Homo sapiens
MRLAAAANEAYTAPLAVSGLLGCKQCGGGRDQDEELGIRIPRPLGQGPSRFIPEKEILQVGSEDAQMHALFADSFAALGRLDNITLVMVFHPQYLESFLKTQHYLLQMDGPLPLHYRHYIGIMAAARHQCSYLVNLHVNDFLHVGGDPKWLNGLENAPQKLQNLGELNKVLAHRPWLITKEHIEGLLKAEEHSWSLAELVHAVVLLTHYHSLASFTFGCGISPEIHCDGGHTFRPPSVSNYCICDITNGNHSVDEMPVNSAENVSVSDSFFEVEALMEKMRQLQECRDEEEASQEEMASRFEIEKRESMFVFSSDDEEVTPARAVSRHFEDTSYGYKDFSRHGMHVPTFRVQDYCWEDHGYSLVNRLYPDVGQLIDEKFHIAYNLTYNTMAMHKDVDTSMLRRAIWNYIHCMFGIRYDDYDYGEINQLLDRSFKVYIKTVVCTPEKVTKRMYDSFWRQFKHSEKVHVNLLLIEARMQAELLYALRAITRYMT

SEQ ID NO: 883802 - protein, 426 aa, Homo sapiens
MHALFADSFAALGRLDNITLVMVFHPQYLESFLKTQHYLLQMDGPLPLHYRHYIGIMAAARHQCSYLVNLHVNDFLHVGGDPKWLNGLENAPQKLQNLGELNKVLAHRPWLITKEHIEGLLKAEEHSWSLAELVHAVVLLTHYHSLASFTFGCGISPEIHCDGGHTFRPPSVSNYCICDITNGNHSVDEMPVNSAENVSVSDSFFEVEALMEKMRQLQECRDEEEASQEEMASRFEIEKRESMFVFSSDDEEVTPARAVSRHFEDTSYGYKDFSRHGMHVPTFRVQDYCWEDHGYSLVNRLYPDVGQLIDEKFHIAYNLTYNTMAMHKDVDTSMLRRAIWNYIHCMFGIRYDDYDYGEINQLLDRSFKVYIKTVVCTPEKVTKRMYDSFWRQFKHSEKVHVNLLLIEARMQAELLYALRAITRYMT

SEQ ID NO: 883803 - protein, 426 aa, Homo sapiens; identical to SEQ ID NO: 883802

SEQ ID NO: 883804 - protein, 474 aa, Homo sapiens
MRLAAAANEAYTAPLAVSGLLGCKQCGGGRDQDEELGIRIPRPLGQGPSRFIPEKEILQVGSEDAQMHALFADSFAALGRLDNITLVMVFHPQYLESFLKTQHYLLQMDGPLPLHYRHYIGIMAAARHQCSYLVNLHVNDFLHVGGDPKWLNGLENAPQKLQNLGELNKVLAHRPWLITKEHIEGLLKAEEHSWSLAELVHAVVLLTHYHSLASFTFGCGISPEIHCDGGHTFRPPSVSNYCICDITNGNHSVDEMPVNSAENVSVSDSFFEVEALMEKMRQLQECRDEEEASQEEMASRFEIEKRESMFVFSSDDEEVTPARAVSRHFEDTSYGYKDFSRHGMHVPTFRVQDYCWEDHGYSLVNRLYPDVGQLIDEKFHIAYNLTYNTMAMHKDVDTSMLRRAIWNYIHCMFGIRYDDYDYGEINQLLDRSFKVYIKTVVCTPEKVTKRMYDSFWRQFKHSEKVCAYCGLFTL

SEQ ID NO: 883805 - protein, 134 aa, Homo sapiens
MAEGENEVRWDGLCSRDSTTRETALENIRQTILRKTEYLRSVKETPHRPSDGLSNTESSDGLNKLLAHLLMLSKRCPFKDVREKSEFILKSIQCTQSEDRKNEDLHDYPRPLNECIANDVSIPTACYSRHHVQT

SEQ ID NO: 883806 - protein, 492 aa, Homo sapiens; identical to SEQ ID NO: 883801

SEQ ID NO: 883807 - protein, 286 aa, Homo sapiens
HGSSEGADLEEAPQKATPLASCLSPLEGSLLLISEPGSPSDQPPGASSGRGPGSFRAQHRQLAVMGGSASSQLDEGKCAYIRGKTEAAIKNFSPYYSRQYSVAFCNHVRTEVEQQRDLTSQFLKTKPPLAPGTILYEAELSQFSEDIKKWKERYVVVKNDYAVESYENKEAYQRGAAPKCRILPAGGKVLTSEDEYNLLSDRHFPDPLASSEKENTQPFVVLPKEFPVYLWQPFFRHGYFCFHEAADQKSFNWPSLEDLPVQGILQIEITLKSQNEHFWKAPKLFL

SEQ ID NO: 883808 - protein, 191 aa, Homo sapiens
HGSSEGADLEEAPQKATPLASCLSPLEGSLLLISEPGSPSDQPPGASSGRGPGSFRAQHRQLAVMGGSASSQLDEGKCAYIRGKTEAAIKNFSPYYSRQYSVAFCNHVRTEVEQQRDLTSQFLKTKPPLAPGTILYEAELSQFSEDIKKWKERYVVVKNDYAVESYENKEGLSEEGAALQELKGPILVKSF

SEQ ID NO: 883809 - protein, 992 aa, Homo sapiens
HGSSEGADLEEAPQKATPLASCLSPLEGSLLLISEPGSPSDQPPGASSGRGPGSFRAQHRQLAVMGGSASSQLDEGKCAYIRGKTEAAIKNFSPYYSRQYSVAFCNHVRTEVEQQRDLTSQFLKTKPPLAPGTILYEAELSQFSEDIKKWKERYVVVKNDYAVESYENKEAYQRGAAPKCRILPAGGKVLTSEDEYNLLSDRHFPDPLASSEKENTQPFVVLPKEFPVYLWQPFFRHGYFCFHEAADQKRFSALLSDCVRHLNHDYMKQMTFEAQAFLEAVQFFRQEKGHYGSWEMITGDEIQILSNLVMEELLPTLQTDLLPKMKGKKNDRKRTWLGLLEEAYTLVQHQVSEGLSALKEECRALTKGLEGTIRSDMDQIVNSKNYLIGKIKAMVAQPAEKSCLESVQPFLASILEELMGPVSSGFSEVRVLFEKEVNEVSQNFQTTKDSVQLKEHLDRLMNLPLHSVKMEPCYTKVNLLHERLQDLKSRFRFPHIDLVVQRTQNYMQELMENAVFTFEQLLSPHLQGEASKTAVAIEKVKLRVLKQYDYDSSTIRKKIFQEALVQITLPTVQKALASTCKPELQKYEQFIFADHTNMIHVENVYEEILHQILLDETLKVIKEAAILKKHNLFEDNMALPSESVSSLTDLKPPTGSNQASPARRASAILPGVLGSETLSNEVFQESEEEKQPEVPSSLAKGESLSLPGPSPPPDGTEQVIISRVDDPVVNPVATEDTAGLPGTCSSELEFGGTLEDEEPAQEEPEPITASGSLKALRKLLTASVEVPVDSAPVMEEDTNGESHVPQENEEEEEKEPSQAAAIHPDNCEESEVSEREAQPPCPEAHGEELGGFPEVGSPASPPASGGLTEEPLGPMEGELPGEACTLTAHEGRGGKCTEEGDASQQEGCTLGSDPICLSESQVSEEQEEMGGQSSAAQATASVNAEEIKVARIHECQWVVEDAPNPDVLLSHKDDVKEGEGGQESFPELPSEE

SEQ ID NO: 883810 - protein, 955 aa, Homo sapiens
HGSSEGADLEEAPQKATPLASCLSPLEGSLLLISEPGSPSDQPPGASSGRGPGSFRAQHRQLAVMGGSASSQLDEGKCAYIRGKTEAAIKNFSPYYSRQYSVAFCNHVRTEVEQQRDLTSQFLKTKPPLAPGTILYEAELSQFSEDIKKWKERYVVVKNDYAVESYENKEAYQRGAAPKCRILPAGGKVLTSEDEYNLLSDRHFPDPLASSEKENTQPFVVLPKEFPVYLWQPFFRHGYFCFHEAADQKRFSALLSDCVRHLNHDYMKQMTFEAQAFLEAVQFFRQEKGHYGSWEMITGDEIQILSNLVMEELLPTLQTDLLPKMKGKKNDRKRTWLGLLEEAYTLVQHQVSEGLSALKEECRALTKGLEGTIRSDMDQIVNSKNYLIGKIKAMVAQPAEKSCLESVQPFLASILEELMGPVSSGFSEVRVLFEKEVNEVSQNFQTTKDSVQLKEHLDRLMNLPLHSVKMEPCYTKVNLLHERLQDLKSRFRFPHIDLVVQRTQNYMQEQYDYDSSTIRKKIFQEALVQITLPTVQKALASTCKPELQKYEQFIFADHTNMIHVENVYEEILHQILLDETLKVIKEAAILKKHNLFEDNMALPSESVSSLTDLKPPTGSNQASPARRASAILPGVLGSETLSNEVFQESEEEKQPEVPSSLAKGESLSLPGPSPPPDGTEQVIISRVDDPVVNPVATEDTAGLPGTCSSELEFGGTLEDEEPAQEEPEPITASGSLKALRKLLTASVEVPVDSAPVMEEDTNGESHVPQENEEEEEKEPSQAAAIHPDNCEESEVSEREAQPPCPEAHGEELGGFPEVGSPASPPASGGLTEEPLGPMEGELPGEACTLTAHEGRGGKCTEEGDASQQEGCTLGSDPICLSESQVSEEQEEMGGQSSAAQATASVNAEEIKVARIHECQWVVEDAPNPDVLLSHKDDVKEGEGGQESFPELPSEE

SEQ ID NO: 883811 - protein, 621 aa, Homo sapiens
HGSSEGADLEEAPQKATPLASCLSPLEGSLLLISEPGSPSDQPPGASSGRGPGSFRAQHRQLAVMGGSASSQLDEGKCAYIRGKTEAAIKNFSPYYSRQYSVAFCNHVRTEVEQQRDLTSQFLKTKPPLAPGTILYEAELSQFSEDIKKWKERYVVVKNDYAVESYENKEAYQRGAAPKCRILPAGGKVLTSEDEYNLLSDRHFPDPLASSEKENTQPFVVLPKEFPVYLWQPFFRHGYFCFHEAADQKRFSALLSDCVRHLNHDYMKQMTFEAQAFLEAVQFFRQEKGHYGSWEMITGDEIQILSNLVMEELLPTLQTDLLPKMKGKKNDRKRTWLGLLEEAYTLVQHQVSEGLSALKEECRALTKGLEGTIRSDMDQIVNSKNYLIGKIKAMVAQPAEKSCLESVQPFLASILEELMGPVSSGFSEVRVLFEKEVNEVSQNFQTTKDSVQLKEHLDRLMNLPLHSVKMEPCYTKVNLLHERLQDLKSRFRFPHIDLVVQRTQNYMQELMENAVFTFEQLLSPHLQGEASKTAVAIEKVKLRVLKQYDYDSSTIRKKIFQEALVQITLPTVQKALASTCKPELQKYEQFIFADHTNMIHVENVYEEILHQILLDETLKAG

SEQ ID NO: 883812 - protein, 101 aa, Homo sapiens
LLPTLQTDLLPKMKGKKNDRKRTWLGVSNGFALQLSYSKWEHSLPFSFRAFVVVVDIPFPGCRNAYFEPAESHLQEDCSKQTPTLKEKLQCVCSSVCYDGL

SEQ ID NO: 883813 - protein, 992 aa, Homo sapiens; identical to SEQ ID NO: 883809

SEQ ID NO: 883814 - protein, 992 aa, Homo sapiens; identical to SEQ ID NO: 883809

SEQ ID NO: 883815 - protein, 992 aa, Homo sapiens; identical to SEQ ID NO: 883809

SEQ ID NO: 883816 - protein, 992 aa, Homo sapiens; identical to SEQ ID NO: 883809

SEQ ID NO: 883817 - protein, 114 aa, Homo sapiens
CFVFRYLSVIKEAAILKKHNLFEDNMALPSESVSSLTDLKPPTGSNQASPARRASAILPGVLGSETLSNEVFQESEEEKQPEVPSSLAKGESLSLPGPSPPPDGTEQVIISRVD

SEQ ID NO: 883818 - protein, 205 aa, Homo sapiens
MAARDATSGSLSEESSALDLPSACDIRDYVLQGPSQEANSEAFSSLEFHSFPYSSDVDPDTSNLNIEQNNSWTAENFWLDPAVKGQSEKEEDDGLRKSLDRFYEMFGHPQPGSANSLSASVCKCLSQKITQLRGQESQKYALRSFQMARVIFNRDGCSVLQRHSRDTHFYPLEEGSTSLDDEKPNPGLSKDITHFLLQQNVMKDL

SEQ ID NO: 883819 - protein, 149 aa, Homo sapiens
MVKDTSNLNIEQNNSWTAENFWLDPAVKGQSEKEEDDGLRKSLDRFYEMFGHPQPGSANSLSASVCKCLSQKITQLRGQESQKYALRSFQMARVIFNRDGCSVLQRHSRDTHFYPLEEGSTSLDDEKPNPGLSKDITHFLLQQNVMKDL

SEQ ID NO: 883820 - protein, 202 aa, Homo sapiens
ILIEVEQRPAVLSQELLRAVAPASGHGQRDSASPCHCRMKGELALLTTLAARDALINTSNLNIEQNNSWTAENFWLDPAVKGQSEKEEDDGLRKSLDRFYEMFGHPQPGSANSLSASVCKCLSQKITQLRGQESQKYALRSFQMARVIFNRDGCSVLQRHSRDTHFYPLEEGSTSLDDEKPNPGLSKDITHFLLQQNVMKDL

SEQ ID NO: 883821 - protein, 68 aa, Homo sapiens
RIVTVRTRIAVLSLRPPVWWNSVSVSGGLAAFLLSFLECFGGEDYGSQGRHFRQPVRGEQCFGPAISV

SEQ ID NO: 883822 - protein, 228 aa, Homo sapiens
PNPLFRPPSQPLPPSPPPERLRTMAARDATSGSLSEESSALDLPSACDIRDYVLQGPSQEANSEAFSSLEFHSFPYSSDVDPDTSNLNIEQNNSWTAENFWLDPAVKGQSEKEEDDGLRKSLDRFYEMFGHPQPGSANSLSASVCKCLSQKITQLRGQESQKYALRSFQMARVIFNRDGCSVLQRHSRDTHFYPLEEGSTSLDDEKPNPGLSKDITHFLLQQNVMKDL

SEQ ID NO: 883823 - protein, 205 aa, Homo sapiens; identical to SEQ ID NO: 883818

SEQ ID NO: 883824 - protein, 502 aa, Homo sapiens
RAPPLGRAVTPLQGRPAELLGRCQRPCHRHVADMVISESMDILFRIRGGLDLAFQLATPNEIFLKKALKHVLSDLSTKLSSNALVFRICHSSVYIWPSSDINTIPGELTDASACKNILRFIQFEPEEDIKRKFMRKKDKKLSDMHQIVNIDLMLEMSTSLAAVTPIIERESGGHHYVNMTLPVDAVISVAPEETWGKVRKLLVDAIHNQLTDMEKCILKYMKGTSIVVPEPLHFLLPGKKNLVTISYPSGIPDGQLQAYRKELHDLFNLPHDRPYFKRSNAYHFPDEPYKDGYIRNPHTYLNPPNMETGMIYVVQGIYGYHHYMQDRIDDNGWGCAYRSLQTICSWFKHQGYTERSIPTHREIQQALVDAGDKPATFVGSRQWIGSIEVQLVLNQLIGITSKILFVSQGSEIASQGRELANHFQSEGTPVMIGGGVLAHTILGVAWNEITGQIKFLILDPHYTGAEDLQVILEKGWCGWKGPDFWNKDAYYNLCLPQRPNMI

SEQ ID NO: 883825 - protein, 502 aa, Homo sapiens; identical to SEQ ID NO: 883824

SEQ ID NO: 883826 - protein, 502 aa, Homo sapiens; identical to SEQ ID NO: 883824

SEQ ID NO: 883827 - protein, 420 aa, Homo sapiens
RAPPLGRAVTPLQGRPAELLGRCQRPCHRHVADMVISESMDILFRIRGGLDLAFQLATPNEIFLKKALKHVLSDLSTKLSSNALVFRICHSSVYIWPSSDINTIPGELTDASACKNILRFIQFEPEEDIKRKFMRKKDKKLSDMHQIVNIDLMLEMSTSLAAVTPIIERESGGHHYVNMTLPVDAVISVAPEETWGKVRKLLVDAIHNQLTDMEKCILKYMKGTSIVVPEPLHFLLPGKKNLVTISYPSGIPDGQLQAYRKELHDLFNLPHDRPYFKRSNAYHFPDEPYKDGYIRNPHTYLNPPNMETGMIYVVQGIYGYHHYMQDRIDDNGWGCAYRSLQTICSWFKHQGYTERSIPTHREIQQALVDAGDKPATFVGSRQWIGSIEVQLVLNQLIGITSKILFVSNTRKNKKVGNIVS

SEQ ID NO: 883828 - protein, 324 aa, Homo sapiens
MTLPVDAVISVAPEETWGKVRKLLVDAIHNQLTDMEKCILKYMKGTSIVVPEPLHFLLPGKKNLVTISYPSGIPDGQLQAYRKELHDLFNLPHDRPYFKRSNAYHFPDEPYKDGYIRNPHTYLNPPNMETGMIYVVQGIYGYHHYMQDRIDDNGWGCAYRSLQTICSWFKHQGYTERSIPTHREIQQALVDAGDKPATFVGSRQWIGSIEVQLVLNQLIGITSKILFVSQGSEIASQGRELANHFQSEGTPVMIGGGVLAHTILGVAWNEITGQIKFLILDPHYTGAEDLQVILEKGWCGWKGPDFWNKDAYYNLCLPQRPNMI

SEQ ID NO: 883829 - protein, 501 aa, Homo sapiens
RAPPLGRAVTPLQGRPAELLGRCQRPCHRHVADMVISESMDILFRIRGGLDLAFQLATPNEIFLKKALKHVLSDLSTKLSSNALVFRICHSSVYIWPSSDINTIPGELTDASACKNILRFIQFEPEEDIKRKFMRKKDKKLSDMHQIVNIDLMLEMSTSLAAVTPIIERESGGHHYVNMTLPVDAVISVAPEETWGKVRKLLVDAIHNQLTDMEKCILKYMKGTSIVVPEPLHFLLPGKKNLVTISYPSGIPDGQLQAYRKELHDLFNLPHDRPYFKRSNAYHFPDEPYKDGYIRNPHTYLNPPNMETGMIYVVQGIYGYHHYMQDRIDDNGWGCAYRSLQTICSWFKHQGYTERSIPTHREIQQALVDAGDKPATFVGSRQWIGSIEVQLVLNQLIGITSKILFVSQGSEIASQGRELANHFQSEGTPVMIGGGVLAHTILGVAWNEITGQIKFLILDPHYTGAEDLQVILEKHLEFEVYKRFFDWCMYLTEYSSNILVL

SEQ ID NO: 883830 - protein, 443 aa, Homo sapiens
RAPPLGRAVTPLQGRPAELLGRCQRPCHRHVADMVISESMDILFRIRGGLDLAFQLATPNEIFLKKALKHVLSDLSTKLSSNALVFRICHSSVYIWPSSDINTIPGELTDASACKNILRFIQFEPEEDIKRKFMRKKDKKLSDMHQIVNIDLMLEMSTSLAAVTPIIERESGGHHYVNMTLPVDAVISVAPEETWGKVRKLLVDAIHNQLTDMEKCILKYMKGTSIVVPEPLHFLLPGKKNLVTISYPSGIPDGQLQAYRKELHDLFNLPHDRPYFKRSNAYHFPDEPYKDGYIRNPHTYLNPPNMETGMIYVVQGIYGYHHYMQDRIDDNGWGCAYRSLQTICSWFKHQGYTERSIPTHREIQQALVDAGDKPATFVGSRQWIGSIEVQLVLNQLIGITSKILFVSQGSEIASQGRELANHFQSEGTPVMIGKLFQTLFLVE

SEQ ID NO: 883831 - protein, 416 aa, Homo sapiens
RAPPLGRAVTPLQGRPAELLGRCQRPCHRHVADMVISESMDILFRIRGGLDLAFQLATPNEIFLKKALKHVLSDLSTKLSSNALVFRICHSSVYIWPSSDINTIPGELTDASACKNILRFIQFEPEEDIKRKFMRKKDKKLSDMHQIVNIDLMLEMSTSLAAVTPIIERESGGHHYVNMTLPVDAVISVAPEETWGKVRKLLVDAIHNQLTDMEKCILKYMKGTSIVVPEPLHFLLPGKKNLVTISYPSGIPDGQLQAYRKELHDLFNLPHDRPYFKRSNAYHFPDEPYKDGYIRNPHTYLNPPNMETGMIYVVQGIYGYHHYMQDRIDDNGWGCAYRSLQTICSWFKHQGYTERSIPTHREIQQALVDAGDKPATFVGSRQWIGSIEVQLVLNQLIGITSKILFVSQSVAGSSRV

SEQ ID NO: 883832 - protein, 152 aa, Homo sapiens
SLFIGTIPTHREIQQALVDAGDKPATFVGSRQWIGSIEVQLVLNQLIGITSKILFVSQGSEIASQGRELANHFQSEGTPVMIGGGVLAHTILGVAWNEITGQIKFLILDPHYTGAEDLQVILEKGWCGWKGPDFWNKDAYYNLCLPQRPNMI

SEQ ID NO: 883833 - protein, 443 aa, Homo sapiens
RAPPLGRAVTPLQGRPAELLGRCQRPCHRHVADMVISESMDILFRIRGGLDLAFQLATPNEIFLKKALKHVLSDLSTKLSSNALVFRICHSSVYIWPSSDINTIPGELTDASACKNILRFIQFEPEEDIKRKFMRKKDKKLSDMHQIVNIDLMLEMSTSLAAVTPIIERESGGHHYVNMTLPVDAVISVAPEETWGKVRKLLVDAIHNQLTDMEKCILKYMKGTSIVVPEPLHFLLPGKKNLELHDLFNLPHDRPYFKRSNAYHFPDEPYKDGYIRNPHTYLNPPNMETGMIYVSPKQEKTNKHKKEDRIDDNGWGCAYRSLQTICSWFKHQGYTERSIPTHREIQQLKYDSREDKPATKNGYATKKKKRHRKTTKTKPKKQRRNSTKNRLVQPRVTEKADTRERKTKRNKTKRKKTPRKRTKERKRGIASTRTKKNQKQIKQ

SEQ ID NO: 883834 - protein, 152 aa, Homo sapiens; identical to SEQ ID NO: 883832

SEQ ID NO: 883835 - protein, 502 aa, Homo sapiens; identical to SEQ ID NO: 883824

SEQ ID NO: 883836 - protein, 483 aa, Homo sapiens
RAPPLGRAVTPLQGRPAELLGRCQRPCHRHVADMVISESMDILFRIRGGLDLAFQLATPNEIFLKKALKHVLSDLSTKLSSNALVFRICHSSVYIWPSSDINTIPGELTDASACKNILRFIQFEPEEDIKRKFMRKKDKKLSDMHQIVNIDLMLEMSTSLAAVTPIIERESGGHHYVNMTLPVDAVISVAPEETWGKVRKLLVDAIHNQLTDMEKCILKYMKGTSIVVPEPLHFLLPGKKNLELHDLFNLPHDRPYFKRSNAYHFPDEPYKDGYIRNPHTYLNPPNMETGMIYVVQGIYGYHHYMQDRIDDNGWGCAYRSLQTICSWFKHQGYTERSIPTHREIQQALVDAGDKPATFVGSRQWIGSIEVQLVLNQLIGITSKILFVSQGSEIASQGRELANHFQSEGTPVMIGGGVLAHTILGVAWNEITGQIKFLILDPHYTGAEDLQVILEKGWCGWKGPDFWNKDAYYNLCLPQRPNMI

SEQ ID NO: 883837 - protein, 375 aa, Homo sapiens
ALDEETAVTDGHKVIDMHQIVNIDLMLEMSTSLAAVTPIIERESGGHHYVNMTLPVDAVISVAPEETWGKVRKLLVDAIHNQLTDMEKCILKYMKGTSIVVPEPLHFLLPGKKNLVTISYPSGIPDGQLQAYRKELHDLFNLPHDRPYFKRSNAYHFPDEPYKDGYIRNPHTYLNPPNMETGMIYVVQGIYGYHHYMQDRIDDNGWGCAYRSLQTICSWFKHQGYTERSIPTHREIQQALVDAGDKPATFVGSRQWIGSIEVQLVLNQLIGITSKILFVSQGSEIASQGRELANHFQSEGTPVMIGGGVLAHTILGVAWNEITGQIKFLILDPHYTGAEDLQVILEKGWCGWKGPDFWNKDAYYNLCLPQRPNMI

SEQ ID NO: 883838 - protein, 420 aa, Homo sapiens; identical to SEQ ID NO: 883827

SEQ ID NO: 883839 - protein, 420 aa, Homo sapiens; identical to SEQ ID NO: 883827

SEQ ID NO: 883840 - protein, 95 aa, Homo sapiens
MEGGFGSDFGGSGSGKLDPGLIMEQVKVQIAVANAQELLQRMTDKCFRKCIGKPGGSLDNSEQKCIAMCMDRYMDAWNTVSRAYNSRLQRERANM

SEQ ID NO: 883841 - protein, 113 aa, Homo sapiens
ITEIICTTAFCSVRQRAPAGRVPSVTLLGREERGFRGRYLPYSSPWVIGPSRSDPSDFPWEPHFHYLENGLNAKVADIYGHPPRGPGVERCLPLQPLPALPPRPGDGMRWVAQ

SEQ ID NO: 883842 - protein, 95 aa, Homo sapiens; identical to SEQ ID NO: 883840

SEQ ID NO: 883843 - protein, 95 aa, Homo sapiens; identical to SEQ ID NO: 883840

SEQ ID NO: 883844 - protein, 95 aa, Homo sapiens; identical to SEQ ID NO: 883840

SEQ ID NO: 883845 - protein, 696 aa, Homo sapiens
MLWKLLLVTEGTAVISGKRVKNLPLFVFNVLGRFRFWLGGNRVGANKKRLVKRFRGKGWLAMLNFRCLLHLHVATVSETDSRFLGKKFKLEKQCGVVERILGIQLRGVGSERLTLLLTCSVTLTKSFDLSGPHLYWKMSSRWSLINFCPVLTLCDSKCIYTDLLNCELFVFSAFSMRTYVCHICSIAFTSLDMFRSHMQGSEHQIKESIVINLVKNSRKTQDSYQNECADYINVQKARGLEAKTCFRKMEESSLETRRYREVVDSRPRHRMFEQRLPFETFRTYAAPYNISQAMEKQLPHSKKTYDSFQDELEDYIKVQKARGLDPKTCFRKMRENSVDTHGYREMVDSGPRSRMCEQRFSHEASQTYQRPYHISPVESQLPQWLPTHSKRTYDSFQDELEDYIKVQKARGLEPKTCFRKIGDSSVETHRNREMVDVRPRHRMLEQKLPCETFQTYSGPYSISQVVENQLPHCLPAHDSKQRLDSISYCQLTRDCFPEKPVPLSLNQQENNSGSYSVESEVYKHLSSENNTADHQAGHKRKHQKRKRHLEEGKERPEKEQSKHKRKKSYEDTDLDKDKSIRQRKREEDRVKVSSGKLKHRKKKKSHDVPSEKEERKHRKEKKNLLKKGQKRKCFGMSLFLDFECLDFVLPKVELKKKNSQYGFRKRNTLMKKRRGRYSQCHFQEGTLRFFLYKNLN

SEQ ID NO: 883846 - protein, 638 aa, Homo sapiens
MESCSVTRLECSGAISAHCSLHLPGSSDSPASASQIAGTTDAIWNEQEKAELFTDKFCQVCGVMLQFESQRISHYEGEKHAQNVSFYFQMHGEQNEVPGKKMKMHVENFQVHRYEGVDKNKFCDLCNMMFSSPLIAQSHYVGKVHAKKLKQLMEEHDQASPSGFQPEMAFSMRTYVCHICSIAFTSLDMFRSHMQGSEHQIKESIVINLVKNSRKTQDSYQNECADYINVQKARGLEAKTCFRKMEESSLETRRYREVVDSRPRHRMFEQRLPFETFRTYAAPYNISQAMEKQLPHSKKTYDSFQDELEDYIKVQKARGLDPKTCFRKMRENSVDTHGYREMVDSGPRSRMCEQRFSHEASQTYQRPYHISPVESQLPQWLPTHSKRTYDSFQDELEDYIKVQKARGLEPKTCFRKIGDSSVETHRNREMVDVRPRHRMLEQKLPCETFQTYSGPYSISQVVENQLPHCLPAHDSKQRLDSISYCQLTRDCFPEKPVPLSLNQQENNSGSYSVESEVYKHLSSENNTADHQAGHKRKHQKRKRHLEEGKERPEKEQSKHKRKKSYEDTDLDKDKSIRQRKREEDRVKVSSGKLKHRKKKKSHDVPSEKEERKHRKEKKKSVEERTEEEMLWDESILGF

SEQ ID NO: 883847 - protein, 696 aa, Homo sapiens; identical to SEQ ID NO: 883845

SEQ ID NO: 883848 - protein, 256 aa, Homo sapiens
KLFFTTANAHFKVGCPVLALEVLSKIPKVTKTSALSAKKDQPDFISHRMDDVPSHSKALSDGNGSSGIEWSNVTSSQYDWSQPIVKVDEEPLNLDWGEDHDSALDEEEDDAVGLVMKSTDAREKDKQSDQKASDPNMLLTPQEEDDPEGDTEVDVIAEQLKFRACLKILMTELRTLATGYEVDGGKLRFQLYNWLEKEIAALHEICNHESVIKEYSSKTYSKVESDLLDQEEMVDNHHLGPHEGYVAEKYSQEICF

SEQ ID NO: 883849 - protein, 1176 aa, Homo sapiens
KLFFTTANAHFKVGCPVLALEVLSKIPKVTKTSALSAKKDQPDFISHRMDDVPSHSKALSDGNGSSGIEWSNVTSSQYDWSQPIVKVDEEPLNLDWGEDHDSALDEEEDDAVGLVMKSTDAREKDKQSDQKASDPNMLLTPQEEDDPEGDTEVDVIAEQLKFRACLKILMTELRTLATGYEVDGGKLRFQLYNWLEKEIAALHEICNHESVIKEYSSKTYSKVESDLLDQEEMVDKPDIGSYERHQIERRRLQAKREHAERRKSWLQKNQDLLRVFLSYCSLHGAQGGGLASVRMELKFLLQESQQETTVKQLQSPLPLPTTLPLLSASIASTKTVIANPVLYLNNHIHDILYTIVQMKTPPHPSIEDVKVHTLHSLAASLSASIYQALCDSHSYSSQTEGNQFTGMAYQGLLLSDRRRLRTESIEEHATPNSSPAQWPGVSSLINLLSSAQDEDQPKLNILLCEAVVAVYLSLLIHALATNSSSELFRLAAHPLNNRMWAAVFGGGVKLVVKPRRQSENISAPPVLSEDIDKHRRRFNMRMLVPGRPVKDATPPPVPAERPSYKEKFIPPELSMWDYFVAKPFLPLSDSGVIYDSDESIHSDEEDDAFFSDTQIQEHQDPNSYSWALLHLTMVKLALHNVKNFFPIAGLEFSELPVTSPLGIAVIKNLENWEQILQEKMDQFEGPPPNYINTYPTDLSVGAGPAILRNKAMLEPENTPFKSRDSSAFPVKRLWHFLVKQEVLQETFIRYIFTKKRKQSESIEEHVEQVNQNCIAEDCHIKVEADLGYPGGKAKVIHKESDMIMAFSVNKANCNEIVLASTHDVQELDVTSLLACQSYIWIGEEYDRESKSSDDVDYRGSTTTLYQPSATSYSASQVHPPSSLPWLGTGQTSTGASVLMKRNLHNVKRMTSHPVHQYYLTGAQDGSVRMFEWTRPQQLVCFRQAGNARVTRLYFNSQGNKCGVADGEGFLSIWQVNQTASNPKPYMSWQCHSKATSDFAFITSSSLVATSGHSNDNRNVCLWDTLISPGNSLIHGFTCHDHGATVLQYAPKQQLLISGGRKGHVCIFDIRQRQLIHTFQAHDSAIKALALDPYEEYFTTGSAEGNIKVWRLTGHGLIHSFKSEHAKQSIFRNIGAGVMQIDIIQGNRLFSCGADGTLKTRVLPNAFNIPNRILDIL

SEQ ID NO: 883850 - protein, 375 aa, Homo sapiens [sequence omitted]

SEQ ID NO: 883851 - protein, 1176 aa, Homo sapiens; identical to SEQ ID NO: 883849

SEQ ID NO: 883852 - protein, 1176 aa, Homo sapiens; identical to SEQ ID NO: 883849

SEQ ID NO: 883853 - protein, 791 aa, Homo sapiens
KLFFTTANAHFKVGCPVLALEVLSKIPKVTKTSALSAKKDQPDFISHRMDDVPSHSKALSDGNGSSGIEWSNVTSSQYDWSQPIVKVDEEPLNLDWGEDHDSALDEEEDDAVGLVMKSTDAREKDKQSDQKASDPNMLLTPQEEDDPEGDTEVDVIAEQLKFRACLKILMTELRTLATGYEVDGGKLRFQLYNWLEKEIAALHEICNHESVIKEYSSKTYSKVESDLLDQEEMVDKPDIGSYERHQIERRRLQAKREHAERRKSWLQKNQDLLRVFLSYCSLHGAQGGGLASVRMELKFLLQESQQETTVKQLQSPLPLPTTLPLLSASIASTKTVIANPVLYLNNHIHDILYTIVQMKTPPHPSIEDVKVHTLHSLAASLSASIYQALCDSHSYSSQTEGNQFTGMAYQGLLLSDRRRLRTESIEEHATPNSSPAQWPGVSSLINLLSSAQDEDQPKLNILLCEAVVAVYLSLLIHALATNSSSELFRLAAHPLNNRMWAAVFGGGVKLVVKPRRQSENISAPPVLSEDIDKHRRRFNMRMLVPGRPVKDATPPPVPAERPSYKEKFIPPELSMWDYFVAKPFLPLSDSGVIYDSDESIHSDEEDDAFFSDTQIQEHQDPNSYSWALLHLTMVKLALHNVKNFFPIAGLEFSELPVTSPLGIAVIKNLENWEQILQEKMDQFEGPPPNYINTYPTDLSVGAGPAILRNKAMLEPENTPFKSRDSSAFPVKRLWHFLVKQEVLQETFIRYIFTKKRKQSEVEADLGYPGGKAKVIHKESDMIMAFSVNKLF

SEQ ID NO: 883854 - protein, 1155 aa, Homo sapiens
KLFFTTANAHFKVGCPVLALEVLSKIPKVTKTSALSAKKDQPDFISHRMDDVPSHSKALSDGNGSSGIEWSNVTSSQYDWSQPIVKVDEEPLNLDWGEDHDSALDEEEDDAVGLVMKSTDAREKDKQSDQKASDPNMLLTPQEEDDPEGDTEVDVIAEQLKFRACLKILMTELRTLATGYEVDGGKLRFQLYNWLEKEIAALHEICNHESVIKEYSSKTYSKVESDLLDQEEMVDKPDIGSYERHQIERRRLQAKREHAERRKSWLQKNQDLLRVFLSYCSLHGAQGGGLASVRMELKFLLQESQQETTVKQLQSPLPLPTTLPLLSASIASTKTVIANPVLYLNNHIHDILYTIVQMKTPPHPSIEDVKVHTLHSLAASLSASIYQALCDSHSYSSQTEGNQFTGMAYQGLLLSDRRRLRTESIEEHATPNSSPAQWPGVSSLINLLSSAQDEDQPKLNILLCEAVVAVYLSLLIHALATNSSSELFRLAAHPLNNRMWAAVFGGGVKLVVKPRRQSENISAPPVLSEDIDKHRRRFNMRMLVPGRPVKDATPPPVPAERPSYKEKFIPPELSMWDYFVAKPFLPLSDSGVIYDSDESIHSDEEDDAFFSDTQIQEHQDPNSYSWALLHLTMVKLALHNVKNFFPIAGLEFSELPVTSPLGIAVIKNLENWEQILQEKMDQFEGPPPNYINTYPTDLSVGAGPAILRNKAMLEPENTPFKSRDSSAFPVKRLWHFLVKQEVLQETFIRYIFTKKRKQSEVEADLGYPGGKAKVIHKESDMIMAFSVNKANCNEIVLASTHDVQELDVTSLLACQSYIWIGEEYDRESKSSDDVDYRGSTTTLYQPSATSYSASQVHPPSSLPWLGTGQTSTGASVLMKRNLHNVKRMTSHPVHQYYLTGAQDGSVRMFEWTRPQQLVCFRQAGNARVTRLYFNSQGNKCGVADGEGFLSIWQVNQTASNPKPYMSWQCHSKATSDFAFITSSSLVATSGHSNDNRNVCLWDTLISPGNSLIHGFTCHDHGATVLQYAPKQQLLISGGRKGHVCIFDIRQRQLIHTFQAHDSAIKALALDPYEEYFTTGSAEGNIKVWRLTGHGLIHSFKSEHAKQSIFRNIGAGVMQIDIIQGNRLFSCGADGTLKTRVLPNAFNIPNRILDIL

SEQ ID NO: 883855 - protein, 1041 aa, Homo sapiens
KLFFTTANAHFKVGCPVLALEVLSKIPKVTKTSALSAKKDQPDFISHRMDDVPSHSKALSDGNGSSGIEWSNVTSSQYDWSQPIVKVDEEPLNLDWGEDHDSALDEEEDDAVGLVMKSTDAREKDKQSDQKASDPNMLLTPQEEDDPEGDTEVDVIAEQLKFRACLKILMTELRTLATGYEVDGGKLRFQLYNWLEKEIAALHEICNHESVIKEYSSKTYSKVESDLLDQEEMVDKPDIGSYERHQIERRRLQAKREHAERRKSWLQKNQDLLRVFLSYCSLHGAQGGGLASVRMELKFLLQESQQETTVKQLQSPLPLPTTLPLLSASIASTKTVIANPVLYLNNHIHDILYTIVQMKTPPHPSIEDVKVHTLHSLAASLSASIYQALCDSHSYSSQTEGNQFTGMAYQGLLLSDRRRLRTESIEEHATPNSSPAQWPGVSSLINLLSSAQDEDQPKLNILLCEAVVAVYLSLLIHALATNSSSELFRLAAHPLNNRMWAAVFGGGVKLVVKPRRQSENISAPPVLSEDIDKHRRRFNMRMLVPGRPVKDATPPPVPAERPSYKEKFIPPELSMWDYFVAKPFLPLSDSGVIYDSDESIHSDEEDDAFFSDTQIQEHQDPNSYSWALLHLTMVKLALHNVKNFFPIAGLEFSELPVTSPLGIAVIKNLENWEQILQEKMDQFEGPPPNYINTYPTDLSVGAGPAILRNKAMLEPENTPFKSRDSSAFPVKRLWHFLVKQEVLQETFIRYIFTKKRKQSESIEEHVEQVNQNCIAEDCHIKVEADLGYPGGKAKVIHKESDMIMAFSVNKANCNEIVLASTHDVQELDVTSLLACQSYIWIGEEYDRESKSSDDVDYRGSTTTLYQPSATSYSASQVHPPSSLPWLGTGQTSTGASVLMKRNLHNVKRMTSHPVHQYYLTGAQDGSVRMFEWTRPQQLVCFRQAGNARVTRLYFNSQGNKCGVADGEGFLSIWQVNQTASNPKPYMSWQCHSKATSDFAFITSSSLVATSGHSNDNRFHVPRSWCHGTAVCTQTATPNLGG

SEQ ID NO: 883856 - protein, 278 aa, Homo sapiens
MKRNLHNVKRMTSHPVHQYYLTGAQDGSVRMFEWTRPQQLVCFRQAGNARVTRLYFNSQGNKCGVADGEGFLSIWQVNQTASNPKPYMSWQCHSKATSDFAFITSSSLVATSGHSNDNRNVCLWDTLISPGNSLIHGFTCHDHGATVLQYAPKQQLLISGGRKGHVCIFDIRQRQLIHTFQAHDSAIKALALDPYEEYFTTGSAEGNIKVWRLTGHGLIHSFKSEHAKQSIFRNIGAGVMQIDIIQGNRLFSCGADGTLKTRVLPNAFNIPNRILDIL

SEQ ID NO: 883857 - protein, 1176 aa, Homo sapiens; identical to SEQ ID NO: 883849

SEQ ID NO: 883858 - protein, 762 aa, Homo sapiens
KLFFTTANAHFKVGCPVLALEVLSKIPKVTKTSALSAKKDQPDFISHRMDDVPSHSKALSDGNGSSGIEWSNVTSSQYDWSQPIVKVDEEPLNLDWGEDHDSALDEEEDDAVGLVMKSTDAREKDKQSDQKASDPNMLLTPQEEDDPEGDTEVDVIAEQLKFRACLKILMTELRTLATGYEVDGGKLRFQLYNWLEKEIAALHEICNHESVIKEYSSKTYSKVESDLLDQEEMVDKPDIGSYERHQIERRRLQAKREHAERRKSWLQKNQDLLRVFLSYCSLHGAQGGGLASVRMELKFLLQESQQETTVKQLQSPLPLPTTLPLLSASIASTKTVIANPVLYLNNHIHDILYTIVQMKTPPHPSIEDVKVHTLHSLAASLSASIYQALCDSHSYSSQTEGNQFTGMAYQGLLLSDRRRLRTESIEEHATPNSSPAQWPGVSSLINLLSSAQDEDQPKLNILLCEAVVAVYLSLLIHALATNSSSELFRLAAHPLNNRMWAAVFGGGVKLVVKPRRQSENISAPPVLSEDIDKHRRRFNMRMLVPGRPVKDATPPPVPAERPSYKEKFIPPELSMWDYFVAKPFLPLSDSGVIYDSDESIHSDEEDDAFFSDTQIQEHQDPNSYSWALLHLTMVKLALHNVKNFFPIAGLEFSELPVTSPLGIAVIKNLENWEQILQEKMDQFEGPPPNYINTYPTDLSVGAGPAILRNKAMLEPENTPFKSRDSSAFPVKRLWHFLVKQEVLQETFIRYIFTKKRKQSEVF

SEQ ID NO: 883859 - protein, 186 aa, Homo sapiens
METGAGGSGVPRPEGKGEVPRLRAGCSSPPPAFALKGAGWARRPRWLELGRWRRWPEAAVPPPPRPGAGGDPSERPRPPMRLLAGWLCLSLASVWLARRMWTLRSPLTRSLYVNMTSGPGGPAAAAGGRKENHQVRAGAGAGAGAWRPGLPALGPAIVRDGSARGRPGPRPSASAPWKVFPAPSPP

SEQ ID NO: 883860 - protein, 163 aa, Homo sapiens
MSRTSINGLLGRGSMFVFSPDQFQRLLKINPDWKTHRLLDLGAGDGEVTKIMSPHFEEIYATELSETMIWQLQKKKYRVLGINEWQNTGFQYDVISCLNLLDRCDQPLTLLKDIRSVLEPTRGRVILALVLPFHPYVENGRWQVGETIRNFGNQRTELGRTSE

SEQ ID NO: 883861 - protein, 139 aa, Homo sapiens
METGAGGSGVPRPEGKGEVPRLRAGCSSPPPAFALKGAGWARRPRWLELGRWRRWPEAAVPPPPRPGAGGDPSERPRPPMRLLAGWLCLSLASVWLARRMWTLRSPLTRSLYVNMTSVVCVQQREIMRITPGCLCSELP

SEQ ID NO: 883862 - protein, 353 aa, Homo sapiens
METGAGGSGVPRPEGKGEVPRLRAGCSSPPPAFALKGAGWARRPRWLELGRWRRWPEAAVPPPPRPGAGGDPSERPRPPMRLLAGWLCLSLASVWLARRMWTLRSPLTRSLYVNMTSGPGGPAAAAGGRKENHQWYVCNREKLCESLQAVFVQSYLDQGTQIFLNNSIEKSGWLFIQLYHSFVSSVFSLFMSRTSINGLLGRGSMFVFSPDQFQRLLKINPDWKTHRLLDLGAGDGEVTKIMSPHFEEIYATELSETMIWQLQKKKYRVLGINEWQNTGFQYDVISCLNLLDRCDQPLTLLKDIRSVLEPTRGRVILALVLPFHPYVENGRWQVGETIRNFGNQRTELGRTSE

SEQ ID NO: 883863 - protein, 353 aa, Homo sapiens; identical to SEQ ID NO: 883862

SEQ ID NO: 883864 - protein, 353 aa, Homo sapiens; identical to SEQ ID NO: 883862

SEQ ID NO: 883865 - protein, 353 aa, Homo sapiens; identical to SEQ ID NO: 883862

SEQ ID NO: 883866 - protein, 186 aa, Homo sapiens
METGAGGSGVPRPEGKGEVPRLRAGCSSPPPAFALKGAGWARRPRWLELGRWRRWPEAAVPPPPRPGAGGDPSERPRPPMRLLAGWLCLSLASVWLARRMWTLRSPLTRSLYVNMTSGPGGPAAAAGGRKENHQWYVCNREKLCESLQAVFVQSYLDQGTQIFLNNSIEKSGWLFIQLYQKCLGAN

SEQ ID NO: 883867 - protein, 340 aa, Homo sapiens
METGAGGSGVPRPEGKGEVPRLRAGCSSPPPAFALKGAGWARRPRWLELGRWRRWPEAAVPPPPRPGAGGDPSERPRPPMRLLAGWLCLSLASVWLARRMWTLRSPLTRSLYVNMTSGPGGPAAAAGGRKENHQWYVCNREKLCESLQAVFVQSYLDQGTQIFLNNSIEKSGWLFIQLYHSFVSSVFSLFMSRTSINGLLGRGSMFVFSPDQFQRLLKINPDWKTHRLLDLGAGDGEVTKIMSPHFEEIYATELSETMIWQLQKKKYRVLGINEWQNTGFQYDVISCLNLLDRCDQPLTLLKDIRSVLEPTRGRVILALVLPFHPYVENGVSVVSQASSY

SEQ ID NO: 883868 - protein, 239 aa, Homo sapiens
METGAGGSGVPRPEGKGEVPRLRAGCSSPPPAFALKGAGWARRPRWLELGRWRRWPEAAVPPPPRPGAGGDPSERPRPPMRLLAGWLCLSLASVWLARRMWTLRSPLTRSLYVNMTSGPGGPAAAAGGRKENHQWYVCNREKLCESLQAVFVQSYLDQGTQIFLNNSIEKSGWLFIQLYHSFVSSVFSLFMSRTSINGLLGRGSMFVFSPDQFQRLLKINPDWKTHRLLHLQHLNPDWK

SEQ ID NO: 883869 - protein, 353 aa, Homo sapiens; identical to SEQ ID NO: 883862

SEQ ID NO: 883870 - protein, 234 aa, Homo sapiens
MDRKTTSWDTKFYEKWYVCNREKLCESLQAVFVQSYLDQGTQIFLNNSIEKSGWLFIQLYHSFVSSVFSLFMSRTSINGLLGRGSMFVFSPDQFQRLLKINPDWKTHRLLDLGAGDGEVTKIMSPHFEEIYATELSETMIWQLQKKKYRVLGINEWQNTGFQYDVISCLNLLDRCDQPLTLLKDIRSVLEPTRGRVILALVLPFHPYVENGRWQVGETIRNFGNQRTELGRTSE

SEQ ID NO: 883871 - protein, 163 aa, Homo sapiens; identical to SEQ ID NO: 883860

SEQ ID NO: 883872 - protein, 149 aa, Homo sapiens
MFVFSPDQFQRLLKINPDWKTHRLLDLGAGDGEVTKIMSPHFEEIYATELSETMIWQLQKKKYRVLGINEWQNTGFQYDVISCLNLLDRCDQPLTLLKDIRSVLEPTRGRVILALVLPFHPYVENGRWQVGETIRNFGNQRTELGRTSE

SEQ ID NO: 883873 - protein, 283 aa, Homo sapiens
METGAGGSGVPRPEGKGEVPRLRAGCSSPPPAFALKGAGWARRPRWLELGRWRRWPEAAVPPPPRPGAGGDPSERPRPPMRLLAGWLCLSLASVWLARRMWTLRSPLTRSLYVNMTSGPGGPAAAAGGRKENHQWYVCNREKLCESLQAVFVQSYLDQGTQIFLNNSIEKSGWLFIQLYHSFVSSVFSLFMSRTSINGVLGINEWQNTGFQYDVISCLNLLDRCDQPLTLLKDIRSVLEPTRGRVILALVLPFHPYVENGRWQVGETIRNFGNQRTELGRTSE

SEQ ID NO: 883874 - protein, 159 aa, Homo sapiens
METGAGGSGVPRPEGKGEVPRLRAGCSSPPPAFALKGAGWARRPRWLELGRWRRWPEAAVPPPPRPGAGGDPSERPRPPMRLLAGWLCLSLASVWLARRMWTLRSPLTRSRCLCSQTSINTWRSKSSESAPSGMCPWKRVCVHNYVKGGPLGTAILNIM

SEQ ID NO: 883875 - protein, 271 aa, Homo sapiens
METGAGGSGVPRPEGKGEVPRLRAGCSSPPPAFALKGAGWARRPRWLELGRWRRWPEAAVPPPPRPGAGGDPSERPRPPMRLLAGWLCLSLASVWLARRMWTLRSPLTRSLYVNMTSGPGGPAAAAGGRKENHQWYVCNREKLCESLQAVFVQSYLDQGTQIFLNNSIEKSGWLFIQLYHSFVSSVFSLFMSRTSINGLLGRGSMFVFSPDQFQRLLKINPDWKTHRLLDLGAGDGEVTKIMSPHFEEIYATELSETMIWQLQKKKYRSLV

SEQ ID NO: 883876 - protein, 389 aa, Homo sapiens
SHWQRRDRRCVRNMAERGRKRPCGPGEHGQRIEWRKWKQQKKEEKKKWKDLKLMKKLERQRAQEEQAKRLEEEEAAAEKEDRGRPYTLSVALPGSILDNAQSPELRTYLAGQIARACAIFCVDEIVVFDEEGQDAKTVEGEFTGVGKKGQACVQLARILQYLECPQYLRKAFFPKHQDLQFAGLLNPLDSPHHMRQDEESEFREGIVVDRPTRPGHGSFVNCGMKKEVKIDKNLEPGLRVTVRLNQQQHPDCKTYHGKVVSSQDPRTKAGLYWGYTVRLASCLSAVFAEAPFQDGYDLTIGTSERGSDVASAQLPNFRHALVVFGGLQGLEAGADADPNLEVAEPSVLFDLYVNTCPGQGSRTIRTEEAILISLAALQPGLIQAGARHT

SEQ ID NO: 883877 - protein, 389 aa, Homo sapiens; identical to SEQ ID NO: 883876

SEQ ID NO: 883878 - protein, 389 aa, Homo sapiens; identical to SEQ ID NO: 883876

SEQ ID NO: 883879 - protein, 364 aa, Homo sapiens
VLRIPVIFYTRNGAQKKEEKKKWKDLKLMKKLERQRAQEEQAKRLEEEEAAAEKEDRGRPYTLSVALPGSILDNAQSPELRTYLAGQIARACAIFCVDEIVVFDEEGQDAKTVEGEFTGVGKKGQACVQLARILQYLECPQYLRKAFFPKHQDLQFAGLLNPLDSPHHMRQDEESEFREGIVVDRPTRPGHGSFVNCGMKKEVKIDKNLEPGLRVTVRLNQQQHPDCKTYHGKVVSSQDPRTKAGLYWGYTVRLASCLSAVFAEAPFQDGYDLTIGTSERGSDVASAQLPNFRHALVVFGGLQGLEAGADADPNLEVAEPSVLFDLYVNTCPGQGSRTIRTEEAILISLAALQPGLIQAGARHT

SEQ ID NO: 883880 - protein, 315 aa, Homo sapiens
LGTSLPCSGRPYTLSVALPGSILDNAQSPELRTYLAGQIARACAIFCVDEIVVFDEEGQDAKTVEGEFTGVGKKGQACVQLARILQYLECPQYLRKAFFPKHQDLQFAGLLNPLDSPHHMRQDEESEFREGIVVDRPTRPGHGSFVNCGMKKEVKIDKNLEPGLRVTVRLNQQQHPDCKTYHGKVVSSQDPRTKAGLYWGYTVRLASCLSAVFAEAPFQDGYDLTIGTSERGSDVASAQLPNFRHALVVFGGLQGLEAGADADPNLEVAEPSVLFDLYVNTCPGQGSRTIRTEEAILISLAALQPGLIQAGARHT

SEQ ID NO: 883881 - protein, 81 aa, Homo sapiens
TRRLSISPHRGDSREKRGQIQGLLLPMGRGEMVRGTRQVFGCGGGMRGLEAGKLTGLPRNQMSRELVLTQSLGQAWPCEWQ

SEQ ID NO: 883882 - protein, 233 aa, Homo sapiens
APGSPLHPVCPSTSQTLPGSASTGLLNPLDSPHHMRQDEESEFREGIVVDRPTRPGHGSFVNCGMKKEVKIDKNLEPGLRVTVRLNQQQHPDCKTYHGKVVSSQDPRTKAGLYWGYTVRLASCLSAVFAEAPFQDGYDLTIGTSERGSDVASAQLPNFRHALVVFGGLQGLEAGADADPNLEVAEPSVLFDLYVNTCPGQGSRTIRTEGSLPNLPWAACTLGLTQAGCPGTPE

SEQ ID NO: 883883 - protein, 389 aa, Homo sapiens; identical to SEQ ID NO: 883876

SEQ ID NO: 883884 - protein, 392 aa, Homo sapiens
SHWQRRDRRCVRNMAERGRKRPCGPGEHGQRIEWRKWKQQKKEEKKKWKDLKLMKKLERQRAQEEQAKRLEEEEAAAEKEDRGRPYTLSVALPGSILDNAQSPELRTYLAGQIARACAIFCVDEIVVFDEEGQDAKTVEGEFTGVGKKGQACVQLARILQYLECPQYLRKAFFPKHQDLQFAGLLNPLDSPHHMRQDEESEFREGIVVDRPTRPGHGSFVNCGMKKEVKIDKNLEPGLRVTVRLNQQQHPDCKTYHGKVVSSQDPRTKAGLYWGYTVRLASCLSAVFAEAPFQDGYDLTIGTSERGSDVASAQLPNFRHALVVFGGLQGLEAGADADPNLEVAEPSVLFDLYVNTCPGQGSRTIRTEGSLPNLPWAACTLGLTQAGCPGTPE

SEQ ID NO: 883885 - protein, 230 aa, Homo sapiens
APGSPLHPVCPSTSQTLPGSASTGLLNPLDSPHHMRQDEESEFREGIVVDRPTRPGHGSFVNCGMKKEVKIDKNLEPGLRVTVRLNQQQHPDCKTYHGKVVSSQDPRTKAGLYWGYTVRLASCLSAVFAEAPFQDGYDLTIGTSERGSDVASAQLPNFRHALVVFGGLQGLEAGADADPNLEVAEPSVLFDLYVNTCPGQGSRTIRTEEAILISLAALQPGLIQAGARHT

SEQ ID NO: 883886 - protein, 965 aa, Homo sapiens
RAPPLTGSGLNQSSRTGGDRSHLLAPRTGLHQPQFRGCGSQKSNLPGTPAPTPARGPSNPPATMKIAVIGQSLFGQEVYCHLRKEGHEVVGVFTVPDKDGKADPLGLEAEKDGVPVFKYSRWRAKGQALPDVVAKYQALGAELNVLPFCSQFIPMEIISAPRHGSIIYHPSLLPRHRGASAINWTLIHGDKKGGFSIFWADDGLDTGDLLLQKECEVLPDDTVSTLYNRFLFPEGIKGMVQAVRLIAEGKAPRLPQPEEGATYEGIQKKETAKINWDQPAEAIHNWIRGNDKVPGAWTEACEQKLTFFNSTLNTSGLVPEGDALPIPGAHRPGVVTKAGLILFGNDDKMLLVKNIQLEDGKMILASNFFKGAASSVLELTEAELVTAEAVRSVWQRILPKVLEVEDSTDFFKSGAASVDVVRLVEEVKELCDGLELENEDVYMASTFGDFIQLLVRKLRGDDEEGECSIDYVEMAVNKRTVRMPHQLFIGGEFVDAEGAKTSETINPTDGSVICQVSLAQVTDVDKAVAAAKDAFENGRWGKISARDRGRLMYRLADLMEQHQEELATIEALDAGAVYTLALKTHVGMSIQTFRYFAGWCDKIQGSTIPINQARPNRNLTLTRKEPVGVCGIIIPWNYPLMMLSWKTAACLAAGNTVVIKPAQVTPLTALKFAELTLKAGIPKGVVNVLPGSGSLVGQRLSDHPDVRKIGFTGSTEVGKHIMKSCAISNVKKVSLELGGKSPLIIFADCDLNKAVQMGMSSVFFNKGENCIAAGRLFVEDSIHDEFVRRVVEEVRKMKVGNPLDRDTDHGPQNHHAHLVKLMEYCQHGVKEGATLVCGGNQVPRPGFFFEPTVFTDVEDHMFIAKEESFGPVMIISRFADGDLDAVLSRANATEFGLASGVFTRDINKALYVSDKLQAGTVFVNTYNKTDVAAPFGGFKQSGFGKDLGEAALNEYLRVKTVTFEY

SEQ ID NO: 883887 - protein, 149 aa, Homo sapiens
EHFEGLRPPVNLCSPGGGLLPPQHQGDPLIPPSLPPTGSLVGQRLSDHPDVRKIGFTGSTEVGKHIMKEVRGWGWSRGGAAVGCAWDMAVLSQELCPASQAPGHSHFRGPAGLYANAEEASAFLAKPRGGLGGDLWSPVRPARGWIERC

SEQ ID NO: 883888 - protein, 948 aa, Homo sapiens
RAPPLTGSGLNQSSRTGGDRSHLLAPRTGLHQPQFRGCGSQKSNLPGTPAPTPARGPSNPPATMKIAVIGQSLFGQEVYCHLRKEGHEVVGVFTVPDKDGKADPLGLEAEKDGVPVFKYSRWRAKGQALPDVVAKYQALGAELNVLPFCSQFIPMEIISAPRHGSIIYHPSLLPRHRGASAINWTLIHGDKKGGFSIFWADDGLDTGDLLLQKECEVLPDDTVSTLYNRFLFPEGIKGMVQAVRLIAEGKAPRLPQPEEGATYEGIQKKETAKINWDQPAEAIHNWIRGNDKVPGAWTEACEQKLTFFNSTLNTSGLVPEGDALPIPGAHRPGVVTKAGLILFGNDDKMLLVKNIQLEDGKMILASNFFKGAASSVLELTEAELVTAEAVRSVWQRILPKVLEVEDSTDFFKSGAASVDVVRLVEEVKELCDGLELENEDVYMASTFGDFIQLLVRKLRGDDEEGECSIDYVEMAVNKRTVRMPHQLFIGGEFVDAEGAKTSETINPTDGSVICQVSLAQVTDVDKAVAAAKDAFENGRWGKISARDRGRLMYRLADLMEQHQEELATIEALDAGAVYTLALKTHVGMSIQTFRYFAGWCDKIQGSTIPINQARPNRNLTLTRKEPVGVCGIIIPWNYPLMMLSWKTAACLAAGNTVVIKPAQVTPLTALKFAELTLKAGIPKGVVNVLPGSGSLVGQRLSDHPDVRKIGFTGSTEVGKHIMKSPLIIFADCDLNKAVQMGMSSVFFNKGENCIAAGRLFVEDSIHDEFVRRVVEEVRKMKVGNPLDRDTDHGPQNHHAHLVKLMEYCQHGVKEGATLVCGGNQVPRPGFFFEPTVFTDVEDHMFIAKEESFGPVMIISRFADGDLDAVLSRANATEFGLASGVFTRDINKALYVSDKLQAGTVFVNTYNKTDVAAPFGGFKQSGFGKDLGEAALNEYLRVKTVTFEY

SEQ ID NO: 883889 - protein, 788 aa, Homo sapiens
RDLWSHGLSGRAAQSPGQLVLLRGRVAGYGPEPTAAGGARGSYVRAACPCPRTGWQGRPQAEVQAVRLIAEGKAPRLPQPEEGATYEGIQKKETAKINWDQPAEAIHNWIRGNDKVPGAWTEACEQKLTFFNSTLNTSGLVPEGDALPIPGAHRPGVVTKAGLILFGNDDKMLLVKNIQLEDGKMILASNFFKGAASSVLELTEAELVTAEAVRSVWQRILPKVLEVEDSTDFFKSGAASVDVVRLVEEVKELCDGLELENEDVYMASTFGDFIQLLVRKLRGDDEEGECSIDYVEMAVNKRTVRMPHQLFIGGEFVDAEGAKTSETINPTDGSVICQVSLAQVTDVDKAVAAAKDAFENGRWGKISARDRGRLMYRLADLMEQHQEELATIEALDAGAVYTLALKTHVGMSIQTFRYFAGWCDKIQGSTIPINQARPNRNLTLTRKEPVGVCGIIIPWNYPLMMLSWKTAACLAAGNTVVIKPAQVTPLTALKFAELTLKAGIPKGVVNVLPGSGSLVGQRLSDHPDVRKIGFTGSTEVGKHIMKSCAISNVKKVSLELGGKSPLIIFADCDLNKAVQMGMSSVFFNKGENCIAAGRLFVEDSIHDEFVRRVVEEVRKMKVGNPLDRDTDHGPQNHHAHLVKLMEYCQHGVKEGATLVCGGNQVPRPGFFFEPTVFTDVEDHMFIAKEESFGPVMIISRFADGDLDAVLSRANATEFGLASGVFTRDINKALYVSDKLQAGTVFVNTYNKTDVAAPFGGFKQSGFGKDLGEAALNEYLRVKTVTFEY

SEQ ID NO: 883890 - protein, 727 aa, Homo sapiens
MVQAVRLIAEGKAPRLPQPEEGATYEGIQKKETAKINWDQPAEAIHNWIRGNDKVPGAWTEACEQKLTFFNSTLNTSGLVPEGDALPIPGAHRPGVVTKAGLILFGNDDKMLLVKNIQLEDGKMILASNFFKGAASSVLELTEAELVTAEAVRSVWQRILPKVLEVEDSTDFFKSGAASVDVVRLVEEVKELCDGLELENEDVYMASTFGDFIQLLVRKLRGDDEEGECSIDYVEMAVNKRTVRMPHQLFIGGEFVDAEGAKTSETINPTDGSVICQVSLAQVTDVDKAVAAAKDAFENGRWGKISARDRGRLMYRLADLMEQHQEELATIEALDAGAVYTLALKTHVGMSIQTFRYFAGWCDKIQGSTIPINQARPNRNLTLTRKEPVGVCGIIIPWNYPLMMLSWKTAACLAAGNTVVIKPAQVTPLTALKFAELTLKAGIPKGVVNVLPGSGSLVGQRLSDHPDVRKIGFTGSTEVGKHIMKSCAISNVKKVSLELGGKSPLIIFADCDLNKAVQMGMSSVFFNKGENCIAAGRLFVEDSIHDEFVRRVVEEVRKMKVGNPLDRDTDHGPQNHHAHLVKLMEYCQHGVKEGATLVCGGNQVPRPGFFFEPTVFTDVEDHMFIAKEESFGPVMIISRFADGDLDAVLSRANATEFGLASGVFTRDINKALYVSDKLQAGTVFVNTYNKTDVAAPFGGFKQSGFGKDLGEAALNEYLRVKTVTFEY

SEQ ID NO: 883891 - protein, 918 aa, Homo sapiens
NCCLIPSPGPSNPPATMKIAVIGQSLFGQEVYCHLRKEGHEVVGVFTVPDKDGKADPLGLEAEKDGVPVFKYSRWRAKGQALPDVVAKYQALGAELNVLPFCSQFIPMEIISAPRHGSIIYHPSLLPRHRGASAINWTLIHGDKKGGFSIFWADDGLDTGDLLLQKECEVLPDDTVSTLYNRFLFPEGIKGMVQAVRLIAEGKAPRLPQPEEGATYEGIQKKETAKINWDQPAEAIHNWIRGNDKVPGAWTEACEQKLTFFNSTLNTSGLVPEGDALPIPGAHRPGVVTKAGLILFGNDDKMLLVKNIQLEDGKMILASNFFKGAASSVLELTEAELVTAEAVRSVWQRILPKVLEVEDSTDFFKSGAASVDVVRLVEEVKELCDGLELENEDVYMASTFGDFIQLLVRKLRGDDEEGECSIDYVEMAVNKRTVRMPHQLFIGGEFVDAEGAKTSETINPTDGSVICQVSLAQVTDVDKAVAAAKDAFENGRWGKISARDRGRLMYRLADLMEQHQEELATIEALDAGAVYTLALKTHVGMSIQTFRYFAGWCDKIQGSTIPINQARPNRNLTLTRKEPVGVCGIIIPWNYPLMMLSWKTAACLAAGNTVVIKPAQVTPLTALKFAELTLKAGIPKGVVNVLPGSGSLVGQRLSDHPDVRKIGFTGSTEVGKHIMKSCAISNVKKVSLELGGKSPLIIFADCDLNKAVQMGMSSVFFNKGENCIAAGRLFVEDSIHDEFVRRVVEEVRKMKVGNPLDRDTDHGPQNHHAHLVKLMEYCQHGVKEGATLVCGGNQVPRPGFFFEPTVFTDVEDHMFIAKEESFGPVMIISRFADGDLDAVLSRANATEFGLASGVFTRDINKALYVSDKLQAGTVFVNTYNKTDVAAPFGGFKQSGFGKDLGEAALNEYLRVKTVTFEY

SEQ ID NO: 883892 - protein, 345 aa, Homo sapiens
TRRGRVRQVCGIIIPWNYPLMMLSWKTAACLAAGNTVVIKPAQVTPLTALKFAELTLKAGIPKGVVNVLPGSGSLVGQRLSDHPDVRKIGFTGSTEVGKHIMKSCAISNVKKVSLELGGKSPLIIFADCDLNKAVQMGMSSVFFNKGENCIAAGRLFVEDSIHDEFVRRVVEEVRKMKVGNPLDRDTDHGPQNHHAHLVKLMEYCQHGVKEGATLVCGGNQVPRPGFFFEPTVFTDVEDHMFIAKEESFGPVMIISRFADGDLDAVLSRANATEFGLASGVFTRDINKALYVSDKLQAGTVFVNTYNKTDVAAPFGGFKQSGFGKDLGEAALNEYLRVKTVTFEY

SEQ ID NO: 883893 - protein, 398 aa, Homo sapiens
RAPPLTGSGLNQSSRTGGDRSHLLAPRTGLHQPQFRGCGSQKSNLPGTPAPTPARGPSNPPATMKIAVIGQSLFGQEVYCHLRKEGHEVVGVFTVPDKDGKADPLGLEAEKDGVPVFKYSRWRAKGQALPDVVAKYQALGAELNVLPFCSQFIPMEIISAPRHGSIIYHPSLLPRHRGASAINWTLIHGDKKGGFSIFWADDGLDTGDLLLQKECEVLPDDTVSTLYNRFLFPEGIKGMVQAVRLIAEGKAPRLPQPEEGATYEGIQKKETAKINWDQPAEAIHNWIRGNDKVPGAWTEACEQKLTFFNSTLNTSGLVPEGDALPIPGAHRPGVVTKAGLILFGNDDKMVRARLWVTCLLKATHAPVLGLRPHRKTLGSSGENGKNQTQEGTLTLICP

SEQ ID NO: 883894 - protein, 459 aa, Homo sapiens
RAPPLTGSGLNQSSRTGGDRSHLLAPRTGLHQPQFRGCGSQKSNLPGTPAPTPARGPSNPPATMKIAVIGQSLFGQEVYCHLRKEGHEVVGVFTVPDKDGKADPLGLEAEKDGVPVFKYSRWRAKGQALPDVVAKYQALGAELNVLPFCSQFIPMEIISAPRHGSIIYHPSLLPRHRGASAINWTLIHGDKKGGFSIFWADDGLDTGDLLLQKECEVLPDDTVSTLYNRFLFPEGIKGMVQAVRLIAEGKAPRLPQPEEGATYEGIQKKETAKINWDQPAEAIHNWIRGNDKVPGAWTEACEQKLTFFNSTLNTSGLVPEGDALPIPGAHRPGVVTKAGLILFGNDDKMLLVKNIQLEDGKMILASNFFKGAASSVLELTEAELVTAEAVRSVWQRILPKVLEVEDSTDFFKSGAASVDVVRLVEEVKELCDGLELENEDVYMASTFGDFIHQKQPLAG

SEQ ID NO: 883895 - protein, 322 aa, Homo sapiens
RAPPLTGSGLNQSSRTGGDRSHLLAPRTGLHQPQFRGCGSQKSNLPGTPAPTPARGPSNPPATMKIAVIGQSLFGQEVYCHLRKEGHEVVGVFTVPDKDGKADPLGLEAEKDGVPVFKYSRWRAKGQALPDVVAKYQALGAELNVLPFCSQFIPMEIISAPRHGSIIYHPSLLPRHRGASAINWTLIHGDKKGGFSIFWADDGLDTGDLLLQKECEVLPDDTVSTLYNRFLFPEGIKGMVQAVRLIAEGKAPRLPQPEEGATYEGIQKKETAKINWDQPAEAIHNWIRGNDKVPGAWTEACEQVCPCMAGIQPRALVYPTGH

SEQ ID NO: 883896 - protein, 66 aa, Homo sapiens
VSTRVQDISLSSVSNPRMSSTEQEWPMRPGDVAAPFGGFKQSGFGKDLGEAALNEYLRVKTVTFEY

SEQ ID NO: 883897 - protein, 88 aa, Homo sapiens
GLLAPARGQAGRDGHRQRCCPGMQQEGRRPWGALAVWAQQEEQLQCPLSPRPPQLLATAFYFSVVLNLSSPQIDQLTKIVNKVELLEI

SEQ ID NO: 883898 - protein, 238 aa, Homo sapiens
SGLSGDPPSPTWRRPVGAGSFASRFGQGGGLGFRQVVFSFTMFGDLFEEEYSTVSNNQYGKGKKLKTKALEPPAPREFTNLSGIRNQGGTCYLNSLLQTLHFTPEFREALFSLGPEELGLFEDKDKPDAKVRIIPLQLQRLFAQLLLLDQEAASTADLTDSFGWTSNEEMRQHDVQELNRILFSALETSLVGTSGHDLIYRLYHGTIVNQIVCKECKNVSERQVNMPEYFSNKLCCKL

SEQ ID NO: 883899 - protein, 295 aa, Homo sapiens
SGLSGDPPSPTWRRPVGAGSFASRFGHGGGLGFRQVVFSFTMFGDLFEEEYSTVSNNQYGKGKKLKTKALEPPAPREFTNLSGIRNQGGTCYLNSLLQTLHFTPEFREALFSLGPEELGLFEDKDKPDAKVRIIPLQLQRLFAQLLLLDQEAASTADLTDSFGWTSNEEMRQHDVQELNRILFSALETSLVGTSGHDLIYRLYVAQVLKKLAVFDTWSSLAVHIAMDNTVVMEESEGCAGQQYPVQAPLRILQIPDRALATDSLPELRSPNRTSANGDPWYFSSPGLGLTEINEA

SEQ ID NO: 883900 - protein, 78 aa, Homo sapiens
YSPQSQGHNCLPRARSPPASCRAIKPGLSHPVPLCHIVPAQAATSFLFSRTEEVPYHVWGGSAVYREWDLHFRSSFQD

SEQ ID NO: 883901 - protein, 1277 aa, Homo sapiens
SGLSGDPPSPTWRRPVGAGSFASRFGQGGGLGFRQVVFSFTMFGDLFEEEYSTVSNNQYGKGKKLKTKALEPPAPREFTNLSGIRNQGGTCYLNSLLQTLHFTPEFREALFSLGPEELGLFEDKDKPDAKVRIIPLQLQRLFAQLLLLDQEAASTADLTDSFGWTSNEEMRQHDVQELNRILFSALETSLVGTSGHDLIYRLYHGTIVNQIVCKECKNVSERQEDFLDLTVAVKNVSGLEDALWNMYVEEEVFDCDNLYHCGTCDRLVKAAKSAKLRKLPPFLTVSLLRFNFDFVKCERYKETSCYTFPLRINLKPFCEQSELDDLEYIYDLFSVIIHKGGCYGGHYHVYIKDVDHLGNWQFQEEKSKPDVNLKDLQSEEEIDHPLMILKAILLEEENNLIPVDQLGQKLLKKIGISWNKKYRKQHGPLRKFLQLHSQIFLLSSDESTVRLLKNSSLQAESDFQRNDQQIFKMLPPESPGLNNSISCPHWFDINDSKVQPIREKDIEQQFQGKESAYMLFYRKSQLQRPPEARANPRYGVPCHLLNEMDAANIELQTKRAECDSANNTFELHLHLGPQYHFFNGALHPVVSQTESVWDLTFDKRKTLGDLRQSIFQLLEFWEGDMVLSVAKLVPAGLHIYQSLGGDELTLCETEIADGEDIFVWNGVEVGGVHIQTGIDCEPLLLNVLHLDTSSDGEKCCQVIESPHVFPANAEVGTVLTALAIPAGVIFINSAGCPGGEGWTAIPKEDMRKTFREQGLRNGSSILIQDSHDDNSLLTKEEKWVTSMNEIDWLHVKNLCQLESEEKQVKISATVNTMVFDIRIKAIKELKLMKELADNSCLRPIDRNGKLLCPVPDSYTLKEAELKMGSSLGLCLGKAPSSSQLFLFFAMGSDVQPGTEMEIVVEETISVRDCLKLMLKKSGLQGDAWHLRKMDWCYEAGEPLCEEDATLKELLICSGDTLLLIEGQLPPLGFLKVPIWWYQLQGPSGHWESHQDQTNCTSSWGRVWRATSSQGASGNEPAQVSLLYLGDIEISEDATLAELKSQAMTLPPFLEFGVPSPAHLRAWTVERKRPGRLLRTDRQPLREYKLGRRIEICLEPLQKGENLGPQDVLLRTQVRIPGERTYAPALDLVWNAAQGGTAGSLRQRVADFYRLPVEKIEIAKYFPEKFEWLPISSWNQQITKRKKKKKQDYLQGAPYYLKDGDTIGVKNLLIDDDDDFSTIRDDTGKEKQKQRALGRRKSQEALHEQSSYILSSAETPARPRAPETSLSIHVGSFR

SEQ ID NO: 883902 - protein, 1277 aa, Homo sapiens; identical to SEQ ID NO: 883901

SEQ ID NO: 883903 - protein, 1183 aa, Homo sapiens
SGLSGDPPSPTWRRPVGAGSFASRFGQGGGLGFRQVVFSFTMFGDLFEEEYSTVSNNQYGKGKKLKTKALEPPAPREFTNLSGIRNQGGTCYLNSLLQTLHFTPEFREALFSLGPEELGLFEDKDKPDAKVRIIPLQLQRLFAQLLLLDQEAASTADLTDSFGWTSNEEMRQHDVQELNRILFSALETSLVGTSGHDLIYRLYHGTIVNQIVCKECKNVSERQEDFLDLTVAVKNVSGLEDALWNMYVEEEVFDCDNLYHCGTCDRLVKAAKSAKLRKLPPFLTVSLLRFNFDFVKCERYKETSCYTFPLRINLKPFCEQSELDDLEYIYDLFSVIIHKGGCYGGHYHVYIKDVDHLGNWQFQEEKSKPDVNLKDLQSEEEIDHPLMILKAILLEEENNLIPVDQLGQKLLKKIGISWNKKYRKQHGPLRKFLQLHSQIFLLSSDESTVRLLKNSSLQAESDFQRNDQQIFKMLPPESPGLNNSISCPHWFDINDSKVQPIREKDIEQQFQGKESAYMLFYRKSQLQRPPEARANPRYGVPCHLLNEMDAANIELQTKRAECDSANNTFELHLHLGPQYHFFNGALHPVVSQTESVWDLTFDKRKTLGDLRQSIFQLLEFWEGDMVLSVAKLVPAGLHIYQSLGGRVGQAIPKEDMRKTFREQGLRNGSSILIQDSHDDNSLLTKEEKWVTSMNEIDWLHVKNLCQLESEEKQVKISATVNTMVFDIRIKAIKELKLMKELADNSCLRPIDRNGKLLCPVPDSYTLKEAELKMGSSLGLCLGKAPSSSQLFLFFAMGSDVQPGTEMEIVVEETISVRDCLKLMLKKSGLQGDAWHLRKMDWCYEAGEPLCEEDATLKELLICSGDTLLLIEGQLPPLGFLKVPIWWYQLQGPSGHWESHQDQTNCTSSWGRVWRATSSQGASGNEPAQVSLLYLGDIEISEDATLAELKSQAMTLPPFLEFGVPSPAHLRAWTVERKRPGRLLRTDRQPLREYKLGRRIEICLEPLQKGENLGPQDVLLRTQVRIPGERTYAPALDLVWNAAQGGTAGSLRQRVADFYRLPVEKIEIAKYFPEKFEWLPISSWNQQITKRKKKKKQDYLQGAPYYLKDGDTIGVKNLLIDDDDDFSTIRDDTGKEKQKQRALGRRKSQEALHEQSSYILSSAETPARPRAPETSLSIHVGSFR

SEQ ID NO: 883904 - protein, 411 aa, Homo sapiens
MGSSLGLCLGKAPSSSQLFLFFAMGSDVQPGTEMEIVVEETISVRDCLKLMLKKSGLQGDAWHLRKMDWCYEAGEPLCEEDATLKELLICSGDTLLLIEGQLPPLGFLKVPIWWYQLQGPSGHWESHQDQTNCTSSWGRVWRATSSQGASGNEPAQVSLLYLGDIEISEDATLAELKSQAMTLPPFLEFGVPSPAHLRAWTVERKRPGRLLRTDRQPLREYKLGRRIEICLEPLQKGENLGPQDVLLRTQVRIPGERTYAPALDLVWNAAQGGTAGSLRQRVADFYRLPVEKIEIAKYFPEKFEWLPISSWNQQITKRKKKKKQDYLQGAPYYLKDGDTIGVKNLLIDDDDDFSTIRDDTGKEKQKQRALGRRKSQEALHEQSSYILSSAETPARPRAPETSLSIHVGSFR

SEQ ID NO: 883905 - protein, 231 aa, Homo sapiens [sequence omitted]

SEQ ID NO: 883906 - protein, 193 aa, Homo sapiens
MPQVTTWFCLFVWIWRLTVFWYSPQDVLLRTQVRIPGERTYAPALDLVWNAAQGGTAGSLRQRVADFYRLPVEKIEIAKYFPEKFEWLPISSWNQQITKRKKKKKQDYLQGAPYYLKDGDTIGVKNLLIDDDDDFSTIRDDTGKEKQKQRALGRRKSQEALHEQSSYILSSAETPARPRAPETSLSIHVGSFR

SEQ ID NO: 883907 - protein, 73 aa, Homo sapiens
VLGSRGLQLLPSTAPQPLFLCGSGAGRAVADRPGIAQVPGFLGMGTGCLAPPIPNPLLPLSTGTAPLRPGQCM

SEQ ID NO: 883908 - protein, 845 aa, Homo sapiens
SGLSGDPPSPTWRRPVGAGSFASRFGQGGGLGFRQVVFSFTMFGDLFEEEYSTVSNNQYGKGKKLKTKALEPPAPREFTNLSGIRNQGGTCYLNSLLQTLHFTPEFREALFSLGPEELGLFEDKDKPDAKVRIIPLQLQRLFAQLLLLDQEAASTADLTDSFGWTSNEEMRQHDVQELNRILFSALETSLVGTSGHDLIYRLYHGTIVNQIVCKECKNVSERQEDFLDLTVAVKNVSGLEDALWNMYVEEEVFDCDNLYHCGTCDRLVKAAKSAKLRKLPPFLTVSLLRFNFDFVKCERYKETSCYTFPLRINLKPFCEQSELDDLEYIYDLFSVIIHKGGCYGGHYHVYIKDVDHLGNWQFQEEKSKPDVNLKDLQSEEEIDHPLMILKAILLEEENNLIPVDQLGQKLLKKIGISWNKKYRKQHGPLRKFLQLHSQIFLLSSDESTVRLLKNSSLQAESDFQRNDQQIFKMLPPESPGLNNSISCPHWFDINDSKVQPIREKDIEQQFQGKESAYMLFYRKSQLQRPPEARANPRYGVPCHLLNEMDAANIELQTKRAECDSANNTFELHLHLGPQYHFFNGALHPVVSQTESVWDLTFDKRKTLGDLRQSIFQLLEFWEGDMVLSVAKLVPAGLHIYQSLGGDELTLCETEIADGEDIFVWNGVEVGGVHIQTGIDCEPLLLNVLHLDTSSDGEKCCQVIESPHVFPANAEVGTVLTALAIPAGVIFINSAGCPGGEGWTAIPKEDMRKTFREQGLRNGSSILIQDSHDDNSLLTKEEKWVTSMNEIDWLHVKNLCQLESEEKQVKISATVNTMVFDIRIKAIKELKLMKELGNHLHFLFGS

SEQ ID NO: 883909 - protein, 147 aa, Homo sapiens
MEEPQTKTPSAEFPPYRAQPAQPATAPAATFATLAICPEPAPTSGPGQPCTAAMGSELETAMETLINVFHAHSGKEGDKYKLSKKELKELLQTELSGFLDAQKDVDAVDKVMKELDENGDGEVDFQEYVVLVAALTVACNNFFWENS

SEQ ID NO: 883910 - protein, 143 aa, Homo sapiens
LVLDRDLELVGRVGPDAWVDPRVRGRVRTLAICPEPAPTSGPGQPCTAAMGSELETAMETLINVFHAHSGKEGDKYKLSKKELKELLQTELSGFLDAQKDVDAVDKVMKELDENGDGEVDFQEYVVLVAALTVACNNFFWENS

SEQ ID NO: 883911 - protein, 147 aa, Homo sapiens; identical to SEQ ID NO: 883909

SEQ ID NO: 883912 - protein, 102 aa, Homo sapiens
MRGSCTAAMGSELETAMETLINVFHAHSGKEGDKYKLSKKELKELLQTELSGFLDAQKDVDAVDKVMKELDENGDGEVDFQEYVVLVAALTVACNNFFWENS

SEQ ID NO: 883913 - protein, 147 aa, Homo sapiens; identical to SEQ ID NO: 883909

SEQ ID NO: 883914 - protein, 77 aa, Homo sapiens
VSALPGSLGSTCLSALPCLPCTAAMGSELETAMETLINVFHAHSGKEGDKYKLSKKELKELLQTELSGFLDVKELML

SEQ ID NO: 883915 - protein, 143 aa, Homo sapiens; identical to SEQ ID NO: 883910

SEQ ID NO: 883916 - protein, 166 aa, Homo sapiens
LVLDRDLELVGRVGPDAWVDPRVRGRVRTLAICPEPAPTSGPGQPCTAAMGSELETAMETLINVFHAHSGKEGDKYKLSKKELKELLQTELSGFLDAQKDVDAVDKVMKELDENGDGEVDFQEYVVLVAALTVACNNFFWENSLMQDQATIWGQGVLLSFCCQTHF

SEQ ID NO: 883917 - protein, 115 aa, Homo sapiens
LPEVSRAPRGAQATRGRCTAAMGSELETAMETLINVFHAHSGKEGDKYKLSKKELKELLQTELSGFLDAQKDVDAVDKVMKELDENGDGEVDFQEYVVLVAALTVACNNFFWENS

SEQ ID NO: 883918 - protein, 131 aa, Homo sapiens
TVEDRSPHTAPAATFATLAICPEPAPTSGPGQPCTAAMGSELETAMETLINVFHAHSGKEGDKYKLSKKELKELLQTELSGFLDAQKDVDAVDKVMKELDENGDGEVDFQEYVVLVAALTVACNNFFWENS

SEQ ID NO: 883919 - protein, 147 aa, Homo sapiens; identical to SEQ ID NO: 883909

SEQ ID NO: 883920 - protein, 102 aa, Homo sapiens
LVLDRDLELVGRVGPDAWVDPRVRRRVGTLAICPEPAPTSGPGQPCTAAMGSELETAMETLINVFHAHSGKEGDKYKLSKKELKELLQTELSGFLDVKELML

SEQ ID NO: 883921 - protein, 172 aa, Homo sapiens
TSSRSRSRTSRTRGSGRVGRPTRPPTRRDLGHLSRTCSHLRPRPTGALKSLPRPPLSPRCWEGSQPSPASPPVGCTAAMGSELETAMETLINVFHAHSGKEGDKYKLSKKELKELLQTELSGFLDAQKDVDAVDKVMKELDENGDGEVDFQEYVVLVAALTVACNNFFWENS

SEQ ID NO: 883922 - protein, 147 aa, Homo sapiens; identical to SEQ ID NO: 883909

SEQ ID NO: 883923 - protein, 106 aa, Homo sapiens
KGRPGEQTDRPTRQPTSNNELSSHTTAYASNQPPIYLTRAPPPSTQVRPVPGPPAGAVVAAPGGALASVSFGELDENGDGEVDFQEYVVLVAALTVACNNFFWENS

SEQ ID NO: 883924 - protein, 77 aa, Homo sapiens
LVLDRDLELVGRVGPDAWVDPRVRRRVGPWPSVQNLLPPQAQANRALLQWALSWRRRWRPSSTCSTPTRAKRGTSTS

SEQ ID NO: 883925 - protein, 127 aa, Homo sapiens
QLVHRWMNAPRICSEYDEEEVDYEESDSDESWTTESAISSEAILSSMCMNGGEEKPFACPVPGCKKRYKNVNGIKYHAKNGHRTQIRVRKPFKCRCGKSYKTAQGLRHHTINFHPPVSAEIIRKMQQ

SEQ ID NO: 883926 - protein, 262 aa, Homo sapiens
SLARPALAEPTPGGSRCSTMTGIAAASFFSNTCRFGGCGLHFPTLADLIEHIEDNHIDTDPRVLEKQELQQPTYVALSYINRFMTDAARREQESLKKKIQPKLSLTLSSSVSRGNVSTPPRHSSGSLTPPVTPPITPSSSFRSSTPTGSEYDEEEVDYEESDSDESWTTESAISSEAILSSMCMNGGEEKPFACPVPGCKKRYKNVNGIKYHAKNGHRTQIRVRKPFKCRCGKSYKTAQGLRHHTINFHPPVSAEIIRKMQQ

SEQ ID NO: 883927 - protein, 262 aa, Homo sapiens; identical to SEQ ID NO: 883926

SEQ ID NO: 883928 - protein, 262 aa, Homo sapiens; identical to SEQ ID NO: 883926

SEQ ID NO: 883929 - protein, 925 aa, Homo sapiens
MDRSGFGEISSPVIREAEVTRTARKQSAQKRVLLQASQDENFGNTTPRNQVIPRTPSSFRQPFTPTSRSLLRQPDISCILGTGGKSPRLTQSSGFFGNLSMVTNLDDSNWAAAFSSQRSGLFTNTEPHSITEDVTISAVMLREDDPGEAASMSMFSDFLQSFLKHSSSTVFDLVEEYENICGSQVNILSKIVSRATPGLQKFSKTASMLWLLQQEMVTWRLLASLYRDRIQSALEEESVFAVTAVNASEKTVVEALFQRDSLVRQSQLVVDWLESIAKDEIGEFSDNIEFYAKSVYWENTLHTLKQRQLTSYVGSVRPLVTELDPDAPIRQKMPLDDLDREDEVRLLKYLFTLIRAGMTEEAQRLCKRCGQAWRAATLEGWKLYHDPNVNGGTELEPVEGNPYRRIWKISCWRMAEDELFNRYERAIYAALSGNLKQLLPVCDTWEDTVWAYFRVMVDSLVEQEIQTSVATLDETEELPREYLGANWTLEKVFEELQATDKKRVLEENQEHYHIVQKFLILGDIDGLMDEFSKWLSKSRNNLPGHLLRFMTHLILFFRTLGLQTKEEVSIEVLKTYIQLLIREKHTNLIAFYTCHLPQDLAVAQYALFLESVTEFEQRHHCLELAKEADLDVATITKTVVENIRKKDNGEFSHHDLAPALDTGTTEEDRLKIDVIDWLVFDPAQRAEALKQGNAIMRKFLASKKHEAAKEVFVKIPQDSIAEIYNQCEEQGMESPLPAEDDNAIREHLCIRAYLEAHETFNEWFKHMNSVPQKPALIPQPTFTEKVAHEHKEKKYEMDFGIWKGHLDALTADVKEKMYNVLLFVDGGWMVDVREDAKEDHERTHQMVLLRKLCLPMLCFLLHTILHSTGQYQECLQLADMVSSERHKLYLVFSKEELRKLLQKLRESSLMLLDQGLDPLGYEIQL

SEQ ID NO: 883930 - protein, 233 aa, Homo sapiens
MDRSGFGEISSPVIREAEVTRTARKQSAQKRVLLQASQDENFGNTTPRNQVIPRTPSSFRQPFTPTSRSLLRQPDISCILGTGGKSPRLTQSSGFFGNLSMVTNLDDSNWAAAFSSQRSGLFTNTEPHSITEDVTISAVMLREDDPGEAASMSMFSDFLQSFLKHSSSTVFDLVEEYENICGSQVNILSKIVSRATPGLQKFSKTASMLWLLQQEMVTWRLLASLYRDRIQAA

SEQ ID NO: 883931 - protein, 896 aa, Homo sapiens
MKILVILHQETRLSLELLAHFDSLVLSTNLLFIVTPTSRSLLRQPDISCILGTGGKSPRLTQSSGFFGNLSMVTNLDDSNWAAAFSSQRSGLFTNTEPHSITEDVTISAVMLREDDPGEAASMSMFSDFLQSFLKHSSSTVFDLVEEYENICGSQVNILSKIVSRATPGLQKFSKTASMLWLLQQEMVTWRLLASLYRDRIQSALEEESVFAVTAVNASEKTVVEALFQRDSLVRQSQLVVDWLESIAKDEIGEFSDNIEFYAKSVYWENTLHTLKQRQLTSYVGSVRPLVTELDPDAPIRQKMPLDDLDREDEVRLLKYLFTLIRAGMTEEAQRLCKRCGQAWRAATLEGWKLYHDPNVNGGTELEPVEGNPYRRIWKISCWRMAEDELFNRYERAIYAALSGNLKQLLPVCDTWEDTVWAYFRVMVDSLVEQEIQTSVATLDETEELPREYLGANWTLEKVFEELQATDKKRVLEENQEHYHIVQKFLILGDIDGLMDEFSKWLSKSRNNLPGHLLRFMTHLILFFRTLGLQTKEEVSIEVLKTYIQLLIREKHTNLIAFYTCHLPQDLAVAQYALFLESVTEFEQRHHCLELAKEADLDVATITKTVVENIRKKDNGEFSHHDLAPALDTGTTEEDRLKIDVIDWLVFDPAQRAEALKQGNAIMRKFLASKKHEAAKEVFVKIPQDSIAEIYNQCEEQGMESPLPAEDDNAIREHLCIRAYLEAHETFNEWFKHMNSVPQKPALIPQPTFTEKVAHEHKEKKYEMDFGIWKGHLDALTADVKEKMYNVLLFVDGGWMVDVREDAKEDHERTHQMVLLRKLCLPMLCFLLHTILHSTGQYQECLQLADMVSSERHKLYLVFSKEELRKLLQKLRESSLMLLDQGLDPLGYEIQL

SEQ ID NO: 883932 - protein, 825 aa, Homo sapiens [sequence omitted]

SEQ ID NO: 883933 - protein, 662 aa, Homo sapiens
KRHEYEPGVIGRGQEDEIGEFSDNIEFYAKSVYWENTLHTLKQRQLTSYVGSVRPLVTELDPDAPIRQKMPLDDLDREDEVRLLKYLFTLIRAGMTEEAQRLCKRCGQAWRAATLEGWKLYHDPNVNGGTELEPVEGNPYRRIWKISCWRMAEDELFNRYERAIYAALSGNLKQLLPVCDTWEDTVWAYFRVMVDSLVEQEIQTSVATLDETEELPREYLGANWTLEKVFEELQATDKKRVLEENQEHYHIVQKFLILGDIDGLMDEFSKWLSKSRNNLPGHLLRFMTHLILFFRTLGLQTKEEVSIEVLKTYIQLLIREKHTNLIAFYTCHLPQDLAVAQYALFLESVTEFEQRHHCLELAKEADLDVATITKTVVENIRKKDNGEFSHHDLAPALDTGTTEEDRLKIDVIDWLVFDPAQRAEALKQGNAIMRKFLASKKHEAAKEVFVKIPQDSIAEIYNQCEEQGMESPLPAEDDNAIREHLCIRAYLEAHETFNEWFKHMNSVPQKPALIPQPTFTEKVAHEHKEKKYEMDFGIWKGHLDALTADVKEKMYNVLLFVDGGWMVDVREDAKEDHERTHQMVLLRKLCLPMLCFLLHTILHSTGQYQECLQLADMVSSERHKLYLVFSKEELRKLLQKLRESSLMLLDQGLDPLGYEIQL

SEQ ID NO: 883934 - protein, 503 aa, Homo sapiens
MDRSGFGEISSPVIREAEVTRTARKQSAQKRVLLQASQDENFGNTTPRNQVIPRTPSSFRQPFTPTSRSLLRQPDISCILGTGGKSPRLTQSSGFFGNLSMVTNLDDSNWAAAFSSQRSGLFTNTEPHSITEDVTISAVMLREDDPGEAASMSMFSDFLQSFLKHSSSTVFDLVEEYENICGSQVNILSKIVSRATPGLQKFSKTASMLWLLQQEMVTWRLLASLYRDRIQSALEEESVFAVTAVNASEKTVVEALFQRDSLVRQSQLVVDWLESIAKDEIGEFSDNIEFYAKSVYWENTLHTLKQRQLTSYVGSVRPLVTELDPDAPIRQKMPLDDLDREDEVRLLKYLFTLIRAGMTEEAQRLCKRCGQAWRAATLEGWKLYHDPNVNGGTELEPVEGNPYRRIWKISCWRMAEDELFNRYERAIYAALSGNLKQLLPVCDTWEDTVWAYFRVMVDSLVEQEIQTSVATLDETEELPREYLGANWTLEKVFEELQATDKKV

SEQ ID NO: 883935 - protein, 619 aa, Homo sapiens
KGAQTISVQQHDSKLRLDPDAPIRQKMPLDDLDREDEVRLLKYLFTLIRAGMTEEAQRLCKRCGQAWRAATLEGWKLYHDPNVNGGTELEPVEGNPYRRIWKISCWRMAEDELFNRYERAIYAALSGNLKQLLPVCDTWEDTVWAYFRVMVDSLVEQEIQTSVATLDETEELPREYLGANWTLEKVFEELQATDKKRVLEENQEHYHIVQKFLILGDIDGLMDEFSKWLSKSRNNLPGHLLRFMTHLILFFRTLGLQTKEEVSIEVLKTYIQLLIREKHTNLIAFYTCHLPQDLAVAQYALFLESVTEFEQRHHCLELAKEADLDVATITKTVVENIRKKDNGEFSHHDLAPALDTGTTEEDRLKIDVIDWLVFDPAQRAEALKQGNAIMRKFLASKKHEAAKEVFVKIPQDSIAEIYNQCEEQGMESPLPAEDDNAIREHLCIRAYLEAHETFNEWFKHMNSVPQKPALIPQPTFTEKVAHEHKEKKYEMDFGIWKGHLDALTADVKEKMYNVLLFVDGGWMVDVREDAKEDHERTHQMVLLRKLCLPMLCFLLHTILHSTGQYQECLQLADMVSSERHKLYLVFSKEELRKLLQKLRESSLMLLDQGLDPLGYEIQL

SEQ ID NO: 883936 - protein, 925 aa, Homo sapiens; identical to SEQ ID NO: 883929

SEQ ID NO: 883937 - protein, 839 aa, Homo sapiens
MDRSGFGEISSPVIREAEVTRTARKQSAQKRVLLQASQDENFGNTTPRNQVIPRTPSSFRQPFTPTSRSLLRQPDISCILGTGGKSPRLTQSSGFFGNLSMVTNLDDSNWAAAFSSQRSGLFTNTEPHSITEDVTISAVMLREDDPGEAASMSMFSDFLQSFLKHSSSTVFDLVEEYENICGSQVNILSKIVSRATPGLQKFSKTASMLWLLQQEMVTWRLLASLYRDRIQSALEEESVFAVTAVNASEKTVVEALFQRDSLVRQSQLVVDWLESIAKDEIGEFSDNIEFYAKSVYWENTLHTLKQRQLTSYVGSVRPLVTELDPDAPIRQKMPLDDLDREDEVRLLKYLFTLIRAGMTEEAQRLCKRCGQAWRAATLEGWKLYHDPNVNGGTELEPVEGNPYRRIWKISCWRMAEDELFNRYERAIYAALSGNLKQLLPVCDTWEDTVWAYFRVMVDSLVEQEIQTSVATLDETEELPREYLGANWTLEKVFEELQATDKKRVLEENQEHYHIVQKFLILGDIDGLMDEFSKWLSKSRNNLPGHLLRFMTHLILFFRTLGLQTKEEVSIEVLKTYIQLLIREKHTNLIAFYTCHLPQDLAVAQYALFLESVTEFEQRHHCLELAKEADLDVATITKTVVENIRKKDNGEFSHHDLAPALDTGTTEEDRLKIDVIDWLVFDPAQRAEALKQGNAIMRKFLASKKHEAAKEVFVKIPQDSIAEIYNQCEEQGMESPLPAEDDNAIREHLCIRAYLEAHETFNEWFKHMNSVPQKPALIPQPTFTEKVAHEHKEKKYEMDFGIWKGHLDALTADVKEKMYNVLLFVDGGATVQGGRGVRAR

SEQ ID NO: 883938 - protein, 110 aa, Homo sapiens
GIKFDFKYSKHPLELDLLSPDIWHLNVLLFPLDFSIYYFITLKFFLVITPLDLSLKFKNYQVNRFSLEEFARLHIMRKIDILRKTIFQICLYSLCFRSFLIDTREQFMQL

SEQ ID NO: 883939 - protein, 610 aa, Homo sapiens
METAPKPGKDVPPKKDKLQTKRKKPRRYWEEETVPTTAGASPGPPRNKKNRELRPQRPKNAYILKKSRISKKPQVPKKPREWKNPESQRGLSGAQDPFPGPAPVPVEVVQKFCRIDKSRKLPHSKAKTRSRLEVAEAEEEETSIKAARSELLLAEEPGFLEGEDGEDTAKICQADIVEAVDIASAAKHFDLNLRQFGPYRLNYSRTGRHLAFGGRRGHVAALDWVTKKLMCEINVMEAVRDIRFLHSEALLAVAQNRWLHIYDNQGIELHCIRRCDRVTRLEFLPFHFLLATASETGFLTYLDVSVGKIVAALNARAGRLDVMSQNPYNAVIHLGHSNGTVSLWSPAMKEPLAKILCHRGGVRAVAVDSTGTYMATSGLDHQLKIFDLRGTYQPLSTRTLPHGAGHLAFSQRGLLVAGMGDVVNIWAGQGKASPPSLEQPYLTHRLSGPVHGLQFCPFEDVLGVGHTGGITSMLVPGAGEPNFDGLESNPYRSRKQRQEWEVKALLEKVPAELICLDPRALAEVDVISLEQGKKEQIERLGYDPQAKAPFQPKPKQKGRSSTASLVKRKRKVMDEEHRDKVRQSLQQQHHKEAKAKPTGARPSALDRFVR

SEQ ID NO: 883940 - protein, 652 aa, Homo sapiens
METAPKPGKDVPPKKDKLQTKRKKPRRYWEEETVPTTAGASPGPPRNKKNRELRPQRPKNAYILKKSRISKKPQVPKKPREWKNPESQRGLSGAQDPFPGPAPVPVEVVQKFCRIDKSRKLPHSKAKTRSRLEVAEAEEEETSIKAARSELLLAEEPGFLEGEDGEDTAKICQADIVEAVDIASAAKHFDLNLRQFGPYRLNYSRTGRHLAFGGRRGHVAALDWVTKKLMCEINVMEAVRDIRFLHSEALLAVAQNRWLHIYDNQGIELHCIRRCDRVTRLEFLPFHFLLATASETGFLTYLDVSVGKIVAALNARAGRLDVMSQNPYNAVIHLGHSNGTVSLWSPAMKEPLAKILCHRGGVRAVAVDSTGTYMATSGLDHQLKIFDLRGTYQPLSTRTLPHGAGHLAFSQRGLLVAGMGDVVNIWAGQGKASPPSLEQPYLTHRLSGPVHGLQFCPFEDVLGVGHTGGITSMLVPGAGEPNFDGLESNPYRSRKQRQEWEVKALLEKVPAELICLDPRALAEVDVISLEQGKKEQIERLGYDPQAKAPFQPKPKQKGRSSTASLVKRKRKVMDEEHRVNEHWHVAGPSTGCTLLLVPLPLSACHFSLCACVLPVSGPQDDKVRQSLQQQHHKEAKAKPTGARPSALDRFVR

SEQ ID NO: 883941 - protein, 563 aa, Homo sapiens
METAPKPGKDVPPKKDKLQTKRKKPRRYWEEETVPTTAGASPGPPRNKKNRELRPQRPKNAYILKKSRISKKPQVPKKPREWKNPESQRGLSGAQDPFPGPAPVPVEVVQKFCRIDKSRKLPHSKAKTRSRLEVAEAEEEETSIKAARSELLLAEEPGFLEGEDGEDTAKICQADIVEAVDIASAAKHFDLNLRQFGPYRLNYSRTGRHLAFGGRRGHVAALDWVTKKLMCEINVMEAVRDIRFLHSEALLAVAQNRWLHIYDNQGIELHCIRRCDRVTRLEFLPFHFLLATASETGFLTYLDVSVGKIVAALNARAGRLDVMSQNPYNAVIHLGHSNGTVSLWSPAMKEPLAKILCHRGGVRAVAVDSTGTYMATSGLDHQLKIFDLRGTYQPLSTRTLPHGAGHLAFSQRGLLVAGMGDVVNIWAGQGAGEPNFDGLESNPYRSRKQRQEWEVKALLEKVPAELICLDPRALAEVDVISLEQGKKEQIERLGYDPQAKAPFQPKPKQKGRSSTASLVKRKRKVMDEEHRDKVRQSLQQQHHKEAKAKPTGARPSALDRFVR

SEQ ID NO: 883942 - protein, 572 aa, Homo sapiens
METAPKPGKDVPPKKDKLQTKRKKPRRYWEEETVPTTAGASPGPPRNKKNRELRPQRPKNAYILKKSRISKKPQVPKKPREWKNPESQRGLSGAQDPFPGPAPVPVEVVQKFCRIDKSRKLPHSKAKTRSRLEVAEAEEEETSIKAARSELLLAEEPGFLEGEDGEDTAKICQADIVEAVDIASAAKHFDLNLRQFGPYRLNYSRTGRHLAFGGRRGHVAALDWVTKKLMCEINVMEAVRDIRFLHSEALLAVAQNRWLHIYDNQGIELHCIRRCDRVTRLEFLPFHFLLATASETGFLTYLDVSVGKIVAALNARAGRLDVMSQNPYNAVIHLGHSNGTVSLWSPAMKEPLAKILCHRGGVRAVAVDSTGTYMATSGLDHQLKIFDLRGTYQPLSTRTLPHGAGHLAFSQRGLLVAGMGDVVNIWAGQGKASPPSLEQPYLTHRLSGPVHGLQFCPFEDVLGVGHTGGITSMLVPGAGEPNFDGLESNPYRSRKQRQEWEVKALLEKVPAELICLDPRALAEVDVISLEQGKKEQIERLDKVRQSLQQQHHKEAKAKPTGARPSALDRFVR

SEQ ID NO: 883943 - protein, 627 aa, Homo sapiens
METAPKPGKDVPPKKDKLQTKRKKPRRYWEEETVPTTAGASPGPPRNKKNRELRPQRPKNAYILKKSRISKKPQVPKKPREWKNPESQRGLSGAQDPFPGPAPVPVEVVQKFCRIDKSRKVRSSRRVGKLLEAGSVWLPHSKAKTRSRLEVAEAEEEETSIKAARSELLLAEEPGFLEGEDGEDTAKICQADIVEAVDIASAAKHFDLNLRQFGPYRLNYSRTGRHLAFGGRRGHVAALDWVTKKLMCEINVMEAVRDIRFLHSEALLAVAQNRWLHIYDNQGIELHCIRRCDRVTRLEFLPFHFLLATASETGFLTYLDVSVGKIVAALNARAGRLDVMSQNPYNAVIHLGHSNGTVSLWSPAMKEPLAKILCHRGGVRAVAVDSTGTYMATSGLDHQLKIFDLRGTYQPLSTRTLPHGAGHLAFSQRGLLVAGMGDVVNIWAGQGKASPPSLEQPYLTHRLSGPVHGLQFCPFEDVLGVGHTGGITSMLVPGAGEPNFDGLESNPYRSRKQRQEWEVKALLEKVPAELICLDPRALAEVDVISLEQGKKEQIERLGYDPQAKAPFQPKPKQKGRSSTASLVKRKRKVMDEEHRDKVRQSLQQQHHKEAKAKPTGARPSALDRFVR

SEQ ID NO: 883944 - protein, 372 aa, Homo sapiens [sequence omitted]

SEQ ID NO: 883945 - protein, 430 aa, Homo sapiens
METAPKPGKDVPPKKDKLQTKRKKPRRYWEEETVPTTAGASPGPPRNKKNRELRPQRPKNAYMFLHSEALLAVAQNRWLHIYDNQGIELHCIRRCDRVTRLEFLPFHFLLATASETGFLTYLDVSVGKIVAALNARAGRLDVMSQNPYNAVIHLGHSNGTVSLWSPAMKEPLAKILCHRGGVRAVAVDSTGTYMATSGLDHQLKIFDLRGTYQPLSTRTLPHGAGHLAFSQRGLLVAGMGDVVNIWAGQGKASPPSLEQPYLTHRLSGPVHGLQFCPFEDVLGVGHTGGITSMLVPGAGEPNFDGLESNPYRSRKQRQEWEVKALLEKVPAELICLDPRALAEVDVISLEQGKKEQIERLGYDPQAKAPFQPKPKQKGRSSTASLVKRKRKVMDEEHRDKVRQSLQQQHHKEAKAKPTGARPSALDRFVR

SEQ ID NO: 883946 - protein, 296 aa, Homo sapiens
METAPKPGKDVPPKKDKLQTKRKKPRRYWEEETVPTTAGASPGPPRNKKNRELRPQRPKNAYILKKSRISKKPQVPKKPREWKNPESQRGLSGAQDPFPGPAPVPVEVVQKFCRIDKSRKLPHSKAKTRSRLEVAEAEEEETSIKAARSELLLAEEPGFLEGEDGEDTPATSHSVPVSSPSPVPRTTRSGRAFSSSIIRRRRPSPRGPGHLPWTDLCAEPDSRVAWEQSLPKITCREMSVPWNKEVGAVWPLPQLGVDSCLLGWVGIKEESDFLEIMCLDHLVDLFPSPLPSMRPF

SEQ ID NO: 883947 - protein, 105 aa, Homo sapiens
METAPKPGKDVPPKKDKLQTKRKKPRRYWEEETVPTTAGASPGPPRNKKNRELRPQRPKNAYILKKSRISKKPQGPAICPGQICALSQTPGLPGNSLSPRSPVGK

SEQ ID NO: 883948 - protein, 610 aa, Homo sapiens; identical to SEQ ID NO: 883939

SEQ ID NO: 883949 - protein, 486 aa, Homo sapiens
METAPKPGKDVPPKKDKLQTKRKKPRRYWEEETVPTTAGASPGPPRNKKNRELRPQRPKNAYILKKSRISKKPQVPKKPREWKNPESQRGLSGAQDPFPGPAPVPVEVVQKFCRIDKSRKLPHSKAKTRSRLEVAEAEEEETSIKAARSELLLAEEPGFLEGEDGEDTAKICQADIVEAVDIASAAKHFDLNLRQFGPYRLNYSRTGRHLAFGGRRGHVAALDWVTKKLMCEINVMEAVRDIRFLHSEALLAVAQNRWLHIYDNQGIELHCIRRCDRVTRLEFLPFHFLLATASETGFLTYLDVSVGKIVAALNARAGRLDVMSQNPYNAVIHLGHSNGTVSLWSPAMKEPLAKILCHRGGVRAVAVDSTGTYMATSGLDHQLKIFDLRGTYQPLSTRTLPHGAGHLAFSQRGLLVAGMGDVVNIWAGQGKASPPSLEQPYLTHRLSGPVHGLQFCPFEDVLGVGHTGGITSMLVPGEWARGWGLK

SEQ ID NO: 883950 - protein, 651 aa, Homo sapiens
METAPKPGKDVPPKKDKLQTKRKKPRRYWEEETVPTTAGASPGPPRNKKNRELRPQRPKNAYILKKSRISKKPQVPKKPREWKNPESQRGLSGAQDPFPGPAPVPVEVVQKFCRIDKSRKLPHSKAKTRSRLEVAEAEEEETSIKAARSELLLAEEPGGVSPNLDPHSLPFGTVFSRFYVGITCFILGSFTAILTLAFRFLEGEDGEDTAKICQADIVEAVDIASAAKHFDLNLRQFGPYRLNYSRTGRHLAFGGRRGHVAALDWVTKKLMCEINVMEAVRDIRFLHSEALLAVAQNRWLHIYDNQGIELHCIRRCDRVTRLEFLPFHFLLATASETGFLTYLDVSVGKIVAALNARAGRLDVMSQNPYNAVIHLGHSNGTVSLWSPAMKEPLAKILCHRGGVRAVAVDSTGTYMATSGLDHQLKIFDLRGTYQPLSTRTLPHGAGHLAFSQRGLLVAGMGDVVNIWAGQGKASPPSLEQPYLTHRLSGPVHGLQFCPFEDVLGVGHTGGITSMLVPGAGEPNFDGLESNPYRSRKQRQEWEVKALLEKVPAELICLDPRALAEVDVISLEQGKKEQIERLGYDPQAKAPFQPKPKQKGRSSTASLVKRKRKVMDEEHRDKVRQSLQQQHHKEAKAKPTGARPSALDRFVR

SEQ ID NO: 883951 - protein, 86 aa, Homo sapiens
ELHTWYAADWMKDRGLPGVFKPTVWQLRRVLHVDRRSGGRDGDSPQAGQGCPAQERQTSDQEKETAAILGGRDRSDHSRSLSRASS

SEQ ID NO: 883952 - protein, 387 aa, Homo sapiens
PRAESARGEINVMEAVRDIRFLHSEALLAVAQNRWLHIYDNQGIELHCIRRCDRVTRLEFLPFHFLLATASETGFLTYLDVSVGKIVAALNARAGRLDVMSQNPYNAVIHLGHSNGTVSLWSPAMKEPLAKILCHRGGVRAVAVDSTGTYMATSGLDHQLKIFDLRGTYQPLSTRTLPHGAGHLAFSQRGLLVAGMGDVVNIWAGQGKASPPSLEQPYLTHRLSGPVHGLQFCPFEDVLGVGHTGGITSMLVPGAGEPNFDGLESNPYRSRKQRQEWEVKALLEKVPAELICLDPRALAEVDVISLEQGKKEQIERLGYDPQAKAPFQPKPKQKGRSSTASLVKRKRKVMDEEHRDKVRQSLQQQHHKEAKAKPTGARPSALDRFVR

SEQ ID NO: 883953 - protein, 363 aa, Homo sapiens
SASEWRNPDVPHRIYDNQGIELHCIRRCDRVTRLEFLPFHFLLATASETGFLTYLDVSVGKIVAALNARAGRLDVMSQNPYNAVIHLGHSNGTVSLWSPAMKEPLAKILCHRGGVRAVAVDSTGTYMATSGLDHQLKIFDLRGTYQPLSTRTLPHGAGHLAFSQRGLLVAGMGDVVNIWAGQGKASPPSLEQPYLTHRLSGPVHGLQFCPFEDVLGVGHTGGITSMLVPGAGEPNFDGLESNPYRSRKQRQEWEVKALLEKVPAELICLDPRALAEVDVISLEQGKKEQIERLGYDPQAKAPFQPKPKQKGRSSTASLVKRKRKVMDEEHRDKVRQSLQQQHHKEAKAKPTGARPSALDRFVR

SEQ ID NO: 883954 - protein, 86 aa, Homo sapiens; identical to SEQ ID NO: 883951

SEQ ID NO: 883955 - protein, 409 aa, Homo sapiens
FSKMVANDIAKMSRKLSLPTDLKPDLDVKDNSFSRSRSSSVTSIDKESREAISALHFCETFTRKTDSSPSPCLWVGTTLGTVLVIALNLPPGGEQRLLQPVIVSPSGTILRLKGAILRMAFLDTTGCLIPPAYEPWREHNVPEEKDEKEKLKKRRPVSVSPSSSQEISENQYAVICSEKQAKVISLPTQNCAYKQNITETSFVLRGDIVALSNSICLACFCANGHIMTFSLPSLRPLLDVYYLPLTNMRIARTFCFTNNGQALYLVSPTEIQRLTYSQETCENLQEMLGELFTPVETPEAPNRGFFKGLFGGGAQSLDREELFGESSSGKASRSLAQHIPGPGGIEGVKGAASGVVGELARARLALDERGQKLGDLEERTAAMLSSAESFSKHAHEIMLKYKDKKWYQF

SEQ ID NO: 883956 - protein, 409 aa, Homo sapiens; identical to SEQ ID NO: 883955

SEQ ID NO: 883957 - protein, 409 aa, Homo sapiens; identical to SEQ ID NO: 883955

SEQ ID NO: 883958 - protein, 625 aa, Homo sapiens
MIFLYQVVHFILFTSVSGECVTQLLKDTCFEGGDITTVFTPSAKYCQVVCTYHPRCLLFTFTAESPSEDPTRWFTCVLKDSVTETLPRVNRTAAISGYSFKQCSHQISACNKDIYVDLDMKGINYNSSVAKSAQECQERCTDDVHCHFFTYATRQFPSLEHRNICLLKHTQTGTPTRITKLDKVVSGFSLKSCALSNLACIRDIFPNTVFADSNIDSVMAPDAFVCGRICTHHPGCLFFTFFSQEWPKESQRNLCLLKTSESGLPSTRIKKSKALSGFSLQSCRHSIPVFCHSSFYHDTDFLGEELDIVAAKSHEACQKLCTNAVRCQFFTYTPAQASCNEGKGKCYLKLSSNGSPTKILHGRGGISGYTLRLCKMDNECTTKIKPRIVGGTASVRGEWPWQVTLHTTSPTQRHLCGGSIIGNQWILTAAHCFYGVESPKILRVYSGILNQSEIKEDTSFFGVQEIIIHDQYKMAESGYDIALLKLETTVNYTDSQRPICLPSKGDRNVIYTDCWVTGWGYRKLRDKIQNTLQKAKIPLVTNEECQKRYRGHKITHKMICAGYREGGKDACKGDSGGPLSCKHNEVWHLVGITSWGEGCAQRERPGVYTNVVEYVDWILEKTQAV

SEQ ID NO: 883959 - protein, 470 aa, Homo sapiens [sequence omitted]

SEQ ID NO: 883960 - protein, 162 aa, Homo sapiens
MIFLYQVVHFILFTSVSGECVTQLLKDTCFEGGDITTVFTPSAKYCQVVCTYHPRCLLFTFTAESPSEDPTRWFTCVLKDSVTETLPRVNRTAAISGYSFKQCSHQISACNKDIYVDLDMKGINYNSSVAKSAQECQERCTDDVHCHFFTYATRQFPSLEHR

SEQ ID NO: 883961 - protein, 343 aa, Homo sapiens [sequence omitted]

SEQ ID NO: 883962 - protein, 376 aa, Homo sapiens
MNYEFEREIGFINSQPSLAECLTSFPPVADTFQSSSIKTSTLSHSTLIPPPFEQTIPSLNPGSHPRHGAGGRPKPSPAGSRGSPVPAGALQPPEYPWMKEKKAAKKTALLPAAAAAATAAATGPACLSHKESLEIADGSGGGSRRLRTAYTNTQLLELEKEFHFNKYLCRPRRVEIAALLDLTERQVKVWFQNRRMKHKRQTQCKENQNSEGKCKSLEDSEKVEEDEEEKTLFEQALSVSGALLEREGYTFQQNALSQQQAPNGHNGDSQSFPVSPLTSNEKNLKHFQHQSPTVPNCLSTMGQNCGAGLNNDSPEALEVPSLQDFSVFSTDSCLQLSDAVSPSLPGSLDSPVDISADSLDFFTDTLTTIDLQHLNY

SEQ ID NO: 883963 - protein, 176 aa, Homo sapiens
PKPSPAGSRGSPVPAGALQPPEYPWMKEKKAAKKTALLPAAAAAATAAATGPACLSHKGQSKDLAPGLWDPLPSPGCPESGCGGRGEWAGREGGEGEMLGCLVPAPVGSGVGLMERKGDPALYNETYIFLGSGGKLSRTCVMWDDLFELELTSSCLVVLEFGFLTVMKSDRSLLLS

SEQ ID NO: 883964 - protein, 376 aa, Homo sapiens; identical to SEQ ID NO: 883962

SEQ ID NO: 883965 - protein, 146 aa, Homo sapiens
LSRDRPGPYSTGAEGCSTSPKRDAAGGRPAQGAGVDRGGALPSGKTPGSREKVTQASDPDPPSAAEPLPPLPPTPKDRLHLPSQPTVGLASLPPTGRSLPPPAWFAAPLRDDTPPAHSAAGRLIPRVPFTGLTASTPRAPSSVIQE

SEQ ID NO: 883966 - protein, 224 aa, Homo sapiens
MVKREHGQERPTFWGWAATPAPVSAPGNPPTGEGERQGSPPGGGFLGSTSFQRRGEKELLWERGQDVSRSVLAMRAILPPSLSKSVHFPPLPHSCTLVALLSLGLQDPLGCRAPATKPTPAGATLSASSLPRPCSPSASLLLSWPLFWGILGGVFFLGSRACTRTQARRHTGPAAALLRLLFPAPRRPGARSRAGYASPGSPERRSPGTAHKGSLPWPLALRLL

SEQ ID NO: 883967 - protein, 224 aa, Homo sapiens; identical to SEQ ID NO: 883966

SEQ ID NO: 883968 - protein, 106 aa, Homo sapiens
MRTFKSFPRETHANLSLIPGQGSCSSSPYFPEAAEVVKLLFTIRFHVNPGLVERKSQTETKNVMQSWVGEIESLSRKLCCINYKQCCINFTPTMCTMLESDEIYSE

SEQ ID NO: 883969 - protein, 224 aa, Homo sapiens; identical to SEQ ID NO: 883966

SEQ ID NO: 883970 - protein, 196 aa, Homo sapiens
MQDEDGYITLNIKTRKPALVSAVMQRNYLQDENENRTGTLQQLAKRFCQYVVKQSELKGTFKGHKCSPCDTNWRYYGDSCYGFFRHNLTWEESKQYCTDMNATLLKIDNRNIVEYIKARTHLIRWVGLSRQKSNEVWKWEDGSVISENMFEFLEDGKGNMNCAYFHNGKMHPTFCENKHYLMCERKAGMTKVDQLP

SEQ ID NO: 883971 - protein, 229 aa, Homo sapiens [sequence omitted]

SEQ ID NO: 883972 - protein, 76 aa, Homo sapiens
TGRSAERLVQIGVGIWVTHLKDSVRLAPSGTEKARRQVSLEKTGLVLAGACVVGLWAAGLQRRKTTSSRFFFQFLL

SEQ ID NO: 883973 - protein, 604 aa, Homo sapiens
MNIVENSIFLSNLMKSANTFELKYDLSCELYRMSTYSTFPAGVPVSERSLARAGFYYTGVNDKVKCFCCGLMLDNWKRGDSPTEKHKKLYPSCRFVQSLNSVNNLEATSQPTFPSSVTNSTHSLLPGTENSGYFRGSYSNSPSNPVNSRANQDFSALMRSSYHCAMNNENARLLTFQTWPLTFLSPTDLAKAGFYYIGPGDRVACFACGGKLSNWEPKDNAMSEHLRHFPKCPFIENQLQDTSRYTVSNLSMQTHAARFKTFFNWPSSVLVNPEQLASAGFYYVGNSDDVKCFCCDGGLRCWESGDDPWVQHAKWFPRCEYLIRIKGQEFIRQVQASYPHLLEQLLSTSDSPGDENAESSIIHFEPGEDHSEDAIMMNTPVINAAVEMGFSRSLVKQTVQRKILATGENYRLVNDLVLDLLNAEDEIREEERERATEEKESNDLLLIRKNRMALFQHLTCVIPILDSLLTAGIINEQEHDVIKQKTQTSLQARELIDTILVKGNIAATVFRNSLQEAEAVLYEHLFVQQDIKYIPTEDVSDLPVEEQLRRLQEERTCKVCMDKEVSIVFIPCGHLVVCKDCAPSLRKCPICRSTIKGTVRTFLS

SEQ ID NO: 883974 - protein, 604 aa, Homo sapiens; identical to SEQ ID NO: 883973

SEQ ID NO: 883975 - protein, 364 aa, Homo sapiens
DRIELVLSNLSMQTHAARFKTFFNWPSSVLVNPEQLASAGFYYVGNSDDVKCFCCDGGLRCWESGDDPWVQHAKWFPRCEYLIRIKGQEFIRQVQASYPHLLEQLLSTSDSPGDENAESSIIHFEPGEDHSEDAIMMNTPVINAAVEMGFSRSLVKQTVQRKILATGENYRLVNDLVLDLLNAEDEIREEERERATEEKESNDLLLIRKNRMALFQHLTCVIPILDSLLTAGIINEQEHDVIKQKTQTSLQARELIDTILVKGNIAATVFRNSLQEAEAVLYEHLFVQQDIKYIPTEDVSDLPVEEQLRRLQEERTCKVCMDKEVSIVFIPCGHLVVCKDCAPSLRKCPICRSTIKGTVRTFLS

SEQ ID NO: 883976 - protein, 604 aa, Homo sapiens; identical to SEQ ID NO: 883973

SEQ ID NO: 883977 - protein, 383 aa, Homo sapiens
MSEHLRHFPKCPFIENQLQDTSRYTVSNLSMQTHAARFKTFFNWPSSVLVNPEQLASAGFYYVGNSDDVKCFCCDGGLRCWESGDDPWVQHAKWFPRCEYLIRIKGQEFIRQVQASYPHLLEQLLSTSDSPGDENAESSIIHFEPGEDHSEDAIMMNTPVINAAVEMGFSRSLVKQTVQRKILATGENYRLVNDLVLDLLNAEDEIREEERERATEEKESNDLLLIRKNRMALFQHLTCVIPILDSLLTAGIINEQEHDVIKQKTQTSLQARELIDTILVKGNIAATVFRNSLQEAEAVLYEHLFVQQDIKYIPTEDVSDLPVEEQLRRLQEERTCKVCMDKEVSIVFIPCGHLVVCKDCAPSLRKCPICRSTIKGTVRTFLS

SEQ ID NO: 883978 - protein, 1140 aa, Homo sapiens [sequence omitted]

SEQ ID NO: 883979 - protein, 149 aa, Homo sapiens
GAGAGDGGAESAGPPASPAGGSRGRSGGGGGGGGSRSASRPGAGAAALPEPDSSLGCRRGHEGRWTLLKTRPGSTPSPLPLSHRFEIPREAKDSYRKYPGGSAERESQKGQRVSGRSGGHSWAHRSSWALASWVTGVLGYWGQDRELIL

SEQ ID NO: 883980 - protein, 1000 aa, Homo sapiens
MDTAEDPAWLQLLQKDSSPPGPRPTAFFCPQDGSLGAGSSAMRDYCPSQQKASPAPPRHTPDQSPGMESRHRSPSGAGEGASCSDGPRGSLACPSPTCFSPQESPSKETLEAHGASISGTPEATTSGKPEPVSSVKTEPKSSDDRNPMFLEKMDFKSSKQADSTSIGKEDPGSSRKADPMFTGKAEPEILGKGDPVAPGRMDPMTVRKEDLGSLGKVDPLCSSKTYTVSPKKGGSCVLRQSGPCIPKKGGAQVFRKRASCVLRKGRSYICRKGRSCIVGKERSWALGKGRSRALGKHGFCVHRKDRAGAPGQADSRLIRQEWACILWDRGSWVLGKAGSHMLGDGRSRICGKVETVPATKEDSRFLGKMDPASSGEGRPVSGHTDTTASAKTDLTSLKNVDPMSSGKVDPVSLGKMDPMCSGKPELLSPGQAERVSVGKAGTVSPGKEDPVSSRREDPISAGSRKTSSEKVNPESSGKTNPVSSGPGDPRSLGTAGPPSAVKAEPATGGKGDPLSSEKAGLVASGKAAPTASGKAEPLAVGKEDPVSKGKADAGPSGQGDSVSIGKVVSTPGKTVPVPSGKVDPVSLGKAEAIPEGKVGSLPLEKGSPVTTTKADPRASGKAQPQSGGKAETKLPGQEGAAAPGEAGAVCLKKETPQASEKVDPGSCRKAEPLASGKGEPVSLGKADSAPSRKTESPSLGKVVPLSLEKTKPSSSSRQLDRKALGSARSPEGARGSEGRVEPKAEPVSSTEASSLGQKDLEAAGAERSPCPEAAAPPPGPRTRDNFTKAPSWEASAPPPPREDAGTQAGAQACVSVAVSPMSPQDGAGGSAFSFQAAPRAPSPPSRRDAGLQVSLGAAETRSVATGPMTPQAAAPPAFPEVRVRPGSALAAAVAPPEPAEPVRDVSWDEKGMTWEVYGAAMEVEVLGMAIQKHLERQIEEHGRQGAPAPPPAARAGPGRSGSVRTAPPDGAAKRPPGLFRALLQSVRRPRCCSRAGPTAE

SEQ ID NO: 883981 - protein, 1053 aa, Homo sapiens
MDTAEDPAWLQLLQKDSSPPGPRPTAFFCPQDGSLGAGSSAMRDYCPSQQKASPAPPRHTPDQSPGMESRHRSPSGAGEGASCSDGPRGSLACPSPTCFSPQESPSKETLEAHGASISGTPEATTSGKPEPVSSVKTEPKSSDDRNPMFLEKMDFKSSKQADSTSIGKEDPGSSRKADPMFTGKAEPEILGKGDPVAPGRMDPMTVRKEDLGSLGKVDPLCSSKTYTVSPKKGGSCVLRQSGPCIPKKGGAQVFRKRASCVLRKGRSYICRKGRSCIVGKERSWALGKGRSRALGKHGFCVHRKDRAGAPGQADSRLIRQEWACILWDRGSWVLGKAGSHMLGDGRSRICGKVETVPATKEDSRFLGKMDPASSGEGRPVSGHTDTTASAKTDLTSLKNVDPMSSGKVDPVSLGKMDPMCSGKPELLSPGQAERVSVGKAGTVSPGKEDPVSSRREDPISAGSRKTSSEKVNPESSGKTNPVSSGPGDPRSLGTAGPPSAVKAEPATGGKGDPLSSEKAGLVASGKAAPTASGKAEPLAVGKEDPVSKGKADAGPSGQGDSVSIGKVVSTPGKTVPVPSGKVDPVSLGKAEAIPEGKVGSLPLEKGSPVTTTKADPRASGKAQPQSGGKAETKLPGQEGAAAPGEAGAVCLKKETPQASEKVDPGSCRKAEPLASGKGEPVSLGKADSAPSRKTESPSLGKVVPLSLEKTKPSSSSRQLDRKALGSARSPEGARGSEGRVEPKAEPVSSTEASSLGQKDLEAAGAERSPCPEAAAPPPGPRTRDNFTKAPSWEASAPPPPREDAGTQAGAQACVSVAVSPMSPQDGAGGSAFSFQAAPRAPSPPSRRDAGLQVSLGAAETRSVATGPMTPQAAAPPAFPEVRGFAGPGFNGLGGPVVRAPGKPGWKPVSRNKLEAGDTEQGLMSWGHRGKYRGRAGPQLQTWVDNGACLGQHSGGPNSTRERHSSVEQRAAPEAIPEGSTHDGGDTRAHKGGEVHPPEERLKALRPAAPQPQMRKPGGTPKDSRASQEDNREEARPRQERPPPQQKVTGAAGP

SEQ ID NO: 883982 - protein, 798 aa, Homo sapiens
MDTAEDPAWLQLLQKDSSPPGPRPTAFFCPQDGSLGAGSSAMRDYCPSQQKASPAPPRHTPDQSPGMESRHRSPSGAGEGASCSDGPRGSLACPSPTCFSPQESPSKETLEAHGASISGTPEATTSGKPEPVSSVKTEPKSSDDRNPMFLEKMDFKSSKQADSTSIGKEDPGSSRKADPMFTGKAEPEILGKGDPVAPGRMDPMTVRKEDLGSLGKVDPLCSSKTYTVSPRKEDPGSLRKVDPVSSDKVDPVFPRKEEPRYSGKEHPVSSEKVAPTSAEKVDLVLSGKRDPGPSGKADPVPLESMDSASTGKTEPGLLGKLIPGSSGKNGPVSSGTGAPGSLGRLDPTCLGMADPASVGNVETVPATKEDSRFLGKMDPASSGEGRPVSGHTDTTASAKTDLTSLKNVDPMSSGKVDPVSLGKMDPMCSGKPELLSPGQAERVSVGKAGTVSPGKEDPVSSRREDPISAGSRKTSSEKVNPESSGKTNPVSSGPGDPRSLGTAGPPSAVKAEPATGGKGDPLSSEKAGLVASGKAAPTASGKAEPLAVGKEDPVSKGKADAGPSGQGDSVSIGKVVSTPGKTVPVPSGKVDPVSLGKAEAIPEGKVGSLPLEKGSPVTTTKADPRASGKAQPQSGGKAETKLPGQEGAAAPGEAGAVCLKKETPQASEKVDPGSCRKAEPLASGKGEPVSLGKADSAPSRKTESPSLGKVVPLSLEKTKPSSSSRQLDRKALGSARSPEGARGSEGRQASARPVPRAAAECAPAAVLLAGGTHGRVICPHFVRPSFRPSQAPFLITGP

SEQ ID NO: 883983 - protein, 1000 aa, Homo sapiens; identical to SEQ ID NO: 883980

SEQ ID NO: 883984 - protein, 1000 aa, Homo sapiens; identical to SEQ ID NO: 883980

SEQ ID NO: 883985 - protein, 132 aa, Homo sapiens
MSHAGCPERASRQREQKVPSSPSSAGPGTFSSAFYSQSHCSATHFSFLGTPDGKWLYLFIPIALGHSQQPLEEAPQVGKETQGSQPALPHLCAGGPSMMMLIHRICMALRGLGRLNTVDRVMRLRAEMLLRG

SEQ ID NO: 883986 - protein, 268 aa, Homo sapiens
ELQSEGVCHSWAQASVLGFVAWLQGDSGGPVLCLEPDGHWVQAGIISFASSCAQEDAPVLLTNTAAHSSWLQARVQGAAFLAQSPETPEMSDEDSCVACGSLRTAGPQAGAPSPWPWEARLMHQGQLACGGALVSEEAVLTAAHCFIGRQAPEEWSVGLGTRPEEWGLKQLILHGAYTHPEGGYDMALLLLAQPVTLGASLRPLCLPYPDHHLPDGERGWVLGRARPGAGISSLQTVPVTLLGPRACSRLHAAPGGDGSPILPGMVCT

SEQ ID NO: 883987 - protein, 187 aa, Homo sapiens
TLPMALGGQADAPGTAGLWRSPGVRGGGANCCPLLHWVSLGSLSAVPPAPAGSPVTWCQSTLPLHRRQAPEEWSVGLGTRPEEWGLKQLILHGAYTHPEGGYDMALLLLAQPVTLGASLRPLCLPYPDHHLPDGERGWVLGRARPGAGRWAQGQGCCPSNLQAGAASFPLLHRHQLPPDSARDPPGA

SEQ ID NO: 883988 - protein, 3521 aa, Homo sapiens
LPPQFAPRLGLERRSAGSGSPSGASRAHSQRPRRRCGATPRPPQSRPRPPREGAELPAAARMASLAALALSLLLRLQLPPLPGARAQSAPGGCSFDEHYSNCGYSVALGTNGFTWEQINTTEKPMLDQAVPTGSFMMVNSSGRASGQKAHLLLPTLKENDTHCIDFHYYFSSRDRSSPGALNVYVKVNGGPQGNPVWNVSGVVTEGWVKAELAISTFWPHFYQVIFESVSLKGHPGYIAVDEVRVLAHPCRKAPHFLRLQNVEVNVGQNATFQCIAGGKWSQHDKLWLQQWNGRDTALMVTRVVNHRRFSATVSVADTAQRSVSKYRCVIRSDGGSGVSNYAELIVKEPPTPIAPPELLAVGATYLWIKPNANSIIGDGPIILKEVEYRTTTGTWAETHIVDSPNYKLWHLDPDVEYEIRVLLTRPGEGGTGPPGAPLTTRTKCADPVHGPQNVEIVDIRARQLTLQWEPFGYAVTRCHSYNLTVQYQYVFNQQQYEAEEVIQTSSHYTLRGLRPFMTIRLRLLLSNPEGRMESEELVVQTEEDVPGAVPLESIQGGPFEEKIYIQWKPPNETNGVITLYEINYKAVGSLDPSADLSSQRGKVFKLRNETHHLFVGLYPGTTYSFTIKASTAKGFGPPVTTRIATKISAPSMPEYDTDTPLNETDTTITVMLKPAQSRGAPVSVYQLVVKEERLQKSRRAADIIECFSVPVSYRNASSLDSLHYFAAELKPANLPVTQPFTVGDNKTYNGYWNPPLSPLKSYSIYFQALSKANGETKINCVRLATKAPMGSAQVTPGTPLCLLTTGASTQNSNTVEPEKQVDNTVKMAGVIAGLLMFIIILLGVMLTIKRRRNAYSYSYYLSQRKLAKKQKETQSGAQREMGPVASADKPTTKLSASRNDEGFSSSSQDVNGFTDGSRGELSQPTLTIQTHPYRTCDPVEMSYPRDQFQLAIRVADLLQHITQMKRGQGYGFKEEYEALPEGQTASWDTAKEDENRNKNRYGNIISYDHSRVRLLVLDGDPHSDYINANYIDGYHRPRHYIATQGPMQETVKDFWRMIWQENSASIVMVTNLVEVGRVKCVRYWPDDTEVYGDIKVTLIETEPLAEYVIRTFTVQKKGYHEIRELRLFHFTSWPDHGVPCYATGLLGFVRQVKFLNPPEAGPIVVHCSAGAGRTGCFIAIDTMLDMAENEGVVDIFNCVRELRAQRVNLVQTEEQYVFVHDAILEACLCGNTAIPVCEFRSLYYNISRLDPQTNSSQIKDEFQTLNIVTPRVRPEDCSIGLLPRNHDKNRSMDVLPLDRCLPFLISVDGESSNYINAALMDSHKQPAAFVVTQHPLPNTVADFWRLVFDYNCSSVVMLNEMDTAQFCMQYWPEKTSGCYGPIQVEFVSADIDEDIIHRIFRICNMARPQDGYRIVQHLQYIGWPAYRDTPPSKRSLLKVVRRLEKWQEQYDGREGRTVVHCLNGGGRSGTFCAICSVCEMIQQQNIIDVFHIVKTLRNNKSNMVETLEQYKFVYEVALEYLSSFSSMGWGTCRSPEAAVTKPPFVGMAVTGLRSSEVAPCLTPRRRLVALCSTGGSAPSEGSPVAVGDAAPKGPGFLFNLTSHSQGPKQKYTHKQGLGFLAPRPPAFVLSLWISWQANCAGAGEWEAPLPSFSLGVEEMCVLLLYVMEKIEALGGHCSAAPCNLLQGPLAPDICSLDQCDLTMFPRPQERPPILTPNLHGASPTTILYPFPSLGLDRPAFTGRPAVSTAVFDKGVLCFFVWSVGGGGTAGNFSAPPCLCKKGPPPWGRAWADLVGCNPCVSLVVAFFGRDKQDEDLIIFQSVCEKKLSFGGCKILVSYVKKKGAGEFEYVPLRQISRAFYFFLAMSLKAPTLGQHATEQGEMGEPEDGPFGFWGKESTSFVHNLDVQIVNSFLKKPSSHLEKGHCGAHYTLIENRPRESGLEIQGLVQSVSESMRGNQHLLSLYCMPGIMLGTFHRTFHTVLRTPRRELLTCYHLHLIISSNEETHAPSLVMKSWVPKGQVMAMRLLRAVFFIFSEAKQLFYGGKIRPETSEQITPQMEIYTFFLMPVLLGSAEFQIYFSNTFPAPQEKPVSSNFLVSKNNSLFLQAMNGPARETLDLDLYPVLRPKYLTASGGLGPRKLHLEGWSSPRQGMRGREFKKVQLWPSRAHCMLGKWNHGAVVWVDECSMSLGARKSLRPRASWRRGRPFLLGLNKHKKEKKETQAKGSICAMAKKCEKALGEAVWGRPAQCGHSTTRGAARDEPGSRRQMPIASTDFVLLATRSPWSFREMHSASCWPRLLLGQWGCLFSFHQTLENIPLSVHFLISHLFVCLLIVLLLELNMQWIMRLRFYEKPRVSALPRSRVTNPDLQAHEDGTGKEPTKVASIGMGSGAVQKSRDTRLDQGRAVTLEVQKEVPQSKGKQRNPTMNLLFSFDEPLPRCISADPGDPPPLGLLASLGSSPMPQLAFPSLQGACSMANLPAVCYFLRSWYIQTEMRVEGELFNTNPKIFFCSGRGEIAGRYKKTVAFIILNGRNLRCDFREKQTCKEKKISGHVGVTQQGPVMISPSSSPYFPTTQPFSKAGQLNRSYASAHRKKLRLMDGDDFPKIPWDKDVARLGGDGAPVPRNLNIFLYPGNLRSQHHHPQGVSPPHPIYRVSSACHEQRKILLMLSESLQQELLPHRCGLCLGKMQGSNEKPRKFLHLCLWPEIASGCILAALQHCILSGVKNLGQPGVLGPLEGHSRPLFVGMEGDSLLLVLALSVGVACKEPTDPMLGTLTCELIKFFQHSKGGFVIVTMLLMRKLRLLGEKSLAHSSTASEMNEPGFKPVFSHYRDNIFPPLYLTFFPGGYPYTEETRVEQIRQWIKLKANNSKLKIPSSLMFYVHNSCKICIPLSDLALLVLICLYEYFKKKCALFLMLFCSVHPAMTDPRSAGLQLDPRIDSRSSDPAASQSQFIGSRSRPTDLLLGSSFGVWVLYLTVHEGTSTEGIFQLGAGRNPLTHTRMMRICSSGVEKDEPNKTLKGKEKLDTAVLSRFLNARLESGACCPSGVTWLLMWASLRTHFMSSWGLEGSSLSLATHNYWVPTAPSTLEGALLGNRDYYGTINSWVRHGVVVDRAQSLFERKHTYMKNIHEKRTLINIRRGRFGALEAGKQERKARKLEPSEYSEPRMQMTYLAKWHFCDIAGERMGNSLPEPLGTRANLSVWGKKMMHFPLTHHVYSSSTPHCHTSSCCKSSPGSTFPRRWWEPLRVHRGISPVRLLYTTEDEAQGVAARPLSCYLCRSDCPTQIQRHLKEMIIPWYLTALGQNEESHPSLGCSLPLLGWVNRSSAPGSTRSNILEDMGEPKRKHEQDAVPKSCQQVVLGQDPQGKKWSTQLEGRLEEKKHKRGYVMSSQIPDLASPLLDSLSSFLACDQLQITAKENKEIGKVNPTRRDKLRFRFVYSSHAKFPCWRFSMYTCLEVIECKALALSCRDLPLRSETEQQGERLVVECGGAVLAPVSSDTFFRIMDLILRSTAEISKPYLCT

SEQ ID NO: 883989 - protein, 1262 aa, Homo sapiens
MSQGPGDRCPSRVQTLSYWQQGVHGALERCTQLRVGQDSFWANGAASFPFIRHCENIPLSVHFLISHLFVCLLIVLLLELNMQWIMRLRFYEKPRVSALPRSRVTNPDLQAHEDGTGKEPTKVASIGMGSGAVQKSRDTRLDQGRAVTLEVQKEVPQSKGKQRNPTMNLLFSFDEPLPRCISADPGDPPPLGLLASLGSSPMPQLAFPSLQGACSMANLPAVCYFLRSWYIQTGMRVEGELFNTNPKIFFCSGRGEIAGRYKKTVAFIILNGRNLRCDFREKQTCKEKKISGHVGVTQQGPVMISPSSSPYFPTTQPFSKAGQLNRSEASAHRKKLRLMDGDDFPKIPWDKDVARLGGDGAPVPRNLNIFLYPGNLRSQHHHPQGVSPPHPIYRVSSACHEQRKILLMLSESLQQELLPHRCGLCLGKMQGSNEKPRKFLHLCLWPEIASGCILAALQHCILSGVKNLGQPGVLGPLEGHSRPLFVGMEGDSLLLVLALSVGVACKEPTDPMLGTLTCELIKFFQHSKGGFVIVTMLLMRKLRLLGEKSLAHSSTASEMNEPGFKPVFSHYRDNIFPPLYLTFFPGGYPYTEETRVEQIRQWIKLKANNSKLKIPSSLMFYVHNSCKICIPLSDLALLVLICLYEYFKKKCALFLMLFCSVHPAMTDPRSAGLQLDPRIDSRSSDPAASQSQFIGSRSRPTDLLLGSSFGVWVLYLTVHEGTSTKDIFQLGAGRNPLTHTRMMRICSSGVEKDEPNKTLKGKEKLDTAVLSRFLNARLESGACCPSGVTWLLMWASLRTHFMSSWGLEGSSLSLATHNYWVPTAPSTLEGALLGNRDYYGTINSWVRHGVVVDRAQSLFERKHTYMKNIHEKRTLINIRRGRFGALEAGKQERKARKLEPSEYSEPRMQMTYLENGHFCDIAGERMGNSLPEPLGTRANLSVWGKKMMHFPLTHHVYSSSTPHCHTSSCCKSSPGSTFPRRWWEPLRVHRGISPVRLLYTTEDEAQGVAARPLSCYLCRSDCPTQIQRHLKEMIIPWYLTALGQNEESHPSLGCSLPLLGWVNRSSAPGSTRSNILEDMGEPKRKHEQDAVPKSCQQVVLGQDPQGKKWSTQLEGRLEEKKHKRGYVMSSQIPDLASPLLDSLSSFLACDQLQITAKENKEIGKVNPTRRDKLRFRFVYSSHAKFPCWRFSMYTCLEVIECKALALSCRDLPLRSETEQQGERLVVEVGGAVLAPVSSDTFFRIMDLILRSTAEISKPYLCT

SEQ ID NO: 883990 - protein, 1524 aa, Homo sapiens
LPPQFAPRLGLERRSAGSGSPSGASRAHSQRPRRRCGATPRPPQSRPRPPREGAELPAAARMASLAALALSLLLRLQLPPLPGARAQSAPGGCSFDEHYSNCGYSVALGTNGFTWEQINTTEKPMLDQAVPTGSFMMVNSSGRASGQKAHLLLPTLKENDTHCIDFHYYFSSRDRSSPGALNVYVKVNGGPQGNPVWNVSGVVTEGWVKAELAISTFWPHFYQVIFESVSLKGHPGYIAVDEVRVLAHPCRKAPHFLRLQNVEVNVGQNATFQCIAGGKWSQHDKLWLQQWNGRDTALMVTRVVNHRRFSATVSVADTAQRSVSKYRCVIRSDGGSGVSNYAELIVKEPPTPIAPPELLAVGATYLWIKPNANSIIGDGPIILKEVEYRTTTGTWAETHIVDSPNYKLWHLDPDVEYEIRVLLTRPGEGGTGPPGAPLTTRTKCADPVHGPQNVEIVDIRARQLTLQWEPFGYAVTRCHSYNLTVQYQYVFNQQQYEAEEVIQTSSHYTLRGLRPFMTIRLRLLLSNPEGRMESEELVVQTEEDVPGAVPLESIQGGPFEEKIYIQWKPPNETNGVITLYEINYKAVGSLDPSADLSSQRGKVFKLRNETHHLFVGLYPGTTYSFTIKASTAKGFGPPVTTRIATKISAPSMPEYDTDTPLNETDTTITVMLKPAQSRGAPVSVYQLVVKEERLQKSRRAADIIECFSVPVSYRNASSLDSLHYFAAELKPANLPVTQPFTVGDNKTYNGYWNPPLSPLKSYSIYFQALSKANGETKINCVRLATKAPMGSAQVTPGTPLCLLTTGASTQNSNTVEPEKQVDNTVKMAGVIAGLLMFIIILLGVMLTIKRRRNAYSYSYYLSQRKLAKKQKETQSGAQREMGPVASADKPTTKLSASRNDEGFSSSSQDVNGFTDGSRGELSQPTLTIQTHPYRTCDPVEMSYPRDQFQLAIRVADLLQHITQMKRGQGYGFKEEYEALPEGQTASWDTAKEDENRNKNRYGNIISYDHSRVRLLVLDGDPHSDYINANYIDGYHRPRHYIATQGPMQETVKDFWRMIWQENSASIVMVTNLVEVGRVKCVRYWPDDTEVYGDIKVTLIETEPLAEYVIRTFTVQKKGYHEIRELRLFHFTSWPDHGVPCYATGLLGFVRQVKFLNPPEAGPIVVHCSAGAGRTGCFIAIDTMLDMAENEGVVDIFNCVRELRAQRVNLVQTEEQYVFVHDAILEACLCGNTAIPVCEFRSLYYNISRLDPQTNSSQIKDEFQTLNIVTPRVRPEDCSIGLLPRNHDKNRSMDVLPLDRCLPFLISVDGESSNYINAALMDSHKQPAAFVVTQHPLPNTVADFWRLVFDYNCSSVVMLNEMDTAQFCMQYWPEKTSGCYGPIQVEFVSADIDEDIIHRIFRICNMARPQDGYRIVQHLQYIGWPAYRDTPPSKRSLLKVVRRLEKWQEQYDGREGRTVVHCLNGGGRSGTFCAICSVCEMIQQQNIIDVFHIVKTLRNNKSNMVETLEQYKFVYEVALEYLSSF

SEQ ID NO: 883991 - protein, 138 aa, Homo sapiens [sequence omitted]

SEQ ID NO: 883992 - protein, 149 aa, Homo sapiens
RAHTQTQTHTPTHTPCPLSPPCKLVAFSSQSLGCDLKEFRQQQSDPGGALDRQPHPRRLGPPSRDASGGLGKHFHPLLSSILAGWLLLLQDSDVSLRSAVRSAGELPTVPQGAGAGDTAEPGNESGHRRGHHDSSAAWSPCWFTVLGSY

SEQ ID NO: 883993 - protein, 113 aa, Homo sapiens
RLSRVPRLPSRLRRGAPRVNPPACKDLDIQRTAEESNVPAFLPLHSHSARNASSSLVFSFQDLNSNPIGSPDTAGGRVRLLLLQDSDVSLRSAVRSAGELPTVPQGSGSFQGI

SEQ ID NO: 883994 - protein, 109 aa, Homo sapiens
MEEVLLPLAVTSDPRPFNQQLPEPPDPRCVLEPQDNPELALALVCALCCCFGIIYCCFSEGRAKDLGGHCPRLSSSRMMPAFLLAPGPSHLLCQGFLPLVWPMLLWLYS

SEQ ID NO: 883995 - protein, 180 aa, Homo sapiens [sequence omitted]

SEQ ID NO: 883996 - protein, 149 aa, Homo sapiens; identical to SEQ ID NO: 883992

SEQ ID NO: 883997 - protein, 219 aa, Homo sapiens
RAHTQTQTHTPTHTPCPLSPPCKLVAFSSQSLGCDLKEFRQQQSDPGGALDRQPHPRRLGPPSRDASGGLGKHFHPLLSSILAGCARNASSSLVFSFQDLNSNPIGSPDTAGGRVRLLLLQDSDVSLRSAVRSAGELPTVPQAGSYWGSGQPWGPLEPWPSGSSCLRNMEATLMSYFQSLQECQLGPGPQTTAPHTVLDLDSDCGSTVPLTLISGSNQT

SEQ ID NO: 883998 - protein, 180 aa, Homo sapiens
RAHTQTQTHTPTHTPCPLSPPCKLVAFSSQSLGCDLKEFRQQQSDPGGALDRQPHPRRLGPPSRDASGGLGKHFHPLLSSILAGCARNASSSLVFSFQDLNSNPIGSPDTAGGRVRLLLLQDSDVSLRSAVRSAGELPTVPQGAGAGDTAEPGNESGHRRGHHDSSAAWSPCWFTVLGSY

SEQ ID NO: 883999 - protein, 250 aa, Homo sapiens
RAHTQTQTHTPTHTPCPLSPPCKLVAFSSQSLGCDLKEFRQQQSDPGGALDRQPHPRRLGPPSRDASGGLGKHFHPLLSSILAGCARNASSSLVFSFQDLNSNPIGSPDTAGGRVRLLLLQDSDVSLRSAVRSAAGSYWGSGQPWGPLEPWPSGSSCLRNMEATLMTLQQKAKWHWIPSGVGLCEGSCRHQLPANTCSPADSLAPSYFQSLQECQLGPGPQTTAPHTVLDLDSDCGSTVPLTLISGSNQT

SEQ ID NO: 884000 - protein, 109 aa, Homo sapiens; identical to SEQ ID NO: 883994

SEQ ID NO: 884001 - protein, 109 aa, Homo sapiens; identical to SEQ ID NO: 883994

SEQ ID NO: 884002 - protein, 152 aa, Homo sapiens
RAHTQTQTHTPTHTPCPLSPPCKLVAFSSQSLGCDLKEFRQQQSDPGGALDRQPHPRRLGPPSRDASGGLGKHFHPLLSSILAGCARNASSSLVFSFQDLNSNPIGSPDTAGGRVSEPFLSLGIHQSHPCRAPFLPLNSSCLTSQATAASRQ

SEQ ID NO: 884003 - protein, 109 aa, Homo sapiens; identical to SEQ ID NO: 883994

SEQ ID NO: 884004 - protein, 109 aa, Homo sapiens; identical to SEQ ID NO: 883994

SEQ ID NO: 884005 - protein, 175 aa, Homo sapiens
RAHTQTQTHTPTHTPCPLSPPCKLVAFSSQSLGCDLKEFRQQQSDPGGALDRQPHPRRLGPPSRDASGGLGKHFHPLLSSILAGCARNASSSLVFSFQDLNSNPIGSPDTAGGRVSWVLLGIWPALGALGALAQWKLVPEEHGGHANELLPESSRVPTGTRTPDHSPPHRPGPGF

SEQ ID NO: 884006 - protein, 116 aa, Homo sapiens
RAHTQTQTHTPTHTPCPLSPPCKLVAFSSQSLGCDLKEFRQQQSDPGGALDRQPHPRRLGPPSRDASGGLGKHFHPLLSSILAGCARNASSSLVFSFQDLNSNPIGSPDTAGGRVR

SEQ ID NO: 884007 - protein, 180 aa, Homo sapiens
RAHTQTQTHTPTHTPCPLSPPCKLVAFSSQSLGCDLKEFRQQQSDPGGALDRQPHPRRLGPPSRDASGGLGKHFHPLLSSILAGWLLLLQDSDVSLRSAVRSAAGSYWGSGQPWGPLEPWPSGSSCLRNMEATLMSYFQSLQECQLGPGPQTTAPHTVLDLDSDCGSTVPLTLISGSNQT

SEQ ID NO: 884008 - protein, 175 aa, Homo sapiens; identical to SEQ ID NO: 884005

SEQ ID NO: 884009 - protein, 211 aa, Homo sapiens
RAHTQTQTHTPTHTPCPLSPPCKLVAFSSQSLGCDLKEFRQQQSDPGGALDRQPHPRRLGPPSRDASGGLGKHFHPLLSSILAGCARNASSSLVFSFQDLNSNPIGSPDTAGGRVRLLLLQDSDVSLRSAVRSAAGSYWGSGQPWGPLEPWPSGSSCLRNMEATLMSYFQSLQECQLGPGPQTTAPHTVLDLDSDCGSTVPLTLISGSNQT

SEQ ID NO: 884010 - protein, 109 aa, Homo sapiens; identical to SEQ ID NO: 883994

SEQ ID NO: 884011 - protein, 129 aa, Homo sapiens
MGKGEEGKYEYLPLTNNRGALVPKEIDSRIPSKPYPYSFCLFVCFQTRSCSVQCRGVTTAHDNFDFPGPSEPLIQPPEWLGPQTPHTANFYVFVFIFLQRQGLPMLPKLVLNSWAQVILLLQPPKVLGL

SEQ ID NO: 884012 - protein, 109 aa, Homo sapiens; identical to SEQ ID NO: 883994

SEQ ID NO: 884013 - protein, 109 aa, Homo sapiens; identical to SEQ ID NO: 883994

SEQ ID NO: 884014 - protein, 495 aa, Homo sapiens
MSLPNSSCLLEDKMCEGNKTTMASPQLMPLVVVLSTICLVTVGLNLLVLYAVRSERKLHTVGNLYIVSLSVADLIVGAVVMPMNILYLLMSKWSLGRPLCLFWLSMDYVASTASIFSVFILCIDRYRSVQQPLRYLKYRTKTRASATILGAWFLSFLWVIPILGWNHFMQQTSVRREDKCETDFYDVTWFKVMTAIINFYLPTLLMLWFYAKIYKAVRQHCQHRELINRSLPSFSEIKLRPENPKGDAKKPGKESPWEVLKRKPKDAGGGSVLKSPSQTPKEMKSPVVFSQEDDREVDKLYCFPLDIVHMQAAAEGSSRDYVAVNRSHGQLKTDEQGLNTHGASEISEDQMLGDSQSFSRTDSDTTTETAPGKGKLRSGSNTGLDYIKFTWKRLRSHSRQYVSGLHMNRERKAAKQLGFIMAAFILCWIPYFIFFMVIAFCKNCCNEHLHMFTIWLGNRARLCLKKKKYNILTMCPLKCAQIHIHGIPKSGGSSK

SEQ ID NO: 884015 - protein, 487 aa, Homo sapiens
MSLPNSSCLLEDKMCEGNKTTMASPQLMPLVVVLSTICLVTVGLNLLVLYAVRSERKLHTVGNLYIVSLSVADLIVGAVVMPMNILYLLMSKWSLGRPLCLFWLSMDYVASTASIFSVFILCIDRYRSVQQPLRYLKYRTKTRASATILGAWFLSFLWVIPILGWNHFMQQTSVRREDKCETDFYDVTWFKVMTAIINFYLPTLLMLWFYAKIYKAVRQHCQHRELINRSLPSFSEIKLRPENPKGDAKKPGKESPWEVLKRKPKDAGGGSVLKSPSQTPKEMKSPVVFSQEDDREVDKLYCFPLDIVHMQAAAEGSSRDYVAVNRSHGQLKTDEQGLNTHGASEISEDQMLGDSQSFSRTDSDTTTETAPGKGKLRSGSNTGLDYIKFTWKRLRSHSRQYVSGLHMNRERKAAKQLGFIMAAFILCWIPYFIFFMVIAFCKNCCNEHLHMFTIWLGYINSTLNPLIYPLCNENFKKTFKRILHIRS

SEQ ID NO: 884016 - protein, 694 aa, Homo sapiens
MEWGYLLEVTSLLAALALLQRSSGAAAASAKELACQEITVPLCKGIGYNYTYMPNQFNHDTQDEAGLEVHQFWPLVEIQCSPDLKFFLCSMYTPICLEDYKKPLPPCRSVCERAKAGCAPLMRQYGFAWPDRMRCDRLPEQGNPDTLCMDYNRTDLTTAAPSPPRRLPPPPPGEQPPSGSGHGRPPGARPPHRGGGRGGGGGDAAAPPARGGGGGGKARPPGGGAAPCEPGCQCRAPMVSVSSERHPLYNRVKTGQIANCALPCHNPFFSQDERAFTVFWIGLWSVLCFVSTFATVSTFLIDMERFKYPERPIIFLSACYLFVSVGYLVRLVAGHEKVACSGGAPGAGGAGGAGGAAAGAGAAGAGAGGPGGRGEYEELGAVEQHVRYETTGPALCTVVFLLVYFFGMASSIWWVILSLTWFLAAGMKWGNEAIAGYSQYFHLAAWLVPSVKSIAVLALSSVDGDPVAGICYVGNQSLDNLRGFVLAPLVIYLFIGTMFLLAGFVSLFRIRSVIKQQDGPTKTHKLEKLMIRLGLFTVLYTVPAAVVVACLFYEQHNRPRWEATHNCPCLRDLQPDQARRPDYAVFMLKYFMCLVVGITSGVWVWSGKTLESWRSLCTRCCWASKGAAVGGGAGATAAGGGGGPGGGGGGGPGGGGGPGGGGGSLYSDVSTGLTWRSGTASSVSYPKQMPLSQV

SEQ ID NO: 884017 - protein, 535 aa, Homo sapiens
PSSICWLIFSLTLVPAARYEVGKRSHRRLLPVLPPARLGLLPSLKVHRGSGAQLGGRRPGGGHLLRGQPEPGCQCRAPMVSVSSERHPLYNRVKTGQIANCALPCHNPFFSQDERAFTVFWIGLWSVLCFVSTFATVSTFLIDMERFKYPERPIIFLSACYLFVSVGYLVRLVAGHEKVACSGGAPGAGGAGGAGGAAAGAGAAGAGAGGPGGRGEYEELGAVEQHVRYETTGPALCTVVFLLVYFFGMASSIWWVILSLTWFLAAGMKWGNEAIAGYSQYFHLAAWLVPSVKSIAVLALSSVDGDPVAGICYVGNQSLDNLRGFVLAPLVIYLFIGTMFLLAGFVSLFRIRSVIKQQDGPTKTHKLEKLMIRLGLFTVLYTVPAAVVVACLFYEQHNRPRWEATHNCPCLRDLQPDQARRPDYAVFMLKYFMCLVVGITSGVWVWSGKTLESWRSLCTRCCWASKGAAVGGGAGATAAGGGGGPGGGGGGGPGGGGGPGGGGGSLYSDVSTGLTWRSGTASSVSYPKQMPLSQV

SEQ ID NO: 884018 - protein, 535 aa, Homo sapiens; identical to SEQ ID NO: 884017

SEQ ID NO: 884019 - protein, 535 aa, Homo sapiens; identical to SEQ ID NO: 884017

SEQ ID NO: 884020 - protein, 550 aa, Homo sapiens
MVGEEKMSLRNRLSKSRENPEEDEDQRNPAKESLETPSNGRIDIKQLIAKKIKLTAEAEELKPFFMKEVGSHFDDFVTNLIEKSASLDNGGCALTTFSVLEGEKNNHRAKDLRAPPEQGKIFIARRSLLDELLEVDHIRTIYHMFIALLILFILSTLVVDYIDEGRLVLEFSLLSYAFGKFPTVVWTWWIMFLSTFSVPYFLFQHWATGYSKSSHPLIRSLFHGFLFMIFQIGVLGFGPTYVVLAYTLPPASRFIIIFEQIRFVMKAHSFVRENVPRVLNSAKEKSSTVPIPTVNQYLYFLFAPTLIYRDSYPRNPTVRWGYVAMKFAQVFGCFFYVYYIFERLCAPLFRNIKQEPFSARVLVLCVFNSILPGVLILFLTFFAFLHCWLNAFAEMLRFGDRMFYKDWWNSTSYSNYYRTWNVVVHDWLYYYAYKDFLWFFSKRFKSAAMLAVFAVSAVVHEYALAVCLSFFYPVLFVLFMFFGMAFNFIVNDSRKKPIWNVLMWTSLFLGNGVLLCFYSQEWYARQHCPLKNPTFLDYVRPRSWTCRYVF

SEQ ID NO: 884021 - protein, 550 aa, Homo sapiens; identical to SEQ ID NO: 884020

SEQ ID NO: 884022 - protein, 550 aa, Homo sapiens; identical to SEQ ID NO: 884020

SEQ ID NO: 884023 - protein, 550 aa, Homo sapiens; identical to SEQ ID NO: 884020

SEQ ID NO: 884024 - protein, 175 aa, Homo sapiens
MVGEEKMSLRNRLSKSRENPEEDEDQRNPAKESLETPSNGRIDIKQLIAKKIKLTAEAEELKPFFMKEVGSHFDDFVTNLIEKSASLDNGGCALTTFSVLEGEKNNHRAKDLRAPPEQGKIFIARRSLLDELLEVDHIRTIYHMFIALLILFILSTLVVDYIDEGRLVLEFSYLC

SEQ ID NO: 884025 - protein, 78 aa, Homo sapiens
SEALESSEAGPDGVPVCSAASVDLSTPVFSCRKRLRLNLARAFWNQTCGGRQGRAGERKAGRAFPRLLHSELCCLWGR

SEQ ID NO: 884026 - protein, 1132 aa, Homo sapiens
MIATPLKHSRIYLPPEASSQRRNLPMDAIFFDSIPSGTLTPVKDLVKYQNSSLKLNDHKKNQFLKMTTFNNKNIFQSTMLTEATTSNSSLDISAIKPNKDGLKNKANYESPGKIFLRMKEKVLRDKQEQPSRNSSLLEPQKSGNNETFTPNRVEKKKLQHTYLCEEKENNKSFQSDDSSLRASVQGVPLESSNNDIFLPVKQKIQCQQEKKAPLHNLTYELPTLNQEQENFLAVEARNKTLTRAQLAKQIFHSKESIVATTKSKKDTFVLESVDSADEQFQNTNAETLSTNCIPIKNGSLLMVSDSERTTEGTSQQKVKEGNGKTVPGETGLPGSMKDTCKIVLATPRLHITIPRRSKRNISKLSPPRIFQTVTNGLKKNQVVQLQEWMIKSINNNTAICVEGKLIDVTNIYWHSNVIIERIEHNKLRTISGNVYILKGMIDQISMKEAGYPNYLIRKFMFGFPENWKEHIDNFLEQLRAGEKNREKTKQKQKTGRSVRDIRKSMKNDARENQTDTAQRATTTYDFDCDNLELKSNKHSESPGATELNMCHSNCQNKPTLRFPDDQVNNTIQNGGGDDLSNQELIGKKEYKMSSKKLKIGERTNERIIKSQKQETTEELDVSIDILTSREQFFSDEERKYMAINQKKAYILVTPLKSRKVIEQRCMRYNLSAGTIKAVTDFVIPECQKKSPISKSMGTLENTFEGHKSKNKEDCDERDLLTVNRKIKISNLEKEQMLTSDFKKNTRLLPKLKKIENQVAMSFYKHQSSPDLSSEESETEKEIKRKAEVKKTKAGNTKEAVVHLRKSTRNTSNIPVILEPETEESENEFYIKQKKARPSVKETLQKSGVRKEFPITEAVGSDKTNRHPLECLPGLIQDKEWNEKELQKLHCAFASLPKHKPGFWSEVAAAVGSRSPEECQRKYMENPRGKGSQKHVTKKKPANSKGQNGKRGDADQKQTIKITAKVGTLKRKQQMREFLEQLPKDDHDDFFSTTPLQHQRILLPSFQDSEDDDDILPNMDKNPTTPSSVIFPLVKTPQCQHVSPGMLGSINRNDCDKYVFRMQKYHKSNGGIVWGNIKKKLVETDFSTPTPRRKTPFNTDLGENSGIGKLFTNAVESLDEEEKDYYFSNSDSA

SEQ ID NO: 884027 - protein, 1171 aa, Homo sapiens
MIATPLKHSRIYLPPEASSQRRNLPMDAIFFDSIPSGTLTPVKDLVKYQNSSLKLNDHKKNQFLKMTTFNNKNIFQSTMLTEATTSNSSLDISAIKPNKDGLKNKANYESPGKIFLRMKEKVLRDKQEQPSRNSSLLEPQKSGNNETFTPNRVEKKKLQHTYLCEEKENNKSFQSDDSSLRASVQGVPLESSNNDIFLPVKQKIQCQQEKKAPLHNLTYELPTLNQEQENFLAVEARNKTLTRAQLAKQIFHSKESIVATTKSKKDTFVLESVDSADEQFQNTNAETLSTNCIPIKNGSLLMVSDSERTTEGTSQQKVKEGNGKTVPGETGLPGSMKDTCKIVLATPRLHITIPRRSKRNISKLSPPRIFQTVTNGLKKNQVVQLQEWMIKSINNNTAICVEGKLIDVTNIYWHSNVIIERIEHNKLRTISGNVYILKGMIDQISMKEAGYPNYLIRKFMFGFPENWKEHIDNFLEQLRDGVCHVGQTGLELLATSDPPVSASQSVGITGMSHCAWPEAGEKNREKTKQKQKTGRSVRDIRKSMKNDARENQTDTAQRATTTYDFDCDNLELKSNKHSESPGATELNMCHSNCQNKPTLRFPDDQVNNTIQNGGGDDLSNQELIGKKEYKMSSKKLKIGERTNERIIKSQKQETTEELDVSIDILTSREQFFSDEERKYMAINQKKAYILVTPLKSRKVIEQRCMRYNLSAGTIKAVTDFVIPECQKKSPISKSMGTLENTFEGHKSKNKEDCDERDLLTVNRKIKISNLEKEQMLTSDFKKNTRLLPKLKKIENQVAMSFYKHQSSPDLSSEESETEKEIKRKAEVKKTKAGNTKEAVVHLRKSTRNTSNIPVILEPETEESENEFYIKQKKARPSVKETLQKSGVRKEFPITEAVGSDKTNRHPLECLPGLIQDKEWNEKELQKLHCAFASLPKHKPGFWSEVAAAVGSRSPEECQRKYMENPRGKGSQKHVTKKKPANSKGQNGKRGDADQKQTIKITAKVGTLKRKQQMREFLEQLPKDDHDDFFSTTPLQHQRILLPSFQDSEDDDDILPNMDKNPTTPSSVIFPLVKTPQCQHVSPGMLGSINRNDCDKYVFRMQKYHKSNGGIVWGNIKKKLVETDFSTPTPRRKTPFNTDLGENSGIGKLFTNAVESLDEEEKDYYFSNSDSA

SEQ ID NO: 884028 - protein, 1151 aa, Homo sapiens
MIATPLKHSRIYLPPEASSQRRNLPMDAIFFDSIPSGTLTPVKDLVKYQNSSLKLNDHKKNQFLKMTTFNNKNIFQSTMLTEATTSNSSLDISAIKPNKDGLKNKANYESPGKIFLRMKEKVLRDKQEQPSRNSSLLEPQKSGNNETFTPNRVEKKKLQHTYLCEEKENNKSFQSDDSSLRASVQGVPLESSNNDIFLPVKQKIQCQQEKKAPLHNLTYELPTLNQEQENFLAVEARNKTLTRAQLAKQIFHSKESIVATTKSKKDTFVLESVDSADEQFQNTNAETLSTNCIPIKNGSLLMVSDSERTTEGTSQQKVKEGNGKTVPGETGLPGSMKDTCKIVLATPRLHITIPRRSKRNISKLSPPRIFQTVTNGLKKNQVVQLQEWMIKSINNNTAICVEGKLIDVTNIYWHSNVIIERIEHNKLRTISGNVYILKGMIDQISMKEAGYPNYLIRKFMFGFPENWKEHIDNFLEQLRDGVCHVGQTGLELLATSDPPVSASQSVGITGMSHCAWPEAGEKNREKTKQKQKTGRSVRDIRKSMKNDARENQTDTAQRATTTYDFDCDNLELKSNKHSESPGATELNMCHSNCQNKPTLRFPDDQVNNTIQNGGGDDLSNQELIGKKEYKMSSKKLKIGERTNERIIKSQKQETTEELDVSIDILTSREQFFSDEERKYMAINQKKAYILVTPLKSRKVIEQRCMRYNLSAGTIKAVTDFVIPECQKKSPISKSMGTLENTFEGHKSKNKEDCDERDLLTVNRKIKISNLEKEQMLTSDFKKNTRLLPKLKKIENQVAMSFYKHQSSPDLSSEESETEKEIKRKAEVKKTKAGNTKEAVVHLRKSTRNTSNIPVILEPETEESENEFYIKQKKARPSVKETLQKSGVRKEFPITEAVGSDKTNRHPLECLPGLIQDKEWNEKELQKLHCAFASLPKHKPGFWSEVAAAVGSRSPEECQRKYMENPRGKGSQKHVTKKKPANSKGQNGKRGDADQKQTIKITAKVGTLKRKQQMREFLEQLPKDDHDDFFSTTPLQHQRILLPSFQDSEDDDDILPNMDKNPTTPSSVIFPLVKTPQCQHVSPGMLGSINRNDCDKYVFRMQKYHKSNGGIVWGNIKKKLVETDFSTPTPRRKTPFNTGNTLTAFFCGSVLL

SEQ ID NO: 884029 - protein, 1090 aa, Homo sapiens
MIATPLKHSRIYLPPEASSQRRNLPMDAIFFDSIPSGTLTPVKDLVKYQNSSLKLNDHKKNQFLKMTTFNNKNIFQSTMLTEATTSNSSLDISAIKPNKDGLKNKANYESPGKIFLRMKEKVLRDKQEQPSRNSSLLEPQKSGNNETFTPNRVEKKKLQHTYLCEEKENNKSFQSDDSSLRASVQGVPLESSNNDIFLPVKQKIQCQQEKKAPLHNLTYELPTLNQEQENFLAVEARNKTLTRAQLAKQIFHSKESIVATTKSKKDTFVLESVDSADEQFQNTNAETLSTNCIPIKNGSLLMVSDSERTTEGTSQQKVKEGNGKTVPGETGLPGSMKDTCKIVLATPRLHITIPRRSKRNISKLSPPRIFQTVTNGLKKNQVVQLQEWMIKSINNNTAICVEGKLIDVTNIYWHSNVIIERIEHNKLRTISGNVYILKGMIDQISMKEAGYPNYLIRKFMFGFPENWKEHIDNFLEQLRDGVCHVGQTGLELLATSDPPVSASQSVGITGMSHCAWPEAGEKNREKTKQKQKTGRSVRDIRKSMKNDARENQTDTAQRATTTYDFDCDNLELKSNKHSESPGATELNMCHSNCQNKPTLRFPDDQVNNTIQNGGGDDLSNQELIGKKEYKMSSKKLKIGERTNERIIKSQKQETTEELDVSIDILTSREQFFSDEERKYMAINQKKAYILVTPLKSRKVIEQRCMRYNLSAGTIKAVTDFVIPECQKKSPISKSMGTLENTFEGHKSKNKEDCDERDLLTVNRKIKISNLEKEQMLTSDFKKNTRLLPKLKKIENQVAMSFYKHQSSPDLSSEESETEKEIKRKAEVKKTKAGNTKEAVVHLRKSTRNTSNIPVILEPETEESENEFYIKQKKARPSVKETLQKSGVRKEFPITEAVGSDKTNRHPLECLPGLIQDKEWNEKELQKLHCAFASLPKHKPGFWSEVAAAVGSRSPEECQRKYMENPRGKGSQKHVTKKKPANSKGQNGKRGDADQKQTIKITAKVGTLKRKQQMREFLEQLPKDDHDDFFSTTPLQHQRILLPSFQDSEDDDDILPNMDKNPTTPSSVIFPLVKTPQCQHVSPGMLGSINR

SEQ ID NO: 884030 - protein, 1171 aa, Homo sapiens; identical to SEQ ID NO: 884027

SEQ ID NO: 884031 - protein, 1132 aa, Homo sapiens; identical to SEQ ID NO: 884026

SEQ ID NO: 884032 - protein, 729 aa, Homo sapiens
IRHEELRKPKQETPKKQVVHLRKSTRNTSNIPVILEPETEESENEFYIKQKKIENQVAMSFYKHQSSPDLSSEESEAGEKNREKTKQKQKTGRSVRDIRKSMKNDARENQTDTAQRATTTYDFDCDNLELKSNKHSESPGATELNMCHSNCQNKPTLRFPDDQVNNTIQNGGGDDLSNQELIGKKEYKMSSKKLKIGERTNERIIKSQKQETTEELDVSIDILTSREQFFSDEERKYMAINQKKAYILVTPLKSRKVIEQRCMRYNLSAGTIKAVTDFVIPECQKKSPISKSMGTLENTFEGHKSKNKEDCDERDLLTVNRKIKISNLEKEQMLTSDFKKNTRLLPKLKKIENQVAMSFYKHQSSPDLSSEESETEKEIKRKAEVKKTKAGNTKEAVVHLRKSTRNTSNIPVILEPETEESENEFYIKQKKARPSVKETLQKSGVRKEFPITEAVGSDKTNRHPLECLPGLIQDKEWNEKELQKLHCAFASLPKHKPGFWSEVAAAVGSRSPEECQRKYMENPRGKGSQKHVTKKKPANSKGQNGKRGDADQKQTIKITAKVGTLKRKQQMREFLEQLPKDDHDDFFSTTPLQHQRILLPSFQDSEDDDDILPNMDKNPTTPSSVIFPLVKTPQCQHVSPGMLGSINRNDCDKYVFRMQKYHKSNGGIVWGNIKKKLVETDFSTPTPRRKTPFNTDLGENSGIGKLFTNAVESLDEEEKDYYFSNSDSA

SEQ ID NO: 884033 - protein, 668 aa, Homo sapiens
ESVLRKNKIIVFKGLAGEKNREKTKQKQKTGRSVRDIRKSMKNDARENQTDTAQRATTTYDFDCDNLELKSNKHSESPGATELNMCHSNCQNKPTLRFPDDQVNNTIQNGGGDDLSNQELIGKKEYKMSSKKLKIGERTNERIIKSQKQETTEELDVSIDILTSREQFFSDEERKYMAINQKKAYILVTPLKSRKVIEQRCMRYNLSAGTIKAVTDFVIPECQKKSPISKSMGTLENTFEGHKSKNKEDCDERDLLTVNRKIKISNLEKEQMLTSDFKKNTRLLPKLKKIENQVAMSFYKHQSSPDLSSEESETEKEIKRKAEVKKTKAGNTKEAVVHLRKSTRNTSNIPVILEPETEESENEFYIKQKKARPSVKETLQKSGVRKEFPITEAVGSDKTNRHPLECLPGLIQDKEWNEKELQKLHCAFASLPKHKPGFWSEVAAAVGSRSPEECQRKYMENPRGKGSQKHVTKKKPANSKGQNGKRGDADQKQTIKITAKVGTLKRKQQMREFLEQLPKDDHDDFFSTTPLQHQRILLPSFQDSEDDDDILPNMDKNPTTPSSVIFPLVKTPQCQHVSPGMLGSINRNDCDKYVFRMQKYHKSNGGIVWGNIKKKLVETDFSTPTPRRKTPFNTDLGENSGIGKLFTNAVESLDEEEKDYYFSNSDSA

SEQ ID NO: 884034 - protein, 238 aa, Homo sapiens
EDRKAHCNTSGSNGGTFDKEIKDKGLLKAAKKEVTHVKGILNKRKPANSKGQNGKRGDADQKQTIKITAKVGTLKRKQQMREFLEQLPKDDHDDFFSTTPLQHQRILLPSFQDSEDDDDILPNMDKNPTTPSSVIFPLVKTPQCQHVSPGMLGSINRNDCDKYVFRMQKYHKSNGGIVWGNIKKKLVETDFSTPTPRRKTPFNTDLGENSGIGKLFTNAVESLDEEEKDYYFSNSDSA

SEQ ID NO: 884035 - protein, 323 aa, Homo sapiens
YASLDKEDLLSPINQNTLQRSSSVRSMVSSATYGGSDDYIGLALPVDINDIFQVKDIPYFQTKNIPPHDDRGARAFAHDAGGLPSGTGGLVKNSFHLLRQQMSLTEIMNSIHSDASLFLESTEDTGLQEHTDDNCLYCVCIEILGFQPSNQLSAICSHSDFQDIPYSDWCEQTIHNPLEVVPSKFSGISGCSDGVSQEGSASSTKSTELLLGVKTIPDDTPMCRILLRREVLRLVINLSSSVSTKCHETGLLTIKEKYPQTFDDICLYSEVSHLLSHCTFRLPCRRFIQELFQDVQFLQMHEEAEAVLATPPKQPIVDTSAES

SEQ ID NO: 884036 - protein, 227 aa, Homo sapiens
YASLDKEDLLSPINQNTLQRSSSVRSMVSSATYGGSDDYIGLALPVDINDIFQVKDIPYFQTKNIPPHDDRGARAFAHDAGGLPSGTGGLVKNSFHLLRQQMSLTEIMNSIHSDASLFLESTEDTGLQEHTDDNCLYCVCIEILGFQPSNQLSAICSHSDFQDIPYSDWCEQTIHNPLEVVPSKFSGISGCSDGVSQEGSASRTKPDWSQGLNNPMVTRGGLRKRLR

SEQ ID NO: 884037 - protein, 323 aa, Homo sapiens; identical to SEQ ID NO: 884035

SEQ ID NO: 884038 - protein, 406 aa, Homo sapiens
MLFHSLSGPEVHGVIDEMDRRAKSEAPAISSAIDRGDTETTMPSISSDRAALCAGCGGKISDRYYLLAVDKQWHMRCLKCCECKLNLESELTCFSKDGSIYCKEDYYRRFSVQRCARCHLGISASEMVMRARDLVYHLNCFTCTTCNKMLTTGDHFGMKDSLVYCRLHFEALLQGEYPAHFNHADVAAAAAAAAAAKSAGLGAAGANPLGLPYYNGVGTVQKGRPRKRKSPGPGADLAAYNAALSCNENDAEHLDRDQPYPSSQKTKRMRTSFKHHQLRTMKSYFAINHNPDAKDLKQLAQKTGLTKRVLQVWFQNARAKFRRNLLRQENTGVDKSTDAALQTGTPSGPASELSNASLSPSSTPTTLTDLTSPTLPTVTSVLTSVPGNLEGHEPHSPSQTTLTNLF

SEQ ID NO: 884039 - protein, 422 aa, Homo sapiens
MLFHSLSGPEVHGVIDEMDRRAKSEAPAISSAIDRGDTETTMPSISSDRAALCAGCGGKISDRYYLLAVDKQWHMRCLKCCECKLNLESELTCFSKDGSIYCKEDYYRRFSVQRCARCHLGISASEMVMRARDLVYHLNCFTCTTCNKMLTTGDHFGMKDSLVYCRLHFEALLQGEYPAHFNHADVAAAAAAAAAAKSAGLGAAGANPLGLPYYNGVGTVQKGRPRKRKSPGPGADLAAYNAALSCNENDAEHLDRDQPYPSSQKTKRMRTSFKHHQLRTMKSYFAINHNPDAKDLKQLAQKTGLTKRVLQASLRFIFCLPDSPGSKVWFQNARAKFRRNLLRQENTGVDKSTDAALQTGTPSGPASELSNASLSPSSTPTTLTDLTSPTLPTVTSVLTSVPGNLEGHEPHSPSQTTLTNLF

SEQ ID NO: 884040 - protein, 389 aa, Homo sapiens
MDRRAKSEAPAISSAIDRGDTETTMPSISSDRAALCAGCGGKISDRYYLLAVDKQWHMRCLKCCECKLNLESELTCFSKDGSIYCKEDYYRRFSVQRCARCHLGISASEMVMRARDLVYHLNCFTCTTCNKMLTTGDHFGMKDSLVYCRLHFEALLQGEYPAHFNHADVAAAAAAAAAAKSAGLGAAGANPLGLPYYNGVGTVQKGRPRKRKSPGPGADLAAYNAALSCNENDAEHLDRDQPYPSSQKTKRMRTSFKHHQLRTMKSYFAINHNPDAKDLKQLAQKTGLTKRVLQVWFQNARAKFRRNLLRQENTGVDKSTDAALQTGTPSGPASELSNASLSPSSTPTTLTDLTSPTLPTVTSVLTSVPGNLEGHEPHSPSQTTLTNLF

SEQ ID NO: 884041 - protein, 622 aa, Homo sapiens
GCLEDHLRRCSASEGPLKWKTALVLMANSSFIGDHVHGAPHAVMPEVEFPDQFFTVLTMDHELVTLRDVVINFSQEEWEYLDSAQRNLYWDVMMENYSNLLSLGLHWDRYRYNGDQDQYRPCSHGIDILVLEMYNKHNLESRNETKHLSVGKDIIQNTGSQWEVMESSKLCGLEGSIFRNDWQSKSKIDVQGPEVGYFSQMKIISENVPSYKTHESLTLPRRTHDSEKPYEYKEYEKVFSCDLEFDEYQKIHTGGKNYECNQCWKTFGIDNSSMLQLNIHTGVKPCKYMEYGNTCSFYKDFNVYQKIHNEKFYKCKEYRRTFERVGKVTPLQRVHDGEKHFECSFCGKSFRVHAQLTRHQKIHTDEKTYKCMECGKDFRFHSQLTEHQRIHTGEKPYKCMHCEKVFRISSQLIEHQRIHTGEKPYACKECGKAFGVCRELARHQRIHTGKKPYECKACGKVFRNSSSLTRHQRIHTGEKPYKCKECEKAFGVGSELTRHERIHSGQKPYECKECGKFFRLTSALIQHQRIHSGEKPYECKVCGKAFRHSSALTEHQRIHTGEKPYECKACGKAFRHSSSFTKHQRIHTDDKPYECKECGNSFSVVGHLTCQPKIYTGEKSFD

SEQ ID NO: 884042 - protein, 435 aa, Homo sapiens
GCLEDHLRRCSASEGPLKWKTALVLMANSSFIGDHVHGAPHAVMPEVEFPDQFFTVLTMDHELVTLRDVVINFSQEEWEYLDSAQRNLYWDVMMENYSNLLSLGLHWDRYRYNGDQDQYRPCSHGIDILVLEMYNKHNLESRNETKHLSVGKDIIQNTGSQWEVMESSKLCGLEGSIFRNDWQSKSKIDVQGPEVGYFSQMKIISENVPSYKTHESLTLPRRTHDSEKPYEYKEYEKVFSCDLEFDEYQKIHTGGKNYECNQCWKTFGIDNSSMLQLNIHTGVKPCKYMEYGNTCSFYKDFNVYQKIHNEKFYKCKEYRRTFERVGKVTPLQRVHDGEKHFECSFCGKSFRVHAQLTRHQKIHTDEKTYKCMECGKDFRFHSQLTEHQRIHTGRLNNLLLEEAEKTMEGKWKLLTYSFPHAGVHLYLRFSCRKKS

SEQ ID NO: 884043 - protein, 458 aa, Homo sapiens
MESSKLCGLEGSIFRNDWQSKSKIDVQGPEVGYFSQMKIISENVPSYKTHESLTLPRRTHDSEKPYEYKEYEKVFSCDLEFDEYQKIHTGGKNYECNQCWKTFGIDNSSMLQLNIHTGVKPCKYMEYGNTCSFYKDFNVYQKIHNEKFYKCKEYRRTFERVGKVTPLQRVHDGEKHFECSFCGKSFRVHAQLTRHQKIHTDEKTYKCMECGKDFRFHSQLTEHQRIHTGEKPYKCMHCEKVFRISSQLIEHQRIHTGEKPYACKECGKAFGVCRELARHQRIHTGKKPYECKACGKVFRNSSSLTRHQRIHTGEKPYKCKECEKAFGVGSELTRHERIHSGQKPYECKECGKFFRLTSALIQHQRIHSGEKPYECKVCGKAFRHSSALTEHQRIHTGEKPYECKACGKAFRHSSSFTKHQRIHTDDKPYECKECGNSFSVVGHLTCQPKIYTGEKSFD

SEQ ID NO: 884044 - protein, 849 aa, Homo sapiens
LSPSSFKAECSEDVENLNAPPAEAGYDQNKTDFDETSSINTAISDATTGDEGNTEMESTTGSSGDVKPALSPKEPKTLDTLPKPATTPTTEVCDDKFLFSLTSPSIHFNDKDGDHDQSFYITDDPDDNADRSETSSIADPSSPNPFGSSNPFKSKSNDRPGHKRFRTQMSNLQLKVLKACFSDYRTPTMQECEMLGNEIGLPKRVVQVWFQNARAKEKKFKINIGKPFMINQGGTEGTKPECTLCGVKYSARLSIRDHIFSKQHISKVRETVGSQLDREKDYLAPTTVRQLMAQQELDRIKKASDVLGLTVQQPGMMDSSSLHGISLPTAYPGLPGLPPVLLPGMNGPSSLPGFPQNSNTLTPPGAGMLGFPTSATSSPALSLSSAPTKPLLQTPPPPPPPPPPPPSSSLSGQQTEQQNKESEKKQTKPNKVKKNQEEELEATKPEKHPKKEEKISSALSVVGKVVGETHVDPIQLQALQNAIAGDPASFIGGQFLPYFIPGFASYFTPQLPGTVQGGYFPPVCGMESLFPYGPTMPQTLAGLSPGALLQQYQQYQQNLQESLQKQQKQQQEQQQKPVQAKTSKVESDQPQNSNDASETKEDKSTATESTKEEPQLESKSADFSDTYVVPFVKYEFICRKCQMMFTDEDAAVNHQKSFCYFGQPLIDPQETVLRVPVSKYQCLACDVAISGNEALSQHLQSSLHKEKTIKQAMRNAKEHVRLLPHSVCSPNPNTTSTSQSAASSNNTYPHLSCFSMKSWPNILFQASARRAASPPSSPPSLSLPSTVTSSLCSTSGVQTSLPTESCSDESDSELSQKLEDLDNSLEVKAKPASGLDGNFNSIRMDMFSV

SEQ ID NO: 884045 - protein, 32 aa, Homo sapiens
LCTSVWQAEVHLFLSLWSKFSCKGITDNQTFV

SEQ ID NO: 884046 - protein, 151 aa, Homo sapiens
SRSDPESKKEQEYSSGFLQTTADEFCFYYARKDGGLCFPDFPRKQVRGPASNYLDQMEEYDKVEEISRKHKHNCFCIQEVVSGLRQPVGALHSGDGSQRLFILEKEGYVKILTPEGEIFKEPYLDIHKLVQSGIKDLLILFIIKKITWLSL

SEQ ID NO: 884047 - protein, 120 aa, Homo sapiens
MRGCVRSCSRRQRRPQHHLEPSAGPASACPAAAVAVSVPATVPPKQLPLHGQVNICGCPLLFFLLFQLLLLLPLPSRSRKPPTQLTLAQLQTVSSAQLYLAPRAPLRHWTHRRVSIDRSV

SEQ ID NO: 884048 - protein, 697 aa, Homo sapiens [sequence omitted]

SEQ ID NO: 884049 - protein, 697 aa, Homo sapiens [sequence omitted]

SEQ ID NO: 884050 - protein, 679 aa, Homo sapiens [sequence omitted]

SEQ ID NO: 884051 - protein, 386 aa, Homo sapiens
MLKMLSFKLLLLAVALGFFEGDAKFGERNEGSGARRRRCLNGNPPKRLKRRDRRMMSQLELLSGGEMLCGGFYPRLSCCLRSDSPGLGRLENKIFSVTNNTECGKLLEEIKCALCSPHSQSLFHSPEREVLERDLVLPLLCKDYCKEFFYTCRGHIPGFLQTTADEFCFYYARKDGGLCFPDFPRKQVRGPASNYLDQMEEYDKVEEISRKHKHNCFCIQEVVSGLRQPVGALHSGDGSQRLFILEKEGYVKILTPEGEIFKEPYLDIHKLVQSGIKGGDERGLLSLAFHPNYKKNGKLYVSYTTNQERWAIGPHDHILRVVEYTVSRKNPHQVDLRTARVFLEVAELHRKHLGGQLLFGPDGFLYIILGDGMITLDDMEEMDGLR

SEQ ID NO: 884052 - protein, 327 aa, Homo sapiens
MLSFKLLLLAVALGFFEGDAKFGERNEGSGARRRRCLNGNPPKRLKRRDRRMMSQLELLSGGEMLCGGFYPRLSCCLRSDSPGLGRLENKIFSVTNNTECGKLLEEIKCALCSPHSQSLFHSPEREVLERDLVLPLLCKDYCKEFFYTCRGHIPGFLQTTADEFCFYYARKDGGLCFPDFPRKQVRGPASNYLDQMEEYDKVEEISRKHKHNCFCIQEVVSGLRQPVGALHSGDGSQRLFILEKEGYVKILTPEGEIFKEPYLDIHKLVQSGIKGGDERGLLSLAFHPNYKKNGKLYVSYTTNQERWAIGPHDHILRVVEYTVSRYH

SEQ ID NO: 884053 - protein, 283 aa, Homo sapiens
MLSFKLLLLAVALGFFEGDAKFGERNEGSGARRRRCLNGNPPKRLKRRDRRMMSQLELLSGGEMLCGGFYPRLSCCLRSDSPGLGRLENKIFSVTNNTECGKLLEEIKCALCSPHSQSLFHSPEREVLERDLVLPLLCKDYCKEFFYTCRGHIPGFLQTTADEFCFYYARKDGGLCFPDFPRKQVRGPASNYLDQMEEYDKVEEISRKHKHNCFCIQEVVSGLRQPVGALHSGDGSQRLFILEKEGYVKILTPEGEIFKEPYLDIHKLVQSGIKVGFLNFKKK

SEQ ID NO: 884054 - protein, 141 aa, Homo sapiens
MRGCVRSCSRRQRRPQHHLEPSAGPASACPAAAVAVSVPATVPPKQLPLHGQVNICGCPLLFFLLFQLLLLLPLPSRSRKPPTQLTLAQLQTVSSAQLYLAPRAPLRHWTHRRVFYFLQSCIAVHIFVPATSLCLWMTARG

SEQ ID NO: 884055 - protein, 293 aa, Homo sapiens
MLKMLSFKLLLLAVALGFFEGDAKFGERNEGSGARRRRCLNGNPPKRLKRRDRRMMSQLELLSGGEMLCGGFYPRLSCCLRSDSPGLGRLENKIFSVTNNTECGKLLEEIKCALCSPHSQSLFHSPEREVLERDLVLPLLCKDYCKEFFYTCRGHIPGFLQTTADEFCFYYARKDGGLCFPDFPRKQVRGPASNYLDQMEEYDKVEEISRKHKHNCFCIQEVVSGLRQPVGALHSGDGSQRLFILEKEGYVKILTPEGEIFKEPYLDIHKLVQSGIKDLLILFIIKKITWLSL

SEQ ID NO: 884056 - protein, 144 aa, Homo sapiens
RVSHHHVFIKTETVLGFLQTTADEFCFYYARKDGGLCFPDFPRKQVRGPASNYLDQMEEYDKVEEISRKHKHNCFCIQEVVSGLRQPVGALHSGDGSQRLFILEKEGYVKILTPEGEIFKEPYLDIHKLVQSGIKVGFLNFKKK

SEQ ID NO: 884057 - protein, 144 aa, Homo sapiens
SDLNVFIATGKKEDSGFLQTTADEFCFYYARKDGGLCFPDFPRKQVRGPASNYLDQMEEYDKVEEISRKHKHNCFCIQEVVSGLRQPVGALHSGDGSQRLFILEKEGYVKILTPEGEIFKEPYLDIHKLVQSGIKVGFLNFKKK

SEQ ID NO: 884058 - protein, 144 aa, Homo sapiens
PAPDTNPKRKPAESSGFLQTTADEFCFYYARKDGGLCFPDFPRKQVRGPASNYLDQMEEYDKVEEISRKHKHNCFCIQEVVSGLRQPVGALHSGDGSQRLFILEKEGYVKILTPEGEIFKEPYLDIHKLVQSGIKVGFLNFKKK

SEQ ID NO: 884059 - protein, 210 aa, Homo sapiens
MSRMFCQAARVDLTLDPDTAHPALMLSPDRRGVRLAERRQEVADHPKRFSADCCVLGAQGFRSGRHYWEVEVGGRRGWAVGAARESTHHKEKVGPGGSSVGSGDASSSRHHHRRRRLHLPQQPLLQREVWCVGTNGKRYQAQSSTEQTLLSPSEKPRRFGVYLDYEAGRLGFYNAETLAHVHTFSAAFLGERVFPFFRVLSKGTRIKLCP

SEQ ID NO: 884060 - protein, 630 aa, Homo sapiens
MAAVAMTPNPVQTLQEEAVCAICLDYFTDPVSIGCGHNFCRVCVTQLWGGEDEEDRDELDREEEEEDGEEEEVEAVGAGAGWDTPMRDEDYEGDMEEEVEEEEEGVFWTSGMSRSSWDNMDYVWEEEDEEEDLDYYLGDMEEEDLRGEDEEDEEEVLEEVEEEDLDPVTPLPPPPAPRRCFTCPQCRKSFPRRSFRPNLQLANMVQVIRQMHPTPGRGSRVTDQGICPKHQEALKLFCEVDEEAICVVCRESRSHKQHSVVPLEEVVQEYKAKLQGHVEPLRKHLEAVQKMKAKEERRVTELKSQMKSELAAVASEFGRLTRFLAEEQAGLERRLREMHEAQLGRAGAAASRLAEQAAQLSRLLAEAQERSQQGGLRLLQDIKETFNRCEEVQLQPPEVWSPDPCQPHSHDFLTDAIVRKMSRMFCQAARVDLTLDPDTAHPALMLSPDRRGVRLAERRQEVADHPKRFSADCCVLGAQGFRSGRHYWEVEVGGRRGWAVGAARESTHHKEKVGPGGSSVGSGDASSSRHHHRRRRLHLPQQPLLQREVWCVGTNGKRYQAQSSTEQTLLSPSEKPRRFGVYLDYEAGRLGFYNAETLAHVHTFSAAFLGERVFPFFRVLSKGTRIKLCP

SEQ ID NO: 884061 - protein, 259 aa, Homo sapiens
PSGNIVVPPPARSPSSRCEEVQLQPPEVWSPDPCQPHSHDFLTDAIVRKMSRMFCQAARVDLTLDPDTAHPALMLSPDRRGVRLAERRQEVADHPKRFSADCCVLGAQGFRSGRHYWEVEVGGRRGWAVGAARESTHHKEKVGPGGSSVGSGDASSSRHHHRRRRLHLPQQPLLQREVWCVGTNGKRYQAQSSTEQTLLSPSEKPRRFGVYLDYEAGRLGFYNAETLAHVHTFSAAFLGERVFPFFRVLSKGTRIKLCP

SEQ ID NO: 884062 - protein, 381 aa, Homo sapiens
MAAVAMTPNPVQTLQEEAVCAICLDYFTDPVSIGCGHNFCRVCVTQLWGGEDEEDRDELDREEEEEDGEEEEVEAVGAGAGWDTPMRDEDYEGDMEEEVEEEEEGVFWTSGMSRSSWDNMDYVWEEEDEEEDLDYYLGDMEEEDLRGEDEEDEEEVLEEVEEEDLDPVTPLPPPPAPRRCFTCPQCRKSFPRRSFRPNLQLANMVQVIRQMHPTPGRGSRVTDQGICPKHQEALKLFCEVDEEAICVVCRESRSHKQHSVVPLEEVVQEYKAKLQGHVEPLRKHLEAVQKMKAKEERRVTELKSQMKSELAAVASEFGRLTRFLAEEQAGLERRLREMHEAQLGRAGAAASRLAEQAAQLSRLLAEAQERSQQGGLRLLQV

SEQ ID NO: 884063 - protein, 630 aa, Homo sapiens; identical to SEQ ID NO: 884060

SEQ ID NO: 884064 - protein, 325 aa, Homo sapiens
MAAVAMTPNPVQTLQEEAVCAICLDYFTDPVSIGCGHNFCRVCVTQLWGGEDEEDRDELDREEEEEDGEEEEVEAVGAGAGWDTPMRDEDYEGDMEEEVEEEEEGVFWTSGMSRSSWDNMDYVWEEEDEEEDLDYYLGDMEEEDLRGEDEEDEEEVLEEVEEEDLDPVTPLPPPPAPRRCFTCPQCRKSFPRRSFRPNLQLANMVQVIRQMHPTPGRGSRVTDQGICPKHQEALKLFCEVDEEAICVVCRESRSHKQHSVVPLEEVVQEYKAKLQGHVEPLRKHLEAVQKMKAKEEEASDRTEEPDEVRAGSGGLGVWATDTVSG

SEQ ID NO: 884065 - protein, 511 aa, Homo sapiens
MAAVAMTPNPVQTLQEEAVCAICLDYFTDPVSIGCGHNFCRVCVTQLWGGEDEEDRDELDREEEEEDGEEEEVEAVGAGAGWDTPMRDEDYEGDMEEEVEEEEEGVFWTSGMSRSSWDNMDYVWEEEDEEEDLDYYLGDMEEEDLRGEDEEDEEEVLEEVEEEDLDPVTPLPPPPAPRRCFTCPQCRKSFPRRSFRPNLQLANMVQVIRQMHPTPGRGSRVTDQGICPKHQEALKLFCEVDEEAICVVCRESRSHKQHSVVPLEEVVQEYKAKLQGHVEPLRKHLEAVQKMKAKEERRVTELKSQMKSELAAVASEFGRLTRFLAEEQAGLERRLREMHEAQLGRAGAAASRLAEQAAQLSRLLAEAQERSQQGGLRLLQDIKETFNRCEEVQLQPPEVWSPDPCQPHSHDFLTDAIVRKMSRMFCQAARVDLTLDPDTAHPALMLSPDRRGVRLAERRQEVADHPKRFSADCCVLGAQGFRSGRHYWETLLASSSAFSHLLCLSNRPARI

SEQ ID NO: 884066 - protein, 630 aa, Homo sapiens; identical to SEQ ID NO: 884060

SEQ ID NO: 884067 - protein, 494 aa, Homo sapiens [sequence omitted]

SEQ ID NO: 884068 - protein, 134 aa, Homo sapiens
TPLFNPEVAKYLKVPQDPLKFYKKIYFCHSCQLYLPSTEFSVSSTSRRIYRCRNCINLQNEAQKRESFLKYKCLLQQLYYTEADYEDDSKIAFLMQLQDIQYLTENIWASQSVLSACDNLSDLVMVRWNKSLEW

SEQ ID NO: 884069 - protein, 277 aa, Homo sapiens
MDEEQARGPLEMRSTQEQLMCWQGASKLVNLCEGSPDLPVSFSPTLLSLSLVRTGVTQLKAGSFLRIPSLHLLLFTSNSFSVIEDDAFAGLSHLQYLFIEDNEIGSISKNALRGLRSLTHLSLANNHLETLPRFLFRGLDTLTHVDLRGNPFQCDCRVLWLLQWMPTVNASVGTGACAGPASLSHMQLHHLDPKTFKCRAIELSWFQTVGESALSVEPFSYQGEPHIVLAQPFAGRCLILSWDYSLQRFRPEEELPAGSVVSCKPLVLGPSLFVLAA

SEQ ID NO: 884070 - protein, 261 aa, Homo sapiens
MGGAGILLLLLAGAGVVVAWRPPKGKCPLRCSCSKDSALCEGSPDLPVSFSPTLLSLSLVRTGVTQLKAGSFLRIPSLHLLLFTSNSFSVIEDDAFAGLSHLQYLFIEDNEIGSISKNALRGLRSLTHLSLANNHLETLPRFLFRGLDTLTHVDLRGNPFQCDCRVLWLLQWMPTVNASVGTGACAGPASLSHMQLHHLDPKTFKCRAIGGGLSRWGGRREIWGKGCQGQEARLTPCPAISRSGKTLSKQHCLPEPQFSHL

SEQ ID NO: 884071 - protein, 285 aa, Homo sapiens
MGGAGILLLLLAGAGVVVAWRPPKGKCPLRCSCSKDSALCEGSPDLPVSFSPTLLSLSLVRTGVTQLKAGSFLRIPSLHLLLFTSNSFSVIEDDAFAGLSHLQYLFIEDNEIGSISKNALRGLRSLTHLSLANNHLETLPRFLFRGLDTLTHVDLRGNPFQCDCRVLWLLQWMPTVNASVGTGACAGPASLSHMQLHHLDPKTFKCRAIELSWFQTVGESALSVEPFSYQGEPHIVLAQPFAGRCLILSWDYSLQRFRPEEELPAGSVVSCKPLVLGPSLFVLAA

SEQ ID NO: 884072 - protein, 251 aa, Homo sapiens
DAQDEEDPGDDEASDLQGLVSVSSRAGKLCEGSPDLPVSFSPTLLSLSLVRTGVTQLKAGSFLRIPSLHLLLFTSNSFSVIEDDAFAGLSHLQYLFIEDNEIGSISKNALRGLRSLTHLSLANNHLETLPRFLFRGLDTLTHVDLRGNPFQCDCRVLWLLQWMPTVNASVGTGACAGPASLSHMQLHHLDPKTFKCRAIGGGLSRWGGRREIWGKGCQGQEARLTPCPAISRSGKTLSKQHCLPEPQFSHL

SEQ ID NO: 884073 - protein, 174 aa, Homo sapiens
QKSETRNVSNDQETTLNYFIEDNEIGSISKNALRGLRSLTHLSLANNHLETLPRFLFRGLDTLTHVDLRGNPFQCDCRVLWLLQWMPTVNASVGTGACAGPASLSHMQLHHLDPKTFKCRAIGGGLSRWGGRREIWGKGCQGQEARLTPCPAISRSGKTLSKQHCLPEPQFSHL

SEQ ID NO: 884074 - protein, 766 aa, Homo sapiens
MRLWKAVVVTLAFMSVDICVTTAIYVFSHLDRSLLEDIRHFNIFDSVLDLWAACLYRSCLLLGATIGVAKNSALGPRRLRASWLVITLVCLFVGIYAMVKLLLFSEVRRPIRDPWFWALFVWTYISLGASFLLWWLLSTVRPGTQALEPGAATEAEGFPGSGRPPPEQASGATLQKLLSYTKPDVAFLVAASFFLIVAALGETFLPYYTGRAIDGIVIQKSMDQFSTAVVIVCLLAIGSSFAAGIRGGIFTLIFARLNIRLRNCLFRSLVSQETSFFDENRTGDLISRLTSDTTMVSDLVSQNINVFLRNTVKVTGVVVFMFSLSWQLSLVTFMGFPIIMMVSNIYGKYYKRLSKEVQNALARASNTAEETISAMKTVRSFANEEEEAEVYLRKLQQVYKLNRKEAAAYMYYVWGSGLTLLVVQVSILYYGGHLVISGQMTSGNLIAFIIYEFVLGDCMESVGSVYSGLMQGVGAAEKVFEFIDRQPTMVHDGSLAPDHLEGRVDFENVTFTYRTRPHTQVLQNVSFSLSPGKVTALVGPSGSGKSSCVNILENFYPLEGGRVLLDGKPISAYDHKYLHRVISLVSQEPVLFARSITDNISYGLPTVPFEMVVEAAQKANAHGFIMELQDGYSTETGEKGAQLSGGQKQRVAMARALVRNPPVLILDEATSALDAESEYLIQQAIHGNLQKHTVLIIAHRLSTVEHAHLIVVLDKGRVVQQGTHQQLLAQGGLYAKLVQRQMLGLQPAADFTAGHNEPVANGSHKA

SEQ ID NO: 884075 - protein, 723 aa, Homo sapiens
MRLWKAVVVTLAFMSVDICVTTAIYVFSHLDRSLLEDIRHFNIFDSVLDLWAACLYRSCLLLGATIGVAKNSALGPRRLRASWLVITLVCLFVGIYAMVKLLLFSEVRRPIRDPWFWALFVWTYISLGASFLLWWLLSTVRPGTQALEPGAATEAEGFPGSGRPPPEQASGATLQKLLSYTKPDVAFLVAASFFLIVAALGETFLPYYTGRAIDGIVIQKSMDQFSTAVVIVCLLAIGSSFAAGIRGGIFTLIFARLNIRLRNCLFRSLVSQETSFFDENRTGDLISRLTSDTTMVSDLVSQNINVFLRNTVKVTGVVVFMFSLSWQLSLVTFMGFPIIMMVSNIYGKYYKRLSKEVQNALARASNTAEETISAMKTVRSFANEEEEAEVYLRKLQQVYKLNRKEAAAYMYYVWGSGSVGSVYSGLMQGVGAAEKVFEFIDRQPTMVHDGSLAPDHLEGRVDFENVTFTYRTRPHTQVLQNVSFSLSPGKVTALVGPSGSGKSSCVNILENFYPLEGGRVLLDGKPISAYDHKYLHRVISLVSQEPVLFARSITDNISYGLPTVPFEMVVEAAQKANAHGFIMELQDGYSTETGEKGAQLSGGQKQRVAMARALVRNPPVLILDEATSALDAESEYLIQQAIHGNLQKHTVLIIAHRLSTVEHAHLIVVLDKGRVVQQGTHQQLLAQGGLYAKLVQRQMLGLQPAADFTAGHNEPVANGSHKA

SEQ ID NO: 884076 - protein, 644 aa, Homo sapiens
MRLWKAVVVTLAFMSVDICVTTAIYVFSHLDRSLLEDIRHFNIFDSVLDLWAACLYRSCLLLGATIGVAKNSALGPRRLRASWLVITLVCLFVGIYAMVKLLLFSEVRRPIRDPWFWALFVWTYISLGASFLLWWLLSTVRPGTQALEPGAATEAEGFPGSGRPPPEQASGATLQKLLSYTKPDVAFLVAASFFLIVAALGETFLPYYTGRAIDGIVIQKSMDQFSTAVVIVCLLAIGSSFAAGIRGGIFTLIFARLNIRLRNCLFRSLVSQETSFFDENRTGDLISRLTSDTTMVSDLVSQNINVFLRNTVKVTGVVVFMFSLSWQLSLVTFMGFPIIMMVSNIYGKYYKRLSKEVQNALARASNTAEETISAMKTVRSFANEEEEAEVYLRKLQQVYKLNRKEAAAYMYYVWGSGLTLLVVQVSILYYGGHLVISGQMTSGNLIAFIIYEFVLGDCMENVSFSLSPGKVTALVGPSGSGKSSCVNILENFYPLEGGRVLLDGKPISAYDHKYLHRVISLVSQEPVLFARSITDNISYGLPTVPFEMVVEAAQKANAHGFIMELQDGYSTETGEKGAQLSGGQKQRVAMARALVRNPPVLILDEATSALDAESEYLVSHRVVGNAGAGAAPGGQSPHRPADGC

SEQ ID NO: 884077 - protein, 84 aa, Homo sapiens
RPGRSACLKARQSQLRPCSGAARVGGGEEQREERSEDRGPAQSSMSSAETAPQTRACCAPPPRAHLVPGNRPGLALWMMMALPP

SEQ ID NO: 884078 - protein, 766 aa, Homo sapiens; identical to SEQ ID NO: 884074

SEQ ID NO: 884079 - protein, 686 aa, Homo sapiens
MRLWKAVVVTLAFMSVDICVTTAIYVFSHLDRSLLEDIRHFNIFDSVLDLWAACLYRSCLLLGATIGVAKNSALGPRRLRASWLVITLVCLFVGIYAMVKLLLFSEVRRPIRDPWFWALFVWTYISLGASFLLWWLLSTVRPGTQALEPGAATEAEGFPGSGRPPPEQASGATLQKLLSYTKPDVAFLVAASFFLIVAALGETFLPYYTGRAIDGIVIQKSMDQFSTAVVIVCLLAIGRLNIRLRNCLFRSLVSQETSFFDENRTGDLISRLTSDTTMVSDLVSQNINVFLRNTVKVTGVVVFMFSLSWQLSLVTFMGFPIIMMVSNIYGKYYKRLSKEVQNALARASNTAEETISAMKTVRSFANEEEEAEVYLRKLQQVYKLNRKEAAAYMYYVWGSGLTLLVVQVSILYYGGHLVISGQMTSGNLIAFIIYEFVLGDCMENVSFSLSPGKVTALVGPSGSGKSSCVNILENFYPLEGGRVLLDGKPISAYDHKYLHRVISLVSQEPVLFARSITDNISYGLPTVPFEMVVEAAQKANAHGFIMELQDGYSTETGEKGAQLSGGQKQRVAMARALVRNPPVLILDEATSALDAESEYLIQQAIHGNLQKHTVLIIAHRLSTVEHAHLIVVLDKGRVVQQGTHQQLLAQGGLYAKLVQRQMLGLQPAADFTAGHNEPVANGSHKA

SEQ ID NO: 884080 - protein, 601 aa, Homo sapiens
MRLWKAVVVTLAFMSVDICVTTAIYVFSHLDRSLLEDIRHFNIFDSVLDLWAACLYRSCLLLGATIGVAKNSALGPRRLRASWLVITLVCLFVGIYAMVKLLLFSEVRRPIRDPWFWALFVWTYISLGASFLLWWLLSTVRPGTQALEPGAATEAEGFPGSGRPPPEQASGATLQKLLSYTKPDVAFLVAASFFLIVAALGETFLPYYTGRAIDGIVIQKSMDQFSTAVVIVCLLAIGSSFAAGIRGGIFTLIFARLNIRLRNCLFRSLVSQETSFFDENRTGDLISRLTSDTTMVSDLVSQNINVFLRNTVKVTGVVVFMFSLSWQLSLVTFMGFPIIMMVSNIYGKYYKRLSKEVQNALARASNTAEETISAMKTVRSFANEEEEAEVYLRKLQQVYKLNRKEAAAYMYYVWGSGNVSFSLSPGKVTALVGPSGSGKSSCVNILENFYPLEGGRVLLDGKPISAYDHKYLHRVISLVSQEPVLFARSITDNISYGLPTVPFEMVVEAAQKANAHGFIMELQDGYSTETGEKGAQLSGGQKQRVAMARALVRNPPVLILDEATSALDAESEYLVSHRVVGNAGAGAAPGGQSPHRPADGC

SEQ ID NO: 884081 - protein, 337 aa, Homo sapiens
QALEDTPANGRHFSLWLGLPSPPPAAWDGSGMGMVGDLRSPRPTSPLPLPQLTLLVVQVSILYYGGHLVISGQMTSGNLIAFIIYEFVLGDCMENVSFSLSPGKVTALVGPSGSGKSSCVNILENFYPLEGGRVLLDGKPISAYDHKYLHRVISLVSQEPVLFARSITDNISYGLPTVPFEMVVEAAQKANAHGFIMELQDGYSTETGEKGAQLSGGQKQRVAMARALVRNPPVLILDEATSALDAESEYLIQQAIHGNLQKHTVLIIAHRLSTVEHAHLIVVLDKGRVVQQGTHQQLLAQGGLYAKLVQRQMLGLQPAADFTAGHNEPVANGSHKA

SEQ ID NO: 884082 - protein, 202 aa, Homo sapiens [sequence omitted]

SEQ ID NO: 884083 - protein, 1191 aa, Homo sapiens
NAPVFQNTAFSTSINETLPVGSVVFSVLAVDKDMGSAGMVVYSIEKVIPSTGDSEHLFRILANGSIVLNGSLSYNNKSAFYQLELKACDLGGMYHNTFTIQCSLPVFLSISVVDQPDLDPQFVREFYSASVAEDAAKGTSVLTVEAVDGDKGINDPVIYSISYSTRPGWFDIGADGVIRVNGSLDREQLLEADEEVQLQVTATETHLNIYGQEAKVSIWVTVRVMDVNDHKPEFYNCSLPACTFTPEEAQVNFTGYVDEHASPRIPIDDLTMVVYDPDKGSNGTFLLSLGGPDAEAFSVSPERAVGSASVQVLVRVSALVDYERQTAMAVQVVATDSVSQNFSVAMVTIHLRDINDHRPTFPQSLYVLTVPEHSATGSVVTDSIHATDPDTGAWGQITYSLLPGNGADLFQVDPVSGTVTVRNGELLDRESQAVYYLTLQATDGGNLSSSTTLQIHLLDINDNAPVVSGSYNIFVQEEEGNVSVTIQAHDNDEPGTNNSRLLFNLLPGPYSHNFSLDPDTGLLRNLGPLDREAIDPALEGRIVLTVLVSDCGEPVLGTKVNVTITVEDINDNLPIFNQSSYNFTVKEEDPGVLVGVVKAWDADQTEANNRISFSLSGSGANYFMIRGLVLGAGWAEGYLRLPPDVSLDYETQPVFNLTVSAENPDPQGGETIVDVCVNVKDVNDNPPTLDVASLRGIRVAENGSQHGQVAVVVASDVDTSAQLEIQLVNILCTKAGVDVGSLCWGWFSVAANGSVYINQSKAIDYEACDLVTLVVRACDLATDPGFQAYSNNGSLLITIEDVNDNAPYFLPENKTFVIIPELVLPNREVASVRARDDDSGNNGVILFSILRVDFISKDGATIPFQGVFSIFTSSEADVFAGSIQPVTSLDSTLQGTYQVTVQARDRPSLGPFLEATTTLNLFTVDQSYRSRLQFSTPKEEVGANRQAINAALTQATRTTVYIVDIQDIDSAARARPHSYLDAYFVFPNGSALTLDELSVMIRNDQDSLTQLLQLGLVVLGSQESQESDLSKQLISVIIGLGVALLLVLVIMTMAFVCVRKSYNRKLQAMKAAKEARKTAAGVMPSAPAIPGTNMYNTERANPMLNLPNKDLGLEYLSPSNDLDSVSVNSLDDNSVDVDKNSQEIKEHRPPHTPPEPDPEPLSVVLLGRQAGASGQLEGPSYTNAGLDTTDL

SEQ ID NO: 884084 - protein, 394 aa, Homo sapiens
MVQVGSVPTPLTPFPFTPAVIIPELVLPNREVASVRARDDDSGNNGVILFSILRVDFISKDGATIPFQGVFSIFTSSEADVFAGSIQPVTSLDSTLQGTYQVTVQARDRPSLGPFLEATTTLNLFTVDQSYRSRLQFSTPKEEVGANRQAINAALTQATRTTVYIVDIQDIDSAARARPHSYLDAYFVFPNGSALTLDELSVMIRNDQDSLTQLLQLGLVVLGSQESQESDLSKQLISVIIGLGVALLLVLVIMTMAFVCVRKSYNRKLQAMKAAKEARKTAAGVMPSAPAIPGTNMYNTERANPMLNLPNKDLGLEYLSPSNDLDSVSVNSLDDNSVDVDKNSQEIKEHRPPHTPPEPDPEPLSVVLLGRQAGASGQLEGPSYTNAGLDTTDL

SEQ ID NO: 884085 - protein, 192 aa, Homo sapiens [sequence omitted]

SEQ ID NO: 884086 - protein, 357 aa, Homo sapiens
MVQVGSVPTPLTPFPFTPAVIIPELVLPNREVASVRARDDDSGNNGVILFSILRVDFISKDGATIPFQGVFSIFTSSEADVFAGSIQPVTSLDSTLQGTYQVTVQARDRPSLGPFLEATTTLNLFTVDQSYRSRLQFSTPKEEVGANRQAINAALTQATRTTVYIVDIQDIDSAARARPHSYLDAYFVFPNGSALTLDELSVMIRNDQDSLTQLLQLGLVVLGSQESQESDLSKQLISVIIGLGVALLLVLVIMTMAFVCVRKSYNRKLQAMKAAKEARKTAAGVMPSAPAIPGTNMYNTERANPMLNLPNKDLGLEYLSPSNDLDSVRVNSLAKTLGCGQERPGIRGPGPPPTPRA

SEQ ID NO: 884087 - protein, 127 aa, Homo sapiens
MIRNDQDSLTQLLQLGLVVLGSQESQESDLSKQLISVIIGLGVALLLVLVIMTMAFVCVRKSYNRKLQAMKAAKEARKTAAGVMPSAPAIPGTNMYNTERANPMLNLPNKDLGLEYLSPSNDLDSVR

SEQ ID NO: 884088 - protein, 63 aa, Homo sapiens
VRSPSELCPLSTGVLVGVVKAWDADQTEANNRISFSLSGSGANYFMIRGLVLGAGWAEGYLRL

SEQ ID NO: 884089 - protein, 101 aa, Homo sapiens
NHLLIRGSVGMADRDGEGQPPRPPLPLIPAGVEGCLAWLGPQILSTLAPKARDDDSGNNGVILFSILRVDFISKDGATIPFQGVFSIFTSSEADVFAGSIQ

SEQ ID NO: 884090 - protein, 111 aa, Homo sapiens [sequence omitted]

SEQ ID NO: 884091 - protein, 111 aa, Homo sapiens [sequence omitted]

SEQ ID NO: 884092 - protein, 111 aa, Homo sapiens [sequence omitted]

SEQ ID NO: 884093 - protein, 111 aa, Homo sapiens [sequence omitted]

SEQ ID NO: 884094 - protein, 72 aa, Homo sapiens
MASLGHILVFCVGLLTMAKAESPKEHDPFTYDYQSLQIGGLVIAGILFILGILIVLSECPQLPPSTPPLPGP

SEQ ID NO: 884095 - protein, 122 aa, Homo sapiens
WARGSKVLSPRGTAGRLGAFFQQGTARLGTMASLGHILVFCVGLLTMAKAESPKEHDPFTYDYQSLQIGGLVIAGILFILGILIVLSRRCRCKFNQQQRTGEPDEEEGTFRSSIRRLSTRRR

SEQ ID NO: 884096 - protein, 110 aa, Homo sapiens
MWESKGTHCLIRGVPPRTMASLGHILVFCVGLLTMAKAESPKEHDPFTYDYQSLQIGGLVIAGILFILGILIVLSRRCRCKFNQQQRTGEPDEEEGTFRSSIRRLSTRRR

SEQ ID NO: 884097 - protein, 155 aa, Homo sapiens
ACVCLSISWPILCFFPSSLPPVLLLPVPSLPFLYTPFLSLVPHFPPPISAPPELSYFPPSACWSFLPVPSFPIYPSPILPPVFPALTFPALLLTDYQSLQIGGLVIAGILFILGILIVLSRRCRCKFNQQQRTGEPDEEEGTFRSSIRRLSTRRR

SEQ ID NO: 884098 - protein, 173 aa, Homo sapiens
RCWGTQDMLNPQPHLPQREPHDTNTKLPSMLGNPGHADLTGWRLHGAAAWKEAEEGEVRLGAHPGALLGAFFQQGTARLGTMASLGHILVFCVGLLTMAKAESPKEHDPFTYDYQSLQIGGLVIAGILFILGILIVLSRRCRCKFNQQQRTGEPDEEEGTFRSSIRRLSTRRR

SEQ ID NO: 884099 - protein, 132 aa, Homo sapiens
CVGLVASLRGGTGGPEEEYWMPDWCLHPTSCSNQQFGERTMASLGHILVFCVGLLTMAKAESPKEHDPFTYDYQSLQIGGLVIAGILFILGILIVLSRRCRCKFNQQQRTGEPDEEEGTFRSSIRRLSTRRR

SEQ ID NO: 884100 - protein, 116 aa, Homo sapiens
MSPRGGQRGCLFLFSLLPREETGWPFPQGQPVAMWQLGLTPAGLCVTPFPALLLTDYQSLQIGGLVIAGILFILGILIVLSRRCRCKFNQQQRTGEPDEEEGTFRSSIRRLSTRRR

SEQ ID NO: 884101 - protein, 92 aa, Homo sapiens
MASLGHILVFCVGLLTMAKAESPKEHDPFTYDYQSLQIGGLVIAGILFILGILIVLSRRCRCKFNQQQRTGEPDEEEGTFRSSIRRLSTRRR

SEQ ID NO: 884102 - protein, 77 aa, Homo sapiens
MPPNNGGEEKQQARGPYQVSPDCPNTSRRIALHTRNIENGRMLRRTETRRRGKAREKKAEQGDEAQTRKERGKATKY

SEQ ID NO: 884103 - protein, 69 aa, Homo sapiens
ADAFTPVRWPTTHRPTNRPGRRVHHVWLLQRRRYEESGSTAPAGGRTQPRKSFPGSCRLETVLSAECST

SEQ ID NO: 884104 - protein, 108 aa, Homo sapiens
WLVRPECRDRPRRAPLSCLAPPTHGPRPTDPRIGPAVACTMSGSSSVAAMKKVVQQLRLEAGLNRVKVSQAAADLKQFCLQNAQHDPLLTGVSSSTNPFRPQKVCSFL

SEQ ID NO: 884105 - protein, 113 aa, Homo sapiens
MRTEGGAAEHRTGNLETKFGAPPPPRAAELSGPADPRPTTHRPTNRPGRRVHHVWLLQRRRYEESGSTAPAILGGLSEERCITVDLGRGAPWGENFQNPRGRGYKQFPRQLQT

SEQ ID NO: 884106 - protein, 229 aa, Homo sapiens
MSGALDVLQMKEEDVLKFLAAGTHLGGTNLDFQMEQYIYKRKSDGIYIINLKRTWEKLLLAARAIVAIENPADVSVISSRNTGQRAVLKFAAATGATPIAGRFTPGTFTNQIQAAFREPRLLVVTDPRADHQPLTEASYVNLPTIALCNTDSPLRYVDIAIPCNNKGAHSVGLMWWMLAREVLRMRGTISREHPWEVMPDLYFYRDPEEIEKEEQAAAEKAVTQGGISG

SEQ ID NO: 884107 - protein, 220 aa, Homo sapiens
SRGYAGTRDSQLSIRRGLSSTRRSGGGGDGDGTPARDLQLGWLHLLHGSGDRRGIEECAIKRKDQGVNQKKKKKRTSKLGRMSSCSNVCGSRQAQAAAEGGYQRYGVRSYLHQFYEDCTASIWEYEDDFQIQRSPNRWSSVFWKVGLISGTVFVILGLTVLAVGFLVPPKIEAFGEADFVVVDTHAVQFNSALDMYKLAGAVLFCIGGTSMAGCLLMSVL

SEQ ID NO: 884108 - protein, 154 aa, Homo sapiens
MLSFQLGRMSSCSNVCGSRQAQAAAEGGYQRYGVRSYLHQFYEDCTASIWEYEDDFQIQRSPNRWSSVFWKQELGFHTSSHSQEWNRKLQHKNCPRCCFGSLSPPGEALLCRHWDWPYHPKAPGCSAEPGGGPFQSIPTLLCGPKRGCFASSEL

SEQ ID NO: 884109 - protein, 82 aa, Homo sapiens
SRGYAGTRDSQLSIRRGLSSTRRSGGGGDGDGTPARDLQLGWLHLLHGSGDRRGIEECAIKRKDQGVNQKKKKKRTSKVPGT

SEQ ID NO: 884110 - protein, 220 aa, Homo sapiens; identical to SEQ ID NO: 884107

SEQ ID NO: 884111 - protein, 149 aa, Homo sapiens
MWMLSFQLGRMSSCSNVCGSRQAQAAAEGGYQRYGVRSYLHQFYEDCTASIWEYEDDFQIQRSPNRWSSVFWKVGLISGTVFVILGLTVLAVGFLVPPKIEAFGEADFVVVDTHAVQFNSALDMYKLAGAVLFCIGGTSMAGCLLMSVL

SEQ ID NO: 884112 - protein, 147 aa, Homo sapiens
SRGYAGTRDSQLSIRRGLSSTRRSGGGGDGDGTPARDLQLGWLHLLHGSGDRRGIEECAIKRKDQGVNQKKKKKRTSKLGRMSSCSNVCGSRQAQAAAEGGYQRYGVRSYLHQFYEDCTASIWEYEDDFQIQRSPNRWSSVFWKHSI

SEQ ID NO: 884113 - protein, 108 aa, Homo sapiens
SRGYAGTRDSQLSIRRGLSSTRRSGGGGDGDGTPARDLQLGWLHLLHGSGDRRGIEECAIKRKDQGVNQKKKKKRTSKHWPCGKVAIMGTSVSLSQNHFMGEKSSMKN

SEQ ID NO: 884114 - protein, 304 aa, Homo sapiens
PRWYGRVLYVTGVGKGRQRRRRQRQRQSPVPRPSDRPAGLGLAKPARRALPTPEPGRKSSDSSLASPGAALQTGPVVRGSGADPEAGFAQPPTRAGPLEGAFNSRTRQATMTENSTSAPAAKPKRAKASKKSTDHPKYSDMIVAAIQAEKNRAGSSRQSIQKYIKSHYKVGENADSQIKLSIKRLVTTGVLKQTKGVGASGSFRLAKSDEPKKSVAFKKTKKEIKKVATPKKASKPKKAASKAPTKKPKATPVKKAKKKLAATPKKAKKPKTVKAKPVKASKPKKAKPVKPKAKSSAKRAGKKK

SEQ ID NO: 884115 - protein, 304 aa, Homo sapiens; identical to SEQ ID NO: 884114

SEQ ID NO: 884116 - protein, 304 aa, Homo sapiens; identical to SEQ ID NO: 884114

SEQ ID NO: 884117 - protein, 304 aa, Homo sapiens; identical to SEQ ID NO: 884114

SEQ ID NO: 884118 - protein, 194 aa, Homo sapiens
MTENSTSAPAAKPKRAKASKKSTDHPKYSDMIVAAIQAEKNRAGSSRQSIQKYIKSHYKVGENADSQIKLSIKRLVTTGVLKQTKGVGASGSFRLAKSDEPKKSVAFKKTKKEIKKVATPKKASKPKKAASKAPTKKPKATPVKKAKKKLAATPKKAKKPKTVKAKPVKASKPKKAKPVKPKAKSSAKRAGKKK

SEQ ID NO: 884119 - protein, 219 aa, Homo sapiens
RARYPLAAQAGPLEGAFNSRTRQATMTENSTSAPAAKPKRAKASKKSTDHPKYSDMIVAAIQAEKNRAGSSRQSIQKYIKSHYKVGENADSQIKLSIKRLVTTGVLKQTKGVGASGSFRLAKSDEPKKSVAFKKTKKEIKKVATPKKASKPKKAASKAPTKKPKATPVKKAKKKLAATPKKAKKPKTVKAKPVKASKPKKAKPVKPKAKSSAKRAGKKK

SEQ ID NO: 884120 - protein, 304 aa, Homo sapiens; identical to SEQ ID NO: 884114

SEQ ID NO: 884121 - protein, 304 aa, Homo sapiens; identical to SEQ ID NO: 884114

SEQ ID NO: 884122 - protein, 304 aa, Homo sapiens; identical to SEQ ID NO: 884114

SEQ ID NO: 884123 - protein, 194 aa, Homo sapiens; identical to SEQ ID NO: 884118

SEQ ID NO: 884124 - protein, 304 aa, Homo sapiens; identical to SEQ ID NO: 884114

SEQ ID NO: 884125 - protein, 304 aa, Homo sapiens; identical to SEQ ID NO: 884114

SEQ ID NO: 884126 - protein, 286 aa, Homo sapiens
PRWYGRVLYVTGVGKGRQRRRRQRQRQSPVPRPSDRPAGLGLAKPARRALPTPEPGRKSSDSSLASPGAALQTGPVVRGSGADPEAGFAQPPTRAGPLEGAFNSRTRQATMTENSTSAPAAKPKRAKASKKSTDHPKYSDMIVAAIQAEKNRAGSSRQSIQKYIKSHYKVGENADSQIKLSIKRLVTTGVLKQTKGVGASGSFRLAKSDEPKKSVAFKKTKKEIKKVATPKKASKPKKAASKAPTKKPKATPVKKAKKKLAATPKKAKKPKTVKAKPVKASKPKKK

SEQ ID NO: 884127 - protein, 169 aa, Homo sapiens
TLVRPRICDRRRKREAEEAEAEAEAEPGAETKRQTGGAGPRKAGSASSPDTRAGEEKQRLLARIPGSRTPDWPGSQGLRSRSRGRLCSASDEGWPFGRRLQQPDQTGHHDREFHVRPCGQAQAGQGLQEVHRPPQVFRHDRGCHPGREEPRWLLAPVHSEVYQEPLQGG

SEQ ID NO: 884128 - protein, 297 aa, Homo sapiens
MTNQESAVHVKMMPEFQKSSVRIKNPTRVEEIICGLIKGGAAKLQIITDFDMTLSRFSYKGKRCPTCHNIIDNCKLVTDECRKKLLQLKEKYYAIEVDPVLTVEEKYPYMVEWYTKSHGLLVQQALPKAKLKEIVAESDVMLKEGYENFFDKLQQHSIPVFIFSAGIGDVLEEVIRQAGVYHPNVKVVSNFMDFDETGVLKGFKGELIHVFNKHDGALRNTEYFNQLKDNSNIILLGDSQGDLRMADGVANVEHILKIGYLNDRVDELLEKYMDSYDIVLVQDESLEVANSILQKIL

SEQ ID NO: 884129 - protein, 205 aa, Homo sapiens
MTNQESAVHVKMMPEFQKSSVRIKNPTRVEEIICGLIKGGAAKLQIITDFDMTLSRFSYKGKRCPTCHNIIDNCKLVTDECRKKLLQLKEKYYAIEVDPVLTVEEKYPYMVEWYTKSHGLLVQQALPKAKLKEIVAESDVMLKEGYENFFDKLQQHSIPVFIFSAGIGDVLEEVIRQAGVYHPNVKVVSNFMDFDETVRISNRSS

SEQ ID NO: 884130 - protein, 165 aa, Homo sapiens
LITSCYLHLTEEGYENFFDKLQQHSIPVFIFSAGIGDVLEEVIRQAGVYHPNVKVVSNFMDFDETGVLKGFKGELIHVFNKHDGALRNTEYFNQLKDNSNIILLGDSQGDLRMADGVANVEHILKIGYLNDRVDELLEKYMDSYDIVLVQDESLEVANSILQKIL

SEQ ID NO: 884131 - protein, 336 aa, Homo sapiens
MRAPSMDRAAVARVGAVASASVCALVAGVVLAQYIFTLKRKTGRKTKIIEMMPEFQKSSVRIKNPTRVEEIICGLIKGGAAKLQIITDFDMTLSRFSYKGKRCPTCHNIIDNCKLVTDECRKKLLQLKEKYYAIEVDPVLTVEEKYPYMVEWYTKSHGLLVQQALPKAKLKEIVAESDVMLKEGYENFFDKLQQHSIPVFIFSAGIGDVLEEVIRQAGVYHPNVKVVSNFMDFDETGVLKGFKGELIHVFNKHDGALRNTEYFNQLKDNSNIILLGDSQGDLRMADGVANVEHILKIGYLNDRVDELLEKYMDSYDIVLVQDESLEVANSILQKIL

SEQ ID NO: 884132 - protein, 297 aa, Homo sapiens; identical to SEQ ID NO: 884128

SEQ ID NO: 884133 - protein, 80 aa, Homo sapiens
PGCSGIPRFRDSQSTRAACFFPAWTRMRAPSMDRAAVARVGAVASASVCALVAGVVLAQYIFTLKRKTGRKTKIIEMKIG

SEQ ID NO: 884134 - protein, 415 aa, Homo sapiens
MAPVSGSRSPDREASGSGGRRRSSSKSPKPSKSARSPRGRRSRSHSCSRSGDRNGLTHQLGGLSQGSRNQSYRSRSRSRSRERPSAPRGIPFASASSSVYYGSYSRPYGSDKPWPSLLDKEREESLRQKRLSERERIGELGAPEVWGLSPKNPEPDSDEHTPVEDEEPKKSTTSASTSEEEKKKKSSRSKERSKKRRKKKSSKRKHKKYSEDSDSDSDSETDSSDEDNKRRAKKAKKKEKKKKHRSKKYKKKRSKKSRKESSDSSSKESQEEFLENPWKDRTKAEEPSDLIGPEAPKTLTSQDDKPLNYGHALLPGEGAAMAEYVKAGKRIPRRGEIGLTSEEIASFECSGYVMSGSRHRRMEAVRLRKENQIYSADEKRALASFNQEERRKRENKILASFREMVYRKTKGKDDK

SEQ ID NO: 884135 - protein, 415 aa, Homo sapiens; identical to SEQ ID NO: 884134

SEQ ID NO: 884136 - protein, 232 aa, Homo sapiens
MKSQRKALLQLLLQKKKSSKRKHKKYSEDSDSDSDSETDSSDEDNKRRAKKAKKKEKKKKHRSKKYKKKRSKKSRKESSDSSSKESQEEFLENPWKDRTKAEEPSDLIGPEAPKTLTSQDDKPLNYGHALLPGEGAAMAEYVKAGKRIPRRGEIGLTSEEIASFECSGYVMSGSRHRRMEAVRLRKENQIYSADEKRALASFNQEERRKRENKILASFREMVYRKTKGKDDK

SEQ ID NO: 884137 - protein, 506 aa, Homo sapiens
MHRGLIHPQSRAVGGDAMTPIVTVLICLRLSLGPRTHVQAGTLPKPTLWAEPGSVITQGSPVTLWCQGILETQEYRLYREKKTAPWITRIPQEIVKKGQFPIPSITWEHTGRYRCFYGSHTAGWSEPSDPLELVVTGAYIKPTLSALPSPVVTSGGNVTLHCVSQVAFGSFILCKEGEDEHPQCLNSQPRTHGWSRAIFSVGPVSPSRRWSYRCYAYDSNSPHVWSLPSDLLELLVLGVSKKPSLSVQPGPIVAPGESLTLQCVSDVSYDRFVLYKEGERDFLQLPGPQPQAGLSQANFTLGPVSRSYGGQYRCSGAYNLSSEWSAPSDPLDILIAGQFRGRPFISVHPGPTVASGENVTLLCQSWGPFHTFLLTKAGAADAPLRLRSIHEYPKYQAEFPMSPVTSAHSGTYRCYGSLSSNPYLLSHPSDSLELMVSGAAETLSPPQNKSDSKAGAANTLSPSQNKTASHPQDYTVENLIRMGIAGLVLVVLGILLFEAQHSQRSL

SEQ ID NO: 884138 - protein, 150 aa, Homo sapiens
QNQAELGALISDAVGDGLPPPWSEGKCGTAPVTDTAGSRSFLGLTVGTGCTEREHQAQQNQAEFRMGPVTSAHVGTYRCYSSLSSNPYLLSLPSDPLELVVSASLGQHPQDYTVENLIRMGVAGLVLVVLGILLFEAQHSQRSLQDAAGR

SEQ ID NO: 884139 - protein, 466 aa, Homo sapiens
MTPILTVLICLGLSLGPRTHVQAGHLPKPTLWAEPGSVIIQGSPVTLRCQGSLQAEEYHLYRENKSASWVRRIQEPGKNGQFPIPSITWEHAGRYHCQYYSHNHSSEYSDPLELVVTGAYSKPTLSALPSPVVTLGGNVTLQCVSQVAFDGFILCKEGEDEHPQRLNSHSHARGWSWAIFSVGPVSPSRRWSYRCYAYDSNSPYVWSLPSDLLELLVPGVSKKPSLSVQPGPMVAPGESLTLQCVSDVGYDRFVLYKEGERDFLQRPGWQPQAGLSQANFTLGPVSPSHGGQYRCYSAHNLSSEWSAPSDPLDILITGQFYDRPSLSVQPVPTVAPGKNVTLLCQSRGQFHTFLLTKEGAGHPPLHLRSEHQAQQNQAEFRMGPVTSAHVGTYRCYSSLSSNPYLLSLPSDPLELVVSASLGQHPQDYTVENLIRMGVAGLVLVVLGILLFEAQHSQRSLQDAAGR

SEQ ID NO: 884140 - protein, 454 aa, Homo sapiens
MTPILTVLICLGHLPKPTLWAEPGSVIIQGSPVTLRCQGSLQAEEYHLYRENKSASWVRRIQEPGKNGQFPIPSITWEHAGRYHCQYYSHNHSSEYSDPLELVVTGAYSKPTLSALPSPVVTLGGNVTLQCVSQVAFDGFILCKEGEDEHPQRLNSHSHARGWSWAIFSVGPVSPSRRWSYRCYAYDSNSPYVWSLPSDLLELLVPGVSKKPSLSVQPGPMVAPGESLTLQCVSDVGYDRFVLYKEGERDFLQRPGWQPQAGLSQANFTLGPVSPSHGGQYRCYSAHNLSSEWSAPSDPLDILITGQFYDRPSLSVQPVPTVAPGKNVTLLCQSRGQFHTFLLTKEGAGHPPLHLRSEHQAQQNQAEFRMGPVTSAHVGTYRCYSSLSSNPYLLSLPSDPLELVVSASLGQHPQDYTVENLIRMGVAGLVLVVLGILLFEAQHSQRSLQDAAGR

SEQ ID NO: 884141 - protein, 255 aa, Homo sapiens
MVAPGESLTLQCVSDVSYDRFVLYKEGERDFLQLPGPQPQAGLSQANFTLGPVSRSYGGQYRCSGAYNLSSEWSAPSDPLDILIAGQFRGRPFISVHPGPTVASGENVTLLCQSWGPFHTFLLTKAGAADAPLRLRSIHEYPKYQAEFPMSPVTSAHSGTYRCYGSLSSNPYLLSHPSDSLELMVSGAAETLSPPQNKSDSKAGAANTLSPSQNKTASHPQDYTVENLIRMGIAGLVLVVLGILLFEAQHSQRSL

SEQ ID NO: 884142 - protein, 287 aa, Homo sapiens
MTPILTVLICLGLSLGPRTHVQAGHLPKPTLWAEPGSVIIQGSPVTLRCQGSLQAEEYHLYRENKSASWVRRIQEPGKNGQFPIPSITWEHAGRYHCQYYSHNHSSEYSDPLELVVTGAYSKPTLSALPSPVVTLGGNVTLQCVSQVAFDGFILCKEGEDEHPQRLNSHSHARGWSWAIFSVGPVSPSRRWSYRCYAYDSNSPYVWSLPSDLLELLVPGAAETLSPPQNKSDSKAGAANTLSPSQNKTASHPQDYTVENLIRMGIAGLVLVVLGILLFEAQHSQRSL

SEQ ID NO: 884143 - protein, 483 aa, Homo sapiens
MTPILTVLICLGLSLGPRTHVQAGHLPKPTLWAEPGSVIIQGSPVTLRCQGSLQAEEYHLYRENKSASWVRRIQEPGKNGQFPIPSITWEHAGRYHCQYYSHNHSSEYSDPLELVVTGAYSKPTLSALPSPVVTLGGNVTLQCVSQVAFDGFILCKEGEDEHPQRLNSHSHARGWSWAIFSVGPVSPSRRWSYRCYAYDSNSPYVWSLPSDLLELLVPGVSKKPSLSVQPGPMVAPGESLTLQCVSDVGYDRFVLYKEGERDFLQRPGWQPQAGLSQANFTLGPVSPSHGGQYRCYSAHNLSSEWSAPSDPLDILITGQFYDRPSLSVQPVPTVAPGKNVTLLCQSRGQFHTFLLTKEGAGHPPLHLRSEHQAQQNQAEFRMGPVTSAHVGTYRCYSSLSSNPYLLSLPSDPLELVVSEAAETLSPSQNKTDSTTTSLGQHPQDYTVENLIRMGVAGLVLVVLGILLFEAQHSQRSLQDAAGR

SEQ ID NO: 884144 - protein, 125 aa, Homo sapiens
MASSPSHPSPGNTQGGITVSTTATITHQKHQAQQNQAEFRMGPVTSAHVGTYRCYSSLSSNPYLLSLPSDPLELVVSASLGQHPQDYTVENLIRMGVAGLVLVVLGILLFEAQHSQRSLQDAAGR

SEQ ID NO: 884145 - protein, 498 aa, Homo sapiens
MEGRTCPGFRGKFLTGNSLPGLSLGPRTHVQAGTLPKPTLWAEPGSVITQGSPVTLWCQGILETQEYRLYREKKTAPWITRIPQEIVKKGQFPIPSITWEHTGRYRCFYGSHTAGWSEPSDPLELVVTGAYIKPTLSALPSPVVTSGGNVTLHCVSQVAFGSFILCKEGEDEHPQCLNSQPRTHGWSRAIFSVGPVSPSRRWSYRCYAYDSNSPHVWSLPSDLLELLVLGVSKKPSLSVQPGPIVAPGESLTLQCVSDVSYDRFVLYKEGERDFLQLPGPQPQAGLSQANFTLGPVSRSYGGQYRCSGAYNLSSEWSAPSDPLDILIAGQFRGRPFISVHPGPTVASGENVTLLCQSWGPFHTFLLTKAGAADAPLRLRSIHEYPKYQAEFPMSPVTSAHSGTYRCYGSLSSNPYLLSHPSDSLELMVSGAAETLSPPQNKSDSKAGAANTLSPSQNKTASHPQDYTVENLIRMGIAGLVLVVLGILLFEAQHSQRSL

SEQ ID NO: 884146 - protein, 420 aa, Homo sapiens
MEVPPRLSHVPPPLFPSAPATLASRSLSHWRPRPPRQLAPLLPSLAPSSARQGARRAQRHVTAQQPSRLAGGAAIKGGRRRRPDLFRRHFKSSSIQRSAAAAAATRTARQHPPADSSVTMEDMNEYSNIEEFAEGSKINASKNQQDDGKMFIGGLSWDTSKKDLTEYLSRFGEVVDCTIKTDPVTGRSRGFGFVLFKDAASVDKVLELKEHKLDGKLIDPKRAKALKGKEPPKKVFVGGLSPDTSEEQIKEYFGAFGEIENIELPMDTKTNERRGFCFITYTDEEPVKKLLESRYHQIGSGKCEIKVAQPKEVYRQQQQQQKGGRGAAAGGRGGTRGRGRGQGQNWNQGFNNYYDQGYGNYNSAYGGDQNYSGYGGYDYTGYNYGNYGYGQGYADYSGQQSTYGKASRGGGNHQNNYQPY

SEQ ID NO: 884147 - protein, 420 aa, Homo sapiens; identical to SEQ ID NO: 884146

SEQ ID NO: 884148 - protein, 420 aa, Homo sapiens; identical to SEQ ID NO: 884146

SEQ ID NO: 884149 - protein, 301 aa, Homo sapiens
MEDMNEYSNIEEFAEGSKINASKNQQDDGKMFIGGLSWDTSKKDLTEYLSRFGEVVDCTIKTDPVTGRSRGFGFVLFKDAASVDKVLELKEHKLDGKLIDPKRAKALKGKEPPKKVFVGGLSPDTSEEQIKEYFGAFGEIENIELPMDTKTNERRGFCFITYTDEEPVKKLLESRYHQIGSGKCEIKVAQPKEVYRQQQQQQKGGRGAAAGGRGGTRGRGRGQGQNWNQGFNNYYDQGYGNYNSAYGGDQNYSGYGGYDYTGYNYGNYGYGQGYADYSGQQSTYGKASRGGGNHQNNYQPY

SEQ ID NO: 884150 - protein, 301 aa, Homo sapiens; identical to SEQ ID NO: 884149

SEQ ID NO: 884151 - protein, 301 aa, Homo sapiens; identical to SEQ ID NO: 884149

SEQ ID NO: 884152 - protein, 301 aa, Homo sapiens; identical to SEQ ID NO: 884149

SEQ ID NO: 884153 - protein, 301 aa, Homo sapiens; identical to SEQ ID NO: 884149

SEQ ID NO: 884154 - protein, 282 aa, Homo sapiens
MEDMNEYSNIEEFAEGSKINASKNQQDDGKMFIGGLSWDTSKKDLTEYLSRFGEVVDCTIKTDPVTGRSRGFGFVLFKDAASVDKVLELKEHKLDGKLIDPKRAKALKGKEPPKKVFVGGLSPDTSEEQIKEYFGAFGEIENIELPMDTKTNERRGFCFITYTDEEPVKKLLESRYHQIGSGKCEIKVAQPKEVYRQQQQQQKGGRGAAAGGRGGTRGRGRGQGQNWNQGFNNYYDQGYGNYNSAYGGDQNYSGYGGYDYTGYNYGNYGYGQGYADYSGKNI

SEQ ID NO: 884155 - protein, 301 aa, Homo sapiens; identical to SEQ ID NO: 884149

SEQ ID NO: 884156 - protein, 301 aa, Homo sapiens; identical to SEQ ID NO: 884149

SEQ ID NO: 884157 - protein, 301 aa, Homo sapiens; identical to SEQ ID NO: 884149

SEQ ID NO: 884158 - protein, 227 aa, Homo sapiens
MEDMNEYSNIEEFAEGSKINASKNQQDDGKMFIGGLSWDTSKKDLTEYLSRFGEVVDCTIKTDPVTGRSRGFGFVLFKDAASVDKVLELKEHKLDGKLIDPKRAKALKGKEPPKKVFVGGLSPDTSEEQIKEYFGAFGEIENIELPMDTKTNERRGFCFITYTDEEPVKKLLESRYHQIGSGKCEIKVAQPKEVYRQQQQQQKGGRGAAAGGRGGTRGRGREVRLNS

SEQ ID NO: 884159 - protein, 301 aa, Homo sapiens; identical to SEQ ID NO: 884149

SEQ ID NO: 884160 - protein, 155 aa, Homo sapiens
MDTKTNERRGFCFITYTDEEPVKKLLESRYHQIGSGKCEIKVAQPKEVYRQQQQQQKGGRGAAAGGRGGTRGRGRGQGQNWNQGFNNYYDQGYGNYNSAYGGDQNYSGYGGYDYTGYNYGNYGYGQGYADYSGQQSTYGKASRGGGNHQNNYQPY

SEQ ID NO: 884161 - protein, 301 aa, Homo sapiens; identical to SEQ ID NO: 884149

SEQ ID NO: 884162 - protein, 244 aa, Homo sapiens
MEDMNEYSNIEEFAEGSKINASKNQQDDGKMFIGGLSWDTSKKDLTEYLSRFGEVVDCTIKTDPVTGRSRGFGFVLFKDAASVDKVLELKEHKLDGKLIDPKRAKALKGKEPPKKVFVGGLSPDTSEEQIKEYFGAFGEIENIELPMDTKTNERRGFCFITYTDEEPVKKLLESRYHQIGSGKCEIKVAQPKEVYRQQQQQQKGGRGAAAGGRGGTRGRGRGQQSTYGKASRGGGNHQNNYQPY

SEQ ID NO: 884163 - protein, 301 aa, Homo sapiens; identical to SEQ ID NO: 884149

SEQ ID NO: 884164 - protein, 301 aa, Homo sapiens; identical to SEQ ID NO: 884149

SEQ ID NO: 884165 - protein, 301 aa, Homo sapiens; identical to SEQ ID NO: 884149

SEQ ID NO: 884166 - protein, 307 aa, Homo sapiens
GAQGSLIKLIPPLQRSAAAAAATRTARQHPPADSSVTMEDMNEYSNIEEFAEGSKINASKNQQDDGKMFIGGLSWDTSKKDLTEYLSRFGEVVDCTIKVLELKEHKLDGKLIDPKRAKALKGKEPPKKVFVGGLSPDTSEEQIKEYFGAFGEIENIELPMDTKTNERRGFCFITYTDEEPVKKLLESRYHQIGSGKTAPGNGQSAQPKKPKNQQQKSRTPPPPGAPTGTRGPARQDGRKQEEQGYGNYNSAYGGDQNYSGYGGYDYTGYNYGNYGYGQGYADYSGQQSTYGKASRGGGNHQNNYQPY

SEQ ID NO: 884167 - protein, 287 aa, Homo sapiens
MEDMNEYSNIEEFAEGSKINASKNQQDDGKMFIGGLSWDTSKKDLTEYLSRFGEVVDCTIKTDPVTGRSRGFGFVLFKDAASVDKVLELKEHKLDGKLIDPKRAKALKGKEPPKKVFVGGLSPDTSEEQIKEYFGAFGEIENIELPMDTKTNERRGFCFITYTDEEPVKKLLESRYHQIGSGKCEIKVAQPKEVYRQQQQQQKGGRGAAAGGRGGTRGRGRGQGQNWNQGFNNYYDQGYGNYNSAYGGDQNYSGYGGYDYTGYNYGNYGYGQGYADYSALVGGDPLN

SEQ ID NO: 884168 - protein, 270 aa, Homo sapiens
MEDMNEYSNIEEFAEGSKINASKNQQDDGKMFIGGLSWDTSKKDLTEYLSRFGEVVDCTIKTDPVTGRSRGFGFVLFKDAASVDKVLELKEHKLDGKLIDPKRAKALKGKEPPKKVFVGGLSPDTSEEQIKEYFGAFGEIENIELPMDTKTNERRGFCFITYTDEEPVKKLLESRYHQIGSGKCEIKVAQPKEVYRQQQQQQKGGRGAAAGGRGGTRGRGRGQGQNWNQGFNNYYDQGYGNYNSAYGGQQSTYGKASRGGGNHQNNYQPY

SEQ ID NO: 884169 - protein, 244 aa, Homo sapiens; identical to SEQ ID NO: 884162

SEQ ID NO: 884170 - protein, 214 aa, Homo sapiens
MEDMNEYSNIEEFAEGSKINASKNQQDDGKMFIGGLSWDTSKKDLTEYLSRFGEVVDCTIKTDPVTGRSRGFGFVLFKDAASVDKVLELKEHKLDGKLIDPKRAKALKGKEPPKKVFVGGLSPDTSEEQIKEYFGAFGEIENIELPMDTKTNERRGFCFITYTDEEPVKKLLESRYHQIGSGKCEIKVAQPKEVYRQQQQQQKGGRENPPTITS

SEQ ID NO: 884171 - protein, 194 aa, Homo sapiens
MEDMNEYSNIEEFAEGSKINASKNQQDDGKMFIGGLSWDTSKKDLTEYLSRFGEVVDCTIKTDPVTGRSRGFGFVLFKDAASVDKVLELKEHKLDGKLIDPKRAKALKGKEPPKKVFVGGLSPDTSEEQIKEYFGAFGEIENIELPMDTKTNERRGFCFITYTDEEPVKKLLESRYHQIGSGKAAHDSPRSSSQ

SEQ ID NO: 884172 - protein, 420 aa, Homo sapiens; identical to SEQ ID NO: 884146

SEQ ID NO: 884173 - protein, 203 aa, Homo sapiens
MFIGGLSWDTSKKDLTEYLSRFGEVVDCTIKTDPVTGRSRGFGFVLFKDAASVDKVLELKEHKLDGKLIDPKRAKALKGKEPPKKVFVGGLSPDTSEEQIKEYFGAFGEIENIELPMDTKTNERRGFCFITYTDEEPVKKLLESRYHQIGSGKCEIKVAQPKEVYRQQQQQQKGGRGAAAGGRGGTRGRGRAGPKLDANSRLF

SEQ ID NO: 884174 - protein, 338 aa, Homo sapiens
GAQGSLIKLIPPLQRSAAAAAATRTARQHPPADSSVTMEDMNEYSNIEEFAEGSKINASKNQQDDGKMFIGGLSWDTSKKDLTEYLSRFGEVVDCTIKTDPVTGRSRGFGFVLFKDAASVDKVLELKEHKLDGKLIDPKRAKALKGKEPPKKVFVGGLSPDTSEEQIKEYFGAFGEIENIELPMDTKTNERRGFCFITYTDEEPVKKLLESRYHQIGSGKCEIKVAQPKEVYRQQQQQQKGGRGAAAGGRGGTRGRGRGQGQNWNQGFNNYYDQGYGNYNSAYGGDQNYSGYGGYDYTGYNYGNYGYGQGYADYSGQQSTYGKASRGGGNHQNNYQPY

SEQ ID NO: 884175 - protein, 301 aa, Homo sapiens; identical to SEQ ID NO: 884149

SEQ ID NO: 884176 - protein, 301 aa, Homo sapiens; identical to SEQ ID NO: 884149

SEQ ID NO: 884177 - protein, 301 aa, Homo sapiens; identical to SEQ ID NO: 884149

SEQ ID NO: 884178 - protein, 301 aa, Homo sapiens; identical to SEQ ID NO: 884149

SEQ ID NO: 884179 - protein, 301 aa, Homo sapiens; identical to SEQ ID NO: 884149

SEQ ID NO: 884180 - protein, 227 aa, Homo sapiens; identical to SEQ ID NO: 884158

SEQ ID NO: 884181 - protein, 244 aa, Homo sapiens; identical to SEQ ID NO: 884162

SEQ ID NO: 884182 - protein, 301 aa, Homo sapiens; identical to SEQ ID NO: 884149

SEQ ID NO: 884183 - protein, 135 aa, Homo sapiens
MWAEAFPTMETEVSMHNEGSVHRSPSRHCREGSSRVRAKTGTKDLITIMIKDMEITIVPMVVIKTIVAMADMIILGITMGTMDMDRDMQTTVANRALMARHLEGVAITKTITSHTKGEHWRKQVCIRVQENSRNV

SEQ ID NO: 884184 - protein, 244 aa, Homo sapiens; identical to SEQ ID NO: 884162

SEQ ID NO: 884185 - protein, 209 aa, Homo sapiens
MEDMNEYSNIEEFAEGSKINASKNQQDDGKMFIGGLSWDTSKKDLTEYLSRFGEVVDCTIKTDPVTGRSRGFGFVLFKDAASVDKVLELKEHKLDGKLIDPKRAKALKGKEPPKKVFVGGLSPDTSEEQIKEYFGAFGEIENIELPMDTKTNERRGFCFITYTDEEPVKKLLESRYHQIGSGKSCTNLTGILFLFLGGDVKVTHLAGRH

SEQ ID NO: 884186 - protein, 301 aa, Homo sapiens
MEDMNEYSNIEEFAEGSKINASKNQQDDGKMFIGGLSWDTSKKDLTEYLSRFGEVVDCTIKTDPVTGRSRGFGFVLFKDAASVDKVLELKEHKLDGKLIDPKRAKALKGKEPPKKVFVGGLSPDTSEEQIKEYFGAFGEIENIELPMDTKTNERRGFCFITYTDEEPVKKLLESRYHQIGSGKCEIKVAQPKEVYRQQQQQQKGGRGAAAGGRGGTRGRGRGQGQNWNQGFNNYYDQGYGNYNSAYGGDQNYSGYGGYDYTGYNYGNYGYGQGYADYSGQQSTYGKASRGGGNHQNNYQPG

SEQ ID NO: 884187 - protein, 294 aa, Homo sapiens
MEDMNEYSNIEEFAEGSKINASKNQQDDGKMFIGGLSWDTSKKDLTEYLSRFGEVVDCTIKTDPVTGRSRGFGFVLFKDAASVDKVLELKEHKLDGKLIDPKRAKALKGKEPPKKVFVGGLSPDTSEEQIKEYFGAFGEIENIELPMDTKTNERRGFCFITYTDEEPVKKLLESRYHQIGSGKTAPGNGQSAQPKKPKNQQQKSRTPPPPGAPTGTRGPARQDGRKQEEQGYGNYNSAYGGDQNYSGYGGYDYTGYNYGNYGYGQGYADYSGQQSTYGKASRGGGNHQNNYQPY

SEQ ID NO: 884188 - protein, 240 aa, Homo sapiens
MEDMNEYSNIEEFAEGSKINASKNQQDDGKMFIGGLSWDTSKKDLTEYLSRFGEVVDCTIKTDPVTGRSRGFGFVLFKDAASVDKVLELKEHKLDGKLIDPKRAKALKGKEPPKKVFVGGLSPDTSEEQIKEYFGAFGEIENIELPMDTKTNERRGFCFITYTDEEPVKKLLESRYHQIGSGKCEIKVAQPKEVYRQQQQQQKGGRGAAAGGRGGTRGRGRAGSLGPRVKGPKLGKPKFK

SEQ ID NO: 884189 - protein, 228 aa, Homo sapiens
MEDMNEYSNIEEFAEGSKINASKNQQDDGKMFIGGLSWDTSKKDLTEYLSRFGEVVDCTIKTDPVTGRSRGFGFVLFKDAASVDKVLELKEHKLDGKLIDPKRAKALKGKEPPKKVFVGGLSPDTSEEQIKEYFGAFGEIENIELPMDTKTNERRGFCFITYTDEEPVKKLLESRYHQIGSGKDIKVPTPRGYKQQRTTKGEVLRGGSVQGRRSGKTGNLQENKHGAK

SEQ ID NO: 884190 - protein, 210 aa, Homo sapiens
MEQDKHTTRPDKETDNKRGERKEAPERHHEEEKKQKQRAEKGAEVKTKTRRQRTNSRRGGKQTRQTTRKNEQDTKTQTKARQPSGKEKTRRDKEAKEKPIITNKGNNEGQKENRGEGHESGAEQVKVSEQQRQRTAEENRRESEEEGARRARNGGEGGSTGRDAEQRRKGAAPSRGEGGRERRGGTGERAREARGQTEERRGRKKEQRVD

SEQ ID NO: 884191 - protein, 153 aa, Homo sapiens
MKHTQSGQSTSPLVIDYTCRVCQMAFVFSSLIPLLLMTPVFCLGNTSECFQNFSQSHKCILMHSPPSAMAELPPSANTSVCSTLYFYGIAIFLGSFVLSLLTIMVLLIRAQTLYKKFVKSTGFLGSEQWAVIHIVDQRVRFYPVAFFCCWGPG

SEQ ID NO: 884192 - protein, 102 aa, Homo sapiens [sequence omitted]

SEQ ID NO: 884193 - protein, 245 aa, Homo sapiens
MKHTQSGQSTSPLVIDYTCRVCQMAFVFSSLIPLLLMTPVFCLGNTSECFQNFSQSHKCILMHSPPSAMAELPPSANTSVCSTLYFYGIAIFLGSFVLSLLTIMVLLIRAQTLYKKFVKSTGFLGSEQWAVIHIVDQRVRFYPVAFFCCWGPAVILMIIKLTKPQDTKLHMALYVLQALTATSQGLLNCGVYGWTQHKFHQLKQEARRDADTQTPLLCSQKRFYSRGLNSLESTLTFPASTSTIF

SEQ ID NO: 884194 - protein, 245 aa, Homo sapiens; identical to SEQ ID NO: 884193

SEQ ID NO: 884195 - protein, 311 aa, Homo sapiens
SRGSLTPCHKVKSTGFLGSEQWAVIHIVDQRVRFYPVTFFCCWGIFYISSFLYTVNYIWYLYTELRMKHTQSGQSTSPLVIDYTCRVCQMAFVFSSLIPLLLMTPVFCLGNTSECFQNFSQSHKCILMHSPPSAMAELPPSANTSVCSTLYFYGIAIFLGSFVLSLLTIMVLLIRAQTLYKKFVKSTGFLGSEQWAVIHIVDQRVRFYPVAFFCCWGPAVILMIIKLTKPQDTKLHMALYVLQALTATSQGLLNCGVYGWTQHKFHQLKQEARRDADTQTPLLCSQKRFYSRGLNSLESTLTFPASTSTIF

SEQ ID NO: 884196 - protein, 163 aa, Homo sapiens
MATLSVIGSSSLIAYAVFHNIQKSPEIRPLFYLSFCDLLLGLCWLTETLLYGASVANKDIICYNLQAVGQIFYISSFLYTVNYIWYLYTELRMKHTQSGQSTSPLVIDYTCRVCQMAFVFSSLIPLLLMTPVFCLGNTSECFQNFSQSHKSYLSEPRHCIRSL

SEQ ID NO: 884197 - protein, 244 aa, Homo sapiens
MATLSVIGSSSLIAYAVFHNIQKSPEIRPLFYLSFCDLLLGLCWLTETLLYGASVANKDIICYNLQAVGQIFYISSFLYTVNYIWYLYTELRMKHTQSGQSTSPLVIDYTCRVCQMAFVFSSLIPLLLMTPVFCLGNTSECFQNFSQSHKCILMHSPPSAMAELPPSANTSVCSTLYFYGIAIFLGSFVLSLLTIMGRCLGLLPGLECSGASRLTATSASRVRAVLLPRPPEWLELEAHAATTG

SEQ ID NO: 884198 - protein, 189 aa, Homo sapiens
MATLSVIGSSSLIAYAVFHNIQKSPEIRPLFYLSFCDLLLGLCWLTETLLYGASVANKDIICYNLQAVGQIFYISSFLYTVNYIWYLYTELRMKHTQSGQSTSPLVIDYTCRVCQMAFVFSSLIPLLLMTPVFCLGNTSECFQNFSQSHKCILMHSPPSAMAELPPSANTSVCSTLYFYGLTYPSPDIV

SEQ ID NO: 884199 - protein, 210 aa, Homo sapiens
MATLSVIGSSSLIAYAVFHNIQKSPEIRPLFYLSFCDLLLGLCWLTETLLYGASVANKDIICYNLQAVGQIFYISSFLYTVNYIWYLYTELRMKHTQSGQSTSPLVIDYTCRVCQMAFVFSSLIPLLLMTPVFCLGNTSECFQNFSQSHKCILMHSPPSAMAELPPSANTSVCSTLYFYGIAIFLGSFVLSLLTIMVWYHPTFLCGEMRK

SEQ ID NO: 884200 - protein, 302 aa, Homo sapiens
MATLSVIGSSSLIAYAVFHNIQKSPEIRPLFYLSFCDLLLGLCWLTETLLYGASVANKDIICYNLQAVGQVIDYTCRVCQMAFVFSSLIPLLLMTPVFCLGNTSECFQNFSQSHKCILMHSPPSAMAELPPSANTSVCSTLYFYGIAIFLGSFVLSLLTIMVLLIRAQTLYKKFVKSTGFLGSEQWAVIHIVDQRVRFYPVAFFCCWGPAVILMIIKLTKPQDTKLHMALYVLQALTATSQGLLNCGVYGWTQHKFHQLKQEARRDADTQTPLLCSQKRFYSRGLNSLESTLTFPASTSTIF

SEQ ID NO: 884201 - protein, 337 aa, Homo sapiens
MATLSVIGSSSLIAYAVFHNIQKSPEIRPLFYLSFCDLLLGLCWLTETLLYGASVANKDIICYNLQAVGQIFYISSFLYTVNYIWYLYTELRMKHTQSGQSTSPLVIDYTCRVCQMAFVFSSLIPLLLMTPVFCLGNTSECFQNFSQSHKCILMHSPPSAMAELPPSANTSVCSTLYFYGIAIFLGSFVLSLLTIMVLLIRAQTLYKKFVKSTGFLGSEQWAVIHIVDQRVRFYPVAFFCCWGPAVILMIIKLTKPQDTKLHMALYVLQALTATSQGLLNCGVYGWTQHKFHQLKQEARRDADTQTPLLCSQKRFYSRGLNSLESTLTFPASTSTIF

SEQ ID NO: 884202 - protein, 222 aa, Homo sapiens
MAFVFSSLIPLLLMTPVFCLGNTSECFQNFSQSHKCILMHSPPSAMAELPPSANTSVCSTLYFYGIAIFLGSFVLSLLTIMVLLIRAQTLYKKFVKSTGFLGSEQWAVIHIVDQRVRFYPVAFFCCWGPAVILMIIKLTKPQDTKLHMALYVLQALTATSQGLLNCGVYGWTQHKFHQLKQEARRDADTQTPLLCSQKRFYSRGLNSLESTLTFPASTSTIF

SEQ ID NO: 884203 - protein, 222 aa, Homo sapiens; identical to SEQ ID NO: 884202

SEQ ID NO: 884204 - protein, 151 aa, Homo sapiens
MFPKLQSEPQVLLIRAQTLYKKFVKSTGFLGSEQWAVIHIVDQRVRFYPVAFFCCWGPAVILMIIKLTKPQDTKLHMALYVLQALTATSQGLLNCGVYGWTQHKFHQLKQEARRDADTQTPLLCSQKRFYSRGLNSLESTLTFPASTSTIF

SEQ ID NO: 884205 - protein, 244 aa, Homo sapiens; identical to SEQ ID NO: 884197

SEQ ID NO: 884206 - protein, 210 aa, Homo sapiens; identical to SEQ ID NO: 884199

SEQ ID NO: 884207 - protein, 111 aa, Homo sapiens
TPPCRREHPINFESVGPTIVGRVAWRSWFRRFLGMSVAFVPDWLRGKAEVNQETIQRLLEENDQLIRCIVEYQNKGRGNECVQYQHVLHRNLIYLATIADASPTSTSKAME

SEQ ID NO: 884208 - protein, 111 aa, Homo sapiens; identical to SEQ ID NO: 884207

SEQ ID NO: 884209 - protein, 111 aa, Homo sapiens; identical to SEQ ID NO: 884207

SEQ ID NO: 884210 - protein, 459 aa, Homo sapiens
KRLGFGSGPMRAGLRGAGRTVAAAGGGGGGAAAAEADWGGGGLARPGLACQGAGGGGSSTMSLQYGAEETPLAGSYGAADSFPKDFGYGVEEEEEEAAAAGGGVGAGAGGGCGPGGADSSKPRILLMGLRRSGKSSIQKVVFHKMSPNETLFLESTNKIYKDDISNSSFVNFQIWDFPGQMDFFDPTFDYEMIFRGTGALIYVIDAQDDYMEALTRLHITVSKAYKVNPDMNFEVFIHKVDGLSDDHKIETQRDIHQRANDDLADAGLEKLHLSFYLTSIYDHSIFEAFSKVVQKLIPQLPTLENLLNIFISNSGIEKAFLFDVVSKIYIATDSSPVDMQSYELCCDMIDVVIDVSCIYGLKEDGSGSAYDKESMAIIKLNNTTVLYLKEVTKFLALVCILREESFERKGLIDYNFHCFRKAIHEVFEVGVTSHRSCGHQTSASSLKALTHNGTPRNAI

SEQ ID NO: 884211 - protein, 459 aa, Homo sapiens; identical to SEQ ID NO: 884210

SEQ ID NO: 884212 - protein, 459 aa, Homo sapiens; identical to SEQ ID NO: 884210

SEQ ID NO: 884213 - protein, 459 aa, Homo sapiens; identical to SEQ ID NO: 884210

SEQ ID NO: 884214 - protein, 249 aa, Homo sapiens [sequence omitted]

SEQ ID NO: 884215 - protein, 258 aa, Homo sapiens
MEEMKKTAIRLPKGKQKPIKTEWNSRCVLFTYFQGDISSVVDEHFSRALSNIKSPQELTPSSQSEGVMLKNDDSMSPNQWRYSSPWTKPQPEVPVTNRAANCNLHVPGPMAVNQFSPSLARRASVRPGELWHFSSLAGTSSLEPGYSHPFPARHLVPEPQPDGKREPLLSLLQQDRCLARPQESAARENGNPGQIAGSTGLLFNLPPGSVHYKKLYVSRGSASTSLPNETLSELETPGKYSLTPPNHWGHPHRYLQHL

SEQ ID NO: 884216 - protein, 211 aa, Homo sapiens
MEEMKKTAIRLPKGKQKPIKTEWNSRCVLFTYFQGDISSVVDEHFSRALSNIKSPQELTPSSQSEGVMLKNDDSMSPNQWRYSSPWTKPQPEVPVTNRAANCNLHVPGPMAVNQFSPSLARRASVRPGELWHFSSLAGTSSLEPGYSHPFPARHLVPEPQPDGKHKKLYVSRGSASTSLPNETLSELETPGKYSLTPPNHWGHPHRYLQHL

SEQ ID NO: 884217 - protein, 79 aa, Homo sapiens
KGTTGFTTLGTVTCTVSTSLAGAVGHSTSGFPGHAITTLGTICLGPPTSIPAASLVKLEEKDNTWSKTRQQDIPAYCSR

SEQ ID NO: 884218 - protein, 111 aa, Homo sapiens
MGALLQRKSEVQVAYMGSFMDTDQRKTVSQGRAAILNLLPITSYPRPQVTWFREGHKIIPSNRIAITLENQLVILATTTSDAGAYYVQAVNEKNGENKTSPFIHLSIASEF

SEQ ID NO: 884219 - protein, 117 aa, Homo sapiens
MGALLQRKSEVQVAYMGSFMDTDQRKTVSQGRAAILNLLPITSYPRPQVTWFREGHKIIPSNRIAITLENQLVILATTTSDAGAYYVQAVNEKNGENKTSPFIHLSIASFCGNTTQD

SEQ ID NO: 884220 - protein, 223 aa, Homo sapiens
MGALLQRKSEVQVAYMGSFMDTDQRKTVSQGRAAILNLLPITSYPRPQVTWFREGHKIIPSNRIAITLENQLVILATTTSDAGAYYVQAVNEKNGENKTSPFIHLSIARDVGTPETMAPTIVVPPGNRSVVAGSSETTLECIASARPVEDLSVTWKRNGVRITSGLHSFGRRLTISNPTSADTGPYVCEAALPGSAFEPARATAFLFIIGNAGASKWCCQHLR

SEQ ID NO: 884221 - protein, 293 aa, Homo sapiens
MGALLQRKSEVQVAYMGSFMDTDQRKTVSQGRAAILNLLPITSYPRPQVTWFREGHKIIPSNRIAITLENQLVILATTTSDAGAYYVQAVNEKNGENKTSPFIHLSIARDVGTPETMAPTIVVPPGNRSVVAGSSETTLECIASARPVEDLSVTWKRNGVRITSGLHSFGRRLTISNPTSADTGPYVCEAALPGSAFEPARATAFLFIIEPPYFTAEPESRISAEVEETVDIGCQAMGVPLPTLQWYKDAISISRLQNPRYKVLASGGLRIQKLRPEDSGIFQCFASNEGGEI

SEQ ID NO: 884222 - protein, 214 aa, Homo sapiens
MGALLQRKSEVQVAYMGSFMDTDQRKTVSQGRAAILNLLPITSYPRPQVTWFREGHKIIPSNRIAITLENQLVILATTTSDAGAYYVQAVNEKNGENKTSPFIHLSIARDVGTPETMAPTIVVPPGNRSVVAGSSETTLECIASARPVEDLSVTWKRNGVRITSGLHSFGRRLTISNPTSADTGPYVCEAALPGSAFEPARATAFLFIIGPTLF

SEQ ID NO: 884223 - protein, 351 aa, Homo sapiens
MTLRLLEDWCRGMDMNPRKALLIAGISQSCSVAEIEEALQAGLAPLGEYRLLGRMFRRDENRKVALVGLTAETSHALVPKEIPGKGGIWRVIFKPPDPDNTFLSRLNEFLAGEGMTVGELSRALGHENGSLDPEQGMIPEMWAPMLAQALEALQPALQCLKYKKLRVFSGRESPEPGEEEFGRWMFHTTQMIKAWQVPDVEKRRRLLESLRGPALDVIRVLKINNPLITVDECLQALEEVFGVTDNPRELQVKYLTTYQKDEEKLSAYVLRLEPLLQKLVQRGAIERDAVNQARLDQVIAGAVHKTIRRELNLPEDGPAPGFLQLLVLIKDYEAAEEEEALLQAILEGNFT

SEQ ID NO: 884224 - protein, 351 aa, Homo sapiens; identical to SEQ ID NO: 884223

SEQ ID NO: 884225 - protein, 215 aa, Homo sapiens [sequence omitted]

SEQ ID NO: 884226 - protein, 277 aa, Homo sapiens
MFDGDSQIPGKGGIWRVIFKPPDPDNTFLSRLNEFLAGEGMTVGELSRALGHENGSLDPEQGMIPEMWAPMLAQALEALQPALQCLKYKKLRVFSGRESPEPGEEEFGRWMFHTTQMIKAWQVPDVEKRRRLLESLRGPALDVIRVLKINNPLITVDECLQALEEVFGVTDNPRELQVKYLTTYQKDEEKLSAYVLRLEPLLQKLVQRGAIERDAVNQARLDQVIAGAVHKTIRRELNLPEDGPAPGFLQLLVLIKDYEAAEEEEALLQAILEGNFT

SEQ ID NO: 884227 - protein, 1462 aa, Homo sapiens
MAPVHGDDSLSDSGSFVSSRARREKKSKKGRQEALERLKKAKAGEKYKYEVEDFTGVYEEVDEEQYSKLVQARQDDDWIVDDDGIGYVEDGREIFDDDLEDDALDADEKGKDGKARNKDKRNVKKLAVTKPNNIKSMFIACAGKKTADKAVDLSKDGLLGDILQDLNTETPQITPPPVMILKKKRSIGASPNPFSVHTATAVPSGKIASPVSRKEPPLTPVPLKRAEFAGDDVQVESTEEEQESGAMEFEDGDFDEPMEVEEVDLEPMAAKAWDKESEPAEEVKQEADSGKGTVSYLGSFLPDVSCWDIDQEGDSSFSVQEVQVDSSHLPLVKGADEEQVFHFYWLDAYEDQYNQPGVVFLFGKVWIESAETHVSCCVMVKNIERTLYFLPREMKIDLNTGKETGTPISMKDVYEEFDEKIATKYKIMKFKSKPVEKNYAFEIPDVPEKSEYLEVKYSAEMPQLPQDLKGETFSHVFGTNTSSLELFLMNRKIKGPCWLEVKKSTALNQPVSWCKVEAMALKPDLVNVIKDVSPPPLVVMAFSMKTMQNAKNHQNEIIAMAALVHHSFALDKAAPKPPFQSHFCVVSKPKDCIFPYAFKEVIEKKNVKVEVAATERTLLGFFLAKVHKIDPDIIVGHNIYGFELEVLLQRINVCKAPHWSKIGRLKRSNMPKLGGRSGFGERNATCGRMICDVEISAKELIRCKSYHLSELVQQILKTERVVIPMENIQNMYSESSQLLYLLEHTWKDAKFILQIMCELNVLPLALQITNIAGNIMSRTLMGGRSERNEFLLLHAFYENNYIVPDKQIFRKPQQKLGDEDEEIDGDTNKYKKGRKKGAYAGGLVLDPKVGFYDKFILLLDFNSLYPSIIQEFNICFTTVQRVASEAQKVTEDGEQEQIPELPDPSLEMGILPREIRKLVERRKQVKQLMKQQDLNPDLILQYDIRQKALKLTANSMYGCLGFSYSRFYAKPLAALVTYKGREILMHTKEMVQKMNLEVIYGDTDSIMINTNSTNLEEVFKLGNKVKSEVNKLYKLLEIDIDGVFKSLLLLKKKKYAALVVEPTSDGNYVTKQELKGLDIVRRDWCDLAKDTGNFVIGQILSDQSRDTIVENIQKRLIEIGENVLNGSVPVSQFEINKALTKDPQDYPDKKSLPHVHVALWINSQGGRKVKAGDTVSYVICQDGSNLTASQRAYAPEQLQKQDNLTIDTQYYLAQQIHPVVARICEPIDGIDAVLIATWLGLDPTQFRVHHYHKDEENDALLGGPAQLTDEEKYRDCERFKCPCPTCGTENIYDNVFDGSGTDMEPSLYRCSNIDCKASPLTFTVQLSNKLIMDIRRFIKKYYDGWLICEEPTCRNRTRHLPLQFSRTGPLCPACMKATLQPEYSDKSLYTQLCFYRYIFDAECALEKLTTDHEKDKLKKQFFTPKVLQDYRKLKNTAEQFLSRSGYSEVNLSKLFAGCAVKS

SEQ ID NO: 884228 - protein, 119 aa, Homo sapiens
MALKPDLVNVIKDVSPPPLVVMAFSMKTMQNAKNHQNEIIAMAALVHHSFALDKAAPKPPFQSHFCVVSKPKDCIFPYAFKEVIEKKVKCSLYEASVCLERERKGGWYGLVEKRCFIFY

SEQ ID NO: 884229 - protein, 1401 aa, Homo sapiens
MAKILLATFRNLIPVLNFVPADGIGYVEDGREIFDDDLEDDALDADEKGKDGKARNKDKRNVKKLAVTKPNNIKSMFIACAGKKTADKAVDLSKDGLLGDILQDLNTETPQITPPPVMILKKKRSIGASPNPFSVHTATAVPSGKIASPVSRKEPPLTPVPLKRAEFAGDDVQVESTEEEQESGAMEFEDGDFDEPMEVEEVDLEPMAAKAWDKESEPAEEVKQEADSGKGTVSYLGSFLPDVSCWDIDQEGDSSFSVQEVQVDSSHLPLVKGADEEQVFHFYWLDAYEDQYNQPGVVFLFGKVWIESAETHVSCCVMVKNIERTLYFLPREMKIDLNTGKETGTPISMKDVYEEFDEKIATKYKIMKFKSKPVEKNYAFEIPDVPEKSEYLEVKYSAEMPQLPQDLKGETFSHVFGTNTSSLELFLMNRKIKGPCWLEVKKSTALNQPVSWCKVEAMALKPDLVNVIKDVSPPPLVVMAFSMKTMQNAKNHQNEIIAMAALVHHSFALDKAAPKPPFQSHFCVVSKPKDCIFPYAFKEVIEKKNVKVEVAATERTLLGFFLAKVHKIDPDIIVGHNIYGFELEVLLQRINVCKAPHWSKIGRLKRSNMPKLGGRSGFGERNATCGRMICDVEISAKELIRCKSYHLSELVQQILKTERVVIPMENIQNMYSESSQLLYLLEHTWKDAKFILQIMCELNVLPLALQITNIAGNIMSRTLMGGRSERNEFLLLHAFYENNYIVPDKQIFRKPQQKLGDEDEEIDGDTNKYKKGRKKGAYAGGLVLDPKVGFYDKFILLLDFNSLYPSIIQEFNICFTTVQRVASEAQKVTEDGEQEQIPELPDPSLEMGILPREIRKLVERRKQVKQLMKQQDLNPDLILQYDIRQKALKLTANSMYGCLGFSYSRFYAKPLAALVTYKGREILMHTKEMVQKMNLEVIYGDTDSIMINTNSTNLEEVFKLGNKVKSEVNKLYKLLEIDIDGVFKSLLLLKKKKYAALVVEPTSDGNYVTKQELKGLDIVRRDWCDLAKDTGNFVIGQILSDQSRDTIVENIQKRLIEIGENVLNGSVPVSQFEINKALTKDPQDYPDKKSLPHVHVALWINSQGGRKVKAGDTVSYVICQDGSNLTASQRAYAPEQLQKQDNLTIDTQYYLAQQIHPVVARICEPIDGIDAVLIATWLGLDPTQFRVHHYHKDEENDALLGGPAQLTDEEKYRDCERFKCPCPTCGTENIYDNVFDGSGTDMEPSLYRCSNIDCKASPLTFTVQLSNKLIMDIRRFIKKYYDGWLICEEPTCRNRTRHLPLQFSRTGPLCPACMKATLQPEYSDKSLYTQLCFYRYIFDAECALEKLTTDHEKDKLKKQFFTPKVLQDYRKLKNTAEQFLSRSGYSEVNLSKLFAGCAVKS

SEQ ID NO: 884230 - protein, 619 aa, Homo sapiens
RGFLISGFYDKFILLLDFNSLYPSIIQEFNICFTTVQRVASEAQKVTEDGEQEQIPELPDPSLEMGILPREIRKLVERRKQVKQLMKQQDLNPDLILQYDIRQKALKLTANSMYGCLGFSYSRFYAKPLAALVTYKGREILMHTKEMVQKMNLEVIYGDTDSIMINTNSTNLEEVFKLGNKVKSEVNKLYKLLEIDIDGVFKSLLLLKKKKYAALVVEPTSDGNYVTKQELKGLDIVRRDWCDLAKDTGNFVIGQILSDQSRDTIVENIQKRLIEIGENVLNGSVPVSQFEINKALTKDPQDYPDKKSLPHVHVALWINSQGGRKVKAGDTVSYVICQDGSNLTASQRAYAPEQLQKQDNLTIDTQYYLAQQIHPVVARICEPIDGIDAVLIATWLGLDPTQFRVHHYHKDEENDALLGGPAQLTDEEKYRDCERFKCPCPTCGTENIYDNVFDGSGTDMEPSLYRCSNIDCKASPLTFTVQLSNKLIMDIRRFIKKYYDGWLICEEPTCRNRTRHLPLQFSRTGPLCPACMKATLQPEYSDKSLYTQLCFYRYIFDAECALEKLTTDHEKDKLKKQFFTPKVLQDYRKLKNTAEQFLSRSGYSEVNLSKLFAGCAVKS

SEQ ID NO: 884231 - protein, 1309 aa, Homo sapiens
MAPVHGDDSLSDSGSFVSSRARREKKSKKGRQEALERLKKAKAGEKYKYEVEDFTGVYEEVDEEQYSKLVQARQDDDWIVDDDGIGYVEDGREIFDDDLEDDALDADEKGKDGKARNKDKRNVKKLAVTKPNNIKSMFIACAGKKTADKAVDLSKDGLLGDILQDLNTETPQITPPPVMILKKKRSIGASPNPFSVHTATAVPSGKIASPVSRKEPPLTPVPLKRAEFAGDDVQVESTEEEQESGAMEFEDGDFDEPMEVEEVDLEPMAAKAWDKESEPAEEVKQEADSGKGTVSYLGSFLPDVSCWDIDQEGDSSFSVQEVQVDSSHLPLVKGADEEQVFHFYWLDAYEDQYNQPGVVFLFGKVWIESAETHVSCCVMVKNIERTLYFLPREMKIDLNTGKETGTPISMKDVYEEFDEKIATKYKIMKFKSKPVEKNYAFEIPDVPEKSEYLEVKYSAEMPQLPQDLKGETFSHVFGTNTSSLELFLMNRKIKGPCWLEVKKSTALNQPVSWCKVEAMALKPDLVNVIKDVSPPPLVVMAFSMKTMQNAKNHQNEIIAMAALVHHSFALDKAAPKPPFQSHFCVVSKPKDCIFPYAFKEVIEKKNVKVEVAATERTLLGFFLAKVHKIDPDIIVGHNIYGFELEVLLQRINVCKAPHWSKIGRLKRSNMPKLGGRSGFGERNATCGRMICDVEISAKELIRCKSYHLSELVQQILKTERVVIPMENIQNMYSESSQLLYLLEHTWKDAKFILQIMCELNVLPLALQITNIAGNIMSRTLMGGRSERNEFLLLHAFYENNYIVPDKQIFRKPQQKLGDEDEEIDGDTNKYKKGRKKGAYAGGLVLDPKVGFYDKFILLLDFNSLYPSIIQEFNICFTTVQRVASEAQKVTEDGEQEQIPELPDPSLEMGILPREIRKLVERRKQVKQLMKQQDLNPDLILQYDIRQKALKLTANSMYGCLGFSYSRFYAKPLAALVTYKGREILMHTKEMVQKMNLEVIYGDTDSIMINTNSTNLEEVFKLGNKVKSEVNKLYKLLEIDIDGVFKSLLLLKKKKYAALVVEPTSDGNYVTKQELKGLDIVRRDWCDLAKDTGNFVIGQILSDQSRDTIVENIQKRLIEIGENVLNGSVPVSQFEINKALTKDPQDYPDKKSLPHVHVALWINSQGGRKVKAGDTVSYVICQDGSNLTASQRAYAPEQLQKQDNLTIDTQYYLAQQIHPVVARICEPIDGIDAVLIATWLGLDPTQFRVHHYHKDEENDALLGGPAQLTDEEKYRDCERFKCPCPTCGTENIYDNVFDGSVSCFCLSFCE

SEQ ID NO: 884232 - protein, 425 aa, Homo sapiens
MATAEVLNIGKKLYEGKTKEVYELLDSPGKVLLQSKDQITAGNAARKNHLEGKAAISNKITSCIFQLLQEAGIKTAFTRKCGETAFIAPQCEMIPIEWVCRRIATGSFLKRNPGVKEGYKFYPPKVELFFKDDANNDPQWSEEQLIAAKFCFAGLLIGQTEVDIMSHATQAIFEILEKSWLPQNCTLVDMKIEFGVDVTTKEIVLADVIDNDSWRLWPSGDRSQQKDKQSYRDLKEVTPEGLQMVKKNFEWVAERVELLLKSESQCRVVVLMGSTSDLGHCEKIKKACGNFGIPCELRVTSAHKGPDETLRIKAEYEGDGIPTVFVAVAGRSNGLGPVMSGNTAYPVISCPPLTPDWGVQDVWSSLRLPSGLGCSTVLSPEGSAQFAAQIFGLSNHLVWSKLRASILNTWISLKQADKKIRECNL

SEQ ID NO: 884233 - protein, 128 aa, Homo sapiens
RWSLPLLLRLECSGALSAHCNLHLPGLNDSPASASQVAGITGAHHHTQLIFCNFSRQGFTVLARLVSHATQAIFEILEKSWLPQNCTLVDMKVQIKQVQIKQQDLKVKVIVERCFHKIVFENFVDMLF

SEQ ID NO: 884234 - protein, 425 aa, Homo sapiens; identical to SEQ ID NO: 884232

SEQ ID NO: 884235 - protein, 425 aa, Homo sapiens; identical to SEQ ID NO: 884232

SEQ ID NO: 884236 - protein, 425 aa, Homo sapiens; identical to SEQ ID NO: 884232

SEQ ID NO: 884237 - protein, 425 aa, Homo sapiens; identical to SEQ ID NO: 884232

SEQ ID NO: 884238 - protein, 410 aa, Homo sapiens
MATAEVLNIGKKLYEGKTKEVYELLDSPGKVLLQSKDQITAGNAARKNHLEGKAAISNKITSCIFQLLQEAGIKTAFTRKCGETAFIAPQCEMIPIEWVCRRIATGSFLKRNPGVKEGYKFYPPKVELFFKDDANNDPQWSEEQLIAAKFCFAGLLIGQTEVDIMSHATQAIFEILEKSWLPQNCTLVDMKIEFGVDVTTKEIVLADVIDNDSWRLWPSGDRSQQKDKQSYRDLKEVTPEGLQMVKKNFEWVAERVELLLKSESQCRVVVLMGSTSDLGHCEKIKKACGNFGIPCELRVTSAHKGPDETLRIKAEYEGDGIPTVFVAVAGRSNGLGPVMSGNTAYPVISCPPLTPDWGVQDVWSSLRLPSDGVGLSCPGWSAMAQSQLTAASASQVQAVLVPQPPEYLGL

SEQ ID NO: 884239 - protein, 425 aa, Homo sapiens; identical to SEQ ID NO: 884232

SEQ ID NO: 884240 - protein, 425 aa, Homo sapiens; identical to SEQ ID NO: 884232

SEQ ID NO: 884241 - protein, 425 aa, Homo sapiens; identical to SEQ ID NO: 884232

SEQ ID NO: 884242 - protein, 372 aa, Homo sapiens
MATAEVLNIGKKLYEGKTKEVYELLDSPGKVLLQSKDQITAGNAARKNHLEGKAAISNKITSCIFQLLQEAGIKTAFTRKCGETAFIAPQCEMIPIEWVCRRIATGSFLKRNPGVKEGYKFYPPKVELFFKDDANNDPQWSEEQLIAAKFCFAGLLIGQTEVDIMSHATQAIFEILEKSWLPQNCTLVDMKIEFGVDVTTKEIVLADVIDNDSWRLWPSGDRSQQKDKQSYRDLKEVTPEGLQMVKKNFEWVAERVELLLKSESQCRVVVLMGSTSDLGHCEKIKKACGNFGIPCELRVTSAHKGPDETLRIKAEYEGLGCSTVLSPEGSAQFAAQIFGLSNHLVWSKLRASILNTWISLKQADKKIRECNL

SEQ ID NO: 884243 - protein, 425 aa, Homo sapiens; identical to SEQ ID NO: 884232

SEQ ID NO: 884244 - protein, 425 aa, Homo sapiens; identical to SEQ ID NO: 884232

SEQ ID NO: 884245 - protein, 425 aa, Homo sapiens; identical to SEQ ID NO: 884232

SEQ ID NO: 884246 - protein, 425 aa, Homo sapiens; identical to SEQ ID NO: 884232

SEQ ID NO: 884247 - protein, 449 aa, Homo sapiens
DHPSFLESSASLPGAVAALSPLRIMATAEVLNIGKKLYEGKTKEVYELLDSPGKVLLQSKDQITAGNAARKNHLEGKAAISNKITSCIFQLLQEAGIKTAFTRKCGETAFIAPQCEMIPIEWVCRRIATGSFLKRNPGVKEGYKFYPPKVELFFKDDANNDPQWSEEQLIAAKFCFAGLLIGQTEVDIMSHATQAIFEILEKSWLPQNCTLVDMKIEFGVDVTTKEIVLADVIDNDSWRLWPSGDRSQQKDKQSYRDLKEVTPEGLQMVKKNFEWVAERVELLLKSESQCRVVVLMGSTSDLGHCEKIKKACGNFGIPCELRVTSAHKGPDETLRIKAEYEGDGIPTVFVAVAGRSNGLGPVMSGNTAYPVISCPPLTPDWGVQDVWSSLRLPSGLGCSTVLSPEGSAQFAAQIFGLSNHLVWSKLRASILNTWISLKQADKKIRECNL

SEQ ID NO: 884248 - protein, 449 aa, Homo sapiens
DAWVDPRSSASLPGAVAALSPLRIMATAEVLNIGKKLYEGKTKEVYELLDSPGKVLLQSKDQITAGNAARKNHLEGKAAISNKITSCIFQLLQEAGIKTAFTRKCGETAFIAPQCEMIPIEWVCRRIATGSFLKRNPGVKEGYKFYPPKVELFFKDDANNDPQWSEEQLIAAKFCFAGLLIGQTEVDIMSHATQAIFEILEKSWLPQNCTLVDMKIEFGVDVTTKEIVLADVIDNDSWRLWPSGDRSQQKDKQSYRDLKEVTPEGLQMVKKNFEWVAERVELLLKSESQCRVVVLMGSTSDLGHCEKIKKACGNFGIPCELRVTSAHKGPDETLRIKAEYEGDGIPTVFVAVAGRSNGLGPVMSGNTAYPVISCPPLTPDWGVQDVWSSLRLPSGLGCSTVLSPEGSAQFAAQIFGLSNHLVWSKLRASILNTWISLKQADKKIRECNL

SEQ ID NO: 884249 - protein, 442 aa, Homo sapiens
YCLGDGEKEQSRGEREMAKGWKVLNIGKKLYEGKTKEVYELLDSPGKVLLQSKDQITAGNAARKNHLEGKAAISNKITSCIFQLLQEAGIKTAFTRKCGETAFIAPQCEMIPIEWVCRRIATGSFLKRNPGVKEGYKFYPPKVELFFKDDANNDPQWSEEQLIAAKFCFAGLLIGQTEVDIMSHATQAIFEILEKSWLPQNCTLVDMKIEFGVDVTTKEIVLADVIDNDSWRLWPSGDRSQQKDKQSYRDLKEVTPEGLQMVKKNFEWVAERVELLLKSESQCRVVVLMGSTSDLGHCEKIKKACGNFGIPCELRVTSAHKGPDETLRIKAEYEGDGIPTVFVAVAGRSNGLGPVMSGNTAYPVISCPPLTPDWGVQDVWSSLRLPSGLGCSTVLSPEGSAQFAAQIFGLSNHLVWSKLRASILNTWISLKQADKKIRECNL

SEQ ID NO: 884250 - protein, 432 aa, Homo sapiens
MATAEVLNIGKKLYEGKTKEVYELLDSPGKVLLQSKDQITAGNAARKNHLEGKAAISNKITSCIFQLLQEAVTSYKSNRIKTAFTRKCGETAFIAPQCEMIPIEWVCRRIATGSFLKRNPGVKEGYKFYPPKVELFFKDDANNDPQWSEEQLIAAKFCFAGLLIGQTEVDIMSHATQAIFEILEKSWLPQNCTLVDMKIEFGVDVTTKEIVLADVIDNDSWRLWPSGDRSQQKDKQSYRDLKEVTPEGLQMVKKNFEWVAERVELLLKSESQCRVVVLMGSTSDLGHCEKIKKACGNFGIPCELRVTSAHKGPDETLRIKAEYEGDGIPTVFVAVAGRSNGLGPVMSGNTAYPVISCPPLTPDWGVQDVWSSLRLPSGLGCSTVLSPEGSAQFAAQIFGLSNHLVWSKLRASILNTWISLKQADKKIRECNL

SEQ ID NO: 884251 - protein, 408 aa, Homo sapiens
MATAEVLNIGKKLYEGKTKEVYELLDSPGKVLLQSKDQITAGNAARKNHLEGKAAISNKITSCIFQLLQEAGIKTAFTRKCGETAFIAPQCEMIPIEWVCRRIATGSFLKRNPGVKEGYKFYPPKVELFFKDDANNDPQWSEEQLIAASHATQAIFEILEKSWLPQNCTLVDMKIEFGVDVTTKEIVLADVIDNDSWRLWPSGDRSQQKDKQSYRDLKEVTPEGLQMVKKNFEWVAERVELLLKSESQCRVVVLMGSTSDLGHCEKIKKACGNFGIPCELRVTSAHKGPDETLRIKAEYEGDGIPTVFVAVAGRSNGLGPVMSGNTAYPVISCPPLTPDWGVQDVWSSLRLPSGLGCSTVLSPEGSAQFAAQIFGLSNHLVWSKLRASILNTWISLKQADKKIRECNL

SEQ ID NO: 884252 - protein, 336 aa, Homo sapiens
MATAEVLNIGKKLYEGKTKEVYELLDSPGKVLLQSKDQITAGNAARKNHLEGKAAISNKITSCIFQLLQEAGIKTAFTRKCGETAFIAPQCEMIPIEWVCRRIATGSFLKRNPGVKEGYKFYPPKVELFFKDDANNDPQWSEEQLIAAKFCFAGLLIGQTEVDIMSHATQAIFEILEKSWLPQNCTLVDMKIEFGVDVTTKEIVLADVIDNDSWRLWPSGDRSQQKDKQSYRDLKEVTPEGLQMVKKNFEWVAERVELLLKSESQCRVVVLMGSTSDLGHCEKIKKACGNFGIPCELRVTSAHKGPDETLRIKAEYEGDGIPTVFVARQTISKHRI

SEQ ID NO: 884253 - protein, 408 aa, Homo sapiens; identical to SEQ ID NO: 884251

SEQ ID NO: 884254 - protein, 333 aa, Homo sapiens
MATAEVLNIGKKLYEGKTKEVYELLDSPGKVLLQSKDQITAGNAARKNHLEGKAAISNKITSCIFQLLQEAGIKTAFTRKCGETAFIAPQCEMIPIEWVCRRIATGSFLKRNPGVKEGYKFYPPKVELFFKDDANNDPQWSEEQLIAAKFCFAGLLIGQTEVDIMSHATQAIFEILEKSWLPQNCTLVDMKIEFGVDVTTKEIVLADVIDNDSWRLWPSGDRSQQKDKQSYRDLKEVTPEGLQMVKKNFEWVAERVELLLKSESQCRVVVLMGSTSDLGHCEKIKKACGNFGIPCELRVTSAHKGPDETLKTLSQKGKKKIADVTHEGNSFSS

SEQ ID NO: 884255 - protein, 298 aa, Homo sapiens
LSLVVKDWLMITMHRKTFRRKGECFVDHFGFLFCVWQSSHATQAIFEILEKSWLPQNCTLVDMKIEFGVDVTTKEIVLADVIDNDSWRLWPSGDRSQQKDKQSYRDLKEVTPEGLQMVKKNFEWVAERVELLLKSESQCRVVVLMGSTSDLGHCEKIKKACGNFGIPCELRVTSAHKGPDETLRIKAEYEGDGIPTVFVAVAGRSNGLGPVMSGNTAYPVISCPPLTPDWGVQDVWSSLRLPSGLGCSTVLSPEGSAQFAAQIFGLSNHLVWSKLRASILNTWISLKQADKKIRECNL

SEQ ID NO: 884256 - protein, 285 aa, Homo sapiens
MATAEVLNIGKKLYEGKTKEVYELLDSPGKVLLQSKDQITAGNAARKNHLEGKAAISNKITSCIFQLLQEAGIKTAFTRKCGETAFIAPQCEMIPIEWVCRRIATGSFLKRNPGVKEGYKFYPPKVELFFKDDANNDPQWSEEQLIAAKFCFAGLLIGQTEVDIMSHATQAIFEILEKSWLPQNCTLVDMKIEFGVDVTTKEIVLADVIDNDSWRLWPSGDRSQQKDKQSYRDLKEVTPEGLQMVKKNFEWVAERVELLLKSESQCRVVVLMGSTSDLGHCEKNC

SEQ ID NO: 884257 - protein, 229 aa, Homo sapiens
RGSPTSPTITDVIDNDSWRLWPSGDRSQQKDKQSYRDLKEVTPEGLQMVKKNFEWVAERVELLLKSESQCRVVVLMGSTSDLGHCEKIKKACGNFGIPCELRVTSAHKGPDETLRIKAEYEGDGIPTVFVAVAGRSNGLGPVMSGNTAYPVISCPPLTPDWGVQDVWSSLRLPSGLGCSTVLSPEGSAQFAAQIFGLSNHLVWSKLRASILNTWISLKQADKKIRECNL

SEQ ID NO: 884258 - protein, 182 aa, Homo sapiens [sequence omitted]

SEQ ID NO: 884259 - protein, 261 aa, Homo sapiens
MATAEVLNIGKKLYEGKTKEVYELLDSPGKVLLQSKDQITAGNAARKNHLEGKAAISNKITSCIFQLLQEAGIKTAFTRKCGETAFIAPQCEMIPIEWVCRRIATGSFLKRNPGVKEGYKFYPPKVELFFKDDANNDPQWSEEQLIAAKFCFAGLLIGQTEVDIMSHATQAIFEILEKSWLPQNCTLVDMKIEFGVDVTTKEIVLADVIDNDSWRLWPSGDRSQQKDKQSYRDLKEVTPEGLQMVKKNFEWVAERVEVNLL

SEQ ID NO: 884260 - protein, 259 aa, Homo sapiens
MATAEVLNIGKKLYEGKTKEVYELLDSPGKVLLQSKDQITAGNAARKNHLEGKAAISNKITSCIFQLLQEAGIKTAFTRKCGETAFIAPQCEMIPIEWVCRRIATGSFLKRNPGVKEGYKFYPPKVELFFKDDANNDPQWSEEQLIAAKFCFAGLLIGQTEVDIMSHATQAIFEILEKSWLPQNCTLVDMKIEFGVDVTTKEIVLADVIDNDSWRLWPSGDRSQQKDKQSYRDLKEVTPGRELIFLVILDCHTLVPLVL

SEQ ID NO: 884261 - protein, 254 aa, Homo sapiens
MATAEVLNIGKKLYEGKTKEVYELLDSPGKVLLQSKDQITAGNAARKNHLEGKAAISNKITSCIFQLLQEAGIKTAFTRKCGETAFIAPQCEMIPIEWVCRRIATGSFLKRNPGVKEGYKFYPPKVELFFKDDANNDPQWSEEQLIAAKFCFAGLLIGQTEVDIMSHATQAIFEILEKSWLPQNCTLVDMKIEFGVDVTTKEIVLADVIDNDSWRLWPSGDRSQQKDKQVDNASGFFILFEIKLRLASRDDRHL

SEQ ID NO: 884262 - protein, 254 aa, Homo sapiens; identical to SEQ ID NO: 884261

SEQ ID NO: 884263 - protein, 116 aa, Homo sapiens
AAARDLEREGQIQHYPDLDSPHSQSTLFQVDCPRTSNNKLSFAPQTSLKIYMLLTLSVENRTHKTYQQISLVLGFSRSLSMVYRLRIDEVAGHSGSHLRSQHFGRLKQADHLRSGV

SEQ ID NO: 884264 - protein, 152 aa, Homo sapiens
MATAEVLNIGKKLYEGKTKEVYELLDSPGKVLLQSKDQITAGNAARKNHLEGKAAISNKITSCIFQLLQEAGIKTAFTRKCGETAFIAPQCEMIPIEWVCRRIATGSFLKRNPGVKEGYKFYPPKVELFFKHCTPTWAAEQDSVSKGEKKNC

SEQ ID NO: 884265 - protein, 110 aa, Homo sapiens
MATAEVLNIGKKLYEGKTKEVYELLDSPGKVLLQSKDQITAGNAARKNHLEGKAAISNKITSCIFQLLQEAGKQLPQSLFSHLLWEACRCLSCEVGINMNNLFADVSKAK

SEQ ID NO: 884266 - protein, 254 aa, Homo sapiens; identical to SEQ ID NO: 884261

SEQ ID NO: 884267 - protein, 171 aa, Homo sapiens
MATAEVLNIGKKLYEGKTKEVYELLDSPGKVLLQSKDQITAGNAARKNHLEGKAAISNKITSCIFQLLQEAGIKTAFTRKCGETAFIAPQCEMIPIEWVCRRIATGSFLKRNPGVKEGYKFYPPKVELFFKDDANNDPQWSEEQLIAAKFCFAGLLIGQTEVDIISPVFQI

SEQ ID NO: 884268 - protein, 120 aa, Homo sapiens
DAWVDPRSSASLPGAVAALSPLRIMATAEVLNIGKKLYEGKTKEVYELLDSPGKVLLQSKDQITAGNAARKNHLEGKAAISNKITSCIFQLLQEAGTTALNQTIRVSDDLIEAVTPRSGH

SEQ ID NO: 884269 - protein, 249 aa, Homo sapiens
HSAHVCGCALALRVKMAERGYSFSLTTFSPSGKLVQIEYALAAVAGGAPSVGIKAANGVVLATEKKQKSILYDERSVHKVEPITKHIGLVYSGMGPDYRVLVHRARKLAQQYYLVYQEPIPTAQLVQRVASVMQEYTQSGGVRPFGVSLLICGWNEGRPYLFQSDPSGAYFAWKATAMGKNYVNGKTFLEKRYNEDLELEDAIHTAILTLKESFEGQMTEDNIEVGICNEAGFRRLTPTEVKDYLAAIA

SEQ ID NO: 884270 - protein, 241 aa, Homo sapiens
RLGARPGWWERGYSFPLTTFSPSGKLVQIEYALAAVAGGAPSVGIKAANGVVLATEKKQKSILYDERSVHKVEPITKHIGLVYSGMGPDYRVLVHRARKLAQQYYLVYQEPIPTAQLVQRVASVMQEYTQSGGVRPFGVSLLICGWNEGRPYLFQSDPSGAYFAWKATAMGKNYVNGKTFLEKRYNEDLELEDAIHTAILTLKESFEGQMTEDNIEVGICNEAGFRRLTPTEVKDYLAAIA

SEQ ID NO: 884271 - protein, 249 aa, Homo sapiens; identical to SEQ ID NO: 884269

SEQ ID NO: 884272 - protein, 241 aa, Homo sapiens; identical to SEQ ID NO: 884270

SEQ ID NO: 884273 - protein, 242 aa, Homo sapiens
RTRGSTHASRRGGTAYSLTTFSPSGKLVQIEYALAAVAGGAPSVGIKAANGVVLATEKKQKSILYDERSVHKVEPITKHIGLVYSGMGPDYRVLVHRARKLAQQYYLVYQEPIPTAQLVQRVASVMQEYTQSGGVRPFGVSLLICGWNEGRPYLFQSDPSGAYFAWKATAMGKNYVNGKTFLEKRYNEDLELEDAIHTAILTLKESFEGQMTEDNIEVGICNEAGFRRLTPTEVKDYLAAIA

SEQ ID NO: 884274 - protein, 249 aa, Homo sapiens; identical to SEQ ID NO: 884269

SEQ ID NO: 884275 - protein, 249 aa, Homo sapiens; identical to SEQ ID NO: 884269

SEQ ID NO: 884276 - protein, 249 aa, Homo sapiens; identical to SEQ ID NO: 884269

SEQ ID NO: 884277 - protein, 198 aa, Homo sapiens
HSAHVCGCALALRVKMAERGYSFSLTTFSPSGKLVQIEYALAAVAGGAPSVGIKAANGVVLATEKKQKSILYDERSVHKVEPITKHIGLVYSGMGPDYRVLVHRARKLAQQYYLVYQEPIPTAQLVQRVASVMQEYTQSGGVRPFGVSLLICGWNEGRPYLFQSDPSGAYFAWKATAMGKNYVNGKTFLEKRKALKGK

SEQ ID NO: 884278 - protein, 193 aa, Homo sapiens
HSAHVCGCALALRVKMAERGYSFSLTTFSPSGKLVQIEYALAAVAGGAPSVGIKAANGVVLATEKKQKSILYDERSVHKVEPITKHIGLVYSGMGPDYRVLVHRARKLAQQYYLVYQEPIPTAQLVQRVASVMQEYTQSGGVRPFGVSLLICGWNEGRPYLFQSDPSGAYFAWKATAMGKNYVNGKTFLEKRY

SEQ ID NO: 884279 - protein, 249 aa, Homo sapiens; identical to SEQ ID NO: 884269

SEQ ID NO: 884280 - protein, 249 aa, Homo sapiens; identical to SEQ ID NO: 884269

SEQ ID NO: 884281 - protein, 264 aa, Homo sapiens
HDETALLVATYEFQWRNGICPEFGHTAGVKMAERGYSFSLTTFSPSGKLVQIEYALAAVAGGAPSVGIKAANGVVLATEKKQKSILYDERSVHKVEPITKHIGLVYSGMGPDYRVLVHRARKLAQQYYLVYQEPIPTAQLVQRVASVMQEYTQSGGVRPFGVSLLICGWNEGRPYLFQSDPSGAYFAWKATAMGKNYVNGKTFLEKRYNEDLELEDAIHTAILTLKESFEGQMTEDNIEVGICNEAGFRRLTPTEVKDYLAAIA

SEQ ID NO: 884282 - protein, 156 aa, Homo sapiens
MGPDYRVLVHRARKLAQQYYLVYQEPIPTAQLVQRVASVMQEYTQSGGVRPFGVSLLICGWNEGRPYLFQSDPSGAYFAWKATAMGKNYVNGKTFLEKRYNEDLELEDAIHTAILTLKESFEGQMTEDNIEVGICNEAGFRRLTPTEVKDYLAAIA

SEQ ID NO: 884283 - protein, 249 aa, Homo sapiens; identical to SEQ ID NO: 884269

SEQ ID NO: 884284 - protein, 241 aa, Homo sapiens
HDETALLVATYEFQWRNGICPEFGHTAGVKMAERGYSFSLTTFSPSGKLVQIEYALAAVAGGAPSVGIKAANGVVLATEKKQKSILYDERSVHKVEPITKHIGLVYSGMGPDYRAQLVQRVASVMQEYTQSGGVRPFGVSLLICGWNEGRPYLFQSDPSGAYFAWKATAMGKNYVNGKTFLEKRYNEDLELEDAIHTAILTLKESFEGQMTEDNIEVGICNEAGFRRLTPTEVKDYLAAIA

SEQ ID NO: 884285 - protein, 156 aa, Homo sapiens; identical to SEQ ID NO: 884282

SEQ ID NO: 884286 - protein, 117 aa, Homo sapiens
MQEYTQSGGVRPFGVSLLICGWNEGRPYLFQSDPSGAYFAWKATAMGKNYVNGKTFLEKRYNEDLELEDAIHTAILTLKESFEGQMTEDNIEVGICNEAGFRRLTPTEVKDYLAAIA

SEQ ID NO: 884287 - protein, 82 aa, Homo sapiens
FPLAVNLLRDVPTDAPPPEVGSLSREVPAVRVFPARTVFNPRPLPFALLNPAPFIGAPAFVQEKPVVSRYNLGAPPRGSIFF

SEQ ID NO: 884288 - protein, 113 aa, Homo sapiens
GGSWVPRPLCVCLGPLFLGCRLFVARQGFLLSSYPSAFCCPAAVVLTPRRFFFYLFLLWGTLFLVVECLVVSSTVVVPRGVFVVVRPPPLLFVFVVVLFFFFFFLFFFFFFFL

SEQ ID NO: 884289 - protein, 113 aa, Homo sapiens; identical to SEQ ID NO: 884288

SEQ ID NO: 884290 - protein, 964 aa, Homo sapiens
MDEQSVESIAEVFRCFICMEKLRDARLCPHCSKLCCFSCIRRWLTEQRAQCPHCRAPLQLRELVNCRWAEEVTQQLDTLQLCSLTKHEENEKDKCENHHEKLSVFCWTCKKCICHQCALWGGMHGGHTFKPLAEIYEQHVTKVNEEVAKLRRRLMELISLVQEVERNVEAVRNAKDERVREIRNAVEMMIARLDTQLKNKLITLMGQKTSLTQETELLESLLQEVEHQLRSCSKSELISKSSEILMMFQQVHRKPMASFVTTPVPPDFTSELVPSYDSATFVLENFSTLRQRADPVYSPPLQVSGLCWRLKVYPDGNGVVRGYYLSVFLELSAGLPETSKYEYRVEMVHQSCNDPTKNIIREFASDFEVGECWGYNRFFRLDLLANEGYLNPQNDTVILRFQVRSPTFFQKSRDQHWYITQLEAAQTSYIQQINNLKERLTIELSRTQKSRDLSPPDNHLSPQNDDALETRAKKSACSDMLLEGGPTTASVREAKEDEEDEEKIQNEDYHHELSDGDLDLDLVYEDEVNQLDGSSSSASSTATSNTEENDIDEETMSGENDVEYNNMELEEGELMEDAAAAGPAGSSHGYVGSSSRISRRTHLCSAATSSLLDIDPLILIHLLDLKDRSSIENLWGLQPRPPASLLQPTASYSRKDKDQRKQQAMWRVPSDLKMLKRLKTQMAEVRCMKTDVKNTLSEIKSSSAASGDMQTSLFSADQAALAACGTENSGRLQDLGMELLAKSSVANCYIRNSTNKKSNSPKPARSSVAGSLSLRRAVDPGENSRSKGDCQTLSEGSPGSSQSGSRHSSPRALIHGSIGDILPKTEDRQCKALDSDAVVVAVFSGLPAVEKRRKMVTLGANAKGGHLEGLQMTDLENNSETGELQPVLPEGASAAPEEGMSSDSDIECDTENEEQEEHTSVGGFHDSFMVMTQPPDEDTHSSFPDGEQIGPEDLSFNTDENSGR

SEQ ID NO: 884291 - protein, 130 aa, Homo sapiens [sequence omitted]

SEQ ID NO: 884292 - protein, 925 aa, Homo sapiens
MDEQSVESIAEVFRCFICMEKLRDARLCPHCSKLCCFSCIRRWLTEQRAQCPHCRAPLQLRELVNCRWAEEVTQQLDTLQLCSLTKHEENEKDKCENHHEKLSVFCWTCKKCICHQCALWGGMHGGHTFKPLAEIYEQHVTKVNEEVAKLRRRLMELISLVQEVERNVEAVRNAKDERVREIRNAVEMMIARLDTQLKNKLITLMGQKTSLTQETELLESLLQEVEHQLRSCSKSELISKSSEILMMFQQVHRKPMASFVTTPVPPDFTSELVPSYDSATFVLENFSTLRQRADPVYSPPLQVSGLCWRLKVYPDGNGVVRGYYLSVFLELSAGLPETSKYEYRVEMVHQSCNDPTKNIIREFASDFEVGECWGYNRFFRLDLLANEGYLNPQNDTVILRFQVRSPTFFQKSRDQHWYITQLEAAQTSYIQQINNLKERLTIELSRTQKSRDLSPPDNHLSPQNDDALETRAKKSACSDMLLEGGPTTASVREAKEDEEDEEKIQNEDYHHELSDGDLDLDLVYEDEVNQLDGSSSSASSTATSNTEENDIDEETMSGENDVEYNNMELEEGELMEDAAAAGPAGSSHGYVGSSSRISRRTHLCSAATSSLLDIDPLILIHLLDLKDRSSIENLWGLQPRPPASLLQPTASYSRKDKDQRKQQAMWRVPSDLKMLKRLKTQMAEVRCMKTDVKNTLSEIKSSSAASGDMQTSLFSADQAALAACGTENSGRLQDLGMELLAKSSVANCYIRNSTNKKSNSPKPARSSVAGSLSLRRAVDPGENSRSKGDCQTLSEGSPGSSQSGSRHSSPRALIHGSIGDILPKTEDRQCKALDSDAVVVAVFSGLPAVEKRRKMVTLGANAKGGHLEGLQMTDLENNSETGELQPVLPEGASAAPEEDTHSSFPDGEQIGPEDLSFNTDENSGR

SEQ ID NO: 884293 - protein, 416 aa, Homo sapiens
ISLLLRIQSGENDVEYNNMELEEGELMEDAAAAGPAGSSHGYVGSSSRISRRTHLCSAATSSLLDIDPLILIHLLDLKDRSSIENLWGLQPRPPASLLQPTASYSRKDKDQRKQQAMWRVPSDLKMLKRLKTQMAEVRCMKTDVKNTLSEIKSSSAASGDMQTSLFSADQAALAACGTENSGRLQDLGMELLAKSSVANCYIRNSTNKKSNSPKPARSSVAGSLSLRRAVDPGENSRSKGDCQTLSEGSPGSSQSGSRHSSPRALIHGSIGDILPKTEDRQCKALDSDAVVVAVFSGLPAVEKRRKMVTLGANAKGGHLEGLQMTDLENNSETGELQPVLPEGASAAPEEGMSSDSDIECDTENEEQEEHTSVGGFHDSFMVMTQPPDEDTHSSFPDGEQIGPEDLSFNTDENSGR

SEQ ID NO: 884294 - protein, 964 aa, Homo sapiens; identical to SEQ ID NO: 884290

SEQ ID NO: 884295 - protein, 973 aa, Homo sapiens
MDEQSVESIAEVFRCFICMEKLRDARLCPHCSKLCCFSCIRRWLTEQRAQCPHCRAPLQLRELVNCRWAEEVTQQLDTLQLCSLTKHEENEKDKCENHHEKLSVFCWTCKKCICHQCALWGGMHGGHTFKPLAEIYEQHVTKVNEEVAKLRRRLMELISLVQEVERNVEAVRNAKDERVREIRNAVEMMIARLDTQLKNKLITLMGQKTSLTQETELLESLLQEVEHQLRSCSKSELISKSSEILMMFQQVHRKPMASFVTTPVPPDFTSELVPSYDSATFVLENFSTLRQRADPVYSPPLQVSGLCWRLKVYPDGNGVVRGYYLSVFLELSAGLPETSKYEYRVEMVHQSCNDPTKNIIREFASDFEVGECWGYNRFFRLDLLANEGYLNPQNDTVILRFQVRSPTFFQKSRDQHWYITQLEAAQTSYIQQINNLKERLTIELSRTQKSRDLSPPDNHLSPQNDDALETRAKKSACSDMLLEGGPTTASVREAKEDEEDEEKIQNEDYHHELSDGDLDLDLVYEDEVNQLDGSSSSASSTATSNTEENDIDEETMSGENDVEYNNMELEEGELMEDAAAAGPAGSSHGYVGSSSRISRRTHLCSAATSSLLDIDPLILIHLLDLKDRSSIENLWGLQPRPPASLLQPTASYSRKDKDQRKQQAMWRVPSDLKMLKRLKTQMAEVRCMKTDVKNTLSEIKSSSAASGDMQTSLFSADQAALAACGTENSGRLQDLGMELLAKSSVANCYIRNSTNKKSNSPKPARSSVAGSLSLRRAVDPGENSRSKGDCQTLSEGSPGSSQSGSRHSSPRALIHGSIGDILPKTEDRQCKALDSDAVVVAVFSGLPAVEKRRKMVTLGANAKGGHLEGLQMTDLENNSETGELQPVLPEGASAAPEEETCSPSFLPGMSSDSDIECDTENEEQEEHTSVGGFHDSFMVMTQPPDEDTHSSFPDGEQIGPEDLSFNTDENSGR

SEQ ID NO: 884296 - protein, 287 aa, Homo sapiens
MDEQSVESIAEVFRCFICMEKLRDARLCPHCSKLCCFSCIRRWLTEQRAQCPHCRAPLQLRELVNCRWAEEVTQQLDTLQLCSLTKHEENEKDKCENHHEKLSVFCWTCKKCICHQCALWGGMHGGHTFKPLAEIYEQHVTKVNEEVAKLRRRLMELISLVQEVERNVEAVRNAKDERVREIRNAVEMMIARLDTQLKNKLITLMGQKTSLTQETELLESLLQEVEHQLRSCSKSELISKSSEILMMFQQVHRKPMASFVTTPVPPDFTSELVPSYDSATFVLENFR

SEQ ID NO: 884297 - protein, 103 aa, Homo sapiens
MDEQSVESIAEVFRCFICMEKLRDARLCPHCSKLCCFSCIRRWLTEQRAQCPHCRAPLQLRELVNCRWAEEVTQQLDTLQLCSLTKHEENEKDKYVLNFFVQY

SEQ ID NO: 884298 - protein, 930 aa, Homo sapiens
MDEQSVERWLTEQRAQCPHCRAPLQLRELVNCRWAEEVTQQLDTLQLCSLTKHEENEKDKCENHHEKLSVFCWTCKKCICHQCALWGGMHGGHTFKPLAEIYEQHVTKVNEEVAKLRRRLMELISLVQEVERNVEAVRNAKDERVREIRNAVEMMIARLDTQLKNKLITLMGQKTSLTQETELLESLLQEVEHQLRSCSKSELISKSSEILMMFQQVHRKPMASFVTTPVPPDFTSELVPSYDSATFVLENFSTLRQRADPVYSPPLQVSGLCWRLKVYPDGNGVVRGYYLSVFLELSAGLPETSKYEYRVEMVHQSCNDPTKNIIREFASDFEVGECWGYNRFFRLDLLANEGYLNPQNDTVILRFQVRSPTFFQKSRDQHWYITQLEAAQTSYIQQINNLKERLTIELSRTQKSRDLSPPDNHLSPQNDDALETRAKKSACSDMLLEGGPTTASVREAKEDEEDEEKIQNEDYHHELSDGDLDLDLVYEDEVNQLDGSSSSASSTATSNTEENDIDEETMSGENDVEYNNMELEEGELMEDAAAAGPAGSSHGYVGSSSRISRRTHLCSAATSSLLDIDPLILIHLLDLKDRSSIENLWGLQPRPPASLLQPTASYSRKDKDQRKQQAMWRVPSDLKMLKRLKTQMAEVRCMKTDVKNTLSEIKSSSAASGDMQTSLFSADQAALAACGTENSGRLQDLGMELLAKSSVANCYIRNSTNKKSNSPKPARSSVAGSLSLRRAVDPGENSRSKGDCQTLSEGSPGSSQSGSRHSSPRALIHGSIGDILPKTEDRQCKALDSDAVVVAVFSGLPAVEKRRKMVTLGANAKGGHLEGLQMTDLENNSETGELQPVLPEGASAAPEEGMSSDSDIECDTENEEQEEHTSVGGFHDSFMVMTQPPDEDTHSSFPDGEQIGPEDLSFNTDENSGR

SEQ ID NO: 884299 - protein, 973 aa, Homo sapiens; identical to SEQ ID NO: 884295

SEQ ID NO: 884300 - protein, 964 aa, Homo sapiens; identical to SEQ ID NO: 884290

SEQ ID NO: 884301 - protein, 340 aa, Homo sapiens
MDEQSVESIAEVFRCFICMEKLRDARLCPHCSKLCCFSCIRRWLTEQRAQCPHCRAPLQLRELVNCRWAEEVTQQLDTLQLCSLTKHEENEKDKCENHHEKLSVFCWTCKKCICHQCALWGGMHGGHTFKPLAEIYEQHVTKVNEEVAKLRRRLMELISLVQEVERNVEAVRNAKDERVREIRNAVEMMIARLDTQLKNKLITLMGQKTSLTQETELLESLLQEVEHQGASCFWKKWCQGRIYTLRSCSKSELISKSSEILMMFQQVHRKPMASFVTTPVPPDFTSELVPSYDSATFVLENFSTLRQRADPVYSPPLQVSGLCWRLKVYPDGNGVVRACS

SEQ ID NO: 884302 - protein, 76 aa, Homo sapiens
RTQKSRDLSPPDNHLSPQNDDALETRAKKSACSDMLLEGGPTTASVREAKEDEEDEEKIQNEDYHVIMRPVLDFCV

SEQ ID NO: 884303 - protein, 120 aa, Homo sapiens
FHLPSRDPGHTGGPQHPAHPEGPQRHPCHAPCCSASHHRPQRHSQSCCGDPAVTLTPPEILGQSSFPQLQRGGRLLKDSPDDMFRRWGLQLPLSCSCVSTSLMPVGWAATSWAALPTKCT

SEQ ID NO: 884304 - protein, 350 aa, Homo sapiens
MATTAAPAGGARNGAGPEWGGFEENIQGGGSAVIDMENMDDTSGSSFEDMGELHQRLREEEVDADAADAAAAEEEDGEFLGMKGFKGQLSRQVADQMWQAGKRQASRAFSLYANIDILRPYFDVEPAQVRSRLLESMIPIKMVNFPQKIAGELYGPLMLVFTLVAILLHGMKTSDTIIREGTLMGTAIGTCFGYWLGVSSFIYFLAYLCNAQITMLQMLALLGYGLFGHCIVLFITYNIHLHALFYLFWLLVGGLSTLRMVAVLVSRTVGPTQRLLLCGTLAALHMLFLLYLHFAYHKVVEGILDTLEGPNIPPIQRVPRDIPAMLPAARLPTTVLNATAKAVAVTLQSH

SEQ ID NO: 884305 - protein, 350 aa, Homo sapiens; identical to SEQ ID NO: 884304

SEQ ID NO: 884306 - protein, 350 aa, Homo sapiens; identical to SEQ ID NO: 884304

SEQ ID NO: 884307 - protein, 315 aa, Homo sapiens
MENMDDTSGSSFEDMGELHQRLREEEVDADAADAAAAEEEDGEFLGMKGFKGQLSRQVADQMWQAGKRQASRAFSLYANIDILRPYFDVEPAQVRSRLLESMIPIKMVNFPQKIAGELYGPLMLVFTLVAILLHGMKTSDTIIREGTLMGTAIGTCFGYWLGVSSFIYFLAYLCNAQITMLQMLALLGYGLFGHCIVLFITYNIHLHALFYLFWLLVGGLSTLRMVAVLVSRTVGPTQRLLLCGTLAALHMLFLLYLHFAYHKVVEGILDTLEGPNIPPIQRVPRDIPAMLPAARLPTTVLNATAKAVAVTLQSH

SEQ ID NO: 884308 - protein, 315 aa, Homo sapiens; identical to SEQ ID NO: 884307

SEQ ID NO: 884309 - protein, 290 aa, Homo sapiens
MATTAAPAGGARNGAGPEWGGFEENIQGGGSAVIDMENMDDTSGSSFEDMGELHQRLREEEVDADAADAAAAEEEDGEFLGMKGFKGQLSRQVADQMWQAGKRQASRAFSLYANIDILRPYFDVEPAQVRSRLLESMIPIKMVNFPQKIAGELYGPLMLVFTLVAILLHGMKTSDTIIREGTLMGTAIGTCFGYWLGVSSFIYFLAYLCNAQITMLQMLALLGMALGHCLSCHHYKFTQPLTFVGGVALAVRGSTGPRGLDWGQVRSVAQGGGGASGDGAPTANCKRGPR

SEQ ID NO: 884310 - protein, 403 aa, Homo sapiens
MATTAAPAGGARNGAGPEWGGFEENIQGGGSAVIDMENMDDTSGSSFEDMGELHQRLREEEVDADAADAAAAEEEDGEFLGMKGFKGQLSRQVADQMWQAGKRQASRAFSLYANIDILRPYFDVEPAQVRSRLLESMIPIKMVNFPQKIAGELYGPLMLVFTLVAILLHGMKTSDTIIRKQDRQLWGGGCTRLKAASGYNGGVRQEQPLRKALGEAEIRGLLGLNRAFTPQREGTLMGTAIGTCFGYWLGVSSFIYFLAYLCNAQITMLQMLALLGYGLFGHCIVLFITYNIHLHALFYLFWLLVGGLSTLRMVAVLVSRTVGPTQRLLLCGTLAALHMLFLLYLHFAYHKVVEGILDTLEGPNIPPIQRVPRDIPAMLPAARLPTTVLNATAKAVAVTLQSH

SEQ ID NO: 884311 - protein, 317 aa, Homo sapiens
MATTAAPAGGARNGAGPEWGGFEENIQGGGSAVIDMENMDDTSGSSFEDMGELHQRLREEEVDADAADAAAAEEEDGEFLGMKGFKGQLSRQVADQMWQAGKRQASRAFSLYANIDILRPYFDVEPAQVRSRLLESMIPIKMVNFPQKIAGELYGPLMLVFTLVAILLHGMKTSDTIIQITMLQMLALLGYGLFGHCIVLFITYNIHLHALFYLFWLLVGGLSTLRMVAVLVSRTVGPTQRLLLCGTLAALHMLFLLYLHFAYHKVVEGILDTLEGPNIPPIQRVPRDIPAMLPAARLPTTVLNATAKAVAVTLQSH

SEQ ID NO: 884312 - protein, 468 aa, Homo sapiens
MATTAAPAGGARNGAGPEWGGFEENIQGGGSAVIDMENMDDTSGSSFEDMGELHQRLREEEVDADAADAAAAEEEDGEFLGMKGFKGQLSRQVADQMWQAGKRQASRAFSLYANIDILRPYFDVEPAQVRSRLLESMIPIKMVNFPQKIAGELYGPLMLVFTLVAILLHGMKTSDTIIRKQDRQLWGGGCTRLKAASGYNGGVRQEQPLRKALGEAEIRGLLGLNRAFTPQREGTLMGTAIGTCFGYWLGVSSFIYFLAYLCNAQITMLQMLALLVRSQVWWARVMLKRVARPWSASVLGPQSLEWEEEANGPCVSQGPHEGPEKQPNLNDFPLHHPPSQGYGLFGHCIVLFITYNIHLHALFYLFWLLVGGLSTLRMVAVLVSRTVGPTQRLLLCGTLAALHMLFLLYLHFAYHKVVEGILDTLEGPNIPPIQRVPRDIPAMLPAARLPTTVLNATAKAVAVTLQSH

SEQ ID NO: 884313 - protein, 360 aa, Homo sapiens
MENMDDTSGSSFEDMGELHQRLREEEVDADAADAAAAEEEDGEFLGMKGFKGQLSRQVADQMWQAGKRQASRAFSLYANIDILRPYFDVEPAQVRSRLLESMIPIKMVNFPQVNRGWHVWRAGGSTRAEGGTTRQILGSHKQMSCCTLSLNELVYGQKIAGELYGPLMLVFTLVAILLHGMKTSDTIIREGTLMGTAIGTCFGYWLGVSSFIYFLAYLCNAQITMLQMLALLGYGLFGHCIVLFITYNIHLHALFYLFWLLVGGLSTLRMVAVLVSRTVGPTQRLLLCGTLAALHMLFLLYLHFAYHKVVEGILDTLEGPNIPPIQRVPRDIPAMLPAARLPTTVLNATAKAVAVTLQSH

SEQ ID NO: 884314 - protein, 332 aa, Homo sapiens
MQAGTAEWYDPGFSFLCSGRSHLSSTLDVYLPEAHILPTPRAGLARVSATGALKGHGNYSGAGGRRPKWSWPGMGRVRRKHPGSSFEDMGELHQRLREEEVDADAADAAAAEEEDGEFLGMKGFKGQLSRQVADQMWQAGKRQASRAFSLYANIDILRPYFDVEPAQVRSRLLESMIPIKMVNFPQKIAGELYGPLMLVFTLVAILLHGMKTSDTIIREGTLMGTAIGTCFGYWLGVSSFIYFLAYLCNAQITMLQMLALLGYGLFGHCIVLFITYNIHLHALFYLFWLLVGGLSTLRMCRGFRPVPPGSFGRGLRLAPRWPGGPVGPPGNP

SEQ ID NO: 884315 - protein, 350 aa, Homo sapiens; identical to SEQ ID NO: 884304

SEQ ID NO: 884316 - protein, 350 aa, Homo sapiens; identical to SEQ ID NO: 884304

SEQ ID NO: 884317 - protein, 350 aa, Homo sapiens; identical to SEQ ID NO: 884304

SEQ ID NO: 884318 - protein, 415 aa, Homo sapiens
MATTAAPAGGARNGAGPEWGGFEENIQGGGSAVIDMENMDDTSGSSFEDMGELHQRLREEEVDADAADAAAAEEEDGEFLGMKGFKGQLSRQVADQMWQAGKRQASRAFSLYANIDILRPYFDVEPAQVRSRLLESMIPIKMVNFPQKIAGELYGPLMLVFTLVAILLHGMKTSDTIIREGTLMGTAIGTCFGYWLGVSSFIYFLAYLCNAQITMLQMLALLVRSQVWWARVMLKRVARPWSASVLGPQSLEWEEEANGPCVSQGPHEGPEKQPNLNDFPLHHPPSQGYGLFGHCIVLFITYNIHLHALFYLFWLLVGGLSTLRMVAVLVSRTVGPTQRLLLCGTLAALHMLFLLYLHFAYHKVVEGILDTLEGPNIPPIQRVPRDIPAMLPAARLPTTVLNATAKAVAVTLQSH

SEQ ID NO: 884319 - protein, 341 aa, Homo sapiens
CRLVRPEWYDGEGRRKHPGGGSAVIDMENMDDTSGSSFEDMGELHQRLREEEVDADAADAAAAEEEDGEFLGMKGFKGQLSRQVADQMWQAGKRQASRAFSLYANIDILRPYFDVEPAQVRSRLLESMIPIKMVNFPQKIAGELYGPLMLVFTLVAILLHGMKTSDTIIREGTLMGTAIGTCFGYWLGVSSFIYFLAYLCNAQITMLQMLALLGYGLFGHCIVLFITYNIHLHALFYLFWLLVGGLSTLRMVAVLVSRTVGPTQRLLLCGTLAALHMLFLLYLHFAYHKVVEGILDTLEGPNIPPIQRVPRDIPAMLPAARLPTTVLNATAKAVAVTLQSH

SEQ ID NO: 884320 - protein, 389 aa, Homo sapiens
CRLVRPEWYDPGFSFLCSGRSHLSSTLDVYLPEAHILPTPRAGLARVSATGALKGHGNYSGAGGRRPKWSWPGMGRVRRKHPGSSFEDMGELHQRLREEEVDADAADAAAAEEEDGEFLGMKGFKGQLSRQVADQMWQAGKRQASRAFSLYANIDILRPYFDVEPAQVRSRLLESMIPIKMVNFPQKIAGELYGPLMLVFTLVAILLHGMKTSDTIIREGTLMGTAIGTCFGYWLGVSSFIYFLAYLCNAQITMLQMLALLGYGLFGHCIVLFITYNIHLHALFYLFWLLVGGLSTLRMVAVLVSRTVGPTQRLLLCGTLAALHMLFLLYLHFAYHKVVEGILDTLEGPNIPPIQRVPRDIPAMLPAARLPTTVLNATAKAVAVTLQSH

SEQ ID NO: 884321 - protein, 209 aa, Homo sapiens
MVNFPQKIAGELYGPLMLVFTLVAILLHGMKTSDTIIREGTLMGTAIGTCFGYWLGVSSFIYFLAYLCNAQITMLQMLALLGYGLFGHCIVLFITYNIHLHALFYLFWLLVGGLSTLRMVAVLVSRTVGPTQRLLLCGTLAALHMLFLLYLHFAYHKVVEGILDTLEGPNIPPIQRVPRDIPAMLPAARLPTTVLNATAKAVAVTLQSH

SEQ ID NO: 884322 - protein, 193 aa, Homo sapiens [sequence omitted]

SEQ ID NO: 884323 - protein, 448 aa, Homo sapiens
MATTAAPAGGARNGAGPEWGGFEENIQGGGSAVIDMENMDDTSGSSFEDMGELHQRLREEEVDADAADAAAAEEEDGEFLGMKGFKGQLSRQVADQMWQAGKRQASRAFSLYANIDILRPYFDVEPAQVRSRLLESMIPIKMVNFPQVNRGWHVWRAGGSTRAEGGTTRQILGSHKQMSCCTLSLNELVYGQKIAGELYGPLMLVFTLVAILLHGMKTSDTIIRKQDRQLWGGGCTRLKAASGYNGGVRQEQPLRKALGEAEIRGLLGLNRAFTPQREGTLMGTAIGTCFGYWLGVSSFIYFLAYLCNAQITMLQMLALLGYGLFGHCIVLFITYNIHLHALFYLFWLLVGGLSTLRMVAVLVSRTVGPTQRLLLCGTLAALHMLFLLYLHFAYHKVVEGILDTLEGPNIPPIQRVPRDIPAMLPAARLPTTVLNATAKAVAVTLQSH

SEQ ID NO: 884324 - protein, 87 aa, Homo sapiens
AGWYGRVVGSGLLLFVFRPIPPLLDPGRLPSGGPHLAHSARGASAGFSDGSPQGTWQLQRRRRAAPEMELARNGEGSKKTSRAEAQL

SEQ ID NO: 884325 - protein, 508 aa, Homo sapiens
MNCQQLWLGFLLPMTVSGRVLGLAEVAPVDYLSQYGYLQKPLEGSNNFKPEDITEALRAFQEASELPVSGQLDDATRARMRQPRCGLEDPFNQKTLKYLLLGRWRKKHLTFRILNLPSTLPPHTARAALRQAFQDWSNVAPLTFQEVQAGAADIRLSFHGRQSSYCSNTFDGPGRVLAHADIPELGSVHFDEDEFWTEGTYRGVNLRIIAAHEVGHALGLGHSRYSQALMAPVYEGYRPHFKLHPDDVAGIQALYGKKSPVIRDEEEEETELPTVPPVPTEPSPMPDPCSSELDAMMLGPRGKTYAFKGDYVWTVSDSGPGPLFRVSALWEGLPGNLDAAVYSPRTQWIHFFKGDKVWRYINFKMSPGFPKKLNRVEPNLDAALYWPLNQKVFLFKGSGYWQWDELARTDFSSYPKPIKGLFTGVPNQPSAAMSWQDGRVYFFKGKVYWRLNQQLRVEKGYPRNISHNWMHCRPRTIDTTPSGGNTTPSGTGITLDTTLSATETTFEY

SEQ ID NO: 884326 - protein, 85 aa, Homo sapiens
MQLSIGLSTKRCSSLRYKVQSKGKSLLRRSGLPYTEKQSLRLKGDVLQLQWAGGGPLGVLSSLLFLSPLPTHPISRAPGTGSGTS

SEQ ID NO: 884327 - protein, 222 aa, Homo sapiens
MGVTWDFSMSNGGPRGKTYAFKGDYVWTVSDSGPGPLFRVSALWEGLPGNLDAAVYSPRTQWIHFFKGDKVWRYINFKMSPGFPKKLNRVEPNLDAALYWPLNQKVFLFKGSGYWQWDELARTDFSSYPKPIKGLFTGVPNQPSAAMSWQDGRVYFFKGKVYWRLNQQLRVEKGYPRNISHNWMHCRPRTIDTTPSGGNTTPSGTGITLDTTLSATETTFEY

SEQ ID NO: 884328 - protein, 508 aa, Homo sapiens; identical to SEQ ID NO: 884325

SEQ ID NO: 884329 - protein, 508 aa, Homo sapiens; identical to SEQ ID NO: 884325

SEQ ID NO: 884330 - protein, 508 aa, Homo sapiens; identical to SEQ ID NO: 884325

SEQ ID NO: 884331 - protein, 279 aa, Homo sapiens
MAPVYEGYRPHFKLHPDDVAGIQALYGKKSPVIRDEEEEETELPTVPPVPTEPSPMPDPCSSELDAMMLGPRGKTYAFKGDYVWTVSDSGPGPLFRVSALWEGLPGNLDAAVYSPRTQWIHFFKGDKVWRYINFKMSPGFPKKLNRVEPNLDAALYWPLNQKVFLFKGSGYWQWDELARTDFSSYPKPIKGLFTGVPNQPSAAMSWQDGRVYFFKGKVYWRLNQQLRVEKGYPRNISHNWMHCRPRTIDTTPSGGNTTPSGTGITLDTTLSATETTFEY

SEQ ID NO: 884332 - protein, 144 aa, Homo sapiens
MSPGFPKKLNRVEPNLDAALYWPLNQKVFLFKGSGYWQWDELARTDFSSYPKPIKGLFTGVPNQPSAAMSWQDGRVYFFKGKVYWRLNQQLRVEKGYPRNISHNWMHCRPRTIDTTPSGGNTTPSGTGITLDTTLSATETTFEY

SEQ ID NO: 884333 - protein, 115 aa, Homo sapiens
GDLEDPISGQDELARTDFSSYPKPIKGLFTGVPNQPSAAMSWQDGRVYFFKGKVYWRLNQQLRVEKGYPRNISHNWMHCRPRTIDTTPSGGNTTPSGTGITLDTTLSATETTFEY

SEQ ID NO: 884334 - protein, 483 aa, Homo sapiens
MNCQQLWLGFLLPMTVSGRVLGLAEVAPVDYLSQYGYLQKPLEGSNNFKPEDITEALRAFQEASELPVSGQLDDATRARMRQPRCGLEDPFNQKTLKYLLLGRWRKKHLTFRILNLPSTLPPHTARAALRQAFQDWSNVAPLTFQEVQAGAADIRLSFHGRQSSYCSNTFDGPGRVLAHADIPELGSVHFDEDEFWTEGTYRGVNLRIIAAHEVGHALGLGHSRYSQALMAPVYEGYRPHFKLHPDDVAGIQALYGKKSPVIRDEEEEETELPTVPPVPTEPSPMPDPCSSELDAMMLGPRGKTYAFKGDYVWTVSDSGPGPLFRVSALWEGLPGNLDAAVYSPRTQWIHFFKGDKVWRYINFKMSPGFPKKLNRVEPNLDAALYWPLNQKVFLFKGSGYWQWDELARTDFSSYPKPIKGLFTGVPNQPSAAMSWQDGRVYFFKGKVYWRLNQQLRVEKGYPRNISHNWMHCRPGLRWDPLDH

SEQ ID NO: 884335 - protein, 508 aa, Homo sapiens; identical to SEQ ID NO: 884325

SEQ ID NO: 884336 - protein, 464 aa, Homo sapiens
MRQPRCGLEDPFNQKTLKYLLLGRWRKKHLTFRILNLPSTLPPHTARAALRQAFQDWSNVAPLTFQEVQAGAADIRLSFHGRQSSYCSNTFDGPGRVLAHADIPELGSVHFDEDEFWTEGTYRGVNLRIIAAHEVGHALGLGHSRYSQALMAPVYEGYRPHFKLHPDDVAGIQALYGKKSPVIRDEEEEETELPTVPPVPTEPSPMPDPCSSELDAMMLGEAPPLQAVGRRWGQLLILRPGQMGVTWDFSMSNGGPRGKTYAFKGDYVWTVSDSGPGPLFRVSALWEGLPGNLDAAVYSPRTQWIHFFKGDKVWRYINFKMSPGFPKKLNRVEPNLDAALYWPLNQKVFLFKGSGYWQWDELARTDFSSYPKPIKGLFTGVPNQPSAAMSWQDGRVYFFKGKVYWRLNQQLRVEKGYPRNISHNWMHCRPRTIDTTPSGGNTTPSGTGITLDTTLSATETTFEY

SEQ ID NO: 884337 - protein, 90 aa, Homo sapiens
GDLEDPISGQDELARTDFSSYPKPIKGLFTGVPNQPSAAMSWQDGRVYFFKGKVYWRLNQQLRVEKGYPRNISHNWMHCRPGLRWDPLDH

SEQ ID NO: 884338 - protein, 339 aa, Homo sapiens [sequence omitted]

SEQ ID NO: 884339 - protein, 397 aa, Homo sapiens
MNCQQLWLGFLLPMTVSGRVLGLAEVAPVDYLSQYGYLQKPLEGSNNFKPEDITEALRAFQEASELPVSGQLDDATRARMRQPRCGLEDPFNQKTLKYLLLGRWRKKHLTFRILNLPSTLPPHTARAALRQAFQDWSNVAPLTFQEVQAGAADIRLSFHGRQSSYCSNTFDGPGRVLAHADIPELGSVHFDEDEFWTEGTYRGVNLRIIAAHEVGHALGLGHSRYSQALMAPVYEGYRPHFKLHPDDVAGIQALYGKKSPVIRDEEEEETELPTVPPVPTEPSPMPDPCSSELDAMMLGPRGKTYAFKGDYVWTVSDSGPGPLFRVSALWEGLPGNLDAAVYSPRTQWIHFFKGDKVWRYINFKMSPGFPKKLNRVEPNLDAALYWPLNQKVFLFKV

SEQ ID NO: 884340 - protein, 193 aa, Homo sapiens
TEFVIADLEVSPRTCYPREYWMLSLCTRLEHNWIHFFKGDKVWRYINFKMSPGFPKKLNRVEPNLDAALYWPLNQKVFLFKGSGYWQWDELARTDFSSYPKPIKGLFTGVPNQPSAAMSWQDGRVYFFKGKVYWRLNQQLRVEKGYPRNISHNWMHCRPRTIDTTPSGGNTTPSGTGITLDTTLSATETTFEY

SEQ ID NO: 884341 - protein, 509 aa, Homo sapiens
MRVRCAIIPSDMLHISTNCRTAEKMALTLLDYLFHREVQAVSNLSGQGKHGKKQLDPLTIYGIRCHLFYKFGITESDWYRIKQSIDSKCRTAWRRKQRGQSLAVKSFSRRTPNSSSYCPSEPMMSTPPPASELPQPQPQPQALHYALANAQQVQIHQIGEDGQVQVIPQGHLHIAQVPQGEQVQITQDSEEPVFWYYVKEVLNKHELQRFYSLRHIASDVGRGRTWLRCALNEHSLERYLHMLLADRCRLSTFYEDWSFVMDEERSSMLPTMAAGPNSILFAINIDNKDLNGQSKFAPTVSDLLKESTQNVTLLKESTQGVSSVFREITASSAISILIKPEQETDPLPVVSRNVSADAKCKKERKKKKQVTNIISFDDEEDEQNSGDMFKKTPGAGESSEDNSDHSSVNIMSAFESPFGPNSNGSQSSNSWKIDSLSLNREFGYQKLDVKSIDDEDVDENEDDVYGNSSGRKHRGHSESPEKNGAHSVTQAGVQWHDLSSLQPLPPGFK

SEQ ID NO: 884342 - protein, 349 aa, Homo sapiens
MAVPGRRQNTIVVKVPGQEDSHHEDGESGSEASDSVSSCGQAGSQSIGSNVTLITLNSEEDYPNGTWLGDENNPEMRVRCAIIPSDMLHISTNCRTAEKMALTLLDYLFHREVQAVSNLSGQGKHGKKQLDPLTIYGIRCHLFYKFGITESDWYRIKQSIDSKCRTAWRRKQRGQSLAVKSFSRRTPNSSSYCPSEPMMSTPPPASELPQPQPQPQALHYALANAQQVQIHQIGEDGQVQVIPQGHLHIAQVPQGEQVQITQDSEGNLQIHHVGQDGQVLQGAQLIAVASSDPAAAGVDGSPLQGSDIQVQYVQLAPVSDHTAGAQTAEALQPTLQPEMQLEHGAIQIQ

SEQ ID NO: 884343 - protein, 138 aa, Homo sapiens
MSEHDLADVVQIAVEDLSPDHPGTELWDRVVLENHVVTDEDEPALKRQRLEINCQDPSIKSFLYSINQTICLRLDSIEAKLQALEATCKSLEEKLDLVTNKQHSPIQVPMVAGSPLGATQTCNKVRWLCLGVGRTPLW

SEQ ID NO: 884344 - protein, 349 aa, Homo sapiens; identical to SEQ ID NO: 884342

SEQ ID NO: 884345 - protein, 191 aa, Homo sapiens
MLPTMAAGPNSILFAINIDNKDLNGQSKFAPTVSDLLKESTQNVTLLKESTQGVSSVFREITASSAISILIKPEQETDPLPVVSRNVSADAKCKKERKKKKQVTNIISFDDEEDEQNSGDMFKKTPGAGESSEDNSDHSSVNIMSAFESPFGPNSNGSQSSNSWKIDSLSLNREFGYQKLDVKSIDDEDVG

SEQ ID NO: 884346 - protein, 742 aa, Homo sapiens
MSEHDLADVVQIAVEDLSPDHPVVLENHVVTDEDEPALKRQRLEINCQDPSIKSFLYSINQTICLRLDSIEAKLQALEATCKSLEEKLDLVTNKQHSPIQVPMVAGSPLGATQTCNKVRCVVPQTTVILNNDRQNAIVAKMEDPLSNRAPDSLENVISNAVPGRRQNTIVVKVPGQEDSHHEDGESGSEASDSVSSCGQAGSQSIGSNVTLITLNSEEDYPNGTWLGDENNPEMRVRCAIIPSDMLHISTNCRTAEKMALTLLDYLFHREVQAVSNLSGQGKHGKKQLDPLTIYGIRCHLFYKFGITESDWYRIKQSIDSKCRTAWRRKQRGQSLAVKSFSRRTPNSSSYCPSEPMMSTPPPASELPQPQPQPQALHYALANAQQVQIHQIGEDGQVQVIPQGHLHIAQVPQGEQVQITQDSEEPVFWYYVKEVLNKHELQAFYSLRHIASDVGRGRTWLRCALNEHSLERYLHMLLADRCRLSTFYEDWSFVMDEERSSMLPTMAAGPNSILFAINIDNKDLNGQSKFAPTVSDLLKESTQNVTLLKESTQGVSSVFREITASSAISILIKPEQETDPLPVVSRNVSADAKCKKERKKKKQVTNIISFDDEEDEQNSGDMFKKTPGAGESSEDNSDHSSVNIMSAFESPFGPNSNGSQSSNSWKIDSLSLNREFGYQKLDVKSIDDEDVDENEDDVYGNSSGRKHRGHSESPEKNGAHSVTQAGVQWHDLSSLQPLPPGFK

SEQ ID NO: 884347 - protein, 749 aa, Homo sapiens
MSEHDLADVVQIAVEDLSPDHPGTELWDSVVLENHVVTDEDEPALKRQRLEINCQDPSIKSFLYSINQTICLRLDSIEAKLQALEATCKSLEEKLDLVTNKQHSPIQVPMVAGSPLGATQTCNKVRCVVPQTTVILNNDRQNAIVAKMEDPLSNRAPDSLENVISNAVPGRRQNTIVVKVPGQEDSHHEDGESGSEASDSVSSCGQAGSQSIGSNVTLITLNSEEDYPNGTWLGDENNPEMRVRCAIIPSDMLHISTNCRTAEKMALTLLDYLFHREVQAVSNLSGQGKHGKKQLDPLTIYGIRCHLFYKFGITESDWYRIKQSIDSKCRTAWRRKQRGQSLAVKSFSRRTPNSSSYCPSEPMMSTPPPASELPQPQPQPQALHYALANAQQVQIHQIGEDGQVQVIPQGHLHIAQVPQGEQVQITQDSEEPVFWYYVKEVLNKHELKRFYSLRHIASDVGRGRTWLRCALNEHSLERYLHMLLADRCRLSTFYEDWSFVMDEERSSMLPTMAAGPNSILFAINIDNKDLNGQSKFAPTVSDLLKESTQNVTLLKESTQGVSSVFREITASSAISILIKPEQETDPLPVVSRNVSADAKCKKERKKKKQVTNIISFDDEEDEQNSGDMFKKTPGAGESSEDNSDHSSVNIMSAFESPFGPNSNGSQSSNSWKIDSLSLNREFGYQKLDVKSIDDEDVDENEDDVYGNSSGRKHRGHSESPEKNGAHSVTQAGVQWHDLSSLQPLPPGFK

SEQ ID NO: 884348 - protein, 742 aa, Homo sapiens
MFLAHSSEASSSVGIVLSEWIELRSGNSCLVFLGVVFLQFRRPFLKPVFSHFQSFLYSINQTICLRLDSIEAKLQALEATCKSLEEKLDLVTNKQHSPIQVPMVAGSPLGATQTCNKVRCVVPQTTVILNNDRQNAIVAKMEDPLSNRAPDSLENVISNAVPGRRQNTIVVKVPGQEDSHHEDGESGSEASDSVSSCGQAGSQSIGSNVTLITLNSEEDYPNGTWLGDENNPEMRVRCAIIPSDMLHISTNCRTAEKMALTLLDYLFHREVQAVSNLSGQGKHGKKQLDPLTIYGIRCHLFYKFGITESDWYRIKQSIDSKCRTAWRRKQRGQSLAVKSFSRRTPNSSSYCPSEPMMSTPPPASELPQPQPQPQALHYALANAQQVQIHQIGEDGQVQVIPQGHLHIAQVPQGEQVQITQDSEEPVFWYYVKEVLNKHELQRFYSLRHIASDVGRGRTWLRCALNEHSLERYLHMLLADRCRLSTFYEDWSFVMDEERSSMLPTMAAGPNSILFAINIDNKDLNGQSKFAPTVSDLLKESTQNVTLLKESTQGVSSVFREITASSAISILIKPEQETDPLPVVSRNVSADAKCKKERKKKKQVTNIISFDDEEDEQNSGDMFKKTPGAGESSEDNSDHSSVNIMSAFESPFGPNSNGSQSSNSWKIDSLSLNREFGYQKLDVKSIDDEDVDENEDDVYGNSSGRKHRGHSESPEKNGAHSVTQAGVQWHDLSSLQPLPPGFK

SEQ ID NO: 884349 - protein, 509 aa, Homo sapiens; identical to SEQ ID NO: 884341

SEQ ID NO: 884350 - protein, 326 aa, Homo sapiens
MIVPLCSSLGDRVRPCPHPTPQKQNKTKKTQTRKRNAVWCTCSSDINSWFSLSTNYMPEPVFWYYVKEVLNKQSCKRFYSLRHIASDVGRGRTWLRCALNEHSLERYLHMLLADRCRLSTFYEDWSFVMDEERSSMLPTMAAGPNSILFAINIDNKDLNGQSKFAPTVSDLLKESTQNVTLLKESTQGVSSVFREITASSAISILIKPEQETDPLPVVSRNVSADAKCKKERKKKKQVTNIISFDDEEDEQNSGDMFKKTPGAGESSEDNSDHSSVNIMSAFESPFGPNSNGSQSSNSWKIDSLSLNREFGYQKLDVKSIDDEDVG

SEQ ID NO: 884351 - protein, 349 aa, Homo sapiens; identical to SEQ ID NO: 884342

SEQ ID NO: 884352 - protein, 172 aa, Homo sapiens
MDEERSSMLPTMAAGPNSILFAINIDNKDLNGQSKFAPTVSDLLKESTQNVTLLKESTQGVSSVFREITASSAISILIKPEQETDPLPVVSRNVSADAKCKKERKKKKQVTNIISFDDEEDEQNSGDMFKKTPGAGESSEDNSDHSSVNIMSAFESPFGPNSNGSQSSYSGG

SEQ ID NO: 884353 - protein, 191 aa, Homo sapiens; identical to SEQ ID NO: 884345

SEQ ID NO: 884354 - protein, 742 aa, Homo sapiens
MSEHDLADVVQIAVEDLSPDHPVVLENHVVTDEDEPALKRQRLEINCQDPSIKSFLYSINQTICLRLDSIEAKLQALEATCKSLEEKLDLVTNKQHSPIQVPMVAGSPLGATQTCNKVRCVVPQTTVILNNDRQNAIVAKMEDPLSNRAPDSLENVISNAVPGRRQNTIVVKVPGQEDSHHEDGESGSEASDSVSSCGQAGSQSIGSNVTLITLNSEEDYPNGTWLGDENNPEMRVRCAIIPSDMLHISTNCRTAEKMALTLLDYLFHREVQAVSNLSGQGKHGKKQLDPLTIYGIRCHLFYKFGITESDWYRIKQSIDSKCRTAWRRKQRGQSLAVKSFSRRTPNSSSYCPSEPMMSTPPPASELPQPQPQPQALHYALANAQQVQIHQIGEDGQVQVIPQGHLHIAQVPQGEQVQITQDSEEPVFWYYVKEVLNKHELQRFYSLRHIASDVGRGRTWLRCALNEHSLERYLHMLLADRCRLSTFYEDWSFVMDEERSSMLPTMAAGPNSILFAINIDNKDLNGQSKFAPTVSDLLKESTQNVTLLKESTQGVSSVFREITASSAISILIKPEQETDPLPVVSRNVSADAKCKKERKKKKQVTNIISFDDEEDEQNSGDMFKKTPGAGESSEDNSDHSSVNIMSAFESPFGPNSNGSQSSNSWKIDSLSLNREFGYQKLDVKSIDDEDVDENEDDVYGNSSGRKHRGHSESPEKNGAHSVTQAGVQWHDLSSLQPLPPGFK

SEQ ID NO: 884355 - protein, 740 aa, Homo sapiens
MSGKTPPSLRNLRAGPAAAAVVLENHVVTDEDEPALKRQRLEINCQDPSIKSFLYSINQTICLRLDSIEAKLQALEATCKSLEEKLDLVTNKQHSPIQVPMVAGSPLGATQTCNKVRCVVPQTTVILNNDRQNAIVAKMEDPLSNRAPDSLENVISNAVPGRRQNTIVVKVPGQEDSHHEDGESGSEASDSVSSCGQAGSQSIGSNVTLITLNSEEDYPNGTWLGDENNPEMRVRCAIIPSDMLHISTNCRTAEKMALTLLDYLFHREVQAVSNLSGQGKHGKKQLDPLTIYGIRCHLFYKFGITESDWYRIKQSIDSKCRTAWRRKQRGQSLAVKSFSRRTPNSSSYCPSEPMMSTPPPASELPQPQPQPQALHYALANAQQVQIHQIGEDGQVQVIPQGHLHIAQVPQGEQVQITQDSEEPVFWYYVKEVLNKHELQRFYSLRHIASDVGRGRTWLRCALNEHSLERYLHMLLADRCRLSTFYEDWSFVMDEERSSMLPTMAAGPNSILFAINIDNKDLNGQSKFAPTVSDLLKESTQNVTLLKESTQGVSSVFREITASSAISILIKPEQETDPLPVVSRNVSADAKCKKERKKKKQVTNIISFDDEEDEQNSGDMFKKTPGAGESSEDNSDHSSVNIMSAFESPFGPNSNGSQSSNSWKIDSLSLNREFGYQKLDVKSIDDEDVDENEDDVYGNSSGRKHRGHSESPEKNGAHSVTQAGVQWHDLSSLQPLPPGFK

SEQ ID NO: 884356 - protein, 770 aa, Homo sapiens
MSEHDLADVVQIAVEDLSPDHPVVLENHVVTDEDEPALKRQRLEINCQDPSIKSFLYSINQTICLRLDSIEAKLQALEATCKSLEEKLDLVTNKQHSPIQVPMVAGSPLGATQTCNKVRCLPQQSRTLDIPCDQKVLRLKKRMMENCGVVPQTTVILNNDRQNAIVAKMEDPLSNRAPDSLENVISNAVPGRRQNTIVVKVPGQEDSHHEDGESGSEASDSVSSCGQAGSQSIGSNVTLITLNSEEDYPNGTWLGDENNPEMRVRCAIIPSDMLHISTNCRTAEKMALTLLDYLFHREVQAVSNLSGQGKHGKKQLDPLTIYGIRCHLFYKFGITESDWYRIKQSIDSKCRTAWRRKQRGQSLAVKSFSRRTPNSSSYCPSEPMMSTPPPASELPQPQPQPQALHYALANAQQVQIHQIGEDGQVQVIPQGHLHIAQVPQGEQVQITQDSEEPVFWYYVKEVLNKHELQRFYSLRHIASDVGRGRTWLRCALNEHSLERYLHMLLADRCRLSTFYEDWSFVMDEERSSMLPTMAAGPNSILFAINIDNKDLNGQSKFAPTVSDLLKESTQNVTLLKESTQGVSSVFREITASSAISILIKPEQETDPLPVVSRNVSADAKCKKERKKKKQVTNIISFDDEEDEQNSGDMFKKTPGAGESSEDNSDHSSVNIMSAFESPFGPNSNGSQSSNSWKIDSLSLNREFGYQKLDVKSIDDEDVDENEDDVYGNSSGRKHRGHSESPEKNGAHSVTQAGVQWHDLSSLQPLPPGFK

SEQ ID NO: 884357 - protein, 165 aa, Homo sapiens
MSEHDLADVVQIAVEDLSPDHPGTELWDRVVLENHVVTDEDEPALKRQRLEINCQDPSIKSFLYSINQTICLRLDSIEAKLQALEATCKSLEEKLDLVTNKQHSPIQVPMVAGSPLGATQTCNKVRWRYRFGMIPTLTWLRTLDLSHGMSDGVTENVKPVLMQVC

SEQ ID NO: 884358 - protein, 225 aa, Homo sapiens
GHIECLQWLIKMGADSNITNKAGERPSDVAKRFAHLAAVKLLEELQKYDIDDENEIDENDVKYFIRHGVEGSTDAKDDLCLSDLDKTDARMRAYKKIVELRHLLEIAESNYKHLGGITEEDLKQKKEQLESEKTIKELQGQLEYERLRREKLECQLDEYRAEVDQLRETLEKIQVPNFVAMEDSASCESNKEKRRVKKKVSSGGVFVRRFTIGQVTLPRAEWIRG

SEQ ID NO: 884359 - protein, 805 aa, Homo sapiens
WVVRRSSSEEKLLCLVRERAGHTCEAAVIVILILVWEGIPLSLADKLYSELTETLRKYGTLTNRRCALNEERTCACQGLDPETCGASFSFGCSWSMYYNGCKFARSKIPRKFKLLGDDPKEEEKLESHLQNLSTLMAPTYKKLAPDAYNNQIEYEHRAPECRLGLKEGRPFSGVTACLDFCAHAHRDLHNMQNGSTLVCTLTREDNREFGGKPEDEQLHVLPLYKVSDVDEFGSVEAQEEKKRSGAIQVLSSFRRKVRMLAEPVKTCRQRKLEAKKAAAEKLSSLENSSNKNEKEKSAPSRTKQTENASQAKQLAELLRLSGPVMQQSQQPQPLQKQPPQPQQQQRPQQQQPHHPQTESVNSYSASGSTNPYMRRPNPVSPYPNSSHTSDIYGSTSPMNFYSTSSQAAGSYLNSSNPMNPYPGLLNQNTQYPSYQCNGNLSVDNCSPYLGSYSPQSQPMDLYRYPSQDPLSKLSLPPIHTLYQPRFGNSQSFTSKYLGYGNQNMQGDGFSSCTIRPNVHHVGKLPPYPTHEMDGHFMGATSRLPPNLSNPNMDYKNGEHHSPSHIIHNYSAAPGMFNSSLHALHLQNKENDMLSHTANGLSKMLPALNHDRTACVQGGLHKLSDANGQEKQPLALVQGVASGAEDNDEVWSDSEQSFLDPDIGGVAVAPTHGSILIECAKRELHATTPLKNPNRNHPTRISLVFYQHKSMNEPKHGLALWEAKMAEKAREKEEECEKYGPDYVPQKSHGKKVKREPAEPHETSEPTYLRFIKSLAERTMSVTTDSTVTTSPYAFTRVTGPYNRYI

SEQ ID NO: 884360 - protein, 805 aa, Homo sapiens; identical to SEQ ID NO: 884359

SEQ ID NO: 884361 - protein, 805 aa, Homo sapiens; identical to SEQ ID NO: 884359

SEQ ID NO: 884362 - protein, 90 aa, Homo sapiens
SVEAQEEKKRSGAIQVLSSFRRKVRMLAEPVKTCRQRKLEAKKAAAEKLSSLENSSNKNEKEKSAPSRTKQTENASQAKQLAGKFNVKHL

SEQ ID NO: 884363 - protein, 755 aa, Homo sapiens
DLKNNEISWTIEDMNGAFYGLDKLRRLILQGNRIRSITKKASTGLDALEHLDLSDNAIMSLQGNAFSQMKKLQQLHLNTSSLLCDCQLKWLPQWVAENNFQSFVNASCAHPQLLKGRSIFAVSPDGFVCDDFPKPQITVQPETQSAIKGSNLSFICSAASSSDSPMTFAWKKDNELLHDAEMENYAHLRAQGGEVMEYTTILRLREVEFASEGKYQCVISNHFGSSYSVKAKLTVNMLPSFTKTPMDLTIRAGAMARLECAAVGHPAPQIAWQKDGGTDFPAARERRMHVMPEDDVFFIVDVKIEDIGVYSCTAQNSAGSISANATLTVLETPSFLRPLLDRTVTKGETAVLQCIAGGSPPPKLNWTKDDSPLVVTERHFFAAGNQLLIIVDSDVSDAGKYTCEMSNTLGTERGNVRLSVIPTPTCDSPQMTAPSLDDDGWATVGVVIIAVVCCVVGTSLVWVVIIYHTRRRNEDCSITNTDETNLPADIPSYLSSQGTLADRQDGYVSSESGSHHQFVTSSGAGFFLPQHDSSGTCHIDNSSEADVEAATDLFLCPFLGSTGPMYLKGNVYGSDPFETYHTGCSPDPRTVLMDHYEPSYIKKKECYPCSHPSEESCERSFSNISWPSHVRKLLNTSYSHNEGPGMKNLCLNKSSLDFSANPEPASVASSNSFMGTFGKALRRPHLDAYSSFGQPSDCQPRAFYLKAHSSPDLDSGSEEDGKERTDFQEENHICTFKQTLENYRTPNFQSYDLDT

SEQ ID NO: 884364 - protein, 788 aa, Homo sapiens
DLKNNEISWTIEDMNGAFYGLDKLRRLILQGNRIRSITKKASTGLDALEHLDLSDNAIMSLQGNAFSQMKKLQQLHLNTSSLLCDCQLKWLPQWVAENNFQSFVNASCAHPQLLKGRSIFAVSPDGFVCDDFPKPQITVQPETQSAIKGSNLSFICSAASSSDSPMTFAWKKDNELLHDAEMENYAHLRAQGGEVMEYTTILRLREVEFASEGKYQCVISNHFGSSYSVKAKLTVNMLPSFTKTPMDLTIRAGAMARLECAAVGHPAPQIAWQKDGGTDFPAARERRMHVMPEDDVFFIVDVKIEDIGVYSCTAQNSAGSISANATLTVLETPSFLRPLLDRTVTKGETAVLQCIAGGSPPPKLNWTKDDSPLVVTERHFFAAGNQLLIIVDSDVSDAGKYTCEMSNTLGTERGNVRLSVIPTPTCDSPQMTAPSLDDDGWATVGVVIIAVVCCVVGTSLVWVVIIYHTRRRNEDCSITNTDETNLPADIPSYLSSQGTLADRQDGYVSSESGSHHQFVTSSGAGFFLPQHDSSGTCHIDNSSEADVEAATDLFLCPFLGSTGPMYLKGNVYGSDPFETYHTGRWFSCLSTVLFLRETSRCANCNLLLLLPPYEKGCSPDPRTVLMDHYEPSYIKKKECYPCSHPSEESCERSFSNISWPSHVRKLLNTSYSHNEGPGMKNLCLNKSSLDFSANPEPASVASSNSFMGTFGKALRRPHLDAYSSFGQPSDCQPRAFYLKAHSSPDLDSGSEEDGKERTDFQEENHICTFKQTLENYRTPNFQSYDLDT

SEQ ID NO: 884365 - protein, 755 aa, Homo sapiens; identical to SEQ ID NO: 884363

SEQ ID NO: 884366 - protein, 103 aa, Homo sapiens
MVPRVQLWGRPRRNRVSWRWERAYFRFRLPTFRNLILRAGLRFQAGFVHIFALEGERSLGHICINCAAGPTPDSFSAHQPALELLERPWLQAGITRRAFDIDA

SEQ ID NO: 884367 - protein, 182 aa, Homo sapiens
MPEAQLWSDSLKRAAASPSQNPALPPERFPGEEGTTNSFLKARPRDLMTFEDVAVEFSQWEWGQLNPAQKDLYREVMLENFRNLAILGLLVSKPYVICQLEEGGEPFMVEREISTGAHSDWKRRSKSKESMPSWGISKEELFQLHEELPVTSCLKKKTLGLGLLMVLHDLLVSPESGQLQYC

SEQ ID NO: 884368 - protein, 400 aa, Homo sapiens
MTFEDVAVEFSQWEWGQLNPAQKDLYREVMLENFRNLAILGLLVSKPYVICQLEEGGEPFMVEREISTGAHSDWKRRSKSKESMPSWGISKEELFQVVSVEKHIQDVLQFSKLKAACGCDGQLEMQQIKQERHLKQMSTIHKSATTLSRDYKWNGFGRSLGLRSVLVNQHSILMGEGSYKCDTEFRQTLGGNNSQRTHPEKKSCKCNECGKSFHFQSELRRHQRCHTGEKPYECSDCGRAFGHISSLIKHQRTHTGEKPYECSECGRAFSQSSSLVLHYRFHTGEKPYKCNECGRAFGHTSSLIKHQRTHTGEKPYECRECGRTFSQSSSLIVHYRFHTGEKPYKCNKCGRAFSQSSSLTQHYRFHTGEKPYKCNECGRAFAHTASLIKHQRSHAGKKTL

SEQ ID NO: 884369 - protein, 400 aa, Homo sapiens; identical to SEQ ID NO: 884368

SEQ ID NO: 884370 - protein, 400 aa, Homo sapiens; identical to SEQ ID NO: 884368

SEQ ID NO: 884371 - protein, 103 aa, Homo sapiens; identical to SEQ ID NO: 884366

SEQ ID NO: 884372 - protein, 400 aa, Homo sapiens; identical to SEQ ID NO: 884368

SEQ ID NO: 884373 - protein, 400 aa, Homo sapiens; identical to SEQ ID NO: 884368

SEQ ID NO: 884374 - protein, 400 aa, Homo sapiens; identical to SEQ ID NO: 884368

SEQ ID NO: 884375 - protein, 681 aa, Homo sapiens
MAPQVWRRRTLERCLTEVGKATGRPECFLTIQEGLASKFTSLTKVLYDFNKILENGRIHGSPLQKLVIENFDDEQIWQQLELQNEPILQYFQNAVSETINDEDISLLPESEEQEREEDGSEIEADDKEDLEDLEEEEVSDMGNDDPEMGERAENSSKSDLRKSPVFSDEDSDLDFDISKLEQQSKVQNKGQGKPREKSIVDDKFFKLSEMEAYLENIEKEEERKDDNDEEEEDIDFFEDIDSDEDEGGLFGSKKLKSGKSSRNLKYKDFFDPVESDEDITNVHDDELDSNKEDDEIAEEEAEELSISETDEDDDLQENEDNKQHKESLKRVTFALPDDAETEDTGVLNVKKNSDEVKSSFEKRQEKMNEKIASLEKELLEKKPWQLQGEVTAQKRPENSLLEETLHFDHAVRMAPVITEETTLQLEDIIKQRIRDQAWDDVVRKEKPKEDAYEYKKRLTLDHEKSKLSLAEIYEQEYIKLNQQKTAEEENPEHVEIQKMMDSLFLKLDALSNFHFIPKPPVPEIKVVSNLPAITMEEVAPVSVSDAALLAPEEIKEKNKAGDIKTAAEKTATDKKRERRKKKYQKRMKIKEKEKRRKLLEKSSVDQAGKYSKTVASEKLKQLTKTGKASFIKDEGKDKALKSSQAFFSKLQDQVKMQINDAKKTEKKKKKRQDISVHKLKL

SEQ ID NO: 884376 - protein, 258 aa, Homo sapiens
MAPQVWRRRTLERCLTEVGKATGRPECFLTIQEGLASKFTSLTKVLYDFNKILENGRIHGSPLQKLVIENFDDEQIWQQLELQNEPILQYFQNAVSETINDEDISLLPESEEQEREEDGSEIEADDKEDLEDLEEEEVSDMGNDDPEMGERAENSSKSDLRKSPVFSDEDSDLDFDISKLEQQSKVQNKGQGKPREKSIVDDKFFKLSEMEAYLENIEKEEERKDDNDEEEEDIDFFEDIDSDEDEGGLFGSKKLKIR

SEQ ID NO: 884377 - protein, 182 aa, Homo sapiens
MDSLFLKLDALSNFHFIPKPPVPEIKVVSNLPAITMEEVAPVSVSDAALLAPEEIKEKNKAGDIKTAAEKTATDKKRERRKKKYQKRMKIKEKEKRRKLLEKSSVDQAGKYSKTVASEKLKQLTKTGKASFIKDEGKDKALKSSQAFFSKLQDQVKMQINDAKKTEKKKKKRQDISVHKLKL

SEQ ID NO: 884378 - protein, 668 aa, Homo sapiens [sequence omitted]

SEQ ID NO: 884379 - protein, 426 aa, Homo sapiens
MAPQVWRRRTLERCLTEVGKATGRPECFLTIQEGLASKFTSLTKVLYDFNKILENGRIHGSPLQKLVIENFDDEQIWQQLELQNEPILQYFQNAVSETINDEDISLLPESEEQEREEDGSEIEADDKEDLEDLEEEEVSDMGNDDPEMGERAENSSKSDLRKSPVFSDEDSDLDFDISKLEQQSKVQNKGQGKPREKSIVDDKFFKLSEMEAYLENIEKEEERKDDNDEEEEDIDFFEDIDSDEDEGGLFGSKKLKSGKSSRNLKYKDFFDPVESDEDITNVHDDELDSNKEDDEIAEEEAEELSISETDEDDDLQENEDNKQHKESLKRVTFALPDDAETEDTGVLNVKKNSDEVKSSFEKRQEKMNEKIASLEKELLEKKPWQLQGEVTAQKRPENSLLEETLHFDHAVRMAPVILTFLEAMSI

SEQ ID NO: 884380 - protein, 288 aa, Homo sapiens
SLISNSAREETLHFDHAVRMAPVITEETTLQLEDIIKQRIRDQAWDDVVRKEKPKEDAYEYKKRLTLDHEKSKLSLAEIYEQEYIKLNQQKTAEEENPEHVEIQKMMDSLFLKLDALSNFHFIPKPPVPEIKVVSNLPAITMEEVAPVSVSDAALLAPEEIKEKNKAGDIKTAAEKTATDKKRERRKKKYQKRMKIKEKEKRRKLLEKSSVDQAGKYSKTVASEKLKQLTKTGKASFIKDEGKDKALKSSQAFFSKLQDQVKMQINDAKKTEKKKKKRQDISVHKLKL

SEQ ID NO: 884381 - protein, 372 aa, Homo sapiens
EFDGFSTGGDSVPQGTRFSLTTGGGCSWHLVSTDRDAAKHPAVSSTAPYNKELFVPIGSMSTVLNKVEKPWSNLTFSTYNGGSGCPKKESGFPEVTQGVRGRLCKLRPCFLLFIERPLCPGLYHAAGAWDDVVRKEKPKEDAYEYKKRLTLDHEKSKLSLAEIYEQEYIKLNQQKTAEEENPEHVEIQKMMDSLFLKLDALSNFHFIPKPPVPEIKVVSNLPAITMEEVAPVSVSDAALLAPEEIKEKNKAGDIKTAAEKTATDKKRERRKKKYQKRMKIKEKEKRRKLLEKSSVDQAGKYSKTVASEKLKQLTKTGKASFIKDEGKDKALKSSQAFFSKLQDQVKMQINDAKKTEKKKKKRQDISVHKLKL

SEQ ID NO: 884382 - protein, 668 aa, Homo sapiens
MAPQVWRRRTLERCLTEVGKATGRPECFLTIQEGLASKFTSLTKVLYDFNKILENGRIHGSPLQKLVIENFDDEQIWQQLELQNEPILQYFQNAVSETINDEDISLLPESEEQEREEDGSEIEADDKEDLEDLEEEEVSDMGNDDPEMGERAENSSKSDLRKSPVFSDEDSDLDFDISKLEQQSKVQNKGQGKPREKSIVDDKFFKLSEMEAYLENIEKEEERKDDNDEEEEDIDFFEDIDSDEDEGGLFGSKKLKSGKSSRNLKYKDFFDPVESDEDITNVHDDELDSNKEDDEIAEEEAEELSISETDEDDDLQENEDNKQHKESLKRVTFALPDDAETEDTGVLNVKKNSDEVKSSFEKRQEKMNEKIASLEKELLEKKPWQLQGEVTAQKRPENSLLEETLHFDHAVRMAPVITEETTLQLEDIIKQRIRDQAWDDVVRKEKPKEDAYEYKKRLTLDHEKSKLSLAEIYEQEYIKLNQQKTAEEENPEHVEIQKMMDSLFLKLDALSNFHFIPKPPVPEIKVVSNLPAITMEEVAPVSEKNKAGDIKTAAEKTATDKKRERRKKKYQKRMKIKEKEKRRKLLEKSSVDQAGKYSKTVASEKLKQLTKTGKASFIKDEGKDKALKSSQAFFSKLQDQVKMQINDAKKTEKKKKKRQDISVHKLKL

SEQ ID NO: 884383 - protein, 668 aa, Homo sapiens [sequence omitted]

SEQ ID NO: 884384 - protein, 112 aa, Homo sapiens [sequence omitted]

SEQ ID NO: 884385 - protein, 441 aa, Homo sapiens
PKKCLCRREGYGYRECPGPLWPSLSPLPEWQVMDLGRDATRRFFNWFYWSINLGAVLSLLVVAFIQQIGEVLYNAAPLSIWWQIPQYLLIGISEIFASIPGLEFAYSEAPRSSKPPMGSQVSSMLKLALQNCCPQLWQRHSARDRQCARVLADERSPQPGASPQEDIANFQVLVKILPVMVTLVPYWMVYFQMQSTYVLQGLHLHIPNIFPANPANISVALRAQGSSYTIPEAWLLLANVVVVLILVPLKDRLIDPLLLRCKLLPSALQKMALGMFFGFTSVIVAGVLEMERLHYIHHNETVSQQIGEVLYNAAPLSIWWQIPQYLLIGISEIFASIPGLEFAYSEAPRSMQGAIMGIFFCLSGVGSLLGSSLVALLSLPGGWLHCPKDFGNINNCRMDLYFFLLAGIQAVTALLFVWIAGRYERASQGPASHSRFSRDRG

SEQ ID NO: 884386 - protein, 581 aa, Homo sapiens
MPAPRAREQPRVPGERQPLLPRGARGPRRWRRAAGAAVLLVEMLERAAFFGVTANLVLYLNSTNFNWTGEQATRAALVFLGASYLLAPVGGWLADVYLGRYRAVALSLLLYLAASGLLPATAFPDGRSSFCGEMPASPLGPACPSAGCPRSSPSPYCAPVLYAGLLLLGLAASSVRSNLTSFGADQVMDLGRDATRRFFNWFYWSINLGAVLSLLVVAFIQQNISFLLGYSIPVGCVGLAFFIFLFATPVFITKPPMGSQVSSMLKLALQNCCPQLWQRHSARDRQCARVLADERSPQPGASPQEDIANFQVLVKILPVMVTLVPYWMVYFQMQSTYVLQGLHLHIPNIFPANPANISVALRAQGSSYTIPEAWLLLANVVVVLILVPLKDRLIDPLLLRCKLLPSALQKMALGMFFGFTSVIVAGVLEMERLHYIHHNETVSQQIGEVLYNAAPLSIWWQIPQYLLIGISEIFASIPGLEFAYSEAPRSMQGAIMGIFFCLSGVGSLLGSSLVALLSLPGGWLHCPKDFGNINNCRMDLYFFLLAGIQAVTALLFVWIAGRYERASQGPASHSRFSRDRG

SEQ ID NO: 884387 - protein, 535 aa, Homo sapiens
MPAPRAREQPRVPGERQPLLPRGARGPRRWRRAAGAAVLLVEMLERAAFFGVTANLVLYLNSTNFNWTGEQATRAALVFLGASYLLAPVGGWLADVYLGRYRAVALSLLLYLAASGLLPATAFPDGRSSFCGEMPASPLGPACPSAGCPRSSPSPYCAPVLYAGLLLLGLAASSVRSNLTSFGADQVMDLGRDATRRFFNWFYWSINLGAVLSLLVVAFIQQNISFLLGYSIPVGCVGLAFFIFLFATPVFITKPPMGSQVSSMLKLALQNCCPQLWQRHSARDRQCARVLADERSPQPGASPQEDIANFQVLVKILPVMVTLVPYWMVYFQMQSTYVLQGLHLHIPNIFPANPANISVALRAQGSSYTIPEAWLLLANVVVVLILVPLKDRLIDPLLLRCKLLPSALQKMALGMFFGFTSVIVAGVLEMERLHYIHHNETVSQQIGEVLYNAAPLSIWWQIPQYLLIGISEIFASIPGLEFAYSEAPRSMQGAIMGIFFCLSGVGSLLGSSLVALLSLPGGWLHCPKDFAEEEL

SEQ ID NO: 884388 - protein, 581 aa, Homo sapiens; identical to SEQ ID NO: 884386

SEQ ID NO: 884389 - protein, 525 aa, Homo sapiens
MPAPRAREQPRVPGERQPLLPRGARGPRRWRRAAGAAVLLVEMLERAAFFGVTANLVLYLNSTNFNWTGEQATRAALVFLGASYLLAPVGGWLADVYLGRYRAVALSLLLYLAASGLLPATAFPDGRSSFCGEMPASPLGPACPSAGCPRSSPSPYCAPVLYAGLLLLGLAASSVRSNLTSFGADQVMDLGRDATRRFFNWFYWSINLGAVLSLLVVAFIQQNISFLLGYSIPVGCVGLAFFIFLFATPVFITKPPMGSQVSSMLKLALQNCCPQLWQRHSARDRQCARVLADERSPQPGASPQEDIANFQVLVKILPVMVTLVPYWMVYFQDAVHLCPAGSSPPHPKHFPSQPGQHLCGPESPGQQLHGVLEMERLHYIHHNETVSQQIGEVLYNAAPLSIWWQIPQYLLIGISEIFASIPGLEFAYSEAPRSMQGAIMGIFFCLSGVGSLLGSSLVALLSLPGGWLHCPKDFGNINNCRMDLYFFLLAGIQAVTALLFVWIAGRYERASQGPASHSRFSRDRG

SEQ ID NO: 884390 - protein, 249 aa, Homo sapiens
MQSTYVLQGLHLHIPNIFPANPANISVALRAQGSSYTIPEAWLLLANVVVVLILVPLKDRLIDPLLLRCKLLPSALQKMALGMFFGFTSVIVAGVLEMERLHYIHHNETVSQQIGEVLYNAAPLSIWWQIPQYLLIGISEIFASIPGLEFAYSEAPRSMQGAIMGIFFCLSGVGSLLGSSLVALLSLPGGWLHCPKDFGNINNCRMDLYFFLLAGIQAVTALLFVWIAGRYERASQGPASHSRFSRDRG

SEQ ID NO: 884391 - protein, 144 aa, Homo sapiens
ARGYELPDGQVITIGNERFRCPEALFQPSFLGMESCGIHETTFNSIMKCDVDIRKDLYANTVLSGGTTMYPGIADRMQKEITALAPSTMKIKIIAPPHLLEGGPLALLVAAETAVKCEVLCLLAARGDEAGRHGSEGCQFCASQ

SEQ ID NO: 884392 - protein, 148 aa, Homo sapiens
MEVKDANSALLSNYEVFQLLTDLKEQRKESGKNKHSSGQQNLNTITYETLKYISKTPCRHQSPEIVREFLTALKSHKLTKAEKLQLLNHRPVTAVEIQLMVEESEERLTEEQIEALLHTVTSILPAEPEAEQKKNTNSNVAMDEEDPA

SEQ ID NO: 884393 - protein, 144 aa, Homo sapiens; identical to SEQ ID NO: 884391

SEQ ID NO: 884394 - protein, 144 aa, Homo sapiens; identical to SEQ ID NO: 884391

SEQ ID NO: 884395 - protein, 144 aa, Homo sapiens; identical to SEQ ID NO: 884391

SEQ ID NO: 884396 - protein, 162 aa, Homo sapiens
MPVKEEKEEEEEEETARKDANSALLSNYEVFQLLTDLKEQRKESGKNKHSSGQQNLNTITYETLKYISKTPCRHQSPEIVREFLTALKSHKLTKAEKLQLLNHRPVTAVEIQLMVEESEERLTEEQIEALLHTVTSILPAEPEAEQKKNTNSNVAMDEEDPA

SEQ ID NO: 884397 - protein, 66 aa, Homo sapiens
RGSGSAKLPACSAAIPASTLARGAGTLALLVAAETAVKCEVLCLLAARGDEAGRHGSEGCQFCASQ

SEQ ID NO: 884398 - protein, 108 aa, Homo sapiens
MKLIRTWSTKGDTSIFPAVHQSPEIVREFLTALKSHKLTKAEKLQLLNHRPVTAVEIQLMVEESEERLTEEQIEALLHTVTSILPAEPEAEQKKNTNSNVAMDEEDPA

SEQ ID NO: 884399 - protein, 115 aa, Homo sapiens
MEVKDANSALLSNYETLKYISKTPCRHQSPEIVREFLTALKSHKLTKAEKLQLLNHRPVTAVEIQLMVEESEERLTEEQIEALLHTVTSILPAEPEAEQKKNTNSNVAMDEEDPA

SEQ ID NO: 884400 - protein, 115 aa, Homo sapiens; identical to SEQ ID NO: 884399

SEQ ID NO: 884401 - protein, 249 aa, Homo sapiens
ARGYELPDGQVITIGNERFRCPEALFQPSFLGMESCGIHETTFNSIMKCDVDIRKDLYANTVLSGGTTMYPGIADRMQKEITALAPSTMKIKIIAPPHLLEGGPLALLVAAETAVKCEVLCLLAARGDEAGRHGSVSLLGRVPFRPRSPTVCPLRAESREPWGLGDPRTGVRAAGRPCPGGPRGGDGDERDSRFALPNLRFPSTPCLVRGRALPCPAAFQCAPSFSHSFTSVSGSQCGGGAQSGIRPRT

SEQ ID NO: 884402 - protein, 144 aa, Homo sapiens; identical to SEQ ID NO: 884391

SEQ ID NO: 884403 - protein, 144 aa, Homo sapiens; identical to SEQ ID NO: 884391

SEQ ID NO: 884404 - protein, 144 aa, Homo sapiens; identical to SEQ ID NO: 884391

SEQ ID NO: 884405 - protein, 144 aa, Homo sapiens; identical to SEQ ID NO: 884391

SEQ ID NO: 884406 - protein, 154 aa, Homo sapiens
PPPPGFKRFSCLSLLSELGLQVFQLLTDLKEQRKESGKNKHSSGQQNLNTITYETLKYISKTPCRHQSPEIVREFLTALKSHKLTKAEKLQLLNHRPVTAVEIQLMVEESEERLTEEQIEALLHTVTSILPAEPEAEQKKNTNSNVAMDEEDPA

SEQ ID NO: 884407 - protein, 67 aa, Homo sapiens
CMEFRDEPPGVTAVEIQLMVEESEERLTEEQIEALLHTVTSILPAEPEAEQKKNTNSNVAMDEEDPA

SEQ ID NO: 884408 - protein, 144 aa, Homo sapiens; identical to SEQ ID NO: 884391

SEQ ID NO: 884409 - protein, 233 aa, Homo sapiens [sequence omitted]

SEQ ID NO: 884410 - protein, 233 aa, Homo sapiens [sequence omitted]

SEQ ID NO: 884411 - protein, 82 aa, Homo sapiens
WGGPESSDKGDPFATCLHVPAPKPRPDSWGEDNWEGLETDSRQVKAELARKKREERRREMEAKRAERKVAKGPMKLGARKLD

SEQ ID NO: 884412 - protein, 201 aa, Homo sapiens
MTLRPSLLPLHLLLLLLLSAAVCRAEAGLETESPVRTLQVETLVEPPEPCAEPAAFGDTLHIHYTGSLVDGRIIDTSLTRDPLVIELGQKQVIPGLEQSLLDMCVGEKRRAIIPSHLAYGKRGFPPSVPADAVVQYDVELIALIRANYWLKLVKGILPLVGMAMVPALLGLIGYHLYRKANRPKVSKKKLKEEKRNKSKKK

SEQ ID NO: 884413 - protein, 139 aa, Homo sapiens
MTLRPSLLPLHLLLLLLLSAAVCRAEAGLETESPVRTLQVETLVEPPEPCAEPAAFGDTLHIHYTGSLVDGRIIDTSLTRDPLVIELGQKQVIPGLEQSLLDMCVGWKNSCFGCEDSGGFAEGASAGLRLLAYLSCLWL

SEQ ID NO: 884414 - protein, 146 aa, Homo sapiens
MTLRPSLLPLHLLLLLLLSAAVCRAEAGLETESPVRTLQVETLVEPPEPCAEPAAFGDTLHIHYTGSLVDGRIIDTSLTRDPLVIELGQKQVIPGLEQSLLDMCVGEKRRAIIPSHLAYGKRGFPPSVPGTKDNLMRPPGMTSSSQ

SEQ ID NO: 884415 - protein, 106 aa, Homo sapiens
MTLRPSLLPLHLLLLLLLSAAVCRAEAGLETESPVRTLQVETLVEPPEPCAEPAAFGDTLHIHYTGSLVDGRIIDTSLTRDPLVIELGQKQVIPGLEQSLLDMCVG

SEQ ID NO: 884416 - protein, 168 aa, Homo sapiens
SKLASSYLARRSAGWRDLREAPAFWGFLFLTAGSLVDGRIIDTSLTRDPLVIELGQKQVIPGLEQSLLDMCVGEKRRAIIPSHLAYGKRGFPPSVPADAVVQYDVELIALIRANYWLKLVKGILPLVGMAMVPALLGLIGYHLYRKANRPKVSKKKLKEEKRNKSKKK

SEQ ID NO: 884417 - protein, 182 aa, Homo sapiens
MTLRPSLLPLHLLLLLLLSAAVCRAEAGLETESPVRTLQVETLVEPPEPCAEPAAFGDTLHIHYTGSLVDGRIIDTSLTRDPLVIELGQKQVIPGLEQSLLDMCVGEKRRAIIPSHLAYGKRGFPPSVPDGVSLLLPRLECNSAIFTHHNLRHPGSSNSPVSASRVAGITGMRHHDRLILYF

SEQ ID NO: 884418 - protein, 146 aa, Homo sapiens
MYALDALSPQGSLVDGRIIDTSLTRDPLVIELGQKQVIPGLEQSLLDMCVGEKRRAIIPSHLAYGKRGFPPSVPADAVVQYDVELIALIRANYWLKLVKGILPLVGMAMVPALLGLIGYHLYRKANRPKVSKKKLKEEKRNKSKKK

SEQ ID NO: 884419 - protein, 139 aa, Homo sapiens; identical to SEQ ID NO: 884413

SEQ ID NO: 884420 - protein, 163 aa, Homo sapiens
GGGGESQSFRAQDGTRTPATDCLMYLQGPRKLMTQGGYDMVQKLFLDFFRRRLSQRPTAEELEQRNILKPRNEQEEQEEKREIKRRLTRKLSQRPTVEELRERKILIRFSDYVEVADAQDYDRRADKPWTRLTAADKVSRGECWRVGGRTVCWVSLGSPLGSV

SEQ ID NO: 884421 - protein, 71 aa, Homo sapiens
GGGGESQSFRAQDGTRTPATDCLMYLQGPRKLMTQGGYDMVQKLFLDFFRRRLSQRPTAEELEQRNILKRK

SEQ ID NO: 884422 - protein, 167 aa, Homo sapiens
GGGGESQSFRAQDGTRTPATDCLMYLQGPRKLMTQGGYDMVQKLFLDFFRRRLSQRPTAEELEQRNILKPRNEQEEQEEKREIKRRLTRKLSQRPTVEELRERKILIRFSDYVEVADAQDYDRRADKPWTRLTAADKAAIRKELNEFKSTEMEVHELSRHLTRFHRP

SEQ ID NO: 884423 - protein, 534 aa, Homo sapiens
MAASSEDDIDRRPIRRVRSKSDTPYLAEARISFNLGAAEEVERLAAMRSDSLVPGTHTPPIRRRSKFANLGRIFKPWKWRKKKSEKFKHTSAALERKISMRQSREELIKRGVLKEIYDKDGELSISNEEDSLENGQSLSSSQLSLPALSEMEPVPMPRDPCSYEVLQPSDIMDGPDPGAPVKLPCLPVKLSPPLPPKKVMICMPVGGPDLSLVSYTAQKSGQQGVAQHHHTVLPSQIQHQLQYGSHGQHLPSTTGSLPMHPSGCRMIDELNKTLAMTMQRLESSEQRVPCSTSYHSSGLHSGDGVTKAGPMGLPEIRQVPTVVIECDDNKENVPHESDYEDSSCLYTREEEEEEEDEDDDSSLYTSSLAMKVCRKDSLAIKLSNRPSKRELEEKNILPRQTDEERLELRQQIGTKLTRRLSQRPTAEELEQRNILKPRNEQEEQEEKREIKRRLTRKLSQRPTVEELRERKILIRFSDYVEVADAQDYDRRADKPWTRLTAADKAAIRKELNEFKSTEMEVHELSRHLTRFHRP

SEQ ID NO: 884424 - protein, 167 aa, Homo sapiens; identical to SEQ ID NO: 884422

SEQ ID NO: 884425 - protein, 274 aa, Homo sapiens
MDPSCQMGGHLVHAEEVERLAAMRSDSLVPGTHTPPIRRRSKFANLGRIFKPWKWRKKKSEKFKHTSAALERKISMRQSREELIKRGVLKEIYDKDGELSISNEEDSLENGQSLSSSQLSLPALSEMEPVPMPRDPCSYEVLQPSDIMDGPVSEESPSASESGVLLSQDPSAKPVLLLPPKKPAAFPGDHEETPVKQLPLLKQPPALPPKPTTRIANHLTDWHQAHQVGQRHPLPPWQWAFSSPGSSKRIQSRPGAVAYACNPSTLGGRGRWIT

SEQ ID NO: 884426 - protein, 104 aa, Homo sapiens
PVKLPCLPVKLSPPLPPKKVMICMPVGGPDLSLVSYTAQKSGQQGVAQHHHTVLPSQIQHQLQYGSHGQHLPSTTGSLPMHPSGCRMIDELNKTLAMTMQRLER

SEQ ID NO: 884427 - protein, 484 aa, Homo sapiens
MDYPKMDYFLDVESAHRLLDVESAQRFFYSQGAQARRATLLLPPTLMAASSEDDIDRRPIRRVRSKSDTPYLAEARISFNLGAAEEVERLAAMRSDSLVPGTHTPPIRRRSKFANLGRIFKPWKWRKKKSEKFKHTSAALERKISMRQSREELIKRGVLKEIYDKDGELSISNEEDSLENGQSLSSSQLSLPALSEMEPVPMPRDPCSYEVLQPSDIMDGPDPGAPVKLPCLPVKLSPPLPPKKVMICMPVGGPDLSLVSYTAQKSGQQGVAQHHHTVLPSQIQHQLQYGSHGQHLPSTTGSLPMHPSGCRMIDELNKTLAMTMQRLESSEQRVPCSTSYHSSGLHSGDGVTKAGPMGLPEIRQVPTVVIECDDNKENVPHESDYEDSSCLYTREEEEEEEDEDDDSSLYTSSLAMKVCRKDSLAIKLSNRPSKRELEEKNILPRQTDEERLELRQQIGTKLTRRLSQRPTAEELEQRNILKRK

SEQ ID NO: 884428 - protein, 169 aa, Homo sapiens
MDYPKMDYFLDVESAHRLLDVESAQRFFYSQGAQARRATLLLPPTLMAASSEDDIDRRPIRRVRSKSDTPYLAEARISFNLGAGVSLFGDMDEARMGPAVPTLGRPLGLELCSLENHGLLKTAPTYTTSAHICSGPSTGGQFSTQGMSPVQGAKRRRVVWLPLEGEEFG

SEQ ID NO: 884429 - protein, 510 aa, Homo sapiens
MDPSCQMGGHLVHAEEVERLAAMRSDSLVPGTHTPPIRRRSKFANLGRIFKPWKWRKKKSEKFKHTSAALERKISMRQSREELIKRGVLKEIYDKDGELSISNEEDSLENGQSLSSSQLSLPALSEMEPVPMPRDPCSYEVLQPSDIMDGPDPGAPVKLPCLPVKLSPPLPPKKVMICMPVGGPDLSLVSYTAQKSGQQGVAQHHHTVLPSQIQHQLQYGSHGQHLPSTTGSLPMHPSGCRMIDELNKTLAMTMQRLESSEQRVPCSTSYHSSGLHSGDGVTKAGPMGLPEIRQVPTVVIECDDNKENVPHESDYEDSSCLYTREEEEEEEDEDDDSSLYTSSLAMKVCRKDSLAIKLSNRPSKRELEEKNILPRQTDEERLELRQQIGTKLTRRLSQRPTAEELEQRNILKPRNEQEEQEEKREIKRRLTRKLSQRPTVEELRERKILIRFSDYVEVADAQDYDRRADKPWTRLTAADKAAIRKELNEFKSTEMEVHELSRHLTRFHRP

SEQ ID NO: 884430 - protein, 526 aa, Homo sapiens
MDPSCQMGGHLVHAEEVERLAAMRSDSLVPGTHTPPIRRRSKFANLGRIFKPWKWRKKKSEKFKHTSAALERKISMRQSREELIKRGVLKEIYDKDGELSISNEEDSLENGQSLSSSQLSLPALSEMEPVPMPRDPCSYEVLQPSDIMDGPDPGAPVKLPCLPVKLSPPLPPKKVMICMPVGGPDLSLVSYTAQKSGQQGVAQHHHTVLPSQIQHQLQYGSHGQHLPSTTGSLPMHPSGCRMIDELNKTLAMTMQRLESSEQRVPCSTSYHSSGLHSGDGVTKAGPMGLPEIRQVPTVVIECDDNKENVPHESDYEDSSCLYTREEEEEEEDEDDDSSLYTSSLAMKVCRKDSLAIKLSNRPSKRELEEKNILPRQTDEERLELRQQIGTKLTRRLSQRPTAEELEQRNILKPRNEQEEQEEKREIKRRLTRKLSQRPTVEELRERKILIRFSDYVEVADAQDYDRRADKPWTRLTAADKAAIRKELNEFKSTEMEVHELSRHLTRLVLRVFFFLFFPQVAIFISK

SEQ ID NO: 884431 - protein, 101 aa, Homo sapiens
RWSLTLSPGLECNGAISAHYNLCLPGSSNSPASASQVVEITDVMGPAFSTSSWAAHNSHLCTCHIPHLVENTQKVLSPPPLGVSPNDCIGGPYFCHRASWP

SEQ ID NO: 884432 - protein, 453 aa, Homo sapiens
MAGAAAGGRGGGAWGPGRGGAGGLRRGCSPPAPAGSPRAGLQPLRATIPFQLQQPHQRRDGGGRAASVPCSVAPEKSVCRPQPLQVRRTFSLDTILSSYLLGQWPRDADGAFTCCTNDKATQTPLSWQELEGERASSCAHKRSASWGSTDHRKEISKLKQQLQRTKLSRSGKEKERGSPLLGDHAVRGALRASPPSFPSGSPVLRLSPCLHRSLEGLNQELEEVFVKEQGEEELLRILDIPDGHRAPAPPQSGSCDHPLLLLEPGNLASSPSMSLASPQPCGLASHEEHRGAAEELASTPNDKASSPGHPAFLEDGSPSPVLAFAASPRPNHSYIFKREPPEGCEKVRVFEEATSPGPDLAFLTSCPDKNKVHFNPTGSAFCPVNLMKPLFPGMGFIFRNCPSNPGSPLPPASPRPPPRKDPEASKASPLPFEPWQRTPPSEEPVLFQSSLMV

SEQ ID NO: 884433 - protein, 421 aa, Homo sapiens
GKFDPFGEASGRHFEVGQKVTPVVEPGANHFLLPSVPCSVAPEKSVCRPQPLQVRRTFSLDTILSSYLLGQWPRDADGAFTCCTNDKATQTPLSWQELEGERASSCAHKRSASWGSTDHRKEISKLKQQLQRTKLSRSGKEKERGSPLLGDHAVRGALRASPPSFPSGSPVLRLSPCLHRSLEGLNQELEEVFVKEQGEEELLRILDIPDGHRAPAPPQSGSCDHPLLLLEPGNLASSPSMSLASPQPCGLASHEEHRGAAEELASTPNDKASSPGHPAFLEDGSPSPVLAFAASPRPNHSYIFKREPPEGCEKVRVFEEATSPGPDLAFLTSCPDKNKVHFNPTGSAFCPVNLMKPLFPGMGFIFRNCPSNPGSPLPPASPRPPPRKDPEASKASPLPFEPWQRTPPSEEPVLFQSSLMV

SEQ ID NO: 884434 - protein, 419 aa, Homo sapiens
VTVEPKQAASPANQYGFQTFQRPINKNASDPASVPCSVAPEKSVCRPQPLQVRRTFSLDTILSSYLLGQWPRDADGAFTCCTNDKATQTPLSWQELEGERASSCAHKRSASWGSTDHRKEISKLKQQLQRTKLSRSGKEKERGSPLLGDHAVRGALRASPPSFPSGSPVLRLSPCLHRSLEGLNQELEEVFVKEQGEEELLRILDIPDGHRAPAPPQSGSCDHPLLLLEPGNLASSPSMSLASPQPCGLASHEEHRGAAEELASTPNDKASSPGHPAFLEDGSPSPVLAFAASPRPNHSYIFKREPPEGCEKVRVFEEATSPGPDLAFLTSCPDKNKVHFNPTGSAFCPVNLMKPLFPGMGFIFRNCPSNPGSPLPPASPRPPPRKDPEASKASPLPFEPWQRTPPSEEPVLFQSSLMV

SEQ ID NO: 884435 - protein, 397 aa, Homo sapiens
HNDSCLISQTSVPCSVAPEKSVCRPQPLQVRRTFSLDTILSSYLLGQWPRDADGAFTCCTNDKATQTPLSWQELEGERASSCAHKRSASWGSTDHRKEISKLKQQLQRTKLSRSGKEKERGSPLLGDHAVRGALRASPPSFPSGSPVLRLSPCLHRSLEGLNQELEEVFVKEQGEEELLRILDIPDGHRAPAPPQSGSCDHPLLLLEPGNLASSPSMSLASPQPCGLASHEEHRGAAEELASTPNDKASSPGHPAFLEDGSPSPVLAFAASPRPNHSYIFKREPPEGCEKVRVFEEATSPGPDLAFLTSCPDKNKVHFNPTGSAFCPVNLMKPLFPGMGFIFRNCPSNPGSPLPPASPRPPPRKDPEASKASPLPFEPWQRTPPSEEPVLFQSSLMV

SEQ ID NO: 884436 - protein, 343 aa, Homo sapiens [sequence omitted]

SEQ ID NO: 884437 - protein, 421 aa, Homo sapiens
MAGAAAGGRGGGAWGPGRGGAGGLRRGCSPPAPAGSPRAGLQPLRATIPFQLQQPHQRRDGGGRAASVPCSVAPEKSVCRPQPLQVRRTFSLDTILSSYLLGQWPRDADGAFTCCTNDKATQISKLKQQLQRTKLSRSGKEKERGSPLLGDHAVRGALRASPPSFPSGSPVLRLSPCLHRSLEGLNQELEEVFVKEQGEEELLRILDIPDGHRAPAPPQSGSCDHPLLLLEPGNLASSPSMSLASPQPCGLASHEEHRGAAEELASTPNDKASSPGHPAFLEDGSPSPVLAFAASPRPNHSYIFKREPPEGCEKVRVFEEATSPGPDLAFLTSCPDKNKVHFNPTGSAFCPVNLMKPLFPGMGFIFRNCPSNPGSPLPPASPRPPPRKDPEASKASPLPFEPWQRTPPSEEPVLFQSSLMV

SEQ ID NO: 884438 - protein, 438 aa, Homo sapiens
MAGAAAGGRGGGAWGPGRGGAGGLRRGCSPPAPAGSPRAGLQPLRATIPFQLQQPHQRRDGGGRAASVPCSVAPEKSVCRPQPLQVRRTFSLDTILSSYLLGQWPRDADGAFTCCTNDKATQTPLSWQELEGERASSCAHKRSASWGSTDHRKEISKLKQQLQRTKLSRSGKEKERGSPLLGDHAVRGALRASPPSFPSGSPVLRLSPCLHRSLEGLNQELEEVFVKEQGEEELLRILDIPDGHRAPAPPQSGSCDHPLLLLEPGNLASSPSMSLASPQPCGLASHEEHRGAAEELASTPNDKASSPGHPAFLEDGSPSPVLAFAASPRPNHSYIFKREPPEGCEKVRVFEEATSPGPDLAFLTSCPDKNKVHFNPTGSAFCPVNLMKPLFPGMGFIFRNCPSLSAFEHFLSLTVSKPWVLFLMGTGPSERDGTCLLH

SEQ ID NO: 884439 - protein, 453 aa, Homo sapiens; identical to SEQ ID NO: 884432

SEQ ID NO: 884440 - protein, 332 aa, Homo sapiens
MPSSPGQGKKDWSLFRMFSRTLTEPCPLASESRVYVDITTYNQDNETLEVHPPPTTTYQDVILGTRKTYAIYDLLDTAMINNSRNLNIQLKWKRPPENEAPPVPFLHAQRYVSGYGLQKGELSTLLYNTHPYRAFPVLLLDTVPWYLRLYVHTLTITSKGKENKPSYIHYQPAQDRLQPHLLEMLIQLPANSVTKVSIQFERALLKWTEYTPDPNHGFYVSPSVLSALVPSMVAAKPVDWEESPLFNSLFPVSDGSNYFVRLYTEPLLVNLPTPDFSMPYNVICLTCTVVAVCYGSFYNLLTRTFHIEEPRTGGLAKRLANLIRRARGVPPL

SEQ ID NO: 884441 - protein, 332 aa, Homo sapiens; identical to SEQ ID NO: 884440

SEQ ID NO: 884442 - protein, 332 aa, Homo sapiens; identical to SEQ ID NO: 884440

SEQ ID NO: 884443 - protein, 332 aa, Homo sapiens; identical to SEQ ID NO: 884440

SEQ ID NO: 884444 - protein, 318 aa, Homo sapiens
MAAAMPLALLVLLLLGPGGWCLAEPPRDSLREELVITPLPSGDVAATFQFRTRWDSELQREGVSHYRLFPKALGQLISKYSLRELHLSFTQGFWRTRYWGPPFLQAPSGAELWVWFQDTVTDVDKSWKELSNVLSGIFCASLNFIDSTNTVTPTASFKPLGLANDTDHYFLRYAVLPREVVCTENLTPWKKLLPCSSKAGLSVLLKADRLFHTSYHSQAVHIRPVCRNARCTSISWELRQTLSVVFDAFITGAGKERLVPLPDVLPNPHGALPPGFREPSLCGHHHLQPGQRDIRGAPTPDHYISGRHPRHSEDLCHL

SEQ ID NO: 884445 - protein, 265 aa, Homo sapiens
MPSSPGQGKKDWSLFRMFSRTLTEPCPLASESRVYVDITTYNQDNETLEVHPPPTTTYQDVILGTRKTYAIYDLLDTAMINNSRNLNIQLKWKRPPENGYIHYQPAQDRLQPHLLEMLIQLPANSVTKVSIQFERALLKWTEYTPDPNHGFYVSPSVLSALVPSMVAAKPVDWEESPLFNSLFPVSDGSNYFVRLYTEPLLVNLPTPDFSMPYNVICLTCTVVAVCYGSFYNLLTRTFHIEEPRTGGLAKRLANLIRRARGVPPL

SEQ ID NO: 884446 - protein, 318 aa, Homo sapiens; identical to SEQ ID NO: 884444

SEQ ID NO: 884447 - protein, 280 aa, Homo sapiens
MPSSPGQGKKDWSLFRMFSRTLTEPCPLASESRVYVDITTYNQDNETLEVHPPPTTTYQDVILGTRKTYAIYDLLDTAMINNSRNLNIQLKWKRPPENEAPPVPFLHAQRYVSGYGLQKGELSTLLYNTHPYRAFPVLLLDTVPWYLRLYVHTLTITSKGKENKPSYIHYQPAQDRLQPHLLEMLIQLPANSVTKVSIQFERALLKWTEYTPDPNHGFYVSPSVLSALVPSMVAAKPVDWEESPLFNSLFPVSDGSNYFVRLYTEPLLVNLPTPDFSKQV

SEQ ID NO: 884448 - protein, 253 aa, Homo sapiens
MPSSPGQGKKDWSLFRMFSRTLTEPCPLASESRVYVDITTYNQDNETLEVHPPPTTTYQDVILGTRKTYAIYDLLDTAMINNSRNLNIQLKWKRPPENEAPPVPFLHAQRYVSGYGLQKGELSTLLYNTHPYRAFPVLLLDTVPWYLRLYVHTLTITSKGKENKPSYIHYQPAQDRLQPHLLEMLIQLPANSVTKVSIQFERALLKWTEYTPDPNHGFYVSPSVLSALVPSMVAAKPVDWEESPLFNSLLPWT

SEQ ID NO: 884449 - protein, 313 aa, Homo sapiens
MPSSPGQGKKDWSLFRMFSRTLTEPCPLASESRVYVDITTYNQDNETLEVHPPPTTTYQDVILGTRKTYAIYDLLDTAMINNSRNLNIQLKWKRPPENEAPPVPFLHAQRYVSGYGLQKGELSTLLYNTHPYRAFPVLLLDTVPWYLRLYVHTLTITSKGKENKPSYIHYQPAQDRLQPHLLEMLIQLPANSVTKVSIQFERALLKWTEYTPDPNHGFYVSPSVLSALVPSMVAAKPVDWEESPLFNSLFGYRLGLTRVPYKWGRAWSPPKGGFRRDGRAEERPLGIEGPAQLTGNDHGGGAPVGRGIEAHPG

SEQ ID NO: 884450 - protein, 332 aa, Homo sapiens; identical to SEQ ID NO: 884440

SEQ ID NO: 884451 - protein, 332 aa, Homo sapiens; identical to SEQ ID NO: 884440

SEQ ID NO: 884452 - protein, 332 aa, Homo sapiens; identical to SEQ ID NO: 884440

SEQ ID NO: 884453 - protein, 318 aa, Homo sapiens; identical to SEQ ID NO: 884444

SEQ ID NO: 884454 - protein, 332 aa, Homo sapiens; identical to SEQ ID NO: 884440

SEQ ID NO: 884455 - protein, 332 aa, Homo sapiens; identical to SEQ ID NO: 884440

SEQ ID NO: 884456 - protein, 332 aa, Homo sapiens; identical to SEQ ID NO: 884440

SEQ ID NO: 884457 - protein, 332 aa, Homo sapiens; identical to SEQ ID NO: 884440

SEQ ID NO: 884458 - protein, 332 aa, Homo sapiens; identical to SEQ ID NO: 884440

SEQ ID NO: 884459 - protein, 332 aa, Homo sapiens; identical to SEQ ID NO: 884440

SEQ ID NO: 884460 - protein, 332 aa, Homo sapiens; identical to SEQ ID NO: 884440

SEQ ID NO: 884461 - protein, 316 aa, Homo sapiens
MFSRTLTEPCPLASESRVYVDITTYNQDNETLEVHPPPTTTYQDVILGTRKTYAIYDLLDTAMINNSRNLNIQLKWKRPPENEAPPVPFLHAQRYVSGYGLQKGELSTLLYNTHPYRAFPVLLLDTVPWYLRLYVHTLTITSKGKENKPSYIHYQPAQDRLQPHLLEMLIQLPANSVTKVSIQFERALLKWTEYTPDPNHGFYVSPSVLSALVPSMVAAKPVDWEESPLFNSLFPVSDGSNYFVRLYTEPLLVNLPTPDFSMPYNVICLTCTVVAVCYGSFYNLLTRTFHIEEPRTGGLAKRLANLIRRARGVPPL

SEQ ID NO: 884462 - protein, 384 aa, Homo sapiens
MAAAMPLALLVLLLLGPGGWCLAEPPRDSLREELVITPLPSGDVAATFQFRTRWDSELQREGDWSLFRMFSRTLTEPCPLASESRVYVDITTYNQDNETLEVHPPPTTTYQDVILGTRKTYAIYDLLDTAMINNSRNLNIQLKWKRPPENEAPPVPFLHAQRYVSGYGLQKGELSTLLYNTHPYRAFPVLLLDTVPWYLRLYVHTLTITSKGKENKPSYIHYQPAQDRLQPHLLEMLIQLPANSVTKVSIQFERALLKWTEYTPDPNHGFYVSPSVLSALVPSMVAAKPVDWEESPLFNSLFPVSDGSNYFVRLYTEPLLVNLPTPDFSMPYNVICLTCTVVAVCYGSFYNLLTRTFHIEEPRTGGLAKRLANLIRRARGVPPL

SEQ ID NO: 884463 - protein, 483 aa, Homo sapiens
MAAAMPLALLVLLLLGPGGWCLAEPPRDSLREELVITPLPSGDVAATFQFRTRWDSELQREGDTDHYFLRYAVLPREVVCTENLTPWKKLLPCSSKAGLSVLLKADRLFHTSYHSQAVHIRPVCRNARCTSISWELRQTLSVVFDAFITGAGKERLVPLPDVLPNPHGALPPGFREPSLCGHHHLQPALPLCPQDNETLEVHPPPTTTYQDVILGTRKTYAIYDLLDTAMINNSRNLNIQLKWKRPPENEAPPVPFLHAQRYVSGYGLQKGELSTLLYNTHPYRAFPVLLLDTVPWYLRLYVHTLTITSKGKENKPSYIHYQPAQDRLQPHLLEMLIQLPANSVTKVSIQFERALLKWTEYTPDPNHGFYVSPSVLSALVPSMVAAKPVDWEESPLFNSLFPVSDGSNYFVRLYTEPLLVNLPTPDFSMPYNVICLTCTVVAVCYGSFYNLLTRTFHIEEPRTGGLAKRLANLIRRARGVPPL

SEQ ID NO: 884464 - protein, 344 aa, Homo sapiens
TQSLFGGLFTLTCMKFGAVTRIGGPPLGDQSPVLLLFAPEKDPPTTSGPQTDQPKDNETLEVHPPPTTTYQDVILGTRKTYAIYDLLDTAMINNSRNLNIQLKWKRPPENEAPPVPFLHAQRYVSGYGLQKGELSTLLYNTHPYRAFPVLLLDTVPWYLRLYVHTLTITSKGKENKPSYIHYQPAQDRLQPHLLEMLIQLPANSVTKVSIQFERALLKWTEYTPDPNHGFYVSPSVLSALVPSMVAAKPVDWEESPLFNSLFPVSDGSNYFVRLYTEPLLVNLPTPDFSMPYNVICLTCTVVAVCYGSFYNLLTRTFHIEEPRTGGLAKRLANLIRRARGVPPL

SEQ ID NO: 884465 - protein, 243 aa, Homo sapiens
VNLLIFLYTEAPPVPFLHAQRYVSGYGLQKGELSTLLYNTHPYRAFPVLLLDTVPWYLRLYVHTLTITSKGKENKPSYIHYQPAQDRLQPHLLEMLIQLPANSVTKVSIQFERALLKWTEYTPDPNHGFYVSPSVLSALVPSMVAAKPVDWEESPLFNSLFPVSDGSNYFVRLYTEPLLVNLPTPDFSMPYNVICLTCTVVAVCYGSFYNLLTRTFHIEEPRTGGLAKRLANLIRRARGVPPL

SEQ ID NO: 884466 - protein, 106 aa, Homo sapiens
VNLLIFLYTEAPPVPFLHAQRYVSGYGLQKGELSTLLYNTHPYRAFPVLLLDTVPWYLRLYVHTLTITSKGKENKPSEDLSPEPGPQPALSCPLQVPQTLISQGSS

SEQ ID NO: 884467 - protein, 179 aa, Homo sapiens
TLEIRKNSEVCTAGVSLGIFPMPAWRYVSERNYTSVCRSVTKVSIQFERALLKWTEYTPDPNHGFYVSPSVLSALVPSMVAAKPVDWEESPLFNSLFPVSDGSNYFVRLYTEPLLVNLPTPDFSMPYNVICLTCTVVAVCYGSFYNLLTRTFHIEEPRTGGLAKRLANLIRRARGVPPL

SEQ ID NO: 884468 - protein, 155 aa, Homo sapiens
MPTGKRTSEAHNRRQRQTDDRRGAKRRRDNQSHNWDRETRETGHTQKHTGTPSEEHGETNRTASITAGVGTSRHEPPERSHQGQQGGHRPPRNRGSKRATRAESREATRNRTRPKNADQRNTQSAHSETPVTTDSNKKKEKDKPEVRTKRHNMLN

SEQ ID NO: 884469 - protein, 265 aa, Homo sapiens; identical to SEQ ID NO: 884445

SEQ ID NO: 884470 - protein, 124 aa, Homo sapiens
GRYDGRRYEVALAPSVLSALVPSMVAAKPVDWEESPLFNSLFPVSDGSNYFVRLYTEPLLVNLPTPDFSMPYNVICLTCTVVAVCYGSFYNLLTRTFHIEEPRTGGLAKRLANLIRRARGVPPL

SEQ ID NO: 884471 - protein, 155 aa, Homo sapiens
MPTGKRTSEAHNRRQRQTDDRRGAKRRRDNQSHNWDRETRETGHTQKHTGTPSEEHGETNRTASITAGVGTSRHEPPERSHQGQQGGHRPPRNRGSKRATRAESREATRNRTRPKNADQRNTQSAHSETPVTNDSNKKKEKDKPEVRTKRHNMLN

SEQ ID NO: 884472 - protein, 418 aa, Homo sapiens
MSLLDCFCTSRTQVESLRPEKQSETSIHQYLVDEPTLSWSRPSTRASEVLCSTNVSHYELQVEIGRGFDNLTSVHLARHTPTGTLVTIKITNLENCNEERLKALQKAVILSHFFRHPNITTYWTVFTVGSWLWVISPFMAYGSASQLLRTYFPEGMSETLIRNILFGAVRGLNYLHQNGCIHRSIKASHILISGDGLVTLSGLSHLHSLVKHGQRHRAVYDFPQFSTSVQPWLSPELLRQDLHGYNVKSDIYSVGITACELASGQVPFQDMHRTQMLLQKLKGPPYSPLDISIFPQSESRMKNSQSGVDSGIGESVLVSSGTHTVNSDRLHTPSSKTFSPAFFSLVQLCLQQDPEKRPSASSLLSHVFFKQMKEESQDSILSLLPPAYNKPSISLPPVLPWTEPECDFPDEKDSYWEF

SEQ ID NO: 884473 - protein, 418 aa, Homo sapiens; identical to SEQ ID NO: 884472

SEQ ID NO: 884474 - protein, 418 aa, Homo sapiens; identical to SEQ ID NO: 884472

SEQ ID NO: 884475 - protein, 418 aa, Homo sapiens; identical to SEQ ID NO: 884472

SEQ ID NO: 884476 - protein, 373 aa, Homo sapiens [sequence omitted]

SEQ ID NO: 884477 - protein, 285 aa, Homo sapiens
MSLLDCFCTSRTQVESLRPEKQSETSIHQYLVDEPTLSWSRPSTRASEVLCSTNVSHYELQVEIGRGFDNLTSVHLARHTPTGTLVTIKITNLENCNEERLKALQKAVILSHFFRHPNITTYWTVFTVGSWLWVISPFMAYGSASQLLRTYFPEGMSETLIRNILFGAVRGLNYLHQNGCIHRSIKASHILISGDGLVTLSGLSHLHSLVKHGQRHRAVYDFPQFSTSVQPWLSPELLRQDLHGYNVKSDIYSVGITACELASGQVPFQDMHRTQLGTALFATRS

SEQ ID NO: 884478 - protein, 363 aa, Homo sapiens
MTQTSPFYNGRGFDNLTSVHLARHTPTGTLVTIKITNLENCNEERLKALQKAVILSHFFRHPNITTYWTVFTVGSWLWVISPFMAYGSASQLLRTYFPEGMSETLIRNILFGAVRGLNYLHQNGCIHRSIKASHILISGDGLVTLSGLSHLHSLVKHGQRHRAVYDFPQFSTSVQPWLSPELLRQDLHGYNVKSDIYSVGITACELASGQVPFQDMHRTQMLLQKLKGPPYSPLDISIFPQSESRMKNSQSGVDSGIGESVLVSSGTHTVNSDRLHTPSSKTFSPAFFSLVQLCLQQDPEKRPSASSLLSHVFFKQMKEESQDSILSLLPPAYNKPSISLPPVLPWTEPECDFPDEKDSYWEF

SEQ ID NO: 884479 - protein, 263 aa, Homo sapiens
MSETLIRNILFGAVRGLNYLHQNGCIHRSIKASHILISGDGLVTLSGLSHLHSLVKHGQRHRAVYDFPQFSTSVQPWLSPELLRQDLHGYNVKSDIYSVGITACELASGQVPFQDMHRTQMLLQKLKGPPYSPLDISIFPQSESRMKNSQSGVDSGIGESVLVSSGTHTVNSDRLHTPSSKTFSPAFFSLVQLCLQQDPEKRPSASSLLSHVFFKQMKEESQDSILSLLPPAYNKPSISLPPVLPWTEPECDFPDEKDSYWEF

SEQ ID NO: 884480 - protein, 256 aa, Homo sapiens
FPARARNRAGSLAARGVLSRGQPGSAAAPRQEKQPRTPWKSRSTWACENGANTSPAKPHSKAGPRTATVAPQASRMTVKPAKAASLARNLAKRRRTYLGGAAGRSQEPEVPCAAVLPGKPGDRNCPEFPPPDRTLGCWATDAAPAAGLCGAGSEPSIAPTSCAGNLPSRPPPLLSPLLASRNPCPWHYLHLSGSHNTLAPTCFKAKLHRKRGSQPPDMASALTDRTSRAPSTYTYTSRPRALPCQRSRYRDSLTQP

SEQ ID NO: 884481 - protein, 464 aa, Homo sapiens
FPARARNRAGSLAARGVLSRGQPGSAAAPRQEKQPRTPWKSRSTWACENGANTSPAKPHSKAGPRTATVAPQASRMTVKPAKAASLARNLAKRRRTYLGGAAGRSQEPEVPCAAVLPGKPGDRNCPEFPPPDRTLGCWATDAAPAAGLCGAGSEPSIAPTSCAGNLPSRPPPLLSPLLASRNPCPWHYLHLSGSHNTLAPTCFKAKLHRKRGSQPPDMASALTDRTSRAPSTYTYTSRPRALPCQRSRYRDSLTQPDEEPMHYGNIMYDRRVIRGNTYALQTGPLLGRPDSLELQRQREARKRALARKQAQEQLRPQTPEPVEGRKHVDVQTELYLEEIADRIIEVDMECQTDAFLDRPPTPLFIPAKTGKDVATQILEGELFDFDLEVKPVLEVLVGKTIEQSLLEVMEEEELANLRASQREYEELRNSERAEVQRLEEQERRHREEKVYIIIFSFLGSLLAS

SEQ ID NO: 884482 - protein, 635 aa, Homo sapiens
FPARARNRAGSLAARGVLSRGQPGSAAAPRQEKQPRTPWKSRSTWACENGANTSPAKPHSKAGPRTATVAPQASRMTVKPAKAASLARNLAKRRRTYLGGAAGRSQEPEVPCAAVLPGKPGDRNCPEFPPPDRTLGCWATDAAPAAGLCGAGSEPSIAPTSCAGNLPSRPPPLLSPLLASRNPCPWHYLHLSGSHNTLAPTCFKAKLHRKRGSQPPDMASALTDRTSRAPSTYTYTSRPRALPCQRSRYRDSLTQPDEEPMHYGNIMYDRRVIRGNTYALQTGPLLGRPDSLELQRQREARKRALARKQAQEQLRPQTPEPVEGRKHVDVQTELYLEEIADRIIEVDMECQTDAFLDRPPTPLFIPAKTGKDVATQILEGELFDFDLEVKPVLEVLVGKTIEQSLLEVMEEEELANLRASQREYEELRNSERAEVQRLEEQERRHREEKERRKKQQWEIMHKHNETSQKIAARAFAQRYLADLLPSVFGSLRDSGYFYDPIERDIEIGFLPWLMNEVEKTMEYSMVGRTVLDMLIREVVEKRLCMYEHGEDTHQSPEPEDEPGGPGAMTESLEASEFLEQSMSQTRELLLDGGYLQRTTYDRRSSQERKFMEERELLGQDEETAMRKSLGEEELS

SEQ ID NO: 884483 - protein, 425 aa, Homo sapiens
RIPCDVECRGRIDAWSLCRFQSRDSETRPRALPCQRSRYRDSLTQPDEEPMHYGNIMYDRRVIRGNTYALQTGPLLGRPDSLELQRQREARKRALARKQAQEQLRPQTPEPVEGRKHVDVQTELYLEEIADRIIEVDMECQTDAFLDRPPTPLFIPAKTGKDVATQILEGELFDFDLEVKPVLEVLVGKTIEQSLLEVMEEEELANLRASQREYEELRNSERAEVQRLEEQERRHREEKERRKKQQWEIMHKHNETSQKIAARAFAQRYLADLLPSVFGSLRDSGYFYDPIERDIEIGFLPWLMNEVEKTMEYSMVGRTVLDMLIREVVEKRLCMYEHGEDTHQSPEPEDEPGGPGAMTESLEASEFLEQSMSQTRELLLDGGYLQRTTYDRRSSQERKFMEERELLGQDEETAMRKSLGEEELS

SEQ ID NO: 884484 - protein, 384 aa, Homo sapiens
MALNDCFLLNLEVDHFMHCNISSHSADLPVNDDWSHPGILYVIPAVYGVIILIGLIGNITLIKIFCTVKSMRNVPNLFISSLALGDLLLLITCAPVDASRYLADRWLFGRIGCKLIPFIQLTSVGVSVFTLTALSADRYKAIVRPMDIQASHALMKICLKAAFIWIISMLLAIPEAVFSDLHPFHEESTNQTFISCAPYPHSNELHPKIHSMASFLVFYVIPLSIISVYYYFIAKNLIQSAYNLPVEGNIHVKKQIESRKRLAKTVLVFVGLFAFCWLPNHVIYLYRSYHYSEVDTSMLHFVTSICARLLAFTNSCVNPFALYLLSKSFRKQFNTQLLCCQPGLIIRSHSTGRSTTCMTSLKSTNPSVATFSLINGNICHERYV

SEQ ID NO: 884485 - protein, 574 aa, Homo sapiens
MASTEGANNMPKQVEVRMHDSHLGSEEPKHRHLGLRLCDKLGKNLLLTLTVFGVILGAVCGGLLRLASPIHPDVVMLIAFPGDILMRMLKMLILPLIISSLITGLSGLDAKASGRLGTRAMVYYMSTTIIAAVLGVILVLAIHPGNPKLKKQLGPGKKNDEVSSLDAFLDLIRNLFPENLVQACFQQIQTVTKKVLVAPPPDEEANATSAVVSLLNETVTEVPEETKMVIKKGLEFKDGMNVLGLIGFFIAFGIAMGKMGDQAKLMVDFFNILNEIVMKLVIMIMWYSPLGIACLICGKIIAIKDLEVVARQLGMYMVTVIIGLIIHGGIFLPLIYFVVTRKNPFSFFAGIFQAWITALGTASSAGTLPVTFRCLEENLGIDKRVTRFVLPVGATINMDGTALYEAVAAIFIAQMNGVVLDGGQIVTVSLTATLASVGAASIPSAGLVTMLLILTAVGLPTEDISLLVAVDWLLDRMRTSVNVVGDSFGAGIVYHLSKSELDTIDSQHRVHEDIEMTKTQSIYDDMKNHRESNSNQCVYAAHNSVIVDECKVTLAANGKSADCSVEEEPWKREK

SEQ ID NO: 884486 - protein, 574 aa, Homo sapiens; identical to SEQ ID NO: 884485

SEQ ID NO: 884487 - protein, 629 aa, Homo sapiens
SRSTPLDLGPPDVGGWGGCACGDLVSSSRAISGHLYLPSTSPDPEAWGQGGEVRCQQWKDSANNMPKQVEVRMHDSHLGSEEPKHRHLGLRLCDKLGKNLLLTLTVFGVILGAVCGGLLRLASPIHPDVVMLIAFPGDILMRMLKMLILPLIISSLITGLSGLDAKASGRLGTRAMVYYMSTTIIAAVLGVILVLAIHPGNPKLKKQLGPGKKNDEVSSLDAFLDLIRNLFPENLVQACFQQIQTVTKKVLVAPPPDEEANATSAVVSLLNETVTEVPEETKMVIKKGLEFKDGMNVLGLIGFFIAFGIAMGKMGDQAKLMVDFFNILNEIVMKLVIMIMWYSPLGIACLICGKIIAIKDLEVVARQLGMYMVTVIIGLIIHGGIFLPLIYFVVTRKNPFSFFAGIFQAWITALGTASSAGTLPVTFRCLEENLGIDKRVTRFVLPVGATINMDGTALYEAVAAIFIAQMNGVVLDGGQIVTVSLTATLASVGAASIPSAGLVTMLLILTAVGLPTEDISLLVAVDWLLDRMRTSVNVVGDSFGAGIVYHLSKSELDTIDSQHRVHEDIEMTKTQSIYDDMKNHRESNSNQCVYAAHNSVIVDECKVTLAANGKSADCSVEEEPWKREK

SEQ ID NO: 884488 - protein, 563 aa, Homo sapiens
MASTEGANNMPKQVEVRMHDSHLGSEEPKHRHLGLRLCDKLGKNLLLTLTVFGVILGAVCGGLLRLASPIHPDVVMLIAFPGDILMRMLKMLILPLIISSLITGLSGLDAKASGRLGTRAMVYYMSTTIIAAVLGVILVLAIHPGNPKLKKQLGPGKKNDEVSSLDAFLDLIRNLFPENLVQACFQQIQTVTKKVLVAPPPDEEANATSAVVSLLNETVTEVPEETKMVIKKGLEFKDGMNVLGLIGFFIAFGIAMGKMGDQAKLMVDFFNILNEIVMKLVIMIMWYSPLGIACLICGKIIAIKDLEVVARQLGMYMVTVIIGLIIHGGIFLPLIYFVVTRKNPFSFFAGIFQAWITALGTASSAGTLPVTFRCLEENLGIDKRVTRFVLPVGATINMDGTALYEAVAAIFIAQMNGVVLDGGQIVTVSLTATLASVGAASIPSAGLVTMLLILTAVGLPTEDISLLVAVDWLLDRMRTSVNVVGDSFGAGIVYHLSKSELDTIDSQHRVHEDIEMTKTQSIYDDMKNHRESNSNQCVYAAHNSVIVDECKVHFPFMDIETCI

SEQ ID NO: 884489 - protein, 69 aa, Homo sapiens
ERDINQLFFRPQGFVPSAMCVKSGIPPPGAKRKSGIAELSCRHLAPGPRGPRDPPLTPPASGPHGRAGP

SEQ ID NO: 884490 - protein, 69 aa, Homo sapiens; identical to SEQ ID NO: 884489

SEQ ID NO: 884491 - protein, 690 aa, Homo sapiens
MGVRQQLALLLLLLLLLWGLGQPVWPVAVALTLRWLLGDPTCCVLLGLAMLARPWLGPWVPHGLSLAAAALALTLLPARLPPGLRWLPADVIFLAKILHLGLKIRGCLSRQPPDTFVDAFERRARAQPGRALLVWTGPGAGSVTFGELDARACQAAWALKAELGDPASLCAGEPTALLVLASQAVPALCMWLGLAKLGCPTAWINPHGRGMPLAHSVLSSGARVLVVDPDLRESLEEILPKLQAENIRCFYLSHTSPTPGVGALGAALDAAPSHPVPADLRAGITWRSPALFIYTSGTTGLPKPAILTHERVLQMSKMLSLSGATADDVVYTVLPLYHVMGLVVGILGCLDLGATCVLAPKFSTSCFWDDCRQHGVTVILYVGELLRYLCNIPQQPEDRTHTVRLAMGNGLRADVWETFQQRFGPIRIWEVYGSTEGNMGLVNYVGRCGALGKMSCLLRMLSPFELVQFDMEAAEPVRDNQGFCIPVGLGEPGLLLTKVVSQQPFVGYRGPRELSERKLVRNVRQSGDVYYNTGDVLAMDREGFLYFRDRLGDTFRWKGENVSTHEVEGVLSQVDFLQQVNVYGVCVPGCEGKVGMAAVQLAPGQTFDGEKLYQHVRAWLPAYATPHFIRIQDAMEVTSTFKLMKTRLVREGFNVGIVVDPLFVLDNRAQSFRPLTAEMYQAVCEGTWRL

SEQ ID NO: 884492 - protein, 148 aa, Homo sapiens
SRGRGHKRRLPPCRWKGENVSTHEVEGVLSQVDFLQQVNVYGVCVPGCEGKVGMAAVQLAPGQTFDGEKLYQHVRAWLPAYATPHFIRIQDAMEVTSTFKLMKTRLVREGFNVGIVVDPLFVLDNRAQSFRPLTAEMYQAVCEGTWRL

SEQ ID NO: 884493 - protein, 142 aa, Homo sapiens
ALKLVIPPGFQEFGPEHEVEGVLSQVDFLQQVNVYGVCVPGCEGKVGMAAVQLAPGQTFDGEKLYQHVRAWLPAYATPHFIRIQDAMEVTSTFKLMKTRLVREGFNVGIVVDPLFVLDNRAQSFRPLTAEMYQAVCEGTWRL

SEQ ID NO: 884494 - protein, 229 aa, Homo sapiens [sequence omitted]

SEQ ID NO: 884495 - protein, 229 aa, Homo sapiens [sequence omitted]

SEQ ID NO: 884496 - protein, 107 aa, Homo sapiens
MLFSTSCSSACICGSQIPPRNLKGEPCLCFSSDPSLQTSGRAWRRSFPSCRLRTSAASTSAIPPLHQGWGLWGLPWMQRPPTQCLLTCVLGSHGEALPSSSIPRGPL

SEQ ID NO: 884497 - protein, 229 aa, Homo sapiens [sequence omitted]

SEQ ID NO: 884498 - protein, 89 aa, Homo sapiens
VSPGWPGGWVEDHSQGAGGCHSDWTMVTALQDAMEVTSTFKLMKTRLVREGFNVGIVVDPLFVLDNRAQSFRPLTAEMYQAVCEGTWRL

SEQ ID NO: 884499 - protein, 101 aa, Homo sapiens
SRRNGSQLCFPGSSAALHTETSGPASAQTSGKAQFLNTHLRQGGPRRGSVVSPGHVTGREGAWCLAVTPQALVSHRREPRPPSRRQGQEEREQLLFLAPRS

SEQ ID NO: 884500 - protein, 453 aa, Homo sapiens
GSPGAGLREARPGRRPGPAGREQQGRPAGGSGSPGTGAGSGASRAGEFRAPSPWPGAGRGDGGGADRPRAGRGRRAWAGAWGCGKMNALLEQKEQQERLREAAALGDIREVQKLVESGVDVNSQNEVNGWTCLHWACKRNHGQVVSYLLKSGADKEILTTKGEMPVQLTSRREIRKIMGVEEEDDDDDDDDNLPQLKKESELPFVPNYLANPAFPFIYTPTAEDSAQMQNGGPSTPPASPPADGSPPLLPPGEPPLLGTFPRDHTSLALVQNGDVSAPSAILRTPESTKPGPVCQPPVSQSRSLFSSVPSKPPMSLEPQNGTYAGPAPAFQPFFFTGAFPFNMQELVLKVRIQNPSLRENDFIEIELDRQELTYQELLRVCCCELGVNPDQVEKIRKLPNTLLRKDKDVARLQDFQELELVLMISENNFLFRNAASTLTERPCYNRRASKLTY

SEQ ID NO: 884501 - protein, 379 aa, Homo sapiens
GSPGAGLREARPGRRPGPAGREQQGRPAGGSGSPGTGAGSGASRAGEFRAPSPWPGAGRGDGGGADRPRAGRGRRAWAGAWGCGKMNALLEQKEQQERLREAAALGDIREVQKLVESGVDVNSQNEVNGWTCLHWACKRNHGQVVSYLLKSGADKEILTTKGEMPVQLTSRREIRKIMGVEEEDDDDDDDDNLPQLKKESELPFVPNYLANPAFPFIYTPTAEDSAQMQNGGPSTPPASPPADGSPPLLPPGEPPLLGTFPRDHTSLALVQNGDVSAPSAILRTPESTKPGPVCQPPVSQSRSLFSSVPSKPPMSLEPQNGTYAGPAPAFQPFFFTGAFPFNMQELVLKVRIQNPSLRENDFIEIEWSLFSFIKSSVVN

SEQ ID NO: 884502 - protein, 290 aa, Homo sapiens
MPVQLTSRREIRKIMGVEEEDDDDDDDDNLPQLKKESELPFVPNYLANPAFPFIYTPTAEDSAQMQNGGPSTPPASPPADGSPPLLPPGEPPLLGTFPRDHTSLALVQNGDVSAPSAILRTPESTKPGPVCQPPVSQSRSLFSSVPSKPPMSLEPQNGTYAGPAPAFQPFFFTGAFPFNMQELVLKVRIQNPSLRENDFIEIELDRQELTYQELLRVCCCELGVNPDQVEKIRKLPNTLLRKDKDVARLQDFQELELVLMISENNFLFRNAASTLTERPCYNRRASKLTY

SEQ ID NO: 884503 - protein, 1007 aa, Homo sapiens
HPALRPPPVRVLRYRLLSVLCSLLLSAPHPLSLPSSPLASPPLQRLHYFLPAGSACTAAAARGGGWVGGEETVQVVGEGVPSSSPLPSPANSFPSFSPFPLPAPTFFLLSEGLVTCRAERTGGGGGGGTIQAGTMGTSALWALWLLLALCWAPRESGATGTGRKAKCEPSQFQCTNGRCITLLWKCDGDEDCVDGSDEKNCVKKTCAESDFVCNNGQCVPSRWKCDGDPDCEDGSDESPEQCHMRTCRIHEISCGAHSTQCIPVSWRCDGENDCDSGEDEENCGNITCSPDEFTCSSGRCISRNFVCNGQDDCSDGSDELDCAPPTCGAHEFQCSTSSCIPISWVCDDDADCSDQSDESLEQCGRQPVIHTKCPASEIQCGSGECIHKKWRCDGDPDCKDGSDEVNCPSRTCRPDQFECEDGSCIHGSRQCNGIRDCVDGSDEVNCKNVNQCLGPGKFKCRSGECIDISKVCNQEQDCRDWSDEPLKECHINECLVNNGGCSHICKDLVIGYECDCAAGFELIDRKTCGDIDECQNPGICSQICINLKGGYKCECSRGYQMDLATGVCKAVGKEPSLIFTNRRDIRKIGLERKEYIQLVEQLRNTVALDADIAAQKLFWADLSQKAIFSASIDDKVGRHVKMIDNVYNPAAIAVDWVYKTIYWTDAASKTISVATLDGTKRKFLFNSDLREPASIAVDPLSGFVYWSDWGEPAKIEKAGMNGFDRRPLVTADIQWPNGITLDLIKSRLYWLDSKLHMLSSVDLNGQDRRIVLKSLEFLAHPLALTIFEDRVYWIDGENEAVYGANKFTGSELATLVNNLNDAQDIIVYHELVQPSGKNWCEEDMENGGCEYLCLPAPQINDHSPKYTCSCPSGYNVEENGRDCQSTATTVTYSETKDTNTTEISATSGLVPGGINVTTAVSEVSVPPKGTSAAWAILPLLLLVMAAVGGYLMWRNWQHKNMKSMNFDNPVYLKTTEEDLSIDIGRHSASVGHTYPAISVVSTDDDLA

SEQ ID NO: 884504 - protein, 756 aa, Homo sapiens
HPALRPPPVRVLRYRLLSVLCSLLLSAPHPLSLPSSPLASPPLQRLHYFLPAGSACTAAAARGGGWVGGEETVQVVGEGVPSSSPLPSPANSFPSFSPFPLPAPTFFLLSEGLVTCRAERTGGGGGGGTIQAGTMGTSALWALWLLLALCWAPRESGATGTGRKAKCEPSQFQCTNGRCITLLWKCDGDEDCVDGSDEKNCVKKTCAESDFVCNNGQCVPSRWKCDGDPDCEDGSDESPEQCHMRTCRIHEISCGAHSTQCIPVSWRCDGENDCDSGEDEENCGNITCSPDEFTCSSGRCISRNFVCNGQDDCSDGSDELDCAPPTCGAHEFQCSTSSCIPISWVCDDDADCSDQSDESLEQCGRQPVIHTKCPASEIQCGSGECIHKKWRCDGDPDCKDGSDEVNCPSRTCRPDQFECEDGSCIHGSRQCNGIRDCVDGSDEVNCKNVNQCLGPGKFKCRSGECIDISKVCNQEQDCRDWSDEPLKECHINECLVNNGGCSHICKDLVIGYECDCAAGFELIDRKTCGDIDECQNPGICSQICINLKGGYKCECSRGYQMDLATGVCKAVGKEPSLIFTNRRDIRKIGLERKEYIQLVEQLRNTVALDADIAAQKLFWADLSQKAIFSASIDDKVGRHVKMIDNVYNPAAIAVDWVYKTIYWTDAASKTISVATLDGTKRKFLFNSDLREPASIAVDPLSGFVYWSDWGEPAKIEKAGMNGFDRRPLVTADIQWPNGITLGMYVLPSRPPTQLSS

SEQ ID NO: 884505 - protein, 912 aa, Homo sapiens
HPALRPPPVRVLRYRLLSVLCSLLLSAPHPLSLPSSPLASPPLQRLHYFLPAGSACTAAAARGGGWVGGEETVQVVGEGVPSSSPLPSPANSFPSFSPFPLPAPTFFLLSEGLVTCRAERTGGGGGGGTIQAGTMGTSALWALWLLLALCWAPRESGATGTGRKAKCEPSQFQCTNGRCITLLWKCDGDEDCVDGSDEKNCVKKTCAESDFVCNNGQCVPSRWKCDGDPDCEDGSDESPEQCHMRTCRIHEISCGAHSTQCIPVSWRCDGENDCDSGEDEENCGNITCSPDEFTCSSGRCISRNFVCNGQDDCSDGSDELDCAPPTCGAHEFQCSTSSCIPISWVCDDDADCSDQSDESLEQCGRQPVIHTKCPASEIQCGSGECIHKKWRCDGDPDCKDGSDEVNCPSRTCRPDQFECEDGSCIHGSRQCNGIRDCVDGSDEVNCKNVNQCLGPGKFKCRSGECIDISKVCNQEQDCRDWSDEPLKECHINECLVNNGGCSHICKDLVIGYECDCAAGFELIDRKTCGDIDECQNPGICSQICINLKGGYKCECSRGYQMDLATGVCKAVGKEPSLIFTNRRDIRKFLFNSDLREPASIAVDPLSGFVYWSDWGEPAKIEKAGMNGFDRRPLVTADIQWPNGITLDLIKSRLYWLDSKLHMLSSVDLNGQDRRIVLKSLEFLAHPLALTIFEDRVYWIDGENEAVYGANKFTGSELATLVNNLNDAQDIIVYHELVQPSGKNWCEEDMENGGCEYLCLPAPQINDHSPKYTCSCPSGYNVEENGRDCQSTATTVTYSETKDTNTTEISATSGLVPGGINVTTAVSEVSVPPKGTSAAWAILPLLLLVMAAVGGYLMWRNWQHKNMKSMNFDNPVYLKTTEEDLSIDIGRHSASVGHTYPAISVVSTDDDLA

SEQ ID NO: 884506 - protein, 979 aa, Homo sapiens
HPALRPPPVRVLRYRLLSVLCSLLLSAPHPLSLPSSPLASPPLQRLHYFLPAGSACTAAAARGGGWVGGEETVQVVGEGVPSSSPLPSPANSFPSFSPFPLPAPTFFLLSEGLVTCRAERTGGGGGGGTIQAGTMGTSALWALWLLLALCWAPRESGATGTGRKAKCEPSQFQCTNGRCITLLWKCDGDEDCVDGSDEKNCVKKTCAESDFVCNNGQCVPSRWKCDGDPDCEDGSDESPEQCHMRTCRIHEISCGAHSTQCIPVSWRCDGENDCDSGEDEENCGNITCSPDEFTCSSGRCISRNFVCNGQDDCSDGSDELDCAPPTCGAHEFQCSTSSCIPISWVCDDDADCSDQSDESLEQCGRQPVIHTKCPASEIQCGSGECIHKKWRCDGDPDCKDGSDEVNCPSRTCRPDQFECEDGSCIHGSRQCNGIRDCVDGSDEVNCKNVNQCLGPGKFKCRSGECIDISKVCNQEQDCRDWSDEPLKECHINECLVNNGGCSHICKDLVIGYECDCAAGFELIDRKTCGDIDECQNPGICSQICINLKGGYKCECSRGYQMDLATGVCKAVGKEPSLIFTNRRDIRKIGLERKEYIQLVEQLRNTVALDADIAAQKLFWADLSQKAIFSASIDDKVGRHVKMIDNVYNPAAIAVDWVYKTIYWTDAASKTISVATLDGTKRKFLFNSDLREPASIAVDPLSGFVYWSDWGEPAKIEKAGMNGFDRRPLVTADIQWPNGITLDLIKSRLYWLDSKLHMLSSVDLNGQDRRIVLKSLEFLAHPLALTIFEDRVYWIDGENEAVYGANKFTGSELATLVNNLNDAQDIIVYHELVQPSGKNWCEEDMENGGCEYLCLPAPQINDHSPKYTCSCPSGYNVEENGRDCQRINVTTAVSEVSVPPKGTSAAWAILPLLLLVMAAVGGYLMWRNWQHKNMKSMNFDNPVYLKTTEEDLSIDIGRHSASVGHTYPAISVVSTDDDLA

SEQ ID NO: 884507 - protein, 447 aa, Homo sapiens
MDLATGVCKAVGKEPSLIFTNRRDIRKIGLERKEYIQLVEQLRNTVALDADIAAQKLFWADLSQKAIFSASIDDKVGRHVKMIDNVYNPAAIAVDWVYKTIYWTDAASKTISVATLDGTKRKFLFNSDLREPASIAVDPLSGFVYWSDWGEPAKIEKAGMNGFDRRPLVTADIQWPNGITLDLIKSRLYWLDSKLHMLSSVDLNGQDRRIVLKSLEFLAHPLALTIFEDRVYWIDGENEAVYGANKFTGSELATLVNNLNDAQDIIVYHELVQPSGKNWCEEDMENGGCEYLCLPAPQINDHSPKYTCSCPSGYNVEENGRDCQSTATTVTYSETKDTNTTEISATSGLVPGGINVTTAVSEVSVPPKGTSAAWAILPLLLLVMAAVGGYLMWRNWQHKNMKSMNFDNPVYLKTTEEDLSIDIGRHSASVGHTYPAISVVSTDDDLA

SEQ ID NO: 884508 - protein, 66 aa, Homo sapiens
KEPSLIFTNRRDIRKIGLERKEYIQLVEQLRNTVALDADIAAQKLFWADLSQKAIFRELSVPFVVS

SEQ ID NO: 884509 - protein, 720 aa, Homo sapiens
AAVPGAPSKLGEGRSRGLQLGKGEESACACTPVCRAESAGGDSLGLGRRRGQGNGGAAPPLSPRISRGSPGLPSAPHHGLARSWDGPRQQQAAGCRALGERGRARGDGEVGWPPSATPAAPTQRPLGGAADSPERTGVWAEAASPRPRLRESPRLFHPLAPATPQDTMSKAAGGAAAAAAAAESCSPAPAGSSAAPPAPVEDLSKVSDEELLQWSKEELIRSLRRAEAEKVSAMLDHSNLIREVNRRLQLHLGEIRGLKDINQKLQEDNQELRDLCCFLDDDRQKGKRVSREWQRLGRYTAGVMHKEVALYLQKLKDLEVKQEEVVKENMELKELCVLLDEEKGAGCAGSRCSIDSQASLCQLTASTAPYVRDVGDGSSTSSTGSTDSPDHHKHHASSGSPEHLQKPRSEGSPEHSKHRSASPEHPQKPRACGTPDRPKALKGPSPEHHKPLCKGSPEQQRHPHPGSSPETLPKHVLSGSPEHFQKHRSGSSPEHARHSGGSPEHLQKHALGGSLEHLPRARGTSPEHLKQHYGGSPDHKHGGGSGGSGGSGGGSREGTLRRQAQEDGSPHHRNVYSGMNESTLSYVRQLEARVRQLEEENRMLPQASQNRRQPPTRNSSNMEKGWGSRARRVLQWWQGCRGIGRCLPTLPGSFRLSSGADGSNSSPNSAASFSGHATPSQQPEPVVHSLKVVWRKLGDAAGSCPGIRQHLSGNQYKGPM

SEQ ID NO: 884510 - protein, 635 aa, Homo sapiens
AAVPGAPSKLGEGRSRGLQLGKGEESACACTPVCRAESAGGDSLGLGRRRGQGNGGAAPPLSPRISRGSPGLPSAPHHGLARSWDGPRQQQAAGCRALGERGRARGDGEVGWPPSATPAAPTQRPLGGAADSPERTGVWAEAASPRPRLRESPRLFHPLAPATPLDTMSKAAGGAAAAAAAAESCSPAPAGSSAAPPAPVEDLSKVSDEELLQWSKEELIRSLRRAEAEKVSAMLDHSNLIREVNRRLQLHLGEIRGLKDINQKLQEDNQELRDLCCFLDDDRQKGKRVSREWQRLGRYTAGVMHKEVALYLQKLKDLEVKQEEVVKENMELKELCVLLDEEKGAGCAGSRCSIDSQASLCQLTASTAPYVRDVGDGSSTSSTGSTDSPDHHKHHASSGSPEHLQKPRSEGSPEHSKHRSASPEHPQKPRACGTPDRPKALKGPSPEHHKPLCKGSPEQQRHPHPGSSPETLPKHVLSGSPEHFQKHRSGSSPEHARHSGGSPEHLQKHALGGSLEHLPRARGTSPEHLKQHYGGSPDHKHGGGSGGSGGSGGGSREGTLRRQAQEDGSPHHRNVYSGMNESTLSYVRQLEARVRQLEEENRMLPQVVWRKLGDAAGSCPGIRQHLSGNQYKGPM

SEQ ID NO: 884511 - protein, 600 aa, Homo sapiens
AAVPGAPSKLGEGRSRGLQLGKGEESACACTPVCRAESAGGDSLGLGRRRGQGNGGAAPPLSPRISRGSPGLPSAPHHGLARSWDGPRQQQAAGCRALGERGRARGDGEVGWPPSATPAAPTQRPLGGAADSPERTGVWAEAASPRPRLRESPRLFHPLAPATPLDTMSKAAGGAAAAAAAAESCSPAPAGSSAAPPAPVEDLSKVSDEELLQWSKEELIRSLRRAEAEKVSAMLDHSNLIREVNRRLQLHLGEIRGLKDINQKLQEDNQELRDLCCFLDDDRQKGKRVSREWQRLGRYTAGVMHKEVALYLQKLKDLEVKQEEVVKENMELKELCVLLDEEKGAGCAGSRCSIDSQASLCQLTASTAPYVRDVGDGSSTSSTGSTDSPDHHKHHASSGSPEHLQKPRSEGSPEHSKHRSASPEHPQKPRACGTPDRPKALKGPSPEHHKPLCKGSPEQQRHPHPGSSPETLPKHVLSGSPEHFQKHRSGSSPEHARHSGGSPEHLQKHALGGSLEHLPRARGTSPEHLKQHYGGSPDHKHGGGSGGSGGSGGGSREGTLRRQAQEDGSPHHRNVYSGMNGGSVCAGVLLGLGNSVESYE

SEQ ID NO: 884512 - protein, 134 aa, Homo sapiens
MSLCFLRKFSKIVCCVPGHSRYSRNGGYEFYHNSLLLGEQLFARLKFGRGTGFPLVLAASTRRVSLQPVSELFGNSTDPCPSVQTMPQGPPAFKLGLFSFPPLLSFQLYGQYMQFSHSFSHLTSNSFMISPFYR

SEQ ID NO: 884513 - protein, 106 aa, Homo sapiens
LEDPHAVYSLILHSPSIPRPHPLYLPSPEHTPNFLTSVPLCKLLPLPGNLHLSSCCCLQDLPGQNLLLSSSATHSNVSLHWLAFPTHWSRATASECPGAGVRNTDF

SEQ ID NO: 884514 - protein, 160 aa, Homo sapiens
TPASLQAWGASFSPVPLLPAGSEPPPPWLLRSASPSFSVHLPQWPLSTLSASASRSLLVPRKHFDLCFPFKCCGSSLPNPTIPPKGAADRESSLSQLLPLPGNLHLSSCCCLQDLPGQNLLLSSSATHSNVSLHWLAFPTHWSRATASECPGAGVRNTDF

SEQ ID NO: 884515 - protein, 162 aa, Homo sapiens
ALQPPCKLGAPHSLPCPFSQLGLSPRPPGSSVLLLPASLSISPNGLSLHSLPQLPGLCWSLGSTLTSASPSNAVDQASPTPPSHQRGLLTERAHSARMRAKEFKMVEPYYAKEPNPSVHWKKTAQDFYLPGNICPESTSWKKTAQDFYLPGNICIRLCGVGK

SEQ ID NO: 884516 - protein, 113 aa, Homo sapiens
MAPAGEVGCLWPYRKGEQLPPRGSVCLRWGSRSVAQAGVQWCNLGSLQPPPPGFKQFSCLSLPSIWNYRARFLLCHPGWHDHSSLQPRTPGFKQSSHLSIPSSWNYREPAVKH

SEQ ID NO: 884517 - protein, 148 aa, Homo sapiens
TPASLQAWGASFSPVPLLPAGSEPPPPWLLRSASPSFSVHLPQWPLSTLSASASRSLLVPRKHFDLCFPFKCCGSSLPNPTIPPKGAADRESSLSQMGVSLCCPGWSAVVQSWLTATSASRVQAILLPEPPEYLELQSQILTLSPRLA

SEQ ID NO: 884518 - protein, 134 aa, Homo sapiens; identical to SEQ ID NO: 884512

SEQ ID NO: 884519 - protein, 618 aa, Homo sapiens
MSVLTSPRGKVEVVHCRRTESQDVYCIKSLIRKFTCKLFGKLNIIYLLEKANLAVTLCNDKEEIMAQATFLDYPNWNVAKQDDWVSVFRELDSDIPCTPLNTLFMHLFVAVDEYSVGCCKEILRTVYKAVPELHFIFLIVPSYMSLGSTLITVFDQVGNIPCLTYEEDFAVHICHRHSHYPQLHVRKARVEDHDDLMPIFMRYDTILKETYGEYFLAELIEAQDEENHAVVCEVEGTAVGFMSVCSRVNMQLLHECFDLGPFHGLCFPHPDDVLESPQDLSVRRSQDAELRSSSQGSQKIVEELQEPVSPDTMENIQGNIAREAASEEALTAVQSGNVSEPEDIEKLSDISTGYAQYHHVSSRSLASLVLPEEPVHFRPIYRGASAAFCIQLFCIDEKYEARSLDFMNFVFSLFSDKNFCVISLPHLTPEFFLIQNFVKMVPFNTCTLEQDLYVFHRAGLLKNICLGRSSEHHQSVKGLCGMQEFQTHGQSGLFFLVLRASSEHRSHIAAHREGWNEKWKRGSTFLLGDMNHLCSYYVIRNLVAWPYLAAREPGRYVAGRLGMCPVKNSVDSLIKKKRKKDTMGTLYLVFILCMYRSSKKLHRISVTLYASGKQDWEL

SEQ ID NO: 884520 - protein, 618 aa, Homo sapiens; identical to SEQ ID NO: 884519

SEQ ID NO: 884521 - protein, 422 aa, Homo sapiens
MLVNRRSLDFMNFVFSLFSDKNFCVISLPHLTPEFFLIQNFVKMVPFNTCTLEQDLYVFHRAGLLKSINIRFATLLDTPGVENLVSTLMLNKSILEDLDRYNKARKDPDIEYIRSHYNIEDFIYFSHHQREEHGHMHHFALNPIFRHYTKFFLKEILRLGFKSCLYYRVYPKSREGKFQNPYAHSLTSALHYLVPVRPRRQIVYPLEKLGINAPSKAVSKDPMSYALNHTNRKLTLEPKITVNAKIIVVGASSVGISFLETLVFCSHMKFNNLTLISTHGLPGKKLLDTEQRKFLASDHCFNDKDYALMSLCSWVNVVVGRMTGIDRAAKHVVLSTDEIVPYDHLILCTGQQYQVPCPTEADISQHLTNREVPNSSQRRYTGKVPCNHFTLNEEEDCFKALIWIRNNSITTEDGGRASVLFC

SEQ ID NO: 884522 - protein, 511 aa, Homo sapiens
MPQPSKKLVQGNIAREAASEEALTAVQSGNVSEPEDIEKLSDISTGYAQYHHVSSRSLASLVLPEEPVHFRPIYRGASAAFCIQLFCIDEKYEARSLDFMNFVFSLFSDKNFCVISLPHLTPEFFLIQNFVKMVPFNTCTLEQDLYVFHRAGLLKSINIRFATLLDTPGVENLVSTLMLNKSILEDLDRYNKARKDPDIEYIRSHYNIEDFIYFSHHQREEHGHMHHFALNPIFRHYTKFFLKEILRLGFKSCLYYRVYPKSREGKFQNPYAHSLTSALHYLVPVRPRRQIVYPLEKLGINAPSKAVSKDPMSYALNHTNRKLTLEPKITVNAKIIVVGASSVGISFLETLVFCSHMKFNNLTLISTHGLPGKKLLDTEQRKFLASDHCFNDKDYALMSLCSWVNVVVGRMTGIDRAAKHVVLSTDEIVPYDHLILCTGQQYQVPCPTEADISQHLTNREVPNSSQRRYTGKVPCNHFTLNEEEDCFKALIWIRNNSITTEDGGRASVLFC

SEQ ID NO: 884523 - protein, 360 aa, Homo sapiens
MLNKSILEDLDRYNKARKDPDGTLLQAFVAEVAEQIVGIAVIRNEMDIEYIRSHYNIEDFIYFSHHQREEHGHMHHFALNPIFRHYTKFFLKEILRLGFKSCLYYRVYPKSREGKFQNPYAHSLTSALHYLVPVRPRRQIVYPLEKLGINAPSKAVSKDPMSYALNHTNRKLTLEPKITVNAKIIVVGASSVGISFLETLVFCSHMKFNNLTLISTHGLPGKKLLDTEQRKFLASDHCFNDKDYALMSLCSWVNVVVGRMTGIDRAAKHVVLSTDEIVPYDHLILCTGQQYQVPCPTEADISQHLTNREVPNSSQRRYTGKVPCNHFTLNEEEDCFKALIWIRNNSITTEDGGRASVLFC

SEQ ID NO: 884524 - protein, 200 aa, Homo sapiens
MSYALNHTNRKLTLEPKITVNAKIIVVGASSVGISFLETLVFCSHMKFNNLTLISTHGLPGKKLLDTEQRKFLASDHCFNDKDYALMSLCSWVNVVVGRMTGIDRAAKHVVLSTDEIVPYDHLILCTGQQYQVPCPTEADISQHLTNREVPNSSQRRYTGKVPCNHFTLNEEEDCFKALIWIRNNSITTEDGGRASVLFC

SEQ ID NO: 884525 - protein, 818 aa, Homo sapiens
MSVLTSPRGKVEVVHCRRTESQDVYCIKSLIRKFTCKLFGKLNIIYLLEKANLAVTLCNDKEEIMAQATFLDYPNWNVAKQDDWVSVFRELDSDIPCTPLNTLFMHLFVAVDEYSVGCCKEILRTVYKAVPELHFIFLIVPSYMSLGSTLITVFDQVGNIPCLTYEEDFAVHICHRHSHYPQLHVRKARVEDHDDLMPIFMRYDTILKETYGEYFLAELIEAQDEENHAVVCEVEGTAVGFMSVCSRVNMQLLHECFDLGPFHGLCFPHPDDVLESPQDLSVRRSQDAELRSSSQGSQKIVEELQEPVSPDTMENIQGNIAREAASEEALTAVQSGNVSEPEDIEKLSDISTGYAQYHHVSSRSLASLVLPEEPVHFRPIYRGASAAFCIQLFCIDEKYEARSLDFMNFVFSLFSDKNFCVISLPHLTPEFFLIQNFVKMVPFNTCTLEQDLYVFHRAGLLKSINIRFATLLDTPGVENLVSTLMLNKSILEDLDRYNKARKDPDIEYIRSHYNIEDFIYFSHHQREEHGHMHHFALNPIFRHYTKFFLKEILRLGFKSCLYYRVYPKSREGKFQNPYAHSLTSALHYLVPVRPRRQIVYPLEKLGINAPSKAVSKDPMSYALNHTNRKLTLEPKITVNAKIIVVGASSVGISFLETLVFCSHMKFNNLTLISTHGLPGKKLLDTEQRKFLASDHCFNDKDYALMSLCSWVNVVVGRMTGIDRAAKHVVLSTDEIVPYDHLILCTGQQYQVPCPTEADISQHLTNREVPNSSQRRYTGKVPCNHFTLNEEEDCFKALIWIRNNSITTEDGGRASVLFC

SEQ ID NO: 884526 - protein, 522 aa, Homo sapiens
VTVRTRIAVLSLRPPVWWNSKGNIAREAASEEALTAVQSGNVSEPEDIEKLSDISTGYAQYHHVSSRSLASLVLPEEPVHFRPIYRGASAAFCIQLFCIDEKYEARSLDFMNFVFSLFSDKNFCVISLPHLTPEFFLIQNFVKMVPFNTCTLEQDLYVFHRAGLLKSINIRFATLLDTPGVENLVSTLMLNKSILEDLDRYNKARKDPDIEYIRSHYNIEDFIYFSHHQREEHGHMHHFALNPIFRHYTKFFLKEILRLGFKSCLYYRVYPKSREGKFQNPYAHSLTSALHYLVPVRPRRQIVYPLEKLGINAPSKAVSKDPMSYALNHTNRKLTLEPKITVNAKIIVVGASSVGISFLETLVFCSHMKFNNLTLISTHGLPGKKLLDTEQRKFLASDHCFNDKDYALMSLCSWVNVVVGRMTGIDRAAKHVVLSTDEIVPYDHLILCTGQQYQVPCPTEADISQHLTNREVPNSSQRRYTGKVPCNHFTLNEEEDCFKALIWIRNNSITTEDGGRASVLFC

SEQ ID NO: 884527 - protein, 586 aa, Homo sapiens
MSWLFGINKGPKGEGAGPPPPLPPAQPGAEGGGDRGLGDRPAPKDKWSNFDPTGLERAAKAARELEHSRYAKDALNLAQMQEQTLQLEQQSKLKEYEAAVEQLKSEQIRAQAEERRKTLSEETRQHQARAQYQDKLARQRYEDQLKQQQLLNEENLRKQEESVQKQEAMRRATVEREMELRHKNEMLRVEAEARARAKAERENADIIREQIRLKAAEHRQTVLESIRTAGTLFGEGFRAFVTDWDKVTATVAGLTLLAVGVYSAKNATLVAGRFIEARLGKPSLVRETSRITVLEALRHPIQVSRRLLSRPQDALEGVVLSPSLEARVRDIAIATRNTKKNRSLYRNILMYGPPGTGKTLFAKKLALHSGMDYAIMTGGDVAPMGREGVTAMHKLFDWANTSRRGLLLFVDEADAFLRKRATEKISEDLRATLNAFLYRTGQHSNKFMLVLASNQPEQFDWAINDRINEMVHFDLPGQEERERLVRMYFDKYVLKPATEGKQRLKLAQFDYGRKCSEVARLTEGMSGREIAQLAVSWQATAYASEDGVLTEAMMDTRVQDAVQQHQQKMCWLKAEGPGRGDEPSPS

SEQ ID NO: 884528 - protein, 600 aa, Homo sapiens
CVWRLRSGGDHRLAARGGCSQPRASQTRVGVPAPPLPPAQPGAEGGGDRGLGDRPAPKDKWSNFDPTGLERAAKAARELEHSRYAKDALNLAQMQEQTLQLEQQSKLKEYEAAVEQLKSEQIRAQAEERRKTLSEETRQHQARAQYQDKLARQRYEDQLKQQQLLNEENLRKQEESVQKQEAMRRATVEREMELRHKNEMLRVEAEARARAKAERENADIIREQIRLKAAEHRQTVLESIRTAGTLFGEGFRAFVTDWDKVTATVAGLTLLAVGVYSAKNATLVAGRFIEARLGKPSLVRETSRITVLEALRHPIQVSRRLLSRPQDALEGVVLSPSLEARVRDIAIATRNTKKNRSLYRNILMYGPPGTGKTLFAKKLALHSGMDYAIMTGGDVAPMGREGVTAMHKLFDWANTSRRGLLLFVDEADAFLRKRATEKISEDLRATLNAFLYRTGQHSNKFMLVLASNQPEQFDWAINDRINEMVHFDLPGQEERERLVRMYFDKYVLKPATEGKQRLKLAQFDYGRKCSEVARLTEGMSGREIAQLAVSWQATAYASEDGVLTEAMMDTRVQDAVQQHQQKMCWLKAEGPGRGDEPSPS

SEQ ID NO: 884529 - protein, 577 aa, Homo sapiens
LVSGTSVVSPPPLPPAQPGAEGGGDRGLGDRPAPKDKWSNFDPTGLERAAKAARELEHSRYAKDALNLAQMQEQTLQLEQQSKLKEYEAAVEQLKSEQIRAQAEERRKTLSEETRQHQARAQYQDKLARQRYEDQLKQQQLLNEENLRKQEESVQKQEAMRRATVEREMELRHKNEMLRVEAEARARAKAERENADIIREQIRLKAAEHRQTVLESIRTAGTLFGEGFRAFVTDWDKVTATVAGLTLLAVGVYSAKNATLVAGRFIEARLGKPSLVRETSRITVLEALRHPIQVSRRLLSRPQDALEGVVLSPSLEARVRDIAIATRNTKKNRSLYRNILMYGPPGTGKTLFAKKLALHSGMDYAIMTGGDVAPMGREGVTAMHKLFDWANTSRRGLLLFVDEADAFLRKRATEKISEDLRATLNAFLYRTGQHSNKFMLVLASNQPEQFDWAINDRINEMVHFDLPGQEERERLVRMYFDKYVLKPATEGKQRLKLAQFDYGRKCSEVARLTEGMSGREIAQLAVSWQATAYASEDGVLTEAMMDTRVQDAVQQHQQKMCWLKAEGPGRGDEPSPS

SEQ ID NO: 884530 - protein, 533 aa, Homo sapiens
KTKGQDKECEPSPVIGYAKDALNLAQMQEQTLQLEQQSKLKEYEAAVEQLKSEQIRAQAEERRKTLSEETRQHQARAQYQDKLARQRYEDQLKQQQLLNEENLRKQEESVQKQEAMRRATVEREMELRHKNEMLRVEAEARARAKAERENADIIREQIRLKAAEHRQTVLESIRTAGTLFGEGFRAFVTDWDKVTATVAGLTLLAVGVYSAKNATLVAGRFIEARLGKPSLVRETSRITVLEALRHPIQVSRRLLSRPQDALEGVVLSPSLEARVRDIAIATRNTKKNRSLYRNILMYGPPGTGKTLFAKKLALHSGMDYAIMTGGDVAPMGREGVTAMHKLFDWANTSRRGLLLFVDEADAFLRKRATEKISEDLRATLNAFLYRTGQHSNKFMLVLASNQPEQFDWAINDRINEMVHFDLPGQEERERLVRMYFDKYVLKPATEGKQRLKLAQFDYGRKCSEVARLTEGMSGREIAQLAVSWQATAYASEDGVLTEAMMDTRVQDAVQQHQQKMCWLKAEGPGRGDEPSPS

SEQ ID NO: 884531 - protein, 586 aa, Homo sapiens; identical to SEQ ID NO: 884527

SEQ ID NO: 884532 - protein, 491 aa, Homo sapiens
MSWLFGINKGPKGEGAGPPPPLPPAQPGAEGGGDRGLGDRPAPKDKWSNFDPTGLERAAKAARELEHSRYAKDALNLAQMQEQTLQLEQQSKLKEYEAAVEQLKSEQIRAQAEERRKTLSEETRQHQARAQYQDKLARQRYEDQLKQQQLLNEENLRKQEESVQKQEAMRRATVEREMELRHKNEMLRVEAEARARAKAERENADIIREQIRLKAAEHRQTVLESIRTAGTLFGEGFRAFVTDWDKVTATVAGLTLLAVGVYSAKNATLVAGRFIEARLGKPSLVRETSRITVLEALRHPIQVSRRLLSRPQDALEGVVLSPSLEARVRDIAIATRNTKKNRSLYRNILMYGPPGTGKTLFAKKLALHSGMDYAIMTGGDVAPMGREGVTAMHKLFDWANTSRRGLLLFVDEADAFLRKRATEKISEDLRATLNAFLYRTGQHSNKFMLVLASNQPEQFDWAINDRINEMVHFDLPGQEERERLAPEAGPV

SEQ ID NO: 884533 - protein, 509 aa, Homo sapiens
MQSWSRVYCSLAKRGHFNRISHGLQGLSAVPLRTYADQPIDADVTVIGSGPGGYVAAIKAAQLGFKTVCIEKNETLGGTCLNVGCIPSKALLNNSHYYHMAHGKDFASRGIEMSEVRLNLDKMMEQKSTAVKALTGGIAHLFKQNKVVHVNGYGKITGKNQVTATKADGGTQVIDTKNILIATGSEVTPFPGITIDEDTIVSSTGALSLKKVPEKMVVIGAGVIGVELGSVWQRLGADVTAVEFLGHVGGVGIDMEISKNFQRILQKQGFKFKLNTKVTGATKKSDGKIDVSIEAASGGKAEVITCDVLLVCIGRRPFTKNLGLEELGIELDPRGRIPVNTRFQTKIPNIYAIGDVVAGPMLAHKAEDEGIICVEGMAGGAVHIDYNCVPSVIYTHPEVAWVGKSEEQLKEEGIEYKVGKFPFAANSRAKTNADTDGMVKILGQKSTDRVLGAHILGPGAGEMVNEAALALEYGASCEDIARVCHAHPTLSEAFREANLAASFGKSINF

SEQ ID NO: 884534 - protein, 354 aa, Homo sapiens
MQSWSRVYCSLAKRGHFNRISHGLQGLSAVPLRTYADQPIDADVTVIGSGPGGYVAAIKAAQLGFKTVCIEKNETLGGTCLNVGCIPSKALLNNSHYYHMAHGKDFASRGIEMSEVRLNLDKMMEQKSTAVKALTGGIAHLFKQNKVVHVNGYGKITGKNQVTATKADGGTQVIDTKNILIATGSEVTPFPGITIDEDTIVSSTGALSLKKVPEKMVVIGAGVIGVELGSVWQRLGADVTAVEFLGHVGGVGIDMEISKNFQRILQKQGFKFKLNTKVTGATKKSDGKIDVSIEAASGGKAEVITCDVLLVCIGRRPFTKNLGLEELGIELDPRGRIPVNTRFQTKIPNSQSRG

SEQ ID NO: 884535 - protein, 410 aa, Homo sapiens
MAHGKDFASRGIEMSEVRLNLDKMMEQKSTAVKALTGGIAHLFKQNKVVHVNGYGKITGKNQVTATKADGGTQVIDTKNILIATGSEVTPFPGITIDEDTIVSSTGALSLKKVPEKMVVIGAGVIGVELGSVWQRLGADVTAVEFLGHVGGVGIDMEISKNFQRILQKQGFKFKLNTKVTGATKKSDGKIDVSIEAASGGKAEVITCDVLLVCIGRRPFTKNLGLEELGIELDPRGRIPVNTRFQTKIPNIYAIGDVVAGPMLAHKAEDEGIICVEGMAGGAVHIDYNCVPSVIYTHPEVAWVGKSEEQLKEEGIEYKVGKFPFAANSRAKTNADTDGMVKILGQKSTDRVLGAHILGPGAGEMVNEAALALEYGASCEDIARVCHAHPTLSEAFREANLAASFGKSINF

SEQ ID NO: 884536 - protein, 387 aa, Homo sapiens
MMEQKSTAVKALTGGIAHLFKQNKVVHVNGYGKITGKNQVTATKADGGTQVIDTKNILIATGSEVTPFPGITIDEDTIVSSTGALSLKKVPEKMVVIGAGVIGVELGSVWQRLGADVTAVEFLGHVGGVGIDMEISKNFQRILQKQGFKFKLNTKVTGATKKSDGKIDVSIEAASGGKAEVITCDVLLVCIGRRPFTKNLGLEELGIELDPRGRIPVNTRFQTKIPNIYAIGDVVAGPMLAHKAEDEGIICVEGMAGGAVHIDYNCVPSVIYTHPEVAWVGKSEEQLKEEGIEYKVGKFPFAANSRAKTNADTDGMVKILGQKSTDRVLGAHILGPGAGEMVNEAALALEYGASCEDIARVCHAHPTLSEAFREANLAASFGKSINF

SEQ ID NO: 884537 - protein, 387 aa, Homo sapiens; identical to SEQ ID NO: 884536

SEQ ID NO: 884538 - protein, 509 aa, Homo sapiens; identical to SEQ ID NO: 884533

SEQ ID NO: 884539 - protein, 509 aa, Homo sapiens; identical to SEQ ID NO: 884533

SEQ ID NO: 884540 - protein, 479 aa, Homo sapiens
MQSWSRVYCSLAKRGHFNRISHGLQGLSAVPLRTYADQPIDADVTVIGSGPGGYVAAIKAAQLGFKTVCIEKNETLGGTCLNVGCIPSKALLNNSHYYHMAHGKDFASRGIEMSEVRLNLDKMMEQKSTAVKALTGGIAHLFKQNKVVHVNGYGKITGKNQVTATKADGGTQVIDTKNILIATGSEVTPFPGITIDEDTIVSSTGALSLKKVPEKMVVIGAGVIGVELGSVWQRLGADVTAVEFLGHVGGVGIDMEISKNFQRILQKQGFKFKLNTKVTGATKKSDGKIDVSIEAASGGKAEVITCDVLLVCIGRRPFTKNLGLEELGIELDPRGRIPVNTRFQTKIPNIYAIGDVVAGPMLAHKAEDEGIICVEGMAGGAVHIDYNCVPSVIYTHPEVAWVGKSEEQLKEEGIEYKVGKFPFAANSRAKTNADTDGMVKILGQKSTDRVLGAHILGPTLSEAFREANLAASFGKSINF

SEQ ID NO: 884541 - protein, 387 aa, Homo sapiens; identical to SEQ ID NO: 884536

SEQ ID NO: 884542 - protein, 496 aa, Homo sapiens
MQSWSRVYCSLAKRGHFNRISHGLQGLSAVPLRTYADQPIDADVTVIGSGPGGYVAAIKAAQLGFKTVCIEKNETLGGTCLNVGCIPSKALLNNSHYYHMAHGKDFASRGIEMSEVRLNLDKMMEQKSTAVKALTGGIAHLFKQNKVVHVNGYGKITGKNQVTANILIATGSEVTPFPGITIDEDTIVSSTGALSLKKVPEKMVVIGAGVIGVELGSVWQRLGADVTAVEFLGHVGGVGIDMEISKNFQRILQKQGFKFKLNTKVTGATKKSDGKIDVSIEAASGGKAEVITCDVLLVCIGRRPFTKNLGLEELGIELDPRGRIPVNTRFQTKIPNIYAIGDVVAGPMLAHKAEDEGIICVEGMAGGAVHIDYNCVPSVIYTHPEVAWVGKSEEQLKEEGIEYKVGKFPFAANSRAKTNADTDGMVKILGQKSTDRVLGAHILGPGAGEMVNEAALALEYGASCEDIARVCHAHPTLSEAFREANLAASFGKSINF

SEQ ID NO: 884543 - protein, 282 aa, Homo sapiens
MERPSLRALLLGAAGLLLLLLPLSSSSSSDTCGPCEPASCPPLPPLGCLLGETRDACGCCPMCARGEGEPCGGGGAGRGYCAPGMECVKSRKRRKGKAGAAAGGPGVSGVCVCKSRYPVCGSDGTTYPSGCQLRAASQRAESRGEKAITQVSKGTCEQGPSIVTPPKDIWNVTGAQVYLSCEVIGIPTPVLIWNKVKRGHYGVQRTELLPGDRDNLAIQTRGGPEKHEVTGWVLVSPLSKEDAGEYECHASNSQGQASASAKITVVDALHEIPVKKGEGAEL

SEQ ID NO: 884544 - protein, 282 aa, Homo sapiens; identical to SEQ ID NO: 884543

SEQ ID NO: 884545 - protein, 282 aa, Homo sapiens; identical to SEQ ID NO: 884543

SEQ ID NO: 884546 - protein, 282 aa, Homo sapiens; identical to SEQ ID NO: 884543

SEQ ID NO: 884547 - protein, 282 aa, Homo sapiens; identical to SEQ ID NO: 884543

SEQ ID NO: 884548 - protein, 243 aa, Homo sapiens
MERPSLRALLLGAAGLLLLLLPLSSSSSSDTCGPCEPASCPPLPPLGCLLGETRDACGCCPMCARGEGEPCGGGGAGRGYCAPGMECVKSRKRRKGKAGAAAGGPGVSGVCVCKSRYPVCGSDGTTYPSGCQLRAASQRAESRGEKAITQVSKGTCEQGPSIVTPPKDIWNVTGAQVYLSCEVIGIPTPVLIWNKVSPLSKEDAGEYECHASNSQGQASASAKITVVDALHEIPVKKGEGAEL

SEQ ID NO: 884549 - protein, 245 aa, Homo sapiens
RTRALAAATAPRHGAAVAARPAPRRRWAAAPAPAPLLFLLFGHLRPLRAGLLPAPAPAGLPAGRAGGPGVSGVCVCKSRYPVCGSDGTTYPSGCQLRAASQRAESRGEKAITQVSKGTCEQGPSIVTPPKDIWNVTGAQVYLSCEVIGIPTPVLIWNKVKRGHYGVQRTELLPGDRDNLAIQTRGGPEKHEVTGWVLVSPLSKEDAGEYECHASNSQGQASASAKITVVDALHEIPVKKGEGAEL

SEQ ID NO: 884550 - protein, 186 aa, Homo sapiens
MERPSLRALLLGAAGLLLLLLPLSSSSSSDTCGPCEPRAASQRAESRGEKAITQVSKGTCEQGPSIVTPPKDIWNVTGAQVYLSCEVIGIPTPVLIWNKVKRGHYGVQRTELLPGDRDNLAIQTRGGPEKHEVTGWVLVSPLSKEDAGEYECHASNSQGQASASAKITVVDALHEIPVKKGEGAEL

SEQ ID NO: 884551 - protein, 282 aa, Homo sapiens; identical to SEQ ID NO: 884543

SEQ ID NO: 884552 - protein, 282 aa, Homo sapiens; identical to SEQ ID NO: 884543

SEQ ID NO: 884553 - protein, 282 aa, Homo sapiens; identical to SEQ ID NO: 884543

SEQ ID NO: 884554 - protein, 282 aa, Homo sapiens; identical to SEQ ID NO: 884543

SEQ ID NO: 884555 - protein, 125 aa, Homo sapiens
SPDCRGRRGREWSGAVPSTLEEVVLPPRSCRVFWIHSGTTMSKVSFKITLTSDPRLPYKVLSVPESTPFTAVLKFAAEEFKVPAATSAIITNDGIGINPAQTAGNVFLKHGSELRIIPRDRVGSC

SEQ ID NO: 884556 - protein, 125 aa, Homo sapiens; identical to SEQ ID NO: 884555

SEQ ID NO: 884557 - protein, 125 aa, Homo sapiens; identical to SEQ ID NO: 884555

SEQ ID NO: 884558 - protein, 125 aa, Homo sapiens; identical to SEQ ID NO: 884555

SEQ ID NO: 884559 - protein, 103 aa, Homo sapiens
MIRAFPTTTPRSLHLFTSSTFLARALPGAFPTGACEERLSVPESTPFTAVLKFAAEEFKVPAATSAIITNDGIGINPAQTAGNVFLKHGSELRIIPRDRVGSC

SEQ ID NO: 884560 - protein, 111 aa, Homo sapiens
SPDCRGRRGREWSGAVPSTLEEVVLPPRSCRVFWIHSGTTMSKVSFKITLTSDPRLPYKVLSVPESTPFTAVLKFAAEEFKVPAATSAIITNDGIGINPAQTAGLAVEIQP

SEQ ID NO: 884561 - protein, 125 aa, Homo sapiens; identical to SEQ ID NO: 884555

SEQ ID NO: 884562 - protein, 125 aa, Homo sapiens; identical to SEQ ID NO: 884555

SEQ ID NO: 884563 - protein, 125 aa, Homo sapiens; identical to SEQ ID NO: 884555

SEQ ID NO: 884564 - protein, 125 aa, Homo sapiens; identical to SEQ ID NO: 884555

SEQ ID NO: 884565 - protein, 125 aa, Homo sapiens; identical to SEQ ID NO: 884555

SEQ ID NO: 884566 - protein, 100 aa, Homo sapiens
SPDCRGRRGREWSGAVPSTLEEVVLPPRSCRVFWIHSGTTMSKVSFKITLTSDPRLPYKVLSVPESTPFTAVLKFAAEEVSTEVGTTFMECGLPICFKCL

SEQ ID NO: 884567 - protein, 111 aa, Homo sapiens; identical to SEQ ID NO: 884560

SEQ ID NO: 884568 - protein, 81 aa, Homo sapiens
SPDCRGRRGREWSGAVPSTLEEVVLPPRSCRVFWIHSGTTMSKVSFKITLTSDPRLPYKVLSVPESTPFTAVLKFAAEEME

SEQ ID NO: 884569 - protein, 125 aa, Homo sapiens; identical to SEQ ID NO: 884555

SEQ ID NO: 884570 - protein, 517 aa, Homo sapiens
MLSSRAEAAMTAADRAIQRFLRTGAAVRYKVMKNWGVIGGIAAALAAGIYVIWGPITERKKRRKGLVPGLVNLGNTCFMNSLLQGLSACPAFIRWLEEFTSQYSRDQKEPPSHQYLSLTLLHLLKALSCQEVTDDEVLDASCLLDVLRMYRWQISSFEEQDAHELFHVITSSLEDERDRQPRVTHLFDVHSLEQQSEITPKQITCRTRGSPHPTSNHWKSQHPFHGRLTSNMVCKHCEHQSPVRFDTFDSLSLSIPAATWGHPLTLDHCLHHFISSESVRDVVCDNCTKIEAKGTLNGEKVEHQRTTFVKQLKLGKLPQCLCIHLQRLSWSSHGTPLKRHEHVQFNEFLMMDIYKYHLLGHKPSQHNPKLNKNPGPTLELQDGPGAPTPVLNQPGAPKTQIFMNGACSPSLLPTLSAPMPFPLPVVPDYSSSTYLFRLMAVVVHHGDMHSGHFVTYRRSPPSARNPLSTSNQWLWVSDDTVRKASLQEVLSSSAYLLFYERVLSRMQHQSQECKSEE

SEQ ID NO: 884571 - protein, 541 aa, Homo sapiens
GHRRLGPGAQHCSRTGGLKPSPPLPPPPPPPPDRGIRRFPRQRNLRPGAAVRYKVMKNWGVIGGIAAALAAGIYVIWGPITERKKRRKGLVPGLVNLGNTCFMNSLLQGLSACPAFIRWLEEFTSQYSRDQKEPPSHQYLSLTLLHLLKALSCQEVTDDEVLDASCLLDVLRMYRWQISSFEEQDAHELFHVITSSLEDERDRQPRVTHLFDVHSLEQQSEITPKQITCRTRGSPHPTSNHWKSQHPFHGRLTSNMVCKHCEHQSPVRFDTFDSLSLSIPAATWGHPLTLDHCLHHFISSESVRDVVCDNCTKIEAKGTLNGEKVEHQRTTFVKQLKLGKLPQCLCIHLQRLSWSSHGTPLKRHEHVQFNEFLMMDIYKYHLLGHKPSQHNPKLNKNPGPTLELQDGPGAPTPVLNQPGAPKTQIFMNGACSPSLLPTLSAPMPFPLPVVPDYSSSTYLFRLMAVVVHHGDMHSGHFVTYRRSPPSARNPLSTSNQWLWVSDDTVRKASLQEVLSSSAYLLFYERVLSRMQHQSQECKSEE

SEQ ID NO: 884572 - protein, 486 aa, Homo sapiens
MKNWGVIGGIAAALAAGIYVIWGPITERKKRRKGLVPGLVNLGNTCFMNSLLQGLSACPAFIRWLEEFTSQYSRDQKEPPSHQYLSLTLLHLLKALSCQEVTDDEVLDASCLLDVLRMYRWQISSFEEQDAHELFHVITSSLEDERDRQPRVTHLFDVHSLEQQSEITPKQITCRTRGSPHPTSNHWKSQHPFHGRLTSNMVCKHCEHQSPVRFDTFDSLSLSIPAATWGHPLTLDHCLHHFISSESVRDVVCDNCTKIEAKGTLNGEKVEHQRTTFVKQLKLGKLPQCLCIHLQRLSWSSHGTPLKRHEHVQFNEFLMMDIYKYHLLGHKPSQHNPKLNKNPGPTLELQDGPGAPTPVLNQPGAPKTQIFMNGACSPSLLPTLSAPMPFPLPVVPDYSSSTYLFRLMAVVVHHGDMHSGHFVTYRRSPPSARNPLSTSNQWLWVSDDTVRKASLQEVLSSSAYLLFYERVLSRMQHQSQECKSEE

SEQ ID NO: 884573 - protein, 446 aa, Homo sapiens
KKRGYSPHINHWKSQHPFHGRLTSNMVCKHCEHQSPVRFDTFDSLSLKYSSRHMALSCQEVTDDEVLDASCLLDVLRMYRWQISSFEEQDAHELFHVITSSLEDERDRQPRVTHLFDVHSLEQQSEITPKQITCRTRGSPHPTSNHWKSQHPFHGRLTSNMVCKHCEHQSPVRFDTFDSLSLSIPAATWGHPLTLDHCLHHFISSESVRDVVCDNCTKIEAKGTLNGEKVEHQRTTFVKQLKLGKLPQCLCIHLQRLSWSSHGTPLKRHEHVQFNEFLMMDIYKYHLLGHKPSQHNPKLNKNPGPTLELQDGPGAPTPVLNQPGAPKTQIFMNGACSPSLLPTLSAPMPFPLPVVPDYSSSTYLFRLMAVVVHHGDMHSGHFVTYRRSPPSARNPLSTSNQWLWVSDDTVRKASLQEVLSSSAYLLFYERVLSRMQHQSQECKSEE

SEQ ID NO: 884574 - protein, 541 aa, Homo sapiens; identical to SEQ ID NO: 884571

SEQ ID NO: 884575 - protein, 369 aa, Homo sapiens [sequence omitted]

SEQ ID NO: 884576 - protein, 292 aa, Homo sapiens
MTAADRAIQRFLRTGAAVRYKVMKNWGVIGGIAAALAAGIYVIWGPITERKKRRKGLVPGLVNLGNTCFMNSLLQGLSACPAFIRWLEEFTSQYSRDQKEPPSHQYLSLTLLHLLKALSCQEVTDDEVLDASCLLDVLRMYRWQISSFEEQDAHELFHVITSSLEDERDRQPRVTHLFDVHSLEQQSEITPKQITCRTRGSPHPTSNHWKSQHPFHGRLTSNMVCKHCEHQPLLTPGSVNFITFSLPPKETPYSLATSPHPFHHPTLVNHESTSVSMDLHILDASYKWNHVM

SEQ ID NO: 884577 - protein, 224 aa, Homo sapiens
MFPAALARRPRRPKSGTGEGPERQRPGGSLRSGFPVPAGGLAGGIEICITFPTEYVKTQLQLDERSHPPRYRGIGDCVRQTVRSHGVLGLYRGLSSLLYGSIPKAAVRFGMFEFLSNHMRDAQGRLDSTRGLLCGLGAGVAEAVVVVCPMETIKVKFIHDQTSPNPKYRGFFHGVREIVREQGLKGTYQGLTATVLKQGSNQAIRFFVMTSLRNWYRGGQPESQ

SEQ ID NO: 884578 - protein, 311 aa, Homo sapiens
MPAPRAPRALAAAAPASGKAKLTHPGKAILAGGLAGGIEICITFPTEYVKTQLQLDERSHPPRYRGIGDCVRQTVRSHGVLGLYRGLSSLLYGSIPKAAVRFGMFEFLSNHMRDAQGRLDSTRGLLCGLGAGVAEAVVVVCPMETIKVKFIHDQTSPNPKYRGFFHGVREIVREQGLKGTYQGLTATVLKQGSNQAIRFFVMTSLRNWYRGDNPNKPMNPLITGVFGAIAGAASVFGNTPLDVIKTRMQGLEAHKYRNTWDCGLQILKKEGLKAFYKGTVPRLGRVCLDVAIVFVIYDEVVKLLNKVWKTD

SEQ ID NO: 884579 - protein, 311 aa, Homo sapiens; identical to SEQ ID NO: 884578

SEQ ID NO: 884580 - protein, 318 aa, Homo sapiens
MFPAALARRPRRPKSGTGEGPERQRPGGSLRSGFPVPAGGLAGGIEICITFPTEYVKTQLQLDERSHPPRYRGIGDCVRQTVRSHGVLGLYRGLSSLLYGSIPKAAVRFGMFEFLSNHMRDAQGRLDSTRGLLCGLGAGVAEAVVVVCPMETIKVKFIHDQTSPNPKYRGFFHGVREIVREQGLKGTYQGLTATVLKQGSNQAIRFFVMTSLRNWYRGDNPNKPMNPLITGVFGAIAGAASVFGNTPLDVIKTRMQGLEAHKYRNTWDCGLQILKKEGLKAFYKGTVPRLGRVCLDVAIVFVIYDEVVKLLNKVWKTD

SEQ ID NO: 884581 - protein, 339 aa, Homo sapiens
MPAPRAPRALAAAAPASGKAKLTHPGKAILAGGLAGGIEICITFPTEYVKTQLQLDERSHPPRYRGIGDCVRQTVRSHGVLGLYRGLSSLLYGSIPKAAVRFGMFEFLSNHMRDAQGRLDSTRGLLCGLGAGVAEAVVVVCPMETIKVKFIHDQTSPNPKYRGFFHGVREIVREQGLKGTYQGLTATVLKQGSNQAIRFFVMTSLRNWYRGDNPNKPMNPLITGVFGAIAGAASVFGNTPLDVIKTRMQVVGPGRGGEGGTRPELAAEPLPADVPHKGLEAHKYRNTWDCGLQILKKEGLKAFYKGTVPRLGRVCLDVAIVFVIYDEVVKLLNKVWKTD

SEQ ID NO: 884582 - protein, 110 aa, Homo sapiens [sequence omitted]

SEQ ID NO: 884583 - protein, 110 aa, Homo sapiens [sequence omitted]

SEQ ID NO: 884584 - protein, 94 aa, Homo sapiens
MTSLRNWYRGDNPNKPMNPLITGVFGAIAGAASVFGNTPLDVIKTRMQACGAKFRDTGDWADILRKGGQISRAVPAGRVARLARVATIDGGLHT

SEQ ID NO: 884585 - protein, 311 aa, Homo sapiens; identical to SEQ ID NO: 884578

SEQ ID NO: 884586 - protein, 321 aa, Homo sapiens
APLPGWAVGWGVVEARSWSPPGALGLARLPSVTPCASPGQRGGLAGGIEICITFPTEYVKTQLQLDERSHPPRYRGIGDCVRQTVRSHGVLGLYRGLSSLLYGSIPKAAVRFGMFEFLSNHMRDAQGRLDSTRGLLCGLGAGVAEAVVVVCPMETIKVKFIHDQTSPNPKYRGFFHGVREIVREQGLKGTYQGLTATVLKQGSNQAIRFFVMTSLRNWYRGDNPNKPMNPLITGVFGAIAGAASVFGNTPLDVIKTRMQGLEAHKYRNTWDCGLQILKKEGLKAFYKGTVPRLGRVCLDVAIVFVIYDEVVKLLNKVWKTD

SEQ ID NO: 884587 - protein, 311 aa, Homo sapiens; identical to SEQ ID NO: 884578

SEQ ID NO: 884588 - protein, 274 aa, Homo sapiens
MPAPRAPRALAAAAPASGKAKLTHPGKAILAGGLAGGIEICITFPTEYVKTQLQLDERSHPPRYRGIGDCVRQTVRSHGVLGLYRGLSSLLYGSIPKAAVRFGMFEFLSNHMRDAQGRLDSTRGLLCGLGAGVAEAVVVVCPMETIKVKFIHDQTSPNPKYRGFFHGVREIVREQGLKGTYQGLTATVLKQGSNQAIRFFVMTSLRNWYRGDNPNKPMNPLITGVFGAIAGAASVFGNTPLDVIKTRMQGLEAHKYRNTWDCGLQILKKEGLKA

SEQ ID NO: 884589 - protein, 341 aa, Homo sapiens
MPAPRAPRALAAAAPASGKAKLTHPGKAILAGGLAGGIEICITFPTEYVKTQLQLDERSHPPRYRGIGEEGEAAAPRGAGTQGGGTEGRGVLPPPPPGDCVRQTVRSHGVLGLYRGLSSLLYGSIPKAAVRFGMFEFLSNHMRDAQGRLDSTRGLLCGLGAGVAEAVVVVCPMETIKVKFIHDQTSPNPKYRGFFHGVREIVREQGLKGTYQGLTATVLKQGSNQAIRFFVMTSLRNWYRGDNPNKPMNPLITGVFGAIAGAASVFGNTPLDVIKTRMQGLEAHKYRNTWDCGLQILKKEGLKAFYKGTVPRLGRVCLDVAIVFVIYDEVVKLLNKVWKTD

SEQ ID NO: 884590 - protein, 527 aa, Homo sapiens [sequence omitted]

SEQ ID NO: 884591 - protein, 550 aa, Homo sapiens
ELSRCRPASFPACSAPSRNYFRGGCRGRCPGEGAWRRAVWGGWRRQPEGGARPEAQHREPICGFTPLMEAAAAGHEIIVQYFLNHGVKVDARDHSGATARMLAKQYGHMKIVALMDTYSPSLPKSLYRSPEKYEDLSSSDESCPAPQRQRPCRKKGVSIHEGPRALARITGIGLGGRAPRPRYEQAPPRGYVTFNSSGENPLEEEGLCCRDVTSPINERDVESSSSSSSREEHAFCANLGPVQSSSSSEGLARAQGLSSEASVESNEDSDHACKSSARKQAKSYMKTKNPDSQWPPRTATDREGFLAESSPQTQRAPYSGPQDLAALLEQIGCLKYLQVFEEQDVDLRIFLTLTESDLKEIGITLFGPKRKMTSAIARWHSSARPPGDALELAYADRLEAEMQELAIQLHKRCEEVEATRGQVCQEQELRAVVESCLLEQDRAREDLQARLRETWALARDAALVLDQLRACQAELSSRVRQDQPPGAATLGLAVPPADSKGWQASLQAMSLPELSGALEDRVREMGQALCLVTQSLEKLQVLNGKKWRET

SEQ ID NO: 884592 - protein, 674 aa, Homo sapiens
GSCPGADPRASRRAPRPPATTSGAGAGGGAPARERGGELFGGVGDGSPRAAQGLRPSTVMSELSDEASEPELLNRSLSMWHGLGTQVSGEELDVPLDLHTAASIGQYEVVKECVQRRELDLNKKNGGGWTPLMYASYIGHDTIVHLLLEAGVSVNVPTPEGQTPLMLASSCGNESSPTFFSREPICGFTPLMEAAAAGHEIIVQYFLNHGVKVDARDHSGATARMLAKQYGHMKIVALMDTYSPSLPKSLYRSPEKYEDLSSSDESCPAPQRQRPCRKKGVSIHEGPRALARITGIGLGGRAPRPRYEQAPPRGYVTFNSSGENPLEEEGLCCRDVTSPINERDVESSSSSSSREEHAFCANLGPVQSSSSSEGLARAQGLSSEASVESNEDSDHACKSSARKQAKSYMKTKNPDSQWPPRTATDREGFLAESSPQTQRAPYSGPQDLAALLEQIGCLKYLQVFEEQDVDLRIFLTLTESDLKEIGITLFGPKRKMTSAIARWHSSARPPGDALELAYADRLEAEMQELAIQLHKRCEEVEATRGQVCQEQELRAVVESCLLEQDRAREDLQARLRETWALARDAALVLDQLRACQAELSSRVRQDQPPGAATLGLAVPPADSKGWQASLQAMSLPELSGALEDRVREMGQALCLVTQSLEKLQVLNGKKWRET

SEQ ID NO: 884593 - protein, 450 aa, Homo sapiens [sequence omitted]

SEQ ID NO: 884594 - protein, 614 aa, Homo sapiens
GSCPGADPRASRRAPRPPATTSGAGAGGGAPARERGGELFGGVGDGSPRAAQGLRPSTVMSELSDEASEPELLNRSLSMWHGLGTQVSGEELDVPLDLHTAASIGQYEVVKECVQRKVQELEMKDIQGWTALFHCTSAGHQHMVRFLLDSGANANVREPICGFTPLMEAAAAGHEIIVQYFLNHGVKVDARDHSGATARMLAKQYGHMKIVALMDTYSPSLPKSLYRSPEKYEDLSSSDESCPAPQRQRPCRKKGVSIHEGPRALARITGIGLGGRAPRPRYEQAPPRGYVTFNSSGENPLEEEGLCCRDVTSPINERDVESSSSSSSREEHAFCANLGPVQSSSSSEGLARAQGLSSEASVESNEDSDHACKSSARKQAKSYMKTKNPDSQWPPRTATDREGFLAESSPQTQRAPYSGPQDLAALLEQIGCLKYLQVFEEQDVDLRIFLTLTESDLKEIGITLFGPKRKMTSAIARWHSSARPPGDALELAYADRLEAEMQELAIQLHKRCEEVEATRGQVCQEQELRAVVESCLLEQDRAREDLQARLRETWALARDAALVLDQLRACQAELSSRVRQDQPPGAATLGLAVPPAGKSSGLTPHWAEGKVGEP

SEQ ID NO: 884595 - protein, 35 aa, Homo sapiens [sequence omitted]

SEQ ID NO: 884596 - protein, 649 aa, Homo sapiens
GSCPGADPRASRRAPRPPATTSGAGAGGGAPARERGGELFGGVGDGSPRAAQGLRPSTVMSELSDEASEPELLNRSLSMWHGLGTQVSGEELDVPLDLHTAASIGQYEVVKECVQRKVQELEMKDIQGWTALFHCTSAGHQHMVRFLLDSGANANVREPICGFTPLMEAAAAGHEIIVQYFLNHGVKVDARDHSGATARMLAKQYGHMKIVALMDTYSPSLPKSLYRSPEKYEDLSSSDESCPAPQRQRPCRKKGVSIHEGPRALARITGIGLGGRAPRPRYEQAPPRGYVTFNSSGENPLEEEGLCCRDVTSPINERDVESSSSSSSREEHAFCANLGPVQSSSSSEGLARAQGLSSEASVESNEDSDHACKSSARKQAKSYMKTKNPDSQWPPRTATDREGFLAESSPQTQRAPYSGPQDLAALLEQIGCLKYLQVFEEQDVDLRIFLTLTESDLKEIGITLFGPKRKMTSAIARWHSSARPPGDALELAYADRLEAEMQELAIQLHKRCEEVEATRGQVCQEQELRAVVESCLLEQDRAREDLQARLRETWALARDAALVLDQLRACQAELSSRVRQDQPPGAATLGLAVPPADSKGWQASLQAMSLPELSGALEDRVREMGQALCLVTQSLEKLQVLNGKKWRET

SEQ ID NO: 884597 - protein, 715 aa, Homo sapiens
GSCPGADPRASRRAPRPPATTSGAGAGGGAPARERGGELFGGVGDGSPRAAQGLRPSTVMSELSDEASEPELLNRSLSMWHGLGTQVSGEELDVPLDLHTAASIGQYEVVKECVQRRELDLNKKNGGGWTPLMYASYIGHDTIVHLLLEAGVSVNVPTPEGQTPLMLASSCGNESIAYFLLQQGAELEMKDIQGWTALFHCTSAGHQHMVRFLLDSGANANVREPICGFTPLMEAAAAGHEIIVQYFLNHGVKVDARDHSGATARMLAKQYGHMKIVALMDTYSPSLPKSLYRSPEKYEDLSSSDESCPAPQRQRPCRKKGVSIHEGPRALARITGIGLGGRAPRPRYEQAPPRGYVTFNSSGENPLEEEGLCCRDVTSPINERDVESSSSSSSREEHAFCANLGPVQSSSSSEGLARAQGLSSEASVESNEDSDHACKSSARKQAKSYMKTKNPDSQWPPRTATDREGFLAESSPQTQRAPYSGPQDLAALLEQIGCLKYLQVFEEQDVDLRIFLTLTESDLKEIGITLFGPKRKMTSAIARWHSSARPPGDALELAYADRLEAEMQELAIQLHKRCEEVEATRGQVCQEQELRAVVESCLLEQDRAREDLQARLRETWALARDAALVLDQLRACQAELSSRVRQDQPPGAATLGLAVPPADSKGWQASLQAMSLPELSGALEDRVREMGQALCLVTQSLEKLQVLNGKKWRET

SEQ ID NO: 884598 - protein, 229 aa, Homo sapiens
MDLAALLEQIGCLKYLQVFEEQDVDLRIFLTLTESDLKEIGITLFGPKRKMTSAIARWHSSARPPGDALELAYADRLEAEMQELAIQLHKRCEEVEATRGQVCQEQELRAVVESCLLEQDRAREDLQARLRETWALARDAALVLDQLRACQAELSSRVRQDQPPGAATLGLAVPPADSKGWQASLQAMSLPELSGALEDRVREMGQALCLVTQSLEKLQVLNGKKWRET

SEQ ID NO: 884599 - protein, 283 aa, Homo sapiens
MAAAPQAPGRGSLRKTRPLVVKTSLNNPYIIRWSALESEDMHFILQTLEDRLKAIGLQKIEDKKKKNKTPFLKKESREKCSIAVDISENLKEKKTDAKQQVSGWTPAHVRKQLAIGVNEVTRALERRELLLVLVCKSVKPAMITSHLIQLSLSRSVPACQVPRLSERIAPVIGLKCVLALAFKKNTTDFVDEVRAIIPRVPSLSVPWLQDRIEDSGENLETEPLESQDRELLDTSFEDLSKPKRKLADGRQASVTLQPLKIKKLIPNPNKIRKPPKSKKATPK

SEQ ID NO: 884600 - protein, 283 aa, Homo sapiens; identical to SEQ ID NO: 884599

SEQ ID NO: 884601 - protein, 167 aa, Homo sapiens
MAAAPQAPGRGSLRKTRPLVVKTSLNNPYIIRWSALESEDMHFILQTLEDRLKAIGLQKIEDKKKKNKTPFLKKESREKCSIAVDISENLKEKKTDAKQQVSGWTPAHVRKQLAIGVNEVTRALERRELLLVLVLTLLPRLECSGVIPAHCNPASWVQAILLPQPPE

SEQ ID NO: 884602 - protein, 761 aa, Homo sapiens
DGPDARIPERRPYTVPFDTHLGHYIYIPSRQDSRKVHTSPPMYSLDRIFAGFRTRSQMLLGHIEEQDKVLHCQFSDNSDDEESEGQEKSGTRCRSRSWIQKPDSVCSLVELSDTQDETQKSDLENEDLKIDCLQESQELNLQKLKNSERILTEAKQKMRDLQINIKMKEDLIKELIKTGNDAKSVSKQYSLKVTKLEHDAEQAKVELIETQKQLQELENKDLSDVAMKVKLQKEFRKKMDAAKLRVQVLQKKQQDSKKLASLSIQNEKRANELEQSVDHMKYQKIQLQRKLREENEKRKQLDAVIKRDQQKIKEIQLKTGQEEGLKPKAEDLDACNLKRRKGSFGSIDHLQKLDEQKKWLDEEVEKVLNQRQELEELEADLKKREAIVSKKEALLQEKSHLENKKLRSSQEEHVLFQLEEGIEALEAAIEYRNESIQNRQKSLRASFHNLSRGEANVLEKLACLSPVEIRTILFRYFNKVVNLREAERKQQLYNEEMKMKVLERDNMVRELESALDHLKLQCDRRLTLQQKEHEQKMQLLLHHFKEQDGEGIMETFKTYEDKIQQLEKDLYFYKKTSRDHKKKLKELVGEAIRRQLAPSEYQEAGDGVLKPEGGGMLSEELKWASRPESMKLSGREREMDSSASSLRTQPNPQKLWEDIPELPPIHSSLAPPSGHMLGNENKTETDDNQFTKSHSRLSSQIQVVGNVGRLHGVTPVKLCRKELRQISALELSLRRSSLGVGIGSMAADSIEVSRKPRDLKT

SEQ ID NO: 884603 - protein, 833 aa, Homo sapiens
DGPDARIPERRPYTVPFDTHLGHYIYIPSRQDSRKVHTSPPMYSLDRIFAGFRTRSQMLLGHIEEQDKVLHCQFSDNSDDEESEGQEKSGTRCRSRSWIQKPDSVCSLVELSDTQDETQKSDLENEDLKIDCLQESQELNLQKLKNSERILTEAKQKMRDLQINIKMKEDLIKELIKTGNDAKSVSKQYSLKVTKLEHDAEQAKVELIETQKQLQELENKDLSDVAMKVKLQKEFRKKMDAAKLRVQVLQKKQQDSKKLASLSIQNEKRANELEQSVDHMKYQKIQLQRKLREENEKRKQLDAVIKRDQQKIKEIQLKTGQEEGLKPKAEDLDACNLKRRKGSFGSIDHLQKLDEQKKWLDEEVEKVLNQRQELEELEADLKKREAIVSKKEALLQEKSHLENKKLRSSQALNTDSLKISTRLNLLEQELSEKNVQLQTSTAEEKTKISEQVEVLQKEKDQLQKRRHDVDEKLKNGRVLSPEEEHVLFQLEEGIEALEAAIEYRNESIQNRQKSLRASFHNLSRGEANVLEKLACLSPVEIRTILFRYFNKVVNLREAERKQQLYNEEMKMKVLERDNMVRELESALDHLKLQCDRRLTLQQKEHEQKMQLLLHHFKEQDGEGIMETFKTYEDKIQQLEKDLYFYKKTSRDHKKKLKELVGEAIRRQLAPSEYQEAGDGVLKPEGGGMLSEELKWASRPESMKLSGREREMDSSASSLRTQPNPQKLWEDIPELPPIHSSLAPPSGHMLGNENKTETDDNQFTKSHSRLSSQIQVVGNVGRLHGVTPVKLCRKELRQISALELSLRRSSLGVGIGSMAADSIEVSRKPRDLKT

SEQ ID NO: 884604 - protein, 240 aa, Homo sapiens
SSRIPLIRFKEHEQKMQLLLHHFKEQDGEGIMETFKTYEDKIQQLEKDLYFYKKTSRDHKKKLKELVGEAIRRQLAPSEYQEAGDGVLKPEGGGMLSEELKWASRPESMKLSGREREMDSSASSLRTQPNPQKLWEDIPELPPIHSSLAPPSGHMLGNENKTETDDNQFTKSHSRLSSQIQVVGNVGRLHGVTPVKLCRKELRQISALELSLRRSSLGVGIGSMAADSIEVSRKPRDLKT

SEQ ID NO: 884605 - protein, 164 aa, Homo sapiens
AWEGRGNGSWRCFAKGPCFCCGKLPGVARASEPKPLPSTPLPACPGAAKRLRSSRPAEMALDPADQHLRHVEKDVLIPKIMREKAKERCSEQVQDFTKCCKNSGVLMVVKCRKENSALKECLTAYYNDPAFYEECKMEYLKEREEFRKTGIPTKKRLQKLPTSM

SEQ ID NO: 884606 - protein, 264 aa, Homo sapiens
MDALVEDDICILNHEKAHKRDTVTPVSIYSGDESVASHFALVTAYEDIKKRLKDSEKENSLLKKRIRFLEEKLIARFEEETSSVGREQVNKAYHAYREVCIDRDNLKSKLDKMNKDNSESLKVLNEQLQSKEVELLQLRTEVETQQVMRNLNPPSSNWEVEKLSCDLKIHGLEQELELMRKECSDLKIELQKAKQTDPYQEDNLKSRDLQKLSISSDNMQHAYWELKREMSNLHLVTQVQAELLRKLKTSTAIKKGKSLFTGNH

SEQ ID NO: 884607 - protein, 164 aa, Homo sapiens; identical to SEQ ID NO: 884605

SEQ ID NO: 884608 - protein, 109 aa, Homo sapiens
EKITISVSILFVVMRNLNPPSSNWEVEKLSCDLKIHGLEQELELMRKECSDLKIELQKAKQTDPYQEDNLKSRDLQKLSISRQSICSTAWSAVAQSWDSMNFEDCSLFA

SEQ ID NO: 884609 - protein, 224 aa, Homo sapiens
RLGTRLGVNRPRKDSEKENSLLKKRIRFLEEKLIARFEEETSSVGREQVNKAYHAYREVCIDRDNLKSKLDKMNKDNSESLKVLNEQLQSKEVELLQLRTEVETQQVMRNLNPPSSNWEVEKLSCDLKIHGLEQELELMRKECSDLKIELQKAKQTDPYQEDNLKSRDLQKLSISSDNMQHAYWELKREMSNLHLVTQVQAELLRKLKTSTAIKKGKSLFTGNH

SEQ ID NO: 884610 - protein, 114 aa, Homo sapiens
MDALVEDDICILNHEKAHKRDTVTPVSIYSGDESVASHFALVTAYEDIKKRLKDSEKENSLLKKRIRFLEEKVIFIFYLHCVCDIRNNSEILEILNTFCPVFHDCTKFPRITHC

SEQ ID NO: 884611 - protein, 392 aa, Homo sapiens
MDALVEDDICILNHEKAHKRDTVTPVSIYSGDESVASHFALVTAYEDIKKRLKDSEKENSLLKKRIRFLEEKLIARFEEETSSVGREQVNKAYHAYREVCIDRDNLKSKLDKMNKDNSESLKVLNEQLQSKEVELLQLRTEVETQQVMRNLNPPSSNWEVEKLSCDLKIHGLEQELELMRKECSDLKIELQKAKQTDPYQEDNLKSRDLQKLSISSDNMQHAYWELKREMSNLHLVTQVQAELLRKLKTSTAIKKACAPVGCSEDLGRDSTKLHLMNFTATYTRHPPLLPNGKALCHTTSSPLPGDVKVLSEKAILQSWTDNERSIPNDGTCFQEHSSYGRNSLEDNSWVFPSPPKSSETAFGETKTKTLPLPNLPPLHYLDQHNQNCLYKN

SEQ ID NO: 884612 - protein, 392 aa, Homo sapiens; identical to SEQ ID NO: 884611

SEQ ID NO: 884613 - protein, 392 aa, Homo sapiens; identical to SEQ ID NO: 884611

SEQ ID NO: 884614 - protein, 392 aa, Homo sapiens; identical to SEQ ID NO: 884611

SEQ ID NO: 884615 - protein, 258 aa, Homo sapiens
EKITISVSILFVVMRNLNPPSSNWEVEKLSCDLKIHGLEQELELMRKECSDLKIELQKAKQTDPYQEDNLKSRDLQKLSISSDNMQHAYWELKREMSNLHLVTQVQAELLRKLKTSTAIKKACAPVGCSEDLGRDSTKLHLMNFTATYTRHPPLLPNGKALCHTTSSPLPGDVKVLSEKAILQSWTDNERSIPNDGTCFQEHSSYGRNSLEDNSWVFPSPPKSSETAFGETKTKTLPLPNLPPLHYLDQHNQNCLYKN

SEQ ID NO: 884616 - protein, 243 aa, Homo sapiens
MDALVEDDICILNHEKAHKRDTVTPVSIYSGDESVASHFALVTAYEDIKKRLKDSEKENSLLKKRIRFLEEKLIARFEEETSSVGREQVNKAYHAYREVCIDRDNLKSKLDKMNKDNSESLKVLNEQLQSKEVELLQLRTEVETQQVMRNLNPPSSNWEVEKLSCDLKIHGLEQELELMRKECSDLKIELQKAKQTDPYQEDNLKSRDLQKLSISRQSICSTAWSAVAQSWDSMNFEDCSLFA

SEQ ID NO: 884617 - protein, 156 aa, Homo sapiens
MDALVEDDICILNHEKAHKRDTVTPVSIYSGDESVASHFALVTAYEDIKKRLKDSEKENSLLKKRIRFLEEKLIARFEEETSSVGREQVNKAYHAYREVCIDRDNLKSKLDKMNKDNSESLKVLNEQLQSKEVELLQLRTEVETQQVIICSMHTGN

SEQ ID NO: 884618 - protein, 134 aa, Homo sapiens
AWEGRGNGSWRCFAKGPCFCCGKLPGVARASEPKPLPSTPLPACPGAAKRLRSSRPAEMALDPADFTKCCKNSGVLMVVKCRKENSALKECLTAYYNDPAFYEECKMEYLKEREEFRKTGIPTKKRLQKLPTSM

SEQ ID NO: 884619 - protein, 243 aa, Homo sapiens; identical to SEQ ID NO: 884616

SEQ ID NO: 884620 - protein, 120 aa, Homo sapiens
MDALVEDDICILNHEKAHKRDTVTPVSIYSGDESVASHFALVTAYEDIKKRLKDSEKENSLLKKRIRFLEEKLIARFEEETSSVGREQVNKAYHAYREVCIDRDNLKSKLDKMVSSFEAN

SEQ ID NO: 884621 - protein, 134 aa, Homo sapiens; identical to SEQ ID NO: 884618

SEQ ID NO: 884622 - protein, 106 aa, Homo sapiens
MALDPADQHLRHVEKDVLIPKIMREKAKERCSEQVQDFTKCCKNSGVLMVVKCRKENSALKECLTAYYNDPAFYEECKMEYLKEREEFRKTGIPTKKRLQKLPTSM

SEQ ID NO: 884623 - protein, 392 aa, Homo sapiens; identical to SEQ ID NO: 884611

SEQ ID NO: 884624 - protein, 392 aa, Homo sapiens; identical to SEQ ID NO: 884611

SEQ ID NO: 884625 - protein, 430 aa, Homo sapiens
MALDPADQHLRHVEKDVLIPKIMREKAKERCSEQVQVVMDALVEDDICILNHEKAHKRDTVTPVSIYSGDESVASHFALVTAYEDIKKRLKDSEKENSLLKKRIRFLEEKLIARFEEETSSVGREQVNKAYHAYREVCIDRDNLKSKLDKMNKDNSESLKVLNEQLQSKEVELLQLRTEVETQQVMRNLNPPSSNWEVEKLSCDLKIHGLEQELELMRKECSDLKIELQKAKQTDPYQEDNLKSRDLQKLSISSDNMQHAYWELKREMSNLHLVTQVQAELLRKLKTSTAIKKACAPVGCSEDLGRDSTKLHLMNFTATYTRHPPLLPNGKALCHTTSSPLPGDVKVLSEKAILQSWTDNERSIPNDGTCFQEHSSYGRNSLEDNSWVFPSPPKSSETAFGETKTKTLPLPNLPPLHYLDQHNQNCLYKN

SEQ ID NO: 884626 - protein, 174 aa, Homo sapiens [sequence omitted]

SEQ ID NO: 884627 - protein, 124 aa, Homo sapiens
AWEGRGNGSWRCFAKGPCFCCGKLPGVARASEPKPLPSTPLPACPGAAKRLRSSRPAEMALDPADQHLRHVEKDVLIPKIMREKAKERCSEQVQDFTKCCKNSGVLMVVKCRKENSALKECLTA

SEQ ID NO: 884628 - protein, 74 aa, Homo sapiens
TPTTEPGFANALPAPSGLTSGFLARPWRRARGQRQPLFRLRAHPHFQSLSGVLPLPPARAGPDGGPGSRARIAG

SEQ ID NO: 884629 - protein, 713 aa, Homo sapiens
MSTRTPLPTVNERDTENHTSHGDGRQEVTSRTSRSGARCRNSIASCADEQPHIGNYRLLKTIGKGNFAKVKLARHILTGREVAIKIIDKTQLNPTSLQKLFREVRIMKILNHPNIVKLFEVIETEKTLYLIMEYASGGEVFDYLVAHGRMKEKEARSKFRQIVSAVQYCHQKRIVHRDLKAENLLLDADMNIKIADFGFSNEFTVGGKLDTFCGSPPYAAPELFQGKKYDGPEVDVWSLGVILYTLVSGSLPFDGQNLKELRERVLRGKYRIPFYMSTDCENLLKRFLVLNPIKRGTLEQIMKDRWINAGHEEDELKPFVEPELDISDQKRIDIMVGMGYSQEEIQESLSKMKYDEITATYLLLGRKSSEVRPSSDLNNSTGQSPHHKVQRSVSSSQKQRRYSDHAGPAIPSVVAYPKRSQTSTADSDLKEDGISSRKSSGSAVGGKGIAPASPMLGNASNPNKADIPERKKSSTVPSSNTASGGMTRRNTYVCSERTTADRHSVIQNGKENSTIPDQRTPVASTHSISSAATPDRIRFPRGTASRSTFHGQPRERRTATYNGPPASPSLSHEATPLSQTRSRGSTNLFSKLTSKLTRSRNVSAEQKDENKEAKPRSLRFTWSMKTTSSMDPGDMMREIRKVLDANNCDYEQRERFLLFCVHGDGHAENLVQWEMEVCKLPRLSLNGVRFKRISGTSIAFKNIASKIANELKL

SEQ ID NO: 884630 - protein, 729 aa, Homo sapiens
MSTRTPLPTVNERDTENHTSHGDGRQEVTSRTSRSGARCRNSIASCADEQPHIGNYRLLKTIGKGNFAKVKLARHILTGREVAIKIIDKTQLNPTSLQKLFREVRIMKILNHPNIVKLFEVIETEKTLYLIMEYASGGEVFDYLVAHGRMKEKEARSKFRQIVSAVQYCHQKRIVHRDLKAENLLLDADMNIKIADFGFSNEFTVGGKLDTFCGSPPYAAPELFQGKKYDGPEVDVWSLGVILYTLVSGSLPFDGQNLKELRERVLRGKYRIPFYMSTDCENLLKRFLVLNPIKRGTLEQIMKDRWINAGHEEDELKPFVEPELDISDQKRIDIMVGMGYSQEEIQESLSKMKYDEITATYLLLGRKSSELDASDSSSSSNLSLAKVRPSSDLNNSTGQSPHHKVQRSVSSSQKQRRYSDHAGPAIPSVVAYPKRSQTSTADSDLKEDGISSRKSSGSAVGGKGIAPASPMLGNASNPNKADIPERKKSSTVPSSNTASGGMTRRNTYVCSERTTADRHSVIQNGKENSTIPDQRTPVASTHSISSAATPDRIRFPRGTASRSTFHGQPRERRTATYNGPPASPSLSHEATPLSQTRSRGSTNLFSKLTSKLTRSRNVSAEQKDENKEAKPRSLRFTWSMKTTSSMDPGDMMREIRKVLDANNCDYEQRERFLLFCVHGDGHAENLVQWEMEVCKLPRLSLNGVRFKRISGTSIAFKNIASKIANELKL

SEQ ID NO: 884631 - protein, 729 aa, Homo sapiens; identical to SEQ ID NO: 884630

SEQ ID NO: 884632 - protein, 729 aa, Homo sapiens; identical to SEQ ID NO: 884630

SEQ ID NO: 884633 - protein, 428 aa, Homo sapiens [sequence omitted]

SEQ ID NO: 884634 - protein, 744 aa, Homo sapiens
MSTRTPLPTVNERDTENHTSHGDGRQEVTSRTSRSGARCRNSIASCADEQPHIGNYRLLKTIGKGNFAKVKLARHILTGREVAIKIIDKTQLNPTSLQKLFREVRIMKILNHPNIVKLFEVIETEKTLYLIMEYASGGEVFDYLVAHGRMKEKEARSKFRQIVSAVQYCHQKRIVHRDLKAENLLLDADMNIKIADFGFSNEFTVGGKLDTFCGSPPYAAPELFQGKKYDGPEVDVWSLGVILYTLVSGSLPFDGQNLKELRERVLRGKYRIPFYMSTDCENLLKRFLVLNPIKRGTLEQIMKDRWINAGHEEDELKPFVEPELDISDQKRIDIMVGMGYSQEEIQESLSKMKYDEITATYLLLGRKSSELDASDSSSSSNLSLAKVRPSSDLNNSTGQSPHHKVQRSVSSSQKQRRYSDHAGPAIPSVVAYPKRSQTSTADSDLKEDGISSRKSSGSAVGGKGIAPASPMLGNASNPNKADIPERKKSSTVPSSNTASGGMTRRNTYVCSERTTADRHSVIQNGKENSTIPDQRTPVASTHSISSAATPDRIRFPRGTASRSTFHGQPRERRTATYNGPPASPSLSHEATPLSQTRSRGSTNLFSKLTSKLTRRLPTEYERNGRYEGSSRNVSAEQKDENKEAKPRSLRFTWSMKTTSSMDPGDMMREIRKVLDANNCDYEQRERFLLFCVHGDGHAENLVQWEMEVCKLPRLSLNGVRFKRISGTSIAFKNIASKIANELKL

SEQ ID NO: 884635 - protein, 623 aa, Homo sapiens
MKILNHPNIVKLFEVIETEKTLYLIMEYASGGEVFDYLVAHGRMKEKEARSKFRQIVSAVQYCHQKRIVHRDLKAENLLLDADMNIKIADFGFSNEFTVGGKLDTFCGSPPYAAPELFQGKKYDGPEVDVWSLGVILYTLVSGSLPFDGQNLKELRERVLRGKYRIPFYMSTDCENLLKRFLVLNPIKRGTLEQIMKDRWINAGHEEDELKPFVEPELDISDQKRIDIMVGMGYSQEEIQESLSKMKYDEITATYLLLGRKSSELDASDSSSSSNLSLAKVRPSSDLNNSTGQSPHHKVQRSVSSSQKQRRYSDHAGPAIPSVVAYPKRSQTSTADSDLKEDGISSRKSSGSAVGGKGIAPASPMLGNASNPNKADIPERKKSSTVPSSNTASGGMTRRNTYVCSERTTADRHSVIQNGKENSTIPDQRTPVASTHSISSAATPDRIRFPRGTASRSTFHGQPRERRTATYNGPPASPSLSHEATPLSQTRSRGSTNLFSKLTSKLTRSRNVSAEQKDENKEAKPRSLRFTWSMKTTSSMDPGDMMREIRKVLDANNCDYEQRERFLLFCVHGDGHAENLVQWEMEVCKLPRLSLNGVRFKRISGTSIAFKNIASKIANELKL

SEQ ID NO: 884636 - protein, 623 aa, Homo sapiens; identical to SEQ ID NO: 884635

SEQ ID NO: 884637 - protein, 623 aa, Homo sapiens; identical to SEQ ID NO: 884635

SEQ ID NO: 884638 - protein, 540 aa, Homo sapiens
MNIKIADFGFSNEFTVGGKLDTFCGSPPYAAPELFQGKKYDGPEVDVWSLGVILYTLVSGSLPFDGQNLKELRERVLRGKYRIPFYMSTDCENLLKRFLVLNPIKRGTLEQIMKDRWINAGHEEDELKPFVEPELDISDQKRIDIMVGMGYSQEEIQESLSKMKYDEITATYLLLGRKSSELDASDSSSSSNLSLAKVRPSSDLNNSTGQSPHHKVQRSVSSSQKQRRYSDHAGPAIPSVVAYPKRSQTSTADSDLKEDGISSRKSSGSAVGGKGIAPASPMLGNASNPNKADIPERKKSSTVPSSNTASGGMTRRNTYVCSERTTADRHSVIQNGKENSTIPDQRTPVASTHSISSAATPDRIRFPRGTASRSTFHGQPRERRTATYNGPPASPSLSHEATPLSQTRSRGSTNLFSKLTSKLTRSRNVSAEQKDENKEAKPRSLRFTWSMKTTSSMDPGDMMREIRKVLDANNCDYEQRERFLLFCVHGDGHAENLVQWEMEVCKLPRLSLNGVRFKRISGTSIAFKNIASKIANELKL

SEQ ID NO: 884639 - protein, 753 aa, Homo sapiens
MSTRTPLPTVNERDTENHTSHGDGRQEVTSRTSRSGARCRNSIASCADEQPHIGNYRLLKTIGKGNFAKVKLARHILTGREVAIKIIDKTQLNPTSLQKLFREVRIMKILNHPNIVKLFEVIETEKTLYLIMEYASGGEVFDYLVAHGRMKEKEARSKFRQIVSAVQYCHQKRIVHRDLKAENLLLDADMNIKIADFGFSNEFTVGGKLDTFCGSPPYAAPELFQGKKYDGPEVDVWSLGVILYTLVSGSLPFDGQNLKELRERVLRGKYRIPFYMSTDCENLLKRFLVLNPIKRGTLEQIMKDRWINAGHEEDELKPFVEPELDISDQKRIDIMVGMGYSQEEIQESLSKMKYDEITATYLLLGRKSSELDASDSSSSSNLSLAKVRPSSDLNNSTGQSPHHKVQRSVSSSQKQRRYSDHAGPAIPSVVAYPKRSQTSTADSDLKEDGISSRKSSGSAVGGKGIAPASPMLGNASNPNKADIPERKKSSTVPSSNTASGGMTRRNTYVCSERTTADRHSVIQNGKENSTIPDQRTPVASTHSISSAATPDRIRFPRGTASRSTFHGQPRERRTATYNGPPASPSLSHEATPLSQTRSRGSTNLFSKLTSKLTRRNMSFRFIKRLPTEYERNGRYEGSSRNVSAEQKDENKEAKPRSLRFTWSMKTTSSMDPGDMMREIRKVLDANNCDYEQRERFLLFCVHGDGHAENLVQWEMEVCKLPRLSLNGVRFKRISGTSIAFKNIASKIANELKL

SEQ ID NO: 884640 - protein, 737 aa, Homo sapiens
MSTRTPLPTVNERDTENHTSHGDGRQEVTSRTSRSGARCRNSIASCADEQPHIGNYRLLKTIGKGNFAKVKLARHILTGREVAIKIIDKTQLNPTSLQKLFREVRIMKILNHPNIVKLFEVIETEKTLYLIMEYASGGEVFDYLVAHGRMKEKEARSKFRQIVSAVQYCHQKRIVHRDLKAENLLLDADMNIKIADFGFSNEFTVGGKLDTFCGSPPYAAPELFQGKKYDGPEVDVWSLGVILYTLVSGSLPFDGQNLKELRERVLRGKYRIPFYMSTDCENLLKRFLVLNPIKRGTLEQIMKDRWINAGHEEDELKPFVEPELDISDQKRIDIMVGMGYSQEEIQESLSKMKYDEITATYLLLGRKSSEVRPSSDLNNSTGQSPHHKVQRSVSSSQKQRRYSDHAGPAIPSVVAYPKRSQTSTADSDLKEDGISSRKSSGSAVGGKGIAPASPMLGNASNPNKADIPERKKSSTVPSSNTASGGMTRRNTYVCSERTTADRHSVIQNGKENSTIPDQRTPVASTHSISSAATPDRIRFPRGTASRSTFHGQPRERRTATYNGPPASPSLSHEATPLSQTRSRGSTNLFSKLTSKLTRRNMSFRFIKRLPTEYERNGRYEGSSRNVSAEQKDENKEAKPRSLRFTWSMKTTSSMDPGDMMREIRKVLDANNCDYEQRERFLLFCVHGDGHAENLVQWEMEVCKLPRLSLNGVRFKRISGTSIAFKNIASKIANELKL

SEQ ID NO: 884641 - protein, 259 aa, Homo sapiens
MLGNASNPNKADIPERKKSSTVPSSNTASGGMTRRNTYVCSERTTADRHSVIQNGKENSTIPDQRTPVASTHSISSAATPDRIRFPRGTASRSTFHGQPRERRTATYNGPPASPSLSHEATPLSQTRSRGSTNLFSKLTSKLTRSRNVSAEQKDENKEAKPRSLRFTWSMKTTSSMDPGDMMREIRKVLDANNCDYEQRERFLLFCVHGDGHAENLVQWEMEVCKLPRLSLNGVRFKRISGTSIAFKNIASKIANELKL

SEQ ID NO: 884642 - protein, 208 aa, Homo sapiens
MVLALHHGDLDSCEKSLGTLYSSIRSLPGLPGLCSLCTASRSTFHGQPRERRTATYNGPPASPSLSHEATPLSQTRSRGSTNLFSKLTSKLTRSRNVSAEQKDENKEAKPRSLRFTWSMKTTSSMDPGDMMREIRKVLDANNCDYEQRERFLLFCVHGDGHAENLVQWEMEVCKLPRLSLNGVRFKRISGTSIAFKNIASKIANELKL

SEQ ID NO: 884643 - protein, 727 aa, Homo sapiens
MSTRTPLPTVNERDTENHTSHGDGRQEVTSRTSRSGARCRNSIASCADEQPHIGNYRLLKTIGKGNFAKVKLARHILTGREVAIKIIDKTQLNPTSLQKLFREVRIMKILNHPNIVKLFEVIETEKTLYLIMEYASGGEVFDYLVAHGRMKEKEARSKFRQIVSAVQYCHQKRIVHRDLKAENLLLDADMNIKIADFGFSNEFTVGGKLDTFCGSPPYAAPELFQGKKYDGPEVDVWSLGVILYTLVSGSLPFDGQNLKELRERVLRGKYRIPFYMSTDCENLLKRFLVLNPIKRGTLEQIMKDRWINAGHEEDELKPFVEPELDISDQKRIDIMVGMGYSQEEIQESLSKMKYDEITATYLLLGRKSSELDASDSSSSSNLSLAKVRPSSDLNNSTGQSPHHKVQRSVSSSQKQRRYSDHAGPAIPSVVAYPKRSQTSTADSDLKEDGISSRKSSGSAVGGKGIAPASPMLGNASNPNKADIPERKKSSTVPSSNTASGGMTRRNTYVCSERTTADRHSVIQNGKENSTIPDQRTPVASTHSISSAATPDRIRFPRGTASRSTFHGQPRERRTATYNGPPASPSLSHEATPLSQTRSRGSTNLFSKLTSKLTRSRNVSAEQKDENKEAKPRSLRFTWSMKTTSSMDPGDMMREIRKVLDANNCDYEQRERFLLFCVHGDGHAENLVQWEMEVCKLPRLSLNGVRFKRISGTSIAFKNIASTIKVFS

SEQ ID NO: 884644 - protein, 161 aa, Homo sapiens
MVLVLVLVVMYWHVRFLFSFPLLSASTFCSLRLPTEYERNGRYEGSSRNVSAEQKDENKEAKPRSLRFTWSMKTTSSMDPGDMMREIRKVLDANNCDYEQRERFLLFCVHGDGHAENLVQWEMEVCKLPRLSLNGVRFKRISGTSIAFKNIASKIANELKL

SEQ ID NO: 884645 - protein, 118 aa, Homo sapiens [sequence omitted]

SEQ ID NO: 884646 - protein, 683 aa, Homo sapiens
MSTRTPLPTVNERDTENHTSHGDGRQEVTSRTSRSGARCRNSIASCADEQPHIGNYRLLKTIGKGNFAKVKLARHILTGREVAIKIIDKTQLNPTSLQKLFREVRIMKILNHPNIVKLFEVIETEKTLYLIMEYASGGEVFDYLVAHGRMKEKEARSKFRQIVSAVQYCHQKRIVHRDLKAENLLLDADMNIKIADFGFSNEFTVGGKLDTFCGSPPYAAPELFQGKKYDGPEVDVWSLGVILYTLVSGSLPFDGQNLKELRERVLRGKYRIPFYMSTDCENLLKRFLVLNPIKRGTLEQIMKDRWINAGHEEDELKPFVEPELDISDQKRIDIMVGMGYSQEEIQESLSKMKYDEITATYLLLGRKSSELDASDSSSSSNLSLAKVRPSSDLNNSTGQSPHHKVQRSVSSSQKQRRYSDHAGPAIPSVVAYPKRSQTSTADSDLKEDGISSRKSSGSAVGGKGIAPASPMLGNASNPNKADIPERKKSSTVPSSNTASGGMTRRNTYVCSERTTADRHSVIQNGKENSTIPDQRTPVASTHSISSAATPDRIRFPRGTASRSTFHGQPRERRTATYNGPPASPSLSHEATPLSQTRSRGSTNLFSKLTSKLTRSRNVSAEQKDENKEAKPRSLRFTWSMKTTSSMDPGDMMREIRKVLDANNCDYEQRERFLLFCCLPSGWV

SEQ ID NO: 884647 - protein, 558 aa, Homo sapiens
MSTRTPLPTVNERDTENHTSHGDGRQEVTSRTSRSGARCRNSIASCADEQPHIGNYRLLKTIGKGNFAKVKLARHILTGREVAIKIIDKTQLNPTSLQKLFREVRIMKILNHPNIVKLFEVIETEKTLYLIMEYASGGEVFDYLVAHGRMKEKEARSKFRQIVSAVQYCHQKRIVHRDLKAENLLLDADMNIKIADFGFSNEFTVGGKLDTFCGSPPYAAPELFQGKKYDGPEVDVWSLGVILYTLVSGSLPFDGQNLKELRERVLRGKYRIPFYMSTDCENLLKRFLVLNPIKRGTLEQIMKDRWINAGHEEDELKPFVEPELDISDQKRIDIMVGMGYSQEEIQESLSKMKYDEITATYLLLGRKSSELDASDSSSSSNLSLAKVRPSSDLNNSTGQSPHHKVQRSVSSSQKQRRYSDHAGPAIPSVVAYPKRSQTSTADSDLKEDGISSRKSSGSAVGGKGIAPASPMLGNASNPNKADIPERKKSSTVPSSNTASGGMTRRNTYVCSERTTADRHSVIQNGKENSTIPDQRTPVASTHSISSATYAPPALLPLP

SEQ ID NO: 884648 - protein, 377 aa, Homo sapiens [sequence omitted]

SEQ ID NO: 884649 - protein, 273 aa, Homo sapiens
MLGQLLPHTARGLGAAEMPGQGPGSDWTERSSSAEPPAVAGTEGGGGGSAGYSCYQNSKGSDRIKDGYKVNSHIAKLQELWKTPQNQTIHLSKSMMEASFFKHPDLTTGQKRYLCSIAKIYNANYLKMLMKRQYMHVLQHSSQKPGVLTHHRSRLSSRYSQKQHYPCTTWRHQLEREDSGSSDIAAASAPEMLIQHSLWRPVRNKEGIKTGYASKTRCKSLKIFRRPRKLFMQTVSSDDSESHMSEEKKEEDLLNNFMQSMSIEEQGEHLMLT

SEQ ID NO: 884650 - protein, 273 aa, Homo sapiens; identical to SEQ ID NO: 884649

SEQ ID NO: 884651 - protein, 256 aa, Homo sapiens [sequence omitted]

SEQ ID NO: 884652 - protein, 377 aa, Homo sapiens
QCDMNEGKKAGKLIDEYTKRVVGEDDKGINTVGCAGKMEESERRGQIQRETPTGSRRVSRLQRTDLTPHAKSQTWGVHETRISKTARNTGIVTHRPRSIDQPVSPALREPTAEYHEGQEIQPTSASQSAGITGVSHHTRPKYQILIIQFVELIFASEIHMMSLPTDRIKDGYKVNSHIAKLQELWKTPQNQTIHLSKSMMEASFFKHPDLTTGQKRYLCSIAKIYNANYLKMLMKRQYMHVLQHSSQKPGVLTHHRSRLSSRYSQKQHYPCTTWRHQLEREDSGSSDIAAASAPEMLIQHSLWRPVRNKEGIKTGYASKTRCKSLKIFRRPRKLFMQTVSSDDSESHMSEEKKEEDLLNNFMQSMSIEEQGEHLMLT

SEQ ID NO: 884653 - protein, 255 aa, Homo sapiens
MLGQLLPHTARGLGAAEMPGQGPGSDWTERSSSAEPPAVAGTEGGGGGSAGYSCYQNSKGSDRIKDGYKVNSHIAKLQELWKTPQNQTIHLSKSMMEASFFKHPDLTTGQKRYLCSIAKIYNANYLKMLMKRQYMHVLQHSSQKPGVLTHHRSRLSSRYSQKQHYPCTTWRHQLEREDSGSSDIAAASAPEMLIQHSLWRPVRNKEGIKTGYASKTRCKSLKIFRRPRKLFMQTVSSDDSESHMSEEKGEHLMLT

SEQ ID NO: 884654 - protein, 185 aa, Homo sapiens
LGDSRVPRMGDHLKHPDLTTGQKRYLCSIAKIYNANYLKMLMKRQYMHVLQHSSQKPGVLTHHRSRLSSRYSQKQHYPCTTWRHQLEREDSGSSDIAAASAPEMLIQHSLWRPVRNKEGIKTGYASKTRCKSLKIFRRPRKLFMQTVSSDDSESHMSEEKKEEDLLNNFMQSMSIEEQGEHLMLT

SEQ ID NO: 884655 - protein, 210 aa, Homo sapiens [sequence omitted]

SEQ ID NO: 884656 - protein, 253 aa, Homo sapiens
MATHRLVMVRHGESTWNQENRFCGWFDAELSEKGTEEAKRGAKAIKDAKMEFDICYTSVLKRAIRTLWAILDGTDQMWLPVVRTWRLNERHYGGLTGLNKAETAAKHGEEQVKIWRRSFDIPPPPMDEKHPYYNSISKERRYAGLKPGELPTCESLKDTIARALPFWNEEIVPQIKAGKRVLIAAHGNSLRGIVKHLEGMSDQAIMELNLPTGIPIVYELNKELKPTKPMQFLGDEETVRKAMEAVAAQGKAK

SEQ ID NO: 884657 - protein, 253 aa, Homo sapiens; identical to SEQ ID NO: 884656

SEQ ID NO: 884658 - protein, 147 aa, Homo sapiens
MATHRLVMVRHGESTWNQENRFCGWFDAELSEKGTEEAKRGAKAIKDAKMEFDICYTSVLKRAIRTLWAILDGTDQMWLPVVRTWRLNERHYGGLTGLNKAETAAKHGEEQVKIWRRSFDIPPPPMDEKHPYYNSISKGCQTRRSWS

SEQ ID NO: 884659 - protein, 288 aa, Homo sapiens
MATHRLVMVRHGESTWNQENRFCGWFDAELSEKGTEEAKRGAKAIKDAKMEFDICYTSVLKRAIRTLWAILDGTDQMWLPVVRTWRLNERHYGGLTGLNKAETAAKHGEEQVKIWRRSFDIPPPPMDEKHPYYNSISKVGCLCWEGLWEAAEWGVGWGPTGLGGKAAVPVSPQERRYAGLKPGELPTCESLKDTIARALPFWNEEIVPQIKAGKRVLIAAHGNSLRGIVKHLEGMSDQAIMELNLPTGIPIVYELNKELKPTKPMQFLGDEETVRKAMEAVAAQGKAK

SEQ ID NO: 884660 - protein, 230 aa, Homo sapiens
MATHRLVMVRHGESTWNQENRFCGWFDAELSEKGTEEAKRGAKAIKDAKMEFDICYTSVLKRAIRTLWAILDGTDQMWLPVVRTWRLNERHYGGLTGLNKAETAAKHGEEQVKIWRRSFDIPPPPMDEKHPYYNSISKERRYAGLKPGELPTCESLKDTIAAHGNSLRGIVKHLEGMSDQAIMELNLPTGIPIVYELNKELKPTKPMQFLGDEETVRKAMEAVAAQGKAK

SEQ ID NO: 884661 - protein, 92 aa, Homo sapiens
IRNEASCALVPPRAVNWLRSPSTPRLDSQEPHLWGYAPTRDHCPQHSDSLFKTWLSAGPSVPTHSCATQPQRQKPMGHCALRGLTREPRAVP

SEQ ID NO: 884662 - protein, 132 aa, Homo sapiens
WQSDGRSTVDSAEDVHSLDSCEYIWEAGVGFAHSPQPNYIHDMNRMELLKLLLTCFSEAMYLPPAPESGSTNPWVQFFCSTENRHALPLFTSLLNTVCAYDPDECVIRNPVSASRSDPVLLISSRRLPKYLP

SEQ ID NO: 884663 - protein, 835 aa, Homo sapiens
AGPTRAGGGARRLSPARAAGAAELEPELKPEPGWSLGGGRAGAGSRDMGSTDSKLNFRKAVIQLTTKTQPVEATDDAFWDQFWADTATSVQDVFALVPAAEIRAVREESPSNLATLCYKAVEKLVQGAESGCHSEKEKQIVLNCSRLLTRVLPYIFEDPDWRGFFWSTVPGAGRGGQGEEDDEHARPLAESLLLAIADLLFCPDFTVQSHRRSTVDSAEDVHSLDSCEYIWEAGVGFAHSPQPNYIHDMNRMELLKLLLTCFSEAMYLPPAPESGSTNPWVQFFCSTENRHALPLFTSLLNTVCAYDPVGYGIPYNHLLFSDYREPLVEEAAQVLIVTLDHDSASSASPTVDGTTTGTAMDDADPPGPENLFVNYLSRIHREEDFQFILKGIARLLSNPLLQTYLPNSTKKIQFHQELLVLFWKLCDFNKKFLFFVLKSSDVLDILVPILFFLNDARADQSRVGLMHIGVFILLLLSGERNFGVRLNKPYSIRVPMDIPVFTGTHADLLIVVFHKIITSGHQRLQPLFDCLLTIVVNVSPYLKSLSMVTANKLLHLLEAFSTTWFLFSAAQNHHLVFFLLEVFNNIIQYQFDGNSNLVYAIIRKRSIFHQLANLPTDPPTIHKALQRRRRTPEPLSRTGSQEGTSMEGSRPAAPAEPGTLKTSLVATPGIDKLTEKSQVSEDGTLRSLEPEPQQSLEDGSPAKGEPSQAWREQRRPSTSSASGQWSPTPEWVLSWKSKLPLQTIMRLLQVLVPQVEKICIDKGLTDESEILRFLQHGTLVGLLPVPHPILIRKYQANSGTAMWFRTYMWGVIYLRNVDPPVWYDTDVKLFEIQRV

SEQ ID NO: 884664 - protein, 900 aa, Homo sapiens
AGPTRAGGGARRLSPARAAGAAELEPELKPEPGWSLGGGRAGAGSRDMGSTDSKLNFRKAVIQLTTKTQPVEATDDAFWDQFWADTATSVQDVFALVPAAEIRAVREESPSNLATLCYKAVEKLVQGAESGCHSEKEKQIVLNCSRLLTRVLPYIFEDPDWRGFFWSTVPGAGRGGQGEEDDEHARPLAESLLLAIADLLFCPDFTVQSHRRSTVDSAEDVHSLDSCEYIWEAGVGFAHSPQPNYIHDMNRMELLKLLLTCFSEAMYLPPAPESGSTNPWVQFFCSTENRHALPLFTSLLNTVCAYDPVGYGIPYNHLLFSDYREPLVEEAAQVLIVTLDHDSASSASPTVDGTTTGTAMDDADPPGPENLFVNYLSRIHREEDFQFILKGIARLLSNPLLQTYLPNSTKKIQFHQELLVLFWKLCDFNKKFLFFVLKSSDVLDILVPILFFLNDARADQCKTRVGVGCWGLSWRRGGGLAICPDSQELRPGTLTSYGGRPPKWSLPGPLLPPPTRVTPPTPPAAARVGLMHIGVFILLLLSGERNFGVRLNKPYSIRVPMDIPVFTGTHADLLIVVFHKIITSGHQRLQPLFDCLLTIVVNVSPYLKSLSMVTANKLLHLLEAFSTTWFLFSAAQNHHLVFFLLEVFNNIIQYQFDGNSNLVYAIIRKRSIFHQLANLPTDPPTIHKALQRRRRTPEPLSRTGSQEGTSMEGSRPAAPAEPGTLKTSLVATPGIDKLTEKSQVSEDGTLRSLEPEPQQSLEDGSPAKGEPSQAWREQRRPSTSSASGQWSPTPEWVLSWKSKLPLQTIMRLLQVLVPQVEKICIDKGLTDESEILRFLQHGTLVGLLPVPHPILIRKYQANSGTAMWFRTYMWGVIYLRNVDPPVWYDTDVKLFEIQRV

SEQ ID NO: 884665 - protein, 825 aa, Homo sapiens
AGPTRAGGGARRLSPARAAGAAELEPELKPEPGWSLGGGRAGAGSRDMGSTDSKLNFRKAVIQLTTKTQPVEATDDAFWDQFWADTATSVQDVFALVPAAEIRAVREESPSNLATLCYKAVEKLVQGAESGCHSEKEKQIVLNCSRLLTRVLPYIFEDPDWRGFFWSTVPGAGRGGQGEEDDEHARPLAESLLLAIADLLFCPDFTVQSHRRSTVDSAEDVHSLDSCEYIWEAGVGFAHSPQPNYIHDMNRMELLKLLLTCFSEAMYLPPAPESGSTNPWVQFFCSTENRHALPLFTSLLNTVCAYDPVGYGIPYNHLLFSDYREPLVEEAAQVLIVTLDHDSASSASPTVDGTTTGTAMDDADPPGPENLFVNYLSRIHREEDFQFILKGIARLLSNPLLQTYLPNSTKKIQFHQELLVLFWKLCDFNKKFLFFVLKSSDVLDILVPILFFLNDARADQSRVGLMHIGVFILLLLSGERNFGVRLNKPYSIRVPMDIPVFTGTHADLLIVVFHKIITSGHQRLQPLFDCLLTIVVNVSPYLKSLSMVTANKLLHLLEAFSTTWFLFSAAQNHHLVFFLLEVFNNIIQYQFDGNSNLVYAIIRKRSIFHQLANLPTDPPTIHKALQRRRRTPEPLSRTGSQEGTSMEGSRPAAPAEPGTLKTSLVATPGIDKLTEKSQVSEDGTLRSLEPEPQQSLEDGSPAKGEPSQAWREQRRPSTSSASGQWSPTPEWVLSWKSKLPLQTIMRLLQVLVPQVEKICIDKGLTDESEILRFLQHGTLVGLLPVPHPILIRKYQANSGTAMWFRTYMWGVIYLRWAPGSGVVST

SEQ ID NO: 884666 - protein, 859 aa, Homo sapiens
AGPTRAGGGARRLSPARAAGAAELEPELKPEPGWSLGGGRAGAGSRDMGSTDSKLNFRKAVIQLTTKTQPVEATDDAFWDQFWADTATSVQDVFALVPAAEIRAVREESPSNLATLCYKAVEKLVQGAESGCHSEKEKQIVLNCSRLLTRVLPYIFEDPDWRGFFWSTVPGAGRGGQGEEDDEHARPLAESLLLAIADLLFCPDFTVQSHRRSTVDSAEDVHSLDSCEYIWEAGVGFAHSPQPNYIHDMNRMELLKLLLTCFSEAMYLPPAPESGSTNPWVQFFCSTENRHALPLFTSLLNTVCAYDPVGYGIPYNHLLFSDYREPLVEEAAQVLIVTLDHDSASSASPTVDGTTTGTAMDDADPPGPENLFVNYLSRIHREEDFQFILKGIARLLSNPLLQTYLPNSTKKIQFHQELLVLFWKLCDFNKKFLFFVLKSSDVLDILVPILFFLNDARADQSRVGLMHIGVFILLLLSGERNFGVRLNKPYSIRVPMDIPVFTGTHADLLIVVFHKIITSGHQRLQPLFDCLLTIVVNVSPYLKSLSMVTANKLLHLLEAFSTTWFLFSAAQNHHLVFFLLEVFNNIIQYQFDGSPPRLDGGSWRGPPEAKACSLPTGNSNLVYAIIRKRSIFHQLANLPTDPPTIHKALQRRRRTPEPLSRTGSQEGTSMEGSRPAAPAEPGTLKTSLVATPGIDKLTEKSQVSEDGTLRSLEPEPQQSLEDGSPAKGEPSQAWREQRRPSTSSASGQWSPTPEWVLSWKSKLPLQTIMRLLQVLVPQVEKICIDKGLTDESEILRFLQHGTLVGLLPVPHPILIRKYQANSGTAMWFRTYMWGVIYLRNVDPPVWYDTDVKLFEIQRV

SEQ ID NO: 884667 - protein, 774 aa, Homo sapiens
AGPTRAGGGARRLSPARAAGAAELEPELKPEPGWSLGGGRAGAGSRDMGSTDSKLNFRKAVIQLTTKTQPVEATDDAFWDQFWADTATSVQDVFALVPAAEIRAVREESPSNLATLCYKAVEKLVQGAESGCHSEKEKQIVLNCSRLLTRVLPYIFEDPDWRGFFWSTVPGAGRGGQGEEDDEHARPLAESLLLAIADLLFCPDFTVQSHRRSTVDSAEDVHSLDSCEYIWEAGVGFAHSPQPNYIHDMNRMELLKLLLTCFSEAMYLPPAPESGSTNPWVQFFCSTENRHALPLFTSLLNTVCAYDPVGYGIPYNHLLFSDYREPLVEEAAQVLIVTLDHDSASSASPTVDGTTTGTAMDDADPPGPENLFVNYLSRIHREEDFQFILKGIARLLSNPLLQTYLPNSTKKIQFHQELLVLFWKLCDFNKKFLFFVLKSSDVLDILVPILFFLNDARADQSRVGLMHIGVFILLLLSGERNFGVRLNKPYSIRVPMDIPVFTGTHADLLIVVFHKIITSGHQRLQPLFDCLLTIVVNVSPYLKSLSMVTANKLLHLLEAFSTTWFLFSAAQNHHLVFFLLEVFNNIIQYQFDGNSNLVYAIIRKRSIFHQLANLPTDPPTIHKALQRRRRTPEPLSRTGSQEGTSMEGSREQRRPSTSSASGQWSPTPEWVLSWKSKLPLQTIMRLLQVLVPQVEKICIDKGLTDESEILRFLQHGTLVGLLPVPHPILIRKYQANSGTAMWFRTYMWGVIYLRNVDPPVWYDTDVKLFEIQRV

SEQ ID NO: 884668 - protein, 728 aa, Homo sapiens
AGPTRAGGGARRLSPARAAGAAELEPELKPEPGWSLGGGRAGAGSRDMGSTDSKLNFRKAVIQLTTKTQQGEEDDEHARPLAESLLLAIADLLFCPDFTVQSHRRSTVDSAEDVHSLDSCEYIWEAGVGFAHSPQPNYIHDMNRMELLKLLLTCFSEAMYLPPAPESGSTNPWVQFFCSTENRHALPLFTSLLNTVCAYDPVGYGIPYNHLLFSDYREPLVEEAAQVLIVTLDHDSASSASPTVDGTTTGTAMDDADPPGPENLFVNYLSRIHREEDFQFILKGIARLLSNPLLQTYLPNSTKKIQFHQELLVLFWKLCDFNKKFLFFVLKSSDVLDILVPILFFLNDARADQSRVGLMHIGVFILLLLSGERNFGVRLNKPYSIRVPMDIPVFTGTHADLLIVVFHKIITSGHQRLQPLFDCLLTIVVNVSPYLKSLSMVTANKLLHLLEAFSTTWFLFSAAQNHHLVFFLLEVFNNIIQYQFDGNSNLVYAIIRKRSIFHQLANLPTDPPTIHKALQRRRRTPEPLSRTGSQEGTSMEGSRPAAPAEPGTLKTSLVATPGIDKLTEKSQVSEDGTLRSLEPEPQQSLEDGSPAKGEPSQAWREQRRPSTSSASGQWSPTPEWVLSWKSKLPLQTIMRLLQVLVPQVEKICIDKGLTDESEILRFLQHGTLVGLLPVPHPILIRKYQANSGTAMWFRTYMWGVIYLRNVDPPVWYDTDVKLFEIQRV

SEQ ID NO: 884669 - protein, 607 aa, Homo sapiens
AGPTRAGGGARRLSPARAAGAAELEPELKPEPGWSLGGGRAGAGSRDMGSTDSKLNFRKAVIQLTTKTQPLLNTVCAYDPVGYGIPYNHLLFSDYREPLVEEAAQVLIVTLDHDSASSASPTVDGTTTGTAMDDADPPGPENLFVNYLSRIHREEDFQFILKGIARLLSNPLLQTYLPNSTKKIQFHQELLVLFWKLCDFNKKFLFFVLKSSDVLDILVPILFFLNDARADQSRVGLMHIGVFILLLLSGERNFGVRLNKPYSIRVPMDIPVFTGTHADLLIVVFHKIITSGHQRLQPLFDCLLTIVVNVSPYLKSLSMVTANKLLHLLEAFSTTWFLFSAAQNHHLVFFLLEVFNNIIQYQFDGNSNLVYAIIRKRSIFHQLANLPTDPPTIHKALQRRRRTPEPLSRTGSQEGTSMEGSRPAAPAEPGTLKTSLVATPGIDKLTEKSQVSEDGTLRSLEPEPQQSLEDGSPAKGEPSQAWREQRRPSTSSASGQWSPTPEWVLSWKSKLPLQTIMRLLQVLVPQVEKICIDKGLTDESEILRFLQHGTLVGLLPVPHPILIRKYQANSGTAMWFRTYMWGVIYLRNVDPPVWYDTDVKLFEIQRV

SEQ ID NO: 884670 - protein, 324 aa, Homo sapiens
SLNGASLSGHQRLQPLFDCLLTIVVNVSPYLKSLSMVTANKLLHLLEAFSTTWFLFSAAQNHHLVFFLLEVFNNIIQYQFDGNSNLVYAIIRKRSIFHQLANLPTDPPTIHKALQRRRRTPEPLSRTGSQEGTSMEGSRPAAPAEPGTLKTSLVATPGIDKLTEKSQVSEDGTLRSLEPEPQQSLEDGSPAKGEPSQAWREQRRPSTSSASGQWSPTPEWVLSWKSKLPLQTIMRLLQVLVPQVEKICIDKGLTDESEILRFLQHGTLVGLLPVPHPILIRKYQANSGTAMWFRTYMWGVIYLRNVDPPVWYDTDVKLFEIQRV

SEQ ID NO: 884671 - protein, 213 aa, Homo sapiens
KIGTIQRRLAWPLRKDDTQIREAVPYFSPAAPAEPGTLKTSLVATPGIDKLTEKSQVSEDGTLRSLEPEPQQSLEDGSPAKGEPSQAWREQRRPSTSSASGQWSPTPEWVLSWKSKLPLQTIMRLLQVLVPQVEKICIDKGLTDESEILRFLQHGTLVGLLPVPHPILIRKYQANSGTAMWFRTYMWGVIYLRNVDPPVWYDTDVKLFEIQRV

SEQ ID NO: 884672 - protein, 835 aa, Homo sapiens; identical to SEQ ID NO: 884663

SEQ ID NO: 884673 - protein, 190 aa, Homo sapiens [sequence omitted]

SEQ ID NO: 884674 - protein, 835 aa, Homo sapiens; identical to SEQ ID NO: 884663

SEQ ID NO: 884675 - protein, 447 aa, Homo sapiens
AGPTRAGGGARRLSPARAAGAAELEPELKPEPGWSLGGGRAGAGSRDMGSTDSKLNFRKAVIQLTTKTQPVEATDDAFWDQFWADTATSVQDVFALVPAAEIRAVREESPSNLATLCYKAVEKLVQGAESGCHSEKEKQIVLNCSRLLTRVLPYIFEDPDWRGFFWSTVPGAGRGGQGEEDDEHARPLAESLLLAIADLLFCPDFTVQSHRRSTVDSAEDVHSLDSCEYIWEAGVGFAHSPQPNYIHDMNRMELLKLLLTCFSEAMYLPPAPESGSTNPWVQFFCSTENRHALPLFTSLLNTVCAYDPVGYGIPYNHLLFSDYREPLVEEAAQVLIVTLDHDSASSASPTVDGTTTGTAMDDADPPGPENLFVNYLSRIHREEDFQFILKGIARLLSNPLLQTYLPNSTKKIQFHQELLVLFWKLCDFNKVGQPRGALQGDGEQLPQ

SEQ ID NO: 884676 - protein, 1115 aa, Homo sapiens
MNFEGLDPGLAEYAPAMHSALDPVLDAHLNPSLLQNVELDPEGVALEALPVQESVHIMEGVYSELHSVVAEVGVPVSVSHFDLHEEMLWVGSHGGHATSFFGPALERYSSFQVNGSDDIRQIQSLENGILFLTKNNLKYMARGGLIIFDYLLDENEDMHSLLLTDSSTLLVGGLQNHILEIDLNTVQETQKYAVETPGVTIMRQTNRFFFCGHTSGKVSLRDLRTFKVEHEFDAFSGSLSDFDVHGNLLAACGFSSRLTGLACDRFLKVYDLRMMRAITPLQVHVDPAFLRFIPTYTSRLAIISQSGQCQFCEPTGLANPADIFHVNPVGPLLMTFDVSASKQALAFGDSEGCVHLWTDSPEPSFNPYSRETEFALPCLVDSLPPLDWSQDLLPLSLIPVPLTTDTLLSDWPAANSAPAPRRAPPVDAEILRTMKKVGFIGYAPNPRTRLRNQIPYRLKESDSEFDSFSQVTESPVGREEEPHLHMVSKKYRKVTIKYSKLGLEDFDFKHYNKTLFAGLEPHIPNAYCNCMIQVLYFLEPVRCLIQNHLCQKEFCLACELGFLFHMLDLSRGDPCQGNNFLRAFRTIPEASALGLILADSDEASGKGNLARLIQRWNRFILTQLHQDMQELEIPQAYRGAGGSSFCSSGDSVIGQLFSCEMENCSLCRCGSETVRASSTLLFTLSYPDGSKDKTGKNYDFAQVLKRSICLDQNTQAWCDTCEKYQPTIQTRNIRHLPDILVINCEVNSSKEADFWRMQAEVAFKMAVKKHGGEISKNKEFALADWKELGSPEGVLVCPSIEELKNVWLPFSIRMKMTKNKGLDVCNWTDGDEMQWGPARAEEEHGVYVYDLMATVVHILDSRTGGSLVAHIKVGETYHQRKEGVTHQQWYLFNDFLIEPIDKHEAVQFDMNWKVPAILYYVKRNLNSRYNLNIKNPIEASVLLAEASLARKQRKTHTTFIPLMLNEMPQIGDLVGLDAEFVTLNEEEAELRSDGTKSTIKPSQMSVARITCVRGQGPNEGIPFIDDYISTQEQVVDYLTQYSGIKPGDLDAKISSKHLTTLKSTYLKLRFLIDIGVKFVGHGLQKDFRVINLMVWQGSFKSLLVRVGPSGYTLCL

SEQ ID NO: 884677 - protein, 1243 aa, Homo sapiens
MNFEGLDPGLAEYAPAMHSALDPVLDAHLNPSLLQNVELDPEGVALEALPVQESVHIMEGVYSELHSVVAEVGVPVSVSHFDLHEEMLWVGSHGGHATSFFGPALERYSSFQVNGSDDIRQIQSLENGILFLTKNNLKYMARGGLIIFDYLLDENEDMHSLLLTDSSTLLVGGLQNHILEIDLNTVQETQKYAVETPGVTIMRQTNRFFFCGHTSGKVSLRDLRTFKVEHEFDAFSGSLSDFDVHGNLLAACGFSSRLTGLACDRFLKVYDLRMMRAITPLQVHVDPAFLRFIPTYTSRLAIISQSGQCQFCEPTGLANPADIFHVNPVGPLLMTFDVSASKQALAFGDSEGCVHLWTDSPEPSFNPYSRETEFALPCLVDSLPPLDWSQDLLPLSLIPVPLTTDTLLSDWPAANSAPAPRRAPPVDAEILRTMKKVGFIGYAPNPRTRLRNQIPYRLKESDSEFDSFSQVTESPVGREEEPHLHMVSKKYRKVTIKYSKLGLEDFDFKHYNKTLFAGLEPHIPNAYCNCMIQVLYFLEPVRCLIQNHLCQKEFCLACELGFLFHMLDLSRGDPCQGNNFLRAFRTIPEASALGLILADSDEASGKGNLARLIQRWNRFILTQLHQDMQELEIPQAYRGAGGSSFCSSGDSVIGQLFSCEMENCSLCRCGSETVRASSTLLFTLSYPDGSKEWYTLQLSWEGSPKCPVISGRGCWGLTVGRGENQEYSINFPSDKTGKNYDFAQVLKRSICLDQNTQAWCDTCEKYQPTIQTRNIRHLPDILVINCEVNSSKEADFWRMQAEVAFKMAVKKHGGEISKNKEFALADWKELGSPEGVLVCPSIEELKNVWLPFSIRMKMTKNKGLDVCNWTDGDEMQWGPARAEEEHGVYVYDLMATVVHILDSRTGGSLVAHIKVGETYHQRKEGVTHQQWYLFNDFLIEPIDKHEAVQFDMNWKVPAILYYVKRNLNSRYNLNIKNPIEASVLLAEASLARKQRKTHTTFIPLMLNEMPQIGDLVGLDAEFVTLNEEEAELRSDGTKSTIKPSQMSVARITCVRGQGPNEGIPFIDDYISTQEQVVDYLTQYSGIKPGDLDAKISSKHLTTLKSTYLKLRFLIDIGVKFVGHGLQKDFRVINLMVPKDQVLDTVYLFHMPRKRMISLRFLAWYFLDLKIQGETHDSIEDARTALQLYRKYLELSKNGTEPESFHKVLKGLYEKGRKMDWKVPEPEGQTSPKNAAVFSSVLAL

SEQ ID NO: 884678 - protein, 1201 aa, Homo sapiens
MNFEGLDPGLAEYAPAMHSALDPVLDAHLNPSLLQNVELDPEGVALEALPVQESVHIMEGVYSELHSVVAEVGVPVSVSHFDLHEEMLWVGSHGGHATSFFGPALERYSSFQVNGSDDIRQIQSLENGILFLTKNNLKYMARGGLIIFDYLLDENEDMHSLLLTDSSTLLVGGLQNHILEIDLNTVQETQKYAVETPGVTIMRQTNRFFFCGHTSGKVSLRDLRTFKVEHEFDAFSGSLSDFDVHGNLLAACGFSSRLTGLACDRFLKVYDLRMMRAITPLQVHVDPAFLRFIPTYTSRLAIISQSGQCQFCEPTGLANPADIFHVNPVGPLLMTFDVSASKQALAFGDSEGCVHLWTDSPEPSFNPYSRETEFALPCLVDSLPPLDWSQDLLPLSLIPVPLTTDTLLSDWPAANSAPAPRRAPPVDAEILRTMKKVGFIGYAPNPRTRLRNQIPYRLKESDSEFDSFSQVTESPVGREEEPHLHMVSKKYRKVTIKYSKLGLEDFDFKHYNKTLFAGLEPHIPNAYCNCMIQVLYFLEPVRCLIQNHLCQKEFCLACELGFLFHMLDLSRGDPCQGNNFLRAFRTIPEASALGLILADSDEASGKGNLARLIQRWNRFILTQLHQDMQELEIPQAYRGAGGSSFCSSGDSVIGQLFSCEMENCSLCRCGSETVRASSTLLFTLSYPDGSKDKTGKNYDFAQVLKRSICLDQNTQAWCDTCEKYQPTIQTRNIRHLPDILVINCEVNSSKEADFWRMQAEVAFKMAVKKHGGEISKNKEFALADWKELGSPEGVLVCPSIEELKNVWLPFSIRMKMTKNKGLDVCNWTDGDEMQWGPARAEEEHGVYVYDLMATVVHILDSRTGGSLVAHIKVGETYHQRKEGVTHQQWYLFNDFLIEPIDKHEAVQFDMNWKVPAILYYVKRNLNSRYNLNIKNPIEASVLLAEASLARKQRKTHTTFIPLMLNEMPQIGDLVGLDAEFVTLNEEEAELRSDGTKSTIKPSQMSVARITCVRGQGPNEGIPFIDDYISTQEQVVDYLTQYSGIKPGDLDAKISSKHLTTLKSTYLKLRFLIDIGVKFVGHGLQKDFRVINLMVPKDQVLDTVYLFHMPRKRMISLRFLAWYFLDLKIQGETHDSIEDARTALQLYRKYLELSKNGTEPESFHKVLKGLYEKGRKMDWKVPEPEGQTSPKNAAVFSSVLAL

SEQ ID NO: 884679 - protein, 732 aa, Homo sapiens
GRAGSTHASGGTSISTWFLIKYRKVTIKYSKLGLEDFDFKHYNKTLFAGLEPHIPNAYCNCMIQVLYFLEPVRCLIQNHLCQKEFCLACELGFLFHMLDLSRGDPCQGNNFLRAFRTIPEASALGLILADSDEASGKGNLARLIQRWNRFILTQLHQDMQELEIPQAYRGAGGSSFCSSGDSVIGQLFSCEMENCSLCRCGSETVRASSTLLFTLSYPDGSKDKTGKNYDFAQVLKRSICLDQNTQAWCDTCEKYQPTIQTRNIRHLPDILVINCEVNSSKEADFWRMQAEVAFKMAVKKHGGEISKNKEFALADWKELGSPEGVLVCPSIEELKNVWLPFSIRMKMTKNKGLDVCNWTDGDEMQWGPARAEEEHGVYVYDLMATVVHILDSRTGGSLVAHIKVGETYHQRKEGVTHQQWYLFNDFLIEPIDKHEAVQFDMNWKVPAILYYVKRNLNSRYNLNIKNPIEASVLLAEASLARKQRKTHTTFIPLMLNEMPQIGDLVGLDAEFVTLNEEEAELRSDGTKSTIKPSQMSVARITCVRGQGPNEGIPFIDDYISTQEQVVDYLTQYSGIKPGDLDAKISSKHLTTLKSTYLKLRFLIDIGVKFVGHGLQKDFRVINLMVPKDQVLDTVYLFHMPRKRMISLRFLAWYFLDLKIQGETHDSIEDARTALQLYRKYLELSKNGTEPESFHKVLKGLYEKGRKMDWKVPEPEGQTSPKNAAVFSSVLAL

SEQ ID NO: 884680 - protein, 1183 aa, Homo sapiens
MNFEGLDPGLAEYAPAMHSALDPVLDAHLNPSLLQNVELDPEGVALEALPVQESVHIMEGVYSELHSVVAEVGVPVSVSHFDLHEEMLWVGSHGGHATSFFGPALERYSSFQVNGSDDIRQIQSLENGILFLTKNNLKYMARGGLIIFDYLLDENEDMHSLLLTDSSTLLVGGLQNHILEIDLNTVQETQKYAVETPGVTIMRQTNRFFFCGHTSGKVSLRDLRTFKVEHEFDAFSGSLSDFDVHGNLLAACGFSSRLTGLACDRFLKVYDLRMMRAITPLQVHVDPAFLRFIPTYTSRLAIISQSGQCQFCEPTGLANPADIFHVNPVGPLLMTFDVSASKQALAFGDSEGCVHLWTDSPEPSFNPYSRETEFALPCLVDSLPPLDWSQDLLPLSLIPVPLTTDTLLSDWPAANSAPAPRRAPPVDAEILRTMKKVGFIGYAPNPRTRLRNQIPYRLKESDSEFDSFSQVTESPVGREEEPHLHMVSKKYRKVTIKYSKLGLEDFDFKHYNKTLFAGLEPHIPNAYCNCMIQVLYFLEPVRCLIQNHLCQKEFCLACELGFLFHMLDLSRGDPCQGNNFLRAFRTIPEASALGLILADSDEASGKGNLARLIQRWNRFILTQLHQDMQELEIPQAYRGAGGSSFCSSGDSVIGQLFSCEMENCSLCRCGSETVRASSTLLFTLSYPDGSKDKTGKNYDFAQVLKRSICLDQNTQAWCDTCEKYQPTIQTRNIRHLPDILVINCEVNSSKEADFWRMQAEVAFKMAVKKHGGEISKNKEFALADWKELGSPEGVLVCPSIEELKNVWLPFSIRMKMTKNKGLDVCNWTDGDEMQWGPARAEEEHGVYVYDLMATVVHILDSRTGGSLVAHIKVGETYHQRKEGVTHQQWYLFNDFLIEPIDKHEAVQFDMNWKVPAILYYVKRNLNSRYNLNIKNPIEASVLLAEASLARKQRDLVGLDAEFVTLNEEEAELRSDGTKSTIKPSQMSVARITCVRGQGPNEGIPFIDDYISTQEQVVDYLTQYSGIKPGDLDAKISSKHLTTLKSTYLKLRFLIDIGVKFVGHGLQKDFRVINLMVPKDQVLDTVYLFHMPRKRMISLRFLAWYFLDLKIQGETHDSIEDARTALQLYRKYLELSKNGTEPESFHKVLKGLYEKGRKMDWKVPEPEGQTSPKNAAVFSSVLAL

SEQ ID NO: 884681 - protein, 1117 aa, Homo sapiens
MNFEGLDPGLAEYAPAMHSALDPVLDAHLNPSLLQNVELDPEGVALEALPVQESVHIMEGVYSELHSVVAEVGVPVSVSHFDLHEEMLWVGSHGGHATSFFGPALERYSSFQVNGSDDIRQIQSLENGILFLTKNNLKYMARGGLIIFDYLLDENEDMHSLLLTDSSTLLVGGLQNHILEIDLNTVQETQKYAVETPGVTIMRQTNRFFFCGHTSGKVSLRDLRTFKVEHEFDAFSGSLSDFDVHGNLLAACGFSSRLTGLACDRFLKVYDLRMMRAITPLQVHVDPAFLRFIPTYTSRLAIISQSGQCQFCEPTGLANPADIFHVNPVGPLLMTFDVSASKQALAFGDSEGCVHLWTDSPEPSFNPYSRETEFALPCLVDSLPPLDWSQDLLPLSLIPVPLTTDTLLSDWPAANSAPAPRRAPPVDAEILRTMKKVGFIGYAPNPRTRLRNQIPYRLKESDSEFDSFSQVTESPVGREEEPHLHMVSKKYRKVTIKYSKLGLEDFDFKHYNKTLFAGLEPHIPNAYCNCMIQVLYFLEPVRCLIQNHLCQKEFCLACELGFLFHMLDLSRGDPCQGNNFLRAFRTIPEASALGLILADSDEASGKGNLARLIQRWNRFILTQLHQDMQELEIPQAYRGAGGSSFCSSGDSVIGQLFSCEMENCSLCRCGSETVRASSTLLFTLSYPDGSKDKTGKNYDFAQVLKRSICLDQNTQAWCDTCEKYQPTIQTRNIRHLPDILVINCEVNSSKEADFWRMQAEVAFKMAVKKHGGEISKNKEFALADWKELGSPEGVLVCPSIEELKNVWLPFSIRMKMTKNKGLDVCNWTDGDEMQWGPARAEEEHGVYVYDLMATVVHILDSRTGGSLVAHIKVGETYHQRKEGVTHQQWYLFNDFLIEPIDKHEAVQFDMNWKVPAILYYVKRNLNSRYNLNIKNPIEASVLLAEASLARKQRKTHTTFIPLMLNEMPQIGDLVGLDAEFVTLNEEEAELRSDGTKSTIKPSQMSVARITCVRGQGPNEGIPFIDDYISTQEQVVDYLTQYSGIKPGDLDAKISSKHLTTLKSTYLKLRFLIDIGVKFVGHGLQKDFRVINLMVPKDQVLDTVYLFHMPPEDSRGNP

SEQ ID NO: 884682 - protein, 1183 aa, Homo sapiens
MNFEGLDPGLAEYAPAMHSALDPVLDAHLNPSLLQNVELDPEGVALEALPVQESVHIMEGVYSELHSVVAEVGVPVSVSHFDLHEEMLWVGSHGGHATSFFGPALERYSSFQVNGSDDIRQIQSLENGILFLTKNNLKYMARGGLIIFDYLLDENEDMHSLLLTDSSTLLVGGLQNHILEIDLNTVQETQKYAVETPGVTIMRQTNRFFFCGHTSGKVSLRDLRTFKVEHEFDAFSGSLSDFDVHGNLLAACGFSSRLTGLACDRFLKVYDLRMMRAITPLQVHVDPAFLRFIPTYTSRLAIISQSGQCQFCEPTGLANPADIFHVNPVGPLLMTFDVSASKQALAFGDSEGCVHLWTDSPEPSFNPYSRETEFALPCLVDSLPPLDWSQDLLPLSLIPVPLTTDTLLSDWPAANSAPAPRRAPPVDAEILRTMKKVGFIGYAPNPRTRLRNQIPYRLKESDSEFDSFSQVTESPVGREEEPHLHMVSKKYRKVTIKYSKLGLEDFDFKHYNKTLFAGLEPHIPNAYCNCMIQVLYFLEPVRCLIQNHLCQKEFCLACELGFLFHMLDLSRGDPCQGNNFLRAFRTIPEASALGLILADSDEASGKGNLARLIQRWNRFILTQLHQDMQELEIPQAYRGAGGSSFCSSGDSVIGQLFSCEMENCSLCRCGSETVRASSTLLFTLSYPDGSKDKTGKNYDFAQVLKRSICLDQNTQAWCDTCEKYQPTIQTRNIRHLPDILVINCEVNSSKEADFWRMQAEVAFKMAVKKHGGEISKNKEFALADWKELGSPEGVLVCPSIEELKNVWLPFSIRMKMTKNKGLDVCNWTDGDEMQWGPARAEEEHGVYVYDLMATVVHILDSRTGGSLVAHIKVGETYHQRKEGVTHQQWYLFNDFLIEPIDKHEAVQFDMNWKVPAILYYVKRNLNSRYNLNIKNPIEASVLLAEASLARKQRKTHTTFIPLMLNEMPQIGDLVGLDAEFVTLNEEEAELRSDGTKSTIKPSQMSVARITCVRGQGPNEGIPFIDDYISTQEQVVDYLTQYSGIKPGDLDAKISSKHLTTLKSTYLKLRFLIDIGVKFVGHGLQKDFRVINLMVPKDQVLDTVYLFHMPRKRMISLRFLAWYFLDLKIQGETHDSIEDARTALQLYRKYLELSKGRKMDWKVPEPEGQTSPKNAAVFSSVLAL

SEQ ID NO: 884683 - protein, 144 aa, Homo sapiens
DEDAVFAARALRNQEEAELRSDGTKSTIKPSQMSVARITCVRGQGPNEGIPFIDDYISTQEQVVDYLTQYSGIKPGDLDAKISSKHLTTLKSTYLKLRFLIDIGVKFVGHGLQKDFRVINLMVWQGSFKSLLVRVGPSGYTLCL

SEQ ID NO: 884684 - protein, 1201 aa, Homo sapiens; identical to SEQ ID NO: 884678

SEQ ID NO: 884685 - protein, 1150 aa, Homo sapiens
MNFEGLDPGLAEYAPAMHSALDPVLDAHLNPSLLQNVELDPEGVALEALPVQESVHIMEGVYSELHSVVAEVGVPVSVSHFDLHEEMLWVGSHGGHATSFFGPALERYSSFQVNGSDDIRQIQSLENGILFLTKNNLKYMARGGLIIFDYLLDENEDMHSLLLTDSSTLLVGGLQNHILEIDLNTVQETQKYAVETPGVTIMRQTNRFFFCGHTSGKVSLRDLRTFKVEHEFDAFSGSLSDFDVHGNLLAACGFSSRLTGLACDRFLKVYDLRMMRAITPLQVHVDPAFLRFIPTYTSRLAIISQSGQCQFCEPTGLANPADIFHVNPVGPLLMTFDVSASKQALAFGDSEGCVHLWTDSPEPSFNPYSRETEFALPCLVDSLPPLDWSQDLLPLSLIPVPLTTDTLLSDWPAANSAPAPRRAPPVDAEILRTMKKVGFIGYAPNPRTRLRNQIPYRLKESDSEFDSFSQVTESPVGREEEPHLHMVSKKYRKVTIKYSKLGLEDFDFKHYNKTLFAGLEPHIPNAYCNCMIQVLYFLEPVRCLIQNHLCQKEFCLACELGFLFHMLDLSRGDPCQGNNFLRAFRTIPEASALGLILADSDEASGKGNLARLIQRWNRFILTQLHQDMQELEIPQAYRGAGGSSFCSSGDSVIGQLFSCEMENCSLCRCGSETVRASSTLLFTLSYPDGSKDKTGKNYDFAQVLKRSICLDQNTQAWCDTCEKYQPTIQTRNIRHLPDILVINCEVNSSKEADFWRMQAEVAFKMAVKKHGGEISKNKEFALADWKELGSPEGVLVCPSIEELKNVWLPFSIRMKMTKNKGLDVCNWTDGDEMQWGPARAEEEHGVYVYDLMATVVHILDSRTGGSLVAHIKVGETYHQRKEGVTHQQWYLFNDFLIEPIDKHEAVQFDMNWKVPAILYYVKRNLNSRYNLNIKNPIEASVLLAEASLARKQRKTHTTFIPLMLNEMPQIGDLVGLDAEFVTLNEEEAELRSDGTKSTIKPSQMSVARITCVRGQGPNEGIPFIDDYISTQEQVVDYLTQYSGIKPGDLDAKISSKHLTTLKSTYLKLRFLIDIGVKFVGHGLQKDFRVINLMAQCTKPDTDYPFHMPRRRLITVRLLASYFLDLEIQRGTHDRIGDARTDLNLTQCIGL

SEQ ID NO: 884686 - protein, 842 aa, Homo sapiens
MNFEGLDPGLAEYAPAMHSALDPVLDAHLNPSLLQNVELDPEGVALEALPVQESVHIMEGVYSELHSVVAEVGVPVSVSHFDLHEEMLWVGSHGGHATSFFGPALERYSSFQVNGSDDIRQIQSLENGILFLTKNNLKYMARGGLIIFDYLLDENEDMHSLLLTDSSTLLVGGLQNHILEIDLNTVQETQKYAVETPGVTIMRQTNRFFFCGHTSGKVSLRDLRTFKVEHEFDAFSGSLSDFDVHGNLLAACGFSSRLTGLACDRFLKVYDLRMMRAITPLQVHVDPAFLRFIPTYTSRLAIISQSGQCQFCEPTGLANPADIFHVNPVGPLLMTFDVSASKQALAFGDSEGCVHLWTDSPEPSFNPYSRETEFALPCLVDSLPPLDWSQDLLPLSLIPVPLTTDTLLSDWPAANSAPAPRRAPPVDAEILRTMKKVGFIGYAPNPRTRLRNQIPYRLKESDSEFDSFSQVTESPVGREEEPHLHMVSKKYRKVTIKYSKLGLEDFDFKHYNKTLFAGLEPHIPNAYCNCMIQVLYFLEPVRCLIQNHLCQKEFCLACELGFLFHMLDLSRGDPCQGNNFLRAFRTIPEASALGLILADSDEASGKGNLARLIQRWNRFILTQLHQDMQELEIPQAYRGAGGSSFCSSGDSVIGQLFSCEMENCSLCRCGSETVRASSTLLFTLSYPDGSKDKTGKNYDFAQVLKRSICLDQNTQAWCDTCEKYQPTIQTRNIRHLPDILVINCEVNSSKEADFWRMQAEVAFKMAVKKHGGEISKNKEFALADWKELGSPEGVLVCPSIEELKNVWLPFSIRMKMTKNKGLDVCNWTDGDEMQRFGILKIT

SEQ ID NO: 884687 - protein, 94 aa, Homo sapiens
RIFVPSGFSGGGSVTEDTTVVQDLAQVTNCFRDTWRGQQVECWWPKQTSVANTIAKRAFGSWTKLGCRLHLFLLMAEKHLSSIPLACPKFCSIF

SEQ ID NO: 884688 - protein, 1201 aa, Homo sapiens; identical to SEQ ID NO: 884678

SEQ ID NO: 884689 - protein, 1062 aa, Homo sapiens
MARGGLIIFDYLLDENEDMHSLLLTDSSTLLVGGLQNHILEIDLNTVQETQKYAVETPGVTIMRQTNRFFFCGHTSGKVSLRDLRTFKVEHEFDAFSGSLSDFDVHGNLLAACGFSSRLTGLACDRFLKVYDLRMMRAITPLQVHVDPAFLRFIPTYTSRLAIISQSGQCQFCEPTGLANPADIFHVNPVGPLLMTFDVSASKQALAFGDSEGCVHLWTDSPEPSFNPYSRETEFALPCLVDSLPPLDWSQDLLPLSLIPVPLTTDTLLSDWPAANSAPAPRRAPPVDAEILRTMKKVGFIGYAPNPRTRLRNQIPYRLKESDSEFDSFSQVTESPVGREEEPHLHMVSKKYRKVTIKYSKLGLEDFDFKHYNKTLFAGLEPHIPNAYCNCMIQVLYFLEPVRCLIQNHLCQKEFCLACELGFLFHMLDLSRGDPCQGNNFLRAFRTIPEASALGLILADSDEASGKGNLARLIQRWNRFILTQLHQDMQELEIPQAYRGAGGSSFCSSGDSVIGQLFSCEMENCSLCRCGSETVRASSTLLFTLSYPDGSKDKTGKNYDFAQVLKRSICLDQNTQAWCDTCEKYQPTIQTRNIRHLPDILVINCEVNSSKEADFWRMQAEVAFKMAVKKHGGEISKNKEFALADWKELGSPEGVLVCPSIEELKNVWLPFSIRMKMTKNKGLDVCNWTDGDEMQWGPARAEEEHGVYVYDLMATVVHILDSRTGGSLVAHIKVGETYHQRKEGVTHQQWYLFNDFLIEPIDKHEAVQFDMNWKVPAILYYVKRNLNSRYNLNIKNPIEASVLLAEASLARKQRKTHTTFIPLMLNEMPQIGDLVGLDAEFVTLNEEEAELRSDGTKSTIKPSQMSVARITCVRGQGPNEGIPFIDDYISTQEQVVDYLTQYSGIKPGDLDAKISSKHLTTLKSTYLKLRFLIDIGVKFVGHGLQKDFRVINLMVPKDQVLDTVYLFHMPRKRMISLRFLAWYFLDLKIQGETHDSIEDARTALQLYRKYLELSKNGTEPESFHKVLKGLYEKGRKMDWKVPEPEGQTSPKNAAVFSSVLAL

SEQ ID NO: 884690 - protein, 1330 aa, Homo sapiens
MNFEGLDPGLAEYAPAMHSALDPVLDAHLNPSLLQNVELDPEGVALEALPVQESVHIMEGVYSELHSVVAEVGVPVSVSHFDLHEEMLWVGSHGGHATSFFGPALERYSSFQVNGSDDIRQIQSLENGILFLTKNNLKYMARGGLIIFDYLLDENEDMHSLLLTDSSTLLVGGLQNHILEIDLNTVQETQKYAVETPGVTIMRQTNRFFFCGHTSGKVSLRDLRTFKVEHEFDAFSGSLSDFDVHGNLLAACGFSSRLTGLACDRFLKVYDLRMMRAITPLQVHVDPAFLRFIPTYTSRLAIISQSGQCQFCEPTGLANPADIFHVNPVGPLLMTFDVSASKQALAFGDSEGCVHLWTDSPEPSFNPYSRETEFALPCLVDSLPPLDWSQDLLPLSLIPVPLTTDTLLSDWPAANSAPAPRRAPPVDAEILRTMKKVGFIGYAPNPRTRLRNQIPYRLKESDSEFDSFSQVTESPVGREEEPHLHMVSKKYRKVTIKYSKLGLEDFDFKHYNKTLFAGLEPHIPNAYCNCMIQVLYFLEPVRCLIQNHLCQKEFCLACELGFLFHMLDLSRGDPCQGNNFLRAFRTIPEASALGLILADSDEASGKGNLARLIQRWNRFILTQLHQDMQELEIPQAYRGAGGSSFCSSGDSVIGQLFSCEMENCSLCRCGSETVRASSTLLFTLSYPDGSKDKTGKNYDFAQVLKRSICLDQNTQAWCDTCEKYQPTIQTRNIRHLPDILVINCEVNSSKEADFWRMQAEVAFKMAVKKHGGEISKNKEFALADWKELGSPEGVLVCPSIEELKNVWLPFSIRMKMTKNKGLDVCNWTDGDEMQWGPARAEEEHGVYVYDLMATVVHILDSRTGGSLVAHIKVGETYHQRKEVSEVVEGRNTPGMATVSPRSVLESETEWSSHQFVSPQAFFVFPWALLTSSGICSMTFLLNLLIRLVATCSVSSFISPFPSILIFEGSIECQADSTGREEGILRNKNHEHLKIAPEKKQKLAPESWPPSEVGEKEKGDIHYAISAFSLLQHEAVQFDMNWKVPAILYYVKRNLNSRYNLNIKNPIEASVLLAEASLARKQRKTHTTFIPLMLNEMPQIGDLVGLDAEFVTLNEEEAELRSDGTKSTIKPSQMSVARITCVRGQGPNEGIPFIDDYISTQEQVVDYLTQYSGIKPGDLDAKISSKHLTTLKSTYLKLRFLIDIGVKFVGHGLQKDFRVINLMVPKDQVLDTVYLFHMPRKRMISLRFLAWYFLDLKIQGETHDSIEDARTALQLYRKYLELSKNGTEPESFHKVLKGLYEKGRKMDWKVPEPEGQTSPKNAAVFSSVLAL

SEQ ID NO: 884691 - protein, 1094 aa, Homo sapiens
MNFEGLDPGLAEYAPAMHSALDPVLDAHLNPSLLQNVELDPEGVALEALPVQESVHIMEGVYSELHSVVAEVGVPVSVSHFDLHEEMLWVGSHGGHATSFFGPALERYSSFQVNGSDDIRQIQSLENGILFLTKNNLKYMARGGLIIFDYLLDENEDMHSLLLTDSSTLLVGGLQNHILEIDLNTVQETQKYAVETPGVTIMRQTNRFFFCGHTSGKVSLRDLRTFKVEHEFDAFSGSLSDFDVHGNLLAACGFSSRLTGLACDRFLKVYDLRMMRAITPLQVHVDPAFLRFIPTYTSRLAIISQSGQCQFCEPTGLANPADIFHVNPVGPLLMTFDVSASKQALAFGDSEGCVHLWTDSPEPSFNPYSRETEFALPCLVDSLPPLDWSQDLLPLSLIPVPLTTDTLLSDWPAANSAPAPRRAPPVDAEILRTMKKVGFIGYAPNPRTRLRNQIPYRLKESDSEFDSFSQVTESPVGREEEPHLHMVSKKYRKVTIKYSKLGLEDFDFKHYNKTLFAGLEPHIPNAYCNCMIQVLYFLEPVRCLIQNHLCQKEFCLACELGFLFHMLDLSRGDPCQGNNFLRAFRTIPEASALGLILADSDEASGKGNLARLIQRWNRFILTQLHQDMQELEIPQAYRGAGGSSFCSSGDSVIGQLFSCEMENCSLCRCGSETVRASSTLLFTLSYPDGSKDKTGKNYDFAQVLKRSICLDQNTQAWCDTCEKYQPTIQTRNIRHLPDILVINCEVNSSKEADFWRMQAEVAFKMAVKKHGGEISKNKEFALADWKELGSPEGVLVCPSIEELKNVWLPFSIRMKMTKNKGLDVCNWTDGDEMQWGPARAEEEHGVYVYDLMATVVHILDSRTGGSLVAHIKVGETYHQRKEGVTHQQWYLFNDFLIEPIDKHEAVQFDMNWKVPAILYYVKRNLNSRYNLNIKNPIEASVLLAEASLARKQRKTHTTFIPLMLNEMPQIGDLVGLDAEFVTLNEEEAELRSDGTKSTIKPSQMSVARITCVRGQGPNEGIPFIDDYISTQEQVVDYLTQYSGIKPGDLDAKISSKHLTTLKSTYLKLRFLIDIGVKFVGHGLQKDFRVINLMT

SEQ ID NO: 884692 - protein, 1115 aa, Homo sapiens; identical to SEQ ID NO: 884676

SEQ ID NO: 884693 - protein, 66 aa, Homo sapiens
GAILDSGQFWTLMFADRYYPSQRTTALSLYCSIAPELGDGFLSWLYLVHFQYWTCSGSRVTDGAIN

SEQ ID NO: 884694 - protein, 1220 aa, Homo sapiens
MNFEGLDPGLAEYAPAMHSALDPVLDAHLNPSLLQNVELDPEGVALEALPVQESVHIMEGVYSELHSVVAEVGVPVSVSHFDLHEEMLWVGSHGGHATSFFGPALERYSSFQVNGSDDIRQIQSLENGILFLTKNNLKYMARGGLIIFDYLLDENEDMHSLLLTDSSTLLVGGLQNHILEIDLNTVQETQKYAVETPGVTIMRQTNRFFFCGHTSGKVSLRDLRTFKVEHEFDAFSGSLSDFDVHGNLLAACGFSSRLTGLACDRFLKVYDLRMMRAITPLQVHVDPAFLRFIPTYTSRLAIISQSGQCQFCEPTGLANPADIFHVNPVGPLLMTFDVSASKQALAFGDSEGCVHLWTDSPEPSFNPYSRETEFALPCLVDSLPPLDWSQDLLPLSLIPVPLTTDTLLSDWPAANSAPAPRRAPPVDAEILRTMKKVGFIGYAPNPRTRLRNQIPYRLKESDSEFDSFSQVTESPVGREEEPHLHMVSKKYRKVTIKYSKLGLEDFDFKHYNKTLFAGLEPHIPNAYCNCMIQVLYFLEPVRCLIQNHLCQKEFCLACELGFLFHMLDLSRGDPCQGNNFLRAFRTIPEASALGLILADSDEASGKGNLARLIQRWNRFILTQLHQDMQELEIPQAYRGAGGSSFCSSGDSVIGQLFSCEMENCSLCRCGSETVRASSTLLFTLSYPDGSKDKTGKNYDFAQVLKRSICLDQNTQAWCDTCEKYQPTIQTRNIRHLPDILVINCEVNSSKEADFWRMQAEVAFKMAVKKHGGEISKNKEFALADWKELGSPEGVLVCPSIEELKNVWLPFSIRMKMTKNKGLDVCNWTDGDEMQWGPARAEEEHGVYVYDLMATVVHILDSRTGGSLVAHIKVGETYHQRKEGVTHQQWYLFNDFLIEPIDKHEAVQFDMNWKVPAILYYVKRNLNSRYNLNIKNPIEASVLLAEASLARKQRKTHTTFIPLMLNEMPQIGDLVGLDAEFVTLNEEEAELRSDGTKSTIKPSQMSVARITCVRGQGPNEGIPFIDDYISTQEQVVDYLTQYSGIKPGDLDAKISSKHLTTLKSTYLKLRFLIDIGVKFVGHGLQKDFRVINLMVPKDQVLDTVYLFHMPRKRMISLRFLAWYFLDLKIQGETHDSIEDARTALQLYRKYLELSKNGTEPESFHKVLKGLYEKGRKMDWKVPEPEGQTSPKSKTWDGTRETGLGGFCILFVCDRVSLCHPG

SEQ ID NO: 884695 - protein, 809 aa, Homo sapiens
MNFEGLDPGLAEYAPAMHSALDPVLDAHLNPSLLQNVELDPEGVALEALPVQESVHIMEGVYSELHSVVAEVGVPVSVSHFDLHEEMLWVGSHGGHATSFFGPALERYSSFQVNGSDDIRQIQSLENGILFLTKNNLKYMARGGLIIFDYLLDENEDMHSLLLTDSSTLLVGGLQNHILEIDLNTVQETQKYAVETPGVTIMRQTNRFFFCGHTSGKVSLRDLRTFKVEHEFDAFSGSLSDFDVHGNLLAACGFSSRLTGLACDRFLKVYDLRMMRAITPLQVHVDPAFLRFIPTYTSRLAIISQSGQCQFCEPTGLANPADIFHVNPVGPLLMTFDVSASKQALAFGDSEGCVHLWTDSPEPSFNPYSRETEFALPCLVDSLPPLDWSQDLLPLSLIPVPLTTDTLLSDWPAANSAPAPRRAPPVDAEILRTMKKVGFIGYAPNPRTRLRNQIPYRLKESDSEFDSFSQVTESPVGREEEPHLHMVSKKYRKVTIKYSKLGLEDFDFKHYNKTLFAGLEPHIPNAYCNCMIQVLYFLEPVRCLIQNHLCQKEFCLACELGFLFHMLDLSRGDPCQGNNFLRAFRTIPEASALGLILADSDEASGKGNLARLIQRWNRFILTQLHQDMQELEIPQAYRGAGGAAFAHRGTLLLGSSSAVRWRTAASAAVAVRPCEPHPGVTHQQWYLFNDFLIEPIDKHEAVQFDMNWKVPAILYYVKRNLNSRYNLNIKNPIEASVLLAEASLARKQRKTHTTFIPLMLNEMPQIGDLVGLDAEFVTLNEQCCQYHCQKGLWILDKAWLPASFIPADG

SEQ ID NO: 884696 - protein, 83 aa, Homo sapiens
LDPVLDAHLNPSLLQNVELDPEGVALEALPVQESVHIMEGVYSELHSVVAEVGVPVSVSHFDLHEEMLWVGSHGVRTVPLCEG

SEQ ID NO: 884697 - protein, 446 aa, Homo sapiens
NQLFHAVQRLQRVQNQLKSMRQAAADAKPESLMKRLEEEIKFNLYMVTEKFPKELENKKKELHFLQKVVSEPAMGHSDLLELESKINEINTEINQLIEKKMMRNEPIEGKLSLYRQQASIISRKKEAKAEELQEAKEKLASLEREASVKRNQTREFDGTEVLKGDEFKRYVNKLRSKSTVFKKKHQIIAELKAEFGLLQRTEELLKQRHENIQQQLQTMEEKKGISGYSYTQEELERVSALKSEVDEMKGRTLDDMSEMVKKLYSLVSEKKSALASVIKELRQLRQKYQELTQECDEKKSQYDSCAAGLESNRSKLEQEVRRLREECLQEESRYHYTNCMIKNLEVQLRRATDEMKAYISSDQQEKRKAIREQYTKNTAEQENLGKKLREKQKVIRESHGPNMKQAKMWRDLEQLMECKKQCFLKQQSQTSIGQVIQEGGEDRLIL

SEQ ID NO: 884698 - protein, 369 aa, Homo sapiens
MRACISLVLAVLCGLAWAEDHKESEPLPQLEEETEEALASNLYSAPTSCQGRCYEAFDKHHQCHCNARCQEFGNCCKDFESLCSDHEVSHSSDAITKEEIQSISEKIYRADTNKAQKEDIVLNSQNCISPSETRNQVDRCPKPLFTYVNEKLFSKPTYAAFINLLNNYQRATGHGEHFSAQELAEQDAFLREIMKTAVMKELYSFLHHQNRYGSEQEFVDDLKNMWFGLYSRGNEEGDSSGFEHVFSGEVKKGKVTGFHNWIRFYLEEKEGLVDYYSHIYDGPWDSYPDVLAMQFNWDGYYKEVGSAFIGSSPEFEFALYSLCFIARPGKVCQLSLGGYPLAVRTYTWDKSTYGNGKKYIATAYIVSST

SEQ ID NO: 884699 - protein, 140 aa, Homo sapiens
SRTYIRTRGTEWLEHVFSGEVKKGKVTGFHNWIRFYLEEKEGLVDYYSHIYDGPWDSYPDVLAMQFNWDGYYKEVGSAFIGSSPEFEFALYSLCFIARPGKVCQLSLGGYPLAVRTYTWDKSTYGNGKKYIATAYIVSST

SEQ ID NO: 884700 - protein, 503 aa, Homo sapiens
PFGRLHPQNLLSSPKSTMTCGSYCGGRAFSCISACGPRPGRCCITAAPYRGISCYRGLTGGFGSHSVCGGFRAGSCGRSFGYRSGGVCGPSPPCITTVSVNESLLTPLNLEIDPNAQCVKQEEKEQIKSLNSRFAAFIDKVRFLEQQNKLLETKLQFYQNRECCQSNLEPLFEGYIETLRREAECVEADSGRLASELNHVQEVLEGYKKKYEEEVSLRATAENEFVALKKDVDCAYLRKSDLEANVEALIQEIDFLRRLYEEEIRVLQSHISDTSVVVKLDNSRDLNMDCIIAEIKAQYDDIVTRSRAEAESWYRSKCEEMKATVIRHGETLRRTKEEINELNRMIQRLTAEVENAKCQNSKLEAAVAQSEQQGEAALSDARCKLAELEGALQKAKQDMACLIREYQEVMNSKLGLDIEIATYRRLLEGEEQRLCEGVGSVNVCVSSSRGGVVCGDLCASTTAPVVSTRVSSVPSNSNVVVGTTNACAPSARVGVCGGSCKRC

SEQ ID NO: 884701 - protein, 503 aa, Homo sapiens; identical to SEQ ID NO: 884700

SEQ ID NO: 884702 - protein, 923 aa, Homo sapiens
MQTLFGKKKSFDPSAREPPGSTAGLPQEPKTTAEDGVPAPPLLDPIVQQFGQFSKDKALEEEEDDRPYDPEEEYDPERAFDTQLVERGRRHEVERAPEAAAAEREEVAYDPEDETILEEAKVTVDDLPNRMCADVRRNSVERPAEPVAGAATPSLVEQQKMLEELNKQIEEQKRQLEEQEEALRQQRAAVGVSMAHFSVSDALMSPPPKSSLPKAELFQQEQQSADKPASLPPASQASNHRDPRQARRLATETGEGEGEPLSRLSARGAQGALPERDASRGGLVGQAPMPVPEEKEPASSPWASGEKPPAGSEQDGWKAEPGEGTRPATVGDSSARPARRVLLPTPPCGALQPGFPLQHDGERDPFTCPGFASQDKALGSAQYEDPRNLHSAGRSSSPAGETEGDREPQARPGEGTAPLPPPGQKVGGSQPPFQGQREPGPHALGMSGLHGPNFPGPRGPAPPFPEENIASNDGPRGPPPARFGAQKGPIPSLFSGQHGPPPYGDSRGPSPSYLGGPRGVAPSQFEERKDPHGEKREFQDAPYNEVTGAPAQFEGTEQAPFLGSRGGAPFQFGGQRRPLLSQLKGPRGGPPPSQFGGQRGPPPGHFVGPRGPHPSQFETARGPHPNQFEGPRGQAPNFMPGPRGIQPQQFEDQRVHSPPRFTNQRAPAPLQFGGLRGSAPFSEKNEQTPSRFHFQGQAPQVMKPGPRPLLELPSHPPQHRKDRWEEAGPPSALSSSAPGQGPEADGQWASADFREGKGHEYRNQTFEGRQRERFDVGPKEKPLEEPDAQGRASEDRRRERERGRNWSRERDWDRPREWDRHRDKDSSRDWDRNRERSANRDREREADRGKEWDRSRERSRNRERERDRRRDRDRSRSRERDRDKARDRERGRDRKDRSKSKESARDPKPEASRASDAGTASQA

SEQ ID NO: 884703 - protein, 923 aa, Homo sapiens; identical to SEQ ID NO: 884702

SEQ ID NO: 884704 - protein, 923 aa, Homo sapiens; identical to SEQ ID NO: 884702

SEQ ID NO: 884705 - protein, 923 aa, Homo sapiens; identical to SEQ ID NO: 884702

SEQ ID NO: 884706 - protein, 122 aa, Homo sapiens
KRGKGRAKARYEAWCCEREGSKMAARKGRRRTCETGEPMEAESGDTSSEGPAQVYLPGRGPPLREGEELVMDEEAYVLYHRAQTGAPCLSFDIVRDHLGDNRTELPLTLYLCPQNPVFCLFV

SEQ ID NO: 884707 - protein, 446 aa, Homo sapiens
MAARKGRRRTCETGEPMEAESGDTSSEGPAQVYLPGRGPPLREGEELVMDEEAYVLYHRAQTGAPCLSFDIVRDHLGDNRTELPLTLYLCAGTQAESAQSNRLMMLRMHNLHGTKPPPSEGSDEEEEEEDEEDEEERKPQLELAMVPHYGGINRVRVSWLGEEPVAGVWSEKGQVEVFALRRLLQVVEEPQALAAFLRDEQAQMKPIFSFAGHMGEGFALDWSPRVTGRLLTGDCQKNIHLWTPTDGGSWHVDQRPFVGHTRSVEDLQWSPTENTVFASCSADASIRIWDIRAAPSKACMLTTATAHDGDVNVISWSRREPFLLSGGDDGALKIWDLRQFKSGSPVATFKQHVAPVTSVEWHPQDSGVFAASGADHQITQWDLAVERDPEAGDVEADPGLADLPQQLLFVHQGETELKELHWHPQCPGLLVSTALSGFTIFRTISV

SEQ ID NO: 884708 - protein, 360 aa, Homo sapiens
MAARKGRRRTCETGEPMEAESGDTSSEGPAQVYLPGRGPPLREGEELVMDEEAYVLYHRAQTGAPCLSFDIVRDHLGDNRTELPLTLYLCAGTQAESAQSNRLMMLRMHNLHGTKPPPSEGSDEEEEEEDEEDEEERKPQLELAMVPHYGGINRVRVSWLGEEPVAGVWSEKGQVEVFALRRLLQVVEEPQALAAFLRDEQAQMKPIFSFAGHMGEGFALDWSPRVTGRLLTGDCQKNIHLWTPTDGGSWHVDQRPFVGHTRSVEDLQWSPTENTVFASCSADASIRIWDIRAAPSKACMLTTATAHDGDVNVISWSRREPFLLSGGDDGALKIWDLRQFKSVPSGHLSGVARDLRSGPE

SEQ ID NO: 884709 - protein, 446 aa, Homo sapiens; identical to SEQ ID NO: 884707

SEQ ID NO: 884710 - protein, 469 aa, Homo sapiens
MAARKGRRRTCETGEPMEAESGDTSSEGPAQVYLPGRGPPLREGEELVMDEEAYVLYHRAQTGAPCLSFDIVRDHLGDNRTELPLTLYLCAGTQAESAQSNRLMMLRMHNLHGTKPPPSEGSDEEEEEEDEEDEEERKPQLELAMVPHYGGINRVRVSWLGEEPVAGVWSEKGQVEVFALRRLLQVVEEPQALAAFLRDEQAQMKPIFSFAGHMGEGFALDWSPRVTGRLLTGDCQKNIHLWTPTDGGSWHVDQRPFVGHTRSVEDLQWSPTENTVFASCSADASIRIWDIRAAPSKACMLTTATAHDGDVNVISWSRREPFLLSGGDDGALKIWDLRQFKSGSPVATFKQHVAPVTSVEWHPQDSGVFAASGADHQITQWDLAVERDPEAGDVEADRMANYRRVWFWTGENDEGLAGPSAQVWDKGWKYTFRTHVGATAIVPSEGEGPGGQVEKGRANVERGLTNKKG

SEQ ID NO: 884711 - protein, 652 aa, Homo sapiens
ATPASQKQPEPIYSKKTEIQRQTVRAPFAKLFIFSALQVARQLLLQQQQQQQVSGLKSPKRNDKQPALQVPVSVAMMTPQVITPQQMQQILQQQVLSPQQLQVLLQQQQALMLQQQQLQEFYKKQQEQLQLQLLQQQHAGKQPKEQQQVATQQLAFQQQLLQMQQLQQQHLLSLQRQGLLTIQPGQPALPLQPLAQGMIPTELQQLWKEVTSAHTAEETTGNNHSSLDLTTTCVSSSAPSKTSLIMNPHASTNGQLSVHTPKRESLSHEEHPHSHPLYGHGVCKWPGCEAVCEDFQSFLKHLNSEHALDDRSTAQCRVQMQVVQQLELQLAKDKERLQAMMTHLHVKSTEPKAAPQPLNLVSSVTLSKSASEASPQSLPHTPTTPTAPLTPVTQGPSVITTTSMHTVGPIRRRYSDKYNVPISSADIAQNQEFYKNAEVRPPFTYASLIRQAILESPEKQLTLNEIYNWFTRMFAYFRRNAATWKNAVRHNLSLHKCFVRVENVKGAVWTVDEVEFQKRRPQKISGNPSLIKNMQSSHAYCTPLNAALQASMAENSIPLYTTASMGNPTLGNLASAIREELNGAMEHTNSNESDSSPGRSPMQAVHPVHVKEEPLDPEEAEGPLSLVTTANHSPDFDHDRDYEDEPVNEDME

SEQ ID NO: 884712 - protein, 505 aa, Homo sapiens
MKDGSRVSGYDDTSSYHSPANAADPPATSAEPSAAPGSPPAAAGPHASTGMIPTELQQLWKEVTSAHTAEETTGNNHSSLDLTTTCVSSSAPSKTSLIMNPHASTNGQLSVHTPKRESLSHEEHPHSHPLYGHGVCKWPGCEAVCEDFQSFLKHLNSEHALDDRSTAQCRVQMQVVQQLELQLAKDKERLQAMMTHLHVKSTEPKAAPQPLNLVSSVTLSKSASEASPQSLPHTPTTPTAPLTPVTQGPSVITTTSMHTVGPIRRRYSDKYNVPISSADIAQNQEFYKNAEVRPPFTYASLIRQAILESPEKQLTLNEIYNWFTRMFAYFRRNAATWKNAVRHNLSLHKCFVRVENVKGAVWTVDEVEFQKRRPQKISGNPSLIKNMQSSHAYCTPLNAALQASMAENSIPLYTTASMGNPTLGNLASAIREELNGAMEHTNSNESDSSPGRSPMQAVHPVHVKEEPLDPEEAEGPLSLVTTANHSPDFDHDRDYEDEPVNEDME

SEQ ID NO: 884713 - protein, 182 aa, Homo sapiens
AIRTNLSLHKCFIRVEDEFGSFWTVDDEEFKRGRHIQRGRPRKYCPDENFDELVAHNPSLIKNMQSSHAYCTPLNAALQASMAENSIPLYTTASMGNPTLGNLASAIREELNGAMEHTNSNESDSSPGRSPMQAVHPVHVKEEPLDPEEAEGPLSLVTTANHSPDFDHDRDYEDEPVNEDME

SEQ ID NO: 884714 - protein, 89 aa, Homo sapiens
LEDPFIGGHLASAIREELNGAMEHTNSNESDSSPGRSPMQAVHPVHVKEEPLDPEEAEGPLSLVTTANHSPDFDHDRDYEDEPVNEDME

SEQ ID NO: 884715 - protein, 94 aa, Homo sapiens
VMIALSSRVSRGGAGAGSRDTGEPQAALGVLRPQRASRGGASLAIRHRERGMCPSSGRVPEAFVDNSSFRTKHFGNGEGFDPFSDLLSAMNGWM

SEQ ID NO: 884716 - protein, 677 aa, Homo sapiens
MMQESGTETKSNGSAIQNGSGGSNHLLECGGLREGRSNGETPAVDIGAADLAHAQQQQQQALQVARQLLLQQQQQQQVSGLKSPKRNDKQPALQVPVSVAMMTPQVITPQQMQQILQQQVLSPQQLQVLLQQQQALMLQQQQLQEFYKKQQEQLQLQLLQQQHAGKQPKEQQQVATQQLAFQQQLLQMQQLQQQHLLSLQRQGLLTIQPGQPALPLQPLAQGMIPTELQQLWKEVTSAHTAEETTGNNHSSLDLTTTCVSSSAPSKTSLIMNPHASTNGQLSVHTPKRESLSHEEHPHSHPLYGHGVCKWPGCEAVCEDFQSFLKHLNSEHALDDRSTAQCRVQMQVVQQLELQLAKDKERLQAMMTHLHVKSTEPKAAPQPLNLVSSVTLSKSASEASPQSLPHTPTTPTAPLTPVTQGPSVITTTSMHTVGPIRRRYSDKYNVPISSADIAQNQEFYKNAEVRPPFTYASLIRQAILESPEKQLTLNEIYNWFTRMFAYFRRNAATWKNAVRHNLSLHKCFVRVENVKGAVWTVDEVEFQKRRPQKISGNPSLIKNMQSSHAYCTPLNAALQASMAENSIPLYTTASMGNPTLGNLASAIREELNGAMEHTNSNESDSSPGRSPMQAVHPVHVKEEPLDPEEAEGPLSLVTTANHSPDFDHDRDYEDEPVNEDME

SEQ ID NO: 884717 - protein, 677 aa, Homo sapiens; identical to SEQ ID NO: 884716

SEQ ID NO: 884718 - protein, 612 aa, Homo sapiens
LCTFQDLLNNEPTCLYQWTALSPHSQKGKVPVSVAMMTPQVITPQQMQQILQQQVLSPQQLQVLLQQQQALMLQQQQLQEFYKKQQEQLQLQLLQQQHAGKQPKEQQQVATQQLAFQQQLLQMQQLQQQHLLSLQRQGLLTIQPGQPALPLQPLAQGMIPTELQQLWKEVTSAHTAEETTGNNHSSLDLTTTCVSSSAPSKTSLIMNPHASTNGQLSVHTPKRESLSHEEHPHSHPLYGHGVCKWPGCEAVCEDFQSFLKHLNSEHALDDRSTAQCRVQMQVVQQLELQLAKDKERLQAMMTHLHVKSTEPKAAPQPLNLVSSVTLSKSASEASPQSLPHTPTTPTAPLTPVTQGPSVITTTSMHTVGPIRRRYSDKYNVPISSADIAQNQEFYKNAEVRPPFTYASLIRQAILESPEKQLTLNEIYNWFTRMFAYFRRNAATWKNAVRHNLSLHKCFVRVENVKGAVWTVDEVEFQKRRPQKISGNPSLIKNMQSSHAYCTPLNAALQASMAENSIPLYTTASMGNPTLGNLASAIREELNGAMEHTNSNESDSSPGRSPMQAVHPVHVKEEPLDPEEAEGPLSLVTTANHSPDFDHDRDYEDEPVNEDME

SEQ ID NO: 884719 - protein, 677 aa, Homo sapiens; identical to SEQ ID NO: 884716

SEQ ID NO: 884720 - protein, 761 aa, Homo sapiens
MMQESGTETKSNGSAIQNGSGGSNHLLECGGLREGRSNGETPAVDIGAADLAHAQQQQQQALQVARQLLLQQQQQQQVSGLKSPKRNDKQPALQVPVSVAMMTPQVITPQQMQQILQQQVLSPQQLQVLLQQQQALMLQQQQLQEFYKKQQEQLQLQLLQQQHAGKQPKEQQQVATQQLAFQQQLLQMQQLQQQHLLSLQRQGLLTIQPGQPALPLQPLAQGMIPTELQQLWKEVTSAHTAEETTGNNHSSLDLTTTCVSSSAPSKTSLIMNPHASTNGQLSVHTPKRESLSHEEHPHSHPLYGHGVCKWPGCEAVCEDFQSFLKHLNSEHALDDRSTAQCRVQMQVVQQLELQLAKDKERLQAMMTHLHVKSTEPKAAPQPLNLVSSVTLSKSASEASPQSLPHTPTTPTAPLTPVTQGPSVITTTSMHTVGPIRRRYSDKYNVPISSADIAQNQEFYKNAEVRPPFTYASLIRQAILESPEKQLTLNEIYNWFTRMFAYFRRNAATWKNAVRHNLSLHKCFVRVENVKGAVWTVDEVEFQKRRPQKISGNPSLIKNMQSSHAYCTPLNAALQASMAENSIPLYTTASMGNPTLGNLASAIREELNGAMEHTNSNESDSSPGRSPMQAVNPVHVRKNPPGSDKNPGEEKAEEEGVAEEEGVNQFSYPPSHRECCPAVEEEDDEEAVKKEAHRTSTSALSPGSKPSTWVSCPGEEENQATEDKRTERSKGARKTSVSPRSSGSDPRSWEYRSKRPAGDPLG

SEQ ID NO: 884721 - protein, 245 aa, Homo sapiens
MMQESGTETKSNGSAIQNGSGGSNHLLECGGLREGRSNGETPAVDIGAADLAHAQQQQQQALQVARQLLLQQQQQQQVSGLKSPKRNDKQPALQVPVSVAMMTPQVITPQQMQQILQQQVLSPQQLQVLLQQQQALMLQQQQLQEFYKKQQEQLQLQLLQQQHAGKQPKEQQQVATQQLAFQQQLLQMQQLQQQHLLSLQRQGLLTIQPGQPALPLQPLAQDFAFPRISVCQFSISCVCNVEIFW

SEQ ID NO: 884722 - protein, 109 aa, Homo sapiens
MMQESGTETKSNGSAIQNGSGGSNHLLECGGLREGRSNGETPAVDIGAADLAHAQQQQQQALQVARQLLLQQQQQQQVSGLKSPKRNDKQPALQVTILFLFKLTLYPLG

SEQ ID NO: 884723 - protein, 576 aa, Homo sapiens
ATPASQKQPEPIYSKKTEIQRQTVRAPFAKLFIFSALQVARQLLLQQQQQQQVSGLKSPKRNDKQPALQQQQVATQQLAFQQQLLQMQQLQQQHLLSLQRQGLLTIQPGQPALPLQPLAQGMIPTELQQLWKEVTSAHTAEETTGNNHSSLDLTTTCVSSSAPSKTSLIMNPHASTNGQLSVHTPKRESLSHEEHPHSHPLYGHGVCKWPGCEAVCEDFQSFLKHLNSEHALDDRSTAQCRVQMQVVQQLELQLAKDKERLQAMMTHLHVKSTEPKAAPQPLNLVSSVTLSKSASEASPQSLPHTPTTPTAPLTPVTQGPSVITTTSMHTVGPIRRRYSDKYNVPISSADIAQNQEFYKNAEVRPPFTYASLIRQAILESPEKQLTLNEIYNWFTRMFAYFRRNAATWKNAVRHNLSLHKCFVRVENVKGAVWTVDEVEFQKRRPQKISGNPSLIKNMQSSHAYCTPLNAALQASMAENSIPLYTTASMGNPTLGNLASAIREELNGAMEHTNSNESDSSPGRSPMQAVHPVHVKEEPLDPEEAEGPLSLVTTANHSPDFDHDRDYEDEPVNEDME

SEQ ID NO: 884724 - protein, 109 aa, Homo sapiens
GGGWAPAPRRTAKREPLPLGGPLECPAGTRKFVRGRERAASERAGRGQRQRRRGPWCCRRLLRGREGGAPTPSPDSAVSQKLLLTIPVSEQNISAMVRASIPSLICCQP

SEQ ID NO: 884725 - protein, 104 aa, Homo sapiens
MASMAENSIPLYTTASMGNPTLGNLASAIREELNGAMEHTNSNESDSSPGRSPMQAVHPVHVKEEPLDPEEAEGPLSLVTTANHSPDFDHDRDYEDEPVNEDME

SEQ ID NO: 884726 - protein, 114 aa, Homo sapiens
MMQESGTETKSNGSAIQNGSGGSNHLLECGGLREGRSNGETPAVDIGAADLAHAQQQQQQWHLINHQPSRSPSSWLKRLISSPWELEVLQVPLWGAVAETKMSGPVCQPNPSPF

SEQ ID NO: 884727 - protein, 617 aa, Homo sapiens
RSPPARRGRRTPRPARAGAPSPAPRAWRLHGECQVPVSVAMMTPQVITPQQMQQILQQQVLSPQQLQVLLQQQQALMLQQQQLQEFYKKQQEQLQLQLLQQQHAGKQPKEQQQVATQQLAFQQQLLQMQQLQQQHLLSLQRQGLLTIQPGQPALPLQPLAQGMIPTELQQLWKEVTSAHTAEETTGNNHSSLDLTTTCVSSSAPSKTSLIMNPHASTNGQLSVHTPKRESLSHEEHPHSHPLYGHGVCKWPGCEAVCEDFQSFLKHLNSEHALDDRSTAQCRVQMQVVQQLELQLAKDKERLQAMMTHLHVKSTEPKAAPQPLNLVSSVTLSKSASEASPQSLPHTPTTPTAPLTPVTQGPSVITTTSMHTVGPIRRRYSDKYNVPISSADIAQNQEFYKNAEVRPPFTYASLIRQAILESPEKQLTLNEIYNWFTRMFAYFRRNAATWKNAVRHNLSLHKCFVRVENVKGAVWTVDEVEFQKRRPQKISGNPSLIKNMQSSHAYCTPLNAALQASMAENSIPLYTTASMGNPTLGNLASAIREELNGAMEHTNSNESDSSPGRSPMQAVHPVHVKEEPLDPEEAEGPLSLVTTANHSPDFDHDRDYEDEPVNEDME

SEQ ID NO: 884728 - protein, 577 aa, Homo sapiens
MMTPQVITPQQMQQILQQQVLSPQQLQVLLQQQQALMLQQQQLQEFYKKQQEQLQLQLLQQQHAGKQPKEQQQVATQQLAFQQQLLQMQQLQQQHLLSLQRQGLLTIQPGQPALPLQPLAQGMIPTELQQLWKEVTSAHTAEETTGNNHSSLDLTTTCVSSSAPSKTSLIMNPHASTNGQLSVHTPKRESLSHEEHPHSHPLYGHGVCKWPGCEAVCEDFQSFLKHLNSEHALDDRSTAQCRVQMQVVQQLELQLAKDKERLQAMMTHLHVKSTEPKAAPQPLNLVSSVTLSKSASEASPQSLPHTPTTPTAPLTPVTQGPSVITTTSMHTVGPIRRRYSDKYNVPISSADIAQNQEFYKNAEVRPPFTYASLIRQAILESPEKQLTLNEIYNWFTRMFAYFRRNAATWKNAVRHNLSLHKCFVRVENVKGAVWTVDEVEFQKRRPQKISGNPSLIKNMQSSHAYCTPLNAALQASMAENSIPLYTTASMGNPTLGNLASAIREELNGAMEHTNSNESDSSPGRSPMQAVHPVHVKEEPLDPEEAEGPLSLVTTANHSPDFDHDRDYEDEPVNEDME

SEQ ID NO: 884729 - protein, 176 aa, Homo sapiens
MFSLLYLLQNAVRHNLSLHKCFVRVENVKGAVWTVDEVEFQKRRPQKISGNPSLIKNMQSSHAYCTPLNAALQASMAENSIPLYTTASMGNPTLGNLASAIREELNGAMEHTNSNESDSSPGRSPMQAVHPVHVKEEPLDPEEAEGPLSLVTTANHSPDFDHDRDYEDEPVNEDME

SEQ ID NO: 884730 - protein, 132 aa, Homo sapiens
MFFLHSNPSLIKNMQSSHAYCTPLNAALQASMAENSIPLYTTASMGNPTLGNLASAIREELNGAMEHTNSNESDSSPGRSPMQAVHPVHVKEEPLDPEEAEGPLSLVTTANHSPDFDHDRDYEDEPVNEDME

SEQ ID NO: 884731 - protein, 114 aa, Homo sapiens; identical to SEQ ID NO: 884726

SEQ ID NO: 884732 - protein, 72 aa, Homo sapiens
APGGTRGSPSPKSQPGWREPSDKAPGARNVPILRPVGASKYWTSSPPPFSPLSFLNLKIWRSKFSVECKVLR

SEQ ID NO: 884733 - protein, 373 aa, Homo sapiens
MSTTGQVIRCKAAILWKPGAPFSIEEVEVAPPKAKEVRIKVVATGLCGTEMKVLGSKHLDLLYPTILGHEGAGIVESIGEGVSTVKPGDKVITLFLPQCGECTSCLNSEGNFCIQFKQSKTQLMSDGTSRFTCKGKSIYHFGNTSTFCEYTVIKEISVAKIDAVAPLEKVCLISCGFSTGFGAAINTAKVTPGSTCAVFGLGGVGLSVVMGCKAAGAARIIGVDVNKEKFKKAQELGATECLNPQDLKKPIQEVLFDMTDAGIDFCFEAIGNLDVLAAALASCNESYGVCVVVGVLPASVQLKISGQLFFSGRSLKGSVFGGWKSRQHIPKLVADYMAEKLNLDPLITHTLNLDKINEAVELMKTGKCGKLPT

SEQ ID NO: 884734 - protein, 357 aa, Homo sapiens
MSTTGQVIRCKAAILWKPGAPFSIEEVEVAPPKAKEVRIKVVATGLCGTEMKVLGSKHLDLLYPTILGHEGAGIVESIGEGVSTVKPGDKVITLFLPQCGECTSCLNSEGNFCIQFKQSKTQLMSDGTSRFTCKGKEISVAKIDAVAPLEKVCLISCGFSTGFGAAINTAKVTPGSTCAVFGLGGVGLSVVMGCKAAGAARIIGVDVNKEKFKKAQELGATECLNPQDLKKPIQEVLFDMTDAGIDFCFEAIGNLDVLAAALASCNESYGVCVVVGVLPASVQLKISGQLFFSGRSLKGSVFGGWKSRQHIPKLVADYMAEKLNLDPLITHTLNLDKINEAVELMKTGKCIRCILLL

SEQ ID NO: 884735 - protein, 375 aa, Homo sapiens
MSTTGQVIRCKAAILWKPGAPFSIEEVEVAPPKAKEVRIKVVATGLCGTEMKVLGSKHLDLLYPTILGHEGAGIVESIGEGVSTVKPGDKVITLFLPQCGECTSCLNSEGNFCIQFKQSKTQLMSDGTSRFTCKGKSIYHFGNTSTFCEYTVIKEISVAKIDAVAPLEKVCLISCGFSTGFGAAINTAKVTPGSTCAVFGLGGVGLSVVMGCKAAGAARIIGVDVNKEKFKKAQELGATECLNPQDLKKPIQEVLFDMTDAGIDFCFEAIGNLDVLAAALASCNESYGVCVVVGVLPASVQLKISGQLFFSGRSLKGSVFGGWKSRQHIPKLVADYMAEKLNLDPLITHTLNLDKINEAVELMKTGKCIRCILLL

SEQ ID NO: 884736 - protein, 357 aa, Homo sapiens; identical to SEQ ID NO: 884734

SEQ ID NO: 884737 - protein, 357 aa, Homo sapiens; identical to SEQ ID NO: 884734

SEQ ID NO: 884738 - protein, 149 aa, Homo sapiens
MSTTGQVIRCKAAILWKPGAPFSIEEVEVAPPKAKEVRIKVVATGLCGTEMKVLGSKHLDLLYPTILGHEGAGIVESIGEGVSTVKPGDKVITLFLPQCGECTSCLNSEGNFCIQFNSTQLVFDVPAGLTCRETSCKIVQSLLRGNLGG

SEQ ID NO: 884739 - protein, 295 aa, Homo sapiens
MSTTGQVIRCKAAILWKPGAPFSIEEVEVAPPKAKEVRIKVVATGLCGTEMKVLGSKHLDLLYPTILGHEGAGIVESIGEGVSTVKPGDKVITLFLPQCGECTSCLNSEGNFCIQFKQSKTQLMSDGTSRFTCKGKSIYHFGNTSTFCEYTVIKEISVAKIDAVAPLEKVCLISCGFSTGFGAAINTAKVTPGSTCAVFGLGGVGLSVVMGCKAAGAARIIGVDVNKEKFKKAQELGATECLNPQDLKKPIQEVLFDMTDAGIDFCFEAIGNLDVLAGRADSTSLNWLLIIWQRS

SEQ ID NO: 884740 - protein, 360 aa, Homo sapiens
MSTTGQVIRCKAAILWKPGAPFSIEEVEVAPPKAKEVRIKVVATGLCGTEMKVLGSKHLDLLYPTILGHEGAGIVESIGEGVSTVKPGDKVITLFLPQCGECTSCLNSEGNFCIQFKQSKTQLMSDGTSRFTCKGKEISVAKIDAVAPLEKVCLISCGFSTGFGAAINTAKVTPGSTCAVFGLGGVGLSVVMGCKAAGAARIIGVDVNKEKFKKAQELGATECLNPQDLKKPIQEVLFDMTDAGIDFCFEAIGNLDVLAAALASCNESYGVCVVVGVLPASVQLKISGQLFFSGRSLKGSVFGGWKSRQHIPKLVADYMAEKLNLDPLITHTLNLDKINEAVELMKTGKCQRIFHQLNGI

SEQ ID NO: 884741 - protein, 357 aa, Homo sapiens; identical to SEQ ID NO: 884734

SEQ ID NO: 884742 - protein, 323 aa, Homo sapiens
MSERKVLNKYYPPDFDPSKIPKLKLPKDRQYVVRLMAPFNMRCKTCGEYIYKGKKFNARKETVQNEVYLGLPIFRFYIKCTRCLAEITFKTDPENTDYTMEHGATRNFQAEKLLEEEEKRVQKEREDEELNNPMKVLENRTKDSKLEMEVLENLQELKDLNQRQAHVDFEAMLRQHRLSEEERRRQQQEEDEQETAALLEEARKRRLLEDSDSEDEAAPSPLQPALRPNPTAILDEAPKPKRKVEVWEQSVGSLGSRPPLSRLVVVKKAKADPDCSNGQPQAAPTPGAPQNRKEANPTPLTPGASSLSQLGAYLDSDDSNGSN

SEQ ID NO: 884743 - protein, 323 aa, Homo sapiens; identical to SEQ ID NO: 884742

SEQ ID NO: 884744 - protein, 288 aa, Homo sapiens [sequence omitted]

SEQ ID NO: 884745 - protein, 282 aa, Homo sapiens
MSERKVLNKYYPPDFDPSKIPKLKLPKDRQYVVRLMAPFNMRCKTCGEYIYKGKKFNARKETVQNEVYLGLPIFRFYIKCTRCLAEITFKTDPENTDYTMEHGATRNFQAEKLLEEEEKRVQKEREDEELNNPMKVLENRTKDSKLEMEVLENLQELKDLNQRQAHVDFEAMLRQHRLSEEERRRQQQEEDEQETAALLEEARKRRLLEDSDSEDEAAPSPLQPALRPNPTAILDEAPKPKRKVEVWEQSVGSLGSRPPLSRLVVVKKAKAYLDSDDSNGSN

SEQ ID NO: 884746 - protein, 449 aa, Homo sapiens
MPATLLRAVARSHHILSKAHQCRRIGHLMLKPLKEFENTTCSTLTIRQSLDLFLPDKTASGLNKSQILEMNQKKSDTSMLSPLNAARCQDEKAHLPTMKSFGTHRRVTHKPNLLGSKWFIKILKRHFSSVSTETFVPKQDFPQVKRPLKASRTRQPSRTNLPVLSVNEDLMHCTAFATADEYHLGNLSQDLASHGYVEVTSLPRDAANILVMGVENSAKEGDPGTIFFFREGAAVFWNVKDKTMKHVMKVLEKHEIQPYEIALVHWENEELNYIKIEGQSKLHRGEIKLNSELDLDDAILEKFAFSNALCLSVKLAIWEASLDKFIESIQSIPEALKAGKKVKLSHEEVMQKIGELFALRHRINLSSDFLITPDFYWDRENLEGLYDKTCQFLSIGRRVKVMNEKLQHCMELTDLMRNHLNEKRALRLEWMIVILITIEVMFELGRVFF

SEQ ID NO: 884747 - protein, 208 aa, Homo sapiens
MPATLLRAVARSHHILSKAHQCRRIGHLMLKPLKEFENTTCSTLTIRQSLDLFLPDKTASGLNKSQILEMNQKKSDTSMLSPLNAARCQDEKAHLPTMKSFGTHRRVTHKPNLLGSKWFIKILKRHFSSVSTETFVPKQDFPQVKRPLKASRTRQPSRTNLPVLSVNEDLMHCTAFATADEYHLGNLSQDLASHGYVEVTSLPRGTSS

SEQ ID NO: 884748 - protein, 449 aa, Homo sapiens; identical to SEQ ID NO: 884746

SEQ ID NO: 884749 - protein, 406 aa, Homo sapiens
MPATLLRAVARSHHILSKAHQCRRIGHLMLKPLKEFENTTCSTLTIRQSLDLFLPDKTASGLNKSQILEMNQKKSDTSMLSPLNAARCQDEKAHLPTMKSFGTHRRVTHKPNLLGSKWFIKILKRHFSSVSTETFVPKQDFPQVKRPLKASRTRQPSRTNLPVLSVNEDLMHCTAFATADEYHLGNLSQDLASHGYVEVTSLPRDAANILVMGVENSAKEGDPGTIFFFREGAAVFWNVKDKTMKHVMKVLEKHEIQPYEIALVHWENEELNYIKIEGQSKLHRGEIKLNSELDLDDAILEKFAFSNALCLSVKLAIWEASLDKFIESIQSIPEALKAGKKVKLSHEEVMQKIGELFALRHRINLSSDFLITPDFYWDRENLEGLYDKTCQFLSIGRRVKVRILHF

SEQ ID NO: 884750 - protein, 224 aa, Homo sapiens
MVLSSGRAAVFWNVKDKTMKHVMKVLEKHEIQPYEIALVHWENEELNYIKIEGQSKLHRGEIKLNSELDLDDAILEKFAFSNALCLSVKLAIWEASLDKFIESIQSIPEALKAGKKVKLSHEEVMQKIGELFALRHRINLSSDFLITPDFYWDRENLEGLYDKTCQFLSIGRRVKVMNEKLQHCMELTDLMRNHLNEKRALRLEWMIVILITIEVMFELGRVFF

SEQ ID NO: 884751 - protein, 238 aa, Homo sapiens
MGVENSAKEGDPGTIFFFREGAAVFWNVKDKTMKHVMKVLEKHEIQPYEIALVHWENEELNYIKIEGQSKLHRGEIKLNSELDLDDAILEKFAFSNALCLSVKLAIWEASLDKFIESIQSIPEALKAGKKVKLSHEEVMQKIGELFALRHRINLSSDFLITPDFYWDRENLEGLYDKTCQFLSIGRRVKVMNEKLQHCMELTDLMRNHLNEKRALRLEWMIVILITIEVMFELGRVFF

SEQ ID NO: 884752 - protein, 277 aa, Homo sapiens
MPATLLRAVARSHHILSKAHQCRRIGHLMLKPLKEFENTTCSTLTIRQSLDLFLPDKTASGLNKSQILEMNQKKSDTSMLSPLNAARCQDEKAHLPTMKSFGTHRRVTHKPNLLGSKWFIKILKRHFSSVSTETFVPKQDFPQVKRPLKASRTRQPSRTNLPVLSVNEDLMHCTAFATADEYHLGNLSQDLASHGYVEVTSLPRDAANILVMGVENSAKEGDPGTIFFFREGAAVFWNVKDKTMKHVMKVLEKHEIQPYEIALVHWENEELNYIKIE

SEQ ID NO: 884753 - protein, 325 aa, Homo sapiens
GGRERPSRRWVGCSSERLGVRLFPCSPAEEACVPGASFFSSGGEDLMHCTAFATADEYHLGNLSQDLASHGYVEVTSLPRDAANILVMGVENSAKEGDPGTIFFFREGAAVFWNVKDKTMKHVMKVLEKHEIQPYEIALVHWENEELNYIKIEGQSKLHRGEIKLNSELDLDDAILEKFAFSNALCLSVKLAIWEASLDKFIESIQSIPEALKAGKKVKLSHEEVMQKIGELFALRHRINLSSDFLITPDFYWDRENLEGLYDKTCQFLSIGRRVKVMNEKLQHCMELTDLMRNHLNEKRALRLEWMIVILITIEVMFELGRVFF

SEQ ID NO: 884754 - protein, 159 aa, Homo sapiens
RRATRGADMEASESRKQARDREVPGPRERKRSRRRGSRGQTVTWPEFLPLSGTRVQCGCAVAGVGGSALPGDGLAAVVRGWGCGSFPAVLPRKRASLALPSSLPAERLVYCLFFSSSSGPAWRSAPWLLAARNVYSYGLRQCGCDPLPLTVIFGQLSWE

SEQ ID NO: 884755 - protein, 219 aa, Homo sapiens
MNRGFSVFSSRRPLDRGSSRGPGRSSRSPFTSSDFSLSPRYPGSGSISPGTPGTSSSRGIFLGSSRSPSDGAGLGASASVSIFSPILLFFSGFSSWFSASSFSRGVLMPSPFSLGAGVAGLEVQGLLVAEASGVVGDVLVGEEALEERLESALGSGISSGIDQRPLMCSNSCTFFLTRDMTPMRVNTCWRLSPSRGTPSAKVSEPSAPGSHRWRMNKDT

SEQ ID NO: 884756 - protein, 546 aa, Homo sapiens
MSSIQITSPARGSFRSSPSDTNAPTISFSFFTKHWRAVGGGCDEGPCRHLAVIGACGGQGPYGCGAEGRPVPRRCSVGTRRVGRCGVRLRALAGQPAEDAALGHLKAGCDGGYSGQRGWQAGHVRLHVAQQLLQLVQNLVQDGVGRLVPRQRLLGEVLVALGQALGLGEAGVEGHGGVRRLLRQVQVGRPPQLLLNHQRLLQELEPPGQELIFHLQKVPLIGFSFKWLVDNGKLSIILDVLPPCIAMEDNPSQKPIVMSSVPDLIEFPRGNSCPFLILPQCVKLCEATIGDIEHEPGLLCLFLSSPIGPWLISRPWSKLPVTFYIFSLAQIPCFPLRPLPVFLSINGFSSPLSPGVDSVADFSLSPRYPGSGSISPGTPGTSSSRGIFLGSSRSPSDGAGLGASASVSIFSPILLFFSGFSSWFSASSFSRGVLMPSPFSLGAGVAGLEVQGLLVAEASGVVGDVLVGEEALEERLESALGSGISSGIDQRPLMCSNSCTFFLTRDMTPMRVNTCWRLSPSRGTPSAKVSEPSAPGSHRWRMNKDT

SEQ ID NO: 884757 - protein, 125 aa, Homo sapiens
MAPAAALRAGLWGAFGCVQVAPSLSQPIGAQSDAIHQELVQEGGGQAFLQGSKAIHLADGDEGMEDISVVPLVCARGLQFSLQLHPGLHHLQGIGEYTGPAGCQATHQEVHGGIAVAGTDPRVRK

SEQ ID NO: 884758 - protein, 118 aa, Homo sapiens
MDERSRFLRFRGFPGLFSFCFLGPRFLFFTPNADGSSRMSSLSGGGGGGGGGSGGGGGGGGGKRWQPGGLWRSRPRSWPGPRPSTPSSSSSSSSSSAASTSSSSSNQYDWCSHKRKKF

SEQ ID NO: 884759 - protein, 1442 aa, Homo sapiens
MSTRCPCSFSFRSIFWSSMSFPDDLISAPPSEAPLGSLGDSIAATGKRYGWLQHFLRSIMILSSDTWFPPPREFKASKFRVRMYLKYFFCMGLSSTRTMSSVLAGMFLKTSALSLRSMCGPSNIMQFLDLVLFGYVSKLLQEALQVVKSLWGEEVQEMEELLQIILQWGSCQQQLMIYLVTIENPEKLGLVVLESMGLIYHKTGPADGTKCCLINGDQLIRCQENMELHLCLPFHLKSFLAPFDGIVLKGEFILTNDGPAVLVTRVCHHIEFGCPHLELPLPVNDGREWGTHQEGTFCVALLVELSRGRRWFVWSCLAPSHQLEWCQCPGPRRSVPVQPFQLIHVQGASSGCDKPWLSLIFHGRIISEENWEAHHPVAPSSSSYTCGAGQGLPPELVLGVSSSFAYVLRIQGYSFHLPPTWTGHMVSPSILLDSGNPLFIHTVVDDAVDGHPLWLDAKTIVLLLHLSIVRVFHFTLVALPIILAGAIVQGWGLIHVILPLVVSIHNQMEDFQLKLLGPGAVPVGESYPLDKELSLLICLEEDGGVGHLDFHLPVEGLALLQVAPPTANVGSSALDPSARGMCIGDTAIHHWECQAGEGLDNECGGGDARVTAQELPAVLAYAAVLHVIILLLLLPFFLSLLFVFFFFLLGLPLDPLLLTVRAAPFALWSPVKLRIKADEVVGTRAGVTQNNFPTLLAHLTVILVIRLVAINLLLPGQLQDSPGPSSSSFLAGLSLVSWCGQGHQAGLRHCGHCHCPGLIPQPLVQDLRRSEKTYEPPFFLLPPRSPSFILSGAIFFPRSFLRPSGTRGLLLRLLWPGPLPSLVLALRMGGGWISAAGGGGRAGGPEGAMGVADETAADTCSATAAAAAAAAAATAAADPLKGLLALNSLHLAPRMVIILDIGILGFFLAIRGLMKLAEGFVVGERVVILLREHMLHILQAPGQKQQLLMTSVPLAFAPHLPPPFSAALSSSPFFLGASFFVSDPVRFHIHCPHSLTSPGTHLAQNQIPPHCHASCVFGVFLACSPSASWVLVFSSSHPMLTAAAECHPYLAAGAAAAGAAVAAAAAAAGRGGSRGGCGGRGPGRGPARARVLPRRRPPHRPRRPPPPPPPPPTNMTGVLIRGRNFDTDIYTGKSMRRHMEKTAIYKMRREGSEETNPADTLILDFLAFRIITKSIFIVEATHSVIHCYGSPQQTKTVSKEYMGILYSLYCNLFKILKLFPNKKVNSYWTHFAHQALYRNSWVKVPGLNPGPHSYWPGRGSHRALSNFLVVQSAGNVGIVNSSLAASFMVVRGSLQLPAVDKEHQITASRVLLLPVVVSLSKRDRFAETRGISRLELKMHLLQLRLNYFSFLFFTPNADGSSRMSSLSGGGGGGGGGSGGGGGGGGGKRWQPGGLWRSRPRSWPGPRPSTPSSSSSSSSSSAASTSSSSSNQYDWCSHKRKKF

SEQ ID NO: 884760 - protein, 125 aa, Homo sapiens; identical to SEQ ID NO: 884757

SEQ ID NO: 884761 - protein, 76 aa, Homo sapiens
MAPAAALRAGLWGAFGCVQVAPSLSQPIGAQSDAIHQELVQEGGGQAFLQGSKAIHLADGDEGMDVTFLIQDPLER

SEQ ID NO: 884762 - protein, 219 aa, Homo sapiens; identical to SEQ ID NO: 884755

SEQ ID NO: 884763 - protein, 670 aa, Homo sapiens
MKKASRSVGSVPKVSAISKTQTAEKIKPENSSSASTGGKLVKPGTAASLSKTKSSDDLLAGMAGGVTVTNGVKGKKSTCPSAAPSASAPAMTTVENKSKISTGTASSTKRSTSTGNKESSSTRERLRERTRLNQSKKLPSAGQGANDMALAKRSRSRTATECDVRMSKSKSDNQISDRAALEAKVKDLLTLAKTKDVEILHLRNELRDMRAQLGINEDHSEGDEKSEKETIMAHQPTDVESTLLQLQEQNTAIREELNQLKNENRMLKDRLNALGFSLEQRLDNSEKLFGYQSLSPEITPGNQSDGGGTLTSSVEGSAPGSVEDLLSQDENTLMDHQHSNSMDNLDSECSEVYQPLTSSDDALDAPSSSESEGIPSIERSRKGSSGNASEVSVACLTERIHQMEENQHSTSEELQATLQELADLQQITQELNSENERLGEEKVILMESLCQQSDKLEHFSRQIEYFRSLLDEHHISYVIDEDVKSGRYMELEQRYMDLAENARFEREQLLGVQQHLSNTLKMAEQDNKEAQEMIGALKERSHHMERIIESEQKGKAALAATLEEYKATVASDQIEMNRLKAQLENEKQKVAELYSIHNSGDKSDIQDLLESVRLDKEKAETLASSLQEDLAHTRNDANRLQDAIAKVEDEYRAFQEEAKKQIEDLNMTLE

SEQ ID NO: 884764 - protein, 1176 aa, Homo sapiens
AGRPGKRRCGVGCFPEAGLNGSRLSHRVSSPPSPNQEIARERCGAARFACKCITKRQPRMKKASRSVGSVPKVSAISKTQTAEKIKPENSSSASTGGKLVKPGTAASLSKTKSSDDLLAGMAGGVTVTNGVKGKKSTCPSAAPSASAPAMTTVENKSKISTGTASSTKRSTSTGNKESSSTRERLRERTRLNQSKKLPSAGQGANDMALAKRSRSRTATECDVRMSKSKSDNQISDRAALEAKVKDLLTLAKTKDVEILHLRNELRDMRAQLGINEDHSEGDEKSEKETIMAHQPTDVESTLLQLQEQNTAIREELNQLKNENRMLKDRLNALGFSLEQRLDNSEKLFGYQSLSPEITPGNQSDGGGTLTSSVEGSAPGSVEDLLSQDENTLMDHQHSNSMDNLDSECSEVYQPLTSSDDALDAPSSSESEGIPSIERSRKGSSGNASEVSVACLTERIHQMEENQHSTSEELQATLQELADLQQITQELNSENERLGEEKVILMESLCQQSDKLEHFSRQIEYFRSLLDEHHISYVIDEDVKSGRYMELEQRYMDLAENARFEREQLLGVQQHLSNTLKMAEQDNKEAQEMIGALKERSHHMERIIESEQKGKAALAATLEEYKATVASDQIEMNRLKAQLENEKQKVAELYSIHNSGDKSDIQDLLESVRLDKEKAETLASSLQEDLAHTRNDANRLQDAIAKVEDEYRAFQEEAKKQIEDLNMTLEKLRSDLDEKETERSDMKETIFELEDEVEQHRAVKLHDNLIISDLENTVKKLQDQKHDMEREIKTLHRRLREESAEWRQFQADLQTAVVIANDIKSEAQEEIGDLKRRLHEAQEKNEKLTKELEEIKSRKQEEERGRVYNYMNAVERDLAALRQGMGLSRRSSTSSEPTPTVKTLIKSFDSASQVPNPAAAAIPRTPLSPSPMKTPPAAAVSPMQRHSISGPISTSKPLTALSDKRPNYGEIPVQEHLLRTSSASRPASLPRVPAMESAKTLSVSRRSSEEMKRDISAQEGASPASLMAMGTTSPQLSLSSSPTASVTPTTRSRIREERKDPLSALAREYGGSKRNALLKWCQKKTEGYQNIDITNFSSSWNDGLAFCALLHTYLPAHIPYQELNSQDKRRNFMLAFQAAESVGIKSTLDINEMVRTERPDWQNVMLYVTAIYKYFET

SEQ ID NO: 884765 - protein, 107 aa, Homo sapiens
YALGRGRGVIGRGKTEGYQNIDITNFSSSWNDGLAFCALLHTYLPAHIPYQELNSQDKRRNFMLAFQAAESVGIKSTLDINEMVRTERPDWQNVMLYVTAIYKYFET

SEQ ID NO: 884766 - protein, 1117 aa, Homo sapiens
MKKASRSVGSVPKVSAISKTQTAEKIKPENSSSASTGGKLVKPGTAASLSKTKSSDDLLAGMAGGVTVTNGVKGKKSTCPSAAPSASAPAMTTVENKSKISTGTASSTKRSTSTGNKESSSTRERLRERTRLNQSKKLPSAGQGANDMALAKRSRSRTATECDVRMSKSKSDNQISDRAALEAKVKDLLTLAKTKDVEILHLRNELRDMRAQLGINEDHSEGDEKSEKETIMAHQPTDVESTLLQLQEQNTAIREELNQLKNENRMLKDRLNALGFSLEQRLDNSEKLFGYQSLSPEITPGNQSDGGGTLTSSVEGSAPGSVEDLLSQDENTLMDHQHSNSMDNLDSECSEVYQPLTSSDDALDAPSSSESEGIPSIERSRKGSSGNASEVSVACLTERIHQMEENQHSTSEELQATLQELADLQQITQELNSENERLGEEKVILMESLCQQSDKLEHFSRQIEYFRSLLDEHHISYVIDEDVKSGRYMELEQRYMDLAENARFEREQLLGVQQHLSNTLKMAEQDNKEAQEMIGALKERSHHMERIIESEQKGKAALAATLEEYKATVASDQIEMNRLKAQLENEKQKVAELYSIHNSGDKSDIQDLLESVRLDKEKAETLASSLQEDLAHTRNDANRLQDAIAKVEDEYRAFQEEAKKQIEDLNMTLEKLRSDLDEKETERSDMKETIFELEDEVEQHRAVKLHDNLIISDLENTVKKLQDQKHDMEREIKTLHRRLREESAEWRQFQADLQTAVVIANDIKSEAQEEIGDLKRRLHEAQEKNEKLTKELEEIKSRKQEEERGRVYNYMNAVERDLAALRQGMGLSRRSSTSSEPTPTVKTLIKSFDSASQVPNPAAAAIPRTPLSPSPMKTPPAAAVSPMQRHSISGPISTSKPLTALSDKRPNYGEIPVQEHLLRTSSASRPASLPRVPAMESAKTLSVSRRSSEEMKRDISAQEGASPASLMAMGTTSPQLSLSSSPTASVTPTTRSRIREERKDPLSALAREYGGSKRNALLKWCQKKTEGYQNIDITNFSSSWNDGLAFCALLHTYLPAHIPYQELNSQDKRRNFMLAFQAAESVGIKSTLDINEMVRTERPDWQNVMLYVTAIYKYFET

SEQ ID NO: 884767 - protein, 183 aa, Homo sapiens
MESAKTLSVSRRSSEEMKRDISAQEGASPASLMAMGTTSPQLSLSSSPTASVTPTTRSRIREERKDPLSALAREYGGSKRNALLKWCQKKTEGYQNIDITNFSSSWNDGLAFCALLHTYLPAHIPYQELNSQDKRRNFMLAFQAAESVGIKSTLDINEMVRTERPDWQNVMLYVTAIYKYFET

SEQ ID NO: 884768 - protein, 1117 aa, Homo sapiens; identical to SEQ ID NO: 884766

SEQ ID NO: 884769 - protein, 576 aa, Homo sapiens
MPVAATNSETAMQQVLDNLGSLPSATGAAELDLIFLRGIMESPIVRSLAKVIMVLWFMQQNVFVPMKYMLKYFGAHERLEETKLEAVRDNNLELVQEILRDLAQLAEQSSTAAELAHILQEPHFQSLLETHDSVASKTYETPPPSPGLDPTFSNQPVPPDAVRMVGIRKTAGEHLGVTFRVEGGELVIARILHGGMVAQQGLLHVGDIIKEVNGQPVGSDPRALQELLRNASGSVILKILPSYQEPHLPRQVFVKCHFDYDPARDSLIPCKEAGLRFNAGDLLQIVNQDDANWWQACHVEGGSAGLIPSQLLEEKRKAFVKRDLELTPNSGTLCGSLSGKKKKRMMYLTTKNAEFDRHELLIYEEVARMPPFRRKTLVLIGAQGVGRRSLKNKLIMWDPDRYGTTVPYTSRRPKDSEREGQGYSFVSRGEMEADVRAGRYLEHGEYEGNLYGTRIDSIRGVVAAGKVCVLDVNPQAVKVLRTAEFVPYVVFIEAPDFETLRAMNRAALESGISTKQLTEADLRRTVEESSRIQRGYGHYFDLCLVNSNLERTFRELQTAMEKLRTEPQWVPVSWVY

SEQ ID NO: 884770 - protein, 225 aa, Homo sapiens
MAALASSLIRQKREVREPGGSRPVSAQRRVCPRGTKSLCQKQLLILLSKVRLCGGRPARPDRGPEPQLKGIVTKLFCRQGFYLQANPDGSIQGTPEDTSSFTHFNLIPVGLRVVTIQSAKLGHYMAMNAEGLLYSSPHFTAECRFKECVFENYYVLYASALYRQRRSGRAWYLGLDKEGQVMKGNRVKKTKAAAHFLPKLLEVAMYQEPSLHSVPEASPSSPPAP

SEQ ID NO: 884771 - protein, 569 aa, Homo sapiens
MAGSPGSGVSLEGISLESSEEAELQREAMQQVLDNLGSLPSATGAAELDLIFLRGIMESPIVRSLAKAHERLEETKLEAVRDNNLELVQEILRDLAQLAEQSSTAAELAHILQEPHFQSLLETHDSVASKTYETPPPSPGLDPTFSNQPVPPDAVRMVGIRKTAGEHLGVTFRVEGGELVIARILHGGMVAQQGLLHVGDIIKEVNGQPVGSDPRALQELLRNASGSVILKILPSYQEPHLPRQVFVKCHFDYDPARDSLIPCKEAGLRFNAGDLLQIVNQDDANWWQACHVEGGSAGLIPSQLLEEKRKAFVKRDLELTPNSGTLCGSLSGKKKKRMMYLTTKNAEFDRHELLIYEEVARMPPFRRKTLVLIGAQGVGRRSLKNKLIMWDPDRYGTTVPYTSRRPKDSEREGQGYSFVSRGEMEADVRAGRYLEHGEYEGNLYGTRIDSIRGVVAAGKVCVLDVNPQAVKVLRTAEFVPYVVFIEAPDFETLRAMNRAALESGISTKQLTEADLRRTVEESSRIQRGYGHYFDLCLVNSNLERTFRELQTAMEKLRTEPQWVPVSWVY

SEQ ID NO: 884772 - protein, 541 aa, Homo sapiens
MQQVLDNLGSLPSATGAAELDLIFLRGIMESPIVRSLAKAHERLEETKLEAVRDNNLELVQEILRDLAQLAEQSSTAAELAHILQEPHFQSLLETHDSVASKTYETPPPSPGLDPTFSNQPVPPDAVRMVGIRKTAGEHLGVTFRVEGGELVIARILHGGMVAQQGLLHVGDIIKEVNGQPVGSDPRALQELLRNASGSVILKILPSYQEPHLPRQVFVKCHFDYDPARDSLIPCKEAGLRFNAGDLLQIVNQDDANWWQACHVEGGSAGLIPSQLLEEKRKAFVKRDLELTPNSGTLCGSLSGKKKKRMMYLTTKNAEFDRHELLIYEEVARMPPFRRKTLVLIGAQGVGRRSLKNKLIMWDPDRYGTTVPYTSRRPKDSEREGQGYSFVSRGEMEADVRAGRYLEHGEYEGNLYGTRIDSIRGVVAAGKVCVLDVNPQAVKVLRTAEFVPYVVFIEAPDFETLRAMNRAALESGISTKQLTEADLRRTVEESSRIQRGYGHYFDLCLVNSNLERTFRELQTAMEKLRTEPQWVPVSWVY

SEQ ID NO: 884773 - protein, 225 aa, Homo sapiens; identical to SEQ ID NO: 884770

SEQ ID NO: 884774 - protein, 110 aa, Homo sapiens
LPPLCLVQPPAQCSDFAGPGSSAETPSLLPEGPGRLAGRGGKLRLRGTGREEPGAEASATRRRINRTGQSLSSKASSPNCSAARVSTSRRIPTEASRAPQRIPAPSPTST

SEQ ID NO: 884775 - protein, 552 aa, Homo sapiens
MPVAATNSETAMQQVLDNLGSLPSATGAAELDLIFLRGIMESPIVRSLAKAHERLEETKLEAVRDNNLELVQEILRDLAQLAEQSSTAAELAHILQEPHFQSLLETHDSVASKTYETPPPSPGLDPTFSNQPVPPDAVRMVGIRKTAGEHLGVTFRVEGGELVIARILHGGMVAQQGLLHVGDIIKEVNGQPVGSDPRALQELLRNASGSVILKILPSYQEPHLPRQVFVKCHFDYDPARDSLIPCKEAGLRFNAGDLLQIVNQDDANWWQACHVEGGSAGLIPSQLLEEKRKAFVKRDLELTPNSGTLCGSLSGKKKKRMMYLTTKNAEFDRHELLIYEEVARMPPFRRKTLVLIGAQGVGRRSLKNKLIMWDPDRYGTTVPYTSRRPKDSEREGQGYSFVSRGEMEADVRAGRYLEHGEYEGNLYGTRIDSIRGVVAAGKVCVLDVNPQAVKVLRTAEFVPYVVFIEAPDFETLRAMNRAALESGISTKQLTEADLRRTVEESSRIQRGYGHYFDLCLVNSNLERTFRELQTAMEKLRTEPQWVPVSWVY

SEQ ID NO: 884776 - protein, 552 aa, Homo sapiens; identical to SEQ ID NO: 884775

SEQ ID NO: 884777 - protein, 225 aa, Homo sapiens; identical to SEQ ID NO: 884770

SEQ ID NO: 884778 - protein, 712 aa, Homo sapiens
MAALASSLIRQKREVREPGGSRPVSAQRRVCPRGTKSLCQKQLLILLSKVRLCGGRPARPDRGPEPQLKGIVTKLFCRQGFYLQANPDGSIQGTPEDTSSFTHFNLIPVGLRVVTIQSAKLGHYMAMNAEGLLYSSTWRSPGLKCWVDPERRFRALASFTMPVAATNSETAMQQVLDNLGSLPSATGAAELDLIFLRGIMESPIVRSLAKAHERLEETKLEAVRDNNLELVQEILRDLAQLAEQSSTAAELAHILQEPHFQSLLETHDSVASKTYETPPPSPGLDPTFSNQPVPPDAVRMVGIRKTAGEHLGVTFRVEGGELVIARILHGGMVAQQGLLHVGDIIKEVNGQPVGSDPRALQELLRNASGSVILKILPSYQEPHLPRQVFVKCHFDYDPARDSLIPCKEAGLRFNAGDLLQIVNQDDANWWQACHVEGGSAGLIPSQLLEEKRKAFVKRDLELTPNSGTLCGSLSGKKKKRMMYLTTKNAEFDRHELLIYEEVARMPPFRRKTLVLIGAQGVGRRSLKNKLIMWDPDRYGTTVPYTSRRPKDSEREGQGYSFVSRGEMEADVRAGRYLEHGEYEGNLYGTRIDSIRGVVAAGKVCVLDVNPQAVKVLRTAEFVPYVVFIEAPDFETLRAMNRAALESGISTKQLTEADLRRTVEESSRIQRGYGHYFDLCLVNSNLERTFRELQTAMEKLRTEPQWVPVSWVY

SEQ ID NO: 884779 - protein, 169 aa, Homo sapiens
SAPTPHILEPQLKGIVTKLFCRQGFYLQANPDGSIQGTPEDTSSFTHFNLIPVGLRVVTIQSAKLGHYMAMNAEGLLYSSPHFTAECRFKECVFENYYVLYASALYRQRRSGRAWYLGLDKEGQVMKGNRVKKTKAAAHFLPKLLEVAMYQEPSLHSVPEASPSSPPAP

SEQ ID NO: 884780 - protein, 81 aa, Homo sapiens
LPPLCLVQPPAQCSDFAGPGSSAETPSLLPEGPGRLAGRGGKLRLRGTGREEPGAEASATRRRINRTGQVEGRREKEEGVL

SEQ ID NO: 884781 - protein, 209 aa, Homo sapiens
MPVAVMAESAFSFKKLLDQCENQELEAPGGIATPPVYGQLLALYLLHNDMNNARYLWKRIPPAIKSANSELGGIWSVGQRIWQRDFPGIYTTINAHQWSETVQPIMEALRDATRRRAFALVSQAYTSIIADDFAAFVGLPVEEAVKGILEQGWQADSTTRMVLPRKPVAGALDVSFNKFIPLSEPAPVPPIPNEQQLARLTDYVAFLEN

SEQ ID NO: 884782 - protein, 209 aa, Homo sapiens; identical to SEQ ID NO: 884781

SEQ ID NO: 884783 - protein, 209 aa, Homo sapiens; identical to SEQ ID NO: 884781

SEQ ID NO: 884784 - protein, 209 aa, Homo sapiens; identical to SEQ ID NO: 884781

SEQ ID NO: 884785 - protein, 160 aa, Homo sapiens
MNNARYLWKRIPPAIKSANSELGGIWSVGQRIWQRDFPGIYTTINAHQWSETVQPIMEALRDATRRRAFALVSQAYTSIIADDFAAFVGLPVEEAVKGILEQGWQADSTTRMVLPRKPVAGALDVSFNKFIPLSEPAPVPPIPNEQQLARLTDYVAFLEN

SEQ ID NO: 884786 - protein, 190 aa, Homo sapiens [sequence omitted]

SEQ ID NO: 884787 - protein, 180 aa, Homo sapiens
MDRRVLSLIYSSRLLPLNGRNISGASYHIPNLATHDLANSELGGIWSVGQRIWQRDFPGIYTTINAHQWSETVQPIMEALRDATRRRAFALVSQAYTSIIADDFAAFVGLPVEEAVKGILEQGWQADSTTRMVLPRKPVAGALDVSFNKFIPLSEPAPVPPIPNEQQLARLTDYVAFLEN

SEQ ID NO: 884788 - protein, 104 aa, Homo sapiens [sequence omitted]

SEQ ID NO: 884789 - protein, 193 aa, Homo sapiens
MPVAVMAESAFSFKKLLDQCENQELEAPGGIATPPVYGQLLALYLLHNDMNNARYLWKRIPPAIKSANSELGGIWSVGQRIWQRDFPGIYTTINAHQWSETVQPIMEALRDATRRRAFALVSQAYTSIIADDFAAFVGLPVEEAVKGILEQGWQADSTTRMVLPRKPEPAPVPPIPNEQQLARLTDYVAFLEN

SEQ ID NO: 884790 - protein, 209 aa, Homo sapiens; identical to SEQ ID NO: 884781

SEQ ID NO: 884791 - protein, 106 aa, Homo sapiens
MPVAVMAESAFSFKKLLDQCENQELEAPGGIATPPVYGQLLALYLLHNDIVSMFEPKAKSNRFLKVIWKYFCTEVAPLNIGTTSYLFYYSNFNVYFLLNHRLMNYD

SEQ ID NO: 884792 - protein, 209 aa, Homo sapiens; identical to SEQ ID NO: 884781

SEQ ID NO: 884793 - protein, 114 aa, Homo sapiens
MPVAVMAESAFSFKKLLDQCENQELEVTLCVALGETAEYVLGPGAAPVSRVTGSEASGLWELTGRAWEVDVWIPDRRNLLRPGPVSPNSPGPFCYVSSACEPENPVRLCSSTYR

SEQ ID NO: 884794 - protein, 209 aa, Homo sapiens; identical to SEQ ID NO: 884781

SEQ ID NO: 884795 - protein, 209 aa, Homo sapiens; identical to SEQ ID NO: 884781

SEQ ID NO: 884796 - protein, 215 aa, Homo sapiens
MPVAVMAESAFSFKKLLDQCENQELEAPGGIATPPVYGQLLALYLLHNDIVVAEIRNNARYLWKRIPPAIKSANSELGGIWSVGQRIWQRDFPGIYTTINAHQWSETVQPIMEALRDATRRRAFALVSQAYTSIIADDFAAFVGLPVEEAVKGILEQGWQADSTTRMVLPRKPVAGALDVSFNKFIPLSEPAPVPPIPNEQQLARLTDYVAFLEN

SEQ ID NO: 884797 - protein, 190 aa, Homo sapiens [sequence omitted]

SEQ ID NO: 884798 - protein, 127 aa, Homo sapiens
MPVAVMAESAFSFKKLLDQCENQELEAPGGIATPPVYGQLLALYLLHNDMNNARYLWKRIPPAIKSESGREISLGSIQPSTLTSGLRRSSQLWKHLEMQQGDAPLPWSLKRILQSSPMILQPLLDFL

SEQ ID NO: 884799 - protein, 76 aa, Homo sapiens
SRGIPGFLQEAVKGILEQGWQADSTTRMVLPRKPVAGALDVSFNKFIPLSEPAPVPPIPNEQQLARLTDYVAFLEN

SEQ ID NO: 884800 - protein, 106 aa, Homo sapiens; identical to SEQ ID NO: 884791

SEQ ID NO: 884801 - protein, 211 aa, Homo sapiens
RGAGVGDITGQALSGNTKFHAGSWESWCCCCLIPADRPWDRGQHWQLEMADTRSVHETRFEAAVKVIQSLPKNVIPHNNEQTLDIAEHAAKQATLRGPRRTAQARRQEHPELARKITGEARRDTDGNDQRGKPGLASTRKNVKRTMDNDATDVQTKTQEEKRHEGTEGNTDDGTNRVTGTRKKRQQRPEKEETKSVTTKQRTENSRRQREK

SEQ ID NO: 884802 - protein, 525 aa, Homo sapiens
MLFLSFHAGSWESWCCCCLIPADRPWDRGQHWQLEMADTRSVHETRFEAAVKVIQSLPKNGSFQPTNEMMLKFYSFYKQATEGPCKLSRPGFWDPIGRYKWDAWSSLGDMTKEEAMIAYVEEMKKIIETMPMTEKVEELLRVIGPFYEIVEDKKSGRSSDITSDLGNVLTSTPNAKTVNGKAESSDSGAESEEEEAQEEVKGAEQSDNDKKMMKKSADHKNLEVIVTNGYDKDGFVQDIQNDIHASSSLNGRSTEEVKPIDENLGQTGKSAVCIHQDINDDHVEDVTGIQHLTSDSDSEVYCDSMEQFGQEESLDSFTSNNGPFQYYLGGHSSQPMENSGFREDIQVPPGNGNIGNMQVVAVEGKGEVKHGGEDGRNNSGAPHREKRGGETDEFSNVRRGRGHRMQHLSEGTKGRQVGSGGDGERWGSDRGSRGSLNEQIALVLMRLQEDMQNVLQRLQKLETLTALQAKSSTSTLQTAPQPTSQRPSWWPFEMSPGVLTFAIIWPFIAQWLVYLYYQRRRRKLN

SEQ ID NO: 884803 - protein, 112 aa, Homo sapiens
RGAGVGDITGQALSGNTKFHAGSWESWCCCCLIPADRPWDRGQHWQLEMADTRSVHETRFEAAVKVIQSLPKNEFSCLRLLSSWDYNCMPPHLANFCIFSRDRVLPCWPGWS

SEQ ID NO: 884804 - protein, 525 aa, Homo sapiens; identical to SEQ ID NO: 884802

SEQ ID NO: 884805 - protein, 112 aa, Homo sapiens; identical to SEQ ID NO: 884803

SEQ ID NO: 884806 - protein, 525 aa, Homo sapiens; identical to SEQ ID NO: 884802

SEQ ID NO: 884807 - protein, 298 aa, Homo sapiens
MKTLQSTLLLLLLVPLIKPAPPTQQDSRIIYDYGTDNFEESIFSQDYEDKYLDGKNIKEKETVIIPNEKSLQLQKDEAITPLPPKKENDEMPTCLLCVCLSGSVYCEEVDIDAVPPLPKESAYLYARFNKIKKLTAKDFADIPNLRRLDFTGNLIEDIEDGTFSKLSLLEELSLAENQLLKLPVLPPKLTLFNAKYNKIKSRGIKANAFKKLNNLTFLYLDHNALESVPLNLPESLRVIHLQFNNIASITDDTFCKANDTSYIRDRIEEIRLEGNPIVLGKHPNSFICLKRLPIGSYF

SEQ ID NO: 884808 - protein, 298 aa, Homo sapiens; identical to SEQ ID NO: 884807

SEQ ID NO: 884809 - protein, 298 aa, Homo sapiens; identical to SEQ ID NO: 884807

SEQ ID NO: 884810 - protein, 113 aa, Homo sapiens
MKTLQSTLLLLLLVPLIKPAPPTQQDSRIIYDYGTDNFEESIFSQDYEDKYLDGKNIKEKETVIIPNEKSLQLQKDEAITPLPPKKENDGKYHSKYFSNGSFKNSYNGLYSLW

SEQ ID NO: 884811 - protein, 298 aa, Homo sapiens; identical to SEQ ID NO: 884807

SEQ ID NO: 884812 - protein, 364 aa, Homo sapiens
TAFHPRERMLAKISTTWKLFLKLLGPEILLSSLKSRHSFSHSPSHLGLMHRHEHLLRKTTKNFKTATTTLQSTLLLLLLVPLIKPAPPTQQDSRIIYDYGTDNFEESIFSQDYEDKYLDGKNIKEKETVIIPNEKSLQLQKDEAITPLPPKKENDEMPTCLLCVCLSGSVYCEEVDIDAVPPLPKESAYLYARFNKIKKLTAKDFADIPNLRRLDFTGNLIEDIEDGTFSKLSLLEELSLAENQLLKLPVLPPKLTLFNAKYNKIKSRGIKANAFKKLNNLTFLYLDHNALESVPLNLPESLRVIHLQFNNIASITDDTFCKANDTSYIRDRIEEIRLEGNPIVLGKHPNSFICLKRLPIGSYF

SEQ ID NO: 884813 - protein, 214 aa, Homo sapiens [sequence omitted]

SEQ ID NO: 884814 - protein, 283 aa, Homo sapiens
MPRGLGGLAVTQRGHRRGGKRDLVRPYPLPVSPGRARATRTDGTRRSWRPAGLAGDPGPCSPGACGEVSLLPCPPALCPLRFAVQPIFPLQGPPGVKGEKGDHGLPGLQGHPGHQGIPGRVGLQGPKGMRGLEGTAGLPGPPGPRGFQGMAGARGTSGERGPPGTVGPTGLPGPKGERGEKGEPQSLATLYQLVSQACESAIQTHVSKFDSFHENTRPPMPILEQKLEPGTEPLGSPGTRSKALVPGEWGRGGRHLEGRGEPGAVGQMGSPGQQGASTQGLWE

SEQ ID NO: 884815 - protein, 616 aa, Homo sapiens
GLWRTSRAVSQVHVAVGRSKVRLYVDCRKVAERPLGEMGSPPAAGFVTLGRLAKARGPRSSSAAFQLQMLQIVCSDTWADEDRCCELPASRDGETCPAFVSACSCSSETPGPPGPQGPPGLPGRNGTPGEQGFPGPRGPPGVKGEKGDHGLPGLQGNPDTGHPRESMAPGTKENERLRDCWLLEPLSPSGFQAWQGAGALVESEDIRDRAATWMPCPNGDRGQMGTRDIATLTRVSQAEYAPRTWPVDLQRHRPDIAQKDARRGAHARSTHVSCRTSGTTALDGLTPLRTAHARQLTALGGPPQDETRADTTHTQRPRARTRPKQTQGPPSAQRTQHDHPNTRATAPTADTSDQTLSTNTKYSPHTPIQTKQNNYTTASQDTKSTPTNYITKSHSLHYIRTLQPPTDDQHTPLNHPPQVRYTEQNNTPTQRRTAHHTYARNTFHNDHYEPQSAQREHEAQNNTTRQHNGKQARETQKRRKDEEREKDSDERDGDTRQAHRRSRDPEERETNRPATDRDESSEEREHCLTRPKTRELRKQAQERLRTNPTATKNEAQEESTELTQSHDPTSRNDKRAEKQQEDIDENAEKGDRRVEMLNDEMAGLLRDAREIDGGAL

SEQ ID NO: 884816 - protein, 1297 aa, Homo sapiens
MSSGDPAHLGLCLWLWLGATLGREQVQASGLLRLAVLPEDRLQMKWRESEGSGLGYLVQVKPMAGDSEQEVILTTKTPKATVGGLSPSKGYTLQIFELTGSGRFLLARREFVIEDLKSSSLDRSSQRPLGSGAPEPTPYHTGSPDPEQASEPQVAFKPSQDPRTPGGSEWRETGPQYRCLPPVPADMVFLVDGSWSIGHSHFQQVKDFLASVIAPFEIGPDKVQVGLTQYSGDAQTEWDLNSLSTKEQVLAAVRRLRYKGGNTFTGLALTHVLGQNLQPAAGLRPEAAKVVILVTDGKSQDDVHTAARVLKDLGVNVFAVGVKNADEAELRLLASPPRDITVHSVLDFLQLGALAGLLSRLICQRLQGGSPRQGPAAAPALDTLPAPTSLVLSQVTSSSIRLSWTPAPRHPLKYLIVWRASRGGTPREVVVEGPAASTELHNLASRTEYLVSVFPIYEGGVGEGLRGLVTTAPLPPPRALTLAAVTPRTVHLTWQPSAGATHYLVRCSPASPKGEEEEREVQVGRPEVLLDGLEPGRDYEVSVQSLRGPEGSEARGIRARTPTLAPPRHLGFSDVSHDAARVFWEGAPRPVRLVRVTYVSSEGGHSGQTEAPGNATSATLGPLSSSTTYTVRVTCLYPGGGSSTLTGRVTTKKAPSPSQLSMTELPGDAVQLAWVAAAPSGVLVYQITWTPLGEGKAHEISVPGNLGTAVLPGLGRHTEYDVTILAYYRDGARSDPVSLRYTPSTVSRSPPSNLALASETPDSLQVSWTPPLGRVLHYWLTYAPASGLGPEKSVSVPGARSHVTLPDLQAATKYRVLVSAIYAAGRSEAVSATGQTACPALRPDGSLPGFDLMVAFSLVEKAYASIRGVAMEPSAFGGTPTFTLFKDAQLTRRVSDVYPAPLPPEHTIVFLVRLLPETPREAFALWQMTAEDFQPLLGVLLDAGKKSLTYFHRDPRAALQEATFDPQEVRKIFFGSFHKVHVAVGRSKVRLYVDCRKVAERPLGEMGSPPAAGFVTLGRLAKARGPRSSSAAFQLQMLQIVCSDTWADEDRCCELPASRDGETCPAFVSACSCSSETPGPPGPQGPPGLPGRNGTPGEQGFPGPRGPPGVKGEKGDHGLPGLQGHPGHQGIPGRVGLQGPKGMRGLEGTAGLPGPPGPRGFQGMAGARGTSGERGPPGTVGPTGLPGPKGERGEKGEPQSLATLYQLVSQACESAIQTHVSKFDSFHENTRPPMPILEQKLEPGTEPLGSPGTRSKALVPGEWGRGGRHLEGRGEPGAVGQMGSPGQQGASTQGLWE

SEQ ID NO: 884817 - protein, 1322 aa, Homo sapiens
MSSGDPAHLGLCLWLWLGATLGREQVQASGLLRLAVLPEDRLQMKWRESEGSGLGYLVQVKPMAGDSEQEVILTTKTPKATVGGLSPSKGYTLQIFELTGSGRFLLARREFVIEDLKSSSLDRSSQRPLGSGAPEPTPYHTGSPDPEQASEPQVAFKPSQDPRTPAGPQYRCLPPVPADMVFLVDGSWSIGHSHFQQVKDFLASVIAPFEIGPDKVQVGLTQYSGDAQTEWDLNSLSTKEQVLAAVRRLRYKGGNTFTGLALTHVLGQNLQPAAGLRPEAAKVVILVTDGKSQDDVHTAARVLKDLGVNVFAVGVKNADEAELRLLASPPRDITVHSVLDFLQLGALAGLLSRLICQRLQGGSPRQGPAAAPALDTLPAPTSLVLSQVTSSSIRLSWTPAPRHPLKYLIVWRASRGGTPREVVVEGPAASTELHNLASRTEYLVSVFPIYEGGVGEGLRGLVTTAPLPPPRALTLAAVTPRTVHLTWQPSAGATHYLVRCSPASPKGEEEEREVQVGRPEVLLDGLEPGRDYEVSVQSLRGPEGSEARGIRARTPTLAPPRHLGFSDVSHDAARVFWEGAPRPVRLVRVTYVSSEGGHSGQTEAPGNATSATLGPLSSSTTYTVRVTCLYPGGGSSTLTGRVTTKKAPSPSQLSMTELPGDAVQLAWVAAAPSGVLVYQITWTPLGEGKAHEISVPGNLGTAVLPGLGRHTEYDVTILAYYRDGARSDPVSLRYTPSTVSRSPPSNLALASETPDSLQVSWTPPLGRVLHYWLTYAPASGLGPEKSVSVPGARSHVTLPDLQAATKYRVLVSAIYAAGRSEAVSATGQTACPALRPDGSLPGFDLMVAFSLVEKAYASIRGVAMEPSAFGGTPTFTLFKDAQLTRRVSDVYPAPLPPEHTIVFLVRLLPETPREAFALWQMTAEDFQPLLGVLLDAGKKSLTYFHRDPRAALQEATFDPQEVRKIFFGSFHKVHVAVGRSKVRLYVDCRKVAERPLGEMGSPPAAGFVTLGRLAKARGPRSSSAAFQLQMLQIVCSDTWADEDRCCELPASRDGETCPAFVSACSCSSETPGPPGPQGPPGLPGRNGTPGEQGFPGPRGEPGPPGQMGPEGPGGQQGSPGTQGRAVQGPVGPPGVKGEKGDHGLPGLQGHPGHQGIPGRVGLQGPKGMRGLEGTAGLPGPPGPRGFQGMAGARGTSGERGPPGTVGPTGLPGPKGERGEKGEPQSLATLYQLVSQACESAIQTHVSKFDSFHENTRPPMPILEQKLEPGTEPLGSPGTRSKALVPGEWGRGGRHLEGRGEPGAVGQMGSPGQQGASTQGLWE

SEQ ID NO: 884818 - protein, 1316 aa, Homo sapiens
MSSGDPAHLGLCLWLWLGATLGREQVQASGLLRLAVLPEDRLQMKWRESEGSGLGYLVQVKPMAGDSEQEVILTTKTPKATVGGLSPSKGYTLQIFELTGSGRFLLARREFVIEDLKSSSLDRSSQRPLGSGAPEPTPYHTGSPDPEQASEPQVAFKPSQDPRTPAGPQYRCLPPVPADMVFLVDGSWSIGHSHFQQVKDFLASVIAPFEIGPDKVQVGLTQYSGDAQTEWDLNSLSTKEQVLAAVRRLRYKGGNTFTGLALTHVLGQNLQPAAGLRPEAAKVVILVTDGKSQDDVHTAARVLKDLGVNVFAVGVKNADEAELRLLASPPRDITVHSVLDFLQLGALAGLLSRLICQRLQGGSPRQGPAAAPALDTLPAPTSLVLSQVTSSSIRLSWTPAPRHPLKYLIVWRASRGGTPREVVVEGPAASTELHNLASRTEYLVSVFPIYEGGVGEGLRGLVTTAPLPPPRALTLAAVTPRTVHLTWQPSAGATHYLVRCSPASPKGEEEEREVQVGRPEVLLDGLEPGRDYEVSVQSLRGPEGSEARGIRARTPTLAPPRHLGFSDVSHDAARVFWEGAPRPVRLVRVTYVSSEGGHSGQTEAPGNATSATLGPLSSSTTYTVRVTCLYPGGGSSTLTGRVTTKKAPSPSQLSMTELPGDAVQLAWVAAAPSGVLVYQITWTPLGEGKAHEISVPGNLGTAVLPGLGRHTEYDVTILAYYRDGARSDPVSLRYTPSTVSRSPPSNLALASETPDSLQVSWTPPLGRVLHYWLTYAPASGLGPEKSVSVPGARSHVTLPDLQAATKYRVLVSAIYAAGRSEAVSATGQTACPALRPDGSLPGFDLMVAFSLVEKAYASIRGVAMEPSAFGGTPTFTLFKDAQLTRRVSDVYPAPLPPEHTIVFLVRLLPETPREAFALWQMTAEDFQPLLGVLLDAGKKSLTYFHRDPRAALQEATFDPQEVRKIFFGSFHKVHVAVGRSKVRLYVDCRKVAERPLGEMGSPPAAGFVTLGRLAKARGPRSSSAAFQLQMLQIVCSDTWADEDRCCELPASRDGETCPAFVSACSCSSETPGPPGPQGPPGLPGRNGTPGEQGFPGPRGEPGPPGQMGPEGPGGQQGSPGTQGRAVQGPVGPPGVKGEKGDHGLPGLQGHPGHQGIPGRVGLQGPKGMRGLEGTAGLPGPPGPRGFQGMAGARGTSGERGPPGTVGPTGLPGPKGERGEKGEPQSLATLYQLVSQASHVSKFDSFHENTRPPMPILEQKLEPGTEPLGSPGTRSKALVPGEWGRGGRHLEGRGEPGAVGQMGSPGQQGASTQGLWE

SEQ ID NO: 884819 - protein, 1394 aa, Homo sapiens
MSSGDPAHLGLCLWLWLGATLGREQVQASGLLRLAVLPEDRLQMKWRESEGSGLGYLVQVKPMAGDSEQEVILTTKTPKATVGGLSPSKGYTLQIFELTGSGRFLLARREFVIEDLKSSSLDRSSQRPLGSGAPEPTPYHTGSPDPEQASEPQVAFKPSQDPRTPAGPQYRCLPPVPADMVFLVDGSWSIGHSHFQQVKDFLASVIAPFEIGPDKVQVGLTQYSGDAQTEWDLNSLSTKEQVLAAVRRLRYKGGNTFTGLALTHVLGQNLQPAAGLRPEAAKVVILVTDGKSQDDVHTAARVLKDLGVNVFAVGVKNADEAELRLLASPPRDITVHSVLDFLQLGALAGLLSRLICQRLQGGSPRQGPAAAPALDTLPAPTSLVLSQVTSSSIRLSWTPAPRHPLKYLIVWRASRGGTPREVVVEGPAASTELHNLASRTEYLVSVFPIYEGGVGEGLRGLVTTAPLPPPRALTLAAVTPRTVHLTWQPSAGATHYLVRCSPASPKGEEEEREVQVGRPEVLLDGLEPGRDYEVSVQSLRGPEGSEARGIRARTPTLAPPRHLGFSDVSHDAARVFWEGAPRPVRLVRVTYVSSEGGHSGQTEAPGNATSATLGPLSSSTTYTVRVTCLYPGGGSSTLTGRVTTKKAPSPSQLSMTELPGDAVQLAWVAAAPSGVLVYQITWTPLGEGKAHEISVPGNLGTAVLPGLGRHTEYDVTILAYYRDGARSDPVSLRYTPSTVSRSPPSNLALASETPDSLQVSWTPPLGRVLHYWLTYAPASGLGPEKSVSVPGARSHVTLPDLQAATKYRVLVSAIYAAGRSEAVSATGQTACPALRPDGSLPGFDLMVAFSLVEKAYASIRGVAMEPSAFGGTPTFTLFKDAQLTRRVSDVYPAPLPPEHTIVFLVRLLPETPREAFALWQMTAEDFQPLLGVLLDAGKKSLTYFHRDPRAALQEATFDPQEVRKIFFGSFHKVHVAVGRSKVRLYVDCRKVAERPLGEMGSPPAAGFVTLGRLAKARGPRSSSAAFQLQMLQIVCSDTWADEDRCCELPASVCPVPAPVPRSKLGQVPTEGHSAWEGWRDLPRLRVCLFLFLRDPWAPRTSRTPSSSAPQVTAGASRAGSGTGQAHFSELSVHSLVYSGGRGLNPELPDYEEGLPGRNGTPGEQGFPGPRGEPGPPGQMGPEGPGGQQGSPGTQGRAVQGPVGPPGVKGEKGDHGLPGLQGHPGHQGIPGRVGLQGPKGMRGLEGTAGLPGPPGPRGFQGMAGARGTSGERGPPGTVGPTGLPGPKGERGEKGEPQSLATLYQLVSQACESAIQTHVSKFDSFHENTRPPMPILEQKLEPGTEPLGSPGTRSKALVPGEWGRGGRHLEGRGEPGAVGQMGSPGQQGASTQGLWE

SEQ ID NO: 884820 - protein, 1303 aa, Homo sapiens
MSSGDPAHLGLCLWLWLGATLGREQVQASGLLRLAVLPEDRLQMKWRESEGSGLGYLVQVKPMAGDSEQEVILTTKTPKATVGGLSPSKGYTLQIFELTGSGRFLLARREFVIEDLKSSSLDRSSQRPLGSGAPEPTPYHTGSPDPEQASEPQVAFKPSQDPRTPAGPQYRCLPPVPADMVFLVDGSWSIGHSHFQQVKDFLASVIAPFEIGPDKVQVGLTQYSGDAQTEWDLNSLSTKEQVLAAVRRLRYKGGNTFTGLALTHVLGQNLQPAAGLRPEAAKVVILVTDGKSQDDVHTAARVLKDLGVNVFAVGVKNADEAELRLLASPPRDITVHSVLDFLQLGALAGLLSRLICQRLQGGSPRQGPAAAPALDTLPAPTSLVLSQVTSSSIRLSWTPAPRHPLKYLIVWRASRGGTPREVVVEGPAASTELHNLASRTEYLVSVFPIYEGGVGEGLRGLVTTAPLPPPRALTLAAVTPRTVHLTWQPSAGATHYLVRCSPASPKGEEEEREVQVGRPEVLLDGLEPGRDYEVSVQSLRGPEGSEARGIRARTPTLAPPRHLGFSDVSHDAARVFWEGAPRPVRLVRVTYVSSEGGHSGQTEAPGNATSATLGPLSSSTTYTVRVTCLYPGGGSSTLTGRVTTKKAPSPSQLSMTELPGDAVQLAWVAAAPSGVLVYQITWTPLGEGKAHEISVPGNLGTAVLPGLGRHTEYDVTILAYYRDGARSDPVSLRYTPSTVSRSPPSNLALASETPDSLQVSWTPPLGRVLHYWLTYAPASGLGPEKSVSVPGARSHVTLPDLQAATKYRVLVSAIYAAGRSEAVSATGQTACPALRPDGSLPGFDLMVAFSLVEKAYASIRGVAMEPSAFGGTPTFTLFKDAQLTRRVSDVYPAPLPPEHTIVFLVRLLPETPREAFALWQMTAEDFQPLLGVLLDAGKKSLTYFHRDPRAALQEATFDPQEVRKIFFGSFHKVHVAVGRSKVRLYVDCRKVAERPLGEMGSPPAAGFVTLGRLAKARGPRSSSAAFQLQMLQIVCSDTWADEDRCCELPASRDGETCPAFVSACSCSSETPGPPGPQGPPGLPGRNGTPGEQGFPGPRGEPGPPGQMGPEGPGGQQGSPGTQGRAVQGPVGPPGVKGEKGDHGLPGLQGHPGHQGIPGRVGLQGPKGMRGLEGTAGLPGPPGPRGFQGMAGARGTSGERGPPGTVGPTGLQGQRDQERRRASPCHLYSCEQGLELPFDTVSSPALPGKTGPPCPFGAQLGTSDLKPGVPGDRKKAWSRAMGWWRTSLARRYREANKSRQRGQQ

SEQ ID NO: 884821 - protein, 989 aa, Homo sapiens
MSSGDPAHLGLCLWLWLGATLGREQVQASGLLRLAVLPEDRLQMKWRESEGSGLGYLVQVKPMAGDSEQEVILTTKTPKATVGGLSPSKGYTLQIFELTGSGRFLLARREFVIEDLKSSSLDRSSQRPLGSGAPEPTPYHTGSPDPEQASEPQVAFKPSQDPRTPAGPQYRCLPPVPADMVFLVDGSWSIGHSHFQQVKDFLASVIAPFEIGPDKVQVGLTQYSGDAQTEWDLNSLSTKEQVLAAVRRLRYKGGNTFTGLALTHVLGQNLQPAAGLRPEAAKVVILVTDGKSQDDVHTAARVLKDLGVNVFAVGVKNADEAELRLLASPPRDITVHSVLDFLQLGALAGLLSRLICQRLQGGSPRQGPAAAPALDTLPAPTSLVLSQVTSSSIRLSWTPAPRHPLKYLIVWRASRGGTPREVVVEGPAASTELHNLASRTEYLVSVFPIYEGGVGEGLRGLVTTAPLPPPRALTLAAVTPRTVHLTWQPSAGATHYLVRCSPASPKGEEEEREVQVGRPEVLLDGLEPGRDYEVSVQSLRGPEGSEARGIRARTPTLAPPRHLGFSDVSHDAARVFWEGAPRPVRLVRVTYVSSEGGHSGQTEAPGNATSATLGPLSSSTTYTVRVTCLYPGGGSSTLTGRVTTKKAPSPSQLSMTELPGDAVQLAWVAAAPSGVLVYQITWTPLGEGKAHEISVPGNLGTAVLPGLGRHTEYDVTILAYYRDGARSDPVSLRYTPSTVSRSPPSNLALASETPDSLQVSWTPPLGRVLHYWLTYAPASGLGPEKSVSVPGARSHVTLPDLQAATKYRVLVSAIYAAGRSEAVSATGQTACPALRPDGSLPGFDLMVAFSLVEKAYASIRGVAMEPSAFGGTPTFTLFKDAQLTRRVSDVYPAPLPPEHTIVFLVRLLPETPREAFALWQMTAEDFQPLLGVLLDGDVGPASPPAVRRSRGREAPEPWEAFRGSPASRPGPQHPLGGRQVSRAGGCGPH

SEQ ID NO: 884822 - protein, 1297 aa, Homo sapiens; identical to SEQ ID NO: 884816

SEQ ID NO: 884823 - protein, 1290 aa, Homo sapiens
MSSGDPAHLGLCLWLWLGATLGREQVQASGLLRLAVLPEDRLQMKWRESEGSGLGYLVQVKPMAGDSEQEVILTTKTPKATVGGLSPSKGYTLQIFELTGSGRFLLARREFVIEDLKSSSLDRSSQRPLGSGAPEPTPYHTGSPDPEQASEPQVAFKPSQDPRTPAGPQYRCLPPVPADMVFLVDGSWSIGHSHFQQVKDFLASVIAPFEIGPDKVQVGLTQYSGDAQTEWDLNSLSTKEQVLAAVRRLRYKGGNTFTGLALTHVLGQNLQPAAGLRPEAAKVVILVTDGKSQDDVHTAARVLKDLGVNVFAVGVKNADEAELRLLASPPRDITVHSVLDFLQLGALAGLLSRLICQRLQGGSPRQGPAAAPALDTLPAPTSLVLSQVTSSSIRLSWTPAPRHPLKYLIVWRASRGGTPREVVVEGPAASTELHNLASRTEYLVSVFPIYEGGVGEGLRGLVTTAPLPPPRALTLAAVTPRTVHLTWQPSAGATHYLVRCSPASPKGEEEEREVQVGRPEVLLDGLEPGRDYEVSVQSLRGPEGSEARGIRARTPTLAPPRHLGFSDVSHDAARVFWEGAPRPVRLVRVTYVSSEGGHSGQTEAPGNATSATLGPLSSSTTYTVRVTCLYPGGGSSTLTGRVTTKKAPSPSQLSMTELPGDAVQLAWVAAAPSGVLVYQITWTPLGEGKAHEISVPGNLGTAVLPGLGRHTEYDVTILAYYRDGARSDPVSLRYTPSTVSRSPPSNLALASETPDSLQVSWTPPLGRVLHYWLTYAPASGLGPEKSVSVPGARSHVTLPDLQAATKYRVLVSAIYAAGRSEAVSATGQTACPALRPDGSLPGFDLMVAFSLVEKAYASIRGVAMEPSAFGGTPTFTLFKDAQLTRRVSDVYPAPLPPEHTIVFLVRLLPETPREAFALWQMTAEDFQPLLGVLLDAGKKSLTYFHRDPRAALQEATFDPQEVRKIFFGSFHKVHVAVGRSKVRLYVDCRKVAERPLGEMGSPPAAGFVTLGRLAKARGPRSSSAAFQLQMLQIVCSDTWADEDRCCELPASRDGETCPAFVSACSCSSETPGPPGPQGPPGLPGRNGTPGEQGFPGPRGPPGVKGEKGDHGLPGLQGHPGHQGIPGRVGLQGPKGMRGLEGTAGLPGPPGPRGFQGMAGARGTSGERGPPGTVGPTGLPGPKGERGEKGEPQSLATLYQLVSQACESAIQTHVSKFDSFHENTRPPMPILEQKLEPGTEPLGSPGTRSKALVPGEWGRGGRHLEGRGEPGAVGQMGSPGQQGASTQGLWE

SEQ ID NO: 884824 - protein, 1272 aa, Homo sapiens
MSSGDPAHLGLCLWLWLGATLGREQVQASGLLRLAVLPEDRLQMKWRESEGSGLGYLVQVKPMAGDSEQEVILTTKTPKATVGGLSPSKGYTLQIFELTGSGRFLLARREFVIEDLKSSSLDRSSQRPLGSGAPEPTPYHTGSPDPEQASEPQVAFKPSQDPRTPAGPQYRCLPPVPADMVFLVDGSWSIGHSHFQQVKDFLASVIAPFEIGPDKVQVGLTQYSGDAQTEWDLNSLSTKEQVLAAVRRLRYKGGNTFTGLALTHVLGQNLQPAAGLRPEAAKVVILVTDGKSQDDVHTAARVLKDLGVNVFAVGVKNADEAELRLLASPPRDITVHSVLDFLQLGALAGLLSRLICQRLQGGSPRQGPAAAPALDTLPAPTSLVLSQVTSSSIRLSWTPAPRHPLKYLIVWRASRGGTPREVVVEGPAASTELHNLASRTEYLVSVFPIYEGGVGEGLRGLVTTAPLPPPRALTLAAVTPRTVHLTWQPSAGATHYLVRCSPASPKGEEEEREVQVGRPEVLLDGLEPGRDYEVSVQSLRGPEGSEARGIRARTPTLAPPRHLGFSDVSHDAARVFWEGAPRPVRLVRVTYVSSEGGHSGQTEAPGNATSATLGPLSSSTTYTVRVTCLYPGGGSSTLTGRVTTKKAPSPSQLSMTELPGDAVQLAWVAAAPSGVLVYQITWTPLGEGKAHEISVPGNLGTAVLPGLGRHTEYDVTILAYYRDGARSDPVSLRYTPSTVSRSPPSNLALASETPDSLQVSWTPPLGRVLHYWLTYAPASGLGPEKSVSVPGARSHVTLPDLQAATKYRVLVSAIYAAGRSEAVSATGQTACPALRPDGSLPGFDLMVAFSLVEKAYASIRGVAMEPSAFGGTPTFTLFKDAQLTRRVSDVYPAPLPPEHTIVFLVRLLPETPREAFALWQMTAEDFQPLLGVLLDAGKKSLTYFHRDPRAALQEATFDPQEVRKIFFGSFHKVHVAVGRSKVRLYVDCRKVAERPLGEMGSPPAAGFVTLGRLAKARGPRSSSAAFQLQMLQIVCSDTWADEDRCCELPASRDGETCPAFVSACSCSSETPGPPGPQGPPGPPGVKGEKGDHGLPGLQGHPGHQGIPGRVGLQGPKGMRGLEGTAGLPGPPGPRGFQGMAGARGTSGERGPPGTVGPTGLPGPKGERGEKGEPQSLATLYQLVSQACESAIQTHVSKFDSFHENTRPPMPILEQKLEPGTEPLGSPGTRSKALVPGEWGRGGRHLEGRGEPGAVGQMGSPGQQGASTQGLWE

SEQ ID NO: 884825 - protein, 1316 aa, Homo sapiens; identical to SEQ ID NO: 884818

SEQ ID NO: 884826 - protein, 452 aa, Homo sapiens
MPSLSSQGSLELLVRWAALGSRGLAPRASGSDRTFSALPRGTLSLPPWVCLDTESDHILEKPGEKLRKSLQVEGEGSSGLGQGPPHTLGSVAFPSSDKPLSAHPAKRGGSHFLGECPPPWLCAPHLEALQLQPQWGRGGAGLMANRVQEGSSALWPSQSSKTGSTTCPAPFSGPHLSLARALWARLSLRLTQATDGSTAGPPVTCTMAPPSEQHSHPGPSTFTSGHRQVPACLIVPSVPSPEGVQILCVNGHPSPTQPCAEFLVQGHCFETWHHQPLVLRVSEQGHPSAGFWPVLLLSTSAQVSPNHHRRCVSLDFLPYPHCGPNSMGASSEHTPGLLGLVARGGDVGTSTSFPNKYSVTSPLLPLRQLSKKGARNEEGSHIIEERMKSIKKEQRETLDIDRRKTHQDHQCSIACTKAYPKEVSAKQLQGKHFIYDSTVPGTDQTWRPNRES

SEQ ID NO: 884827 - protein, 407 aa, Homo sapiens
MRWVWALLKNASLAGAPKYIEHFSKFSPSPLSMKQFLDFGSSNACEKTSFTFLRQELPVRLANIMKEINLLPDRVLSTPSVQLVQSWYVQSLLDIMEFLDKDPEDHRTLSQFTDALVTIRNRHNDVVPTMAQGVLEYKDTYGDDPVSNQNIQYFLDRFYLSRISIRMLINQHTLIFDGSTNPAHPKHIGSIDPNCNVSEVVKDAYDMAKLLCDKYYMASPDLEIQEINAANSKQPIHMVYVPSHLYHMLFELFKNAMRATVESHESSLILPPIKVMVALGEEDLSIKMSDRGGGVPLRKIERLFSYMYSTAPTPQPGTGGTPLAGFGYGLPISRLYAKYFQGDLQLFSMEGFGTDAVIYLKALSTDSVERLPVYNKSAWRHYQTIQEAGDWCVPSTEPKNTSTYRVS

SEQ ID NO: 884828 - protein, 184 aa, Homo sapiens
WAGAPGTVMWSQAAYTSLGCPRVLGSSNACEKTSFTFLRQELPVRLANIMKEINLLPDRVLSTPSVQLVQSWYVQSLLDIMEFLDKDPEDHRTLSQFTDALVTIRNRHNDVVPTMAQGVLEYKDTYGDDPVSNQNIQYFLDRFYLSRISIRMLINQHSGCRPQRRGAGGGGGGAGAQGRAAEGT

SEQ ID NO: 884829 - protein, 111 aa, Homo sapiens
WNARQGKGREEAAEPRRWAERCASAARAGTTTKVAAAAAMRWVWALLKNASLAGAPKYIEHFSKFSPSPLSMKQFLDFGTEWAGGGWQRRPAGRWEGQPGARGTEEKKGPE

SEQ ID NO: 884830 - protein, 407 aa, Homo sapiens; identical to SEQ ID NO: 884827

SEQ ID NO: 884831 - protein, 407 aa, Homo sapiens; identical to SEQ ID NO: 884827

SEQ ID NO: 884832 - protein, 418 aa, Homo sapiens
VPGRADIEHFIKFSPSPLLKNASLAGAPKYIEHFSKFSPSPLSMKQFLDFGSSNACEKTSFTFLRQELPVRLANIMKEINLLPDRVLSTPSVQLVQSWYVQSLLDIMEFLDKDPEDHRTLSQFTDALVTIRNRHNDVVPTMAQGVLEYKDTYGDDPVSNQNIQYFLDRFYLSRISIRMLINQHTLIFDGSTNPAHPKHIGSIDPNCNVSEVVKDAYDMAKLLCDKYYMASPDLEIQEINAANSKQPIHMVYVPSHLYHMLFELFKNAMRATVESHESSLILPPIKVMVALGEEDLSIKMSDRGGGVPLRKIERLFSYMYSTAPTPQPGTGGTPLAGFGYGLPISRLYAKYFQGDLQLFSMEGFGTDAVIYLKALSTDSVERLPVYNKSAWRHYQTIQEAGDWCVPSTEPKNTSTYRVS

SEQ ID NO: 884833 - protein, 347 aa, Homo sapiens
MRWVWALLKNASLAGAPKYIEHFSKFSPSPLSMKQFLDFGSSNACEKTSFTFLRQELPVRLANIMKEINLLPDRVLSTPSVQLVQSWYVQSLLDIMEFLDKDPEDHRTLSQFTDALVTIRNRHNDVVPTMAQGVLEYKDTYGDDPVSNQNIQYFLDRFYLSRISIRMLINQHTLIFDGSTNPAHPKHIGSIDPNCNVSEVVKDAYDMAKLLCDKYYMASPDLEIQEINAANSKQPIHMVYVPSHLYHMLFELFKNAMRATVESHESSLILPPIKVMVALGEEDLSIKMSDRGGGVPLRKIERLFSYMYSTAPTSVTHLDGQIFLTQGHHDLDGWENEAGLMAFHSRP

SEQ ID NO: 884834 - protein, 392 aa, Homo sapiens
WAGAPGTVMWSQAAYTSLGCPRVLGSSNACEKTSFTFLRQELPVRLANIMKEINLLPDRVLSTPSVQLVQSWYVQSLLDIMEFLDKDPEDHRTLSQFTDALVTIRNRHNDVVPTMAQGVLEYKDTYGDDPVSNQNIQYFLDRFYLSRISIRMLINQHTLIFDGSTNPAHPKHIGSIDPNCNVSEVVKDAYDMAKLLCDKYYMASPDLEIQEINAANSKQPIHMVYVPSHLYHMLFELFKNAMRATVESHESSLILPPIKVMVALGEEDLSIKMSDRGGGVPLRKIERLFSYMYSTAPTPQPGTGGTPLAGFGYGLPISRLYAKYFQGDLQLFSMEGFGTDAVIYLKALSTDSVERLPVYNKSAWRHYQTIQEAGDWCVPSTEPKNTSTYRVS

SEQ ID NO: 884835 - protein, 278 aa, Homo sapiens
MAQGVLEYKDTYGDDPVSNQNIQYFLDRFYLSRISIRMLINQHTLIFDGSTNPAHPKHIGSIDPNCNVSEVVKDAYDMAKLLCDKYYMASPDLEIQEINAANSKQPIHMVYVPSHLYHMLFELFKNAMRATVESHESSLILPPIKVMVALGEEDLSIKMSDRGGGVPLRKIERLFSYMYSTAPTPQPGTGGTPLAGFGYGLPISRLYAKYFQGDLQLFSMEGFGTDAVIYLKALSTDSVERLPVYNKSAWRHYQTIQEAGDWCVPSTEPKNTSTYRVS

SEQ ID NO: 884836 - protein, 199 aa, Homo sapiens
MRWVWALLKNASLAGAPKYIEHFSKFSPSPLSMKQFLDFGSSNACEKTSFTFLRQELPVRLANIMKEINLLPDRVLSTPSVQLVQSWYVQSLLDIMEFLDKDPEDHRTLSQFTDALVTIRNRHNDVVPTMAQGVLEYKDTYGDDPVSNQNIQYFLDRFYLSRISIRMLINQHSGCRPQRRGAGGGGGGAGAQGRAAEGT

SEQ ID NO: 884837 - protein, 199 aa, Homo sapiens; identical to SEQ ID NO: 884836

SEQ ID NO: 884838 - protein, 151 aa, Homo sapiens [sequence omitted]

SEQ ID NO: 884839 - protein, 113 aa, Homo sapiens
SVVCSTIKVLRDLSSEPGLALNLGGGTPLAGFGYGLPISRLYAKYFQGDLQLFSMEGFGTDAVIYLKALSTDSVERLPVYNKSAWRHYQTIQEAGDWCVPSTEPKNTSTYRVS

SEQ ID NO: 884840 - protein, 299 aa, Homo sapiens
HPRSCHSVQRRRLRPGVRDLLRVTQPSLLPLPLPPLEGAACLNGQERDTGGTTLLWSFQAPVSGSWAAAGAGVGWSAEEWTRHREVGGADPDTPQGPVHGLGGAPACLQQVSLAPLPDHPGGRRLVCAQHGAQEHVHVPRQLRAAVHLHLRGRTAASGSPHRGAPHHPPGGAGGGFSLMTRFCLYGSHCGDRSVMVPKCQSISVETPRWPPYLCGRCLRVRDVSTLMGCPRDIFPWQSSSLRPGLSLFCQGYWVPLSTLHSTGLPSGCPVALFPQPTKAPWPWSAEVLGRGWVPSRPGD

SEQ ID NO: 884841 - protein, 202 aa, Homo sapiens
MRWVWALLKNASLAGAPKYIEHFSKFSPSPLSMKQFLDFGSSNACEKTSFTFLRQELPVRLANIMKEINLLPDRVLSTPSVQLVQSWYVQSLLDIMEFLDKDPEDHRTLSQFTDALVTIRNRHNDVVPTMAQGVLEYKDTYGDDPVSNQNIQYFLDRFYLSRISIRMLINQHTLIFDGSTNPHPSPKHTGVKAVCPSQWLWQ

SEQ ID NO: 884842 - protein, 91 aa, Homo sapiens
VPGRADIEHFIKFSPSPLLKNASLAGAPKYIEHFSKFSPSPLSMKQFLDFGSSNACEKTSFTFLRQELPVRLANIMKEINLLPDRVLSTVH

SEQ ID NO: 884843 - protein, 1308 aa, Homo sapiens
DESSLLRRRGLQKELSLPRRGRGCRSGNRKSLVVGTPSPTLSRPLSPLSVPTAGSSPLDSPRNFSAASALNFPFARRADGRRWSLASLPSSGYGTNTPSSTLSSSSSSRERLHQLPFQPTPDELHFLSKHFRSSENVLDEEGGRSPRLRPRSRSLSPGRATGTFDNEIVMMNHVYRERFPKATAQMEGRLQEFLTAYAPGARLALADGVLGFIHHQIVELARDCLAKSGENLVTSRYFLEMQEKLERLLQDAHERSDSEEVSFIVQLVRKLLIIISRPARLLECLEFDPEEFYHLLEAAEGHAREGQGIKTDLPQYIIGQLGLAKDPLEEMVPLSHLEEEQPPAPESPESRALVGQSRRKPCESDFETIKLISNGAYGAVYLVRHRDTRQRFAIKKINKQNLILRNQIQQVFVERDILTFAENPFVVSMFCSFETRRHLCMVMEYVEGGDCATLLKNMGPLPVDMARLYFAETVLALEYLHNYGIVHRDLKPDNLLITSLGHIKLTDFGLSKIGLMSMATNLYEGHIEKDAREFIDKQVCGTPEYIAPEVIFRQGYGKPVDWWAMGVVLYEFLVGCVPFFGDTPEELFGQVVSDEIMWPEGDEALPADAQDLITRLLRQSPLDRLGTGGTHEVKQHPFFLALDWAGLLRHKAEFVPQLEAEDDTSYFDTRSERYRHLGSEDDETNDEESSTEIPQFSSCSHRFSKVYSSSEFLAVQPTPTFAERSFSEDREEGWERSEVDYGRRLSADIRLRSWTSSGSSCQSSSSQPERGPSPSLLNTISLDTMPKFAFSSEDEGVGPGPAGPKRPVFILGEPDPPPAATPVMPKPSSLSADTAALSHARLRSNSIGARHSTPRPLDASRGRRLGGPRDPAPEKSRASSSGGSGGGSGGRVPKSASVSALSLIITADDGSGGPLMSPLSPRSLSSNPSSRDSSPSRDPSPVCGSLRPPIVIHSSGKKYGFSLRAIRVYMGDSDVYTVHHVVWSVEDGSPAQEAGLRAGDLITHINGESVLGLVHMDVVELLLKSGNKISLRTTALENTSIKVGPARKNVAKGRMARRSKRSRRRETQDRRKSLFKKISKQTSVLHTSRSFSSGLHHSLSSSESLPGSPTHSLSPSPTTPCRSPAPDVPADTTASPPSASPSSSSPASPAAAGHTRPSSLHGLAAKLGPPRPKTGRRKSTSSIPPSPLACPPISAPPPRSPSPLPGHPPAPARSPRLRRGQSADKLGTGERLDGEAGRRTRGPEAELVVMRRLHLSERRDSFKKQEAVQEVSFDEPQEEATGLPTSVPQIAVEGEEAVPVALGPTGRD

SEQ ID NO: 884844 - protein, 1138 aa, Homo sapiens
MNHVYRERFPKATAQMEGRLQEFLTAYAPGARLALADGVLGFIHHQIVELARDCLAKSGENLVTSRYFLEMQEKLERLLQDAHERSDSEEVSFIVQLVRKLLIIISRPARLLECLEFDPEEFYHLLEAAEGHAREGQGIKTDLPQYIIGQLGLAKDPLEEMVPLSHLEEEQPPAPESPESRALVGQSRRKPCESDFETIKLISNGAYGAVYLVRHRDTRQRFAIKKINKQNLILRNQIQQVFVERDILTFAENPFVVSMFCSFETRRHLCMVMEYVEGGDCATLLKNMGPLPVDMARLYFAETVLALEYLHNYGIVHRDLKPDNLLITSLGHIKLTDFGLSKIGLMSMATNLYEGHIEKDAREFIDKQVCGTPEYIAPEVIFRQGYGKPVDWWAMGVVLYEFLVGCVPFFGDTPEELFGQVVSDEIMWPEGDEALPADAQDLITRLLRQSPLDRLGTGGTHEVKQHPFFLALDWAGLLRHKAEFVPQLEAEDDTSYFDTRSERYRHLGSEDDETNDEESSTEIPQFSSCSHRFSKVYSSSEFLAVQPTPTFAERSFSEDREEGWERSEVDYGRRLSADIRLRSWTSSGSSCQSSSSQPERGPSPSLLNTISLDTMPKFAFSSEDEGVGPGPAGPKRPVFILGEPDPPPAATPVMPKPSSLSADTAALSHARLRSNSIGARHSTPRPLDASRGRRLGGPRDPAPEKSRASSSGGSGGGSGGRVPKSASVSALSLIITADDGSGGPLMSPLSPRSLSSNPSSRDSSPSRDPSPVCGSLRPPIVIHSSGKKYGFSLRAIRVYMGDSDVYTVHHVVWSVEDGSPAQEAGLRAGDLITHINGESVLGLVHMDVVELLLKSGNKISLRTTALENTSIKVGPARKNVAKGRMARRSKRSRRRETQDRRKSLFKKISKQTSVLHTSRSFSSGLHHSLSSSESLPGSPTHSLSPSPTTPCRSPAPDVPADTTASPPSASPSSSSPASPAAAGHTRPSSLHGLAAKLGPPRPKTGRRKSTSSIPPSPLACPPISAPPPRSPSPLPGHPPAPARSPRLRRGQSADKLGTGERLDGEAGRRTRGPEAELVVMRRLHLSERRDSFKKQEAVQEVSFDEPQEEATGLPTSVPQIAVEGEEAVPVALGPTGRD

SEQ ID NO: 884845 - protein, 1147 aa, Homo sapiens
MNHVYRERFPKATAQMEGRLQEFLTAYAPGARLALADGVLGFIHHQIVELARDCLAKSGENLVTSRYFLEMQEKLERLLQDAHERSDSEEVSFIVQLVRKLLIIISRPARLLECLEFDPEEFYHLLEAAEGHAREGQGIKTDLPQYIIGQLGLAKDPLEEMVPLSHLEEEQPPAPESPESRALVGQSRRKPCESDFETIKLISNGAYGAVYLVRHRDTRQRFAIKKINKQNLILRNQIQQVFVERDILTFAENPFVVSMFCSFETRRHLCMVMEYVEGGDCATLLKNMGPLPVDMARLYFAETVLALEYLHNYGIVHRDLKPDNLLITSLGHIKLTDFGLSKIGLMSMATNLYEGHIEKDAREFIDKQVCGTPEYIAPEVIFRQGYGKPVDWWAMGVVLYEFLVGCVPFFGDTPEELFGQVVSDEIMWPEGDEALPADAQDLITRLLRQSPLDRLGTGGTHEVKQHPFFLALDWAGLLRHKAEFVPQLEAEDDTSYFDTRSERYRHLGSEDDETNDEESSTEIPQFSSCSHRFSKVYSSSEFLAVQPTPTFAERSFSEDREEGWERSEVDYGRRLSADIRLRSWTSSGSSCQSSSSQPERGPSPSLLNTISLDTMPKFAFSSEDEGVGPGPAGPKRPVFILGEPDPPPAATPVMPKPSSLSADTAALSHARLRSNSIGARHSTPRPLDASRGRRLGGPRDPAPEKSRASSSGGSGGGSGGRVPKSASVSALSLIITADDGSGGPLMSPLSPRSLSSNPSSRDSSPSRDPSPVCGSLRPPIVIHSSGKKYGFSLRAIRVYMGDSDVYTVHHVVWSVEDGSPAQEAGLRAGDLITHINGESVLGLVHMDVVELLLKSGNKISLRTTALENTSIKVGPARKNVAKGRMARRSKRSRRRETQDRCAAVTTRERRKSLFKKISKQTSVLHTSRSFSSGLHHSLSSSESLPGSPTHSLSPSPTTPCRSPAPDVPADTTASPPSASPSSSSPASPAAAGHTRPSSLHGLAAKLGPPRPKTGRRKSTSSIPPSPLACPPISAPPPRSPSPLPGHPPAPARSPRLRRGQSADKLGTGERLDGEAGRRTRGPEAELVVMRRLHLSERRDSFKKQEAVQEVSFDEPQEEATGLPTSVPQIAVEGEEAVPVALGPTGRD

SEQ ID NO: 884846 - protein, 1101 aa, Homo sapiens
MNHVYRERFPKATAQMEGRLQEFLTAYAPGARLALADGVLGFIHHQIVELARDCLAKSGENLVTSRYFLEMQEKLERLLQDAHERSDSEEVSFIVQLVRKLLIIISRPARLLECLEFDPEEFYHLLEAAEGHAREGQGIKTDLPQYIIGQLGLAKDPLEEMVPLSHLEEEQPPAPESPESRALVGQSRRKPCESDFETIKLISNGAYGAVYLVRHRDTRQRFAIKKINKQNLILRNQIQQVFVERDILTFAENPFVVSMFCSFETRRHLCMVMEYVEGGDCATLLKNMGPLPVDMARLYFAETVLALEYLHNYGIVHRDLKPDNLLITSLGHIKLTDFGLSKIGLMSMATNLYEGHIEKDAREFIDKQVCGTPEYIAPEVIFRQGYGKPVDWWAMGVVLYEFLVGCVPFFGDTPEELFGQVVSDEIMWPEGDEALPADAQDLITRLLRQSPLDRLGTGGTHEVKQHPFFLALDWAGLLRHKAEFVPQLEAEDDTSYFDTRSERYRHLGSEDDETNDEESSTEIPQFSSCSHRFSKVYSSSEFLAVQPTPTFAERSFSEDREEGWERSEVDYGRRLSADIRLRSWTSSGSSCQSSSSQPERGPSPSLLNTISLDTMPKFAFSSEDEGVGPGPAGPKRPVFILGEPDPPPAATPVMPKPSSLSADTAALSHARLRSNSIGARHSTPRPLDASRGRRLGGPRDPAPEKSRASSSGGSGGGSGGRVPKSASVSALSLIITAAAGKKYGFSLRAIRVYMGDSDVYTVHHVVWSVEDGSPAQEAGLRAGDLITHINGESVLGLVHMDVVELLLKSGNKISLRTTALENTSIKVGPARKNVAKGRMARRSKRSRRRETQDRCAAVTTRERRKSLFKKISKQTSVLHTSRSFSSGLHHSLSSSESLPGSPTHSLSPSPTTPCRSPAPDVPADTTASPPSASPSSSSPASPAAAGHTRPSSLHGLAAKLGPPRPKTGRRKSTSSIPPSPLACPPISAPPPRSPSPLPGHPPAPARSPRLRRGQSADKLGTGERLDGEAGRRTRGPEAELVVMRRLHLSERRDSFKKQEAVQEVSFDEPQEEATGLPTSVPQIAVEGEEAVPVALGPTGRD

SEQ ID NO: 884847 - protein, 1076 aa, Homo sapiens
MNHVYRERFPKATAQMEGRLQEFLTAYAPGARLALADGVLGFIHHQIVELARDCLAKSGENLVTSRYFLEMQEKLERLLQDAHERSDSEEVSFIVQLVRKLLIIISRPARLLECLEFDPEEFYHLLEAAEGHAREGQGIKTDLPQYIIGQLGLAKDPLEEMVPLSHLEEEQPPAPESPESRALVGQSRRKPCESDFETIKLISNGAYGAVYLVRHRDTRQRFAIKKINKQNLILRNQIQQVFVERDILTFAENPFVVSMFCSFETRRHLCMVMEYVEGGDCATLLKNMGPLPVDMARLYFAETVLALEYLHNYGIVHRDLKPDNLLITSLGHIKLTDFGLSKIGLMSMATNLYEGHIEKDAREFIDKQVCGTPEYIAPEVIFRQGYGKPVDWWAMGVVLYEFLVGCVPFFGDTPEELFGQVVSDEIMWPEGDEALPADAQDLITRLLRQSPLDRLGTGGTHEVKQHPFFLALDWAGLLRHKAEFVPQLEAEDDTSYFDTRSERYRHLGSEDDETNDEESSTEIPQFSSCSHRFSKVYSSSEFLAVQPTPTFAERSFSEDREEGWERSEVDYGRRLSADIRGADPPPAATPVMPKPSSLSADTAALSHARLRSNSIGARHSTPRPLDASRGRRLGGPRDPAPEKSRASSSGGSGGGSGGRVPKSASVSALSLIITADDGSGGPLMSPLSPRSLSSNPSSRDSSPSRDPSPVCGSLRPPIVIHSSGKKYGFSLRAIRVYMGDSDVYTVHHVVWSVEDGSPAQEAGLRAGDLITHINGESVLGLVHMDVVELLLKSGNKISLRTTALENTSIKVGPARKNVAKGRMARRSKRSRRRETQDRRKSLFKKISKQTSVLHTSRSFSSGLHHSLSSSESLPGSPTHSLSPSPTTPCRSPAPDVPADTTASPPSASPSSSSPASPAAAGHTRPSSLHGLAAKLGPPRPKTGRRKSTSSIPPSPLACPPISAPPPRSPSPLPGHPPAPARSPRLRRGQSADKLGTGERLDGEAGRRTRGPEAELVVMRRLHLSERRDSFKKQEAVQEVSFDEPQEEATGLPTSVPQIAVEGEEAVPVALGPTGRD

SEQ ID NO: 884848 - protein, 574 aa, Homo sapiens
MLLCLTQLAKGLVTPELRSWTSSGSSCQSSSSQPERGPSPSLLNTISLDTMPKFAFSSEDEGVGPGPAGPKRPVFILGEPDPPPAATPVMPKPSSLSADTAALSHARLRSNSIGARHSTPRPLDASRGRRLGGPRDPAPEKSRASSSGGSGGGSGGRVPKSASVSALSLIITADDGSGGPLMSPLSPRSLSSNPSSRDSSPSRDPSPVCGSLRPPIVIHSSGKKYGFSLRAIRVYMGDSDVYTVHHVVWSVEDGSPAQEAGLRAGDLITHINGESVLGLVHMDVVELLLKSGNKISLRTTALENTSIKVGPARKNVAKGRMARRSKRSRRRETQDRRKSLFKKISKQTSVLHTSRSFSSGLHHSLSSSESLPGSPTHSLSPSPTTPCRSPAPDVPADTTASPPSASPSSSSPASPAAAGHTRPSSLHGLAAKLGPPRPKTGRRKSTSSIPPSPLACPPISAPPPRSPSPLPGHPPAPARSPRLRRGQSADKLGTGERLDGEAGRRTRGPEAELVVMRRLHLSERRDSFKKQEAVQEVSFDEPQEEATGLPTSVPQIAVEGEEAVPVALGPTGRD

SEQ ID NO: 884849 - protein, 1138 aa, Homo sapiens; identical to SEQ ID NO: 884844

SEQ ID NO: 884850 - protein, 1138 aa, Homo sapiens; identical to SEQ ID NO: 884844

SEQ ID NO: 884851 - protein, 1138 aa, Homo sapiens; identical to SEQ ID NO: 884844

SEQ ID NO: 884852 - protein, 774 aa, Homo sapiens
MNHVYRERFPKATAQMEGRLQEFLTAYAPGARLALADGVLGFIHHQIVELARDCLAKSGENLVTSRYFLEMQEKLERLLQDAHERSDSEEVSFIVQLVRKLLIIISRPARLLECLEFDPEEFYHLLEAAEGHAREGQGIKTDLPQYIIGQLGLAKDPLEEMVPLSHLEEEQPPAPESPESRALVGQSRRKPCESDFETIKLISNGAYGAVYLVRHRDTRQRFAIKKINKQNLILRNQIQQVFVERDILTFAENPFVVSMFCSFETRRHLCMVMEYVEGGDCATLLKNMGPLPVDMARLYFAETVLALEYLHNYGIVHRDLKPDNLLITSLGHIKLTDFGLSKIGLMSMATNLYEGHIEKDAREFIDKQVCGTPEYIAPEVIFRQGYGKPVDWWAMGVVLYEFLVGCVPFFGDTPEELFGQVVSDEIMWPEGDEALPADAQDLITRLLRQSPLDRLGTGGTHEVKQHPFFLALDWAGLLRHKAEFVPQLEAEDDTSYFDTRSERYRHLGSEDDETNDEESSTEIPQFSSCSHRFSKVYSSSEFLAVQPTPTFAERSFSEDREEGWERSEVDYGRRLSADIRLRSWTSSGSSCQSSSSQPERGPSPSLLNTISLDTMPKFAFSSEDEGVGPGPAGPKRPVFILGEPDPPPAATPVMPKPSSLSADTAALSHARLRSNSIGARHSTPRPLDASRGRRLGGPRDPAPEKSRASSILQTKQLRPQRGAETCPTITQQESWQNGASARPCCGRCHQGSLNGGSGVRYSRLQPQLIPHDAV

SEQ ID NO: 884853 - protein, 1151 aa, Homo sapiens
MNHVYRERFPKATAQMEGRLQEFLTAYAPGARLALADGVLGFIHHQIVELARDCLAKSGENLVTSRYFLEMQEKLERLLQDAHERSDSEEVSFIVQLVRKLLIIISRPARLLECLEFDPEEFYHLLEAAEGHAREGQGIKTDLPQYIIGQLGLAKDPLEEMVPLSHLEEEQPPAPESPESRALVGQSRRKPCESDFETIKLISNGAYGAVYLVRHRDTRQRFAIKKINKQNLILRNQIQQVFVERDILTFAENPFVVSMFCSFETRRHLCMVMEYVEGGDCATLLKNMGPLPVDMARLYFAETVLALEYLHNYGIVHRDLKPDNLLITSLGHIKLTDFGLSKIGLMSMATNLYEGHIEKDAREFIDKQVCGTPEYIAPEVIFRQGYGKPVDWWAMGVVLYEFLVGCVPFFGDTPEELFGQVVSDEIMWPEGDEALPADAQDLITRLLRQSPLDRLGTGGTHEVKQHPFFLALDWAGLLRHKAEFVPQLEAEDDTSYFDTRSERYRHLGSEDDETNDEESSTEIPQFSSCSHRFSKVYSSSEFLAVQPTPTFAERSFSEDREEGWERSEVDYGRRLSADIRLRSWTSSGSSCQSSSSQPERGPSPSLLNTISLDTMPKFAFSSEDEGVGPGPAGPKRPVFILGEPDPPPAATPVMPKPSSLSADTAALSHARLRSNSIGARHSTPRPLDASRGRRLGGPRDPAPEKSRASSSGGSGGGSGGRVPKSASVSALSLIITADDGSGGPLMSPLSPRSLSSNPSSRDSSPSRDPSPVCGSLRPPIVIHSSGKKYGFSLRAIRVYMGDSDVYTVHHVVWSVEDGSPAQEAGLRAGDLITHINGESVLGLVHMDVVELLLKSGNKISLRTTALENTSIKVGPARKNVAKGRMARRSKRSRRRETQDRCAAVTTRERRKSLFKKISKQTSVLHTSRSFSSGLHHSLSSSESLPGSPTHSLSPSPTTPCRSPAPDVPADTTCSTATQAHPPKHPSQATAITRDMLAGAQTDQALRATAHGPASIARHNHQPRRGPAKTSHKQHIARLSTIKTRALNIQPHSELHRYPAPCRAPQIELDQTSHIALPDPHSQRALTRNAPPTQPDSSMSHSRAIPHKPTHIDTSSCSQRTHQQPTQTSRRHPSTTPPENQSHNRDTTACSH

SEQ ID NO: 884854 - protein, 120 aa, Homo sapiens
MATNLYEGHIEKDAREFIDKQVGGQVGGQPRDASSSLLGPLLGWGLASVSPFSLAQVCGTPEYIAPEVIFRQGYGKPVDWWAMGVVLYEFLVGCVPFFGDTPEELFGQVVSGAFPPRAWV

SEQ ID NO: 884855 - protein, 180 aa, Homo sapiens
MSVLRPLDKLPGLNTATILLVGTEDALLQQLADSMLKEDCASELKVHLAKSLPLPSSVNRPRIDLIVFVVNLHSKYSLQNTEESLRHVDASFFLGKVCFLATGAGRESHCSIHRHTVVKLAHTYQSPLLYCDLEVEGFRATMAQRLVRVLQICAGHVPGVSALNLLSLLRSSEGPSLEDL

SEQ ID NO: 884856 - protein, 105 aa, Homo sapiens
SGSGCLRRLFEGLGKLRQLEATLRCGMNEGVAVVGSGDLSYPQVSAPSPALAAPAAALGKGAGPAFYLTAVLCSPRRWKALGPPWRSAWCACCRSVLATCPVSQL

SEQ ID NO: 884857 - protein, 180 aa, Homo sapiens; identical to SEQ ID NO: 884855

SEQ ID NO: 884858 - protein, 180 aa, Homo sapiens; identical to SEQ ID NO: 884855

SEQ ID NO: 884859 - protein, 237 aa, Homo sapiens
WERGSGSRECGAHRPAAGPNLRPPARAASRGPLLGKCPPSRLLAVSRSPREWVEGPGPPQGVLCLGLDCPLSLPAQLVGTEDALLQQLADSMLKEDCASELKVHLAKSLPLPSSVNRPRIDLIVFVVNLHSKYSLQNTEESLRHVDASFFLGKVCFLATGAGRESHCSIHRHTVVKLAHTYQSPLLYCDLEVEGFRATMAQRLVRVLQICAGHVPGVSALNLLSLLRSSEGPSLEDL

SEQ ID NO: 884860 - protein, 107 aa, Homo sapiens
MSVLRPLDKLPGLNTATILLVGTEDALLQQLADSMLKEDCASELKVHLAKSLPLPSSVNRPRIDLIVFVVNLHSKYSLQNTEESLRHVDASFFLGKVCFLATGGGRL

SEQ ID NO: 884861 - protein, 206 aa, Homo sapiens
WERGSGSRECGAHRPAAGPNLRPPARAASRGPLLGKCPPSRLLAVSRSPREWVEGPGPPQGVLCLGLDCPLSLPAQLVGTEDALLQQLADSMLKEDCASELKVLQNTEESLRHVDASFFLGKVCFLATGAGRESHCSIHRHTVVKLAHTYQSPLLYCDLEVEGFRATMAQRLVRVLQICAGHVPGVSALNLLSLLRSSEGPSLEDL

SEQ ID NO: 884862 - protein, 164 aa, Homo sapiens
WERGSGSRECGAHRPAAGPNLRPPARAASRGPLLGKCPPSRLLAVSRSPREWVEGPGPPQGVLCLGLDCPLSLPAQLVGTEDALLQQLADSMLKEDCASELKVHLAKSLPLPSSVNRPRIDLIVFVVNLHSKYSLQNTEESLRHVDASFFLGKVCFLATGGGRL

SEQ ID NO: 884863 - protein, 107 aa, Homo sapiens; identical to SEQ ID NO: 884860

SEQ ID NO: 884864 - protein, 132 aa, Homo sapiens
MSVLRPLDKLPGLNTATILLVGTEDALLQQLADSMLKEDCASELKVHLAKSLPLPSSVNRPRIDLIVFVVNLHSKYSLQNTEESLRHVDASFFLGKVCFLATGGKYVPRLLLPTPSQGKAGAAVGFLLRHPG

SEQ ID NO: 884865 - protein, 399 aa, Homo sapiens
MGILLGLLLLGHLTVDTYGRPILEVPESVTGPWKGDVNLPCTYDPLQGYTQVLVKWLVQRGSDPVTIFLRDSSGDHIQQAKYQGRLHVSHKVPGDVSLQLSTLEMDDRSHYTCEVTWQTPDGNQVVRDKITELRVQKLSVSKPTVTTGSGYGFTVPQGMRISLQCQARGSPPISYIWYKQQTNNQEPIKVATLSTLLFKPAVIADSGSYFCTAKGQVGSEQHSDIVKFVVKDSSKLLKTKTEAPTTMTYPLKATSTVKQSWDWTTDMDGYLGETSAGPGKSLPVFAIILIISLCCMVVFTMAYIMLCRKTSQQEHVYEAARAHAREANDSGETMRVAIFASGCSSDEPTSQNLGNNYSDEPCIGQEYQIIAQINGNYARLLDTVPLDYEFLATEGKSVC

SEQ ID NO: 884866 - protein, 445 aa, Homo sapiens
QRETISYYRNVRKAAVRSEFWDAATRSLSLFGSRRLEERTEVALAVMGILLGLLLLGHLTVDTYGRPILEVPESVTGPWKGDVNLPCTYDPLQGYTQVLVKWLVQRGSDPVTIFLRDSSGDHIQQAKYQGRLHVSHKVPGDVSLQLSTLEMDDRSHYTCEVTWQTPDGNQVVRDKITELRVQKLSVSKPTVTTGSGYGFTVPQGMRISLQCQARGSPPISYIWYKQQTNNQEPIKVATLSTLLFKPAVIADSGSYFCTAKGQVGSEQHSDIVKFVVKDSSKLLKTKTEAPTTMTYPLKATSTVKQSWDWTTDMDGYLGETSAGPGKSLPVFAIILIISLCCMVVFTMAYIMLCRKTSQQEHVYEAARAHAREANDSGETMRVAIFASGCSSDEPTSQNLGNNYSDEPCIGQEYQIIAQINGNYARLLDTVPLDYEFLATEGKSVC

SEQ ID NO: 884867 - protein, 399 aa, Homo sapiens; identical to SEQ ID NO: 884865

SEQ ID NO: 884868 - protein, 332 aa, Homo sapiens
MGILLGLLLLGHLTVDTYGRPILEVPESVTGPWKGDVNLPCTYDPLQGYTQVLVKWLVQRGSDPVTIFLRDSSGDHIQQAKYQGRLHVSHKVPGDVSLQLSTLEMDDRSHYTCEVTWQTPDGNQVVRDKITELRVQKLSVSKPTVTTGSGYGFTVPQGMRISLQCQARGSPPISYIWYKQQTNNQEPIKVATLSTLLFKPAVIADSGSYFCTAKGQVGSEQHSDIVKFVVKDSSKLLKTKTEAPTTMTYPLKATSTVKQSWDWTTDMDGYLGETSAGPGKSLPVFAIILIISLCCMVVFTMAYIMLCRKTSQQEHVYEAARIWATTTLMSPA

SEQ ID NO: 884869 - protein, 407 aa, Homo sapiens
MGILLGLLLLGHLTVDTYGRPILEVPESVTGPWKGDVNLPCTYDPLQGYTQVLVKWLVQRGSDPVTIFLRDSSGDHIQQAKYQGRLHVSHKVPGDVSLQLSTLEMDDRSHYTCEVTWQTPDGNQVVRDKITELRVQKLSVSKPTVTTGSGYGFTVPQGMRISLQCQARGSPPISYIWYKQQTNNQEPIKVATLSTLLFKPAVIADSGSYFCTAKGQVGSEQHSDIVKFVVKDSSKLLKTKTEAPTTMTYPLKATSTVKQSWDWTTDMDGYLGETSAGPGKSLPVFAIILIISLCCMVVFTMAYIMLCRKTSQQEHVYEAARAHAREANDSGETMRVAIFASGCSSDEPTSQNLGNNYSDEPCIGQEYQIIAQINGNYARLLDTVGFALEFARCISSKPAAGFGSGPF

SEQ ID NO: 884870 - protein, 347 aa, Homo sapiens
MGILLGLLLLGHLTVDTYGRPILEVPESVTGPWKGDVNLPCTYDPLQGYTQVLVKWLVQRGSDPVTIFLRDSSGDHIQQAKYQGRLHVSHKVPGDVSLQLSTLEMDDRSHYTCEVTWQTPDGNQVVRDKITELRVQKLSVSKPTVTTGSGYGFTVPQGMRISLQCQARGSPPISYIWYKQQTNNQEPIKVATLSTLLFKPAVIADSGSYFCTAKGQVGSEQHSDIVKFVVKDSSKLLKTKTEAPTTMTYPLKATSTVKQSWDWTTDMDGYLGETSAGPGKSLPVFAIILIISLCCMVVFTMAYIMLCRKTSQQEHVYEAASPKCPPTNTGAAGSHWLCPGICQMHLK

SEQ ID NO: 884871 - protein, 351 aa, Homo sapiens
QRETISYYRNVRKAAVRSEFWDAATRSLSLFGSRRLEERTEVALAVMGILLGLLLLGHLTVDTYGRPILEVPESVTGPWKGDVNLPCTYDPLQGYTQVLVKWLVQRGSDPVTIFLRDSSGDHIQQAKYQGRLHVSHKVPGDVSLQLSTLEMDDRSHYTCEVTWQTPDGNQVVRDKITELRVQKHSSKLLKTKTEAPTTMTYPLKATSTVKQSWDWTTDMDGYLGETSAGPGKSLPVFAIILIISLCCMVVFTMAYIMLCRKTSQQEHVYEAARAHAREANDSGETMRVAIFASGCSSDEPTSQNLGNNYSDEPCIGQEYQIIAQINGNYARLLDTVPLDYEFLATEGKSVC

SEQ ID NO: 884872 - protein, 388 aa, Homo sapiens
MGILLGLLLLGHLTVDTYGRPILEVPESVTGPWKGDVNLPCTYDPLQGYTQVLVKWLVQRGSDPVTIFLRDSSGDHIQQAKYQGRLHVSHKVPGDVSLQLSTLEMDDRSHYTCEVTWQTPDGNQVVRDKITELRVQKLSVSKPTVTTGSGYGFTVPQGMRISLQCQARGSPPISYIWYKQQTNNQEPIKVATLSTLLFKPAVIADSGSYFCTAKGQVGSEQHSDIVKFVVKDSSKLLKTKTEAPTTMTYPLKATSTVKQSWDWTTDMDGYLGETSAGPGKSLPVFAIILIISLCCMVVFTMAYIMLCRKTSQQEHVYEAARAHAREANDSGETMRVAIFASGCSSDEPTSQNLGNNYSDEPCIGQEYQIIAQINGNYARLLDTVSGPF

SEQ ID NO: 884873 - protein, 321 aa, Homo sapiens
MGILLGLLLLGHLTVDTYGRPILEVPESVTGPWKGDVNLPCTYDPLQGYTQVLVKWLVQRGSDPVTIFLRDSSGDHIQQAKYQGRLHVSHKVPGDVSLQLSTLEMDDRSHYTCEVTWQTPDGNQVVRDKITELRVQKLSVSKPTVTTGSGYGFTVPQGMRISLQCQARGSPPISYIWYKQQTNNQEPIKVATLSTLLFKPAVIADSGSYFCTAKGQVGSEQHSDIVKFVVKDSSKLLKTKTEAPTTMTYPLKATSTVKQSWDWTTDMDGYLGETSAGPGKSLPVFAIILIISLCCMVVFTMAYIMLCRKTSQQEHVYEAAR

SEQ ID NO: 884874 - protein, 341 aa, Homo sapiens
MGILLGLLLLGHLTVDTYGRPILEVPESVTGPWKGDVNLPCTYDPLQGYTQVLVKWLVQRGSDPVTIFLRDSSGDHIQQAKYQGRLHVSHKVPGDVSLQLSTLEMDDRSHYTCEVTWQTPDGNQVVRDKITELRVQKLSVSKPTVTTGSGYGFTVPQGMRISLQCQARGSPPISYIWYKQQTNNQEPIKVATLSTLLFKPAVIADSGSYFCTAKGQVGSEQHSDIVKFVVKDSSKLLKTKTEAPTTMTYPLKATSTVKQSWDWTTDMDGYLGETSAGPGKSLPVFAIILIISLCCMVVFTMAYIMLCRKTSQQEHVYETPRHMPESPLFLKTPWGGLFWGG

SEQ ID NO: 884875 - protein, 351 aa, Homo sapiens; identical to SEQ ID NO: 884871

SEQ ID NO: 884876 - protein, 340 aa, Homo sapiens
QRETISYYRNVRKAAVRSEFWDAATRSLSLFGSRRLEERTEVALAVMGILLGLLLLGHLTVDTYGRPILEVPESVTGPWKGDVNLPCTYDPLQGYTQVLVKWLVQRGSDPVTIFLRDSSGDHIQQAKYQGRLHVSHKVPGDVSLQLSTLEMDDRSHYTCEVTWQTPDGNQVVRDKITELRVQKHSSKLLKTKTEAPTTMTYPLKATSTVKQSWDWTTDMDGYLGETSAGPGKSLPVFAIILIISLCCMVVFTMAYIMLCRKTSQQEHVYEAARAHAREANDSGETMRVAIFASGCSSDEPTSQNLGNNYSDEPCIGQEYQIIAQINGNYARLLDTVSGPF

SEQ ID NO: 884877 - protein, 321 aa, Homo sapiens; identical to SEQ ID NO: 884873

SEQ ID NO: 884878 - protein, 185 aa, Homo sapiens
QRETISYYRNVRKAAVRSEFWDAATRSLSLFGSRRLEERTEVALAVMGILLGLLLLGHLTVDTYGRPILEVPESVTGPWKGDVNLPCTYDPLQGYTQVLVKWLVQRGSDPVTIFLRDSSGDHIQQAKYQGRLHVSHKVPGDVSLQLSTLEMDDRSHYTCEVTGFALEFARCISSKPAAGFGSGPF

SEQ ID NO: 884879 - protein, 84 aa, Homo sapiens
MKGWGWLALLLGALLGTAWARRSQDLHCGACRALVDELEWEIAQVDPKKTIQMGSFRINPDGSQSVVEVTVTVPPNKVAHSGFG

SEQ ID NO: 884880 - protein, 108 aa, Homo sapiens
MGVNRPRVRRSPGHPVCGRRRSALENPGQPCSLQPGVVSGATGAKVRVQRSSSAWATAAALGAEVERPHYAKDERLGLAGPASGGPAGNRLGSEEPGSPLWSMQGSGG

SEQ ID NO: 884881 - protein, 182 aa, Homo sapiens
MKGWGWLALLLGALLGTAWARRSQDLHCGACRALVDELEWEIAQVDPKKTIQMGSFRINPDGSQSVVEVPYARSEAHLTELLEEICDRMKEYGEQIDPSTHRKNYVRVVGRNGESSELDLQGIRIDSDISGTLKFACESIVEEYEDELIEFFSREADNVKDKLCSKRTDLCDHALHISHDEL

SEQ ID NO: 884882 - protein, 75 aa, Homo sapiens
THASGVLATGAKVRVQRSSSAWATAAALGAEVERPHYAKDERLGLAGPASGGPAGNRLGSEEPGSPLWSMQGSGG

SEQ ID NO: 884883 - protein, 115 aa, Homo sapiens
MVPYARSEAHLTELLEEICDRMKEYGEQIDPSTHRKNYVRVVGRNGESSELDLQGIRIDSDISGTLKFACESIVEEYEDELIEFFSREADNVKDKLCSKRTDLCDHALHISHDEL

SEQ ID NO: 884884 - protein, 105 aa, Homo sapiens
DNLNPVPAVMWSDPITLKMKGWGWLALLLGALLGTAWARRSQDLHCGACRALVDELEWEIAQVDPKKTIQMGSFRINPDGSQSVVEVSALCPLRGPPHRAAGGDM

SEQ ID NO: 884885 - protein, 85 aa, Homo sapiens
KDEWKSWVDPILLTPYPLPCPLLSFSPLPPACRALVDELEWEIAQVDPKKTIQMGSFRINPDGSQSVVEVTVTVPPNKVAHSGFG

SEQ ID NO: 884886 - protein, 136 aa, Homo sapiens
WCSRGSHARRFINPDGSSQWWMVPYARSEAHLTELLEEICDRMKEYGEQIDPSTHRKNYVRVVGRNGESSELDLQGIRIDSDISGTLKFACESIVEEYEDELIEFFSREADNVKDKLCSKRTDLCDHALHISHDEL

SEQ ID NO: 884887 - protein, 104 aa, Homo sapiens
RLVRGSVVNGRGEYGEQIDPSTHRKNYVRVVGRNGESSELDLQGIRIDSDISGTLKFACESIVEEYEDELIEFFSREADNVKDKLCSKRTDLCDHALHISHDEL

SEQ ID NO: 884888 - protein, 114 aa, Homo sapiens
GGGGTNRQVEAGCVRRSPGHPVCGRRRSALENPGQPCSLQPGVVSGATGAKVRVQRSSSAWATAAALGAEVERPHYAKDERLGLAGPASGGPAGNRLGSEEPGSPLWSMQGSGG

SEQ ID NO: 884889 - protein, 115 aa, Homo sapiens; identical to SEQ ID NO: 884883

SEQ ID NO: 884890 - protein, 40 aa, Homo sapiens
MDHPQEGDGHTKGDGHTKGDGHTKGDGHAKGDGHTKGDEH

SEQ ID NO: 884891 - protein, 105 aa, Homo sapiens
MGIGSWFLDIKGLLENQLESEADILVLLFGSEGKRPLIALCHPFLPWVGSVRALWRNTRMNSLNSFPERLTMLKTNFAVSEQIFVTMPCTYRMMSYEPLEQPTLA

SEQ ID NO: 884892 - protein, 122 aa, Homo sapiens
GGHSFIRSHISSSSSVRASERAKEICDRMKEYGEQIDPSTHRKNYVRVVGRNGESSELDLQGIRIDSDISGTLKFACESIVEEYEDELIEFFSREADNVKDKLCSKRTDLCDHALHISHDEL

SEQ ID NO: 884893 - protein, 85 aa, Homo sapiens
KSGINADLPLRPVGTAWARRSQDLHCGACRALVDELEWEIAQVDPKKTIQMGSFRINPDGSQSVVEVNEVPGTVVHACSPSTLGG

SEQ ID NO: 884894 - protein, 182 aa, Homo sapiens; identical to SEQ ID NO: 884881

SEQ ID NO: 884895 - protein, 140 aa, Homo sapiens [sequence omitted]

SEQ ID NO: 884896 - protein, 140 aa, Homo sapiens [sequence omitted]

SEQ ID NO: 884897 - protein, 246 aa, Homo sapiens
SLFSRHLVHPCLEGGGCGIQYRQEDMPFTCEGITPDIIINPHAIPSRMTIGHLIECLQGKVSANKGEIGDATPFNDAVNVQKISNLLSDYGYHLRGNEVLYNGFTGRKITSQIFIGPTYYQRLKHMVDDKIHSRARGPIQILNRQPMEGRSRDGGLRFGEMERDCQIAHGAAQFLRERLFEASDPYQVHVCNLCGIMAIANTRTHTYECRGCRNKTQISLVRMPYACKLLFQELMSMSIAPRMMSV

SEQ ID NO: 884898 - protein, 265 aa, Homo sapiens
MYDADEDMQYDEDDDEITPDLWQEACWIVISSYFDEKGLVRQQLDSFDEFIQMSVQRIVEDAPPIDLQAEAQHASGEVEEPPRYLLKFEQIYLSKPTHWERDGAPSPMMPNEARLRNLTYSAPLYVDITKTVIKEGEEQLQTQHQKTFIGKIPIMLRSTYCLLNGLTDRDLCELNECPLDPGGYFIINGSEKVLIAQEKMATNTVYVFAKKDSKYAYTGECGSMASRNTRPRTSKDSMGSTRRPEGRDRWTRKRGKRPQDEGGDT

SEQ ID NO: 884899 - protein, 1174 aa, Homo sapiens
MYDADEDMQYDEDDDEITPDLWQEACWIVISSYFDEKGLVRQQLDSFDEFIQMSVQRIVEDAPPIDLQAEAQHASGEVEEPPRYLLKFEQIYLSKPTHWERDGAPSPMMPNEARLRNLTYSAPLYVDITKTVIKEGEEQLQTQHQKTFIGKIPIMLRSTYCLLNGLTDRDLCELNECPLDPGGYFIINGSEKVLIAQEKMATNTVYVFAKKDSKYAYTGECRSCLENSSRPTSTIWVSMLARGGQGAKKSAIGQRIVATLPYIKQEVPIIIVFRALGFVSDRDILEHIIYDFEDPEMMEMVKPSLDEAFVIQEQNVALNFIGSRGAKPGVTKEKRIKYAKEVLQKEMLPHVGVSDFCETKKAYFLGYMVHRLLLAALGRRELDDRDHYGNKRLDLAGPLLAFLFRGMFKNLLKEVRIYAQKFIDRGKDFNLELAIKTRIISDGLKYSLATGNWGDQKKAHQARAGVSQVLNRLTFASTLSHLRRLNSPIGRDGKLAKPRQLHNTLWGMVCPAETPEGHAVGLVKNLALMAYISVGSQPSPILEFLEEWSMENLEEISPAAIADATKIFVNGCWVGIHKDPEQLMNTLRKLRRQMDIIVSEVSMIRDIREREIRIYTDAGRICRPLLIVEKQKLLLKKRHIDQLKEREYNNYSWQDLVASGVVEYIDTLEEETVMLAMTPDDLQEKEVAYCSTYTHCEIHPSMILGVCASIIPFPDHNQSPRNTYQSAMGKQAMGVYITNFHVRMDTLAHVLYYPQKPLVTTRSMEYLRFRELPAGINSIVAIASYTGYNQEDSVIMNRSAVDRGFFRSVFYRSYKEQESKKGFDQEEVFEKPTRETCQGMRHAIYDKLDDDGLIAPGVRVSGDDVIIGKTVTLPENEDELESTNRRYTKRDCSTFLRTSETGIVDQVMVTLNQEGYKFCKIRVRSVRIPQIGDKFASRHGQKGTCGIQYRQEDMPFTCEGITPDIIINPHAIPSRMTIGHLIECLQGKVSANKGEIGDATPFNDAVNVQKISNLLSDYGYHLRGNEVLYNGFTGRKITSQIFIGPTYYQRLKHMVDDKIHSRARGPIQILNRQPMEGRSRDGGLRFGEMERDCQIAHGAAQFLRERLFEASDPYQVHVCNLCGIMAIANTRTHTYECRGCRNKTQISLVRMPYACKLLFQELMSMSIAPRMMSV

SEQ ID NO: 884900 - protein, 1174 aa, Homo sapiens; identical to SEQ ID NO: 884899

SEQ ID NO: 884901 - protein, 645 aa, Homo sapiens
MYDADEDMQYDEDDDEITPDLWQEACWIVISSYFDEKGLVRQQLDSFDEFIQMSVQRIVEDAPPIDLQAEAQHASGEVEEPPRYLLKFEQIYLSKPTHWERDGAPSPMMPNEARLRNLTYSAPLYVDITKTVIKEGEEQLQTQHQKTFIGKIPIMLRSTYCLLNGLTDRDLCELNECPLDPGGYFIINGSEKVLIAQEKMATNTVYVFAKKDSKYAYTGECRSCLENSSRPTSTIWVSMLARGGQGAKKSAIGQRIVATLPYIKQEVPIIIVFRALGFVSDRDILEHIIYDFEDPEMMEMVKPSLDEAFVIQEQNVALNFIGSRGAKPGVTKEKRIKYAKEVLQKEMLPHVGVSDFCETKKAYFLGYMVHRLLLAALGRRELDDRDHYGNKRLDLAGPLLAFLFRGMFKNLLKEVRIYAQKFIDRGKDFNLELAIKTRIISDGLKYSLATGNWGDQKKAHQARAGVSQVLNRLTFASTLSHLRRLNSPIGRDGKLAKPRQLHNTLWGMVCPAETPEGHAVGLVKNLALMAYISVGSQPSPILEFLEEWSMENLEEISPAAIADATKIFVNGCWVGIHKDPEQLMNTLRKLRRQMDIIVSEVSMIRDIREREIRIYTDAGRICRPLLIVEKQKLAGSCGQWGSGVY

SEQ ID NO: 884902 - protein, 929 aa, Homo sapiens [sequence omitted]

SEQ ID NO: 884903 - protein, 1174 aa, Homo sapiens; identical to SEQ ID NO: 884899

SEQ ID NO: 884904 - protein, 1099 aa, Homo sapiens
MLDCNQPRYLLKFEQIYLSKPTHWERDGAPSPMMPNEARLRNLTYSAPLYVDITKTVIKEGEEQLQTQHQKTFIGKIPIMLRSTYCLLNGLTDRDLCELNECPLDPGGYFIINGSEKVLIAQEKMATNTVYVFAKKDSKYAYTGECRSCLENSSRPTSTIWVSMLARGGQGAKKSAIGQRIVATLPYIKQEVPIIIVFRALGFVSDRDILEHIIYDFEDPEMMEMVKPSLDEAFVIQEQNVALNFIGSRGAKPGVTKEKRIKYAKEVLQKEMLPHVGVSDFCETKKAYFLGYMVHRLLLAALGRRELDDRDHYGNKRLDLAGPLLAFLFRGMFKNLLKEVRIYAQKFIDRGKDFNLELAIKTRIISDGLKYSLATGNWGDQKKAHQARAGVSQVLNRLTFASTLSHLRRLNSPIGRDGKLAKPRQLHNTLWGMVCPAETPEGHAVGLVKNLALMAYISVGSQPSPILEFLEEWSMENLEEISPAAIADATKIFVNGCWVGIHKDPEQLMNTLRKLRRQMDIIVSEVSMIRDIREREIRIYTDAGRICRPLLIVEKQKLLLKKRHIDQLKEREYNNYSWQDLVASGVVEYIDTLEEETVMLAMTPDDLQEKEVAYCSTYTHCEIHPSMILGVCASIIPFPDHNQSPRNTYQSAMGKQAMGVYITNFHVRMDTLAHVLYYPQKPLVTTRSMEYLRFRELPAGINSIVAIASYTGYNQEDSVIMNRSAVDRGFFRSVFYRSYKEQESKKGFDQEEVFEKPTRETCQGMRHAIYDKLDDDGLIAPGVRVSGDDVIIGKTVTLPENEDELESTNRRYTKRDCSTFLRTSETGIVDQVMVTLNQEGYKFCKIRVRSVRIPQIGDKFASRHGQKGTCGIQYRQEDMPFTCEGITPDIIINPHAIPSRMTIGHLIECLQGKVSANKGEIGDATPFNDAVNVQKISNLLSDYGYHLRGNEVLYNGFTGRKITSQIFIGPTYYQRLKHMVDDKIHSRARGPIQILNRQPMEGRSRDGGLRFGEMERDCQIAHGAAQFLRERLFEASDPYQVHVCNLCGIMAIANTRTHTYECRGCRNKTQISLVRMPYACKLLFQELMSMSIAPRMMSV

SEQ ID NO: 884905 - protein, 669 aa, Homo sapiens
AGCGEMVFCEPGHAVGLVKNLALMAYISVGSQPSPILEFLEEWSMENLEEISPAAIADATKIFVNGCWVGIHKDPEQLMNTLRKLRRQMDIIVSEVSMIRDIREREIRIYTDAGRICRPLLIVEKQKLLLKKRHIDQLKEREYNNYSWQDLVASGVVEYIDTLEEETVMLAMTPDDLQEKEVAYCSTYTHCEIHPSMILGVCASIIPFPDHNQSPRNTYQSAMGKQAMGVYITNFHVRMDTLAHVLYYPQKPLVTTRSMEYLRFRELPAGINSIVAIASYTGYNQEDSVIMNRSAVDRGFFRSVFYRSYKEQESKKGFDQEEVFEKPTRETCQGMRHAIYDKLDDDGLIAPGVRVSGDDVIIGKTVTLPENEDELESTNRRYTKRDCSTFLRTSETGIVDQVMVTLNQEGYKFCKIRVRSVRIPQIGDKFASRHGQKGTCGIQYRQEDMPFTCEGITPDIIINPHAIPSRMTIGHLIECLQGKVSANKGEIGDATPFNDAVNVQKISNLLSDYGYHLRGNEVLYNGFTGRKITSQIFIGPTYYQRLKHMVDDKIHSRARGPIQILNRQPMEGRSRDGGLRFGEMERDCQIAHGAAQFLRERLFEASDPYQVHVCNLCGIMAIANTRTHTYECRGCRNKTQISLVRMPYACKLLFQELMSMSIAPRMMSV

SEQ ID NO: 884906 - protein, 1174 aa, Homo sapiens; identical to SEQ ID NO: 884899

SEQ ID NO: 884907 - protein, 263 aa, Homo sapiens
NSAIMAGCKIRVRSVRIPQIGDKFASRHGQKGTCGIQYRQEDMPFTCEGITPDIIINPHAIPSRMTIGHLIECLQGKVSANKGEIGDATPFNDAVNVQKISNLLSDYGYHLRGNEVLYNGFTGRKITSQIFIGPTYYQRLKHMVDDKIHSRARGPIQILNRQPMEGRSRDGGLRFGEMERDCQIAHGAAQFLRERLFEASDPYQVHVCNLCGIMAIANTRTHTYECRGCRNKTQISLVRMPYACKLLFQELMSMSIAPRMMSV

SEQ ID NO: 884908 - protein, 198 aa, Homo sapiens
LNGVASPISPLKVSANKGEIGDATPFNDAVNVQKISNLLSDYGYHLRGNEVLYNGFTGRKITSQIFIGPTYYQRLKHMVDDKIHSRARGPIQILNRQPMEGRSRDGGLRFGEMERDCQIAHGAAQFLRERLFEASDPYQVHVCNLCGIMAIANTRTHTYECRGCRNKTQISLVRMPYACKLLFQELMSMSIAPRMMSV

SEQ ID NO: 884909 - protein, 238 aa, Homo sapiens [sequence omitted]

SEQ ID NO: 884910 - protein, 238 aa, Homo sapiens [sequence omitted]

SEQ ID NO: 884911 - protein, 238 aa, Homo sapiens [sequence omitted]

SEQ ID NO: 884912 - protein, 1174 aa, Homo sapiens; identical to SEQ ID NO: 884899

SEQ ID NO: 884913 - protein, 1174 aa, Homo sapiens; identical to SEQ ID NO: 884899

SEQ ID NO: 884914 - protein, 1174 aa, Homo sapiens; identical to SEQ ID NO: 884899

SEQ ID NO: 884915 - protein, 1174 aa, Homo sapiens; identical to SEQ ID NO: 884899

SEQ ID NO: 884916 - protein, 238 aa, Homo sapiens [sequence omitted]

SEQ ID NO: 884917 - protein, 789 aa, Homo sapiens
MYDADEDMQYDEDDDEITPDLWQEACWIVISSYFDEKGLVRQQLDSFDEFIQMSVQRIVEDAPPIDLQAEAQHASGEVEEPPRYLLKFEQIYLSKPTHWERDGAPSPMMPNEARLRNLTYSAPLYVDITKTVIKEGEEQLQTQHQKTFIGKIPIMLRSTYCLLNGLTDRDLCELNECPLDPGGYFIINGSEKVLIAQEKMATNTVYVFAKKDSKYAYTGECRSCLENSSRPTSTIWVSMLARGGQGAKKSAIGQRIVATLPYIKQEVPIIIVFRALGFVSDRDILEHIIYDFEDPEMMEMVKPSLDEAFVIQEQNVALNFIGSRGAKPGVTKEKRIKYAKEVLQKEMLPHVGVSDFCETKKAYFLGYMVHRLLLAALGRRELDDRDHYGNKRLDLAGPLLAFLFRGMFKNLLKEVRIYAQKFIDRGKDFNLELAIKTRIISDGLKYSLATGNWGDQKKAHQARAGVSQVLNRLTFASTLSHLRRLNSPIGRDGKLAKPRQLHNTLWGMVCPAETPEGHAVGLVKNLALMAYISVGSQPSPILEFLEEWSMENLEEISPAAIADATKIFVNGCWVGIHKDPEQLMNTLRKLRRQMDIIVSEVSMIRDIREREIRIYTDAGRICRPLLIVEKQKLLLKKRHIDQLKEREYNNYSWQDLVASGVVEYIDTLEEETVMLAMTPDDLQEKEVAYCSTYTHCEIHPSMILGVCASIIPFPDHNQSPRNTYQSAMGKQAMGVYITNFHVRMDTLAHVLYYPQKPLVTTRSMEYLRFRELPAGMVSFALRYLRSFCA

SEQ ID NO: 884918 - protein, 193 aa, Homo sapiens
MYDADEDMQYDEDDDEITPDLWQEACWIVISSYFDEKGLVRQQLDSFDEFIQMSVQRIVEDAPPIDLQAEAQHASGEVEEPPRYLLKFEQIYLSKPTHWERDGAPSPMMPNEARLRNLTYSAPLYVDITKTVIKEGEEQLQTQHQKTFIGKIPIMLRSTYCLLNGLTDRDLCELNECPLDPGGYFIINGSEKV

SEQ ID NO: 884919 - protein, 1174 aa, Homo sapiens; identical to SEQ ID NO: 884899

SEQ ID NO: 884920 - protein, 1174 aa, Homo sapiens; identical to SEQ ID NO: 884899

SEQ ID NO: 884921 - protein, 1174 aa, Homo sapiens; identical to SEQ ID NO: 884899

SEQ ID NO: 884922 - protein, 649 aa, Homo sapiens
MYDADEDMQYDEDDDEITPDLWQEACWIVISSYFDEKGLVRQQLDSFDEFIQMSVQRIVEDAPPIDLQAEAQHASGEVEEPPRYLLKFEQIYLSKPTHWERDGAPSPMMPNEARLRNLTYSAPLYVDITKTVIKEGEEQLQTQHQKTFIGKIPIMLRSTYCLLNGLTDRDLCELNECPLDPGGYFIINGSEKVLIAQEKMATNTVYVFAKKDSKYAYTGECRSCLENSSRPTSTIWVSMLARGGQGAKKSAIGQRIVATLPYIKQEVPIIIVFRALGFVSDRDILEHIIYDFEDPEMMEMVKPSLDEAFVIQEQNVALNFIGSRGAKPGVTKEKRIKYAKEVLQKEMLPHVGVSDFCETKKAYFLGYMVHRLLLAALGRRELDDRDHYGNKRLDLAGPLLAFLFRGMFKNLLKEVRIYAQKFIDRGKDFNLELAIKTRIISDGLKYSLATGNWGDQKKAHQARAGVSQVLNRLTFASTLSHLRRLNSPIGRDGKLAKPRQLHNTLWGMVCPAETPEGHAVGLVKNLALMAYISVGSQPSPILEFLEEWSMENLEEISPAAIADATKIFVNGCWVGIHKDPEQLMNTLRKLRRQMDIIVSEVSMIRDIREREIRIYTDAGRICRPLLIVEKQKLLLKKRHIDQLKERSTI

SEQ ID NO: 884923 - protein, 957 aa, Homo sapiens
MYDADEDMQYDEDDDEITPDLWQEACWIVISSYFDEKGLVRQQLDSFDEFIQMSVQRIVEDAPPIDLQAEAQHASGEVEEPPRYLLKFEQIYLSKPTHWERDGAPSPMMPNEARLRNLTYSAPLYVDITKTVIKEGEEQLQTQHQKTFIGKIPIMLRSTYCLLNGLTDRDLCELNECPLDPGGYFIINGSEKVLIAQEKMATNTVYVFAKKDSKYAYTGECRSCLENSSRPTSTIWVSMLARGGQGAKKSAIGQRIVATLPYIKQEVPIIIVFRALGFVSDRDILEHIIYDFEDPEMMEMVKPSLDEAFVIQEQNVALNFIGSRGAKPGVTKEKRIKYAKEVLQKEMLPHVGVSDFCETKKAYFLGYMVHRLLLAALGRRELDDRDHYGNKRLDLAGPLLAFLFRGMFKNLLKEVRIYAQKFIDRGKDFNLELAIKTRIISDGLKYSLATGNWGDQKKAHQARAGVSQVLNRLTFASTLSHLRRLNSPIGRDGKLAKPRQLHNTLWGMVCPAETPEGHAVGLVKNLALMAYISVGSQPSPILEFLEEWSMENLEEISPAAIADATKIFVNGCWVGIHKDPEQLMNTLRKLRRQMDIIVSEVSMIRDIREREIRIYTDAGRICRPLLIVEKQKLLLKKRHIDQLKEREYNNYSWQDLVASGVVEYIDTLEEETVMLAMTPDDLQEKEVAYCSTYTHCEIHPSMILGVCASIIPFPDHNQSPRNTYQSAMGKQAMGVYITNFHVRMDTLAHVLYYPQKPLVTTRSMEYLRFRELPAGINSIVAIASYTGYNQEDSVIMNRSAVDRGFFRSVFYRSYKEQESKKGFDQEEVFEKPTRETCQGMRHAIYDKLDDDGLIAPGVRVSGDDVIIGKTVTLPENEDELESTNRRYTKRDCSTFLRTSETGIVDQVMVTLNQEGYKFCKIRVRSVRIPQIGDKFASRHGQVSPLISSSIPMPSPLV

SEQ ID NO: 884924 - protein, 929 aa, Homo sapiens [sequence omitted]

SEQ ID NO: 884925 - protein, 878 aa, Homo sapiens
MMEMVKPSLDEAFVIQEQNVALNFIGSRGAKPGVTKEKRIKYAKEVLQKEMLPHVGVSDFCETKKAYFLGYMVHRLLLAALGRRELDDRDHYGNKRLDLAGPLLAFLFRGMFKNLLKEVRIYAQKFIDRGKDFNLELAIKTRIISDGLKYSLATGNWGDQKKAHQARAGVSQVLNRLTFASTLSHLRRLNSPIGRDGKLAKPRQLHNTLWGMVCPAETPEGHAVGLVKNLALMAYISVGSQPSPILEFLEEWSMENLEEISPAAIADATKIFVNGCWVGIHKDPEQLMNTLRKLRRQMDIIVSEVSMIRDIREREIRIYTDAGRICRPLLIVEKQKLLLKKRHIDQLKEREYNNYSWQDLVASGVVEYIDTLEEETVMLAMTPDDLQEKEVAYCSTYTHCEIHPSMILGVCASIIPFPDHNQSPRNTYQSAMGKQAMGVYITNFHVRMDTLAHVLYYPQKPLVTTRSMEYLRFRELPAGINSIVAIASYTGYNQEDSVIMNRSAVDRGFFRSVFYRSYKEQESKKGFDQEEVFEKPTRETCQGMRHAIYDKLDDDGLIAPGVRVSGDDVIIGKTVTLPENEDELESTNRRYTKRDCSTFLRTSETGIVDQVMVTLNQEGYKFCKIRVRSVRIPQIGDKFASRHGQKGTCGIQYRQEDMPFTCEGITPDIIINPHAIPSRMTIGHLIECLQGKVSANKGEIGDATPFNDAVNVQKISNLLSDYGYHLRGNEVLYNGFTGRKITSQIFIGPTYYQRLKHMVDDKIHSRARGPIQILNRQPMEGRSRDGGLRFGEMERDCQIAHGAAQFLRERLFEASDPYQVHVCNLCGIMAIANTRTHTYECRGCRNKTQISLVRMPYACKLLFQELMSMSIAPRMMSV

SEQ ID NO: 884926 - protein, 355 aa, Homo sapiens
MWFLIFVGDYVTFRVYFLTGMRHAIYDKLDDDGLIAPGVRVSGDDVIIGKTVTLPENEDELESTNRRYTKRDCSTFLRTSETGIVDQVMVTLNQEGYKFCKIRVRSVRIPQIGDKFASRHGQKGTCGIQYRQEDMPFTCEGITPDIIINPHAIPSRMTIGHLIECLQGKVSANKGEIGDATPFNDAVNVQKISNLLSDYGYHLRGNEVLYNGFTGRKITSQIFIGPTYYQRLKHMVDDKIHSRARGPIQILNRQPMEGRSRDGGLRFGEMERDCQIAHGAAQFLRERLFEASDPYQVHVCNLCGIMAIANTRTHTYECRGCRNKTQISLVRMPYACKLLFQELMSMSIAPRMMSV

SEQ ID NO: 884927 - protein, 246 aa, Homo sapiens; identical to SEQ ID NO: 884897

SEQ ID NO: 884928 - protein, 1174 aa, Homo sapiens; identical to SEQ ID NO: 884899

SEQ ID NO: 884929 - protein, 1174 aa, Homo sapiens; identical to SEQ ID NO: 884899

SEQ ID NO: 884930 - protein, 1174 aa, Homo sapiens; identical to SEQ ID NO: 884899

SEQ ID NO: 884931 - protein, 1174 aa, Homo sapiens; identical to SEQ ID NO: 884899

SEQ ID NO: 884932 - protein, 976 aa, Homo sapiens [sequence omitted]

SEQ ID NO: 884933 - protein, 265 aa, Homo sapiens; identical to SEQ ID NO: 884898

SEQ ID NO: 884934 - protein, 749 aa, Homo sapiens
MARKLSVILILTFALSVTNPLHELKAAAFPQTTEKISPNWESGINVDLAISTRQYHLQQLFYRYGENNSLSVEGFRKLLQNIGIDKIKRIHIHHDHDHHSDHEHHSDHERHSDHEHHSDHEHHSDHNHAASGKNKRKALCPDHDSDSSGKDPRNSQGKGAHRPEHASGRRNVKDSVSASEVTSTVYNTVSEGTHFLETIETPRPGKLFPKDVSSSTPPSVTSKSRVSRLAGRKTNESVSEPRKGFMYSRNTNENPQECFNASKLLTSHGMGIQVPLNATEFNYLCPAIINQIDARSCLIHTSEKKAEIPPKTYSLQIAWVGGFIAISIISFLSLLGVILVPLMNRVFFKFLLSFLVALAVGTLSGDAFLHLLPHSHASHHHSHSHEEPAMEMKRGPLFSHLSSQNIEESAYFDSTWKGLTALGGLYFMFLVEHVLTLIKQFKDKKKKNQKKPENDDDVEIKKQLSKYESQLSTNEEKVDTDDRTEGYLRADSQEPSHFDSQQPAVLEEEEVMIAHAHPQEVYNEYVPRGCKNKCHSHFHDTLGQSDDLIHHHHDYHHILHHHHHQNHHPHSHSQRYSREELKDAGVATLAWMVIMGDGLHNFSDGLAIGAAFTEGLSSGLSTSVAVFCHELPHELGDFAVLLKAGMTVKQAVLYNALSAMLAYLGMATGIFIGHYAENVSMWIFALTAGLFMYVALVDMVPEMLHNDASDHGCSRWGYFFLQNAGMLLGFGIMLLISIFEHKIVFRINF

SEQ ID NO: 884935 - protein, 504 aa, Homo sapiens
MYSRNTNENPQECFNASKLLTSHGMGIQVPLNATEFNYLCPAIINQIDARSCLIHTSEKKAEIPPKTYSLQIAWVGGFIAISIISFLSLLGVILVPLMNRVFFKFLLSFLVALAVGTLSGDAFLHLLPHSHASHHHSHSHEEPAMEMKRGPLFSHLSSQNIEESAYFDSTWKGLTALGGLYFMFLVEHVLTLIKQFKDKKKKNQKKPENDDDVEIKKQLSKYESQLSTNEEKVDTDDRTEGYLRADSQEPSHFDSQQPAVLEEEEVMIAHAHPQEVYNEYVPRGCKNKCHSHFHDTLGQSDDLIHHHHDYHHILHHHHHQNHHPHSHSQRYSREELKDAGVATLAWMVIMGDGLHNFSDGLAIGAAFTEGLSSGLSTSVAVFCHELPHELGDFAVLLKAGMTVKQAVLYNALSAMLAYLGMATGIFIGHYAENVSMWIFALTAGLFMYVALVDMVPEMLHNDASDHGCSRWGYFFLQNAGMLLGFGIMLLISIFEHKIVFRINF

SEQ ID NO: 884936 - protein, 749 aa, Homo sapiens; identical to SEQ ID NO: 884934

SEQ ID NO: 884937 - protein, 500 aa, Homo sapiens
LCFGTADSGTDCCSSEEVGFPEGSVPLNATEFNYLCPAIINQIDARSCLIHTSEKKAEIPPKTYSLQIAWVGGFIAISIISFLSLLGVILVPLMNRVFFKFLLSFLVALAVGTLSGDAFLHLLPHSHASHHHSHSHEEPAMEMKRGPLFSHLSSQNIEESAYFDSTWKGLTALGGLYFMFLVEHVLTLIKQFKDKKKKNQKKPENDDDVEIKKQLSKYESQLSTNEEKVDTDDRTEGYLRADSQEPSHFDSQQPAVLEEEEVMIAHAHPQEVYNEYVPRGCKNKCHSHFHDTLGQSDDLIHHHHDYHHILHHHHHQNHHPHSHSQRYSREELKDAGVATLAWMVIMGDGLHNFSDGLAIGAAFTEGLSSGLSTSVAVFCHELPHELGDFAVLLKAGMTVKQAVLYNALSAMLAYLGMATGIFIGHYAENVSMWIFALTAGLFMYVALVDMVPEMLHNDASDHGCSRWGYFFLQNAGMLLGFGIMLLISIFEHKIVFRINF

SEQ ID NO: 884938 - protein, 104 aa, Homo sapiens [sequence omitted]

SEQ ID NO: 884939 - protein, 702 aa, Homo sapiens
MARKLSVILILTFALSVTNPLHELKAAAFPQTTEKISPNWESGINVDLAISTRQYHLQQLFYRYGENNSLSVEGFRKLLQNIGIDKIKRIHIHHDHDHHSDHEHHSDHERHSDHEHHSDHEHHSDHNHAASGKNKRKALCPDHDSDSSGKDPRNSQGKGAHRPEHASGRRNVKDSVSASEVTSTVYNTVSEGTHFLETIETPRPGKLFPKDVSSSTPPSVTSKSRVSRLAGRKTNESVSEPRKGFMYSRNTNENPQECFNASKLLTSHGMGIQVPLNATEFNYLCPAIINQIDARSCLIHTSEKKAEIPPKTYSLQIAWVGGFIAISIISFLSLLGVILVPLMNRVFFKFLLSFLVALAVGTLSGDAFLHLLPHSHASHHHSHSHEEPAMEMKRGPLFSHLSSQNIEESAYFDSTWKGLTALGGLYFMFLVEHVLTLIKQFKDKKKKNQKKPENDDDVEIKKQLSKYESQLSTNEEKVDTDDRTEGYLRADSQEPSHFDSQQPAVLEEEEVMIAHAHPQEVYNEYVPRGCKNKCHSHFHDTLGQSDDLIHHHHDYHHILHHHHHQNHHPHSHSQRYSREELKDAGVATLAWMVIMGDGLHNFSDGLAIGAAFTEGLSSGLSTSVAVFCHELPHELGDFAVLLKAGMTVKQAVLYNALSAMLAYLGMATGIFIGHYAENVSMWIFALTAGLFMYVALVDMVSF

SEQ ID NO: 884940 - protein, 692 aa, Homo sapiens
MARKLSVILILTFALSVTNPLHELKAAAFPQTTEKISPNWESGINVDLAISTRQYHLQQLFYRYGENNSLSVEGFRKLLQNIGIDKIKRIHIHHDHDHHSDHEHHSDHERHSDHEHHSDHEHHSDHNHAASGKNKRKALCPDHDSDSSGKDPRNSQGKGAHRPEHASGRRNVKDSVSASEVTSTVYNTVSEGTHFLETIETPRPGKLFPKDVSSSTPPSVTSKSRVSRLAGRKTNESVSEPRKGFMYSRNTNENPQECFNASKLLTSHGMGIQVPLNATEFNYLCPAIINQIDARSCLIHTSEKKAEIPPKTYSLQIAWVGGFIAISIISFLSLLGVILVPLMNRVFFKFLLSFLVALAVGTLSGDAFLHLLPHSHASHHHSHSHEEPAMEMKRGPLFSHLSSQNIEESAYFDSTWKGLTALGGLYFMFLVEHVLTLIKQFKDKKKKNQKKPENDDDVEIKKQLSKYESQLSTNEEKVDTDDRTEGYLRADSQEPSHFDSQQPAVLEEEEVMIAHAHPQEVYNEYVPRGCKNKCHSHFHDTLGQSDDLIHHHHDYHHILHHHHHQNHHPHSHSQRYSREELKDAGVATLAWMVIMGDGLHNFSDGLAIGAAFTEGLSSGLSTSVAVFCHELPHELGDFAVLLKAGMTVKQAVLYNALSAMLAYLGMATGIFIGHYAENVSMWIFDWFRVPSS

SEQ ID NO: 884941 - protein, 613 aa, Homo sapiens
MARKLSVILILTFALSVTNPLHELKAAAFPQTTEKISPNWESGINVDLAISTRQYHLQQLFYRYGENNSLSVEGFRKLLQNIGIDKIKRIHIHHDHDHHSDHEHHSDHERHSDHEHHSDHEHHSDHNHAASGKNKRKALCPDHDSDSSGKDPRNSQGKGAHRPEHASGRRNVKDSVSASEVTSTVYNTVSEGTHFLETIETPRPGKLFPKDVSSSTPPSVTSKSRVSRLAGRKTNESVSEPRKGFMYSRNTNENPQECFNASKLLTSHGMGIQVPLNATEFNYLCPAIINQIDARSCLIHTSEKKAEIPPKTYSLQIAWVGGFIAISIISFLSLLGVILVPLMNRVFFKFLLSFLVALAVGTLSGDAFLHLLPHSHASHHHSHSHEEPAMEMKRGPLFSHLSSQNIEESAYFDSTWKGLTALGGLYFMFLVEHVLTLIKQFKDKKKKNQKKPENDDDVEIKKQLSKYESQLSTNEEKVDTDDRTEGYLRADSQEPSHFDSQQPAVLEEEEVMIAHAHPQEVYNEYVPRGCKNKCHSHFHDTLGQSDDLIHHHHDYHHILHHHHHQNHHPHSHSQRYSREELKDAGVATLAWMVIMGDGLHNFSDGLAIAAAFN

SEQ ID NO: 884942 - protein, 777 aa, Homo sapiens
LLLWLPRDPPCCQTWSGRGTTRRGDEGAMARKLSVILILTFALSVTNPLHELKAAAFPQTTEKISPNWESGINVDLAISTRQYHLQQLFYRYGENNSLSVEGFRKLLQNIGIDKIKRIHIHHDHDHHSDHEHHSDHERHSDHEHHSDHEHHSDHNHAASGKNKRKALCPDHDSDSSGKDPRNSQGKGAHRPEHASGRRNVKDSVSASEVTSTVYNTVSEGTHFLETIETPRPGKLFPKDVSSSTPPSVTSKSRVSRLAGRKTNESVSEPRKGFMYSRNTNENPQECFNASKLLTSHGMGIQVPLNATEFNYLCPAIINQIDARSCLIHTSEKKAEIPPKTYSLQIAWVGGFIAISIISFLSLLGVILVPLMNRVFFKFLLSFLVALAVGTLSGDAFLHLLPHSHASHHHSHSHEEPAMEMKRGPLFSHLSSQNIEESAYFDSTWKGLTALGGLYFMFLVEHVLTLIKQFKDKKKKNQKKPENDDDVEIKKQLSKYESQLSTNEEKVDTDDRTEGYLRADSQEPSHFDSQQPAVLEEEEVMIAHAHPQEVYNEYVPRGCKNKCHSHFHDTLGQSDDLIHHHHDYHHILHHHHHQNHHPHSHSQRYSREELKDAGVATLAWMVIMGDGLHNFSDGLAIGAAFTEGLSSGLSTSVAVFCHELPHELGDFAVLLKAGMTVKQAVLYNALSAMLAYLGMATGIFIGHYAENVSMWIFALTAGLFMYVALVDMVPEMLHNDASDHGCSRWGYFFLQNAGMLLGFGIMLLISIFEHKIVFRINF

SEQ ID NO: 884943 - protein, 480 aa, Homo sapiens [sequence omitted]

SEQ ID NO: 884944 - protein, 320 aa, Homo sapiens
EGVKKHHHSKSQRPVPQGNQKKPENDDDVEIKKQLSKYESQLSTNEEKVDTDDRTEGYLRADSQEPSHFDSQQPAVLEEEEVMIAHAHPQEVYNEYVPRGCKNKCHSHFHDTLGQSDDLIHHHHDYHHILHHHHHQNHHPHSHSQRYSREELKDAGVATLAWMVIMGDGLHNFSDGLAIGAAFTEGLSSGLSTSVAVFCHELPHELGDFAVLLKAGMTVKQAVLYNALSAMLAYLGMATGIFIGHYAENVSMWIFALTAGLFMYVALVDMVPEMLHNDASDHGCSRWGYFFLQNAGMLLGFGIMLLISIFEHKIVFRINF

SEQ ID NO: 884945 - protein, 588 aa, Homo sapiens
MARKLSVILILTFALSVTNPLHELKAAAFPQTTEKISPNWESGINVDLAISTRQYHLQQLFYRYGENNSLSVEGFRKLLQNIGIDKIKRIHIHHDHDHHSDHEHHSDHERHSDHEHHSDHEHHSDHNHAASGKNKRKALCPDHDSDSSGKDPRNSQGKGAHRPEHASGRRNVKDSVSASEVTSTVYNTVSEGTHFLETIETPRPGKLFPKDVSSSTPPSVTSKSRVSRLAGRKTNESVSEPRKGFMYSRNTNENPQECFNASKLLTSHGMGIQVPLNATEFNYLCPAIINQIDARSCLIHTSEKKAEIPPKTYSLQIAWVGGFIAISIISFLSLLGVILVPLMNRVFFKFLLSFLVALAVGTLSGDAFLHLLPHSHASHHHSHSHEEPAMEMKRGPLFSHLSSQNIEESAYFDSTWKGLTALGGLYFMFLVEHVLTLIKQFKDKKKKNQKKPENDDDVEIKKQLSKYESQLSTNEEKVDTDDRTEGYLRADSQEPSHFDSQQPAVLEEEEVMIAHAHPQEVYNEYVPRGCKNKCHSHFHDTLGQSDDLIHHHHDYHHILHHHHHQNHHPHSHSQRYSREELKDAGVAT

SEQ ID NO: 884946 - protein, 588 aa, Homo sapiens; identical to SEQ ID NO: 884945

SEQ ID NO: 884947 - protein, 83 aa, Homo sapiens
DDLIHHHHDYHHILHHHHHQNHHPHSHSQRYSREELKDAGVATLAWMVIMGDGLHNFSDGLAIGIYLHICSLLIDSENVTLNT

SEQ ID NO: 884948 - protein, 292 aa, Homo sapiens
MSASVKESLQLQLLEMEMLFSMFPNQGEVKLEDVNALTNIKRYLEGTREALPPKIEFVITLQIEEPKVKIDLQVTMPHSYPYVALQLFGRSSELDRHQQLLLNKGLTSYIGTFDPGELCVCAAIQWLQDNSASYFLNRKLVYEPSTQAKPVKNTFLRMWIYSHHIYQQDLRKKILDVGKRLDVTGFCMTGKPGIICVEGFKEHCEEFWHTIRYPNWKHISCKHAESVETEGNGEDLRLFHSFEELLLEAHGDYGLRNDYHMNLGQFLEFLKKHKSEHVFQILFGIESKSSDS

SEQ ID NO: 884949 - protein, 318 aa, Homo sapiens
MSASVKESLQLQLLEMEMLFSMFPNQGEVKLEDVNALTNIKRYLEGTREALPPKIEFVITLQIEEPKRRLSGSPDWILSRWFTHFNGTLHFSMVKIDLQVTMPHSYPYVALQLFGRSSELDRHQQLLLNKGLTSYIGTFDPGELCVCAAIQWLQDNSASYFLNRKLVYEPSTQAKPVKNTFLRMWIYSHHIYQQDLRKKILDVGKRLDVTGFCMTGKPGIICVEGFKEHCEEFWHTIRYPNWKHISCKHAESVETEGNGEDLRLFHSFEELLLEAHGDYGLRNDYHMNLGQFLEFLKKHKSEHVFQILFGIESKSSDS

SEQ ID NO: 884950 - protein, 217 aa, Homo sapiens
MPHSYPYVALQLFGRSSELDRHQQLLLNKGLTSYIGTFDPGELCVCAAIQWLQDNSASYFLNRKLVYEPSTQAKPVKNTFLRMWIYSHHIYQQDLRKKILDVGKRLDVTGFCMTGKPGIICVEGFKEHCEEFWHTIRYPNWKHISCKHAESVETEGNGEDLRLFHSFEELLLEAHGDYGLRNDYHMNLGQFLEFLKKHKSEHVFQILFGIESKSSDS

SEQ ID NO: 884951 - protein, 136 aa, Homo sapiens
MSAALLRRGLELLAASEAPRDPPGQAKPRGAPVKRPRKTKAIQAQKLRNSAKGKVPKSALDEYRKRECRDHLRVNLKFLTRTRSTVAESVSQQILRQNRGRKACDRPVAKTKKKKAEGTVFTEEDFQKFQQEYFGS

SEQ ID NO: 884952 - protein, 111 aa, Homo sapiens
MSAALLRRGLELLAASEAPRDPPGQAKPRGAPVKRPRKTKAIQAQKLRNSAKGKVPKSALGKFGKGLKVLPPVLGPAPQRRWRLRQGLKRSPGIARPTVCQARSGALDIRR

SEQ ID NO: 884953 - protein, 140 aa, Homo sapiens
MGVGAKSLGLSAGPVWRMHLMEKSPAAVITWEGNDEVFGRAMGQGLRMVPGGVNLKCAPCLLPTDEYRKRECRDHLRVNLKFLTRTRSTVAESVSQQILRQNRGRKACDRPVAKTKKKKAEGTVFTEEDFQKFQQEYFGS

SEQ ID NO: 884954 - protein, 105 aa, Homo sapiens
MRQVQCDYGKDKKKLEQSSPNELSKWNYLDEYRKRECRDHLRVNLKFLTRTRSTVAESVSQQILRQNRGRKACDRPVAKTKKKKAEGTVFTEEDFQKFQQEYFGS

SEQ ID NO: 884955 - protein, 136 aa, Homo sapiens; identical to SEQ ID NO: 884951

SEQ ID NO: 884956 - protein, 140 aa, Homo sapiens; identical to SEQ ID NO: 884953

SEQ ID NO: 884957 - protein, 136 aa, Homo sapiens; identical to SEQ ID NO: 884951

SEQ ID NO: 884958 - protein, 137 aa, Homo sapiens
MGTLRALSPGSLPLSSPTAPRDPPGQAKPRGAPVKRPRKTKAIQAQKLRNSAKGKVPKSALDEYRKRECRDHLRVNLKFLTRTRSTVAESVSQQILRQNRGRKACDRPVAKTKKKKAEGTVFTEEDFQKFQQEYFGS

SEQ ID NO: 884959 - protein, 72 aa, Homo sapiens
MRPCIWIHVHLKPPCRLVELLPFSSALQGLSHLSLGTTLPVILPERNEEQNLQELSHNADKYQMGDCCKEEI

SEQ ID NO: 884960 - protein, 86 aa, Homo sapiens
MAGAPPPASLPPCSLISDCCASNQRDSVGVAPSEPGAGYNLVVHRFLSWSEKRSIRVGVTRFSRYSPLVECKWKPEEKGTLDTVFI

SEQ ID NO: 884961 - protein, 107 aa, Homo sapiens
MECWNAAEVSWEGAWCSPHVYTVARPGWHFACGKRSENGGGCLRGITGILRYHRPEPSLPFLSHRWKFECWGSVEHLKEAGEADVPLCLPSVMQPVHACQHLCRWTL

SEQ ID NO: 884962 - protein, 107 aa, Homo sapiens
MAGAPPPASLPPCSLISDCCASNQRDSVGVAPSEPGAGYNLVVHRFLSWSEKRSIRVGVTRFSRCCVAIFKVITLDHISIASCLGIINEDKVGLLFSMIWAFVFSTG

SEQ ID NO: 884963 - protein, 86 aa, Homo sapiens; identical to SEQ ID NO: 884960

SEQ ID NO: 884964 - protein, 72 aa, Homo sapiens; identical to SEQ ID NO: 884959

SEQ ID NO: 884965 - protein, 186 aa, Homo sapiens [sequence omitted]

SEQ ID NO: 884966 - protein, 191 aa, Homo sapiens
MEPTRDCPLFGGAFSAILPMGAIDVSDLRPVPDNQEVFCHPVTDQSLIVELLELQAHVRGEAAARYHFEDVGGVQGARAVHVESVQPLSLENLALRGRCQEAWVLSGKQQIAKENQQVAKDVTLHQALLRLPQYQTDLLLTFNQPPSPRKEEGTGGYLMTGFPGESGWEGQNRETHWWDPPRKQEWARGLG

SEQ ID NO: 884967 - protein, 138 aa, Homo sapiens
MEPTRDCPLFGGAFSAILPMGAIDVSDLRPVPDNQEVFCHPVTDQSLIVELLELQAHVRGEAAARYHFEDVGGVQGARAVHVESVQPLSLENLALRGRCQEAWVLSGKQQIAKENQQVRARECVMSWKGGSGDAEIQP

SEQ ID NO: 884968 - protein, 165 aa, Homo sapiens
MEPTRDCPLFGGAFSAILPMGAIDVSDLRPVPDNQEVFCHPVTDQSLIVELLELQAHVRGEAAARYHFEDVGGVQGARAVHVESVQPLSLENLALRGRCQEAWVLSGKQQIAKENQQVRARECVMSWKGGSGDAEIQVSILTLIPLGSKGRDTSSGLAEAAPVPD

SEQ ID NO: 884969 - protein, 118 aa, Homo sapiens
MEPTRDCPLFGGAFSAILPMGAIDVSDLRPVPDNQEVFCHPVTDQSLIVELLELQAHVRGEAAARYHFEDVGGVQGARAVHVESVQPLSLENLALRGRCQEAWVLSGKQQIAKENQQP

SEQ ID NO: 884970 - protein, 124 aa, Homo sapiens
SASTRSALGEPEPEVEEVKRRARRLLQEPARDPSILRLPRVVGVPGPRGRRHRGEQQQQREQRGGGARAPGPGPGSRQPLPAGLHGRRKVGSAPDRHGLGAGSAGARGNKAVIIVKHLCQALGE

SEQ ID NO: 884971 - protein, 123 aa, Homo sapiens
SASTRSALGEPEPEVEEVKRRARRLLQEPARDPSILRLPRVVGVPGPRGRRHRGEQQQQREQRGGGARAPGPGPGSRQPLPAGLHGRRKVGSAPDRHGLGAGSAGARGNKAVVGPSPPPPGRR

SEQ ID NO: 884972 - protein, 123 aa, Homo sapiens; identical to SEQ ID NO: 884971

SEQ ID NO: 884973 - protein, 123 aa, Homo sapiens; identical to SEQ ID NO: 884971

SEQ ID NO: 884974 - protein, 123 aa, Homo sapiens; identical to SEQ ID NO: 884971

SEQ ID NO: 884975 - protein, 501 aa, Homo sapiens
WLLSSLKRHFSETQSFSSAKMKHSLNALLIFLIITSAWGGSKGPLDQLEKGGETAQSADPQWEQLNNKNLSMPLLPADFHKVDLEKIFSEDDDYIDIVDSLSVSPTDSDVSAGNILQLFHGKSRIQRLNILNAKFAFNLYRVLKDQVNTFDNIFIAPVGISTAMGMISLGLKGETHEQVHSILHFKDFVNASSKYEITTIHNLFRKLTHRLFRRNFGYTLRSVNDLYIQKQFPILLDFKTKVREYYFAEAQIADFSDPAFISKTNNHIMKLTKGLIKDALENIDPATQMMILNCIYFKGSWVNKFPVEMTHNHNFRLNEREVVKVSMMQTKGNFLAANDQELDCDILQLEYVGGISMLIVVPHKMSGMKTLEAQLTPRVVERWQKSMTNRTREVLLPKFKLEKNYNLVESLKLMGIRMLFDKNGNMAGISDQRIAIDLFKHQGTITVNEEGTQATTVTTVGFMPLSTQVRFTVDRPFLFLIYEHRTSCLLFMGRVANPSRS

SEQ ID NO: 884976 - protein, 503 aa, Homo sapiens
WLLSSLKRHFSETQSFSSAKMKHSLNALLIFLIITSAWGGSKGPLDQLEKGGETAQSADPQWEQLNNKNLSMPLLPADFHKENTVTNDWIPEGEEDDDYLDLEKIFSEDDDYIDIVDSLSVSPTDSDVSAGNILQLFHGKSRIQRLNILNAKFAFNLYRVLKDQVNTFDNIFIAPVGISTAMGMISLGLKGETHEQVHSILHFKDFVNASSKYEITTIHNLFRKLTHRLFRRNFGYTLRSVNDLYIQKQFPILLDFKTKVREYYFAEAQIADFSDPAFISKTNNHIMKLTKGLIKDALENIDPATQMMILNCIYFKGSWVNKFPVEMTHNHNFRLNEREVVKVSMMQTKGNFLAANDQELDCDILQLEYVGGISMLIVVPHKMSGMKTLEAQLTPRVVERWQKSMTNRTREVLLPKFKLEKNYNLVESLKLMGIRMLFDKFKHQGTITVNEEGTQATTVTTVGFMPLSTQVRFTVDRPFLFLIYEHRTSCLLFMGRVANPSRS

SEQ ID NO: 884977 - protein, 332 aa, Homo sapiens
WLLSSLKRHFSETQSFSSAKMKHSLNALLIFLIITSAWGGSKGPLDQLEKGGETAQSADPQWEQLNNKNLSMPLLPADFHKENTVTNDWIPEGEEDDDYLDLEKIFSEDDDYIDIVDSLSVSPTDSDVSAGNILQLFHGKSRIQRLNILNAKFAFNLYRVLKDQVNTFDNIFIAPVGISTAMGMISLGLKGETHEQVHSILHFKDFVNASSKYEITTIHNLFRKLTHRLFRRNFGYTLRSVNDLYIQKQFPILLDFKTKVREYYFAEAQIADFSDPAFISKTNNHIMKLTKGLIKDALENIDPHPCTPDSVTQAFLHQAPHLNTKHRNEWCD

SEQ ID NO: 884978 - protein, 519 aa, Homo sapiens
WLLSSLKRHFSETQSFSSAKMKHSLNALLIFLIITSAWGGSKGPLDQLEKGGETAQSADPQWEQLNNKNLSMPLLPADFHKENTVTNDWIPEGEEDDDYLDLEKIFSEDDDYIDIVDSLSVSPTDSDVSAGNILQLFHGKSRIQRLNILNAKFAFNLYRVLKDQVNTFDNIFIAPVGISTAMGMISLGLKGETHEQVHSILHFKDFVNASSKYEITTIHNLFRKLTHRLFRRNFGYTLRSVNDLYIQKQFPILLDFKTKVREYYFAEAQIADFSDPAFISKTNNHIMKLTKGLIKDALENIDPATQMMILNCIYFKGSWVNKFPVEMTHNHNFRLNEREVVKVSMMQTKGNFLAANDQELDCDILQLEYVGGISMLIVVPHKMSGMKTLEAQLTPRVVERWQKSMTNRTREVLLPKFKLEKNYNLVESLKLMGIRMLFDKNGNMAGISDQRIAIDLFKHQGTITVNEEGTQATTVTTVGFMPLSTQVRFTVDRPFLFLIYEHRTSCLLFMGRVANPSRS

SEQ ID NO: 884979 - protein, 373 aa, Homo sapiens
WLLSSLKRHFSETQSFSSAKMKHSLNALLIFLIITSAWGGSKGPLDQLEKGGETAQSADPQWEQLNNKNLSMPLLPADFHKENTVTNDWIPEGEEDDDYLDLEKIFSEDDDYIDIVDSLSVSPTDSDVSAGNILQLFHGKSRIQRLNILNAKFAFNLYRVLKDQVNTFDNIFIAPVGISTAMGMISLGLKGETHEQVHSILHFKDFVNASSKYEITTIHNLFRKLTHRLFRRNFGYTLRSVNDLYIQKQFPILLDFKTKVREYYFAEAQIADFSDPAFISKTNNHIMKLTKGLIKDALENIDPATQMMILNCIYFKGSWVNKFPVEMTHNHNFRLNEREVVKVSMMQTKGNFLALPALHGKSGQPQQVLEVEV

SEQ ID NO: 884980 - protein, 519 aa, Homo sapiens; identical to SEQ ID NO: 884978

SEQ ID NO: 884981 - protein, 163 aa, Homo sapiens
DSASGPARVGCFGGRERSGRVLLSNPRGGGRTPTSHAAPQPGRGSSLRGPSLLFPPVFSPPLPSPPGSAWLRAGRAGLRARAGPQQLLPISPRPSAGPRTPMAGSEQHAAAAAGRRRLGRGSGGGGAPAGRGAGPGRHQHAAQQRLQGVGPAFQTIQKKFFDF

SEQ ID NO: 884982 - protein, 551 aa, Homo sapiens
MRPRRRDDGDSDAAAAAAAPLQDAELALAGINMLLNNGFRESDQLFKQYRNHSPLMSFGASFVSFLNAMMTFEEEKMQLACDDLKTTEKLCESEEAGVIETIKNKIKKNVDVRKSAPSMVDRLQRQIIIADCQVYLAVLSFVKQELSAYIKGGWILRKAWKIYNKCYLDINALQELYQKKLTEESLTSDAANDNHIVAEGVSEESLNRLKGAVSFGYGLFHLCISMVPPNLLKIINLLGFPGDRLQGLSSLMYAKRKLALLWYHTVVRPFFALDGSDNKAGLDEAKEILLKKEAAYPNSSLFMFFKGRIQRLECQINSALTSFHTALELAVDQREIQHVCLYEIGWCSMIELNFKDAFDSFERLKNESRWSQCYYAYLTAVCQGATGDVDGAQIVFKEVQKLFKRKNNQIEQFSVKASIEVLYLWKALPNCSFPNLQRMSQACHEVDDSSVVGLKYLLLGAIHKCLGNSEDAVQYFQRAVKDELCRQNNLYVQPYACYELGCLLLDKPETVGRGRALLLQAKEDFSGYDFENRLHVRIHAALASLRELVPQ

SEQ ID NO: 884983 - protein, 568 aa, Homo sapiens
MRPRRRDDGDSDAAAAAAAPLQDAELALAGINMLLNNGFRESDQLFKQYRNHSPLMSFGASFVSFLNAMMTFEEEKMQLACDDLKTTEKLCESEEAGVIETIKNKIKKNVDVRKSAPSMVDRLQRQIIIADCQVYLAVLSFVKQELSAYIKGGWILRKAWKIYNKCYLDINALQELYQKKLTEESLTSDAANDNHIVAEGVSEESLNRLKGAVSFGYGLFHLCISMVPPNLLKIINLLGFPGDRLQGLSSLMYAKRKLALLWYHTVVRPFFALDGSDNKAGLDEAKEILLKKEAAYPNSSLFMFFKGRIQRLECQINSALTSFHTALELAVDQREIQHVCLYEIGWCSMIELNFKDAFDSFERLKNESRWSQCYYAYLTAVCQGATGDVDGAQIVFKEVQKLFKRKNNQIEQFSVKKAERFRKQTPTKALCVLASIEVLYLWKALPNCSFPNLQRMSQACHEVDDSSVVGLKYLLLGAIHKCLGNSEDAVQYFQRAVKDELCRQNNLYVQPYACYELGCLLLDKPETVGRGRALLLQAKEDFSGYDFENRLHVRIHAALASLRELVPQ

SEQ ID NO: 884984 - protein, 568 aa, Homo sapiens; identical to SEQ ID NO: 884983

SEQ ID NO: 884985 - protein, 142 aa, Homo sapiens
MRPRRRDDGDSDAAAAAAAPLQDAELALAGINMLLNNGFRESDQLFKQYRNHSPLMSFGASFVSFLNAMMTFEEEKMQLACDDLKTTEKLCESEEAGVIETIKNKIKKNLISKVGGSLGKPGRFTINAIWTSMPFRSCIRRS

SEQ ID NO: 884986 - protein, 266 aa, Homo sapiens
EPLTPEQRRERWRRRRVRAEPLPPEQGECQINSALTSFHTALELAVDQREIQHVCLYEIGWCSMIELNFKDAFDSFERLKNESRWSQCYYAYLTAVCQGATGDVDGAQIVFKEVQKLFKRKNNQIEQFSVKASIEVLYLWKALPNCSFPNLQRMSQACHEVDDSSVVGLKYLLLGAIHKCLGNSEDAVQYFQRAVKDELCRQNNLYVQPYACYELGCLLLDKPETVGRGRALLLQAKEDFSGYDFENRLHVRIHAALASLRELVPQ

SEQ ID NO: 884987 - protein, 113 aa, Homo sapiens [sequence omitted]

SEQ ID NO: 884988 - protein, 87 aa, Homo sapiens
SCRIRHEAVQYFQRAVKDELCRQNNLYVQPYACYELGCLLLDKPETVGRGRALLLQAKEDFSGYDFENRLHVRIHAALASLRELVPQ

SEQ ID NO: 884989 - protein, 560 aa, Homo sapiens
MRPRRRDDGDSDAAAAAAAPLQDAELALAGINMLLNNGFRESDQLFKQYRNHSPLMSFGASFVSFLNAMMTFEEEKMQLACDDLKTTEKLCESEEAGVIETIKNKIKKNVDVRKSAPSMVDRLQRQIIIADCQVYLAVLSFVKQELSAYIKGGWILRKAWKIYNKCYLDINALQELYQKKLTEESLTSDAANDNHIVAEGVSEESLNRLKGAVSFGYGLFHLCISMVPPNLLKIINLLGFPGDRLQGLSSLMYASESKDMKAPLATLALLWYHTVVRPFFALDGSDNKAGLDEAKEILLKKEAAYPNSSLFMFFKGRIQRLECQINSALTSFHTALELAVDQREIQHVCLYEIGWCSMIELNFKDAFDSFERLKNESRWSQCYYAYLTAVCQGATGDVDGAQIVFKEVQKLFKRKNNQIEQFSVKASIEVLYLWKALPNCSFPNLQRMSQACHEVDDSSVVGLKYLLLGAIHKCLGNSEDAVQYFQRAVKDELCRQNNLYVQPYACYELGCLLLDKPETVGRGRALLLQAKEDFSGYDFENRLHVRIHAALASLRELVPQ

SEQ ID NO: 884990 - protein, 439 aa, Homo sapiens
MRPRRRDDGDSDAAAAAAAPLQDAELALAGINMLLNNGFRESDQLFKQYRNHSPLMSFGASFVSFLNAMMTFEEEKMQLACDDLKTTEKLCESEEAGVIETIKNKIKKNVDVRKSAPSMVDRLQRQIIIADCQVYLAVLSFVKQELSAYIKGGWILRKAWKIYNKCYLDINALQELYQKKLTEESLTSDAANDNHIVAEGVSEESLNRLKGAVSFGYGLFHLCISMVPPNLLKIINLLGFPGDRLQGLSSLMYAKRKLALLWYHTVVRPFFALDGSDNKAGLDEAKEILLKKEAAYPNSSLFMFFKGRIQRLECQINSALTSFHTALELAVDQREIQHVCLYEIGWCSMIELNFKDAFDSFERLKNESRWSQCYYAYLTAVCQGATGDVDGAQIVFKEVQKLFKRKNNQIEQFSVKKRLLKCCTCGKLFQTVPSPTCRG

SEQ ID NO: 884991 - protein, 271 aa, Homo sapiens
MLLSCSSWVLVASCWQTLSDIFSGGKTKCISLGCQINSALTSFHTALELAVDQREIQHVCLYEIGWCSMIELNFKDAFDSFERLKNESRWSQCYYAYLTAVCQGATGDVDGAQIVFKEVQKLFKRKNNQIEQFSVKASIEVLYLWKALPNCSFPNLQRMSQACHEVDDSSVVGLKYLLLGAIHKCLGNSEDAVQYFQRAVKDELCRQNNLYVQPYACYELGCLLLDKPETVGRGRALLLQAKEDFSGYDFENRLHVRIHAALASLRELVPQ

SEQ ID NO: 884992 - protein, 87 aa, Homo sapiens; identical to SEQ ID NO: 884988

SEQ ID NO: 884993 - protein, 544 aa, Homo sapiens
GALWRRQPGWQLTGQPGSILLRVFSKSRAGLEARKLKAYRTMEYMAESTDRSPGHILCCECGVPISPNPANICVACLRSKVDISQGIPKQVSISFCKQCQRYFQPPGTWIQCALESRELLALCLKKIKAPLSKVRLVDAGFVWTEPHSKRLKVKLTIQKEVMNGAILQQVFVVDYVVQSQMCGDCHRVEAKDFWKAVIQVRQKTLHKKTFYYLEQLILKYGMHQNTLRIKEIHDGLDFYYSSKQHAQKMVEFLQCTVPCRYKASQRLISQDIHSNTYNYKSTFSVEIVPICKDNVVCLSPKLAQSLGNMNQICVCIRVTSAIHLIDPNTLQVADIDGSTFWSHPFNSLCHPKQLEEFIVMECSIVQDIKRAAGAGMISKKHTLGEVWVQKTSEMNTDKQYFCRTHLGHLLNPGDLVLGFDLANCNLNDEHVNKMNSDRVPDVVLIKKSYDRTKRQRRRNWKLKELARERENMDTDDERQYQDFLEDLEEDEAIRKNVNIYRDSAIPVESDTDDEGAPRISLAEMLEDLHISQDATGEEGASMLT

SEQ ID NO: 884994 - protein, 544 aa, Homo sapiens; identical to SEQ ID NO: 884993

SEQ ID NO: 884995 - protein, 544 aa, Homo sapiens; identical to SEQ ID NO: 884993

SEQ ID NO: 884996 - protein, 544 aa, Homo sapiens; identical to SEQ ID NO: 884993

SEQ ID NO: 884997 - protein, 544 aa, Homo sapiens; identical to SEQ ID NO: 884993

SEQ ID NO: 884998 - protein, 544 aa, Homo sapiens; identical to SEQ ID NO: 884993

SEQ ID NO: 884999 - protein, 544 aa, Homo sapiens; identical to SEQ ID NO: 884993

SEQ ID NO: 885000 - protein, 192 aa, Homo sapiens
HILEEWPRTAPLLPELGRRRSSRMAPSEDPRDWRANLKGTIRETGLETSSGGKLAGHQKTVPTAHLTFVIDCIHGKQLSLAATASPPQAPSPNRGLVTPPMKTYIVFCGENWPHLTRVTPMGGGCLAQARATLPLCRGSVASASFPVSPLCPQEVPEAKGKPVKAAPVRSSTWGTVKDSLKALSSCVCGQAD

SEQ ID NO: 885001 - protein, 161 aa, Homo sapiens
SLPSLASCPSSQTHKKKGPGGKLAGHQKTVPTAHLTFVIDCIHGKQLSLAATASPPQAPSPNRGLVTPPMKTYIVFCGENWPHLTRVTPMGGGCLAQARATLPLCRGSVASASFPVSPLCPQEVPEAKGKPVKAAPVRSSTWGTVKDSLKALSSCVCGQAD

SEQ ID NO: 885002 - protein, 219 aa, Homo sapiens [sequence omitted]

SEQ ID NO: 885003 - protein, 161 aa, Homo sapiens
SGSWDEERHWVSTSADKGYSLQGRVLSLFSAGPRWQLLASGLPSASLWDLCLPGISCLASAGGASLWGRSLPPALSSSPEAAALPGWAQEAPCRHMMGRGCPYPPPRGYSPVSGHVSPGLSPGCWFLFCGAQTSVKHTDVGKMKNCGPTGLNPMDGGIFIQ

SEQ ID NO: 885004 - protein, 219 aa, Homo sapiens [sequence omitted]

SEQ ID NO: 885005 - protein, 219 aa, Homo sapiens [sequence omitted]

SEQ ID NO: 885006 - protein, 219 aa, Homo sapiens [sequence omitted]

SEQ ID NO: 885007 - protein, 219 aa, Homo sapiens [sequence omitted]

SEQ ID NO: 885008 - protein, 219 aa, Homo sapiens [sequence omitted]

SEQ ID NO: 885009 - protein, 92 aa, Homo sapiens
VTVSTRAPRSQHAALTQSGTDHAQECLDLVHVLPEAVEQPVVLEQCVMVVRVCVKLAVGLLEDLPRSRRSAKLAERRESRVHNQCHTEAGRV

SEQ ID NO: 885010 - protein, 332 aa, Homo sapiens [sequence omitted]

SEQ ID NO: 885011 - protein, 332 aa, Homo sapiens [sequence omitted]

SEQ ID NO: 885012 - protein, 184 aa, Homo sapiens
MALLCYNRGCGQRFDPETNSDDACTYHPGVPVFHDALKGWSCCKRRTTDFSDFLSIVGCTKGRHNSEKPPEPVKPEVKTTEKKELCELKPKFQEHIIQAPKPVEAIKRPSPDEPMTNLELKISASLKQALDKLKLSSGNEENKKEEDNDEIKIGTSCKNGGCSKSLHLQQQWGPDLPDKPWIYI

SEQ ID NO: 885013 - protein, 83 aa, Homo sapiens
SGVKRNGSFPEAGSRLSRQTGASDTGVANASSCRSRCLGLACDGGKRKWPCCATTGAAVSASILRPIPTKLAHTTEVCGGSHL

SEQ ID NO: 885014 - protein, 332 aa, Homo sapiens [sequence omitted]

SEQ ID NO: 885015 - protein, 144 aa, Homo sapiens [sequence omitted]

SEQ ID NO: 885016 - protein, 188 aa, Homo sapiens [sequence omitted]

SEQ ID NO: 885017 - protein, 313 aa, Homo sapiens [sequence omitted]

SEQ ID NO: 885018 - protein, 133 aa, Homo sapiens [sequence omitted]

SEQ ID NO: 885019 - protein, 332 aa, Homo sapiens [sequence omitted]

SEQ ID NO: 885020 - protein, 361 aa, Homo sapiens
YRKIPCHCWKRSPLHDKCTKNLCVRVRLLWSGKRNGCVLRGWARFILNNPDACTYHPGVPVFHDALKGWSCCKRRTTDFSDFLSIVGCTKGRHNSEKPPEPVKPEVKTTEKKELCELKPKFQEHIIQAPKPVEAIKRPSPDEPMTNLELKISASLKQALDKLKLSSGNEENKKEEDNDEIKIGTSCKNGGCSKTYQGLESLEEVCVYHSGVPIFHEGMKYWSCCRRKTSDFNTFLAQEGCTKGKHMWTKKDAGKKVVPCRHDWHQTGGEVTISVYAKNSLPELSRVEANSTLLNVHIVFEGEKEFDQNVKLWGVIDVKRSYVTMTATKIEITMRKAEPMQWASLELPAAKKQEKQKDDTTD

SEQ ID NO: 885021 - protein, 207 aa, Homo sapiens
MAKTYDYLFKLLLIGDSGVGKTCVLFRFSEDAFNSTFISTIGIDFKIRTIELDGKRIKLQIWDTAGQERFRTITTAYYRGAMGIMLVYDITNEKSFDNIRNWIRNIEEHASADVEKMILGNKCDVNDKRQVSKERGEKLALDYGIKFMETSAKANINVENAFFTLARDIKAKMDKKLEGNSPQGSNQGVKITPDQQKRSSFFRCVLL

SEQ ID NO: 885022 - protein, 207 aa, Homo sapiens; identical to SEQ ID NO: 885021

SEQ ID NO: 885023 - protein, 218 aa, Homo sapiens
MLGTSLGYNRPRAKTYDYLFKLLLIGDSGVGKTCVLFRFSEDAFNSTFISTIGIDFKIRTIELDGKRIKLQIWDTAGQERFRTITTAYYRGAMGIMLVYDITNEKSFDNIRNWIRNIEEHASADVEKMILGNKCDVNDKRQVSKERGEKLALDYGIKFMETSAKANINVENAFFTLARDIKAKMDKKLEGNSPQGSNQGVKITPDQQKRSSFFRCVLL

SEQ ID NO: 885024 - protein, 78 aa, Homo sapiens
SCTTDWKNKNSRAKNVRFGDSGRTRRSGGHFGAERRVPQLQEDHVTAVVVFGVTCQHTLRPLDALWGPHTGLRTSEVP

SEQ ID NO: 885025 - protein, 207 aa, Homo sapiens; identical to SEQ ID NO: 885021

SEQ ID NO: 885026 - protein, 213 aa, Homo sapiens
MVRKRWEAKTYDYLFKLLLIGDSGVGKTCVLFRFSEDAFNSTFISTIGIDFKIRTIELDGKRIKLQIWDTAGQERFRTITTAYYRGAMGIMLVYDITNEKSFDNIRNWIRNIEEHASADVEKMILGNKCDVNDKRQVSKERGEKLALDYGIKFMETSAKANINVENAFFTLARDIKAKMDKKLEGNSPQGSNQGVKITPDQQKRSSFFRCVLL

SEQ ID NO: 885027 - protein, 207 aa, Homo sapiens; identical to SEQ ID NO: 885021

SEQ ID NO: 885028 - protein, 207 aa, Homo sapiens; identical to SEQ ID NO: 885021

SEQ ID NO: 885029 - protein, 207 aa, Homo sapiens; identical to SEQ ID NO: 885021

SEQ ID NO: 885030 - protein, 207 aa, Homo sapiens; identical to SEQ ID NO: 885021

SEQ ID NO: 885031 - protein, 177 aa, Homo sapiens
QVGTGRVANRPRIDFKIRTIELDGKRIKLQIWDTAGQERFRTITTAYYRGAMGIMLVYDITNEKSFDNIRNWIRNIEEHASADVEKMILGNKCDVNDKRQVSKERGEKLALDYGIKFMETSAKANINVENAFFTLARDIKAKMDKKLEGNSPQGSNQGVKITPDQQKRSSFFRCVLL

SEQ ID NO: 885032 - protein, 123 aa, Homo sapiens
MLVYDITNEKSFDNIRNWIRNIEEHASADVEKMILGNKCDVNDKRQVSKERGEKLALDYGIKFMETSAKANINVENAFFTLARDIKAKMDKKLEGNSPQGSNQGVKITPDQQKRSSFFRCVLL

SEQ ID NO: 885033 - protein, 144 aa, Homo sapiens
GRSEEDPRAASTAYYRSAMGIMLVYDITNEKSFDNIRNWIRNIEEHASADVEKMILGNKCDVNDKRQVSKERGEKLALDYGIKFMETSAKANINVENAFFTLARDIKAKMDKKLEGNSPQGSNQGVKITPDQQKRSSFFRCVLL

SEQ ID NO: 885034 - protein, 106 aa, Homo sapiens
TRARYREPTHTLYIQRERGSQGVTVDHSQCQASASGPLLCGLTATQSSTRRLVHVPYHGSEVPEGQRWFQEQQLPNPEQGNRSPGPGSITQEIWRPLPPLLSVLDK

SEQ ID NO: 885035 - protein, 207 aa, Homo sapiens; identical to SEQ ID NO: 885021

SEQ ID NO: 885036 - protein, 229 aa, Homo sapiens
MAKTYDYLFKLLLIGDSGVGKTCVLFRFSEDAFNSTFISTIGIDFKIRTIELDGKRIKLQIWDTAGQERFRTITTAYYRGAMGIMLVYDITNEKSFDNIRNWIRNIEEHASADVEKMILGNKCDVNDKRQVSKERGEKLALDYGIKFMETSAKANINVENAFFTLARDIKAKMDKKLVHSQGLGLQARLRSPSSIKGTLCVLQVTPKTTTAVTWSTPRPRGQRHGQNAI

SEQ ID NO: 885037 - protein, 225 aa, Homo sapiens
MAKTYDYLFKLLLIGDSGVGKTCVLFRFSEDAFNSTFISTIGIDFKIRTIELDGKRIKLQIWDTAGQERFRTITTAYYRGAMGIMLVYDITNEKSFDNIRNWIRNIEEHASADVEKMILGNKCDVNDKRQVSKERGEKLALDYGIKFMETSAKANINVENAFFTLARDIKAEFAKKAEEMEQPEKKVMPNSPQNGVLVKETAIETKVTVFEEEILAATRGMNGDS

SEQ ID NO: 885038 - protein, 215 aa, Homo sapiens
MAKTYDYLFKLLLIGDSGVGKTCVLFRFSEDAFNSTFISTIGIDFKIRTIELDGKRIKLQIWDTAGQERFRTITTAYYRGAMGIMLVYDITNEKSFDNIRNWIRNIEEHASADVEKMILGNKCDVNDKRQVSKERGEKLALDYGIKFMETSAKANINVENAFFTLARDIKAGNSDSEEDDANGRVELILEPKDLYIDRPLPYLIGSKLFMEQEDV

SEQ ID NO: 885039 - protein, 522 aa, Homo sapiens
MRLRVRLLKRTWPLEVPETEPTLGHLRSHLRQSLLCTWGYSSNTRFTITLNYKDPLTGDEETLASYGIVSGDLICLILQDDIPAPNIPSSTDSEHSSLQNNEQPSLATSSNQTSMQDEQPSDSFQGQAAQSGVWNDDSMLGPSQNFEAESIQDNAHMAEGTGFYPSEPMLCSESVEGQVPHSLETLYQSADCSDANDALIVLIHLLMLESGYIPQGTEAKALSMPEKWKLSGVYKLQYMHPLCEGSSATLTCVPLGNLIVVNATLKINNEIRSVKRLQLLPESFICKEKLGENVANIYKDLQKLSRLFKDQLVYPLLAFTRQALNLPDVFGLVVLPLELKLRIFRLLDVRSVLSLSAVCRDLFTASNDPLLWRFLYLRDFRDNTVRVQDTDWKELYRKRHIQRKESPKGRFVMLLPSSTHTIPFYPNPLHPRPFPSSRLPPGIIGGEYDQRPTLPYVGDPISSLIPGPGETPSQFPPLRPRFDPVGPLPGPNPILPGRGGPNDRFPFRPSRGRPTDGRLSFM

SEQ ID NO: 885040 - protein, 135 aa, Homo sapiens
ILNDFTKGDLALKAKIRPEPKGRFVMLLPSSTHTIPFYPNPLHPRPFPSSRLPPGIIGGEYDQRPTLPYVGDPISSLIPGPGETPSQFPPLRPRFDPVGPLPGPNPILPGRGGPNDRFPFRPSRGRPTDGRLSFM

SEQ ID NO: 885041 - protein, 155 aa, Homo sapiens
MQDEQPSDSFQGQAAQSGVWNDDSMLGPSQNFEAESIQDNAHMAEGTGFYPSEPMLCSESVEGQVPHSLETLYQSADCSDANDALIVLIHLLMLESGYIPQGTEAKALSMPEKWKLSGVYKLQYMHPLCEGSSATLTCVPLGNLIVVNGCLHGDH

SEQ ID NO: 885042 - protein, 290 aa, Homo sapiens
GDRPSAGTPGGPSREARALPGVAEPEGAGDGKRGWSAGVRLLENMARPPGGSGPLLDSEHSSLQNNEQPSLATSSNQTSMQDEQPSDSFQGQAAQSGVWNDDSMLGPSQNFEAESIQDNAHMAEGTGFYPSEPMLCSESVEGQVPHSLETLYQSADCSDANDALIVLIHLLMLESGYIPQGTEAKALSMPEKWKLSGVYKLQYMHPLCEGSSATLTCVPLGNLIVVNATLKINNEIRSVKRLQLLPESFICKEKLGENVANIYKDLQKLSRLFKDQLVYPLLAFTRQALN

SEQ ID NO: 885043 - protein, 408 aa, Homo sapiens
MQDEQPSDSFQGQAAQSGVWNDDSMLGPSQNFEAESIQDNAHMAEGTGFYPSEPMLCSESVEGQVPHSLETLYQSADCSDANDALIVLIHLLMLESGYIPQGTEAKALSMPEKWKLSGVYKLQYMHPLCEGSSATLTCVPLGNLIVVNATLKINNEIRSVKRLQLLPESFICKEKLGENVANIYKDLQKLSRLFKDQLVYPLLAFTRQALNLPDVFGLVVLPLELKLRIFRLLDVRSVLSLSAVCRDLFTASNDPLLWRFLYLRDFRDNTVRVQDTDWKELYRKRHIQRKESPKGRFVMLLPSSTHTIPFYPNPLHPRPFPSSRLPPGIIGGEYDQRPTLPYVGDPISSLIPGPGETPSQFPPLRPRFDPVGPLPGPNPILPGRGGPNDRFPFRPSRGRPTDGRLSFM

SEQ ID NO: 885044 - protein, 494 aa, Homo sapiens
MDGTGCSRRNGKSSNTRFTITLNYKDPLTGDEETLASYGIVSGDLICLILQDDIPAPNIPSSTDSEHSSLQNNEQPSLATSSNQTSMQDEQPSDSFQGQAAQSGVWNDDSMLGPSQNFEAESIQDNAHMAEGTGFYPSEPMLCSESVEGQVPHSLETLYQSADCSDANDALIVLIHLLMLESGYIPQGTEAKALSMPEKWKLSGVYKLQYMHPLCEGSSATLTCVPLGNLIVVNATLKINNEIRSVKRLQLLPESFICKEKLGENVANIYKDLQKLSRLFKDQLVYPLLAFTRQALNLPDVFGLVVLPLELKLRIFRLLDVRSVLSLSAVCRDLFTASNDPLLWRFLYLRDFRDNTVRVQDTDWKELYRKRHIQRKESPKGRFVMLLPSSTHTIPFYPNPLHPRPFPSSRLPPGIIGGEYDQRPTLPYVGDPISSLIPGPGETPSQFPPLRPRFDPVGPLPGPNPILPGRGGPNDRFPFRPSRGRPTDGRLSFM

SEQ ID NO: 885045 - protein, 486 aa, Homo sapiens
MTTVCSNTRFTITLNYKDPLTGDEETLASYGIVSGDLICLILQDDIPAPNIPSSTDSEHSSLQNNEQPSLATSSNQTSMQDEQPSDSFQGQAAQSGVWNDDSMLGPSQNFEAESIQDNAHMAEGTGFYPSEPMLCSESVEGQVPHSLETLYQSADCSDANDALIVLIHLLMLESGYIPQGTEAKALSMPEKWKLSGVYKLQYMHPLCEGSSATLTCVPLGNLIVVNATLKINNEIRSVKRLQLLPESFICKEKLGENVANIYKDLQKLSRLFKDQLVYPLLAFTRQALNLPDVFGLVVLPLELKLRIFRLLDVRSVLSLSAVCRDLFTASNDPLLWRFLYLRDFRDNTVRVQDTDWKELYRKRHIQRKESPKGRFVMLLPSSTHTIPFYPNPLHPRPFPSSRLPPGIIGGEYDQRPTLPYVGDPISSLIPGPGETPSQFPPLRPRFDPVGPLPGPNPILPGRGGPNDRFPFRPSRGRPTDGRLSFM

SEQ ID NO: 885046 - protein, 408 aa, Homo sapiens; identical to SEQ ID NO: 885043

SEQ ID NO: 885047 - protein, 418 aa, Homo sapiens
MRLRVRLLKRTWPLEVPETEPTLGHLRSHLRQSLLCTWGYSSNTRFTITLNYKDPLTGDEETLASYGIVSGDLICLILQDDIPAPNIPSSTDSEHSSLQNNEQPSLATSSNQTSMQDEQPSDSFQGQAAQSGVWNDDSMLGPSQNFEAESIQDNAHMAEGTGFYPSEPMLCSESVEGQVPHSLETLYQSADCSDANDALIVLIHLLMLESGYIPQGTEAKALSMPEKWKLSGVYKLQYMHPLCEGSSATLTCVPLGNLIVVNATLKINNEIRSVKRLQLLPESFICKEKLGENVANIYKDLQKLSRLFKDQLVYPLLAFTRQALNLPDVFGLVVLPLELKLRIFRLLDVRSVLSLSAVCRDLFTASNDPLLWRFLYLRDFRAVQEEAHTKKRIPERAVCDAPAIVNSHHSILSQPLAP

SEQ ID NO: 885048 - protein, 408 aa, Homo sapiens; identical to SEQ ID NO: 885043

SEQ ID NO: 885049 - protein, 487 aa, Homo sapiens
GDRPSAGTPGGPSREARALPGVAEPEGAGDGKRGWSAGVRLLENMARPPGGSGPLLDSEHSSLQNNEQPSLATSSNQTSMQDEQPSDSFQGQAAQSGVWNDDSMLGPSQNFEAESIQDNAHMAEGTGFYPSEPMLCSESVEGQVPHSLETLYQSADCSDANDALIVLIHLLMLESGYIPQGTEAKALSMPEKWKLSGVYKLQYMHPLCEGSSATLTCVPLGNLIVVNATLKINNEIRSVKRLQLLPESFICKEKLGENVANIYKDLQKLSRLFKDQLVYPLLAFTRQALNLPDVFGLVVLPLELKLRIFRLLDVRSVLSLSAVCRDLFTASNDPLLWRFLYLRDFRDNTVRVQDTDWKELYRKRHIQRKESPKGRFVMLLPSSTHTIPFYPNPLHPRPFPSSRLPPGIIGGEYDQRPTLPYVGDPISSLIPGPGETPSQFPPLRPRFDPVGPLPGPNPILPGRGGPNDRFPFRPSRGRPTDGRLSFM

SEQ ID NO: 885050 - protein, 394 aa, Homo sapiens
QVTPRINANNLLGPSQNFEAESIQDNAHMAEGTGFYPSEPMLCSESVEGQVPHSLETLYQSADCSDANDALIVLIHLLMLESGYIPQGTEAKALSMPEKWKLSGVYKLQYMHPLCEGSSATLTCVPLGNLIVVNATLKINNEIRSVKRLQLLPESFICKEKLGENVANIYKDLQKLSRLFKDQLVYPLLAFTRQALNLPDVFGLVVLPLELKLRIFRLLDVRSVLSLSAVCRDLFTASNDPLLWRFLYLRDFRDNTVRVQDTDWKELYRKRHIQRKESPKGRFVMLLPSSTHTIPFYPNPLHPRPFPSSRLPPGIIGGEYDQRPTLPYVGDPISSLIPGPGETPSQFPPLRPRFDPVGPLPGPNPILPGRGGPNDRFPFRPSRGRPTDGRLSFM

SEQ ID NO: 885051 - protein, 440 aa, Homo sapiens
RAIGQVRGRRGGLHGRPGLFRASRSRRVQATGSAGGRLGSGSWRTWPGLPGALVPSSLGPSQNFEAESIQDNAHMAEGTGFYPSEPMLCSESVEGQVPHSLETLYQSADCSDANDALIVLIHLLMLESGYIPQGTEAKALSMPEKWKLSGVYKLQYMHPLCEGSSATLTCVPLGNLIVVNATLKINNEIRSVKRLQLLPESFICKEKLGENVANIYKDLQKLSRLFKDQLVYPLLAFTRQALNLPDVFGLVVLPLELKLRIFRLLDVRSVLSLSAVCRDLFTASNDPLLWRFLYLRDFRDNTVRVQDTDWKELYRKRHIQRKESPKGRFVMLLPSSTHTIPFYPNPLHPRPFPSSRLPPGIIGGEYDQRPTLPYVGDPISSLIPGPGETPSQFPPLRPRFDPVGPLPGPNPILPGRGGPNDRFPFRPSRGRPTDGRLSFM

SEQ ID NO: 885052 - protein, 366 aa, Homo sapiens
MAEGTGFYPSEPMLCSESVEGQVPHSLETLYQSADCSDANDALIVLIHLLMLESGYIPQGTEAKALSMPEKWKLSGVYKLQYMHPLCEGSSATLTCVPLGNLIVVNATLKINNEIRSVKRLQLLPESFICKEKLGENVANIYKDLQKLSRLFKDQLVYPLLAFTRQALNLPDVFGLVVLPLELKLRIFRLLDVRSVLSLSAVCRDLFTASNDPLLWRFLYLRDFRDNTVRVQDTDWKELYRKRHIQRKESPKGRFVMLLPSSTHTIPFYPNPLHPRPFPSSRLPPGIIGGEYDQRPTLPYVGDPISSLIPGPGETPSQFPPLRPRFDPVGPLPGPNPILPGRGGPNDRFPFRPSRGRPTDGRLSFM

SEQ ID NO: 885053 - protein, 384 aa, Homo sapiens [sequence omitted]

SEQ ID NO: 885054 - protein, 522 aa, Homo sapiens; identical to SEQ ID NO: 885039

SEQ ID NO: 885055 - protein, 316 aa, Homo sapiens [sequence omitted]

SEQ ID NO: 885056 - protein, 343 aa, Homo sapiens
ITFSRLVFLSTLLKTQSRSHGLLPHLLMLESGYIPQGTEAKALSMPEKWKLSGVYKLQYMHPLCEGSSATLTCVPLGNLIVVNATLKINNEIRSVKRLQLLPESFICKEKLGENVANIYKDLQKLSRLFKDQLVYPLLAFTRQALNLPDVFGLVVLPLELKLRIFRLLDVRSVLSLSAVCRDLFTASNDPLLWRFLYLRDFRDNTVRVQDTDWKELYRKRHIQRKESPKGRFVMLLPSSTHTIPFYPNPLHPRPFPSSRLPPGIIGGEYDQRPTLPYVGDPISSLIPGPGETPSQFPPLRPRFDPVGPLPGPNPILPGRGGPNDRFPFRPSRGRPTDGRLSFM

SEQ ID NO: 885057 - protein, 285 aa, Homo sapiens
MSSIFILWVWKRDDAVKTSKIILMNTTLKINNEIRSVKRLQLLPESFICKEKLGENVANIYKDLQKLSRLFKDQLVYPLLAFTRQALNLPDVFGLVVLPLELKLRIFRLLDVRSVLSLSAVCRDLFTASNDPLLWRFLYLRDFRDNTVRVQDTDWKELYRKRHIQRKESPKGRFVMLLPSSTHTIPFYPNPLHPRPFPSSRLPPGIIGGEYDQRPTLPYVGDPISSLIPGPGETPSQFPPLRPRFDPVGPLPGPNPILPGRGGPNDRFPFRPSRGRPTDGRLSFM

SEQ ID NO: 885058 - protein, 483 aa, Homo sapiens
MRLRVRLLKRTWPLEVPETEPTLGHLRSHLRQSLLCTWGYSSNTRFTITLNYKDPLTGDEETLASYGIVSGDLICLILQDDIPAPNIPSSTDSEHSSLQNNEQPSLATSSNQTSMQDEQPSDSFQGQAAQSGVWNDDSMLGPSQNFEAESIQDNAHMAEGTGFYPSEPMLCSESVEGQVPHSLETLYQSADCSDANDALIVLIHLLMLESGYIPQGTEAKALSMPEKWKLSGVYKLQYMHPLCEGSSATLTCVPLGNLIVVNATLKINNEIRSVKRLQLLPESFICKEKLGENVANIYKDLQKLSRLFKDQLVYPLLAFTRQALNLPDVFGLVVLPLELKLRIFRLLDVRSVLSLSAVCRDLFTASNDPLLWRFLYLRDFRDNTVRVQDTDWKELYRKRHIQRKESPKGRFVMLLPSSTHTIPFYPNPLHPRPFPSSRLPPGIIGGEYDQRPNPILPGRGGPNDRFPFRPSRGRPTDGRLSFM

SEQ ID NO: 885059 - protein, 519 aa, Homo sapiens
MRLRVRLLKRTWPLEVPETEPTLGHLRSHLRQSLLCTWGYSSNTRFTITLNYKDPLTGDEETLASYGIVSGDLICLILQDDIPAPNIPSSTDSEHSSLQNNEQPSLATSSNQTSMQDEQPSDSFQGQAAQSGVWNDDSMLGPSQNFEAESIQDNAHMAEGTGFYPSEPMLCSESVEGQVPHSLETLYQSADCSDANDALIVLIHLLMLESGYIPQGTEAKALSMPEKWKLSGVYKLQYMHPLCEGSSATLTCVPLGNLIVVNATLKINNEIRSVKRLQLLPESFICKEKLGENVANIYKDLQKLSRLFKDQLVYPLLAFTRQALNLPDVFGLVVLPLELKLRIFRLLDVRSVLSLSAVCRDLFTASNDPLLWRFLYLRDFRDNTVRVQDTDWKELYRKRHIQRKESPKGRFVMLLPSSTHTIPFYPNPLHPRPFPSSRLPPGIIGGEYDQRPTLPYVGDPISSLIPGPGETPSQFPPLRPRFDPVGPLPGPNPILPGRLAANYSQGQPCHRGTFGSYHP

SEQ ID NO: 885060 - protein, 414 aa, Homo sapiens
MRLRVRLLKRTWPLEVPETEPTLGHLRSHLRQSLLCTWGYSSNTRFTITLNYKDPLTGDEETLASYGIVSGDLICLILQDDIPAPNIPSSTDSEHSSLQNNEQPSLATSSNQTSMQDEQPSDSFQGQAAQSGVWNDDSMLGPSQNFEAESIQDNAHMAEGTGFYPSEPMLCSESVEGQVPHSLETLYQSADCSDANDALIVLIHLLMLESGYIPQGTEAKALSMPEKWKLSGVYKLQYMHPLCEGSSATLTCVPLGNLIVVNATLKINNEIRSVKRLQLLPESFICKEKLGENVANIYKDLQKLSRLFKDQLVYPLLAFTRQALNLPDVFGLVVLPLELKLRIFRLLDVRSVLSLSAVCRDLFTASNDPLLWRFLYLRDFRGDFRNDIFTRKGSYCLDYSAHQKFLVVGFFCCK

SEQ ID NO: 885061 - protein, 242 aa, Homo sapiens
MRLRVRLLKRTWPLEVPETEPTLGHLRSHLRQSLLCTWGYSSNTRFTITLNYKDPLTGDEETLASYGIVSGDLICLILQDDIPAPNIPSSTDSEHSSLQNNEQPSLATSSNQTSMQDEQPSDSFQGQAAQSGVWNDDSMLGPSQNFEAESIQDNAHMAEGTGFYPSEPMLCSESVEGQVPHSLETLYQSADCSDANDALIVLIHLLMLESGYIPQVSTASKTQTSYDCSYMWMVPALKLPVV

SEQ ID NO: 885062 - protein, 316 aa, Homo sapiens
GDRPSAGTPGGPSREARALPGVAEPEGAGDGKRGWSAGVRLLENMARPPGGSGPLLATLKINNEIRSVKRLQLLPESFICKEKLGENVANIYKDLQKLSRLFKDQLVYPLLAFTRQALNLPDVFGLVVLPLELKLRIFRLLDVRSVLSLSAVCRDLFTASNDPLLWRFLYLRDFRDNTVRVQDTDWKELYRKRHIQRKESPKGRFVMLLPSSTHTIPFYPNPLHPRPFPSSRLPPGIIGGEYDQRPTLPYVGDPISSLIPGPGETPSQFPPLRPRFDPVGPLPGPNPILPGRGGPNDRFPFRPSRGRPTDGRLSFM

SEQ ID NO: 885063 - protein, 361 aa, Homo sapiens
MRLRVRLLKRTWPLEVPETEPTLGHLRSHLRQSLLCTWGYSSNTRFTITLNYKDPLTGDEETLASYGIVSGDLICLILQDDIPAPNIPSSTDSEHSSLQNNEQPSLATSSNQTSMQDEQPSDSFQGQAAQSGVWNDDSMLGPSQNFEAESIQDNAHMAEGTGFYPSEPMLCSESGGKMHIIKLFIKDVMHDAEGVTLQVSGNTKGTNKLRRRTSAETQHPRTHHVTFQCSNTRLYRKRHIQRKESPKGRFVMLLPSSTHTIPFYPNPLHPRPFPSSRLPPGIIGGEYDQRPTLPYVGDPISSLIPGPGETPSQFPPLRPRFDPVGPLPGPNPILPGRGGPNDRFPFRPSRGRPTDGRLSFM

SEQ ID NO: 885064 - protein, 149 aa, Homo sapiens
PRVRGRRGSTHASVQDTDWKELYRKRHIQRKESPKGRFVMLLPSSTHTIPFYPNPLHPRPFPSSRLPPGIIGGEYDQRPTLPYVGDPISSLIPGPGETPSQFPPLRPRFDPVGPLPGPNPILPGRGGPNDRFPFRPSRGRPTDGRLSFM

SEQ ID NO: 885065 - protein, 332 aa, Homo sapiens
MRLRVRLLKRTWPLEVPETEPTLGHLRSHLRQSLLCTWGYSSNTRFTITLNYKDPLTGDEETLASYGIVSGDLICLILQDDIPAPNIPSSTDSEHSSLQNNEQPSLATSSNQTSMQDEQPSDSFQGQAAQSGVWNDDSMLGPSQNFEAESIQDNAHMAEGTGFYPSEPMLCSESVEGQVPHSLETLYQSADCSDANDALIVLIHLLMLESGYIPQGTEAKALSMPEKWKLSGVYKLQYMHPLCEGSSATLTCVPLGNLIVVNATLKINNEIRSVKRLQLLPESFICKEKLGENVANIYKDLQKLSRLFKDQLVYPLLAFTRQDTEPTRMYIG

SEQ ID NO: 885066 - protein, 272 aa, Homo sapiens [sequence omitted]

SEQ ID NO: 885067 - protein, 263 aa, Homo sapiens [sequence omitted]

SEQ ID NO: 885068 - protein, 307 aa, Homo sapiens
MRPGLFKGQAPGSRRRPTAGLAVVRADSHKKEPRASGSARPAMLLWPLRGWAARALRCFGPGSRGSPASGPGPRRVQRRAWPPDKEQEKEKKSVICVEGNIASGKTTCLEFFSNATDVEVLTEPVSKWRNVRGHNPLGLMYHDASRWGLTLQTYVQLTMLDRHTRPQVSSVRLMERSIHSARYIFVENLYRSGKMPEVDYVVLSEWFDWILRNMDVSVDLIVYLRTNPETCYQRLKKRCREEEKVIPLEYLEAIHHLHEEWLIKGSLFPMAAPVLVIEADHHMERMLELFEQNRDRILTPENRKHCP

SEQ ID NO: 885069 - protein, 307 aa, Homo sapiens; identical to SEQ ID NO: 885068

SEQ ID NO: 885070 - protein, 307 aa, Homo sapiens; identical to SEQ ID NO: 885068

SEQ ID NO: 885071 - protein, 307 aa, Homo sapiens; identical to SEQ ID NO: 885068

SEQ ID NO: 885072 - protein, 307 aa, Homo sapiens; identical to SEQ ID NO: 885068

SEQ ID NO: 885073 - protein, 232 aa, Homo sapiens
VQRYAWPPDKEQEKEKKSVICVEGNIASGKTTCLEFFSNATDVEVLTEPVSKWRNVRGHNPLGLMYHDASRWGLTLQTYVQLTMLDRHTRPQVSSVRLMERSIHSARYIFVENLYRSGKMPEVDYVVLSEWFDWILRNMDVSVDLIVYLRTNPETCYQRLKKRCREEEKVIPLEYLEAIHHLHEEWLIKGSLFPMAAPVLVIEADHHMERMLELFEQNRDRILTPENRKHCP

SEQ ID NO: 885074 - protein, 307 aa, Homo sapiens; identical to SEQ ID NO: 885068

SEQ ID NO: 885075 - protein, 243 aa, Homo sapiens
MTSFSLPSGDCQHHSPPGRDKEQEKEKKSVICVEGNIASGKTTCLEFFSNATDVEVLTEPVSKWRNVRGHNPLGLMYHDASRWGLTLQTYVQLTMLDRHTRPQVSSVRLMERSIHSARYIFVENLYRSGKMPEVDYVVLSEWFDWILRNMDVSVDLIVYLRTNPETCYQRLKKRCREEEKVIPLEYLEAIHHLHEEWLIKGSLFPMAAPVLVIEADHHMERMLELFEQNRDRILTPENRKHCP

SEQ ID NO: 885076 - protein, 307 aa, Homo sapiens; identical to SEQ ID NO: 885068

SEQ ID NO: 885077 - protein, 307 aa, Homo sapiens; identical to SEQ ID NO: 885068

SEQ ID NO: 885078 - protein, 307 aa, Homo sapiens; identical to SEQ ID NO: 885068

SEQ ID NO: 885079 - protein, 2180 aa, Homo sapiens
MNANAAAGLAPEHIPTPGAALSWQAAIDAARQAKLMGSAGNATISTVSSTQRKRQQYGKPKKQGSTTATRPPRALLCLTLKNPIRRACISIVEWKPFEIIILLTIFANCVALAIYIPFPEDDSNATNSNLERVEYLFLIIFTVEAFLKVIAYGLLFHPNAYLRNGWNLLDFIIVVVGLFSAILEQATKADGANALGGKGAGFDVKALRAFRVLRPLRLVSGVPSLQVVLNSIIKAMVPLLHIALLVLFVIIIYAIIGLELFMGKMHKTCYNQEGIADVPAEDDPSPCALETGHGRQCQNGTVCKPGWDGPKHGITNFDNFAFAMLTVFQCITMEGWTDVLYWMQDAMGYELPWVYFVSLVIFGSFFVLNLVLGVLSGEFSKEREKAKARGDFQKLREKQQLEEDLKGYLDWITQAEDIDPENEDEGMDEEKPRNMSMPTSETESVNTENVAGGDIEGENCGARLAHRISKSKFSRYWRRWNRFCRRKCRAAVKSNVFYWLVIFLVFLNTLTIASEHYNQPNWLTEVQDTANKALLALFTAEMLLKMYSLGLQAYFVSLFNRFDCFVVCGGILETILVETKIMSPLGISVLRCVRLLRIFKITRYWNSLSNLVASLLNSVRSIASLLLLLFLFIIIFSLLGMQLFGGKFNFDEMQTRRSTFDNFPQSLLTVFQILTGEDWNSVMYDGIMAYGGPSFPGMLVCIYFIILFICGNYILLNVFLAIAVDNLADAESLTSAQKEEEEEKERKKLARTASPEKKQELVEKPAVGESKEEKIELKSITADGESPPATKINMDDLQPNENEDKSPYPNPETTGEEDEEEPEMPVGPRPRPLSELHLKEKAVPMPEASAFFIFSSNNRFRLQCHRIVNDTIFTNLILFFILLSSISLAAEDPVQHTSFRNHILFYFDIVFTTIFTIEIALKMTAYGAFLHKGSFCRNYFNILDLLVVSVSLISFGIQSSAINVVKILRVLRVLRPLRAINRAKGLKHVVQCVFVAIRTIGNIVIVTTLLQFMFACIGVQLFKGKLYTCSDSSKQTEAECKGNYITYKDGEVDHPIIQPRSWENSKFDFDNVLAAMMALFTVSTFEGWPELLYRSIDSHTEDKGPIYNYRVEISIFFIIYIIIIAFFMMNIFVGFVIVTFQEQGEQEYKNCELDKNQRQCVEYALKARPLRRYIPKNQHQYKVWYVVNSTYFEYLMFVLILLNTICLAMQHYGQSCLFKIAMNILNMLFTGLFTVEMILKLIAFKPKGYFSDPWNVFDFLIVIGSIIDVILSETNPAEHTQCSPSMNAEENSRISITFFRLFRVMRLVKLLSRGEGIRTLLWTFIKSFQALPYVALLIVMLFFIYAVIGMQVFGKIALNDTTEINRNNNFQTFPQAVLLLFRCATGEAWQDIMLACMPGKKCAPESEPSNSTEGETPCGSSFAVFYFISFYMLCAFLIINLFVAVIMDNFDYLTRDWSILGPHHLDEFKRIWAEYDPEAKGRIKHLDVVTLLRRIQPPLGFGKLCPHRVACKRLVSMNMPLNSDGTVMFNATLFALVRTALRIKTEGNLEQANEELRAIIKKIWKRTSMKLLDQVVPPAGDDEVTVGKFYATFLIQEYFRKFKKRKEQGLVGKPSQRNALSLQAGLRTLHDIGPEIRRAISGDLTAEEELDKAMKEAVSAASEDDIFRRAGGLFGNHVSYYQSDGRSAFPQTFTTQRPLHINKAGSSQGDTESPSHEKLVDSTFTPSSYSSTGSNANINNANNTALGRLPRPAGYPSTVSTVEGHGPPLSPAIRVQEVAWKLSSNRMHCCDMLDGGTFPPALGPRRAPPCLHQQLQGSLAGLREDTPCIVPGHASLCCSSRVGEWLPAGCTAPQHARCHSRESQAAMAGQEETSQDETYEVKMNHDTEACSEPSLLSTEMLSYQDDENRQLTLPEEDKRDIRQSPKRGFLRSASLGRRASFHLECLKRQKDRGGDISQKTVLPLHLVHHQALAVAGLSPLLQRSHSPASFPRPFATPPATPGSRGWPPQPVPTLRLEGVESSEKLNSSFPSIHCGSWAETTPGGGGSSAARRVRPVSLMVPSQAGAPGRQFHGSASSLVEAVLISEGLGQFAQDPKFIEVTTQELADACDMTIEEMESAADNILSGGAPQSPNGALLPFVNCRDAGQDRAGGEEDAGCVRARGAPSEEELQDSRVYVSSL

SEQ ID NO: 885080 - protein, 2138 aa, Homo sapiens [sequence omitted]

SEQ ID NO: 885081 - protein, 2157 aa, Homo sapiens
MVNENTRMYIPEENHQGSNYGSPRPAHANMNANAAAGLAPEHIPTPGAALSWQAAIDAARQAKLMGSAGNATISTVSSTQRKRQQYGKPKKQGSTTATRPPRALLCLTLKNPIRRACISIVEWKPFEIIILLTIFANCVALAIYIPFPEDDSNATNSNLERVEYLFLIIFTVEAFLKVIAYGLLFHPNAYLRNGWNLLDFIIVVVGLFSAILEQATKADGANALGGKGAGFDVKALRAFRVLRPLRLVSGVPSLQVVLNSIIKAMVPLLHIALLVLFVIIIYAIIGLELFMGKMHKTCYNQEGIADVPAEDDPSPCALETGHGRQCQNGTVCKPGWDGPKHGITNFDNFAFAMLTVFQCITMEGWTDVLYWVNDAVGRDWPWIYFVTLIIIGSFFVLNLVLGVLSGEFSKEREKAKARGDFQKLREKQQLEEDLKGYLDWITQAEDIDPENEDEGMDEEKPRNMSMPTSETESVNTENVAGGDIEGENCGARLAHRISKSKFSRYWRRWNRFCRRKCRAAVKSNVFYWLVIFLVFLNTLTIASEHYNQPNWLTEVQDTANKALLALFTAEMLLKMYSLGLQAYFVSLFNRFDCFVVCGGILETILVETKIMSPLGISVLRCVRLLRIFKITRYWNSLSNLVASLLNSVRSIASLLLLLFLFIIIFSLLGMQLFGGKFNFDEMQTRRSTFDNFPQSLLTVFQILTGEDWNSVMYDGIMAYGGPSFPGMLVCIYFIILFICGNYILLNVFLAIAVDNLADAESLTSAQKEEEEEKERKKLARTASPEKKQELVEKPAVGESKEEKIELKSITADGESPPATKINMDDLQPNENEDKSPYPNPETTGEEDEEEPEMPVGPRPRPLSELHLKEKAVPMPEASAFFIFSSNNRFRLQCHRIVNDTIFTNLILFFILLSSISLAAEDPVQHTSFRNHILGNADYVFTSIFTLEIILKMTAYGAFLHKGSFCRNYFNILDLLVVSVSLISFGIQSSAINVVKILRVLRVLRPLRAINRAKGLKHVVQCVFVAIRTIGNIVIVTTLLQFMFACIGVQLFKGKLYTCSDSSKQTEAECKGNYITYKDGEVDHPIIQPRSWENSKFDFDNVLAAMMALFTVSTFEGWPELLYRSIDSHTEDKGPIYNYRVEISIFFIIYIIIIAFFMMNIFVGFVIVTFQEQGEQEYKNCELDKNQRQCVEYALKARPLRRYIPKNQHQYKVWYVVNSTYFEYLMFVLILLNTICLAMQHYGQSCLFKIAMNILNMLFTGLFTVEMILKLIAFKPKHYFCDAWNTFDALIVVGSIVDIAITEVNPAEHTQCSPSMNAEENSRISITFFRLFRVMRLVKLLSRGEGIRTLLWTFIKSFQALPYVALLIVMLFFIYAVIGMQVFGKIALNDTTEINRNNNFQTFPQAVLLLFRCATGEAWQDIMLACMPGKKCAPESEPSNSTEGETPCGSSFAVFYFISFYMLCAFLIINLFVAVIMDNFDYLTRDWSILGPHHLDEFKRIWAEYDPEAKGRIKHLDVVTLLRRIQPPLGFGKLCPHRVACKRLVSMNMPLNSDGTVMFNATLFALVRTALRIKTEEGPSPSEAHQGAEDPFRPAGNLEQANEELRAIIKKIWKRTSMKLLDQVVPPAGDDEVTVGKFYATFLIQEYFRKFKKRKEQGLVGKPSQRNALSLQAGLRTLHDIGPEIRRAISGDLTAEEELDKAMKEAVSAASEDDIFRRAGGLFGNHVSYYQSDGRSAFPQTFTTQRPLHINKAGSSQGDTESPSHEKLVDSTFTPSSYSSTGSNANINNANNTALGRLPRPAGYPSTVSTVEGHGPPLSPAIRVQEVAWKLSSNRCHSRESQAAMAGQEETSQDETYEVKMNHDTEACSEPSLLSTEMLSYQDDENRQLTLPEEDKRDIRQSPKRGFLRSASLGRRASFHLECLKRQKDRGGDISQKTVLPLHLVHHQALAVAGLSPLLQRSHSPASFPRPFATPPATPGSRGWPPQPVPTLRLEGVESSEKLNSSFPSIHCGSWAETTPGGGGSSAARRVRPVSLMVPSQAGAPGRQFHGSASSLVEAVLISEGLGQFAQDPKFIEVTTQELADACDMTIEEMESAADNILSGGAPQSPNGALLPFVNCRDAGQDRAGGEEDAGCVRARGAPSEEELQDSRVYVSSL

SEQ ID NO: 885082 - protein, 2146 aa, Homo sapiens
MVNENTRMYIPEENHQGSNYGSPRPAHANMNANAAAGLAPEHIPTPGAALSWQAAIDAARQAKLMGSAGNATISTVSSTQRKRQQYGKPKKQGSTTATRPPRALLCLTLKNPIRRACISIVEWKPFEIIILLTIFANCVALAIYIPFPEDDSNATNSNLERVEYLFLIIFTVEAFLKVIAYGLLFHPNAYLRNGWNLLDFIIVVVGLFSAILEQATKADGANALGGKGAGFDVKALRAFRVLRPLRLVSGVPSLQVVLNSIIKAMVPLLHIALLVLFVIIIYAIIGLELFMGKMHKTCYNQEGIADVPAEDDPSPCALETGHGRQCQNGTVCKPGWDGPKHGITNFDNFAFAMLTVFQCITMEGWTDVLYWVNDAVGRDWPWIYFVTLIIIGSFFVLNLVLGVLSGEFSKEREKAKARGDFQKLREKQQLEEDLKGYLDWITQAEDIDPENEDEGMDEEKPRNMSMPTSETESVNTENVAGGDIEGENCGARLAHRISKSKFSRYWRRWNRFCRRKCRAAVKSNVFYWLVIFLVFLNTLTIASEHYNQPNWLTEVQDTANKALLALFTAEMLLKMYSLGLQAYFVSLFNRFDCFVVCGGILETILVETKIMSPLGISVLRCVRLLRIFKITRYWNSLSNLVASLLNSVRSIASLLLLLFLFIIIFSLLGMQLFGGKFNFDEMQTRRSTFDNFPQSLLTVFQILTGEDWNSVMYDGIMAYGGPSFPGMLVCIYFIILFICGNYILLNVFLAIAVDNLADAESLTSAQKEEEEEKERKKLARTASPEKKQELVEKPAVGESKEEKIELKSITADGESPPATKINMDDLQPNENEDKSPYPNPETTGEEDEEEPEMPVGPRPRPLSELHLKEKAVPMPEASAFFIFSSNNRFRLQCHRIVNDTIFTNLILFFILLSSISLAAEDPVQHTSFRNHILGNADYVFTSIFTLEIILKMTAYGAFLHKGSFCRNYFNILDLLVVSVSLISFGIQSSAINVVKILRVLRVLRPLRAINRAKGLKHVVQCVFVAIRTIGNIVIVTTLLQFMFACIGVQLFKGKLYTCSDSSKQTEAECKGNYITYKDGEVDHPIIQPRSWENSKFDFDNVLAAMMALFTVSTFEGWPELLYRSIDSHTEDKGPIYNYRVEISIFFIIYIIIIAFFMMNIFVGFVIVTFQEQGEQEYKNCELDKNQRQCVEYALKARPLRRYIPKNQHQYKVWYVVNSTYFEYLMFVLILLNTICLAMQHYGQSCLFKIAMNILNMLFTGLFTVEMILKLIAFKPKHYFCDAWNTFDALIVVGSIVDIAITEVNNAEENSRISITFFRLFRVMRLVKLLSRGEGIRTLLWTFIKSFQALPYVALLIVMLFFIYAVIGMQVFGKIALNDTTEINRNNNFQTFPQAVLLLFRCATGEAWQDIMLACMPGKKCAPESEPSNSTEGETPCGSSFAVFYFISFYMLCAFLIINLFVAVIMDNFDYLTRDWSILGPHHLDEFKRIWAEYDPEAKGRIKHLDVVTLLRRIQPPLGFGKLCPHRVACKRLVSMNMPLNSDGTVMFNATLFALVRTALRIKTEEGPSPSEAHQGAEDPFRPAGNLEQANEELRAIIKKIWKRTSMKLLDQVVPPAGDDEVTVGKFYATFLIQEYFRKFKKRKEQGLVGKPSQRNALSLQAGLRTLHDIGPEIRRAISGDLTAEEELDKAMKEAVSAASEDDIFRRAGGLFGNHVSYYQSDGRSAFPQTFTTQRPLHINKAGSSQGDTESPSHEKLVDSTFTPSSYSSTGSNANINNANNTALGRLPRPAGYPSTVSTVEGHGPPLSPAIRVQEVAWKLSSNRCHSRESQAAMAGQEETSQDETYEVKMNHDTEACSEPSLLSTEMLSYQDDENRQLTLPEEDKRDIRQSPKRGFLRSASLGRRASFHLECLKRQKDRGGDISQKTVLPLHLVHHQALAVAGLSPLLQRSHSPASFPRPFATPPATPGSRGWPPQPVPTLRLEGVESSEKLNSSFPSIHCGSWAETTPGGGGSSAARRVRPVSLMVPSQAGAPGRQFHGSASSLVEAVLISEGLGQFAQDPKFIEVTTQELADACDMTIEEMESAADNILSGGAPQSPNGALLPFVNCRDAGQDRAGGEEDAGCVRARGAPSEEELQDSRVYVSSL

SEQ ID NO: 885083 - protein, 2186 aa, Homo sapiens [sequence omitted]

SEQ ID NO: 885084 - protein, 2158 aa, Homo sapiens [sequence omitted]

SEQ ID NO: 885085 - protein, 2127 aa, Homo sapiens
MVNENTRMYIPEENHQGSNYGSPRPAHANMNANAAAGLAPEHIPTPGAALSWQAAIDAARQAKLMGSAGNATISTVSSTQRKRQQYGKPKKQGSTTATRPPRALLCLTLKNPIRRACISIVEWKPFEIIILLTIFANCVALAIYIPFPEDDSNATNSNLERVEYLFLIIFTVEAFLKVIAYGLLFHPNAYLRNGWNLLDFIIVVVGLFSAILEQATKADGANALGGKGAGFDVKALRAFRVLRPLRLVSGVPSLQVVLNSIIKAMVPLLHIALLVLFVIIIYAIIGLELFMGKMHKTCYNQEGIADVPAEDDPSPCALETGHGRQCQNGTVCKPGWDGPKHGITNFDNFAFAMLTVFQCITMEGWTDVLYWVNDAVGRDWPWIYFVTLIIIGSFFVLNLVLGVLSGEFSKEREKAKARGDFQKLREKQQLEEDLKGYLDWITQAEDIDPENEDEGMDEEKPRNMSMPTSETESVNTENVAGGDIEGENCGARLAHRISKSKFSRYWRRWNRFCRRKCRAAVKSNVFYWLVIFLVFLNTLTIASEHYNQPNWLTEVQDTANKALLALFTAEMLLKMYSLGLQAYFVSLFNRFDCFVVCGGILETILVETKIMSPLGISVLRCVRLLRIFKITRYWNSLSNLVASLLNSVRSIASLLLLLFLFIIIFSLLGMQLFGGKFNFDEMQTRRSTFDNFPQSLLTVFQILTGEDWNSVMYDGIMAYGGPSFPGMLVCIYFIILFICGNYILLNVFLAIAVDNLADAESLTSAQKEEEEEKERKKLARTASPEKKQELVEKPAVGESKEEKIELKSITADGESPPATKINMDDLQPNENEDKSPYPNPETTGEEDEEEPEMPVGPRPRPLSELHLKEKAVPMPEASAFFIFSSNNRFRLQCHRIVNDTIFTNLILFFILLSSISLAAEDPVQHTSFRNHILGNADYVFTSIFTLEIILKMTAYGAFLHKGSFCRNYFNILDLLVVSVSLISFGIQSSAINVVKILRVLRVLRPLRAINRAKGLKHVVQCVFVAIRTIGNIVIVTTLLQFMFACIGVQLFKGKLYTCSDSSKQTEAECKGNYITYKDGEVDHPIIQPRSWENSKFDFDNVLAAMMALFTVSTFEGWPELLYRSIDSHTEDKGPIYNYRVEISIFFIIYIIIIAFFMMNIFVGFVIVTFQEQGEQEYKNCELDKNQRQCVEYALKARPLRRYIPKNQHQYKVWYVVNSTYFEYLMFVLILLNTICLAMQHYGQSCLFKIAMNILNMLFTGLFTVEMILKLIAFKPKHYFCDAWNTFDALIVVGSIVDIAITEVNNAEENSRISITFFRLFRVMRLVKLLSRGEGIRTLLWTFIKSFQALPYVALLIVMLFFIYAVIGMQVFGKIALNDTTEINRNNNFQTFPQAVLLLFRCATGEAWQDIMLACMPGKKCAPESEPSNSTEGETPCGSSFAVFYFISFYMLCAFLIINLFVAVIMDNFDYLTRDWSILGPHHLDEFKRIWAEYDPEAKGRIKHLDVVTLLRRIQPPLGFGKLCPHRVACKRLVSMNMPLNSDGTVMFNATLFALVRTALRIKTEGNLEQANEELRAIIKKIWKRTSMKLLDQVVPPAGDDEVTVGKFYATFLIQEYFRKFKKRKEQGLVGKPSQRNALSLQAGLRTLHDIGPEIRRAISGDLTAEEELDKAMKEAVSAASEDDIFRRAGGLFGNHVSYYQSDGRSAFPQTFTTQRPLHINKAGSSQGDTESPSHEKLVDSTFTPSSYSSTGSNANINNANNTALGRLPRPAGYPSTVSTVEGHGPPLSPAIRVQEVAWKLSSNRCHSRESQAAMAGQEETSQDETYEVKMNHDTEACSEPSLLSTEMLSYQDDENRQLTLPEEDKRDIRQSPKRGFLRSASLGRRASFHLECLKRQKDRGGDISQKTVLPLHLVHHQALAVAGLSPLLQRSHSPASFPRPFATPPATPGSRGWPPQPVPTLRLEGVESSEKLNSSFPSIHCGSWAETTPGGGGSSAARRVRPVSLMVPSQAGAPGRQFHGSASSLVEAVLISEGLGQFAQDPKFIEVTTQELADACDMTIEEMESAADNILSGGAPQSPNGALLPFVNCRDAGQDRAGGEEDAGCVRARGAPSEEELQDSRVYVSSL

SEQ ID NO: 885086 - protein, 2139 aa, Homo sapiens
MVNENTRMYIPEENHQGSNYGSPRPAHANMNANAAAGLAPEHIPTPGAALSWQAAIDAARQAKLMGSAGNATISTVSSTQRKRQQYGKPKKQGSTTATRPPRALLCLTLKNPIRRACISIVEWKPFEIIILLTIFANCVALAIYIPFPEDDSNATNSNLERVEYLFLIIFTVEAFLKVIAYGLLFHPNAYLRNGWNLLDFIIVVVGLFSAILEQATKADGANALGGKGAGFDVKALRAFRVLRPLRLVSGVPSLQVVLNSIIKAMVPLLHIALLVLFVIIIYAIIGLELFMGKMHKTCYNQEGIADVPAEDDPSPCALETGHGRQCQNGTVCKPGWDGPKHGITNFDNFAFAMLTVFQCITMEGWTDVLYWVNDAVGRDWPWIYFVTLIIIGSFFVLNLVLGVLSGEFSKEREKAKARGDFQKLREKQQLEEDLKGYLDWITQAEDIDPENEDEGMDEEKPRNMSMPTSETESVNTENVAGGDIEGENCGARLAHRISKSKFSRYWRRWNRFCRRKCRAAVKSNVFYWLVIFLVFLNTLTIASEHYNQPNWLTEVQDTANKALLALFTAEMLLKMYSLGLQAYFVSLFNRFDCFVVCGGILETILVETKIMSPLGISVLRCVRLLRIFKITRYWNSLSNLVASLLNSVRSIASLLLLLFLFIIIFSLLGMQLFGGKFNFDEMQTRRSTFDNFPQSLLTVFQILTGEDWNSVMYDGIMAYGGPSFPGMLVCIYFIILFICGNYILLNVFLAIAVDNLADAESLTSAQKEEEEEKERKKLARTASPEKKQELVEKPAVGESKEEKIELKSITADGESPPATKINMDDLQPNENEDKSPYPNPETTGEEDEEEPEMPVGPRPRPLSELHLKEKAVPMPEASAFFIFSSNNRFRLQCHRIVNDTIFTNLILFFILLSSISLAAEDPVQHTSFRNHILGNADYVFTSIFTLEIILKMTAYGAFLHKGSFCRNYFNILDLLVVSVSLISFGIQSSAINVVKILRVLRVLRPLRAINRAKGLKHVVQCVFVAIRTIGNIVIVTTLLQFMFACIGVQLFKGKLYTCSDSSKQTEAECKGNYITYKDGEVDHPIIQPRSWENSKFDFDNVLAAMMALFTVSTFEGWPELLYRSIDSHTEDKGPIYNYRVEISIFFIIYIIIIAFFMMNIFVGFVIVTFQEQGEQEYKNCELDKNQRQCVEYALKARPLRRYIPKNQHQYKVWYVVNSTYFEYLMFVLILLNTICLAMQHYGQSCLFKIAMNILNMLFTGLFTVEMILKLIAFKPKHYFCDAWNTFDALIVVGSIVDIAITEVNPAEHTQCSPSMNAEENSRISITFFRLFRVMRLVKLLSRGEGIRTLLWTFIKSFQALPYVALLIVMLFFIYAVIGMQVFGKIALNDTTEINRNNNFQTFPQAVLLLFRCATGEAWQDIMLACMPGKKCAPESEPSNSTEGETPCGSSFAVFYFISFYMLCAFLIINLFVAVIMDNFDYLTRDWSILGPHHLDEFKRIWAEYDPEAKGRIKHLDVVTLLRRIQPPLGFGKLCPHRVACKRLVSMNMPLNSDGTVMFNATLFALVRTALREAELSSQVQYQAKEASLLERRRKSSHPKSSTKPNKLLSSGGSTGWVEDARALEGQVLARGCGWLGSLEERERGPHHPPLGFQAGLRTLHDIGPEIRRAISGDLTAEEELDKAMKEAVSAASEDDIFRRAGGLFGNHVSYYQSDGRSAFPQTFTTQRPLHINKAGSSQGDTESPSHEKLVDSTFTPSSYSSTGSNANINNANNTALGRLPRPAGYPSTVSTVEGHGPPLSPAIRVQEVAWKLSSNRCHSRESQAAMAGQEETSQDETYEVKMNHDTEACSEPSLLSTEMLSYQDDENRQLTLPEEDKRDIRQSPKRGFLRSASLGRRASFHLECLKRQKDRGGDISQKTVLPLHLVHHQALAVAGLSPLLQRSHSPASFPRPFATPPATPGSRGWPPQPVPTLRLEGVESSEKLNSSFPSIHCGSWAETTPGGGGSSAARRVRPVSLMVPSQAGAPGRQFHGSASSLVEAVLISEGLGQFAQDPKFIEVTTQELADACDMTIEEMESAADNILSGGAPQSPNGALLPFVNCRDAGQDRAGGEEDAGCVRARGAPSEEELQDSRVYVSSL

SEQ ID NO: 885087 - protein, 1043 aa, Homo sapiens
MAYVCKLLMSKTRPLVMIGVAWVMLLYRSIDSHTEDKGPIYNYRVEISIFFIIYIIIIAFFMMNIFVGFVIVTFQEQGEQEYKNCELDKNQRQCVEYALKARPLRRYIPKNQHQYKVWYVVNSTYFEYLMFVLILLNTICLAMQHYGQSCLFKIAMNILNMLFTGLFTVEMILKLIAFKPKGYFSDPWNVFDFLIVIGSIIDVILSETNPAEHTQCSPSMNAEENSRISITFFRLFRVMRLVKLLSRGEGIRTLLWTFIKSFQALPYVALLIVMLFFIYAVIGMQVFGKIALNDTTEINRNNNFQTFPQAVLLLFRCATGEAWQDIMLACMPGKKCAPESEPSNSTEGETPCGSSFAVFYFISFYMLCAFLIINLFVAVIMDNFDYLTRDWSILGPHHLDEFKRIWAEYDPEAKGRIKHLDVVTLLRRIQPPLGFGKLCPHRVACKRLVSMNMPLNSDGTVMFNATLFALVRTALRIKTEGNLEQANEELRAIIKKIWKRTSMKLLDQVVPPAGDDEVTVGKFYATFLIQEYFRKFKKRKEQGLVGKPSQRNALSLQAGLRTLHDIGPEIRRAISGDLTAEEELDKAMKEAVSAASEDDIFRRAGGLFGNHVSYYQSDGRSAFPQTFTTQRPLHINKAGSSQGDTESPSHEKLVDSTFTPSSYSSTGSNANINNANNTALGRLPRPAGYPSTVSTVEGHGPPLSPAIRVQEVAWKLSSNRCHSRESQAAMAGQEETSQDETYEVKMNHDTEACSEPSLLSTEMLSYQDDENRQLTLPEEDKRDIRQSPKRGFLRSASLGRRASFHLECLKRQKDRGGDISQKTVLPLHLVHHQALAVAGLSPLLQRSHSPASFPRPFATPPATPGSRGWPPQPVPTLRLEGVESSEKLNSSFPSIHCGSWAETTPGGGGSSAARRVRPVSLMVPSQAGAPGRQFHGSASSLVEAVLISEGLGQFAQDPKFIEVTTQELADACDMTIEEMESAADNILSGGAPQSPNGALLPFVNCRDAGQDRAGGEEDAGCVRARGAPSEEELQDSRVYVSSL

SEQ ID NO: 885088 - protein, 805 aa, Homo sapiens
MRLVKLLSRGEGIRTLLWTFIKSFQALPYVALLIVMLFFIYAVIGMQVFGKIALNDTTEINRNNNFQTFPQAVLLLFRCATGEAWQDIMLACMPGKKCAPESEPSNSTEGETPCGSSFAVFYFISFYMLCAFLIINLFVAVIMDNFDYLTRDWSILGPHHLDEFKRIWAEYDPEAKGRIKHLDVVTLLRRIQPPLGFGKLCPHRVACKRLVSMNMPLNSDGTVMFNATLFALVRTALRIKTEGNLEQANEELRAIIKKIWKRTSMKLLDQVVPPAGDDEVTVGKFYATFLIQEYFRKFKKRKEQGLVGKPSQRNALSLQAGLRTLHDIGPEIRRAISGDLTAEEELDKAMKEAVSAASEDDIFRRAGGLFGNHVSYYQSDGRSAFPQTFTTQRPLHINKAGSSQGDTESPSHEKLVDSTFTPSSYSSTGSNANINNANNTALGRLPRPAGYPSTVSTVEGHGPPLSPAIRVQEVAWKLSSNRCHSRESQAAMAGQEETSQDETYEVKMNHDTEACSEPSLLSTEMLSYQDDENRQLTLPEEDKRDIRQSPKRGFLRSASLGRRASFHLECLKRQKDRGGDISQKTVLPLHLVHHQALAVAGLSPLLQRSHSPASFPRPFATPPATPGSRGWPPQPVPTLRLEGVESSEKLNSSFPSIHCGSWAETTPGGGGSSAARRVRPVSLMVPSQAGAPGRQFHGSASSLVEAVLISEGLGQFAQDPKFIEVTTQELADACDMTIEEMESAADNILSGGAPQSPNGALLPFVNCRDAGQDRAGGEEDAGCVRARGAPSEEELQDSRVYVSSL

SEQ ID NO: 885089 - protein, 698 aa, Homo sapiens
MVALPIPSLILSLFSLTSFSAHMSPSLLLPSPVFFWPFEDVPAEDDPSPCALETGHGRQCQNGTVCKPGWDGPKHGITNFDNFAFAMLTVFQCITMEGWTDVLYWMQDAMGYELPWVYFVSLVIFGSFFVLNLVLGVLSGEFSKEREKAKARGDFQKLREKQQLEEDLKGYLDWITQAEDIDPENEDEGMDEEKPRNMSMPTSETESVNTENVAGGDIEGENCGARLAHRISKSKFSRYWRRWNRFCRRKCRAAVKSNVFYWLVIFLVFLNTLTIASEHYNQPNWLTEVQDTANKALLALFTAEMLLKMYSLGLQAYFVSLFNRFDCFVVCGGILETILVETKIMSPLGISVLRCVRLLRIFKITRYWNSLSNLVASLLNSVRSIASLLLLLFLFIIIFSLLGMQLFGGKFNFDEMQTRRSTFDNFPQSLLTVFQILTGEDWNSVMYDGIMAYGGPSFPGMLVCIYFIILFICGNYILLNVFLAIAVDNLADAESLTSAQKEEEEEKERKKLARTASPEKKQELVEKPAVGESKEEKIELKSITADGESPPATKINMDDLQPNENEDKSPYPNPETTGEEDEEEPEMPVGPRPRPLSELHLKEKAVPMPEASAFFIFSSNNRFRLQCHRIVNDTIFTNLILFFILLSSISLAAEDPVQHTSFRNHVCIACVFCTPSPWGCARPTASVADIIVQSGAQF

SEQ ID NO: 885090 - protein, 140 aa, Homo sapiens
VRGEKSHGAASWVGGNLNSQPTPPFSPCPLSSRYWRRWNRFCRRKCRAAVKSNVFYWLVIFLVFLNTLTIASEHYNQPNWLTEVQGERRPQLCSGFLLVTQPQGPGEGITTGRRWRGKQPMVGALGRCCAGDTKGLAVPK

SEQ ID NO: 885091 - protein, 2138 aa, Homo sapiens [sequence omitted]

SEQ ID NO: 885092 - protein, 2173 aa, Homo sapiens
MVNENTRMYIPEENHQGSNYGSPRPAHANMNANAAAGLAPEHIPTPGAALSWQAAIDAARQAKLMGSAGNATISTVSSTQRKRQQYGKPKKQGSTTATRPPRALLCLTLKNPIRRACISIVEWKPFEIIILLTIFANCVALAIYIPFPEDDSNATNSNLERVEYLFLIIFTVEAFLKVIAYGLLFHPNAYLRNGWNLLDFIIVVVGLFSAILEQATKADGANALGGKGAGFDVKALRAFRVLRPLRLVSGVPSLQVVLNSIIKAMVPLLHIALLVLFVIIIYAIIGLELFMGKMHKTCYNQEGIADVPAEDDPSPCALETGHGRQCQNGTVCKPGWDGPKHGITNFDNFAFAMLTVFQCITMEGWTDVLYWMQDAMGYELPWVYFVSLVIFGSFFVLNLVLGVLSGEFSKEREKAKARGDFQKLREKQQLEEDLKGYLDWITQAEDIDPENEDEGMDEEKPRNMSMPTSETESVNTENVAGGDIEGENCGARLAHRISKSKFSRYWRRWNRFCRRKCRAAVKSNVFYWLVIFLVFLNTLTIASEHYNQPNWLTEVQDTANKALLALFTAEMLLKMYSLGLQAYFVSLFNRFDCFVVCGGILETILVETKIMSPLGISVLRCVRLLRIFKITRYWNSLSNLVASLLNSVRSIASLLLLLFLFIIIFSLLGMQLFGGKFNFDEMQTRRSTFDNFPQSLLTVFQILTGEDWNSVMYDGIMAYGGPSFPGMLVCIYFIILFICGNYILLNVFLAIAVDNLADAESLTSAQKEEEEEKERKKLARTASPEKKQELVEKPAVGESKEEKIELKSITADGESPPATKINMDDLQPNENEDKSPYPNPETTGEEDEEEPEMPVGPRPRPLSELHLKEKAVPMPEASAFFIFSSNNRFRLQCHRIVNDTIFTNLILFFILLSSISLAAEDPVQHTSFRNHILGNADYVFTSIFTLEIILKMTAYGAFLHKGSFCRNYFNILDLLVVSVSLISFGIQSSAINVVKILRVLRVLRPLRAINRAKGLKHVVQCVFVAIRTIGNIVIVTTLLQFMFACIGVQLFKGKLYTCSDSSKQTEAECKGNYITYKDGEVDHPIIQPRSWENSKFDFDNVLAAMMALFTVSTFEGWPELLYRSIDSHTEDKGPIYNYRVEISIFFIIYIIIIAFFMMNIFVGFVIVTFQEQGEQEYKNCELDKNQRQCVEYALKARPLRRYIPKNQHQYKVWYVVNSTYFEYLMFVLILLNTICLAMQHYGQSCLFKIAMNILNMLFTGLFTVEMILKLIAFKPKGYFSDPWNVFDFLIVIGSIIDVILSETNPAEHTQCSPSMNAEENSRISITFFRLFRVMRLVKLLSRGEGIRTLLWTFIKSFQALPYVALLIVMLFFIYAVIGMQVFGKIALNDTTEINRNNNFQTFPQAVLLLFRCATGEAWQDIMLACMPGKKCAPESEPSNSTEGETPCGSSFAVFYFISFYMLCAFLIINLFVAVIMDNFDYLTRDWSILGPHHLDEFKRIWAEYDPEAKGRIKHLDVVTLLRRIQPPLGFGKLCPHRVACKRLVSMNMPLNSDGTVMFNATLFALVRTALRIKTEGNLEQANEELRAIIKKIWKRTSMKLLDQVVPPAGDDEVTVGKFYATFLIQEYFRKFKKRKEQGLVGKPSQRNALSLQAGLRTLHDIGPEIRRAISGDLTAEEELDKAMKEAVSAASEDDIFRRAGGLFGNHVSYYQSDGRSAFPQTFTTQRPLHINKAGSSQGDTESPSHEKLVDSTFTPSSYSSTGSNANINNANNTALGRLPRPAGYPSTVSTVEGHGPPLSPAIRVQEVAWKLSSNRERHVPVCEDLELRRDSGSAGTQAHCLLLRRANPSRCHSRESQAAMAGQEETSQDETYEVKMNHDTEACSEPSLLSTEMLSYQDDENRQLTLPEEDKRDIRQSPKRGFLRSASLGRRASFHLECLKRQKDRGGDISQKTVLPLHLVHHQALAVAGLSPLLQRSHSPASFPRPFATPPATPGSRGWPPQPVPTLRLEGVESSEKLNSSFPSIHCGSWAETTPGGGGSSAARRVRPVSLMVPSQAGAPGRQFHGSASSLVEAVLISEGLGQFAQDPKFIEVTTQELADACDMTIEEMESAADNILSGGAPQSPNGALLPFVNCRDAGQDRAGGEEDAGCVRARGAPSEEELQDSRVYVSSL

SEQ ID NO: 885093 - protein, 2166 aa, Homo sapiens [sequence omitted]

SEQ ID NO: 885094 - protein, 2155 aa, Homo sapiens [sequence omitted]

SEQ ID NO: 885095 - protein, 2169 aa, Homo sapiens
MNANAAAGLAPEHIPTPGAALSWQAAIDAARQAKLMGSAGNATISTVSSTQRKRQQYGKPKKQGSTTATRPPRALLCLTLKNPIRRACISIVEWKPFEIIILLTIFANCVALAIYIPFPEDDSNATNSNLERVEYLFLIIFTVEAFLKVIAYGLLFHPNAYLRNGWNLLDFIIVVVGLFSAILEQATKADGANALGGKGAGFDVKALRAFRVLRPLRLVSGVPSLQVVLNSIIKAMVPLLHIALLVLFVIIIYAIIGLELFMGKMHKTCYNQEGIADVPAEDDPSPCALETGHGRQCQNGTVCKPGWDGPKHGITNFDNFAFAMLTVFQCITMEGWTDVLYWMQDAMGYELPWVYFVSLVIFGSFFVLNLVLGVLSGEFSKEREKAKARGDFQKLREKQQLEEDLKGYLDWITQAEDIDPENEDEGMDEEKPRNMSMPTSETESVNTENVAGGDIEGENCGARLAHRISKSKFSRYWRRWNRFCRRKCRAAVKSNVFYWLVIFLVFLNTLTIASEHYNQPNWLTEVQDTANKALLALFTAEMLLKMYSLGLQAYFVSLFNRFDCFVVCGGILETILVETKIMSPLGISVLRCVRLLRIFKITRYWNSLSNLVASLLNSVRSIASLLLLLFLFIIIFSLLGMQLFGGKFNFDEMQTRRSTFDNFPQSLLTVFQILTGEDWNSVMYDGIMAYGGPSFPGMLVCIYFIILFICGNYILLNVFLAIAVDNLADAESLTSAQKEEEEEKERKKLARTASPEKKQELVEKPAVGESKEEKIELKSITADGESPPATKINMDDLQPNENEDKSPYPNPETTGEEDEEEPEMPVGPRPRPLSELHLKEKAVPMPEASAFFIFSSNNRFRLQCHRIVNDTIFTNLILFFILLSSISLAAEDPVQHTSFRNHILFYFDIVFTTIFTIEIALKMTAYGAFLHKGSFCRNYFNILDLLVVSVSLISFGIQSSAINVVKILRVLRVLRPLRAINRAKGLKHVVQCVFVAIRTIGNIVIVTTLLQFMFACIGVQLFKGKLYTCSDSSKQTEAECKGNYITYKDGEVDHPIIQPRSWENSKFDFDNVLAAMMALFTVSTFEGWPELLYRSIDSHTEDKGPIYNYRVEISIFFIIYIIIIAFFMMNIFVGFVIVTFQEQGEQEYKNCELDKNQRQCVEYALKARPLRRYIPKNQHQYKVWYVVNSTYFEYLMFVLILLNTICLAMQHYGQSCLFKIAMNILNMLFTGLFTVEMILKLIAFKPKHYFCDAWNTFDALIVVGSIVDIAITEVNNAEENSRISITFFRLFRVMRLVKLLSRGEGIRTLLWTFIKSFQALPYVALLIVMLFFIYAVIGMQVFGKIALNDTTEINRNNNFQTFPQAVLLLFRCATGEAWQDIMLACMPGKKCAPESEPSNSTEGETPCGSSFAVFYFISFYMLCAFLIINLFVAVIMDNFDYLTRDWSILGPHHLDEFKRIWAEYDPEAKGRIKHLDVVTLLRRIQPPLGFGKLCPHRVACKRLVSMNMPLNSDGTVMFNATLFALVRTALRIKTEGNLEQANEELRAIIKKIWKRTSMKLLDQVVPPAGDDEVTVGKFYATFLIQEYFRKFKKRKEQGLVGKPSQRNALSLQAGLRTLHDIGPEIRRAISGDLTAEEELDKAMKEAVSAASEDDIFRRAGGLFGNHVSYYQSDGRSAFPQTFTTQRPLHINKAGSSQGDTESPSHEKLVDSTFTPSSYSSTGSNANINNANNTALGRLPRPAGYPSTVSTVEGHGPPLSPAIRVQEVAWKLSSNRMHCCDMLDGGTFPPALGPRRAPPCLHQQLQGSLAGLREDTPCIVPGHASLCCSSRVGEWLPAGCTAPQHARCHSRESQAAMAGQEETSQDETYEVKMNHDTEACSEPSLLSTEMLSYQDDENRQLTLPEEDKRDIRQSPKRGFLRSASLGRRASFHLECLKRQKDRGGDISQKTVLPLHLVHHQALAVAGLSPLLQRSHSPASFPRPFATPPATPGSRGWPPQPVPTLRLEGVESSEKLNSSFPSIHCGSWAETTPGGGGSSAARRVRPVSLMVPSQAGAPGRQFHGSASSLVEAVLISEGLGQFAQDPKFIEVTTQELADACDMTIEEMESAADNILSGGAPQSPNGALLPFVNCRDAGQDRAGGEEDAGCVRARGAPSEEELQDSRVYVSSL

SEQ ID NO: 885096 - protein, 1872 aa, Homo sapiens
MVALPIPSLILSLFSLTSFSAHMSPSLLLPSPVFFWPFEDVPAEDDPSPCALETGHGRQCQNGTVCKPGWDGPKHGITNFDNFAFAMLTVFQCITMEGWTDVLYWMQDAMGYELPWVYFVSLVIFGSFFVLNLVLGVLSGEFSKEREKAKARGDFQKLREKQQLEEDLKGYLDWITQAEDIDPENEDEGMDEEKPRNMSMPTSETESVNTENVAGGDIEGENCGARLAHRISKSKFSRYWRRWNRFCRRKCRAAVKSNVFYWLVIFLVFLNTLTIASEHYNQPNWLTEVQDTANKALLALFTAEMLLKMYSLGLQAYFVSLFNRFDCFVVCGGILETILVETKIMSPLGISVLRCVRLLRIFKITRYWNSLSNLVASLLNSVRSIASLLLLLFLFIIIFSLLGMQLFGGKFNFDEMQTRRSTFDNFPQSLLTVFQILTGEDWNSVMYDGIMAYGGPSFPGMLVCIYFIILFICGNYILLNVFLAIAVDNLADAESLTSAQKEEEEEKERKKLARTASPEKKQELVEKPAVGESKEEKIELKSITADGESPPATKINMDDLQPNENEDKSPYPNPETTGEEDEEEPEMPVGPRPRPLSELHLKEKAVPMPEASAFFIFSSNNRFRLQCHRIVNDTIFTNLILFFILLSSISLAAEDPVQHTSFRNHILFYFDIVFTTIFTIEIALKMTAYGAFLHKGSFCRNYFNILDLLVVSVSLISFGIQSSAINVVKILRVLRVLRPLRAINRAKGLKHVVQCVFVAIRTIGNIVIVTTLLQFMFACIGVQLFKGKLYTCSDSSKQTEAECKGNYITYKDGEVDHPIIQPRSWENSKFDFDNVLAAMMALFTVSTFEGWPELLYRSIDSHTEDKGPIYNYRVEISIFFIIYIIIIAFFMMNIFVGFVIVTFQEQGEQEYKNCELDKNQRQCVEYALKARPLRRYIPKNQHQYKVWYVVNSTYFEYLMFVLILLNTICLAMQHYGQSCLFKIAMNILNMLFTGLFTVEMILKLIAFKPKGYFSDPWNVFDFLIVIGSIIDVILSETNPAEHTQCSPSMNAEENSRISITFFRLFRVMRLVKLLSRGEGIRTLLWTFIKSFQALPYVALLIVMLFFIYAVIGMQVFGKIALNDTTEINRNNNFQTFPQAVLLLFRCATGEAWQDIMLACMPGKKCAPESEPSNSTEGETPCGSSFAVFYFISFYMLCAFLIINLFVAVIMDNFDYLTRDWSILGPHHLDEFKRIWAEYDPEAKGRIKHLDVVTLLRRIQPPLGFGKLCPHRVACKRLVSMNMPLNSDGTVMFNATLFALVRTALRIKTEGNLEQANEELRAIIKKIWKRTSMKLLDQVVPPAGDDEVTVGKFYATFLIQEYFRKFKKRKEQGLVGKPSQRNALSLQAGLRTLHDIGPEIRRAISGDLTAEEELDKAMKEAVSAASEDDIFRRAGGLFGNHVSYYQSDGRSAFPQTFTTQRPLHINKAGSSQGDTESPSHEKLVDSTFTPSSYSSTGSNANINNANNTALGRLPRPAGYPSTVSTVEGHGPPLSPAIRVQEVAWKLSSNRCHSRESQAAMAGQEETSQDETYEVKMNHDTEACSEPSLLSTEMLSYQDDENRQLTLPEEDKRDIRQSPKRGFLRSASLGRRASFHLECLKRQKDRGGDISQKTVLPLHLVHHQALAVAGLSPLLQRSHSPASFPRPFATPPATPGSRGWPPQPVPTLRLEGVESSEKLNSSFPSIHCGSWAETTPGGGGSSAARRVRPVSLMVPSQAGAPGRQFHGSASSLVEAVLISEGLGQFAQDPKFIEVTTQELADACDMTIEEMESAADNILSGGAPQSPNGALLPFVNCRDAGQDRAGGEEDAGCVRARGAPSEEELQDSRVYVSSL

SEQ ID NO: 885097 - protein, 1795 aa, Homo sapiens
MVALPIPSLILSLFSLTSFSAHMSPSLLLPSPVFFWPFEDVPAEDDPSPCALETGHGRQCQNGTVCKPGWDGPKHGITNFDNFAFAMLTVFQCITMEGWTDVLYWMQDAMGYELPWVYFVSLVIFGSFFVLNLVLGVLSGEFSKEREKAKARGDFQKLREKQQLEEDLKGYLDWITQAEDIDPENEDEGMDEEKPRNMSMPTSETESVNTENVAGGDIEGENCGARLAHRISKSKFSRYWRRWNRFCRRKCRAAVKSNVFYWLVIFLVFLNTLTIASEHYNQPNWLTEVQDTANKALLALFTAEMLLKMYSLGLQAYFVSLFNRFDCFVVCGGILETILVETKIMSPLGISVLRCVRLLRIFKITRYWNSLSNLVASLLNSVRSIASLLLLLFLFIIIFSLLGMQLFGGKFNFDEMQTRRSTFDNFPQSLLTVFQILTGEDWNSVMYDGIMAYGGPSFPGMLVCIYFIILFICGNYILLNVFLAIAVDNLADAESLTSAQKEEEEEKERKKLARTASPEKKQELVEKPAVGESKEEKIELKSITADGESPPATKINMDDLQPNENEDKSPYPNPETTGEEDEEEPEMPVGPRPRPLSELHLKEKAVPMPEASAFFIFSSNNRFRLQCHRIVNDTIFTNLILFFILLSSISLAAEDPVQHTSFRNHILFYFDIVFTTIFTIEIALKMTAYGAFLHKGSFCRNYFNILDLLVVSVSLISFGIQSSAINVVKILRVLRVLRPLRAINRAKGLKHVVQCVFVAIRTIGNIVIVTTLLQFMFACIGVQLFKGKLYTCSDSSKQTEAECKGNYITYKDGEVDHPIIQPRSWENSKFDFDNVLAAMMALFTVSTFEGWPELLYRSIDSHTEDKGPIYNYRVEISIFFIIYIIIIAFFMMNIFVGFVIVTFQEQGEQEYKNCELDKNQRQCVEYALKARPLRRYIPKNQHQYKVWYVVNSTYFEYLMFVLILLNTICLAMQHYGQSCLFKIAMNILNMLFTGLFTVEMILKLIAFKPKGYFSDPWNVFDFLIVIGSIIDVILSETNPAEHTQCSPSMNAEENSRISITFFRLFRVMRLVKLLSRGEGIRTLLWTFIKSFQALPYVALLIVMLFFIYAVIGMQVFGKIALNDTTEINRNNNFQTFPQAVLLLFRCATGEAWQDIMLACMPGKKCAPESEPSNSTEGETPCGSSFAVFYFISFYMLCAFLIINLFVAVIMDNFDYLTRDWSILGPHHLDEFKRIWAEYDPEAKGRIKHLDVVTLLRRIQPPLGFGKLCPHRVACKRLVSMNMPLNSDGTVMFNATLFALVRTALRIKTEGNLEQANEELRAIIKKIWKRTSMKLLDQVVPPAGDDEVTVGKFYATFLIQEYFRKFKKRKEQGLVGKPSQRNALSLQAGLRTLHDIGPEIRRAISGDLTAEEELDKAMKEAVSAASEDDIFRRAGGLFGNHVSYYQSDGRSAFPQTFTTQRPLHINKAGSSQGDTESPSHEKLVDSTFTPSSYSSTGSNANINNANNTALGRLPRPAGYPSTVSTVEGHGPPLSPAIRVQEVAWKLSSNRCHSRESQAAMAGQEETSQDETYEVKMNHDTEACSEPSLLSTEMLSYQDDENRQLTLPEEDKRDIRQSPKRGFLRSASLGRRASFHLECLKRQKDRGGDISQKTVLPLHLVHHQALAVAGLSPLLQRSHSPASFPRPFATPPATPGSRGWPPQPVPTLRLEGVESSEKLNSSFPSIHCGSWAETTPGGGGSSAARRVRPVSLMVPSQAGAPGRQFHGSASSLVEAVGDSQMGRGERPRATRGLGMRG

SEQ ID NO: 885098 - protein, 109 aa, Homo sapiens
MVALPIPSLILSLFSLTSFSAHMSPSLLLPSPVFFWPFEMFQQKMTLPLVRWKRATGGSARTARCASPAGMVPSTASPTLTTLPSPCSRCSSASPWRAGRTCCTGSMMP

SEQ ID NO: 885099 - protein, 66 aa, Homo sapiens
NGIRRPRRRRRRGSEWSLGTRRTGVPVGPSVASRMEPGVGVMMQSSMLDPRGLPHDLSGRYGIFQG

SEQ ID NO: 885100 - protein, 259 aa, Homo sapiens
EPAGPSLNPTLAATAALIPLHRRAGDIRPGPLPGGSDAPSQLPVQETRPRLCAGQLKGTTTPRRIEGDRWGRGGAQPCEALTQRWGGGRPKGGRWSGRASGDGMGPGLRLVTGGGCRRGPREGGAGARREATPTAAPGGARPAAAGRGGAAAAAAPGHHRSLRGDVTAAGPPAPGAGWWRERLSQTWSAPPAGCLRQRRLSKGCWRWSCGALTIPEQNTLTSLPPQGRWLDSEQLPSVKGPVFTGSGWYLALSLEWQLC

SEQ ID NO: 885101 - protein, 215 aa, Homo sapiens
EPAGPSLNPTLAATAALIPLHRRAGDIAQARFREEVTLPASFRSRRLGPASAPGSLKGPRPPGGLKETGGGCRRGPREGGAGARREATPTAAPGGARPAAAGRGGAAAAAAPGHHRSLRGDVTAAGPPAPGAGWWRERLSQTWSAPPAGCLRQRRLSKGCWRWSCGALTIPEQNTLTSLPPQGRWLDSEQLPSVKGPVFTGSGWYLALSLEWQLC

SEQ ID NO: 885102 - protein, 262 aa, Homo sapiens
EPAGPSLNPTLAATAALIPLHRRAGDIRPGPLPGGSDAPSQLPVQETRPRLCAGQLKGTTTPRRIEGDRWGRGGAQPCEALTQRWGGGRPKGGRWSGRASGDGMGPGLRLVTGVRGGPSGREEGAWPRASAGPDRLSLALSRAGRLPAWTAGRRGWGSAGGHPHSRPGRSAPSSCWTRWSSGSGSSWTPSQPARRCYGSWAAGARSRLVAGTSQPNLERPPSRLSPPEAAFQRMLAMELRSPDHPRAEYPDFSPSPGPVAGL

SEQ ID NO: 885103 - protein, 262 aa, Homo sapiens; identical to SEQ ID NO: 885102

SEQ ID NO: 885104 - protein, 366 aa, Homo sapiens
EPAGPSLNPTLAATAALIPLHRRAGDIRPGPLPGGSDAPSQLPVQETRPRLCAGQLKGTTTPRRIEGDRWGRGGAQPCEALTQRWGGGRPKGGRWSGRASGDGMGPGLRLVTGGGCRRGPREGGAGARREATPTAAPGGARPAAAGRGGAAAAAAPGHHRSLRGDVTAAGPPAPGAGWWRERLSQTWSAPPAGCLRQRRLSKGCWRWSCGALTIPEQNTLTSLPPQGQLKQNHEIQAPNSEKISQCNMIANRRIIRGHISLGGEAGDKQWQARGNSTPLSYQEQKKAGARTEERSIQKKTQGQITADIGAGPAVARQEVGLRPGYGGGSRVGWLHRSIFHGIWGGHKCPHKNTFQKKPLIKNRKPG

SEQ ID NO: 885105 - protein, 215 aa, Homo sapiens; identical to SEQ ID NO: 885101

SEQ ID NO: 885106 - protein, 262 aa, Homo sapiens; identical to SEQ ID NO: 885102

SEQ ID NO: 885107 - protein, 259 aa, Homo sapiens; identical to SEQ ID NO: 885100

SEQ ID NO: 885108 - protein, 162 aa, Homo sapiens; identical to SEQ ID NO: 871967

SEQ ID NO: 885109 - protein, 227 aa, Homo sapiens
AWSGPAFPVRSARPAQAASPPSPGPGPLAPVPAPRGLGARAAPPRPGLGPPGPQCESACSLCPRVMTTPNKGNKALKVKREPGENGTSLTDEELVTMSVRELNQHLRGLSKEEIVQLKQRRRTLKNRGYAASCRVKRVTQKEELEKQKAELQQEVEKLASENASMKLELDALRSKYEALQTFARTVARSPVAPARGPLAAGLGPLVPGKVAATSVITIVKSKTDARS

SEQ ID NO: 885110 - protein, 227 aa, Homo sapiens; identical to SEQ ID NO: 885109

SEQ ID NO: 885111 - protein, 132 aa, Homo sapiens
MAAMVAASLFQAFCSEWAERDATENRSELYFQRRKLWRVLTTLHELTRQRPLLRVRHVGVRLDSLLEALGAMSSVPFYGHPIPLPSQGKGLFATQLIRKGETIFVERPLVAAQFLWNALYRYRGEYISPTPH

SEQ ID NO: 885112 - protein, 334 aa, Homo sapiens
MAASMCDVFSFCVGVAGRARVSVEVRFVSSAKGKGLFATQLIRKGETIFVERPLVAAQFLWNALYRYRACDHCLRALEKAEENAQRLTGKPGQVLPHPELCTVRKDLHQNCPHCQVMYCSAECRLAATEQYHQVLCPGPSQDDPLHPLNKLQEAWRSIHYPPETASIMLMARMVATVKQAKDKDRWIRLFSQFCNKTANEEEEIVHKLLGDKFKGQLELLRRLFTEALYEEAVSQWFTPDGFRSLFALVGTNGQGIGTSSLSQWVHACDTLELKPQDREQLDAFIDQLYKDIEAGNLYQLLGLLSAGAQPPQPPQDPQGELSICLFLSQMPGRG

SEQ ID NO: 885113 - protein, 473 aa, Homo sapiens
MAAMVAASLFQAFCSEWAERDATENRSELYFQRRKLWRVLTTLHELTRQRPLLRVRHVGVRLDSLLEALGAMSSVPFYGHPIPLPSQGKGLFATQLIRKGETIFVERPLVAAQFLWNALYRYRACDHCLRALEKAEENAQRLTGKPGQVLPHPELCTVRKDLHQNCPHCQVMYCSAECRLAATEQYHQVLCPGPSQDDPLHPLNKLQEAWRSIHYPPETASIMLMARMVATVKQAKDKDRWIRLFSQFCNKTANEEEEIVHKLLGDKFKGQLELLRRLFTEALYEEAVSQWFTPDGFRSLFALVGTNGQGIGTSSLSQWVHACDTLELKPQDREQLDAFIDQLYKDIEAATGEFLNCEGSGLFVLQSCCNHSCVPNAETSFPENNFLLHVTALEDIKPGEEICISYLDCCQRERSRHSRHKILRENYLFVCSCPKCLAEADEPNVTSEEEEEEEEEEEGEPEDAELGDEMTDV

SEQ ID NO: 885114 - protein, 366 aa, Homo sapiens
MWPLLSRYCCVWLSPSACDHCLRALEKAEENAQRLTGKPGQVLPHPELCTVRKDLHQNCPHCQVMYCSAECRLAATEQYHQVLCPGPSQDDPLHPLNKLQEAWRSIHYPPETASIMLMARMVATVKQAKDKDRWIRLFSQFCNKTANEEEEIVHKLLGDKFKGQLELLRRLFTEALYEEAVSQWFTPDGFRSLFALVGTNGQGIGTSSLSQWVHACDTLELKPQDREQLDAFIDQLYKDIEAATGEFLNCEGSGLFVLQSCCNHSCVPNAETSFPENNFLLHVTALEDIKPGEEICISYLDCCQRERSRHSRHKILRENYLFVCSCPKCLAEADEPNVTSEEEEEEEEEEEGEPEDAELGDEMTDV

SEQ ID NO: 885115 - protein, 234 aa, Homo sapiens
MVILLSTMRNLSRTLVYVLGREPLPKLCLWDYGEYGGPLESPGLYSLQLAGVSHRMDVRSRLALAESNGQGIGTSSLSQWVHACDTLELKPQDREQLDAFIDQLYKDIEAATGEFLNCEGSGLFVLQSCCNHSCVPNAETSFPENNFLLHVTALEDIKPGEEICISYLDCCQRERSRHSRHKILRENYLFVCSCPKCLAEADEPNVTSEEEEEEEEEEEGEPEDAELGDEMTDV

SEQ ID NO: 885116 - protein, 266 aa, Homo sapiens
MAASMCDVFSFCVGVAGRARVSVEVRFVSSAKGKGLFATQLIRKGETIFVERPLVAAQFLWNALYRYRACDHCLRALEKAEENAQRLTGKPGQVLPHPELCTVRKDLHQNCPHCQVMYCSAECRLAATEQYHQVLCPGPSQDDPLHPLNKLQEAWRSIHYPPETASIMLMARMVATVKQAKDKDRWIRLFSQFCNKTANEEEEIVHKLLGDKFKGQLELLRRLFTEALYEEAVSQWFTPDGFRSLFALVGTNGQGIGTRSRMFQSY

SEQ ID NO: 885117 - protein, 229 aa, Homo sapiens
MAEDSQDEQQPEQDRPSLDSHCDCPQNLAAAQDPFTEALYEEAVSQWFTPDGFRSLFALVGTNGQGIGTSSLSQWVHACDTLELKPQDREQLDAFIDQLYKDIEAATGEFLNCEGSGLFVLQSCCNHSCVPNAETSFPENNFLLHVTALEDIKPGEEICISYLDCCQRERSRHSRHKILRENYLFVCSCPKCLAEADEPNVTSEEEEEEEEEEEGEPEDAELGDEMTDV

SEQ ID NO: 885118 - protein, 418 aa, Homo sapiens
MAASMCDVFSFCVGVAGRARVSVEVRFVSSAKGKGLFATQLIRKGETIFVERPLVAAQFLWNALYRYRACDHCLRALEKAEENAQRLTGKPGQVLPHPELCTVRKDLHQNCPHCQVMYCSAECRLAATEQYHQVLCPGPSQDDPLHPLNKLQEAWRSIHYPPETASIMLMARMVATVKQAKDKDRWIRLFSQFCNKTANEEEEIVHKLLGDKFKGQLELLRRLFTEALYEEAVSQWFTPDGFRSLFALVGTNGQGIGTSSLSQWVHACDTLELKPQDREQLDAFIDQLYKDIEAATGEFLNCEGSGLFVLQSCCNHSCVPNAETSFPENNFLLHVTALEDIKPGEEICISYLDCCQRERSRHSRHKILRENYLFVCSCPKCLAEADEPNVTSEEEEEEEEEEEGEPEDAELGDEMTDV

SEQ ID NO: 885119 - protein, 366 aa, Homo sapiens; identical to SEQ ID NO: 885114

SEQ ID NO: 885120 - protein, 142 aa, Homo sapiens
FLTVKDLASLTSYTRTSRPTGEFLNCEGSGLFVLQSCCNHSCVPNAETSFPENNFLLHVTALEDIKPGEEICISYLDCCQRERSRHSRHKILRENYLFVCSCPKCLAEADEPNVTSEEEEEEEEEEEGEPEDAELGDEMTDV

SEQ ID NO: 885121 - protein, 334 aa, Homo sapiens; identical to SEQ ID NO: 885112

SEQ ID NO: 885122 - protein, 693 aa, Homo sapiens
MIAPLLCILSYNFNTFAILNVYSKLTMFCTTNSLPMDLLLKQGSLKQEVESFCYQIVSESNDQKVGILQSEDKQLQPSVSKKSEGELSRVKFISNSNKITFSKKPKRRKYDESYLSFGFTYFGNRDAPHAQCVLCKKILSNSSLAPSKLRRHLETKHAAYKDKDISFFKQHLDSPENNKPPTPKIVNTDNESATEASYNVSYHIALSGEAHTIGELLIKPCAKDVVMRMFDEQYSKKIDAVQLSNSTVARRIKDLAADIEEELVCRLKICDGFSLQLDESADVSGLAVLLVFVRYRFNKSIEEDLLLCESLQSNATGEEIFNCINSFMQKHEIEWEKCVDVCSDASRAVDGKIAEAVTLIKYVAPESTSSHCLLYRHALAVKIMPTSLKNVLDQAVQIINYIKARPHQSRLLKILCEEMGAQHTALLLNTEVRWLSRGKVLVRLFELRRELLVFMDSAFRLSDCLTNSSWLLRLAYLADIFTKLNEVNLSMQGKNVTVFTVFDKMSSLLRKLEFWASSVEEENFDCFPTLSDFLTEINSTVDKDICSAIVQHLRGLRATLLKYFPVTNDNNAWVRNPFTVTVKPASLVARDYESLIDLTSDSQVKQNFSELSLNDFWSSLIQEYPSIARRAVRVLLPFATMHLCETGFSYYAATKTKYRKRLDAAPHMRIRLSNITPNIKRICDKKTQKHCSH

SEQ ID NO: 885123 - protein, 693 aa, Homo sapiens; identical to SEQ ID NO: 885122

SEQ ID NO: 885124 - protein, 693 aa, Homo sapiens; identical to SEQ ID NO: 885122

SEQ ID NO: 885125 - protein, 693 aa, Homo sapiens
MIAPLLCILSYNFNTFAILNVYSKLTMFCTTNSLPMDLLLKQGSLKQEVESFCYQIVSESNDQKVGILQSEDKQLQPSVSKKSEGELSRVKFISNSNKITFSKKPKRRKYDESYLSFGFTYFGNRDAPHAQCVLCKKILSNSSLAPSKLRRHLETKHAAYKDKDISFFKQHLDSPENNKPPTPKIVNTDNESATEASYNVSYHIALSGEAHTIGELLIKPCAKDVVMRMFDEQYSKKIVGGGVGGWGREGVGGGGAADIEEELVCRLKICDGFSLQLDESADVSGLAVLLVFVRYRFNKSIEEDLLLCESLQSNATGEEIFNCINSFMQKHEIEWEKCVDVCSDASRAVDGKIAEAVTLIKYVAPESTSSHCLLYRHALAVKIMPTSLKNVLDQAVQIINYIKARPHQSRLLKILCEEMGAQHTALLLNTEVRWLSRGKVLVRLFELRRELLVFMDSAFRLSDCLTNSSWLLRLAYLADIFTKLNEVNLSMQGKNVTVFTVFDKMSSLLRKLEFWASSVEEENFDCFPTLSDFLTEINSTVDKDICSAIVQHLRGLRATLLKYFPVTNDNNAWVRNPFTVTVKPASLVARDYESLIDLTSDSQVKQNFSELSLNDFWSSLIQEYPSIARRAVRVLLPFATMHLCETGFSYYAATKTKYRKRLDAAPHMRIRLSNITPNIKRICDKKTQKHCSH

SEQ ID NO: 885126 - protein, 693 aa, Homo sapiens; identical to SEQ ID NO: 885122

SEQ ID NO: 885127 - protein, 693 aa, Homo sapiens; identical to SEQ ID NO: 885122

SEQ ID NO: 885128 - protein, 693 aa, Homo sapiens; identical to SEQ ID NO: 885122

SEQ ID NO: 885129 - protein, 354 aa, Homo sapiens
TLAAEAEADGVSPKQRLGHELTRDSGGGGPFGHLLAECSLLTGTDFNIMAGRHQNRSFPLPGVQSSGQVHAFGNCSDSDILEEDAEVYELRSRGKEKVRRSTSRDRLDDIIVLTKDIQEGDTLNAIALQYCCTVADIKRVNNLISDQDFFALRSIKIPVKKFSSLTETLCPPKGRQTSRHSSVQYSSEQQEILPANDSLAYSDSAGSFLKEVDRDIEQIVKCTDNKRENLNEVVSALTAQQMRFEPDNKNTQRKDPYYGADWGIGWWTAVVIMLIVGIITPVFYLLYYEILAKVDVSHHSTVDSSHLHSKITPPSQQREMENGIVPTKGIHFSQQDDHKLYSQDSQSPAAQQET

SEQ ID NO: 885130 - protein, 354 aa, Homo sapiens; identical to SEQ ID NO: 885129

SEQ ID NO: 885131 - protein, 175 aa, Homo sapiens
TLAAEAEADGVSPKQRLGHELTRDSGGGGPFGHLLAECSLLTGTDFNIMAGRHQNRSFPLPGVQSSGQVHAFGNCSDSDILEEDAEVYELRSRGKEKVRRSTSRDRLDDIIVLTKDIQEGDTLNAIALQYCCTVYQNSSKKVQFLDRNTLSSKRKTDFTSFICSILFRTTGNFAS

SEQ ID NO: 885132 - protein, 502 aa, Homo sapiens
MAWALKLPLADEVIESGLVQDFDASLSGIGQELGAGAYSMSDVLALPIFKQEESSLPPDNENKILPFQYVLCAATSPAVKLHDETLTYLNQGQSYEIRMLDNRKLGELPEINGKLVKSIFRVVFHDRRLQYTEHQQLEGWRWNRPGDRILDIDIPMSVGIIDPRANPTQLNTVEFLWDPAKRTSVFIQVHCISTEFTMRKHGGEKGVPFRVQIDTFKENENGEYTEHLHSASCQIKVFKPKGADRKQKTDREKMEKRTPHEKEKYQPSYETTILTECSPWPEITYVNNSPSPGFNSSHSSFSLGEGNGSPNHQPEPPPPVTDNLLPTTTPQEAQQWLHRNRFSTFTRLFTNFSGADLLKLTRDDVIQICGPADGIRLFNALKGRMVRPRLTIYVCQESLQLREQQQQQQQQQQKHEDGDSNGTFFVYHAIYLEELTAVELTEKIAQLFSISPCQISQIYKQGPTGIHVLISDEMIQNFQEEACFILDTMKAETNDSYHIILK

SEQ ID NO: 885133 - protein, 451 aa, Homo sapiens
MAWALKLPLADEVIESGLVQDFDASLSGIGQELGAGAYSMSDVLALPIFKQEESSLPPDNENKILPFQYVLCAATSPAVKLHDETLTYLNQGQSYEIRMLDNRKLGELPEINGKLVKSIFRVVFHDRRLQYTEHQQLEGWRWNRPGDRILDIDIPMSVGIIDPRANPTQLNTVEFLWDPAKRTSVFIQPKGADRKQKTDREKMEKRTPHEKEKYQPSYETTILTECSPWPEITYVNNSPSPGFNSSHSSFSLGEGNGSPNHQPEPPPPVTDNLLPTTTPQEAQQWLHRNRFSTFTRLFTNFSGADLLKLTRDDVIQICGPADGIRLFNALKGRMVRPRLTIYVCQESLQLREQQQQQQQQQQKHEDGDSNGTFFVYHAIYLEELTAVELTEKIAQLFSISPCQISQIYKQGPTGIHVLISDEMIQNFQEEACFILDTMKAETNDSYHIILK

SEQ ID NO: 885134 - protein, 502 aa, Homo sapiens; identical to SEQ ID NO: 885132

SEQ ID NO: 885135 - protein, 502 aa, Homo sapiens; identical to SEQ ID NO: 885132

SEQ ID NO: 885136 - protein, 495 aa, Homo sapiens
WIPRAAGFGTRVQDFDASLSGIGQELGAGAYSMSDVLALPIFKQEESSLPPDNENKILPFQYVLCAATSPAVKLHDETLTYLNQGQSYEIRMLDNRKLGELPEINGKLVKSIFRVVFHDRRLQYTEHQQLEGWRWNRPGDRILDIDIPMSVGIIDPRANPTQLNTVEFLWDPAKRTSVFIQVHCISTEFTMRKHGGEKGVPFRVQIDTFKENENGEYTEHLHSASCQIKVFKPKGADRKQKTDREKMEKRTPHEKEKYQPSYETTILTECSPWPEITYVNNSPSPGFNSSHSSFSLGEGNGSPNHQPEPPPPVTDNLLPTTTPQEAQQWLHRNRFSTFTRLFTNFSGADLLKLTRDDVIQICGPADGIRLFNALKGRMVRPRLTIYVCQESLQLREQQQQQQQQQQKHEDGDSNGTFFVYHAIYLEELTAVELTEKIAQLFSISPCQISQIYKQGPTGIHVLISDEMIQNFQEEACFILDTMKAETNDSYHIILK

SEQ ID NO: 885137 - protein, 424 aa, Homo sapiens
MAWALKLPLADEVIESGLVQDFDASLSGIGQELGAGAYSMSDVLALPIFKQEESSLPPDNENKILPFQYVLCAATSPAVKLHDETLTYLNQGQSYEIRMLDNRKLGELPEINGKLVKSIFRVVFHDRRLQYTEHQQLEGWRWNRPGDRILDIDIPMSVGIIDPRANPTQLNTVEFLWDPAKRTSVFIQVHCISTEFTMRKHGGEKGVPFRVQIDTFKENENGEYTEHLHSASCQIKVFKPKGADRKQKTDREKMEKRTPHEKEKYQPSYETTILTECSPWPEITYVNNSPSPGFNSSHSSFSLGEGMVRPRLTIYVCQESLQLREQQQQQQQQQQKHEDGDSNGTFFVYHAIYLEELTAVELTEKIAQLFSISPCQISQIYKQGPTGIHVLISDEMIQNFQEEACFILDTMKAETNDSYHIILK

SEQ ID NO: 885138 - protein, 410 aa, Homo sapiens
DLEDPRYPYNRKLGELPEINGKLVKSIFRVVFHDRRLQYTEHQQLEGWRWNRPGDRILDIDIPMSVGIIDPRANPTQLNTVEFLWDPAKRTSVFIQVHCISTEFTMRKHGGEKGVPFRVQIDTFKENENGEYTEHLHSASCQIKVFKPKGADRKQKTDREKMEKRTPHEKEKYQPSYETTILTECSPWPEITYVNNSPSPGFNSSHSSFSLGEGNGSPNHQPEPPPPVTDNLLPTTTPQEAQQWLHRNRFSTFTRLFTNFSGADLLKLTRDDVIQICGPADGIRLFNALKGRMVRPRLTIYVCQESLQLREQQQQQQQQQQKHEDGDSNGTFFVYHAIYLEELTAVELTEKIAQLFSISPCQISQIYKQGPTGIHVLISDEMIQNFQEEACFILDTMKAETNDSYHIILK

SEQ ID NO: 885139 - protein, 401 aa, Homo sapiens
WGELQNSVKTLGETHPFTKLVVDLDRRLQYTEHQQLEGWRWNRPGDRILDIDIPMSVGIIDPRANPTQLNTVEFLWDPAKRTSVFIQVHCISTEFTMRKHGGEKGVPFRVQIDTFKENENGEYTEHLHSASCQIKVFKPKGADRKQKTDREKMEKRTPHEKEKYQPSYETTILTECSPWPEITYVNNSPSPGFNSSHSSFSLGEGNGSPNHQPEPPPPVTDNLLPTTTPQEAQQWLHRNRFSTFTRLFTNFSGADLLKLTRDDVIQICGPADGIRLFNALKGRMVRPRLTIYVCQESLQLREQQQQQQQQQQKHEDGDSNGTFFVYHAIYLEELTAVELTEKIAQLFSISPCQISQIYKQGPTGIHVLISDEMIQNFQEEACFILDTMKAETNDSYHIILK

SEQ ID NO: 885140 - protein, 439 aa, Homo sapiens
MAWALKLPLADEVIESGLVQDFDASLSGIGQELGAGAYSMSDVLALPIFKQEESSLPPDNENKILPFQYVLCAATSPAVKLHDETLTYLNQGQSYEIRMLDNRKLGELPEINGKLVKSIFRVVFHDRRLQYTEHQQLEGWRWNRPGDRILDIDIPMSVGIIDPRANPTQLNTVEFLWDPAKRTSVFIQVHCISTEFTMRKHGGEKGVPFRVQIDTFKENENGEYTEHLHSASCQIKVFKPKGADRKQKTDREKMEKRTPHEKEKYQPSYETTILTECSPWPEITYVNNSPSPGFNSSHSSFSLGEGNGSPNHQPEPPPPVTDNLLPTTTPQEAQQWLHRNRFSTFTRLFTNFSGADLLKLTRDDVIQICGPADGIRLFNALKGRMVRPRLTIYVCQESLQLREQQQQQQQQQQKHEDGDSNGTFFVYHAIYLEKKKKPP

SEQ ID NO: 885141 - protein, 124 aa, Homo sapiens
MAWALKLPLADEVIESGLVQDFDASLSGIGQELGAGAYSMSDVLALPIFKQEESSLPPDNENKILPFQYVLCAATSPAVKLHDETLTYLNQGQSYEIRMLDNRKLGELPEINGKLVKSIFRDPQ

SEQ ID NO: 885142 - protein, 502 aa, Homo sapiens; identical to SEQ ID NO: 885132

SEQ ID NO: 885143 - protein, 502 aa, Homo sapiens; identical to SEQ ID NO: 885132

SEQ ID NO: 885144 - protein, 484 aa, Homo sapiens
MAWALKLPLADEVIESGLVQDFDASLSGIGQELGAGAYSMSDVLALPIFKQEESSLPPDNENIHDETLTYLNQGQSYEIRMLDNRKLGELPEINGKLVKSIFRVVFHDRRLQYTEHQQLEGWRWNRPGDRILDIDIPMSVGIIDPRANPTQLNTVEFLWDPAKRTSVFIQVHCISTEFTMRKHGGEKGVPFRVQIDTFKENENGEYTEHLHSASCQIKVFKPKGADRKQKTDREKMEKRTPHEKEKYQPSYETTILTECSPWPEITYVNNSPSPGFNSSHSSFSLGEGNGSPNHQPEPPPPVTDNLLPTTTPQEAQQWLHRNRFSTFTRLFTNFSGADLLKLTRDDVIQICGPADGIRLFNALKGRMVRPRLTIYVCQESLQLREQQQQQQQQQQKHEDGDSNGTFFVYHAIYLEELTAVELTEKIAQLFSISPCQISQIYKQGPTGIHVLISDEMIQNFQEEACFILDTMKAETNDSYHIILK

SEQ ID NO: 885145 - protein, 502 aa, Homo sapiens; identical to SEQ ID NO: 885132

SEQ ID NO: 885146 - protein, 495 aa, Homo sapiens [sequence omitted]

SEQ ID NO: 885147 - protein, 341 aa, Homo sapiens
MAWALKLPLADEVIESGLVQDFDASLSGIGQELGAGAYSMSDVLALPIFKQEESSLPPDNENKILPFQYVLCAATSPAVKLHDETLTYLNQGQSYEIRMLDNRKLGELPEINGKLVKSIFRVVFHDRRLQYTEHQQLEGWRWNRPGDRILDIDIPMSVGIIDPRANPTQLNTVEFLWDPAKRTSVFIQVHCISTEFTMRKHGGEKGVPFRVQIDTFKENENGEYTEHLHSASCQIKVFKPKGADRKQKTDREKMEKRTPHEKEKYQPSYETTILTECSPWPEITYVNNSPSPGFNSSHSSFSLGEGTSYQQPHLRKLSSGCIEIVFLHSQGFSQTSQGQIY

SEQ ID NO: 885148 - protein, 184 aa, Homo sapiens
GRNRNPERPKLSAPLGQRVAAAGNAAPRRTGRPQRSALRGVLICLFSKKLNHSDNDQPPDYSFSKRMVRPRLTIYVCQESLQLREQQQQQQQQQQKHEDGDSNGTFFVYHAIYLEELTAVELTEKIAQLFSISPCQISQIYKQGPTGIHVLISDEMIQNFQEEACFILDTMKAETNDSYHIILK

SEQ ID NO: 885149 - protein, 389 aa, Homo sapiens
MAWALKLPLADEVIESGLVQDFDASLSGIGQELGAGAYSMSDVLALPIFKQEESSLPPDNENKILPFQYVLCAATSPAVKLHDETLTYLNQGQSYEIRMLDNRKLGELPEINGKLVKSIFRVVFHDRRLQYTEHQQLEGWRWNRPGDRILDIDIPMSVGIIDPRANPTQLNTVEFLWDPAKRTSVFIQVHCISTEFTMRKHGGEKGVPFRVQIDTFKENENGEYTEHLHSASCQIKVFKPKGADRKQKTDREKMEKRTPHEKEKYQPSYETTILTECSPWPEITYVNNSPSPGFNSSHSSFSLGEGNGSPNHQPEPPPPVTDNLLPTTTPQEAQQWLHRNRFSTFTRLFTNFSGADLLKLTRILALCVGPSSCGTHRLLPNMQFCSCFS

SEQ ID NO: 885150 - protein, 239 aa, Homo sapiens
MAWALKLPLADEVIESGLVQDFDASLSGIGQELGAGAYSMSDVLALPIFKQEESSLPPDNENKILPFQYVLCAATSPAVKLHDETLTYLNQGQSYEAFDMLDNRVFIMEFHCWRGSGTPSATPDLSPLTSATPSQTPVRLRRQQNQRLLRDTARTTSQLWTTSPWGSSQDPVSWHSHPAQNSSKILFTGQSPKKQGTYRGNPCTYLEGRRHVQVRSVPKREDLGAQSHTPEDRDSSGIP

SEQ ID NO: 885151 - protein, 485 aa, Homo sapiens
MATEPKKAAAQNSPEDEGLLIVKIEEEEFIHGQDTCLQRSELLKQELCRQLFRQFCYQDSPGPREALSRLRELCCQWLKPEIHTKEQILELLVLEQFLTILPGDLQAWVHEHYPESGEEAVTILEDLERGTDEAVLQVQAHEHGQEIFQKKVSPPGPALNVKLQPVETKAHFDSSEPQLLWDCDNESENSRSMPKLEIFEKIESQRIISGRISGYISEASGESQDICKSAGRVKRQWEKESGESQRLSSAQDEGFGKILTHKNTVRGEIISHDGCERRLNLNSNEFTHQKSCKHGTCDQSFKWNSDFINHQIIYAGEKNHQYGKSFKSPKLAKHAAVFSGDKTHQCNECGKAFRHSSKLARHQRIHTGERCYECNECGKSFAESSDLTRHRRIHTGERPFGCKECGRAFNLNSHLIRHQRIHTREKPYECSECGKTFRVSSHLIRHFRIHTGEKPYECSECGRAFSQSSNLSQHQRIHMRENLLM

SEQ ID NO: 885152 - protein, 485 aa, Homo sapiens; identical to SEQ ID NO: 885151

SEQ ID NO: 885153 - protein, 485 aa, Homo sapiens; identical to SEQ ID NO: 885151

SEQ ID NO: 885154 - protein, 485 aa, Homo sapiens; identical to SEQ ID NO: 885151

SEQ ID NO: 885155 - protein, 466 aa, Homo sapiens
MVMEKPSPLLVGREFVRQYYTLLNQAPDMLHRFYGKNSSYVHGGLDSNGKPADAVYGQKEIHRKVMSQNFTNCHTKIRHVDAHATLNDGVVVQVMGLLSNNNQALRRFMQTFVLAPEGSVANKFYVHNDIFRYQDEVFGGFVTEPQEESEEEVEEPEERQQTPEVVPDDSGTFYDQAVVSNDMEEHLEEPVAEPEPDPEPEPEQEPVSEIQEEKPEPVLEETAPEDAQKSSSPAPADIAQTVQEDLRTFSWASVTSKNLPPSGAVPVTGIPPHVVKVPASQPRPESKPESQIPPQRPQRDQRVREQRINIPPQRGPRPIREAGEQGDIEPRRMVRHPDSHQLFIGNLPHEVDKSELKDFFQSYGNVVELRINSGGKLPNFGFVVFDDSEPVQKVLSNRPIMFRGEVRLNVEEKKTRAAREGDRRDNRLRGPGGPRGGLGGGMRGPPRGGMVQKPGFGVGRGLAPRQ

SEQ ID NO: 885156 - protein, 466 aa, Homo sapiens; identical to SEQ ID NO: 885155

SEQ ID NO: 885157 - protein, 466 aa, Homo sapiens; identical to SEQ ID NO: 885155

SEQ ID NO: 885158 - protein, 494 aa, Homo sapiens
MRASELEPLGQAVPKFLTLRNCVELTKAMVMEKPSPLLVGREFVRQYYTLLNQAPDMLHRFYGKNSSYVHGGLDSNGKPADAVYGQKEIHRKVMSQNFTNCHTKIRHVDAHATLNDGVVVQVMGLLSNNNQALRRFMQTFVLAPEGSVANKFYVHNDIFRYQDEVFGGFVTEPQEESEEEVEEPEERQQTPEVVPDDSGTFYDQAVVSNDMEEHLEEPVAEPEPDPEPEPEQEPVSEIQEEKPEPVLEETAPEDAQKSSSPAPADIAQTVQEDLRTFSWASVTSKNLPPSGAVPVTGIPPHVVKVPASQPRPESKPESQIPPQRPQRDQRVREQRINIPPQRGPRPIREAGEQGDIEPRRMVRHPDSHQLFIGNLPHEVDKSELKDFFQSYGNVVELRINSGGKLPNFGFVVFDDSEPVQKVLSNRPIMFRGEVRLNVEEKKTRAAREGDRRDNRLRGPGGPRGGLGGGMRGPPRGGMVQKPGFGVGRGLAPRQ

SEQ ID NO: 885159 - protein, 466 aa, Homo sapiens; identical to SEQ ID NO: 885155

SEQ ID NO: 885160 - protein, 421 aa, Homo sapiens
MVMEKPADAVYGQKEIHRKVMSQNFTNCHTKIRHVDAHATLNDGVVVQVMGLLSNNNQALRRFMQTFVLAPEGSVANKFYVHNDIFRYQDEVFGGFVTEPQEESEEEVEEPEERQQTPEVVPDDSGTFYDQAVVSNDMEEHLEEPVAEPEPDPEPEPEQEPVSEIQEEKPEPVLEETAPEDAQKSSSPAPADIAQTVQEDLRTFSWASVTSKNLPPSGAVPVTGIPPHVVKVPASQPRPESKPESQIPPQRPQRDQRVREQRINIPPQRGPRPIREAGEQGDIEPRRMVRHPDSHQLFIGNLPHEVDKSELKDFFQSYGNVVELRINSGGKLPNFGFVVFDDSEPVQKVLSNRPIMFRGEVRLNVEEKKTRAAREGDRRDNRLRGPGGPRGGLGGGMRGPPRGGMVQKPGFGVGRGLAPRQ

SEQ ID NO: 885161 - protein, 446 aa, Homo sapiens
MVMEKPSPLLVGREFVRQYYTLLNQAPDMLHRFYGKNSSYVHGGLDSNGKPADAVYGQKEIHRKVMSQNFTNCHTKIRHVDAHATLNDGVVVQVMGLLSNNNQALRRFMQTFVLAPEGSVANKFYVHNDIFRYQDEVFGGFVTEPQEESEEEVEEPEERQQTPEVVPDDSGTFYDQAVVSNDMEEHLEEPVAEPEPDPEPEPEQEPVSEIQEEKPEPVLEETAPEDAQKSSSPAPADIAQTVQEDLRTFSWASVTSKNLPPSGAVPVTGIPPHVVKVPASQPRPESKPESQIPPQRPQRDQRVREQRINIPPQRGPRPIREAGEQGDIEPRRMVRHPDSHQLFIGNLPHEVDKSELKDFFQSYGNVVELRINSGGKLPNFGFVVFDDSEPVQKVLSNRPIMFRGEVRLNVEEKKTRAAREGDRRDNRLRGPGGPRAISPKECLAYY

SEQ ID NO: 885162 - protein, 284 aa, Homo sapiens [sequence omitted]

SEQ ID NO: 885163 - protein, 276 aa, Homo sapiens
MVMEKPSPLLVGREFVRQYYTLLNQAPDMLHRFYGKNSSYVHGGLDSNGKPADAVYGQKEIHRKVMSQNFTNCHTKIRHVDAHVVKVPASQPRPESKPESQIPPQRPQRDQRVREQRINIPPQRGPRPIREAGEQGDIEPRRMVRHPDSHQLFIGNLPHEVDKSELKDFFQSYGNVVELRINSGGKLPNFGFVVFDDSEPVQKVLSNRPIMFRGEVRLNVEEKKTRAAREGDRRDNRLRGPGGPRGGLGGGMRGPPRGGMVQKPGFGVGRGLAPRQ

SEQ ID NO: 885164 - protein, 154 aa, Homo sapiens
MVMEKPSPLLVGREFVRQYYTLLNQAPDMLHRFYGKNSSYVHGGLDSNGKPADAVYGQKEIHRKVMSQNFTNCHTKIRHVDAHATLNDGVVVQVMGLLSNNNQALRRFMQTFVLAPEGSVANKFYVHNPVQSLSLNLRFHHKDLSGIKECENNE

SEQ ID NO: 885165 - protein, 446 aa, Homo sapiens; identical to SEQ ID NO: 885161

SEQ ID NO: 885166 - protein, 533 aa, Homo sapiens
MVMEKPSPLLVGREFVRQYYTLLNQAPDMLHRFYGKNSSYVHGGLDSNGKPADAVYGQKEIHRKVMSQNFTNCHTKIRHVDAHATLNDGVVVQVMGLLSNNNQALRRFMQTFVLAPEGSVANKFYVHNDIFRYQDEVFGGFVTEPQEESEEEVEEPEERQQTPEVVPDDSGTFYDQAVVSNDMEEHLEEPVAEPEPDPEPEPEQEPVSEIQEEKPEPVLEETAPEDAQKSSSPAPADIAQTVQEDLRTFSWASVTSKNLPPSGAVPVTGIPPHVVKVPASQPRPESKPESQIPPQRPQRDQRVREQRINIPPQRGPRPIREAGEQGDIEPRRMVRHPDSHQLFIGNLPHEVDKSELKDFFQSYGNVVELRINSGGKLPNFGFVVFDDSEPVQKVLSNRPIMFRGEVRLNVEEKKTRAAREGDRRDNRLRGPGGPRGGLGGGMRGPPRGGMVQKPGFGVGRGLAPREKKIKGSLRQAYKNGNQKGRGKFIERAWGKRGERNERPGKKRDKGREKKKTRRGRGKKGGEEHQNGWE

SEQ ID NO: 885167 - protein, 333 aa, Homo sapiens
MVMEKPSPLLVGREFVRQYYTLLNQAPDMLHRFYGKNSSYVHGGLDSNGKPADAVYGQKEIHRKVMSQNFTNCHTKIRHVDAHATLNDGVVVQVMGLLSNNNQALRRFMQTFVLAPEGSVANKFYVHNDIFRYQDEVFGGFVTEPQEESEEEVEEPEERQQTPEVVPDDSGTFYDQAVVSNDMEEHLEEPVAEPEPDPEPEPEQEPVSEIQEEKPEPVLEETAPEDAQKSSSPAPADIAQTVQEDLRTFSWASVTSKNLPPSGAVPVTGIPPHVVKVPASQPRPESKPESQIPPQRPQRDQRVREQRINIPPQRGPRPSKSSEGRFLVWGILR

SEQ ID NO: 885168 - protein, 170 aa, Homo sapiens
MVMEKPSPLLVGREFVRQYYTLLNQAPDMLHRFYGKNSSYVHGGLDSNGKPADAVYGQKEIHRKVMSQNFTNCHTKIRHVDAHATLNDGVVVQPFPQRNVLHITDIWYVSFIGIFLIFYVFEKPVRNTGFDNILKAGKTQIVSSLRVMTTFWCGEIAIGKFDNFDSHWYV

SEQ ID NO: 885169 - protein, 180 aa, Homo sapiens
MVMEKPSPLLVGREFVRQYYTLLNQAPDMLHRFYGKNSSYVHGGLDSNGKPADAVYGQKEIHRKVMSQNFTNCHTKIRHVDAHATLNDGVVVQVMGLLSNNNQALRRFMQTFVLAPEGSVANKFYVHNDIFRYQDEVFGGFVTEPQEESEEEVEEPEERQQTPEVVPDDSGTFYDQAVVR

SEQ ID NO: 885170 - protein, 154 aa, Homo sapiens; identical to SEQ ID NO: 885164

SEQ ID NO: 885171 - protein, 125 aa, Homo sapiens
MVMEKPSPLLVGREFVRQYYTLLNQAPDMLHRFYGKNSSYVHGGLDSNGKPADAVYGQKEIHRKVMSQNFTNCHTKIRHVDAHATLNDGVVVQVMGLLSNNNQALRRFMQTFVLAPEVCVGMIIL

SEQ ID NO: 885172 - protein, 466 aa, Homo sapiens; identical to SEQ ID NO: 885155

SEQ ID NO: 885173 - protein, 476 aa, Homo sapiens
MVMEKPSPLLVGREFVRQYYTLLNQAPDMLHRFYGKNSSYVHGGLDSNGKPADAVYGQKEIHRKVMSQNFTNCHTKIRHVDAHATLNDGVVVQVMGLLSNNNQALRRFMQTFVLAPEGSVANKFYVHNDIFRYQDEVFGGFVTEPQEESEEEVEEPEERQQTPEVVPDDSGTFYDQAVVRMIFLKFSCQSNDMEEHLEEPVAEPEPDPEPEPEQEPVSEIQEEKPEPVLEETAPEDAQKSSSPAPADIAQTVQEDLRTFSWASVTSKNLPPSGAVPVTGIPPHVVKVPASQPRPESKPESQIPPQRPQRDQRVREQRINIPPQRGPRPIREAGEQGDIEPRRMVRHPDSHQLFIGNLPHEVDKSELKDFFQSYGNVVELRINSGGKLPNFGFVVFDDSEPVQKVLSNRPIMFRGEVRLNVEEKKTRAAREGDRRDNRLRGPGGPRGGLGGGMRGPPRGGMVQKPGFGVGRGLAPRQ

SEQ ID NO: 885174 - protein, 473 aa, Homo sapiens [sequence omitted]

SEQ ID NO: 885175 - protein, 401 aa, Homo sapiens [sequence omitted]

SEQ ID NO: 885176 - protein, 262 aa, Homo sapiens
TTVLAELCLQVLEKNSSEHPQGQLLLGLAQAFPLAFQIQEDLRTFSWASVTSKNLPPSGAVPVTGIPPHVVKVPASQPRPESKPESQIPPQRPQRDQRVREQRINIPPQRGPRPIREAGEQGDIEPRRMVRHPDSHQLFIGNLPHEVDKSELKDFFQSYGNVVELRINSGGKLPNFGFVVFDDSEPVQKVLSNRPIMFRGEVRLNVEEKKTRAAREGDRRDNRLRGPGGPRGGLGGGMRGPPRGGMVQKPGFGVGRGLAPRQ

SEQ ID NO: 885177 - protein, 410 aa, Homo sapiens
MVMEKPSPLLVGREFVRQYYTLLNQAPDMLHRFYGKNSSYVHGGLDSNGKPADAVYGQKEIHRKVMSQNFTNCHTKIRHVDAHATLNDGVVVQVMGLLSNNNQALRRFMQTFVLAPEGSVANKFYVHNDIFRYQDEVFGGFVTEPQEESEEEVEEPEERQQTPEVVPDDSGTFYDQAVVSNDMEEHLEEPVAEPEPDPEPEPEQEPVSEIQEEKPEPVLEETAPEDAQKSSSPAPADIAQTVQEDLRTFSWASVTSKNLPPSGAVPVTGIPPHVVKVPASQPRPESKPESQIPPQRPQRDQRVREQRINIPPQRGPRPIREAGEQGDIEPRRMPFPQRNVLHITDIWYVSFIGIFLIFYVFEKPVRNTGFDNILKAGKTQIVSSLRVMTTFWCGEIAIGKFDNFDSHWYV

SEQ ID NO: 885178 - protein, 146 aa, Homo sapiens
MVMEKPSPLLVGREFVRQYYTLLNQAPDMLHRFYGKNSSYVHGGLDSNGKPADAVYGQKEIHRKVMSQNFTNCHTKIRHVDAHATLNDGVVVQVMGLLSNNNQALRRFMQTFVLAPEGSVANKFYVHNDIFRYQDLSGIKECENNE

SEQ ID NO: 885179 - protein, 369 aa, Homo sapiens
MVMEKPSPLLVGREFVRQYYTLLNQAPDMLHRFYGKNSSYVHGGLDSNGKPADAVYGQKEIHRKVMSQNFTNCHTKIRHVDAHATLNDGVVVQVMGLLSNNNQALRRFMQTFVLAPEGSVANKFYVHNDIFRYQDEVFGGFVTEPQEESEEEVEEPEERQQTPEVVPDDSGTFYDQAVVSNDMEEHLEEPVAEPEPDPEPEPEQEPVSEIQEEKPEPVLEETAPEDAQKSSSPAPADIAQTVQEDLRTFSWASVTSKNLPPSGAVPVTGIPPHVVKVPASQPRPESKPESQIPPQRPQRDQRVREQRINIPPQRGPRPIREAGEQGDIEPRRMVRHPDSHQLFIGNLPHEVDKSELKDFFQSRLLSFEH

SEQ ID NO: 885180 - protein, 535 aa, Homo sapiens
MVMEKPSPLLVGREFVRQYYTLLNQAPDMLHRFYGKNSSYVHGGLDSNGKPADAVYGQKEIHRKVMSQNFTNCHTKIRHVDAHATLNDGVVVQVMGLLSNNNQALRRFMQTFVLAPEGSVANKFYVHNDIFRYQDEVFGGFVTEPQEESEEEVEEPEERQQTPEVVPDDSGTFYDQAVVSNDMEEHLEEPVAEPEPDPEPEPEQEPVSEIQEEKPEPVLEETAPEDAQKSSSPAPADIAQTVQEDLRTFSWASVTSKNLPPSGAVPVTGIPPHVVKVPASQPRPESKPESQIPPQRPQRDQRVREQRINIPPQRGPRPILQAGETSADSLKPPEHMAETTPDQITQTSYHYGTTLHYTRHDANNTQGQLKRIHTQKLNGHTPRGKQHGRTTKPNEHDKGTTKPKTLQTPQNHTTIHPATLATTPRTQNTKQRHHPNNRPAKTDRTRNHTPHTKRTATDTGQRKTQAETDARNRERAETRGEKQARNNKGPEQTTGKPKPQTADRETKREDHKGDTDDEGNKRGRETRRDREKHKA

SEQ ID NO: 885181 - protein, 73 aa, Homo sapiens
QARASPAQGGERARLPRGRGRRPCSFSSASLPRHRRSTCFISKILSKTPRETLVTCLSIVLFGYWSLLVPICY

SEQ ID NO: 885182 - protein, 125 aa, Homo sapiens; identical to SEQ ID NO: 885171

SEQ ID NO: 885183 - protein, 390 aa, Homo sapiens
MGPPPGAGVSCRGGCGFSRLLAWCFLLALSPQAPGSRGAEAVWTAYLNVSWRVPHTGVNRTVWELSEEGVYGQDSPLEPVAGVLVPPDGPGALNACNPHTNFTVPTVWGSTVQVSWLALIQRGGGCTFADKIHLAYERGASGAVIFNFPGTRNEVIPMSHPGAVDIVAIMIGNLKGTKILQSIQRGIQVTMVIEVGKKHGPWVNHYSIFFVSVSFFIITAATVGYFIFYSARRLRNARAQSRKQRQLKADAKKAIGRLQLRTLKQGDKEIGPDGDSCAVCIELYKPNDLVRILTCNHIFHKTCVDPWLLEHRTCPMCKCDILKAWELRWMLKMDQCLYKSLYPMKYLIVPPPMKRIIAARPHHLDMLQYREQMNRLWRNTCSQQMKVYSW

SEQ ID NO: 885184 - protein, 390 aa, Homo sapiens; identical to SEQ ID NO: 885183

SEQ ID NO: 885185 - protein, 551 aa, Homo sapiens
MAAPALSWRLPLLILLLPLATSWASAAVNGTSQFTCFYNSRANISCVWSQDGALQDTSCQVHAWPDRRRWNQTCELLPVSQASWACNLILGAPDSQKLTTVDIVTLRVLCREGVRWRVMAIQDFKPFENLRLMAPISLQVVHVETHRCNISWEISQASHYFERHLEFEARTLSPGHTWEEAPLLTLKQKQEWICLETLTPDTQYEFQVRVKPLQGEFTTWSPWSQPLAFRTKPAALGKDTIPWLGHLLVGLSGAFGFIILVYLLINCRNTGPWLKKVLKCNTPDPSKFFSQLSSEHGGDVQKWLSSPFPSSSFSPGGLAPEISPLEVLERDKVTQLLLQQDKVPEPASLSSNHSLTSCFTNQGYFFFHLPDALEIEACQVYFTYDPYSEEDPDEGVAGAPTGSSPQPLQPLSGEDDAYCTFPSRDDLLLFSPSLLGGPSPPSTAPGGSGAGEERMPPSLQERVPRDWDPQPLGPPTPGVPDLVDFQPPPELVLREAGEEVPDAGPREGVSFPWSRPPGQGEFRALNARLPLNTDAYLSLQELQGQDPTHLV

SEQ ID NO: 885186 - protein, 594 aa, Homo sapiens
SQSSAGPWRDGHGPSTGEDWRARAATAPCLSQGFLPRLHPVDVMAAPALSWRLPLLILLLPLATSWASAAVNGTSQFTCFYNSRANISCVWSQDGALQDTSCQVHAWPDRRRWNQTCELLPVSQASWACNLILGAPDSQKLTTVDIVTLRVLCREGVRWRVMAIQDFKPFENLRLMAPISLQVVHVETHRCNISWEISQASHYFERHLEFEARTLSPGHTWEEAPLLTLKQKQEWICLETLTPDTQYEFQVRVKPLQGEFTTWSPWSQPLAFRTKPAALGKDTIPWLGHLLVGLSGAFGFIILVYLLINCRNTGPWLKKVLKCNTPDPSKFFSQLSSEHGGDVQKWLSSPFPSSSFSPGGLAPEISPLEVLERDKVTQLLLQQDKVPEPASLSSNHSLTSCFTNQGYFFFHLPDALEIEACQVYFTYDPYSEEDPDEGVAGAPTGSSPQPLQPLSGEDDAYCTFPSRDDLLLFSPSLLGGPSPPSTAPGGSGAGEERMPPSLQERVPRDWDPQPLGPPTPGVPDLVDFQPPPELVLREAGEEVPDAGPREGVSFPWSRPPGQGEFRALNARLPLNTDAYLSLQELQGQDPTHLV

SEQ ID NO: 885187 - protein, 594 aa, Homo sapiens; identical to SEQ ID NO: 885186

SEQ ID NO: 885188 - protein, 365 aa, Homo sapiens
MNITNCTTEASMAIRPKTITEKMLICMTLVVITTLTTLLNLAVIMAIGTTKKLHQPANYLICSLAVTDLLVAVLVMPLSIIYIVMDRWKLGYFLCEVWLSVDMTCCTCSILHLCVIALDRYWAITNAIEYARKRTAKRAALMILTVWTISIFISMPPLFWRSHRRLSPPPSQCTIQHDHVIYTIYSTLGAFYIPLTLILILYYRIYHAAKSLYQKRGSSRHLSNRSTDSQNSFASCKLTQTFCVSDFSTSDPTTEFEKFHASIRIPPFDNDLDHPGERQQISSTRERKAARILGLILGAFILSWLPFFIKELIVGLSIYTVSSEVADFLTWLGYVNSLINPLLYTSFNEDFKLAFKKLIRCREHT

SEQ ID NO: 885189 - protein, 129 aa, Homo sapiens
EYLGAATSSSQYHLPHTRAHLFIPHPPPPSPFTVSREAATCVDDLADCPCPCSCSCSSSSSSPLSPSRLLFQSRRPDSANAAPCHQRCLGLPGAPRSQVLSRRTPAGTGAGKDAGGENALGSTYSRIEC

SEQ ID NO: 885190 - protein, 365 aa, Homo sapiens; identical to SEQ ID NO: 885188

SEQ ID NO: 885191 - protein, 365 aa, Homo sapiens; identical to SEQ ID NO: 885188

SEQ ID NO: 885192 - protein, 120 aa, Homo sapiens
MWASELRGPGCADSLNAALAHSPLRNRQCRGFPGGGHSIQPLYTPRAPAAAPPPPHKMAAPIEETAAASPAPFCGRREICQHGKPLLRMHPSLETPLKGWSLGDHIKRKMPTTSTTSTRF

SEQ ID NO: 885193 - protein, 120 aa, Homo sapiens; identical to SEQ ID NO: 885192

SEQ ID NO: 885194 - protein, 120 aa, Homo sapiens; identical to SEQ ID NO: 885192

SEQ ID NO: 885195 - protein, 120 aa, Homo sapiens; identical to SEQ ID NO: 885192

SEQ ID NO: 885196 - protein, 2392 aa, Homo sapiens
MKKLLPNMLSPDPRELQKSIEVQLLRSSVCLATALNPIEQDQKWQSITENVVKYLKQTSRIAIGPLRLSTLTVSQSLPVLSTLQLYCSSALENTVSNRLSTEDCLIPLFSEALRSCKQHDVRPWMQALRYTMYQNQLLEKIKEQTVPIRSHLMELGLTAAKFARKRGNVSLATRLLAQCSEVQLGKTTTAQDLVQHFKKLSTQGQVDEKWGPELDIEKTKLLYTAGQSTHAMEMLSSCAISFCKSVKAEYAVAKSILTLAKWIQAEWKEISGQLKQVYRAQHQQNFTGLSTLSKNILTLIELPSVNTMEEEYPRIESESTVHIGVGEPDFILGQLYHLSSVQAPEVAKSWAALASWAYRWGRKVVDNASQGEGVRLLPREKSEVQNLLPDTITEEEKERIYGILGQAVCRPAGIQDEDITLQITESEDNEEDDMVDVIWRQLISSCPWLSELDESATEGVIKVWRKVVDRIFSLYKLSCSAYFTFLKLNAGQIPLDEDDPRLHLSHRVEQSTDDMIVMATLRLLRLLVKHAGELRQYLEHGLETTPTAPWRGIIPQLFSRLNHPEVYVRQSICNLLCRVAQDSPHLILYPAIVGTISLSSESQASGNKFSTAIPTLLGNIQGEELLVSECEGGSPPASQDSNKDEPKSGLNEDQAMMQDCYSKIVDKLSSANPTMVLQVQMLVAELRRVTVLWDELWLGVLLQQHMYVLRRIQQLEDEVKRVQNNNTLRKEEKIAIMREKHTALMKPIVFALEHVRSITAAPAETPHEKWFQDNYGDAIENALEKLKTPLNPAKPGSSWIPFKEIMLSLQQRAQKRASYILRLEEISPWLAAMTNTEIALPGEVSARDTVTIHSVGGTITILPTKTKPKKLLFLGSDGKSYPYLFKGLEDLHLDERIMQFLSIVNTMFATINRQETPRFHARHYSVTPLGTRSGLIQWVDGATPLFGLYKRWQQREAALQAQKAQDSYQTPQNPGIVPRPSELYYSKIGPALKTVGLSLDVSRRDWPLHVMKAVLEELMEATPPNLLAKELWSSCTTPDEWWRVTQSYARSTAVMSMVGYIIGLGDRHLDNVLIDMTTGEVVHIDYNVCFEKGKSLRVPEKVPFRMTQNIETALGVTGVEGVFRLSCEQVLHIMRRGRETLLTLLEAFVYDPLVDWTAGGEAGFAGAVYGGGGQQAESKQSKREMEREITRSLFSSRVAEIKVNWFKNRDEMLVVLPKLDGSLDEYLSLQEQLTDVEKLQGKLLEEIEFLEGAEGVDHPSHTLQHRYSEHTQLQTQQRAVQEAIQVKLNEFEQWITHYQAAFNNLEATQLASLLQEISTQMDLGPPSYVPATAFLQNAGQAHLISQCEQLEGEVGALLQQRRSVLRGCLEQLHHYATVALQYPKAIFQKHRIEQWKTWMEELICNTTVERCQELYRKYEMQYAPQPPPTVCQFITATEMTLQRYAADINSRLIRQVERLKQEAVTVPVCEDQLKEIERCIKVFLHENGEEGSLSLASVIISALCTLTRRNLMMEGAASSAGEQLVDLTSRDGAWFLEELCSMSGNVTCLVQLLKQCHLVPQDLDIPNPMEASETVHLANGVYTSLQELNSNFRQIIFPEALRCLMKGEYTLESMLHELDGLIEQTTDGVPLQTLVESLQAYLRNAAMGLEEETHAHYIDVARLLHAQYGELIQPRNGSVDETPKMSAGQMLLVAFDGMFAQVETAFSLLVEKLNKMEIPIAWRKIDIIREARSTQVNFFDDDNHRQVLEEIFFLKRLQTIKEFFRLCGTFSRTLSGSSSLEDQNTVNGPVQIVNVKTLFRNSCFSEDQMAKPIKAFTADFVRQLLIGLPNQALGLTLCSFISALGVDIIAQVEAKDFGAESKVSVDDLCKKAVEHNIQIGKFSQLVMNRATVLASSYDTAWKKHDLVRRLETSISSCKTSLQRVQLHIAMFQWQHEDLLINRPQAMSVTPPPRSAILTSMKKKLHTLSQIETSIATVQEKLAALESSIEQRLKWAGGANPALAPVLQDFEATIAERRNLVLKESQRASQVTFLCSNIIHFESLRTRTAEALNLDAALFELIKRCQQMCSFASQFNSSVSELELRLLQRVDTGLEHPIGSSEWLLSAHKQLTQDMSTQRAIQTEKEQQIETVCETIQNLVDNIKTVLTGHNRQLGDVKHLLKAMAKDEEAALADGEDVPYENSVRQFLGEYKSWQDNIQTVLFTLVQAMGQVRSQEHVEMLQEITPTLKELKTQSQSIYNNLVSFASPLVTDATNECSSPTSSATYQPSFAAAVRSNTGQKTQPDVMSQNARKLIQKNLATSADTPPSTVPGTGKSVACSPKKAVRDPKTGKAVQERNSYAVSVWKRVKAKLEGRDVDPNRRMSVAEQVDYVIKEATNLDNLAQLYEGWTAWV

SEQ ID NO: 885197 - protein, 185 aa, Homo sapiens [sequence omitted]

SEQ ID NO: 885198 - protein, 2352 aa, Homo sapiens
MKKLLPNMLSPDPRELQKSIEVQLLRSSVCLATALNPIEQDQKWQSITENVVKYLKQTSRIAIGPLRLSTLTVSQSLPVLSTLQLYCSSALENTVSNRLSTEDCLIPLFSEALRSCKQHDVRPWMQALRYTMYQNQLLEKIKEQTVPIRSHLMELGLTAAKFARKRGNVSLATRLLAQCSEVQLGKTTTAQDLVQHFKKLSTQGQVDEKWGPELDIEKTKLLYTAGQSTHAMEMLSSCAISFCKSVKAEYAVAKSILTLAKWIQAEWKEISGQLKQVYRAQHQQNFTGLSTLSKNILTLIELPSVNTMEEEYPRIESESTVHIGVGEPDFILGQLYHLSSVQAPEVAKSWAALASWAYRWGRKVVDNASQGEGVRLLPREKSEVQNLLPDTITEEEKERIYGILGQAVCRPAGIQDEDITLQITESEDNEEDDMVDVIWRQLISSCPWLSELDESATEGVIKVWRKVVDRIFSLYKLSCSAYFTFLKLNAGQIPLDEDDPRLHLSHRVEQSTDDMIVMATLRLLRLLVKHAGELRQYLEHGLETTPTAPWRGIIPQLFSRLNHPEVYVRQSICNLLCRVAQDSPHLILYPAIVGTISLSSESQASGNKFSTAIPTLLGNIQGEELLVSECEGGSPPASQDSNKDEPKSGLNEDQAMMQDCYSKIVDKLSSANPTMVLQVQMLVAELRRVTVLWDELWLGVLLQQHMYVLRRIQQLEDEVKRVQNNNTLRKEEKIAIMREKHTALMKPIVFALEHVRSITAAPAETPHEKWFQDNYGDAIENALEKLKTPLNPAKPGSSWIPFKEIMLSLQQRAQKRASYILRLEEISPWLAAMTNTEIALPGEVSARDTVTIHSVGGTITILPTKTKPKKLLFLGSDGKSYPYLFKGLEDLHLDERIMQFLSIVNTMFATINRQETPRFHARHYSVTPLGTRSGLIQWVDGATPLFGLYKRWQQREAALQAQKAQDSYQTPQNPGIVPRPSELYYSKIGPALKTVGLSLDVSRRDWPLHVMKAVLEELMEATPPNLLAKELWSSCTTPDEWWRVTQSYARSTAVMSMVGYIIGLGDRHLDNVLIDMTTGEVVHIDYNVCFEKGKSLRVPEKVPFRMTQNIETALGVTGVEGVFRLSCEQVLHIMRRGRETLLTLLEAFVYDPLVDWTAGGEAGFAGAVYGGGGQQAESKQSKREMEREITRSLFSSRVAEIKVNWFKNRDEMLVVLPKLDGSLDEYLSLQEQLTDVEKLQGKLLEEIEFLEGAEGVDHPSHTLQHRYSEHTQLQTQQRAVQEAIQVKLNEFEQWITHYQAAFNNLEATQLASLLQEISTQMDLGPPSYVPATAFLQNAGQAHLISQCEQLEGEVGALLQQRRSVLRGCLEQLHHYATVALQYPKAIFQKHRIEQWKTWMEELICNTTVERCQELYRKYEMQYAPQPPPTVCQFITATEMTLQRYAADINSRLIRQVERLKQEAVTVPVCEDQLKEIERCIKVFLHENGEEGSLSLASVIISALCTLTRRNLMMEGAASSAGEQLVDLTSRDGAWFLEELCSMSGNVTCLVQLLKQCHLVPQDLDIPNPMEASETVHLANGVYTSLQELNSNFRQIIFPEALRCLMKGEYTLESMLHELDGLIEQTTDGVPLQTLVESLQAYLRNAAMGLEEETHAHYIDVARLLHAQYGELIQPRNGSVDETPKMSAGQMLLVAFDGMFAQVETAFSLLVEKLNKMEIPIAWRKIDIIREARSTQVNFFDDDNHRQVLEEIFFLKRLQTIKEFFRLCGTFSRTLSGSSSLEDQNTVNGPVQIVNVKTLFRNSCFSEDQMAKPIKAFTADFVRQLLIGLPNQALGLTLCSFISALGVDIIAQVEAKDFGAESKVSVDDLCKKAVEHNIQIGKFSQLVMNRATVLASSYDTAWKKHDLVRRLETSISSCKTSLQRVQLHIAMFQWQHEDLLINRPQAMSVTPPPRSAILTSMKKKLHTLSQIETSIATVQEKLAALESSIEQRLKWAGGANPALAPVLQDFEATIAERRNLVLKESQRASQVTFLCSNIIHFESLRTRTAEALNLDAALFELIKRCQQMCSFASQFNSSVSELELRLLQRVDTGLEHPIGSSEWLLSAHKQLTQDMSTQRAIQTEKEQQIETVCETIQNLVDNIKTVLTGHNRQLGDVKHLLKAMAKDEEAALADGEDVPYENSVRQFLGEYKSWQDNIQTVLFTLVQAMGQVRSQEHVEMLQEITPTLKELKTQSQSIYNNLVSFASPLVTDATNECSSPTSSATYQPSFAAAVRSNTGQKTQPDVMSQNARKLIQKNLATSADTPPSTVPGTGKSVACSPKKAVRDPKTGKAVNEGNSYSGSWWIVYRVAYH

SEQ ID NO: 885199 - protein, 2236 aa, Homo sapiens
MKKLLPNMLSPDPRELQKSIEVQLLRSSVCLATALNPIEQDQKWQSITENVVKYLKQTSRIAIGPLRLSTLTVSQSLPVLSTLQLYCSSALENTVSNRLSTEDCLIPLFSEALRSCKQHDVRPWMQALRYTMYQNQLLEKIKEQTVPIRSHLMELGLTAAKFARKRGNVSLATRLLAQCSEVQLGKTTTAQDLVQHFKKLSTQGQVDEKWGPELDIEKTKLLYTAGQSTHAMEMLSSCAISFCKSVKAEYAVAKSILTLAKWIQAEWKEISGQLKQVYRAQHQQNFTGLSTLSKNILTLIELPSVNTMEEEYPRIESESTVHIGVGEPDFILGQLYHLSSVQAPEVAKSWAALASWAYRWGRKVVDNASQGEGVRLLPREKSEVQNLLPDTITEEEKERIYGILGQAVCRPAGIQDEDITLQITESEDNEEDDMVDVIWRQLISSCPWLSELDESATEGVIKVWRKVVDRIFSLYKLSCSAYFTFLKLNAGQIPLDEDDPRLHLSHRVEQSTDDMIVMATLRLLRLLVKHAGELRQYLEHGLETTPTAPWRGIIPQLFSRLNHPEVYVRQSICNLLCRVAQDSPHLILYPAIVGTISLSSESQASGNKFSTAIPTLLGNIQGEELLVSECEGGSPPASQDSNKDEPKSGLNEDQAMMQDCYSKIVDKLSSANPTMVLQVQMLVAELRRVTVLWDELWLGVLLQQHMYVLRRIQQLEDEVKRVQNNNTLRKEEKIAIMREKHTALMKPIVFALEHVRSITAAPAETPHEKWFQDNYGDAIENALEKLKTPLNPAKPGSSWIPFKEIMLSLQQRAQKRASYILRLEEISPWLAAMTNTEIALPGEVSARDTVTIHSVGGTITILPTKTKPKKLLFLGSDGKSYPYLFKGLEDLHLDERIMQFLSIVNTMFATINRQETPRFHARHYSVTPLGTRSGLIQWVDGATPLFGLYKRWQQREAALQAQKAQDSYQTPQNPGIVPRPSELYYSKIGPALKTVGLSLDVSRRDWPLHVMKAVLEELMEATPPNLLAKELWSSCTTPDEWWRVTQSYARSTAVMSMVGYIIGLGDRHLDNVLIDMTTGEVVHIDYNVCFEKGKSLRVPEKVPFRMTQNIETALGVTGVEGVFRLSCEQVLHIMRRGRETLLTLLEAFVYDPLVDWTAGGEAGFAGAVYGGGGQQAESKQSKREMEREITRSLFSSRVAEIKVNWFKNRDEMLVVLPKLDGSLDEYLSLQEQLTDVEKLQGKLLEEIEFLEGAEGVDHPSHTLQHRYSEHTQLQTQQRAVQEAIQVKLNEFEQWITHYQAAFNNLEATQLASLLQEISTQMDLGPPSYVPATAFLQNAGQAHLISQCEQLEGEVGALLQQRRSVLRGCLEQLHHYATVALQYPKAIFQKHRIEQWKTWMEELICNTTVERCQELYRKYEMQYAPQPPPTVCQFITATEMTLQRYAADINSRLIRQVERLKQEAVTVPVCEDQLKEIERCIKVFLHENGEEGSLSLASVIISALCTLTRRNLMMEGAASSAGEQLVDLTSRDGAWFLEELCSMSGNVTCLVQLLKQCHLVPQDLDIPNPMEASETVHLANGVYTSLQELNSNFRQIIFPEALRCLMKGEYTLESMLHELDGLIEQTTDGVPLQTLVESLQAYLRNAAMGLEEETHAHYIDVARLLHAQYGELIQPRNGSVDETPKMSAGQMLLVAFDGMFAQVETAFSLLVEKLNKMEIPIAWRKIDIIREARSTQVNFFDDDNHRQVLEEIFFLKRLQTIKEFFRLCGTFSRTLSGSSSLEDQNTVNGPVQIVNVKTLFRNSCFSEDQMAKPIKAFTADFVRQLLIGLPNQALGLTLCSFISALGVDIIAQVEAKDFGAESKVSVDDLCKKAVEHNIQIGKFSQLVMNRATVLASSYDTAWKKHDLVRRLETSISSCKTSLQRVQLHIAMFQWQHEDLLINRPQAMSVTPPPRSAILTSMKKKLHTLSQIETSIATVQEKLAALESSIEQRLKWAGGANPALAPVLQDFEATIAERRNLVLKESQRASQVTFLCSNIIHFESLRTRTAEALNLDAALFELIKRCQQMCSFASQFNSSVSELELRLLQRVDTGLEHPIGSSEWLLSAHKQLTQDMSTQRAIQTEKEQQIETVCETIQNLVDNIKTVLTGHNRQLGDVKHLLKAMAKDEEAALADGEDVPYENSVRQFLGEYKSWQDNIQTVLFTLVQAMGQVRSQEHVEMLQEITPTLKELKTQSQR

SEQ ID NO: 885200 - protein, 1274 aa, Homo sapiens
MKKLLPNMLSPDPRELQKSIEVQLLRSSVCLATALNPIEQDQKWQSITENVVKYLKQTSRIAIGPLRLSTLTVSQSLPVLSTLQLYCSSALENTVSNRLSTEDCLIPLFSEALRSCKQHDVRPWMQALRYTMYQNQLLEKIKEQTVPIRSHLMELGLTAAKFARKRGNVSLATRLLAQCSEVQLGKTTTAQDLVQHFKKLSTQGQVDEKWGPELDIEKTKLLYTAGQSTHAMEMLSSCAISFCKSVKAEYAVAKSILTLAKWIQAEWKEISGQLKQVYRAQHQQNFTGLSTLSKNILTLIELPSVNTMEEEYPRIESESTVHIGVGEPDFILGQLYHLSSVQAPEVAKSWAALASWAYRWGRKVVDNASQGEGVRLLPREKSEVQNLLPDTITEEEKERIYGILGQAVCRPAGIQDEDITLQITESEDNEEDDMVDVIWRQLISSCPWLSELDESATEGVIKVWRKVVDRIFSLYKLSCSAYFTFLKLNAGQIPLDEDDPRLHLSHRVEQSTDDMIVMATLRLLRLLVKHAGELRQYLEHGLETTPTAPWRGIIPQLFSRLNHPEVYVRQSICNLLCRVAQDSPHLILYPAIVGTISLSSESQASGNKFSTAIPTLLGNIQGEELLVSECEGGSPPASQDSNKDEPKSGLNEDQAMMQDCYSKIVDKLSSANPTMVLQVQMLVAELRRVTVLWDELWLGVLLQQHMYVLRRIQQLEDEVKRVQNNNTLRKEEKIAIMREKHTALMKPIVFALEHVRSITAAPAETPHEKWFQDNYGDAIENALEKLKTPLNPAKPGSSWIPFKEIMLSLQQRAQKRASYILRLEEISPWLAAMTNTEIALPGEVSARDTVTIHSVGGTITILPTKTKPKKLLFLGSDGKSYPYLFKGLEDLHLDERIMQFLSIVNTMFATINRQETPRFHARHYSVTPLGTRSGLIQWVDGATPLFGLYKRWQQREAALQAQKAQDSYQTPQNPGIVPRPSELYYSKIGPALKTVGLSLDVSRRDWPLHVMKAVLEELMEATPPNLLAKELWSSCTTPDEWWRVTQSYARSTAVMSMVGYIIGLGDRHLDNVLIDMTTGEVVHIDYNVCFEKGKSLRVPEKVPFRMTQNIETALGVTGVEGVFRLSCEQVLHIMRRGRETLLTLLEAFVYDPLVDWTAGGEAGFAGAVYGGGGQQAESKQSKREMEREITRSLFSSRVAEIKVKPSDGISHCLLFINRVNMLIKMLRQIVSLIFLAKLMYNIEMAVKYGSLRPACPTLVWATLNPVSTKNTNKT

SEQ ID NO: 885201 - protein, 887 aa, Homo sapiens
MKKLLPNMLSPDPRELQKSIEVQLLRSSVCLATALNPIEQDQKWQSITENVVKYLKQTSRIAIGPLRLSTLTVSQSLPVLSTLQLYCSSALENTVSNRLSTEDCLIPLFSEALRSCKQHDVRPWMQALRYTMYQNQLLEKIKEQTVPIRSHLMELGLTAAKFARKRGNVSLATRLLAQCSEVQLGKTTTAQDLVQHFKKLSTQGQVDEKWGPELDIEKTKLLYTAGQSTHAMEMLSSCAISFCKSVKAEYAVAKSILTLAKWIQAEWKEISGQLKQVYRAQHQQNFTGLSTLSKNILTLIELPSVNTMEEEYPRIESESTVHIGVGEPDFILGQLYHLSSVQAPEVAKSWAALASWAYRWGRKVVDNASQGEGVRLLPREKSEVQNLLPDTITEEEKERIYGILGQAVCRPAGIQDEDITLQITESEDNEEDDMVDVIWRQLISSCPWLSELDESATEGVIKVWRKVVDRIFSLYKLSCSAYFTFLKLNAGQIPLDEDDPRLHLSHRVEQSTDDMIVMATLRLLRLLVKHAGELRQYLEHGLETTPTAPWRGIIPQLFSRLNHPEVYVRQSICNLLCRVAQDSPHLILYPAIVGTISLSSESQASGNKFSTAIPTLLGNIQGEELLVSECEGGSPPASQDSNKDEPKSGLNEDQAMMQDCYSKIVDKLSSANPTMVLQVQMLVAELRRVTVLWDELWLGVLLQQHMYVLRRIQQLEDEVKRVQNNNTLRKEEKIAIMREKHTALMKPIVFALEHVRSITAAPAETPHEKWFQDNYGDAIENALEKLKTPLNPAKPGSSWIPFKEVQNNPKHATEMAHHSSHEIRNFNKWTSYLECKRFYKPIGGSLWPVAYKEHRKKCFCLRIWKSVGKGGWTAKVPNLSCMEGSHQ

SEQ ID NO: 885202 - protein, 965 aa, Homo sapiens
MKKLLPNMLSPDPRELQKSIEVQLLRSSVCLATALNPIEQDQKWQSITENVVKYLKQTSRIAIGPLRLSTLTVSQSLPVLSTLQLYCSSALENTVSNRLSTEDCLIPLFSEALRSCKQHDVRPWMQALRYTMYQNQLLEKIKEQTVPIRSHLMELGLTAAKFARKRGNVSLATRLLAQCSEVQLGKTTTAQDLVQHFKKLSTQGQVDEKWGPELDIEKTKLLYTAGQSTHAMEMLSSCAISFCKSVKAEYAVAKSILTLAKWIQAEWKEISGQLKQVYRAQHQQNFTGLSTLSKNILTLIELPSVNTMEEEYPRIESESTVHIGVGEPDFILGQLYHLSSVQAPEVAKSWAALASWAYRWGRKVVDNASQGEGVRLLPREKSEVQNLLPDTITEEEKERIYGILGQAVCRPAGIQDEDITLQITESEDNEEDDMVDVIWRQLISSCPWLSELDESATEGVIKVWRKVVDRIFSLYKLSCSAYFTFLKLNAGQIPLDEDDPRLHLSHRVEQSTDDMIVMATLRLLRLLVKHAGELRQYLEHGLETTPTAPWRGIIPQLFSRLNHPEVYVRQSICNLLCRVAQDSPHLILYPAIVGTISLSSESQASGNKFSTAIPTLLGNIQGEELLVSECEGGSPPASQDSNKDEPKSGLNEDQAMMQDCYSKIVDKLSSANPTMVLQVQMLVAELRRVTVLWDELWLGVLLQQHMYVLRRIQQLEDEVKRVQNNNTLRKEEKIAIMREKHTALMKPIVFALEHVRSITAAPAETPHEKWFQDNYGDAIENALEKLKTPLNPAKPGSSWIPFKEIMLSLQQRAQKRASYILRLEEISPWLAAMTNTEIALPGEVSARDTVTIHSVGGTITILPTKTKPKKLLFLGSDGKSYPYLFKGLEDLHLDERIMQFLSIVNTMFATINRQETPRFHARHYSVTPLGTRSGLIQWVDGATPLFGLYKRWQQREAALQAQKVD

SEQ ID NO: 885203 - protein, 692 aa, Homo sapiens
MKKLLPNMLSPDPRELQKSIEVQLLRSSVCLATALNPIEQDQKWQSITENVVKYLKQTSRIAIGPLRLSTLTVSQSLPVLSTLQLYCSSALENTVSNRLSTEDCLIPLFSEALRSCKQHDVRPWMQALRYTMYQNQLLEKIKEQTVPIRSHLMELGLTAAKFARKRGNVSLATRLLAQCSEVQLGKTTTAQDLVQHFKKLSTQGQVDEKWGPELDIEKTKLLYTAGQSTHAMEMLSSCAISFCKSVKAEYAVAKSILTLAKWIQAEWKEISGQLKQVYRAQHQQNFTGLSTLSKNILTLIELPSVNTMEEEYPRIESESTVHIGVGEPDFILGQLYHLSSVQAPEVAKSWAALASWAYRWGRKVVDNASQGEGVRLLPREKSEVQNLLPDTITEEEKERIYGILGQAVCRPAGIQDEDITLQITESEDNEEDDMVDVIWRQLISSCPWLSELDESATEGVIKVWRKVVDRIFSLYKLSCSAYFTFLKLNAGQIPLDEDDPRLHLSHRVEQSTDDMIVMATLRLLRLLVKHAGELRQYLEHGLETTPTAPWRGIIPQLFSRLNHPEVYVRQSICNLLCRVAQDSPHLILYPAIVGTISLSSESQASGNKFSTAIPTLLGNIQGEELLVSECEGGSPPASQDSNKDEPKSGLNEDQAMMQDCYSKIVDKLSSANPTMVLQVQRNSHVVEEFFIE

SEQ ID NO: 885204 - protein, 153 aa, Homo sapiens
MKKLLPNMLSPDPRELQKSIEVQLLRSSVCLATALNPIEQDQKWQSITENVVKYLKQTSRIAIGPLRLSTLTVSQSLPVLSTLQLYCSSALENTVSNRLSTEDCLIPLFSEALRSCKQHDVRPWMQALRYTMYQNQLLEKIKGKWFFFLVREN

SEQ ID NO: 885205 - protein, 133 aa, Homo sapiens
GAHPPRPHTETPGEKKREAWITKLLEELREAKENHTPEMKHFVGLEKKIKQMEMRHAQREQELQQIIQQTHQVVETEQNKEVEKWKRLAQLKNRELEKFRTELDSILDVLRELHRQGVVVPVAFADEMNAPEY

SEQ ID NO: 885206 - protein, 133 aa, Homo sapiens; identical to SEQ ID NO: 885205

SEQ ID NO: 885207 - protein, 120 aa, Homo sapiens
GGFLPEGLPNFLEDWGEPKENHTPEMKHFVGLEKKIKQMEMRHAQREQELQQIIQQTHQVVETEQNKEVEKWKRLAQLKNRELEKFRTELDSILDVLRELHRQGVVVPVAFADEMNAPEY

SEQ ID NO: 885208 - protein, 1327 aa, Homo sapiens
MEIEEESAEKIQFLKSSGTSLLSTDSLETNELVVSELNHSSLGVGLDTLEEQEEKEQFFARLEKGLTSSIDYSRLNKELDSNDSTHFKALHINQANAELTDDEHENESKHEELAENYSDDFEDEYVGAPLTTKDEEMPSKENSKSEKISVPKQEEEKTGMLANVVLLDSLDSVAEVNLDEQDKITPKPRCLPEMTENEMTGTGVSYGQSSSDVEALHQAYCHIAHSLGDEDKQKIESNTVEDIKSSVKGHPQENEENSKNISTMESDLPTVEELMKPIRIDSFGISGFDLQPVSSEKVAERKETEFFSSLPLKMNPNILSQDSQHVNLFFDKNDENVILQKTTNESMENSCPQVTEVTATEEHVDKMYLNILRKKITVNSSSLSQDDKINKTYRSQLSSEEEGAVMGKQVPYKKARSAPPLLKRKPQSGLYASVRSSGYGKPSSPLKMFSTLEKKTSEDIIKSKNLRSISTSNQPRKKEILSGTKLIKPAALDKPAHKTESCLSTRKKSENPTETDSCIQFQTDSLGYCGENKEKKLLMFKRVQEAEDKWRGAQALIEQIKATFSEKEKELENKLEELKKQQEKELFKLNQDNYILQAKLSSFEETNKKQRWLHFGEAADPVTGEKLKQIQKEIQEQETLLQGYQQENERLYNQVKDLQEQNKKNEERMFKENQSLFSEVASLKEQMHKSRFLSQVVEDSEPTRNQNFTDLLAELRMAQKEKDSLLEDIKRLKQDKQALEVDFEKMKKERDQAKDQIAYVTGEKLYEIKILEETHKQEISRLQKRLQWYAENQELLDKDALRLREANEEIEKLKLEIEKLKAESGNPSIRQKIRLKDKAADAKKIQDLERQVKEMEGILKRRYPNSLPALILAASAAGDTVDKNTVEFMEKRIKKLEADLEGKDEDAKKSLRTMEQQFQKMKIQYEQRLEQQEQLLACKLNQHDSPRIKALEKELDDIKEAHQITVRNLEAEIDVLKHQNAELDVKKNDKDDEDFQSIEFQVEQAHAKAKLVRLNEELAAKKREIQDLSKTVERLQKDRRMMLSNQNSKGREEMSAKRAKKDVLHSSKGNANSFPGTLDSKLYQPHTFTDSHVSEVLQENYRLKNELEGLISEKNELKMKSEAVMNQFENSMRRVKEDTAAHIASLKASHQREIEKLLCQNAVENSSSKVAELNRKIATQEVLIRHFQSQVNELQSKQESLVVSEVREEILQKEITKLLEELREAKENHTPEMKHFVGLEKKIKQMEMRHAQREQELQQIIQQTHQVVETEQNKEVEKWKRLAQLKNRELEKFRTELDSILDVLRELHRQGVVVPVAFADEMNAPEY

SEQ ID NO: 885209 - protein, 1403 aa, Homo sapiens
MANCSQEELDEEFEQFMKELSDDSFENSDKTARQSKKEMKKKDTVPWWITEDDFKDDGLLGTNVSYLKTKKTSQPVMEIEEESAEKIQFLKSSGTSLLSTDSLETNELVVSELNHSSLGVGLDTLEEQEEKEQFFARLEKGLTSSIDYSRLNKELDSNDSTHFKALHINQANAELTDDEHENESKHEELAENYSDDFEDEYVGAPLTTKDEEMPSKENSKSEKISVPKQEEEKTGMLANVVLLDSLDSVAEVNLDEQDKITPKPRCLPEMTENEMTGTGVSYGQSSSDVEALHQAYCHIAHSLGDEDKQKIESNTVEDIKSSVKGHPQENEENSKNISTMESDLPTVEELMKPIRIDSFGISGFDLQPVSSEKVAERKETEFFSSLPLKMNPNILSQDSQHVNLFFDKNDENVILQKTTNESMENSCPQVTEVTATEEHVDKMYLNILRKKITVNSSSLSQDDKINKTYRSQLSSEEEGAVMGKQVPYKKARSAPPLLKRKPQSGLYASVRSSGYGKPSSPLKMFSTLEKKTSEDIIKSKNLRSISTSNQPRKKEILSGTKLIKPAALDKPAHKTESCLSTRKKSENPTETDSCIQFQTDSLGYCGENKEKKLLMFKRVQEAEDKWRGAQALIEQIKATFSEKEKELENKLEELKKQQEKELFKLNQDNYILQAKLSSFEETNKKQRWLHFGEAADPVTGEKLKQIQKEIQEQETLLQGYQQENERLYNQVKDLQEQNKKNEERMFKENQSLFSEVASLKEQMHKSRFLSQVVEDSEPTRNQNFTDLLAELRMAQKEKDSLLEDIKRLKQDKQALEVDFEKMKKERDQAKDQIAYVTGEKLYEIKILEETHKQEISRLQKRLQWYAENQELLDKDALRLREANEEIEKLKLEIEKLKAESGNPSIRQKIRLKDKAADAKKIQDLERQVKEMEGILKRRYPNSLPALILAASAAGDTVDKNTVEFMEKRIKKLEADLEGKDEDAKKSLRTMEQQFQKMKIQYEQRLEQQEQLLACKLNQHDSPRIKALEKELDDIKEAHQITVRNLEAEIDVLKHQNAELDVKKNDKDDEDFQSIEFQVEQAHAKAKLVRLNEELAAKKREIQDLSKTVERLQKDRRMMLSNQNSKGREEMSAKRAKKDVLHSSKGNANSFPGTLDSKLYQPHTFTDSHVSEVLQENYRLKNELEGLISEKNELKMKSEAVMNQFENSMRRVKEDTAAHIASLKASHQREIEKLLCQNAVENSSSKVAELNRKIATQEVLIRHFQSQVNELQSKQESLVVSEVREEILQKEITKLLEELREAKENHTPEMKHFVGLEKKIKQMEMRHAQREQELQQIIQQTHQVVETEQNKEVEKWKRLAQLKNRELEKFRTELDSILDVLRELHRQGVVVPVAFADEMNAPEY

SEQ ID NO: 885210 - protein, 473 aa, Homo sapiens [sequence omitted]

SEQ ID NO: 885211 - protein, 149 aa, Homo sapiens
GTISSFQKGRARQMVSLRLSQVGSSPGFRLRTDAPAGTQARCFPSQASGPPPDSPLCSFPEAFPAKAAHLANGVVVGVLLVHRGRRDVEGAPPDLHLLLPVLGGRFCLVEACEAPVMPLIEAPSAHHRQPHLVRAVQDGPEGADGPLQH

SEQ ID NO: 885212 - protein, 149 aa, Homo sapiens; identical to SEQ ID NO: 885211

SEQ ID NO: 885213 - protein, 149 aa, Homo sapiens; identical to SEQ ID NO: 885211

SEQ ID NO: 885214 - protein, 111 aa, Homo sapiens
KNSEPQFEKVPEIMGVICAQLSIISQPRVRQQIINTVSLFISRPKYTDIVLSFLLCHPVPYNRHLAEVWRMLSVELPSTTWILWRLLRKLQKCHNEPAQEKMAYVAVAVSP

SEQ ID NO: 885215 - protein, 207 aa, Homo sapiens
MAPWAEAEHSALNPLRAVWLTLTAAFLLTLLLQLLPPGLLPGCAIFQDLIRYGKTKCGEPSRPAACRAFDVPKRYFSHFYIISVLWNGFLLWCLTQSLFLGAPFPSWLHGLLRILGAAQFQGVVIHCNHRIPFGDWFEYVSSPNYLAELMIYVSMAVTFGFHNLTWWLVVTNVFFNQALSAFLSHQFYKSKFVSYPKHRKAFLPFLF

SEQ ID NO: 885216 - protein, 318 aa, Homo sapiens
MAPWAEAEHSALNPLRAVWLTLTAAFLLTLLLQLLPPGLLPGCAIFQDLIRYGKTKCGEPSRPAACRAFDVPKRYFSHFYIISVLWNGFLLWCLTQSLFLGAPFPSWLHGLLRILGAAQFQGGELALSAFLVLVFLWLHSLRRLFECLYVSVFSNVMIHVVQYCFGLVYYVLVGLTVLSQVPMDGRNAYITGKNLLMQARWFHILGMMMFIWSSAHQYKCHVILGNLRKNKAGVVIHCNHRIPFGDWFEYVSSPNYLAELMIYVSMAVTFGFHNLTWWLVVTNVFFNQALSAFLSHQFYKSKFVSYPKHRKAFLPFLF

SEQ ID NO: 885217 - protein, 318 aa, Homo sapiens; identical to SEQ ID NO: 885216

SEQ ID NO: 885218 - protein, 318 aa, Homo sapiens; identical to SEQ ID NO: 885216

SEQ ID NO: 885219 - protein, 106 aa, Homo sapiens
MLSFDGHKLGYCSKVQTGITAAEPGGRTMSDHWQCCWKLYCPSEFSETLPVCRVFPSYCFIYQSYRCIGLQKQQHLCSPSSSPSLRQLLPSVLVGYFCCYCHFSKW

SEQ ID NO: 885220 - protein, 88 aa, Homo sapiens
TPLLEFFFPMFCFFQVKIISVNEDVTLRSALDRNLKSAVTAAFLMLPESFSEEDLFIEIAGLSYSDEKTEAQNGSLSKVTHLVHGGLV

SEQ ID NO: 885221 - protein, 406 aa, Homo sapiens
MALQTLQSSWVTFRKILSHFPEELSLAFVYGSGVYRQAGPSSDQKSYLTAASRTCWLPYPQSTFLQHGSLPFPVLPPVLPASLFNSRVLQDSDLSSLGEFLPPVPLIMIPMLSANAMLDFVFTVDDPVAWHSKNLKKNWSHYSFLKVLGPKIITSIQNNYGAGVYYNSLIMCNGRLIKYGVISTNVLIEDLLNWNNLYIAGRLQKPVKIISVNEDVTLRSALDRNLKSAVTAAFLMLPESFSEEDLFIEIAGLSYSGDFRMVVGEDKTKVLNIVKPNIAHFRELYGSILQENPQVVYKSQQGWLEIDKSPEGQFTQLMTLPKTLQQQINHIMDPPGKNRDVEETLFQVAHDPDCGDVVRLGLSAIVRPSSIRQSTKGIFTAGLKKSVIYSSLKLHKMWKGWLRKTS

SEQ ID NO: 885222 - protein, 452 aa, Homo sapiens
MALQTLQSSWVTFRKILSHFPEELSLAFVYGSGVYRQAGPSSDQKNAMLDFVFTVDDPVAWHSKNLKKNWSHYSFLKVLGPKIITSIQNNYGAGVYYNSLIMCNGRLIKYGVISTNVLIEDLLNWNNLYIAGRLQKPVKIISVNEDVTLRSALDRNLKSAVTAAFLMLPESFSEEDLFIEIAGLSYSGDFRMVVGEDKTKVLNIVKPNIAHFRELYGSILQENPQVVYKSQQGWLEIDKSPEGQFTQLMTLPKTLQQQINHIMDPPGKNRDVEETLFQVAHDPDCGDVVRLGLSAIVRPSSIRQSTKGIFTAGKSFGNPCVTYLLTEWLPHSWLQCKALYLLGACEMLSFDGHKLGYCSKVQTGITAAEPGGRTMSDHWQCCWKLYCPSEFSETLPVCRVFPSYCFIYQSYRCIGLQKQQHLCSPSSSPSLRQLLPSVLVGYFCCYCHFSKW

SEQ ID NO: 885223 - protein, 452 aa, Homo sapiens; identical to SEQ ID NO: 885222

SEQ ID NO: 885224 - protein, 204 aa, Homo sapiens
MALQTLQSSWVTFRKILSHFPEELSLAFVYGSGVYRQAGPSSDQKNAMLDFVFTVDDPVAWHSKNLKKNWSHYSFLKVLGPKIITSIQNNYGAGVYYNSLIMCNGRLIKYGVISTNVLIEDLLNWNNLYIAGRLQKPVKIISVNEDVTLRSALDRNLKSAVTAAFLMLPESFSEEDLFIEIAGLSYSEVSMVAAQMFYKGEIYI

SEQ ID NO: 885225 - protein, 316 aa, Homo sapiens
MALQTLQSSWVTFRKILSHFPEELSLAFVYGSGVYRQAGPSSDQKNAMLDFVFTVDDPVAWHSKNLKKNWSHYSFLKVLGPKIITSIQNNYGAGVYYNSLIMCNGRLIKYGVISTNVLIEDLLNWNNLYIAGRLQKPVKIISVNEDVTLRSALDRNLKSAVTAAFLMLPESFSEEDLFIEIAGLSYSGDFRMVVGEDKTKVLNIVKPNIAHFRELYGSILQENPQVVYKSQQGWLEIDKSPEGQFTQLMTLPKTLQQQINHIMDPPGKNRDVEETLFQVAHDPDCGDVVRLGLKKSVIYSSLKLHKMWKGWLRKTS

SEQ ID NO: 885226 - protein, 337 aa, Homo sapiens
MALQTLQSSWVTFRKILSHFPEELSLAFVYGSGVYRQAGPSSDQKNAMLDFVFTVDDPVAWHSKNLKKNWSHYSFLKVLGPKIITSIQNNYGAGVYYNSLIMCNGRLIKYGVISTNVLIEDLLNWNNLYIAGRLQKPVKIISVNEDVTLRSALDRNLKSAVTAAFLMLPESFSEEDLFIEIAGLSYSGDFRMVVGEDKTKVLNIVKPNIAHFRELYGSILQENPQVVYKSQQGWLEIDKSPEGQFTQLMTLPKTLQQQINHIMDPPGKNRDVEETLFQVAHDPDCGDVVRLGLSAIVRPSSIRQSTKGIFTAGLKKSVIYSSLKLHKMWKGWLRKTS

SEQ ID NO: 885227 - protein, 325 aa, Homo sapiens [sequence omitted]

SEQ ID NO: 885228 - protein, 200 aa, Homo sapiens
MALQTLQSSWVTFRKILSHFPEELSLAFVYGSGVYRQAGPSSDQKNAMLDFVFTVDDPVAWHSKNLKKNWSHYSFLKVLGPKIITSIQNNYGAGVYYNSLIMCNGRLIKYGVISTNVLIEDLLNWNNLYIAGRLQKPVKIISVNEDVTLRSALDRNLKSAVTAAFLMLPESFSEEDLFIEIAGLSYSVSVIRMVVGDLHV

SEQ ID NO: 885229 - protein, 151 aa, Homo sapiens
MALQTLQSSWVTFRKILSHFPEELSLAFVYGSGVYRQAGPSSDQKNAMLDFVFTVDDPVAWHSKNLKKNWSHYSFLKVLGPKIITSIQNNYGAGVYYNSLIMCNGRLIKYGVISTNVLIEDLLNWNNLYIAGRLQKPASLAVSQEFTGFSL

SEQ ID NO: 885230 - protein, 566 aa, Homo sapiens
MALSVPGYSPGFRKPPEVVRLRRKRARSRGAAASPPRELTEPAARRAALVAGLPLRPFPAAGGRGGGSGGGPAAARRNPFARLDNRPRVAAEPPDGPAREQPEAPVPFLDSNQENDLLWEEKFPERTTVTELPQTSHVSFSEPDIPSSKSTELPVDWSIKTRLLFTSSQPFTWADHLKAQEEAQGLVQHCRATEVTLPKSIQDPKLSSELRCTFQQSLIYWLHPALSWLPLFPRIGADRKMAGKTSPWSNDATLQHVLMSDWSVSFTSLYNLLKTKLCPYFYVCTYQFTVLFRAAGLAGSDLITALISPTTRGLREAMRNEGIEFSLPLIKESGHKKETASGTSLGYGEEQAISDEDEEESFSWLEEMGVQDKIKKPDILSIKLRKEKHEVQMDHRPESVVLVKGINTFTLLNFLINSKSLVATSGPQAGLPPTLLSPVAFRGATMQMLKARSVNVKTQALSGYRDQFSLEITGPIMPHSLHSLTMLLKSSQSGSFSAVLYPHEPTAVFNICLQMDKVLDMEVVHKELTNCGLHPNTLEQLSQIPLLGKSSLRNVVLRDYIYNWRS

SEQ ID NO: 885231 - protein, 566 aa, Homo sapiens; identical to SEQ ID NO: 885230

SEQ ID NO: 885232 - protein, 263 aa, Homo sapiens
MALSVPGYSPGFRKPPEVVRLRRKRARSRGAAASPPRELTEPAARRAALVAGLPLRPFPAAGGRGGGSGGGPAAARRNPFARLDNRPRVAAEPPDGPAREQPEAPVPFLDSNQENDLLWEEKFPERTTVTELPQTSHVSFSEPDIPSSKSTELPVDWSIKTRLLFTSSQPFTWADHLKAQEEAQGLVQHCRATEVTLPKSIQDPKLSSELRCTFQQSLIYWLHPALSWLPLFPRIGADRKMAGKTSPWSNDATLQHVLMSDWY

SEQ ID NO: 885233 - protein, 173 aa, Homo sapiens
CPGGRRGSSEQPEAPVPFLDSNQENDLLWEEKFPERTTVTELPQTSHVSFSEPDIPSSKSTELPVDWSIKTRLLFTSSQPFTWADHLKAQEEAQGLVQHCRATEVTLPKSIQDPKLSSELRCTFQQSLIYWLHPALSWLPLFPRIGADRKMAGKTSPWSNDATLQHVLMSDWY

SEQ ID NO: 885234 - protein, 552 aa, Homo sapiens
MALSVPGYSPGFRKPPEVVRLRRKRARSRGAAASPPRELTEPAARRAALVAGLPLRPFPAAGGRGGGSGGGPAAARRNPFARLDNRPRVAAEPPDGPAREQPEAPVPFLDSNQENDLLWEEKFPERTTVTELPQTSHVSFSEPDIPSSKSTELPVDWSIKTRLLFTSSQPFTWADHLKAQEEAQGLVQHCRATEVTLPKSIQSLIYWLHPALSWLPLFPRIGADRKMAGKTSPWSNDATLQHVLMSDWSVSFTSLYNLLKTKLCPYFYVCTYQFTVLFRAAGLAGSDLITALISPTTRGLREAMRNEGIEFSLPLIKESGHKKETASGTSLGYGEEQAISDEDEEESFSWLEEMGVQDKIKKPDILSIKLRKEKHEVQMDHRPESVVLVKGINTFTLLNFLINSKSLVATSGPQAGLPPTLLSPVAFRGATMQMLKARSVNVKTQALSGYRDQFSLEITGPIMPHSLHSLTMLLKSSQSGSFSAVLYPHEPTAVFNICLQMDKVLDMEVVHKELTNCGLHPNTLEQLSQIPLLGKSSLRNVVLRDYIYNWRS

SEQ ID NO: 885235 - protein, 265 aa, Homo sapiens
MALSVPGYSPGFRKPPEVVRLRRKRARSRGAAASPPRELTEPAARRAALVAGLPLRPFPAAGGRGGGSGGGPAAARRNPFARLDNRPRVAAEPPDGPAREQPEAPVPFLDSNQENDLLWEEKFPERTTVTELPQTSHVSFSEPDIPSSKSTELPVDWSIKTRLLFTSSQPFTWADHLKAQEEAQGLVQHCRATEVTLPKSIQDPKLSSELRCTFQQSLIYWLHPALSWLPLFPRIGADRKMAGKTSPWSNDATLQHVLMSDWHGV

SEQ ID NO: 885236 - protein, 136 aa, Homo sapiens
MALSVPGYSPGFRKPPEVVRLRRKRARSRGAAASPPRELTEPAARRAALVAGLPLRPFPAAGGRGGGSGGGPAAARRNPFARLDNRPRVAAEPPDGPAREQPEAPVPFLDSNQENDLLWEEKFPERTTVTELPQII

SEQ ID NO: 885237 - protein, 566 aa, Homo sapiens; identical to SEQ ID NO: 885230

SEQ ID NO: 885238 - protein, 133 aa, Homo sapiens
KRLRDDLNFPFLYIFMKARSVNVKTQALSGYRDQFSLEITGPIMPHSLHSLTMLLKSSQSGSFSAVLYPHEPTAVFNICLQMDKVLDMEVVHKELTNCGLHPNTLEQLSQIPLLGKSSLRNVVLRDYIYNWRS

SEQ ID NO: 885239 - protein, 457 aa, Homo sapiens
MALSVPGYSPGFRKPPEVVRLRRKRARSRGAAASPPRELTEPAARRAALVAGLPLRPFPAAGGRGGGSGGGPAAARRNPFARLDNRPRVAAEPPDGPAREQPEAPVPFLDSNQENDLLWEEKFPERTTVTELPQTSHVSFSEPDIPSSKSTELPVDWSIKTRLLFTSSQPFTWADHLKAQEEAQGLVQHCRATEVTLPKSIQDPKLSSELRCTFQQSLIYWLHPALSWLPLFPRIGADRKMAGKTSPWSNDATLQHVLMSDWSVSFTSLYNLLKTKLCPYFYVCTYQFTVLFRAAGLAGSDLITALISPTTRGLREAMRNEGIEFSLPLIKESGHKKETASGTSLGYGEEQAISDEDEEESFSWLEEMGVQDKIKKPDILSIKLRKEKHEVQMDHRPESVVLVKGINTFTLLNFLINSKSLVATSGPQAGLPPTLLSPVAFRGATMQMLKVIKVCIT

SEQ ID NO: 885240 - protein, 67 aa, Homo sapiens
APLATPLRAVLTGRVPEESEGAPEGSEEPLGEDLEVTWKRARKTLRAPILQGRCSMGQVTSPASPVI

SEQ ID NO: 885241 - protein, 67 aa, Homo sapiens; identical to SEQ ID NO: 885240

SEQ ID NO: 885242 - protein, 67 aa, Homo sapiens; identical to SEQ ID NO: 885240

SEQ ID NO: 885243 - protein, 539 aa, Homo sapiens
MALSVPGYSPGFRKPPEVVRLRRKRARSRGAAASPPRELTEPAARRAALVAGLPLRPFPAAGGRGGGSGGGPAAARRNPFARLDNRPRVAAEPPDGPAREQPEAPVPTSHVSFSEPDIPSSKSTELPVDWSIKTRLLFTSSQPFTWADHLKAQEEAQGLVQHCRATEVTLPKSIQDPKLSSELRCTFQQSLIYWLHPALSWLPLFPRIGADRKMAGKTSPWSNDATLQHVLMSDWSVSFTSLYNLLKTKLCPYFYVCTYQFTVLFRAAGLAGSDLITALISPTTRGLREAMRNEGIEFSLPLIKESGHKKETASGTSLGYGEEQAISDEDEEESFSWLEEMGVQDKIKKPDILSIKLRKEKHEVQMDHRPESVVLVKGINTFTLLNFLINSKSLVATSGPQAGLPPTLLSPVAFRGATMQMLKARSVNVKTQALSGYRDQFSLEITGPIMPHSLHSLTMLLKSSQSGSFSAVLYPHEPTAVFNICLQMDKVLDMEVVHKELTNCGLHPNTLEQLSQIPLLGKSSLRNVVLRDYIYNWRS

SEQ ID NO: 885244 - protein, 479 aa, Homo sapiens
MALSVPGYSPGFRKPPEVVRLRRKRARSRGAAASPPRELTEPAARRAALVAGLPLRPFPAAGGRGGGSGGGPAAARRNPFARLDNRPRVAAEPPDGPAREQPEAPVPFLDSNQENDLLWEEKFPERTTVTELPQTSHVSFSEPDIPSSKSTELPVDWSIKTRLLFTSSQPFTWADHLKAQEEAQGLVQHCRATEVTLPKSIQDPKLSSELRCTFQQSLIYWLHPALSWLPLFPRIGADRKMAGKTSPWSNDATLQHVLMSDWEQAISDEDEEESFSWLEEMGVQDKIKKPDILSIKLRKEKHEVQMDHRPESVVLVKGINTFTLLNFLINSKSLVATSGPQAGLPPTLLSPVAFRGATMQMLKARSVNVKTQALSGYRDQFSLEITGPIMPHSLHSLTMLLKSSQSGSFSAVLYPHEPTAVFNICLQMDKVLDMEVVHKELTNCGLHPNTLEQLSQIPLLGKSSLRNVVLRDYIYNWRS

SEQ ID NO: 885245 - protein, 566 aa, Homo sapiens; identical to SEQ ID NO: 885230

SEQ ID NO: 885246 - protein, 566 aa, Homo sapiens; identical to SEQ ID NO: 885230

SEQ ID NO: 885247 - protein, 552 aa, Homo sapiens; identical to SEQ ID NO: 885234

SEQ ID NO: 885248 - protein, 302 aa, Homo sapiens
PLLGLGVWASNKLVLQTWAKEPEAMQWLRVRESPGEATGHRVTMGTAALGPVWAALLLFLLMCEIPMVELTFDRAVASGCQRCCDSEDPLDPAHVSSASSSGRPHALPEIRPYINITILKGDKGDPGPMGLPGYMGREGPQGEPGPQGSKGDKGEMGSPGAPCQKRFFAFSVGRKTALHSGEDFQTLLFERVFVNLDGCFDMATGQFAAPLRGIYFFSLNVHSWNYKETYVHIMHNQKEAVILYAQPSERSIMQSQSVMLDLAYGDRVWVRLFKRQRENAIYSNDFDTYITFSGHLIKAEDD

SEQ ID NO: 885249 - protein, 259 aa, Homo sapiens
MGTAALGPVWAALLLFLLMCEIPMVELTFDRAVASGCQRCCDSEDPLDPAHVSSASSSGRPHALPEIRPYINITILKGDKGDPGPMGLPGYMGREGPQGEPGPQGSKGDKGEMGSPGAPCQKRFFAFSVGRKTALHSGEDFQTLLFERVFVNLDGCFDMATGQFAAPLRGIYFFSLNVHSWNYKETYVHIMHNQKEAVILYAQPSERSIMQSQSVMLDLAYGDRVWVRLFKRQRENAIYSNDFDTYITFSGHLIKAEDD

SEQ ID NO: 885250 - protein, 259 aa, Homo sapiens; identical to SEQ ID NO: 885249

SEQ ID NO: 885251 - protein, 359 aa, Homo sapiens
PLLGLGVWASNKLVLQTWAKEPEAMQWLRVRESPGEATGHRVTMGTAALGPVWAALLLFLLMCEIPMVELTFDRAVASGCQRCCDSEDPLDPAHVSSASSSGRPHALPEIRPYINITILKAQRAQHHAEPECDAGPGLRGPRLGAALQAPARERHLQQRLRHLHHLQRPPHQGRGRLRASGPPSRLESSADTASCEKTCPPHWDPLPASSQGSARALLSPFHQSHLNFRFPRASSCPQTLMSVPRCSLPLMPLSPAQCPDSPGFIKVLRPGWAAPRLRALLRPGAAFTNTCRRRATEAPGFRALSRSGELEQRRDLRPSVSSSRVGWPGVPLAFQTQVACPSPQREAASAHWCSCRLWG

SEQ ID NO: 885252 - protein, 180 aa, Homo sapiens [sequence omitted]

SEQ ID NO: 885253 - protein, 259 aa, Homo sapiens; identical to SEQ ID NO: 885249

SEQ ID NO: 885254 - protein, 259 aa, Homo sapiens; identical to SEQ ID NO: 885249

SEQ ID NO: 885255 - protein, 259 aa, Homo sapiens; identical to SEQ ID NO: 885249

SEQ ID NO: 885256 - protein, 259 aa, Homo sapiens; identical to SEQ ID NO: 885249

SEQ ID NO: 885257 - protein, 116 aa, Homo sapiens
MEIAAEPSLYSVDSRTRLANSFCLFCFLVAKGYKSLPPTPPPIALCAIIFQGDLAFEVPAICSAGLYFAGCESTAFPECLLFYPTWLLIALPVRGKESCAVAPLKPSPCCLPQKAT

SEQ ID NO: 885258 - protein, 1235 aa, Homo sapiens
MRSRSNSGVRLDGYARLVQQTILCYQNPVTGLLSASHEQKDAWVRDNIYSILAVWGLGMAYRKNADRDEDKAKAYELEQNVVKLMRGLLQCMMRQVAKVEKFKHTQSTKDSLHAKYNTATCGTVVGDDQWGHLQVDATSLFLLFLAQMTASGLRIIFTLDEVAFIQNLVFYIEAAYKVADYGMWERGDKTNQGIPELNASSVGMAKAALEAIDELDLFGAHGGRKSVIHVLPDEVEHCQSILFSMLPRASTSKEIDAGLLSIISFPAFAVEDVNLVNVTKNEIISKLQGRYGCCRFLRDGYKTPREDPNRLHYDPAELKLFENIECEWPVFWTYFIIDGVFSGDAVQVQEYREALEGILIRGKNGIRLVPELYAVPPNKVDEEYKNPHTVDRVPMGKVPHLWGQSLYILSSLLAEGFLAAGEIDPLNRRFSTSVKPDVVVQVTVLAENNHIKDLLRKHGVNVQSIADIHPIQVQPGRILSHIYAKLGRNKNMNLSGRPYRHIGVLGTSKLYVIRNQIFTFTPQFTDQHHFYLALDNEMIVEMLRIELAYLCTCWRMTGRPTLTFPISRTMLTNDGSDIHSAVLSTIRKLEDGYFGGARVKLGNLSEFLTTSFYTYLTFLDPDCDEKLFDNASEGTFSPDSDSDLVGYLEDTCNQESQDELDHYINHLLQSTSLRSYLPPLCKNTEDRHVFSAIHSTRDILSVMAKAKGLEVPFVPMTLPTKVLSAHRKSLNLVDSPQPLLEKVPESDFQWPRDDHGDVDCEKLVEQLKDCSNLQDQADILYILYVIKGPSWDTNLSGQHGVTVQNLLGELYGKAGLNQEWGLIRYISGLLRKKVEVLAEACTDLLSHQKQLTVGLPPEPREKIISAPLPPEELTKLIYEASGQDISIAVLTQEIVVYLAMYVRAQPSLFVEMLRLRIGLIIQVMATELARSLNCSGEEASESLMNLSPFDMKNLLHHILSGKEFGVERSVRPIHSSTSSPTISIHEVGHTGVTKTERSGINRLRSEMKQMTRRFSADEQFFSVGQAASSSAHSSKSARSSTPSSPTGTSSSDSGGHHIGWGERQGQWLRRRRLDGAINRVPVGFYQRVWKILQKCHGLSIDGYVLPSSTTREMTPHEIKFAVHVESVLNRVPQPEYRQLLVEAIMVLTLLSDTEMTSIGGIIHVDQIVQMASQLFLQDQVSIGAMDTLEKDQATGICHFFYDSAPSGAYGTMTYLTRAVASYLQELLPNSGCQMQ

SEQ ID NO: 885259 - protein, 1235 aa, Homo sapiens; identical to SEQ ID NO: 885258

SEQ ID NO: 885260 - protein, 1275 aa, Homo sapiens
MRSRSNSGVRLDGYARLVQQTILCYQNPVTGLLSASHEQKDAWVRDNIYSILAVWGLGMAYRKNADRDEDKAKAYELEQNVVKLMRGLLQCMMRQVAKVEKFKHTQSTKDSLHAKYNTATCGTVVGDDQWGHLQVDATSLFLLFLAQMTASGLRIIFTLDEVAFIQNLVFYIEAAYKVADYGMWERGDKTNQGIPELNASSVGMAKAALEAIDELDLFGAHGGRKSVIHVLPDEVEHCQSILFSMLPRASTSKEIDAGLLSIISFPAFAVEDVNLVNVTKNEIISKLQGRYGCCRFLRDGYKTPREDPNRLHYDPAELKLFENIECEWPVFWTYFIIDGVFSGDAVQVQEYREALEGILIRGKNGIRLVPELYAVPPNKVDEEYKNPHTVDRVPMGKVPHLWGQSLYILSSLLAEGFLAAGEIDPLNRRFSTSVKPDVVVQVTVLAENNHIKDLLRKHGVNVQSIADIHPIQVQPGRILSHIYAKLGRNKNMNLSGRPYRHIGVLGTSKLYVIRNQIFTFTPQFTDQHHFYLALDNEMIVEMLRIELAYLCTCWRMTGRPTLTFPISRTMLTNDGSDIHSAVLSTIRKLEDGYFGGARVKLGNLSEFLTTSFYTYLTFLDPDCDEKLFDNASEGTFSPDSDSDLVGYLEDTCNQESQDELDHYINHLLQSTSLRSYLPPLCKNTEDRHVFSAIHSTRDILSVMAKAKGLEVPFVPMTLPTKVLSAHRKSLNLVDSPQPLLEKVPESDFQWPRDDHGDVDCEKLVEQLKDCSNLQDQADILYILYVIKGPSWDTNLSGQHGVTVQNLLGELYGKAGLNQEWGLIRYISGLLRKKVEVLAEACTDLLSHQKQLTVGLPPEPREKIISAPLPPEELTKLIYEASGQDISIAVLTQEIVVYLAMYVRAQPSLFVEMLRLRIGLIIQVMATELARSLNCSGEEASESLMNLSPFDMKNLLHHILSGKEFGVERSDTRSHHAAQAGLELLGSSSLPTSASQSAGITGVSHRCLASVRPIHSSTSSPTISIHEVGHTGVTKTERSGINRLRSEMKQMTRRFSADEQFFSVGQAASSSAHSSKSARSSTPSSPTGTSSSDSGGHHIGWGERQGQWLRRRRLDGAINRVPVGFYQRVWKILQKCHGLSIDGYVLPSSTTREMTPHEIKFAVHVESVLNRVPQPEYRQLLVEAIMVLTLLSDTEMTSIGGIIHVDQIVQMASQLFLQDQVSIGAMDTLEKDQATGICHFFYDSAPSGAYGTMTYLTRAVASYLQELLPNSGCQMQ

SEQ ID NO: 885261 - protein, 1217 aa, Homo sapiens
MRSRSNSGVRLDGYARLVQQTILCYQNPVTGLLSASHEQKDAWVRDNIYSILAVWGLGMAYRKNADRDEDKAKAYELEQNVVKLMRGLLQCMMRQVAKVEKFKHTQSTKDSLHAKYNTATCGTVVGDDQWGHLQVDATSLFLLFLAQMTASGLRIIFTLDEVAFIQNLVFYIEAAYKVADYGMWERGDKTNQGIPELNASSVGMAKAALEAIDELDLFGAHGGRKSVIHVLPDEVEHCQSILFSMLPRASTSKEIDAGLLSIISFPAFAVEDVNLVNVTKNEIISKLQGRYGCCRFLRDGYKTPREDPNRLHYDPAELKLFENIECEWPVFWTYFIIDGVFSGDAVQVQEYREALEGILIRGKNGIRLVPELYAVPPNKVDEEYKNPHTVDRVPMGKVPHLWGQSLYILSSLLAEGFLAAGEIDPLNRRFSTSVKPDVVVQVTVLAENNHIKDLLRKHGVNVQSIADIHPIQVQPGRILSHIYAKLGRNKNMNLSGRPYRHIGVLGTSKLYVIRNQIFTFTPQFTDQHHFYLALDNEMIVEMLRIELAYLCTCWRMTGRPTLTFPISRTMLTNDGSDIHSAVLSTIRKLEDGYFGGARVKLGNLSEFLTTSFYTYLTFLDPDCDEKLFDNASEGTFSPDSDSDLVGYLEDTCNQESQDELDHYINHLLQSTSLRSYLPPLCKNTEDRHVFSAIHSTRDILSVMAKAKGLEVPFVPMTLPTKVLSAHRKSLNLVDSPQPLLEKVPESDFQWPRDDHGDVDCEKLVEQLKDCSNLQDQADILYILYVIKGPSWDTNLSGQHGVTVQNLLGELYGKAGLNQEWGLIRYISGLLRKKVEVLAEACTDLLSHQKQLTVGLPPEPREKIISASPQPWGPQEIVVYLAMYVRAQPSLFVEMLRLRIGLIIQVMATELARSLNCSGEEASESLMNLSPFDMKNLLHHILSGKEFGVERSVRPIHSSTSSPTISIHEVGHTGVTKTERSGINRLRSEMKQMTRRFSADEQFFSVGQAASSSAHSSKSARSSTPSSPTGTSSSDSGGHHIGWGERQGQWLRRRRLDGAINRVPVGFYQRVWKILQKCHGLSIDGYVLPSSTTREMTPHEIKFAVHVESVLNRVPQPEYRQLLVEAIMVLTLLSDTEMTSIGGIIHVDQIVQMASQLFLQDQVSIGAMDTLEKDQATGICHFFYDSAPSGAYGTMTYLTRAVASYLQELLPNSGCQMQ

SEQ ID NO: 885262 - protein, 894 aa, Homo sapiens
MVRGLGVQEYREALEGILIRGKNGIRLVPELYAVPPNKVDEEYKNPHTVDRVPMGKVPHLWGQSLYILSSLLAEGFLAAGEIDPLNRRFSTSVKPDVVVQVTVLAENNHIKDLLRKHGVNVQSIADIHPIQVQPGRILSHIYAKLGRNKNMNLSGRPYRHIGVLGTSKLYVIRNQIFTFTPQFTDQHHFYLALDNEMIVEMLRIELAYLCTCWRMTGRPTLTFPISRTMLTNDGSDIHSAVLSTIRKLEDGYFGGARVKLGNLSEFLTTSFYTYLTFLDPDCDEKLFDNASEGTFSPDSDSDLVGYLEDTCNQESQDELDHYINHLLQSTSLRSYLPPLCKNTEDRHVFSAIHSTRDILSVMAKAKGLEVPFVPMTLPTKVLSAHRKSLNLVDSPQPLLEKVPESDFQWPRDDHGDVDCEKLVEQLKDCSNLQDQADILYILYVIKGPSWDTNLSGQHGVTVQNLLGELYGKAGLNQEWGLIRYISGLLRKKVEVLAEACTDLLSHQKQLTVGLPPEPREKIISAPLPPEELTKLIYEASGQDISIAVLTQEIVVYLAMYVRAQPSLFVEMLRLRIGLIIQVMATELARSLNCSGEEASESLMNLSPFDMKNLLHHILSGKEFGVERSVRPIHSSTSSPTISIHEVGHTGVTKTERSGINRLRSEMKQMTRRFSADEQFFSVGQAASSSAHSSKSARSSTPSSPTGTSSSDSGGHHIGWGERQGQWLRRRRLDGAINRVPVGFYQRVWKILQKCHGLSIDGYVLPSSTTREMTPHEIKFAVHVESVLNRVPQPEYRQLLVEAIMVLTLLSDTEMTSIGGIIHVDQIVQMASQLFLQDQVSIGAMDTLEKDQATGICHFFYDSAPSGAYGTMTYLTRAVASYLQELLPNSGCQMQ

SEQ ID NO: 885263 - protein, 1238 aa, Homo sapiens
MRSRSNSGVRLDGYARLVQQTILCYQNPVTGLLSASHEQKDAWVRDNIYSILAVWGLGMAYRKNADRDEDKAKAYELEQNVVKLMRGLLQCMMRQVAKVEKFKHTQSTKDSLHAKYNTATCGTVVGDDQWGHLQVDATSLFLLFLAQMTASGLRIIFTLDEVAFIQNLVFYIEAAYKVADYGMWERGDKTNQGIPELNASSVGMAKAALEAIDELDLFGAHGGRKSVIHVLPDEVEHCQSILFSMLPRASTSKEIDAGLLSIISFPAFAVEDVNLVNVTKNEIISKLQGRYGCCRFLRDGYKTPREDPNRLHYDPAELKLFENIECEWPVFWTYFIIDGVFSGDAVQVQEYREALEGILIRGKNGIRLVPELYAVPPNKVDEEYKNPHTVDRVPMGKVPHLWGQSLYILSSLLAEGFLAAGEIDPLNRRFSTSVKPDVVVQVTVLAENNHIKDLLRKHGVNVQSIADIHPIQVQPGRILSHIYAKLGRNKNMNLSGRPYRHIGVLGTSKLYVIRNQIFTFTPQFTDQHHFYLALDNEMIVEMLRIELAYLCTCWRMTGRPTLTFPISRTMLTNDGSDIHSAVLSTIRKLEDGYFGGARVKLGNLSEFLTTSFYTYLTFLDPDCDEKLFDNASEGTFSPDSDSDLVGYLEDTCNQESQDELDHYINHLLQSTSLRSYLPPLCKNTEDRHVFSAIHSTRDILSVMAKAKGLEVPFVPMTLPTKVLSAHRKSLNLVDSPQPLLEKVPESDFQWPRDDHGDVDCEKLVEQLKDCSNLQDQADILYILYVIKGPSWDTNLSGQHGVTVQNLLGELYGKAGLNQEWGLIRYISGLLRKKVEVLAEACTDLLSHQKQLTVGLPPEPREKIISAPLPPEELTKLIYEASGQDISIAVLTQEIVVYLAMYVRAQPSLFVEMLRLRIGLIIQVMATELARSLNCSGEEASESLMNLSPFDMKNLLHHILSGKEFGVERSDTRSHHAAQAGLELLGSSSLPTSASQSAGITVRPIHSSTSSPTISIHEVGHTGVTKTERSGINRLRSEMKQRSSTPSSPTGTSSSDSGGHHIGWGERQGQWLRRRRLDGAINRVPVGFYQRVWKILQKCHGLSIDGYVLPSSTTREMTPHEIKFAVHVESVLNRVPQPEYRQLLVEAIMVLTLLSDTEMTSIGGIIHVDQIVQMASQLFLQDQVSIGAMDTLEKDQATGICHFFYDSAPSGAYGTMTYLTRAVASYLQELLPNSGCQMQ

SEQ ID NO: 885264 - protein, 1207 aa, Homo sapiens
MRSRSNSGVRLDGYARLVQQTILCYQNPVTGLLSASHEQKDAWVRDNIYSILAVWGLGMAYRKNADRDEDKAKAYELEQNVVKLMRGLLQCMMRQVAKVEKFKHTQSTKDSLHAKYNTATCGTVVGDDQWGHLQVDATSLFLLFLAQMTASGLRIIFTLDEVAFIQNLVFYIEAAYKVADYGMWERGDKTNQGIPELNASSVGMAKAALEAIDELDLFGAHGGRKSVIHVLPDEVEHCQSILFSMLPRASTSKEIDAGLLSIISFPAFAVEDVNLVNVTKNEIISKLQGRYGCCRFLRDGYKTPREDPNRLHYDPAELKLFENIECEWPVFWTYFIIDGVFSGDAVQVQEYREALEGILIRGKNGIRLVPELYAVPPNKVDEEYKNPHTVDRVPMGKVPHLWGQSLYILSSLLAEGFLAAGEIDPLNRRFSTSVKPDVVVQVTVLAENNHIKDLLRKHGVNVQSIADIHPIQVQPGRILSHIYAKLGRNKNMNLSGRPYRHIGVLGTSKLYVIRNQIFTFTPQFTDQHHFYLALDNEMIVEMLRIELAYLCTCWRMTGRPTLTFPISRTMLTNDGSDIHSAVLSTIRKLEDGYFGGARVKLGNLSEFLTTSFYTYLTFLDPDCDEKLFDNASEGTFSPDSDSDLVGYLEDTCNQESQDELDHYINHLLQSTSLRSYLPPLCKNTEDRHVFSAIHSTRDILSVMAKAKGLEVPFVPMTLPTKVLSAHRKSLNLVDSPQPLLEKVPESDFQWPRDDHGDVDCEKLVEQLKDCSNLQDQADILYILYVIKGPSWDTNLSGQHGVTVQNLLGELYGKAGLNQEWGLIRYISGLLRKKVEVLAEACTDLLSHQKQLTVGLPPEPREKIISAPLPPEELTKLIYEASGQDISIAVLTQEIVVYLAMYVRAQPSLFVEMLRLRIGLIIQVMATELARSLNCSGEEASESLMNLSPFDMKNLLHHILSGKEFGVERSVRPIHSSTSSPTISIHEVGHTGVTKTERSGINRLRSEMKQRSSTPSSPTGTSSSDSGGHHIGWGERQGQWLRRRRLDGAINRVPVGFYQRVWKILQKCHGLSIDGYVLPSSTTREMTPHEIKFAVHVESVLNRVPQPEYRQLLVEAIMVLTLLSDTEMTSIGGIIHVDQIVQMASQLFLQDQVSIGAMDTLEKDQATGICHFFYDSAPSGAYGTMTYLTRAVASYLQELLPNSGCQMQ

SEQ ID NO: 885265 - protein, 123 aa, Homo sapiens [sequence omitted]

SEQ ID NO: 885266 - protein, 321 aa, Homo sapiens
VLCLRISHRGHGPSHGGMNCSGEEASESLMNLSPFDMKNLLHHILSGKEFGVERSVRPIHSSTSSPTISIHEVGHTGVTKTERSGINRLRSEMKQMTRRFSADEQFFSVGQAASSSAHSSKSARSSTPSSPTGTSSSDSGGHHIGWGERQGQWLRRRRLDGAINRVPVGFYQRVWKILQKCHGLSIDGYVLPSSTTREMTPHEIKFAVHVESVLNRVPQPEYRQLLVEAIMVLTLLSDTEMTSIGGIIHVDQIVQMASQLFLQDQVSIGAMDTLEKDQATGICHFFYDSAPSGAYGTMTYLTRAVASYLQELLPNSGCQMQ

SEQ ID NO: 885267 - protein, 226 aa, Homo sapiens
MTRRFSADEQFFSVGQAASSSAHSSKSARSSTPSSPTGTSSSDSGGHHIGWGERQGQWLRRRRLDGAINRVPVGFYQRVWKILQKCHGLSIDGYVLPSSTTREMTPHEIKFAVHVESVLNRVPQPEYRQLLVEAIMVLTLLSDTEMTSIGGIIHVDQIVQMASQLFLQDQVSIGAMDTLEKDQATGICHFFYDSAPSGAYGTMTYLTRAVASYLQELLPNSGCQMQ

SEQ ID NO: 885268 - protein, 1181 aa, Homo sapiens
MRSRSNSGVRLDGYARLVQQTILCYQNPVTGLLSASHEQKDAWVRDNIYSILAVWGLGMAYRKNADRDEDKAKAYELEQNVVKLMRGLLQCMMRQVAKVEKFKHTQSTKDSLHAKYNTATCGTVVGDDQWGHLQVDATSLFLLFLAQMTASGLRIIFTLDEVAFIQNLVFYIEAAYKVADYGMWERGDKTNQGIPELNASSVGMAKAALEAIDELDLFGAHGGRKSVIHVLPDEVEHCQSILFSMLPRASTSKEIDAGLLSIISFPAFAVEDVNLVNVTKNEIISKLQGRYGCCRFLRDGYKTPREDPNRLHYDPAELKLFENIECEWPVFWTYFIIDGVFSGDAVQVQEYREALEGILIRGKNGIRLVPELYAVPPNKVDEEYKNPHTVDRVPMGKVPHLWGQSLYILSSLLAEGFLAAGEIDPLNRRFSTSVKPDVVVQVTVLAENNHIKDLLRKHGVNVQSIADIHPIQVQPGRILSHIYAKLGRNKNMNLSGRPYRHIGVLGTSKLYVIRNQIFTFTPQFTDQHHFYLALDNEMIVEMLRIELAYLCTCWRMTGRPTLTFPISRTMLTNDGSDIHSAVLSTIRKLEDGYFGGARVKLGNLSEFLTTSFYTYLTFLDPDCDEKLFDNASEGTFSPDSDSDLVGYLEDTCNQESQDELDHYINHLLQSTSLRSYLPPLCKNTEDRHVFSAIHSTRDILSVMAKAKGLEVPFVPMTLPTKVLSAHRKSLNLVDSPQPLLEKVPESDFQWPRDDHGDVDCEKLVEQLKDCSNLQDQADILYILYVIKGPSWDTNLSGQHGVTVQNLLGELYGKAGLNQEWGLIRYISGLLRKKVEVLAEACTDLLSHQKQLTVGLPPEPREKIISAPLPPEELTKLIYEASGQDISIAVLTQEIVVYLAMYVRAQPSLFVEMLRLRIGLIIQVMATELARSLNCSGEEASESLMNLSPFDMKNLLHHILSGKEFGVERSVRPIHSSTSSPTISIHEVGHTGVTKTERSGINRLRSEMKQMTRRFSADEQFFSVGQAASSSAHSSKSARSSTPSSPTGTSSSDSGGHHIGWGERQGQWLRRRRLDGAINRVPVGFYQRVWKILQKCHGLSIDGYVLPSSTTREMTPHEIKFAVHVESVLNRAARCNRVSPGNMITLSICHVPPSLTGNLLSPKIPCAIRKACPIRNTLGGQW

SEQ ID NO: 885269 - protein, 123 aa, Homo sapiens [sequence omitted]

SEQ ID NO: 885270 - protein, 140 aa, Homo sapiens
LEDPCTLGMSPISTTREMTPHEIKFAVHVESVLNRVPQPEYRQLLVEAIMVLTLLSDTEMTSIGGIIHVDQIVQMASQLFLQDQVSIGAMDTLEKDQATGICHFFYDSAPSGAYGTMTYLTRAVASYLQELLPNSGCQMQ

SEQ ID NO: 885271 - protein, 183 aa, Homo sapiens
PHPLSLSSHMILFRLFFTRQLDGAINRVPVGFYQRVWKILQKCHGLSIDGYVLPSSTTREMTPHEIKFAVHVESVLNRVPQPEYRQLLVEAIMVLTLLSDTEMTSIGGIIHVDQIVQMASQLFLQDQVSIGAMDTLEKDQATGICHFFYDSAPSGAYGTMTYLTRAVASYLQELLPNSGCQMQ

SEQ ID NO: 885272 - protein, 1235 aa, Homo sapiens; identical to SEQ ID NO: 885258

SEQ ID NO: 885273 - protein, 1204 aa, Homo sapiens
MRSRSNSGVRLDGYARLVQQTILCYQNPVTGLLSASHEQKDAWVRDNIYSILAVWGLGMAYRKNADRDEDKAKAYELEQNVVKLMRGLLQCMMRQVAKVEKFKHTQSTKDSLHAKYNTATCGTVVGDDQWGHLQVDATSLFLLFLAQMTASGLRIIFTLDEVAFIQNLVFYIEAAYKVADYGMWERGDKTNQGIPELNASSVGMAKAALEAIDELDLFGAHGGRKSVIHVLPDEVEHCQSILFSMLPRASTSKEIDAGLLSIISFPAFAVEDVNLVNVTKNEIISKLQGRYGCCRFLRDGYKTPREDPNRLHYDPAELKLFENIECEWPVFWTYFIIDGVFSGDAVQVQEYREALEGILIRGKNGIRLVPELYAVPPNKVDEEYKNPHTVDRVPMGKVPHLWGQSLYILSSLLAEGFLAAGEIDPLNRRFSTSVKPDVVVQVTVLAENNHIKDLLRKHGVNVQSIADIHPIQVQPGRILSHIYAKLGRNKNMNLSGRPYRHIGVLGTSKLYVIRNQIFTFTPQFTDQHHFYLALDNEMIVEMLRIELAYLCTCWRMTGRPTLTFPISRTMLTNDGSDIHSAVLSTIRKLEDGYFGGARVKLGNLSEFLTTSFYTYLTFLDPDCDEKLFDNASEGTFSPDSDSDLVGYLEDTCNQESQDELDHYINHLLQSTSLRSYLPPLCKNTEDRHVFSAIHSTRDILSVMAKAKGLEVPFVPMTLPTKVLSAHRKSLNLVDSPQPLLEKVPESDFQWPRDDHGDVDCEKLVEQLKDCSNLQDQADILYILYVIKGPSWDTNLSGQHGVTVQNLLGELYGKAGLNQEWGLIRYISGLLRKKVEVLAEACTDLLSHQKQLTVGLPPEPREKIISAPLPPEELTKLIYEASGQDISIAVLTQEIVVYLAMYVRAQPSLFVEMLRLRIGLIIQVMATELARSLNCSGEEASESLMNLSPFDMKNLLHHILSGKEFGVERSVRPIHSSTSSPTISIHEVGHTGVTKTERSGINRLRSEMKQMTRRFSADEQFFSVGQAASSSAHSSKSARSSTPSSPTGTSSSDSGGHHIGWGERQGQWLRRRRLDGAINRVPVGFYQRVWKILQKCHGLSIDGYVLPSSTTREMTPHEIKFAVHVESVLNRVPQPEYRQLLVEAIMVLTLLSDTEMTSIGGIIHVDQIVQMASQLFLQDQVGVPGSWVGWHLSLLRLEIPETDVC

SEQ ID NO: 885274 - protein, 1210 aa, Homo sapiens
MRSRSNSGVRLDGYARLVQQTILCYQNPVTGLLSASHEQKDAWVRDNIYSILAVWGLGMAYRKNADRDEDKAKAYELEQNVVKLMRGLLQCMMRQVAKVEKFKHTQSTKDSLHAKYNTATCGTVVGDDQWGHLQVDATSLFLLFLAQMTASGLRIIFTLDEVAFIQNLVFYIEAAYKVADYGMWERGDKTNQGIPELNASSVGMAKAALEAIDELDLFGAHGGRKSVIHVLPDEVEHCQSILFSMLPRASTSKEIDAGLLSIISFPAFAVEDVNLVNVTKNEIISKLQGRYGCCRFLRDGYKTPREDPNRLHYDPAELKLFENIECEWPVFWTYFIIDGVFSGDAVQVQEYREALEGILIRGKNGIRLVPELYAVPPNKVDEEYKNPHTVDRVPMGKVPHLWGQSLYILSSLLAEGFLAAGEIDPLNRRFSTSVKPDVVVQVTVLAENNHIKDLLRKHGVNVQSIADIHPIQVQPGRILSHIYAKLGRNKNMNLSGRPYRHIGVLGTSKLYVIRNQIFTFTPQFTDQHHFYLALDNEMIVEMLRIELAYLCTCWRMTGRPTLTFPISRTMLTNDGSDIHSAVLSTIRKLEDGYFGGARVKLGNLSEFLTTSFYTYLTFLDPDCDEKLFDNASEGTFSPDSDSDLVGYLEDTCNQESQDELDHYINHLLQSTSLRSYLPPLCKNTEDRHVFSAIHSTRDILSVMAKAKGLEVPFVPMTLPTKVLSAHRKSLNLVDSPQPLLEKVPESDFQWPRDDHGDVDCEKLVEQLKDCSNLQDQADILYILYVIKGPSWDTNLSGQHGVTVQNLLGELYGKAGLNQEWGLIRYISGLLRKKVEVLAEACTDLLSHQKQLTVGLPPEPREKIISAPLPPEELTKLIYEASGQDISIAVLTQEIVVYLAMYVRAQPSLFVEMLRLRIGLIIQVMATELARSLNCSGEEASESLMNLSPFDMKNLLHHILSGKEFGVERSVRPIHSSTSSPTISIHEVGHTGVTKTERSGINRLRSEMKQMTRRFSADEQFFSVGQAASSSAHSSKSARSSTPSSPTGTSSSDSGGHHIGWGERQGQWLRRRRLDGAINRVPVGFYQRVWKILQKCHGLSIDGYVLPSSTTREMTPHEIKFAVHVESVLNRVPQPEYRQLLVEAIMVLTLLSDTEMTSIGGIIHVDQIVQMASQLFLQDQVGVPGSWVGWHLSLLRLEILCPIGKNILEPR

SEQ ID NO: 885275 - protein, 1042 aa, Homo sapiens
MRSRSNSGVRLDGYARLVQQTILCYQNPVTGLLSASHEQKDAWVRDNIYSILAVWGLGMAYRKNADRDEDKAKAYELEQNVVKLMRGLLQCMMRQVAKVEKFKHTQSTKDSLHAKYNTATCGTVVGDDQWGHLQVDATSLFLLFLAQMTASGLRIIFTLDEVAFIQNLVFYIEAAYKVADYGMWERGDKTNQGIPELNASSVGMAKAALEAIDELDLFGAHGGRKSVIHVLPDEVEHCQSILFSMLPRASTSKEIDAGLLSIISFPAFAVEDVNLVNVTKNEIISKLQGRYGCCRFLRDGYKTPREDPNRLHYDPAELKLFENIECEWPVFWTYFIIDGVFSGDAVQVQEYREALEGILIRGKNGIRLVPELYAVPPNKVDEEYKNPHTVDRVPMGKVPHLWGQSLYILSSLLAEGFLAAGEIDPLNRRFSTSVKPDVVVQVTVLAENNHIKDLLRKHGVNVQSIADIHPIQVQPGRILSHIYAKLGRNKNMNLSGRPYRHIGVLGTSKLYVIRNQIFTFTPQFTDQHHFYLALDNEMIVEMLRIELAYLCTCWRMTGRPTLTFPISRTMLTNDGSDIHSAVLSTIRKLEDGYFGGARVKLGNLSEFLTTSFYTYLTFLDPDCDEKLFDNASEGTFSPDSDSDLVGYLEDTCNQESQDELDHYINHLLQSTSLRSYLPPLCKNTEDRHVFSAIHSTRDILSVMAKAKGLEVPFVPMTLPTKVLSAHRKSLNLVDSPQPLLEKVPESDFQWPRDDHGDVDCEKLVEQLKDCSNLQDQADILYILYVIKGPSWDTNLSGQHGVTVQNLLGELYGKAGLNQEWGLIRYISGLLRKKVEVLAEACTDLLSHQKQLTVGLPPEPREKIISAPLPPEELTKLIYEASGQDISIAVLTQEIVVYLAMYVRAQPSLFVEMLRLRIGLIIQVMATELARSLNCSGEEASESLMNLSPFDMKNLLHHILSGKEFGVERSDTRSHHAAQAGLELLGSSSLPTSASQSAGITGVSHRAWPRCALSTPPHPALPSPSTRWAIPESPKLRGVALTD

SEQ ID NO: 885276 - protein, 593 aa, Homo sapiens [sequence omitted]

SEQ ID NO: 885277 - protein, 100 aa, Homo sapiens
IVHKITLSCRRSPHRAEDHFHVGVGSLVQETLVEVGSPAEEIPEEVIQPYQEFSVEVGRLAQETSAINLLSQGIPEIDKPSQEFPEEIDLQAQEVPEEIN

SEQ ID NO: 885278 - protein, 324 aa, Homo sapiens
EFLSRVCQRHTDAQAQASAALFDSMHSSQASDNPFSPPRTLHSPPLQLQQRSEKPPWYSSGPSSTVSSAGPSSPTTVDGNSQFGFSDQPSLNSHVAEEHQGLGLLQETPGSGAQELSIEGEQELFEPNQSPQVPPMETSQPYEEVSQPCQEVPDISQPCQDISEALSQPCQKVPDISQQCQENHDNGNHTCQEVPHISQPCQKSSQLCQKVSEEVCQLCLENSEEVSQPCQGVSVEVGKLVHKFHVGVGSLVQETLVEVGSPAEEIPEEVIQPYQEFSVEVGRLAQETSAINLLSQGIPEIDKPSQEFPEEIDLQAQEVPEEIN

SEQ ID NO: 885279 - protein, 324 aa, Homo sapiens; identical to SEQ ID NO: 885278

SEQ ID NO: 885280 - protein, 377 aa, Homo sapiens
MASSEQAEQPSQPSSTPGSENVLPREPLIATAVKFLQNSRVRQSPLATRRAFLKKKGLTDEEIDMAFQQSGTAADEPSSLGPATQVVPVQPPHLISQPYSPAGSRWRDYGALAIIMAGIAFGFHQLYKKYLLPLILGGREDRKQLERMEAGLSELSGSVAQTVTQLQTTLASVQELLIQQQQKIQELAHELAAAKATTSTNWILESQNINELKSEINSLKGLLLNRRQFPPSPSAPKIPSWQIPVKSPSPSSPAAVNHHSSSDISPVSNESTSSSPGKEGHSPEGSTVTYHLLGPQEEGEGVVDVKGQVRMEVQGEEEKREDKEDEEDEEDDDVSHVDEEDCLGVQREDRRGGDGQINEQVEKLRRPEGASNESERD

SEQ ID NO: 885281 - protein, 184 aa, Homo sapiens
MKNQLEWRSGGTGRIVAGLKLGRGIRFDRLRYRKPVKTGKQHRLSFEIATAVKFLQNSRVRQSPLATRRAFLKKKGLTDEEIDMAFQQSGTAADEPSSLGPATQVVPVQPPHLISQPYSPAGSRWRDYGALAIIMAGIAFGFHQLYKKYLLPLILGGREDRKQLERMEAGLSELSGSVAQTGKD

SEQ ID NO: 885282 - protein, 377 aa, Homo sapiens; identical to SEQ ID NO: 885280

SEQ ID NO: 885283 - protein, 504 aa, Homo sapiens
MASSEQAEQPSQPSSTPGSENVLPREPLIATAVKFLQNSRVRQSPLATRRAFLKKKGLTDEEIDMAFQQSGTAADEPSSLGPATQVVPVQPPHLISQPYSPAGSRWRDYGALAIIMAGIAFGFHQLYKKYLLPLILGGREDRKQLERMEAGLSELSGSVAQTVTQLQTTLASVQELLIQQQQKIQELAHELAAAKATTSTNWILESQNINELKSEINSLKGLLLNRRQFPPSPSAPKIPSWQIPVKSPSPSSPAAVNHHSSSDISPVSNESTSSSPGKEGHSPEGSTVTYHLLGPQEEGEGVVDVKGQVRMEVQGEEEKREDKEDEEDEEDDDVSHVDEEDCLGVQREDRRGGDGQINEQVEKLRRPSPLSRTDALPRVCLLSVLTTVTPRMARASVPTASRLLSGGGAAVPLVSAIPLPPWARPWTRQVPVPSPNPTHAPSSSQTNETTLRFRCPRLPCNGSANPMARWGLTPEEEPGSRAFLTNSQLCPSPQETHVHLCDHV

SEQ ID NO: 885284 - protein, 377 aa, Homo sapiens; identical to SEQ ID NO: 885280

SEQ ID NO: 885285 - protein, 383 aa, Homo sapiens
LVRPGGKGSSEQAEQPSQPSSTPGSENVLPREPLIATAVKFLQNSRVRQSPLATRRAFLKKKGLTDEEIDMAFQQSGTAADEPSSLGPATQVVPVQPPHLISQPYSPAGSRWRDYGALAIIMAGIAFGFHQLYKKYLLPLILGGREDRKQLERMEAGLSELSGSVAQTVTQLQTTLASVQELLIQQQQKIQELAHELAAAKATTSTNWILESQNINELKSEINSLKGLLLNRRQFPPSPSAPKIPSWQIPVKSPSPSSPAAVNHHSSSDISPVSNESTSSSPGKEGHSPEGSTVTYHLLGPQEEGEGVVDVKGQVRMEVQGEEEKREDKEDEEDEEDDDVSHVDEEDCLGVQREDRRGGDGQINEQVEKLRRPEGASNESERD

SEQ ID NO: 885286 - protein, 334 aa, Homo sapiens
MASSEQAEQPSQPSSTPGSENVLPREPLIATAVKFLQNSRVRQSPLATRRAFLKKKGPAGSRWRDYGALAIIMAGIAFGFHQLYKKYLLPLILGGREDRKQLERMEAGLSELSGSVAQTVTQLQTTLASVQELLIQQQQKIQELAHELAAAKATTSTNWILESQNINELKSEINSLKGLLLNRRQFPPSPSAPKIPSWQIPVKSPSPSSPAAVNHHSSSDISPVSNESTSSSPGKEGHSPEGSTVTYHLLGPQEEGEGVVDVKGQVRMEVQGEEEKREDKEDEEDEEDDDVSHVDEEDCLGVQREDRRGGDGQINEQVEKLRRPEGASNESERD

SEQ ID NO: 885287 - protein, 379 aa, Homo sapiens
MASSEQAEQPSQPSSTPGSENVLPREPLIATAVKFLQNSRVRQSPLATRRAFLKKKGLTDEEIDMAFQQSGTAADEPSSLGPATQVVPVQPPHLISQPYSPAGSRWRDYGALAIIMAGIAFGFHQLYKKYLLPLILGGREDRKQLERMEAGLSELSGSVAQTVTQLQTTLASVQELLIQQQQKIQELAHELAAAKATTSTNWILESQNINELKSEINSLKGLLLNRRQFPPSPSAPKIPSWQIPVKSPSPSSPAAVNHHAWPELASLLPPDSSVEEELRSLWCLPSPSLPGPGPGPVRCLSPAFSRTDALPRVCLLSVLTTNETTLRFRCPRLPCNGSANPMARWGLTPEEEPGSRAFLTNSQLCPSPQETHVHLCDHV

SEQ ID NO: 885288 - protein, 72 aa, Homo sapiens
QAPTNKKRKKLVESDEAEQAEQPSQTESHSVDQLECSGAISAYCNLRLPGSSDSPASASQVAGATAKLYSRK

SEQ ID NO: 885289 - protein, 116 aa, Homo sapiens
MAIIERREPCWGSPRSTYKHPSHARLTAELPMHRGSATDSSRDFSSCLLWERENLEVESCQVRGDSINTLDFALKSQKGYPLGANTTPQGYGIFPRTKGKTKIKHKIVPTPDLQVI

SEQ ID NO: 885290 - protein, 67 aa, Homo sapiens
WYGLEVRDPRSRQSSRASQALLQEVKMCCLESRWDLLCCSGWSAVCKHGLLQPSPSGRSDPPASTSM

SEQ ID NO: 885291 - protein, 377 aa, Homo sapiens; identical to SEQ ID NO: 885280

SEQ ID NO: 885292 - protein, 423 aa, Homo sapiens
MASSEQAEQPSQPSSTPGSENVLPREPLIATAVKFLQNSRVRQSPLATRRAFLKKKGLTDEEIDMAFQQSGTAADEPSSLGPATQVVPVQPPHLISQPYSPAGSRWRDYGALAIIMAGIAFGFHQLYKKYLLPLILGGREDRKQLERMEAGLSELSGSVAQTVTQLQTTLASVQELLIQQQQKIQELAHELAAAKATTSTNWILESQNINELKSEINSLKGLLLNRRQFPPSPSAPKIPSWQIPVKSPSPSSPAAVNHHSSSDISPVSNESTSSSPGKEGHSPEGSTVTYHLLGPQEEGEGVVDVKGQVRMEVQGEEEKREDKDGGGAAVPLVSAIPLPPWARPWTRQVPVPSPNPTHAPSSSQTNETTLRFRCPRLPCNGSANPMARWGLTPEEEPGSRAFLTNSQLCPSPQETHVHLCDHV

SEQ ID NO: 885293 - protein, 313 aa, Homo sapiens
MAFQQSGTAADEPSSLGPATQVVPVQPPHLISQPYSPAGSRWRDYGALAIIMAGIAFGFHQLYKKYLLPLILGGREDRKQLERMEAGLSELSGSVAQTVTQLQTTLASVQELLIQQQQKIQELAHELAAAKATTSTNWILESQNINELKSEINSLKGLLLNRRQFPPSPSAPKIPSWQIPVKSPSPSSPAAVNHHSSSDISPVSNESTSSSPGKEGHSPEGSTVTYHLLGPQEEGEGVVDVKGQVRMEVQGEEEKREDKEDEEDEEDDDVSHVDEEDCLGVQREDRRGGDGQINEQVEKLRRPEGASNESERD

SEQ ID NO: 885294 - protein, 198 aa, Homo sapiens
MASSEQAEQPSQPSSTPGSENVLPREPLIATAVKFLQNSRVRQSPLATRRAFLKKKGLTDEEIDMAFQQSGTAADEPSSLGPATQVVPVQPPHLISQPYSPAGSRWRDYGALAIIMAGIAFGFHQLYKPNPTHAPSSSQTNETTLRFRCPRLPCNGSANPMARWGLTPEEEPGSRAFLTNSQLCPSPQETHVHLCDHV

SEQ ID NO: 885295 - protein, 295 aa, Homo sapiens
MDVLPMCSIFQELQIVHETGYFSALPSLEEYWQQTCLELERYLQSEPCYVSASEIKFDSQEDLWTKIILAREKKEESELKISSSPPEDTLISPSFCYNLETNSLNSDVSSESSDSSEELSPTAKFTSDPIGEVLVSSGKLSSSVTSTPPSSPELSREPSQLWGCVPGELPSPGKVRSGTSGKPGDKGNGDASPDGRRRVHRCHFNGCRKVYTKSSHLKAHQRTHTEVSAHAGPGGRPLVGATALHQPWREPGLAAQDVVRADKSSLPQMFSTKALGLFGVQSRILKTGLLSWINV

SEQ ID NO: 885296 - protein, 283 aa, Homo sapiens
MDVLPMCSIFQELQIVHETGYFSALPSLEEYWQQTCLELERYLQSEPCYVSASEIKFDSQEDLWTKIILAREKKEESELKISSSPPEDTLISPSFCYNLETNSLNSDVSSESSDSSEELSPTAKFTSDPIGEVLVSSGKLSSSVTSTPPSSPELSREPSQLWGCVPGELPSPGKVRSGTSGKPGDKGNGDASPDGRRRVHRCHFNGCRKVYTKSSHLKAHQRTHTGEKPYRCSWEGCEWRFARSDELTRHFRKHTGAKPFKCSHCDRCFSRSDHLALHMKRHL

SEQ ID NO: 885297 - protein, 283 aa, Homo sapiens; identical to SEQ ID NO: 885296

SEQ ID NO: 885298 - protein, 283 aa, Homo sapiens; identical to SEQ ID NO: 885296

SEQ ID NO: 885299 - protein, 283 aa, Homo sapiens; identical to SEQ ID NO: 885296

SEQ ID NO: 885300 - protein, 295 aa, Homo sapiens; identical to SEQ ID NO: 885295

SEQ ID NO: 885301 - protein, 295 aa, Homo sapiens; identical to SEQ ID NO: 885295

SEQ ID NO: 885302 - protein, 283 aa, Homo sapiens [sequence omitted]

SEQ ID NO: 885303 - protein, 305 aa, Homo sapiens
MDVLPMCSIFQELQIVHETGYFSALPSLEEYWQQWLESLKWWGEGMLISAVVASWKTCLELERYLQSEPCYVSASEIKFDSQEDLWTKIILAREKKEESELKISSSPPEDTLISPSFCYNLETNSLNSDVSSESSDSSEELSPTAKFTSDPIGEVLVSSGKLSSSVTSTPPSSPELSREPSQLWGCVPGELPSPGKVRSGTSGKPGDKGNGDASPDGRRRVHRCHFNGCRKVYTKSSHLKAHQRTHTGEKPYRCSWEGCEWRFARSDELTRHFRKHTGAKPFKCSHCDRCFSRSDHLALHMKRHL

SEQ ID NO: 885304 - protein, 270 aa, Homo sapiens
MDVLPMCSIFQELQIVHETGYFSALPSLEEYWQQTCLELERYLQSEPCYVSASEIKFDSQEDLWTKIILAREKKEESELKISSSPPEDTLISPSFCYNLETNSLNSDVSSESSDSSEELSPTAKFTSDPIGEVLVSSGKLSSSVTSTPPSSPELSREPSQLWGCVPGELPSPGKVRSGTSGKPGDKGNGDASPDGRRRVHRCHFNGCRKVYTKSSHLKAHQRTHTGEKPYRCSWEGCEWRFARSDELTRHFRKHTGGLSLEGLLRAKKVL

SEQ ID NO: 885305 - protein, 283 aa, Homo sapiens; identical to SEQ ID NO: 885296

SEQ ID NO: 885306 - protein, 295 aa, Homo sapiens; identical to SEQ ID NO: 885295

SEQ ID NO: 885307 - protein, 140 aa, Homo sapiens
MDVLPMCSIFQELQIVHETGYFSALPSLEEYWQQVNAAGRGSLRAPGRGPGRLFGVQTRCSLRSAGPGPRAVTGGAGAAPPPIDPPGCDQRPPREAPTPGTARPSPWHEFGACPRSRRHSWSLSWGPTCSACQGLSKVRR

SEQ ID NO: 885308 - protein, 283 aa, Homo sapiens; identical to SEQ ID NO: 885296

SEQ ID NO: 885309 - protein, 283 aa, Homo sapiens; identical to SEQ ID NO: 885296

SEQ ID NO: 885310 - protein, 283 aa, Homo sapiens; identical to SEQ ID NO: 885296

SEQ ID NO: 885311 - protein, 283 aa, Homo sapiens; identical to SEQ ID NO: 885296

SEQ ID NO: 885312 - protein, 283 aa, Homo sapiens; identical to SEQ ID NO: 885296

SEQ ID NO: 885313 - protein, 383 aa, Homo sapiens
MDVLPMCSIFQELQIVHETGYFSALPSLEEYWQQVNAAGRGSLRAPGRGPGRLFGVQTRCSLRSAGPGPRAVTGGAGAAPPPIDPPGCDQRPPREAPTPGTARPSPWHEFGACPRSRRHSWSLSWGPTCSACQGTCLELERYLQSEPCYVSASEIKFDSQEDLWTKIILAREKKEESELKISSSPPEDTLISPSFCYNLETNSLNSDVSSESSDSSEELSPTAKFTSDPIGEVLVSSGKLSSSVTSTPPSSPELSREPSQLWGCVPGELPSPGKVRSGTSGKPGDKGNGDASPDGRRRVHRCHFNGCRKVYTKSSHLKAHQRTHTGEKPYRCSWEGCEWRFARSDELTRHFRKHTGAKPFKCSHCDRCFSRSDHLALHMKRHL

SEQ ID NO: 885314 - protein, 228 aa, Homo sapiens
MDVLPMCSIFQELQIVHETGYFSALPSLEEYWQQTCLELERYLQSEPCYVSASEIKFDSQEDLWTKIILAREKKEESELKISSSPPEDTLISPSFCYNLETNSLNSDVSSESSDSSEELSPTAKFTSDPIGEVLVSSGKLSSSVTSTPPSSPELSREPSQLWGCVPGELPSPGKVRSGTSGKPGDKGNGDASPDGRRRVHRCHFNGCRKVYTKSSHLKAHQRTHTDAH

SEQ ID NO: 885315 - protein, 283 aa, Homo sapiens; identical to SEQ ID NO: 885296

SEQ ID NO: 885316 - protein, 267 aa, Homo sapiens
CQEEEERGRRRCAESRGPAKASAARATMATDELATKLSRRLQMEGEGGGETPEQPGLNGAAAAAAGAPDEAAEALGSADCELSAKLLRRADLNQGIGEPQSPSRRVFNPYTEFKEFSRKQIKDMEKMFKQYDAGRDGFIDLMELKLMMEKLGAPQTHLGLKNMIKEVDEDFDSKLSFREFLLIFRKAAAGELQEDSGLCVLARLSEIDVSSEGVKGAKSFFEAKVQAINVSSRFEEEIKAEQEERKKQAEEMKQRKAAFKELQSTFK

SEQ ID NO: 885317 - protein, 267 aa, Homo sapiens; identical to SEQ ID NO: 885316

SEQ ID NO: 885318 - protein, 104 aa, Homo sapiens
RLCRAGVNRPRLSFREFLLIFRKAAAGELQEDSGLCVLARLSEIDVSSEGVKGAKSFFEAKVQAINVSSRFEEEIKAEQEERKKQAEEMKQRKAAFKELQSTFK

SEQ ID NO: 885319 - protein, 303 aa, Homo sapiens
CQEEEERGRRRCAESRGPAKASAARATMATDELATKLSRRLQMEGEGGGETPEQPGLNGAAAAAAGAPDEAAEALGSADCELSAKLLRRADLNQGIGEPQSPSRRVFNPYTEFKEFSRKQIKDMEKMFKQYDAGRDGFIDLMELKLMMEKLGAPQTHLGLKNMIKEVDEDFDSKLSFREFLLIFRKAAAGELQEDSGLCVLARLSEIDVSSEGVKGAKSFFEAKWNWVCRWGPRTGSRGSGWQQLERLPSSALALQQPQNIGPGHQRVQPLRGGDQGRAGGKEEAGGGDEAAESGLQGAAVHL

SEQ ID NO: 885320 - protein, 151 aa, Homo sapiens
MAVVSLDMVLPVRLIAYDAGALSIADVPACWVPPVATGLSLGHPMLDAWLAFYACDGADVCCAVPGTPALLQQAAPPLGPPASPFPGWETAEEIESGLPPQSGTQGANWRHEGTPPQGLFLLCVFHLLKWERGWGASVLVKGPGQAPSTPC

SEQ ID NO: 885321 - protein, 292 aa, Homo sapiens
CQEEEERGRRRCAESRGPAKASAARATMATDELATKLSRRLQMEGEGGGETPEQPGLNGAAAAAAGAPDEAAEALGSADCELSAKLLRRADLNQGIGEPQSPSRRVFNPYTEFKEFSRKQIKDMEKMFKQYDAGRDGFIDLMELKLMMEKLGAPQTHLGLKNMIKEVDEDFDSKLSFREFLLIFRKAAAGELQEDSGLCVLARLSEIDVSSEGVKGAKSFFEAKWNWVCRWGPRTGSRGSGWQQLERLPSSALALQQPQNIGSLFQSSQQLPKIRVIGCQVLSEETEAQEGE

SEQ ID NO: 885322 - protein, 267 aa, Homo sapiens; identical to SEQ ID NO: 885316

SEQ ID NO: 885323 - protein, 288 aa, Homo sapiens
MAVVSLDMVLPVRLIAYDAGALSIADVPACWVPPVATGLSLGHPMLDAWLAFYACDGADVCCAVLMTPVMQALVLELWACCACVLAGAPDEAAEALGSADCELSAKLLRRADLNQGIGEPQSPSRRVFNPYTEFKEFSRKQIKDMEKMFKQYDAGRDGFIDLMELKLMMEKLGAPQTHLGLKNMIKEVDEDFDSKLSFREFLLIFRKAAAGELQEDSGLCVLARLSEIDVSSEGVKGAKSFFEAKVQAINVSSRFEEEIKAEQEERKKQAEEMKQRKAAFKELQSTFK

SEQ ID NO: 885324 - protein, 267 aa, Homo sapiens; identical to SEQ ID NO: 885316

SEQ ID NO: 885325 - protein, 267 aa, Homo sapiens; identical to SEQ ID NO: 885316

SEQ ID NO: 885326 - protein, 267 aa, Homo sapiens; identical to SEQ ID NO: 885316

SEQ ID NO: 885327 - protein, 244 aa, Homo sapiens
MGCRDVHAATVLSFLCGIASVAGLFAGTLLPNWRKLRLITFNRNEKNLTVYTGLWVKCARYDGSSDCLMYDTTWYSSVDQLDLRVLQFALPLSMLIAMGALLLCLIGMCNTAFRSSVPNIKLAKCLVNSAGCHLVAGLLFFLAGTVSLSPSIWVIFYNIHLNKKFEPVFSFDYAVYVTIASAGGLFMTSLILFIWYCTCKSLPSPFWQPLYSHPPSMHTYSQPYSARSRLSAIEIDIPVVSHTT

SEQ ID NO: 885328 - protein, 244 aa, Homo sapiens; identical to SEQ ID NO: 885327

SEQ ID NO: 885329 - protein, 244 aa, Homo sapiens; identical to SEQ ID NO: 885327

SEQ ID NO: 885330 - protein, 240 aa, Homo sapiens
SEHTDGHTSVQSVIEKLQEENRLLKQKVTHVEDLNAKWQRYNASRDEYVRGLHAQLRGLQIPHEPELMRKEISRLNRQLEEKINDCAEVKQELAASRTARDAALERVQMLEQQILAYKDDFMSERADRERAQSRIQELEEKVASLLHQVSWRQDSREPDAGRIHAGSKTAKYLAADALELMVPGGWRPGTGSQQPEPPAEGGHPGAVQRGQGDLQCPHCLQCFSDEQGEELLRHVAECCQ

SEQ ID NO: 885331 - protein, 240 aa, Homo sapiens; identical to SEQ ID NO: 885330

SEQ ID NO: 885332 - protein, 134 aa, Homo sapiens
ISRLNRQLEEKINDCAEVKQELAASRTARDAALERVQMLEQQVSVPRAPDGTDQMLLAGGGRNHGTGWAEGLVALSGQWSRWGWEKPGGALPPSLSRNVCLASLQILAYKDDFMSERADRERAQSRIQELEEKV

SEQ ID NO: 885333 - protein, 135 aa, Homo sapiens
KCGHFLLPVLTHPGCCPLWLPWKYNSRRTQTRTGRPCSGWQWSLARCPPGLGLLWQRKHEVGPGLPSSELRCPLGFLPPCSLAGPLHPRTQRSGFAPPPGWLEVGPLPGWPQVPSPPGRLSFPLCPMQRCRDSLL

SEQ ID NO: 885334 - protein, 236 aa, Homo sapiens
MTSLFRRSSSGSGGGGTAGARGGGGGTAAPQELNNSRPARQVRRLEFNQAMDDFKTMFPNMDYDIIECVLRANSGAVDATIDQLLQMNLEGGGSSGGVYEDSSDSEDSIPPEILERTLEPDSSDEEPPPVYSPPAYHMHVFDRPYPLAPPTPPPRIDALGSGAPTSQRRYRNWNPPLLGNLPDDFLRILPQQLDSIQGNAGGPKPGSGEGCPPAMAGPGPGDQESRWKQYLEDEID

SEQ ID NO: 885335 - protein, 386 aa, Homo sapiens
MTSLFRRSSSGSGGGGTAGARGGGGGTAAPQELNNSRPARQVRRLEFNQAMDDFKTMFPNMDYDIIECVLRANSGAVDATIDQLLQMNLEGGGSSGGVYEDSSDSEDSIPPEILERTLEPDSSDEEPPPVYSPPAYHMHVFDRPYPLAPPTPPPRIDALGSGAPTSQRRYRNWNPPLLGNLPDDFLRILPQQLDSIQGNAGGPKPGSGEGCPPAMAGPGPGDQESRWKQYLEDERIALFLQNEEFMKELQRNRDFLLALERDRLKYESQKSKSSSVAVGNDFGFSSPVPGTGDANPAVSEDALFRDKLKHMGKSTRRKLFELARAFSEKTKMRKSKRKHLLKHQSLGAAASTANLLDDVEGHACDEDFRGRRQEAPKVEEGLREGQ

SEQ ID NO: 885336 - protein, 386 aa, Homo sapiens; identical to SEQ ID NO: 885335

SEQ ID NO: 885337 - protein, 342 aa, Homo sapiens
MTSLFRRSSSGSGGGGTAGARGGGGGTAAPQELNNSRPARQVRRLEFNQAMDDFKTMFPNMDYDIIECVLRANSGAVDATIDQLLQMNLEGGGSSGGVYEDSSDSEDSIPPEILERTLEPDSSDEEPPPVYSPPAYHMHVFDRPYPLAPPTPPPRIDALGSGAPTSQRRYRNWNPPLLGNLPDDFLRILPQQLDSIQGNAGGPKPGSGEGCPPAMAGPGPGDQESRWKQYLEDERIALFLQNEEFMKELQRNRDFLLALERDRLKYESQKSKSSSVAVGNDFGFSSPVPGTGDANPAVSEDALFRDKLKHMGKSTRRKLFELARAFSEKTAGGCRVNSQPPG

SEQ ID NO: 885338 - protein, 66 aa, Homo sapiens
RIPLSLRIVCCALGTLRHAARSSSLSWSGSVFVKLVARPSWVRPVFVILVVLFPRVSSLAQSRGRA

SEQ ID NO: 885339 - protein, 386 aa, Homo sapiens; identical to SEQ ID NO: 885335

SEQ ID NO: 885340 - protein, 386 aa, Homo sapiens; identical to SEQ ID NO: 885335

SEQ ID NO: 885341 - protein, 386 aa, Homo sapiens; identical to SEQ ID NO: 885335

SEQ ID NO: 885342 - protein, 386 aa, Homo sapiens; identical to SEQ ID NO: 885335

SEQ ID NO: 885343 - protein, 386 aa, Homo sapiens; identical to SEQ ID NO: 885335

SEQ ID NO: 885344 - protein, 312 aa, Homo sapiens
MTSLFRRSSSGSGGGGTAGARGGGGGTAAPQELNNSRPARQVRRLEFNQAMDDFKTMFPNMDYDIIECVLRANSGAVDATIDQLLQMNLEGGGSSGGVYEDSSDSEDSIPPEILERTLEPDSSDEEPPPVYSPPAYHMHVFDRPYPLAPPTPPPRIDALGSGAPTSQRRYRNWNPPLLGNLPDDFLRILPQQLDSIQGNAGGPKPGSGEGCPPAMAGPGPGDQESRWKQYLEDERIALFLQNEEFMKELQRNRDFLLALERDRLKYESQKSKSSSVAVGNDFGFSSPVPGNFAFWGRKPRGIVGSSHPTLLC

SEQ ID NO: 885345 - protein, 304 aa, Homo sapiens
MSLMVVSMACVGFFLLQGAWPHEGVHRKPSLLAHPGPLVKSEETVILQCWSDVRFEHFLLHREGKFKDTLHLIGEHHDGVSKANFSIGPMMQDLAGTYRCYGSVTHSPYQLSAPSDPLDIVITGLYEKPSLSAQPGPTVLAGESVTLSCSSRSSYDMYHLSREGEAHERRFSAGPKVNGTFQADFPLGPATHGGTYRCFGSFRDSPYEWSNSSDPLLVSVTGNPSNSWPSPTEPSSKTGNPRHLHVLIGTSVVKSLSPSSSSFSFIAGAPTKKMHAVMDQEPAGNRTVNREDSDEQDHQEVSYA

SEQ ID NO: 885346 - protein, 304 aa, Homo sapiens
MSLMVVSMACVGFFLLQGAWPHEGVHRKPSLLAHPGPLVKSEETVILQCWSDVRFEHFLLHREGKYKDTLHLIGEHHDGVSKANFSIGPMMQDLAGTYRCYGSVTHSPYQLSAPSDPLDIVITGLYEKPSLSAQPGPTVLAGESVTLSCSSRSSYDMYHLSREGEAHERRFSAGPKVNGTFQADFPLGPATHGGTYRCFGSFRDSPYEWSNSSDPLLVSVTGNPSNSWPSPTEPSSKTGNPRHLHVLIGTSVVKIPFTILLFFLLHRWCSNKKNAAVMDQEPAGNRTVNSEDSDEQDHQEVSYA

SEQ ID NO: 885347 - protein, 382 aa, Homo sapiens
MSLMVVSMACVGLFLVQRAGPHMGGQDKPFLSAWPSAVVPRGGHVTLRCHYRHRFNNFMLYKEDRIHVPIFHGRIFQEGFNMSPVTTAHAGNYTCRGSHPHSPTGWSAPSNPMVIMVTGNHRKPSLLAHPGPLVKSGERVILQCWSDIMFEHFFLHKEWISKDPSRLVGQIHDGVSKANFSIGSMMRALAGTYRCYGSVTHTPYQLSAPSDPLDIVVTGLYEKPSLSAQPGPKVQAGESVTLSCSSRSSYDMYHLSREGGAHERRLPAVRKVNRTFQADFPLGPATHGGTYRCFGSFRHSPYEWSDPSDPLLVSVTGNPRHLHVLIGTSVVKIPFTILLFFLLHRWCSNKKNAAVMDQEPAGNRTVNSEDSDEQDHQEVSYA

SEQ ID NO: 885348 - protein, 204 aa, Homo sapiens
MSLMVVSMACVGFFLLQGAWPHEGLYEKPSLSAQPGPTVLAGESVTLSCSSRSSYDMYHLSREGEAHERRFSAGPKVNGTFQADFPLGPATHGGTYRCFGSFRDSPYEWSNSSDPLLVSVTGNPSNSWPSPTEPSSKTGNPRHLHVLIGTSVVKIPFTILLFFLLHRWCSNKKNAAVMDQEPAGNRTVNSEDSDEQDHQEVSYA

SEQ ID NO: 885349 - protein, 110 aa, Homo sapiens
TGSTMSLMVVSMACVGFFLLQGAWPHEGNPSNSWPSPTEPSSKTGNPRHLHVLIGTSVVKIPFTILLFFLLHRWCSNKKNAAVMDQEPAGNRTVNSEDSDEQDHQEVSYA

SEQ ID NO: 885350 - protein, 386 aa, Homo sapiens
TGSTMSLMVVSMACVGLFLVQRAGPHMGGQDKPFLSAWPSAVVPRGGHVTLRCHYRHRFNNFMLYKEDRIHVPIFHGRIFQEGFNMSPVTTAHAGNYTCRGSHPHSPTGWSAPSNPMVIMVTGNHRKPSLLAHPGPLVKSGERVILQCWSDIMFEHFFLHKEWISKDPSRLVGQIHDGVSKANFSIGSMMRALAGTYRCYGSVTHTPYQLSAPSDPLDIVVTGLYEKPSLSAQPGPKVQAGESVTLSCSSRSSYDMYHLSREGGAHERRLPAVRKVNRTFQADFPLGPATHGGTYRCFGSFRHSPYEWSDPSDPLLVSVTGNPSSSWPSPTEPSSKSGNLRHLHILIGTSVVKIPFTILLFFLLHRWCSNKKKCCCNGPRACREQK

SEQ ID NO: 885351 - protein, 287 aa, Homo sapiens
MSLMVVSMACVGFFLLQGAWPHEGVHRKPSLLAHPGPLVKSEETVILQCWSDVRFEHFLLHREGKYKDTLHLIGEHHDGVSKANFSIGPMMQDLAGTYRCYGSVTHSPYQLSAPSDPLDIVITGLYEKPSLSAQPGPTVLAGESVTLSCSSRSSYDMYHLSREGEAHERRFSAGPKVNGTFQADFPLGPATHGGTYRCFGSFRDSPYEWSNSSDPLLVSVTGNPRHLHVLIGTSVVKIPFTILLFFLLHRWCSNKKNAAVMDQEPAGNRTVNSEDSDEQDHQEVSYA

SEQ ID NO: 885352 - protein, 206 aa, Homo sapiens
MSLMVVSMACVGFFLLQGAWPHEGVHRKPSLLAHPGPLVKSEETVILQCWSDVRFEHFLLHREGKYKDTLHLIGEHHDGVSKANFSIGPMMQDLAGTYRCFGSFRDSPYEWSNSSDPLLVSVTGNPSNSWPSPTEPSSKTGNPRHLHVLIGTSVVKIPFTILLFFLLHRWCSNKKNAAVMDQEPAGNRTVNSEDSDEQDHQEVSYA

SEQ ID NO: 885353 - protein, 210 aa, Homo sapiens
KSRCCGGRCSSGGPVVARPPAPVRSGPATEAAQRRDSEPTPPSELRRTVPSHPAPTSPMGPQRRLSPAGAALLWGFLLQLTAAQEAILHASGNGTTKDYCMLYNPYWTALPSTLENATSISLMNLTSTPLCNLSDIPPVGIKSKAVVVPWGSCHFLEKARIAQKGGAEAMLVVNNSVLFPPSGNRSEFPDVKILIAFISYKDFRDMNQVN

SEQ ID NO: 885354 - protein, 581 aa, Homo sapiens
GLVLVGILGWRCSSGGPVVARPPAPVRSGPATEAAQRRDSEPTPPSELRRTVPSHPAPTSPMGPQRRLSPAGAALLWGFLLQLTAAQEAILHASGNGTTKDYCMLYNPYWTALPSTLENATSISLMNLTSTPLCNLSDIPPVGIKSKAVVVPWGSCHFLEKARIAQKGGAEAMLVVNNSVLFPPSGNRSEFPDVKILIAFISYKDFRDMNQTLGDNITVKMYSPSWPNFDYTMVVIFVIAVFTVALGGYWSGLVELENLKAVTTEDREMRKKKEEYLTFSPLTVVIFVVICCVMMVLLYFFYKWLVYVMIAIFCIASAMSLYNCLAALIHKIPYGQCTIACRGKNMEVRLIFLSGLCIAVAVVWAVFRNEDRWAWILQDILGIAFCLNLIKTLKLPNFKSCVILLGLLLLYDVFFVFITPFITKNGESIMVELAAGPFGNNEKLPVVIRVPKLIYFSVMSVCLMPVSILGFGDIIVPGLLIAYCRRFDVQTGSSYIYYVSSTVAYAIGMILTFVVLVLMKKGQPALLYLVPCTLITASVVAWRRKEMKKFWKGNSYQMMDHLDCATNEENPVISGEQIVQQ

SEQ ID NO: 885355 - protein, 599 aa, Homo sapiens
GLVLVGILGWRCSSGGPVVARPPAPVRSGPATEAAQRRDSEPTPPSELRRTVPSHPAPTSPMGPQRRLSPAGAALLWGFLLQLTAAQEAILHASGNGTTKDYCMLYNPYWTALPSTLENATSISLMNLTSTPLCNLSDIPPVGIKSKAVVVPWGSCHFLEKARIAQKGGAEAMLVVNNSVLFPPSGNRSEFPDVKILIAFISYKDFRDMNQTLGDNITVKMYSPSWPNFDYTMVVIFVIAVFTVALGGYWSGLVELENLKAVTTEDREMRKKKEEYLTFSPLTVVIFVVICCVMMVLLYFFYKWLVYVMIAIFCIASAMSLYNCLAALIHKIPYGQCTIACRGKNMEVRLIFLSGLCIAVAVVWAVFRNEDRWAWILQDILGIAFCLNLIKTLKLPNFKSCVILLGLLLLYDVFFVFITPFITKNGESIMVELAAGPFGNNEKNDGNLVEATGQPSAPHEKLPVVIRVPKLIYFSVMSVCLMPVSILGFGDIIVPGLLIAYCRRFDVQTGSSYIYYVSSTVAYAIGMILTFVVLVLMKKGQPALLYLVPCTLITASVVAWRRKEMKKFWKGNSYQMMDHLDCATNEENPVISGEQIVQQ

SEQ ID NO: 885356 - protein, 581 aa, Homo sapiens; identical to SEQ ID NO: 885354

SEQ ID NO: 885357 - protein, 513 aa, Homo sapiens
GLVLVGILGWRCSSGGPVVARPPAPVRSGPATEAAQRRDSEPTPPSELRRTVPSHPAPTSPMGPQRRLSPAGAALLWGFLLQLTAAQEAILHASGNGTTKDYCMLYNPYWTALPSTLENATSISLMNLTSTPLCNLSDIPPVGIKSKAVVVPWGSCHFLEKARIAQKGGAEAMLVVNNSVLFPPSGNRSEFPDVKILIAFISYKDFRDMNQTLGDNITVKMYSPSWPNFDYTMVVIFVIAVFTVALGGYWSGLVELENLKAVTTEDREMRKKKEEYLTFSPLTVVIFVVICCVMMVLLYFFYKWLVYVMIAIFCIASAMSLYNCLAALIHKIPYGQCTIACRGKNMEVRLIFLSGLCIAVAVVWAVFRNEDRWAWILQDILGIAFCLNLIKTLKLPNFKSCVILLGLLLLYDVFFVFITPFITKNGESIMVELAAGPFGNNEKLPVVIRVPKLIYFSVMSVCLMPVSILGFGDIIVPGLLIAYCRRFDVQTGSSYIYYVSSTVDDGPFGLCNK

SEQ ID NO: 885358 - protein, 167 aa, Homo sapiens
MSKDCQEVHWRPLFCFLFCFVLFCFVFEQLPVVIRVPKLIYFSVMSVCLMPVSILGFGDIIVPGLLIAYCRRFDVQTGSSYIYYVSSTVAYAIGMILTFVVLVLMKKGQPALLYLVPCTLITASVVAWRRKEMKKFWKGNSYQMMDHLDCATNEENPVISGEQIVQQ

SEQ ID NO: 885359 - protein, 374 aa, Homo sapiens
GLVLVGILGWRCSSGGPVVARPPAPVRSGPATEAAQRRDSEPTPPSELRRTVPSHPAPTSPMGPQRRLSPAGAALLWGFLLQLTAAQEAILHASGNGTTKDYCMLYNPYWTALPSTLENATSISLMNLTSTPLCNLSDIPPVGIKSKAVVVPWGSCHFLEKARIAQKGGAEAMLVVNNSVLFPPSGNRSEFPDVKILIAFISYKDFRDMNQTLGDNITVKMYSPSWPNFDYTMVVIFVIAVFTVALGGYWSGLVELENLKAVTTEDREMRKKKEEYLTFSPLTVVIFVVICCVMMVLLYFFYKWLVYVMIAIFCIASAMSLYNCLAALIHKIPYGQCTIACRGKNMEVRLIFLSGLCIAVAVVWAVFRNEDSHV

SEQ ID NO: 885360 - protein, 280 aa, Homo sapiens
GLVLVGILGWRCSSGGPVVARPPAPVRSGPATEAAQRRDSEPTPPSELRRTVPSHPAPTSPMGPQRRLSPAGAALLWGFLLQLTAAQEAILHASGNGTTKDYCMLYNPYWTALPSTLENATSISLMNLTSTPLCNLSDIPPVGIKSKAVVVPWGSCHFLEKARIAQKGGAEAMLVVNNSVLFPPSGNRSEFPDVKILIAFISYKDFRDMNQTLGDNITVKMYSPSWPNFDYTMVVIFVIAVFTVALGGYWSGLVEFLCYDSNFLHSISNESVQLSCCTNS

SEQ ID NO: 885361 - protein, 581 aa, Homo sapiens; identical to SEQ ID NO: 885354

SEQ ID NO: 885362 - protein, 599 aa, Homo sapiens; identical to SEQ ID NO: 885355

SEQ ID NO: 885363 - protein, 513 aa, Homo sapiens; identical to SEQ ID NO: 885357

SEQ ID NO: 885364 - protein, 261 aa, Homo sapiens
GLVLVGILGWRCSSGGPVVARPPAPVRSGPATEAAQRRDSEPTPPSELRRTVPSHPAPTSPMGPQRRLSPAGAALLWGFLLQLTAAQEAILHASGNGTTKDYCMLYNPYWTALPSTLENATSISLMNLTSTPLCNLSDIPPVGIKSKAVVVPWGSCHFLEKARIAQKGGAEAMLVVNNSVLFPPSGNRSEFPDVKILIAFISYKDFRDMNQTLGDNITVKMYSPSWPNFDYTMVVIFVIAVFTVALGGYWSGLVELKPCKQ

SEQ ID NO: 885365 - protein, 168 aa, Homo sapiens
MLFRLSEHSSPEEEASPHQRASGEGHHLKSKRPNPCAYTPPSLKAVQRIAESHLQSISNLNENQASEEEDELGELRELGYPREEDEEEEEDDEEEEEEEDSQAEVLKVIRQSAGQKTTCGQGLEGPWERPPPLDESERDGGSEDQVEDPALSEPGEEPQRPSPSEPGT

SEQ ID NO: 885366 - protein, 145 aa, Homo sapiens
QLLAVHSWILTNQIQAASREPRLLVVLTPRADHQPLTEASYVNLPTIALCNTDSPLRYVDIAIPCNNKGAHSVGLMWWMLAREVLRMRGTISREHPWEVMPDLYFYRDPEEIEKEEQAAAEKAVTKEEFQGEWTAPAPEFHCYSA

SEQ ID NO: 885367 - protein, 204 aa, Homo sapiens
MDPKDRKKIQFSVPAPPSQLDPRQVEMIRRRRPTPAMLFRLSEHSSPEEEASPHQRASGEGHHLKSKRPNPCAYTPPSLKAVQRIAESHLQSISNLNENQASEEEDELGELRELGYPREEDEEEEEDDEEEEEEEDSQAEVLKVIRQSAGQKTTCGQGLEGPWERPPPLDESERDGGSEDQVEDPALSEPGEEPQRPSPSEPGT

SEQ ID NO: 885368 - protein, 290 aa, Homo sapiens
AACVVAAAAASRQLASGNRTRVSSGVPAPAFLGTMNPNCARCGKIVYPTEKVNCLDKPAACAGEPSTDRRRDPESRTPAPPATPRAMDPKDRKKIQFSVPAPPSQLDPRQVEMIRRRRPTPAMLFRLSEHSSPEEEASPHQRASGEGHHLKSKRPNPCAYTPPSLKAVQRIAESHLQSISNLNENQASEEEDELGELRELGYPREEDEEEEEDDEEEEEEEDSQAEVLKVIRQSAGQKTTCGQGLEGPWERPPPLDESERDGGSEDQVEDPALSEPGEEPQRPSPSEPGT

SEQ ID NO: 885369 - protein, 300 aa, Homo sapiens
SSSGETAGGPPAGSPGLGSNSHPPPSPRRTRFSMLIGQFPLNPPSEHPGASAQAEGTGWGPQSWDRRPAACAGEPSTDRRRDPESRTPAPPATPRAMDPKDRKKIQFSVPAPPSQLDPRQVEMIRRRRPTPAMLFRLSEHSSPEEEASPHQRASGEGHHLKSKRPNPCAYTPPSLKAVQRIAESHLQSISNLNENQASEEEDELGELRELGYPREEDEEEEEDDEEEEEEEDSQAEVLKVIRQSAGQKTTCGQGLEGPWERPPPLDESERDGGSEDQVEDPALSEPGEEPQRPSPSEPGT

SEQ ID NO: 885370 - protein, 253 aa, Homo sapiens
SSSGETAGGPPAGSPGLGSNSHPPPSPRRTRFSMLIGQFPLNPPSEHPGAIPGGGDGLGTPKLGPEGEPGRGRDTRGEEERLREGGGEGRERQREETRRDTQEGRDTETQRHSGGERHRDAETPRPGSARERGTDLAQRARGASPESREPGGAPSPGADPPPAPAPSPRRARYFYPCANSPPPPLAAQPAACAGEPSTDRRRDPESRTPAPPATPRAMDPKPESLRRGAPSQVEETQPLCLHTTFAESCAAHC

SEQ ID NO: 885371 - protein, 234 aa, Homo sapiens
AACVVAAAAASRQLASGNRTRVSSGVPAPAFLGTMNPNCARCGKIVYPTEKVNCLDKIRRRRPTPAMLFRLSEHSSPEEEASPHQRASGEGHHLKSKRPNPCAYTPPSLKAVQRIAESHLQSISNLNENQASEEEDELGELRELGYPREEDEEEEEDDEEEEEEEDSQAEVLKVIRQSAGQKTTCGQGLEGPWERPPPLDESERDGGSEDQVEDPALSEPGEEPQRPSPSEPGT

SEQ ID NO: 885372 - protein, 218 aa, Homo sapiens
FTSHKDWVKSSAALQRLEKKPKPRPPERSPRPLWVPEPQLEIRRRRPTPAMLFRLSEHSSPEEEASPHQRASGEGHHLKSKRPNPCAYTPPSLKAVQRIAESHLQSISNLNENQASEEEDELGELRELGYPREEDEEEEEDDEEEEEEEDSQAEVLKVIRQSAGQKTTCGQGLEGPWERPPPLDESERDGGSEDQVEDPALSEPGEEPQRPSPSEPGT

SEQ ID NO: 885373 - protein, 145 aa, Homo sapiens
TPQTASRIETNPCAYTKPSLKAVQRIAESHLQSISNLNENQASEEEDELGELRELGYPREEDEEEEEDDEEEEEEEDSQAEVLKVIRQSAGQKTTCGQGLEGPWERPPPLDESERDGGSEDQVEDPALSEPGEEPQRPSPSEPGT

SEQ ID NO: 885374 - protein, 204 aa, Homo sapiens; identical to SEQ ID NO: 885367

SEQ ID NO: 885375 - protein, 204 aa, Homo sapiens; identical to SEQ ID NO: 885367

SEQ ID NO: 885376 - protein, 1167 aa, Homo sapiens
QFPAVPLEPLPTTEGTPGLPLQQAEERYESQEPLAGQESPLPLATREAALPILEPVLGQEQPAAPDQPCVLFADAPEPGQALPVEEEAVTLARAETTQARTEAQDLCRASPEPPGPESSSRWLDDLLASPPPSGGGARRGAGAELKDTQSPSTCSEGLLGWSQKDLQSEFGITGDPQPSSFSPSSWCQGASQDYGLGGASPRGDPGLGERDWTSKYGQGAGEGSTREWASRCGIGQEEMEASSSQDQSKVSAPGVLTAQDRVVGKPAQLGTQRSQEADVQDWEFRKRDSQGTYSSRDAELQDQEFGKRDSLGTYSSRDVSLGDWEFGKRDSLGAYASQDANEQGQDLGKRDHHGRYSSQDADEQDWEFQKRDVSLGTYGSRAAEPQEQEFGKSAWIRDYSSGGSSRTLDAQDRSFGTRPLSSGFSPEEAQQQDEEFEKKIPSVEDSLGEGSRDAGRPGERGSGGLFSPSTAHVPDGALGQRDQSSWQNSDASQEVGGHQERQQAGAQGPGSADLEDGEMGKRGWVGEFSLSVGPQREAAFSPGQQDWSRDFCIEASERSYQFGIIGNDRVSGAGFSPSSKMEGGHFVPPGKTTAGSVDWTDQLGLRNLEVSSCVGSGGSSEARESAVGQMGWSGGLSLRDMNLTGCLESGGSEEPGGIGVGEKDWTSDVNVKSKDLAEVGEGGGHSQARESGVGQTDWSGVEAGEFLKSRERGVGQADWTPDLGLRNMAPGAVCSPGESKELGVGQMDWGNNLGLRDLEVTCDPDSGGSQGLRGCGVGQMDWTQDLAPQNVELFGAPSEAREHGVGGVSQCPEPGLRHNGSLSPGLEARDPLEARELGVGETSGPETQGEDYSSSSLEPHPADPGMETGEALSFGASPGRCPARPPPSGSQGLLEEMLAASSSKAVARRESAASGLGGLLEEEGAGAGAAQEEVLEPGRDSPPSWRPQPDGEASQTEDVDGTWGSSAARWSDQGPAQTSRRPSQGPPARSPSQDFSFIEDTEILDSAMYRSRANLGRKRGHRAPVIRPGGTLGLSEAADSDAHLFQDSTEPRASRVPSSDEEVVEEPQSRRTRMSLGTKGLKVNLFPGLSPSALKAKLRPRNRSAEEGELAESKSSQKESAVQRSKSCKVPGLGKPLTLPPKPEKSSGSEGSSPNWLQALKLKKKKV

SEQ ID NO: 885377 - protein, 649 aa, Homo sapiens
MGKRGWVGEFSLSVGPQREAAFSPGQQDWSRDFCIEASERSYQFGIIGNDRVSGAGFSPSSKMEGGHFVPPGKTTAGSVDWTDQLGLRNLEVSSCVGSGGSSEARESAVGQMGWSGGLSLRDMNLTGCLESGGSEEPGGIGVGEKDWTSDVNVKSKDLAEVGEGGGHSQARESGVGQTDWSGVEAGEFLKSRERGVGQADWTPDLGLRNMAPGAVCSPGESKELGVGQMDWGNNLGLRDLEVTCDPDSGGSQGLRGCGVGQMDWTQDLAPQNVELFGAPSEAREHGVGGVSQCPEPGLRHNGSLSPGLEARDPLEARELGVGETSGPETQGEDYSSSSLEPHPADPGMETGEALSFGASPGRCPARPPPSGSQGLLEEMLAASSSKAVARRESAASGLGGLLEEEGAGAGAAQEEVLEPGRDSPPSWRPQPDGEASQTEDVDGTWGSSAARWSDQGPAQTSRRPSQGPPARSPSQDFSFIEDTEILDSAMYRSRANLGRKRGHRAPVIRPGGTLGLSEAADSDAHLFQDSTEPRASRVPSSDEEVVEEPQSRRTRMSLGTKGLKVNLFPGLSPSALKAKLRPRNRSAEEGELAESKSSQKESAVQRSKSCKVPGLGKPLTLPPKPEKSSGSEGSSPNWLQALKLKKKKV

SEQ ID NO: 885378 - protein, 301 aa, Homo sapiens [sequence omitted]

SEQ ID NO: 885379 - protein, 1167 aa, Homo sapiens; identical to SEQ ID NO: 885376

SEQ ID NO: 885380 - protein, 1167 aa, Homo sapiens; identical to SEQ ID NO: 885376

SEQ ID NO: 885381 - protein, 1167 aa, Homo sapiens; identical to SEQ ID NO: 885376

SEQ ID NO: 885382 - protein, 125 aa, Homo sapiens
PLSRAFAEPRASRVPSSDEEVVEEPQSRRTRMSLGTKGLKVNLFPGLSPSALKAKLRPRNRSAEEGELAESKSSQKESAVQRSKSCKVPGLGKPLTLPPKPEKSSGSEGSSPNWLQALKLKKKKV

SEQ ID NO: 885383 - protein, 1167 aa, Homo sapiens; identical to SEQ ID NO: 885376

SEQ ID NO: 885384 - protein, 1167 aa, Homo sapiens; identical to SEQ ID NO: 885376

SEQ ID NO: 885385 - protein, 1167 aa, Homo sapiens; identical to SEQ ID NO: 885376

SEQ ID NO: 885386 - protein, 1049 aa, Homo sapiens
QFPAVPLEPLPTTEGTPGLPLQQAEERYESQEPLAGQESPLPLATREAALPILEPVLGQEQPAAPDQPCVLFADAPEPGQALPVEEEAVTLARAETTQARTEAQDLCRASPEPPGPESSSRWLDDLLASPPPSGGGARRGAGAELKDTQSPSTCSEGLLGWSQKDLQSEFGITGDPQPSSFSPSSWCQGASQDYGLGGASPRGDPGLGERDWTSKYGQGAGEGSTREWASRCGIGQEEMEASSSQDQSKVSAPGVLTAQDRVVGKPAQLGTQRSQEADVQDWEFRKRDSQGTYSSRDAELQDQEFGKRDSLGTYSSRDVSLGDWEFGKRDSLGAYASQDANEQGQDLGKRDHHGRYSSQDADEQDWEFQKRDVSLGTYGSRAAEPQEQEFGKSAWIRDYSSGGSSRTLDAQDRSFGTRPLSSGFSPEEAQQQDEEFEKKIPSVEDSLGEGSRDAGRPGERGSGGLFSPSTAHVPDGALGQRDQSSWQNSDASQEVGGHQERQQAGAQGPGSADLEDGEMGKRGWVGEFSLSVGPQREAAFSPGQQDWSRDFCIEASERSYQFGIIGNDRVSGAGFSPSSKMEGGHFVPPGKTTAGSVDWTDQLGLRNLEVSSCVGSGGSSEARESAVGQMGWSGGLSLRDMNLTGCLESGGSEEPGGIGVGEKDWTSDVNVKSKDLAEVGEGGGHSQARESGVGQTDWSGVEAGEFLKSRERGVGQADWTPDLGLRNMAPGAVCSPGESKELGVGQMDWGNNLGLRDLEVTCDPDSGGSQGLRGCGVGQMDWTQDLAPQNVELFGAPSEAREHGVGGVSQCPEPGLRHNGSLSPGLEARDPLEARELGVGETSGPETQGEDYSSSSLEPHPADPGMETGEALSFGASPGRCPARPPPSGSQGLLEEMLAASSSKAVARRESAASGLGGLLEEEGAGAGAAQEEVLEPGRDSPPSWRPQPDGEASQTEDVDGTWGSSAARWSDQGPAQTSRRPSQGPPARSPSQDFSFIEDTEILDSAMNSEVPMNSEAPFFFYKFVEVQFLTDDGYQTFVGCKVYVPRI

SEQ ID NO: 885387 - protein, 877 aa, Homo sapiens
QFPAVPLEPLPTTEGTPGLPLQQAEERYESQEPLAGQESPLPLATREAALPILEPVLGQEQPAAPDQPCVLFADAPEPGQALPVEEEAVTLARAETTQARTEAQDLCRASPEPPGPESSSRWLDDLLASPPPSGGGARRGAGAELKDTQSPSTCSEGLLGWSQKDLQSEFGITGDPQPSSFSPSSWCQGASQDYGLGGASPRGDPGLGERDWTSKYGQGAGEGSTREWASRCGIGQEEMEASSSQDQSKVSAPGVLTAQDRVVGKPAQLGTQRSQEADVQDWEFRKRDSQGTYSSRDAELQDQEFGKRDSLGTYSSRDVSLGDWEFGKRDSLGAYASQDANEQGQDLGKRDHHGRYSSQDADEQDWEFQKRDVSLGTYGSRAAEPQEQEFGKSAWIRDYSSGGSSRTLDAQDRSFGTRPLSSGFSPEEAQQQDEEFEKKIPSVEDSLGEGSRDAGRPGERGSGGLFSPSTAHVPDGALGQRDQSSWQNSDASQEVGGHQERQQAGAQGPGSADLEDGEMGKRGWVGEFSLSVGPQREAAFSPGQQDWSRDFCIEASERSYQFGIIGNDRVSGAGFSPSSKMEGGHFVPPGKTTAGSVDWTDQLGLRNLEVSSCVGSGGSSEARESAVGQMGWSGGLSLRDMNLTGCLESGGSEEPGGIGVGEKDWTSDVNVKSKDLAEVGEGGGHSQARESGVGQTDWSGVEAGEFLKSRERGVGQADWTPDLGLRNMAPGAVCSPGESKELGVGQMDWGNNLGLRDLEVTCDPDSGGSQGLRGCGVGQMDWTQDLAPQNVELFGAPSEAREHGVGGVSQCPEPGLRHNGSLSPGLEARDPLEARELGVGETSGPETQGEDYSSSSLEPHPADPGMETGEALSFGAR

SEQ ID NO: 885388 - protein, 877 aa, Homo sapiens; identical to SEQ ID NO: 885387

SEQ ID NO: 885389 - protein, 877 aa, Homo sapiens; identical to SEQ ID NO: 885387

SEQ ID NO: 885390 - protein, 877 aa, Homo sapiens; identical to SEQ ID NO: 885387

SEQ ID NO: 885391 - protein, 786 aa, Homo sapiens
QFPAVPLEPLPTTEGTPGLPLQQAEERYESQEPLAGQESPLPLATREAALPILEPVLGQEQPAAPDQPCVLFADAPEPGQALPVEEEAVTLARAETTQARTEAQDLCRASPEPPGPESSSRWLDDLLASPPPSGGGARRGAGAELKDTQSPSTCSEGLLGWSQKDLQSEFGITGDPQPSSFSPSSWCQGASQDYGLGGASPRGDPGLGERDWTSKYGQGAGEGSTREWASRCGIGQEEMEASSSQDQSKVSAPGVLTAQDRVVGKPAQLGTQRSQEADVQDWEFRKRDSQGTYSSRDAELQDQEFGKRDSLGTYSSRDVSLGDWEFGKRDSLGAYASQDANEQGQDLGKRDHHGRYSSQDADEQDWEFQKRDVSLGTYGSRAAEPQEQEFGKSAWIRDYSSGGSSRTLDAQDRSFGTRPLSSGFSPEEAQQQDEEFEKKIPSVEDSLGEGSRDAGRPGERGSGGLFSPSTAHVPDGALGQRDQSSWQNSDASQEVGGHQERQQAGAQGPGSADLEDGEMGKRGWVGEFSLSVGPQREAAFSPGQQDWSRDFCIEASERSYQFGIIGNDRVSGAGFSPSSKMEGGHFVPPGKTTAGSVDWTDQLGLRNLEVSSCVGSGGSSEARESAVGQMGWSGGLSLRDMNLTGCLESGGSEEPGGIGVGEKDWTSDVNVKSKDLAEVGEGGGHSQARESGVGQTDWSGVEAGEFLKSRERGVGQADWTPDLGLRNMAPGAVCSPGESKELGVGQMDWGNNLGLRDLEVTCDPDSGGSQGLRGCGVGQSLPWVFF

SEQ ID NO: 885392 - protein, 786 aa, Homo sapiens; identical to SEQ ID NO: 885391

SEQ ID NO: 885393 - protein, 658 aa, Homo sapiens
QFPAVPLEPLPTTEGTPGLPLQQAEERYESQEPLAGQESPLPLATREAALPILEPVLGQEQPAAPDQPCVLFADAPEPGQALPVEEEAVTLARAETTQARTEAQDLCRASPEPPGPESSSRWLDDLLASPPPSGGGARRGAGAELKDTQSPSTCSEGLLGWSQKDLQSEFGITGDPQPSSFSPSSWCQGASQDYGLGGASPRGDPGLGERDWTSKYGQGAGEGSTREWASRCGIGQEEMEASSSQDQSKVSAPGVLTAQDRVVGKPAQLGTQRSQEADVQDWEFRKRDSQGTYSSRDAELQDQEFGKRDSLGTYSSRDVSLGDWEFGKRDSLGAYASQDANEQGQDLGKRDHHGRYSSQDADEQDWEFQKRDVSLGTYGSRAAEPQEQEFGKSAWIRDYSSGGSSRTLDAQDRSFGTRPLSSGFSPEEAQQQDEEFEKKIPSVEDSLGEGSRDAGRPGERGSGGLFSPSTAHVPDGALGQRDQSSWQNSDASQEVGGHQERQQAGAQGPGSADLEDGEMGKRGWVGEFSLSVGPQREAAFSPGQQDWSRDFCIEASERSYQFGIIGNDRVSGAGFSPSSKMEGGHFVPPGKTTAGSVDWTDQLGLRNLEVSSCVGSGGSSEARESAVGQMGWSGGLSLRDMNLTGCLESGGSEEPGGI

SEQ ID NO: 885394 - protein, 503 aa, Homo sapiens
QFPAVPLEPLPTTEGTPGLPLQQAEERYESQEPLAGQESPLPLATREAALPILEPVLGQEQPAAPDQPCVLFADAPEPGQALPVEEEAVTLARAETTQARTEAQDLCRASPEPPGPESSSRWLDDLLASPPPSGGGARRGAGAELKDTQSPSTCSEGLLGWSQKDLQSEFGITGDPQPSSFSPSSWCQGASQDYGLGGASPRGDPGLGERDWTSKYGQGAGEGSTREWASRCGIGQEEMEASSSQDQSKVSAPGVLTAQDRVVGKPAQLGTQRSQEADVQDWEFRKRDSQGTYSSRDAELQDQEFGKRDSLGTYSSRDVSLGDWEFGKRDSLGAYASQDANEQGQDLGKRDHHGRYSSQDADEQDWEFQKRDVSLGTYGSRAAEPQEQEFGKSAWIRDYSSGGSSRTLDAQDRSFGTRPLSSGFSPEEAQQQDGSTLFRGWSQEGPVKSPAECREEHSKTPEERSLPSDLAFNGDLAKAASSELQPPLGFLLIPIYSIFYKSL

SEQ ID NO: 885395 - protein, 445 aa, Homo sapiens
QFPAVPLEPLPTTEGTPGLPLQQAEERYESQEPLAGQESPLPLATREAALPILEPVLGQEQPAAPDQPCVLFADAPEPGQALPVEEEAVTLARAETTQARTEAQDLCRASPEPPGPESSSRWLDDLLASPPPSGGGARRGAGAELKDTQSPSTCSEGLLGWSQKDLQSEFGITGDPQPSSFSPSSWCQGASQDYGLGGASPRGDPGLGERDWTSKYGQGAGEGSTREWASRCGIGQEEMEASSSQDQSKVSAPGVLTAQDRVVGKPAQLGTQRSQEADVQDWEFRKRDSQGTYSSRDAELQDQEFGKRDSLGTYSSRDVSLGDWEFGKRDSLGAYASQDANEQGQDLGKRDHHGRYSSQDADEQDWEFQKRDVSLGTYGSRAAEPQEQEFGKSAWIRDYSSGGSSRTLDAQDRSFGTRPLSSGFSPEEAQQQDEEFEKKIPSVRN

SEQ ID NO: 885396 - protein, 402 aa, Homo sapiens
QFPAVPLEPLPTTEGTPGLPLQQAEERYESQEPLAGQESPLPLATREAALPILEPVLGQEQPAAPDQPCVLFADAPEPGQALPVEEEAVTLARAETTQARTEAQDLCRASPEPPGPESSSRWLDDLLASPPPSGGGARRGAGAELKDTQSPSTCSEGLLGWSQKDLQSEFGITGDPQPSSFSPSSWCQGASQDYGLGGASPRGDPGLGERDWTSKYGQGAGEGSTREWASRCGIGQEEMEASSSQDQSKVSAPGVLTAQDRVVGKPAQLGTQRSQEADVQDWEFRKRDSQGTYSSRDAELQDQEFGKRDSLGTYSSRDVSLGDWEFGKRDSLGAYASQDANEQGQDLGKRDHHGRYSSQDADEQDWEFQKRDVSLGTYGSRAAEPQEQEFGKSGNTGQSATP

SEQ ID NO: 885397 - protein, 438 aa, Homo sapiens
QFPAVPLEPLPTTEGTPGLPLQQAEERYESQEPLAGQESPLPLATREAALPILEPVLGQEQPAAPDQPCVLFADAPEPGQALPVEEEAVTLARAETTQARTEAQDLCRASPEPPGPESSSRWLDDLLASPPPSGGGARRGAGAELKDTQSPSTCSEGLLGWSQKDLQSEFGITGDPQPSSFSPSSWCQGASQDYGLGGASPRGDPGLGERDWTSKYGQGAGEGSTREWASRCGIGQEEMEASSSQDQSKVSAPGVLTAQDRVVGKPAQLGTQRSQEADVQDWEFRKRDSQGTYSSRDAELQDQEFGKRDSLGTYSSRDVSLGDWEFGKRDSLGAYASQDANEQGQDLGKRDHHGRYSSQDADEQDWEFQKRDVSLGTYGSRAAEPQEQEFGKSAWIRDYSSGGSSRTLDAQDRSFGTRPLSSAMRSRSHERLAGRRTR

SEQ ID NO: 885398 - protein, 342 aa, Homo sapiens
GGGDWHRGPEPSGDPGRARLQPPQLIPLCLPALKEGLPHVMKVSTLRESSAMASPLPREMEEELVPTGSEPGDTRAKPPVKPKPRALPAKPALPAKPSLLVPVGPRPPRGPLAELPSARKMNMLAGPQPYGGSKRPLPFAPRPAVEASTGGEATQETGKEEAGKEEPPPLTPPARCAAPGGVRKAPAPFRPASERFAATTVEEILAKMEQPRKEVLASPDRLWGSRLTFNHDGSSRYGPRTYGTTTAPRDEDGSTLFRGWSQEGPVKSPAECREEHSKTPEERSLPSDLAFNGDLAKAASSELPADISKPWIPSSPAPSSENGGPASPGLPAEASGSGPGSP

SEQ ID NO: 885399 - protein, 173 aa, Homo sapiens
MVYTLWAAVWVTWNVFIICFYLEVGGLLKDSELLTFSLSRHRSWWRERWPGCLHEEVPAVGLGAPHGQALVSGAGCALEPSYVEALHSCLQILIALLGFVCGCQVVSVFTEEEDSCEYGASAGSGAGDGYRGGSSESVPSGARRETSPLGRDLTPSRALLTAVGLSEDSPHTR

SEQ ID NO: 885400 - protein, 165 aa, Homo sapiens
TLFTKAAGSSLGCSLGGGFWGALQWRPVLSTCNVSPVRRGQVTAAQPGCCVRTPTCAGAPLSWLSHRLIPGAPTWESSETCPRWAWGTPFSMLCIWGPPDSGAEAAPPMRSWDPFPRGLDASRCARELCSAAAPSSPLPSTRCGQPSGSPGTSSSSASTWKSVAS

SEQ ID NO: 885401 - protein, 208 aa, Homo sapiens
MGSCSGRCALVVLCAFQLVAALERQVFDFLGYQWAPILANFVHIIIVILGLFGTIQYRLRYVMVYTLWAAVWVTWNVFIICFYLEVGGLLKDSELLTFSLSRHRSWWRERWPGCLHEEVPAVGLGAPHGQALVSGAGCALEPSYVEALHSCLQILIALLGFVCGCQVVSVFTEEEDSFDFIGGFDPFPLYHVNEKPSSLLSKQVYLPA

SEQ ID NO: 885402 - protein, 146 aa, Homo sapiens
MVYTLWAAVWVTWNVFIICFYLEVGGLLKDSELLTFSLSRHRSWWRERWPGCLHEEVPAVGLGAPHGQALVSGAGCALEPSYVEALHSCLQILIALLGFVCGCQVVSVFTEEEDSFDFIGGFDPFPLYHVNEKPSSLLSKQVYLPA

SEQ ID NO: 885403 - protein, 229 aa, Homo sapiens
QSNSHPGPRTAAGRSGRGGRQLLGAGREKRPFIRGTKLEVAALERQVFDFLGYQWAPILANFVHIIIVILGLFGTIQYRLRYVMVYTLWAAVWVTWNVFIICFYLEVGGLLKDSELLTFSLSRHRSWWRERWPGCLHEEVPAVGLGAPHGQALVSGAGCALEPSYVEALHSCLQILIALLGFVCGCQVVSVFTEEEDSFDFIGGFDPFPLYHVNEKPSSLLSKQVYLPA

SEQ ID NO: 885404 - protein, 284 aa, Homo sapiens
TLFTKAAGSSLGCSLGGGFWGALQWRPVLSTCNVSPVRRGQVTAAQPGCCVRTPTCAGAPLSWLSHRLIPGAPTWESSETCPRWAWGTPFSMLCIWGPPDSGAEAAPPMRSWDPFPRGLDASRCARELCSAAAPSSPLPEYTLWAAVWVTWNVFIICFYLEVGGLLKDSELLTFSLSRHRSWWRERWPGCLHEEVPAVGLGAPHGQALVSGAGCALEPSYVEALHSCLQILIALLGFVCGCQVVSVFTEEEDSFDFIGGFDPFPLYHVNEKPSSLLSKQVYLPA

SEQ ID NO: 885405 - protein, 146 aa, Homo sapiens
PGRDLQVNGHHPPGATWGPLSQPDQPSRLDSELLTFSLSRHRSWWRERWPGCLHEEVPAVGLGAPHGQALVSGAGCALEPSYVEALHSCLQILIALLGFVCGCQVVSVFTEEEDSFDFIGGFDPFPLYHVNEKPSSLLSKQVYLPA

SEQ ID NO: 885406 - protein, 119 aa, Homo sapiens
MVYTLWAAVWVTWNVFIICFYLEVGGLLKDSELLTFSLSRHRSWWRERWPGCLHEEVPAVGLGAPHGQALVSGAGCALEPSYVEALHSCLQILIALLGFVCGCQVVSVFTEEEDSCLRK

SEQ ID NO: 885407 - protein, 181 aa, Homo sapiens
MGSCSGRCALVVLCAFQLVAALERQVFDFLGYQWAPILANFVHIIIVILGLFGTIQYRLRYVMVYTLWAAVWVTWNVFIICFYLEVGGLLKDSELLTFSLSRHRSWWRERWPGCLHEEVPAVGLGAPHGQALVSGAGCALEPSYVEALHSCLQILIALLGFVCGCQVVSVFTEEEDSCLRK

SEQ ID NO: 885408 - protein, 162 aa, Homo sapiens
TPRGFPTAHNSASNQLLAEESLPTTPFYFILGKHRQQQDEKLNETLENELVQLPLTENIPAISELLHTPAHVLPSAAFLCSMFVNSLLLSKETKSAKEIPEDVDMEEEKESEDSDEENDFTEKVQDTSNTGLGEDIIHQLSKSEEKELRKFRKIDYSWIAAL

SEQ ID NO: 885409 - protein, 113 aa, Homo sapiens
PGSTKEVQGGTRDWPFRYCAKMVEEENIRVVRCGGSELNFRRAVFSADSKYIFCVSGDFVKVYSTVTEECVHILHGHRNLVTGIQLNPNNHLQVPLHALRISKRVTANLEVID

SEQ ID NO: 885410 - protein, 851 aa, Homo sapiens
PGSTKEVQGGTRDWPFRYCAKMVEEENIRVVRCGGSELNFRRAVFSADSKYIFCVSGDFVKVYSTVTEECVHILHGHRNLVTGIQLNPNNHLQLYSCSLDGTIKLWDYIDGILIKTFIVGCKLHALFTLAQAEDSVFVIVNKEKPDIFQLVSVKLPKSSSQEVEAKELSFVLDYINQSPKCIAFGNEGVYVAAVREFYLSVYFFKKKTTSRFTLSSSRNKKHAKNNFTCVACHPTEDCIASGHMDGKIRLWRNFYDDKKYTYTCLHWHHDMVMDLAFSVTGTSLLSGGRESVLVEWRDATEKNKEFLPRLGATIEHISVSPAGDLFCTSHSDNKIIIIHRNLEASAVIQGLVKDRSIFTGLMIDPRTKALVLNGKPGHLQFYSLQSDKQLYNLDIIQQEYINDYGLIQIELTKAAFGCFGNWLATVEQRQEKETELELQMKLWMYNKKTQGFILNTKINMPHEDCITALCFCNAEKSEQPTLVTASKDGYFKVWILTDDSDIYKKAVGWTCDFVGSYHKYQATNCCFSEDGSLLAVSFEEIVTIWDSVTWELKCTFCQRAGKIRHLCFGRLTCSKYLLGATENGILCCWNLLSCALEWNAKLNVRVMEPDPNSENIAAISQSSVGSDLFVFKPSEPRPLYIQKGISREKVQWGVFVPRDVPESFTSEAYQWLNRSQFYFLTKSQSLLTFSTKSPEEKLTPTSKQLLAEESLPTTPFYFILGKHRQQQDEKLNETLENELVQLPLTENIPAISELLHTPAHVLPSAAFLCSMFVNSLLLSKETKSAKEIPEDVDMEEEKESEDSDEENDFTEKVQDTSNTGLGEDIIHQLSKSEEKELRKFRKIDYSWIAAL

SEQ ID NO: 885411 - protein, 851 aa, Homo sapiens; identical to SEQ ID NO: 885410

SEQ ID NO: 885412 - protein, 851 aa, Homo sapiens; identical to SEQ ID NO: 885410

SEQ ID NO: 885413 - protein, 853 aa, Homo sapiens
PGSTKEVQGGTRDWPFRYCAKMVEEENIRVVRCGGSELNFRRAVFSADSKYIFCVSGDFVKVYSTVTEECVHILHGHRNLVTGIQLNPNNHLQLYSCSLDGTIKLWDYIDGILIKTFIVGCKLHALFTLAQAEDSVFVIVNKEKPDIFQLVSVKLPKSSSQEVEAKELSFVLDYINQSPKCIAFGNEGVYVAAVREFYLSVYFFKKKTTSRFTLSSSRNKKHAKNNFTCVACHPTEDCIASGHMDGKIRLWRNFYDDKKYTYTCLHWHHDMVMDLAFSVTGTSLLSGGRESVLVEWRDATEKNKEFLPRLGATIEHISVSPAGDLFCTSHSDNKIIIIHRNLEASAVIQGLVKDRSIFTGLMIDPRTKALVLNGKPGHLQFYSLQSDKQLYNLDIIQQEYINDYGLIQIELTKAAFGCFGNWLATVEQRQEKETELELQMKLWMYNKKTQGFILNTKINMPHEDCITALCFCNAEKSEQPTLVTASKDGYFKVWILTDDSDIYKKAVGWTCDFVGSYHKYQATNCCFSEDGSLLAVSFEEIVTIWDSVTWELKCTFCQRAGKIRHLCFGRLTCSKYLLGATENGILCCWNLLSCALEWNAKLNVRVMEPDPNSENIAAISQSSVGSDLFVFKPSEPRPLYIQKGISREKVQWGVFVPRDVPESFTSEAYQWLNRSQFYFLTKSQSLLTFSTKSPEEKLTPTSKQLLAEESLPTTPFYFILGKHRQQQDEKLNETLENELVQLPLTENIPAISELLHTPAHVLPSAAFLCSMFVNSLLLSKETKSAKEIPEDVDMEEEKESEDSDEENDFTEKVQDTSNTGLGEDIIHQLSKSEEKELRKFRLGLCVFDCMLIF

SEQ ID NO: 885414 - protein, 608 aa, Homo sapiens
MDGKIRLWRNFYDDKKYTYTCLHWHHDMVMDLAFSVTGTSLLSGGRESVLVEWRDATEKNKEFLPRLGATIEHISVSPAGDLFCTSHSDNKIIIIHRNLEASAVIQGLVKDRSIFTGLMIDPRTKALVLNGKPGHLQFYSLQSDKQLYNLDIIQQEYINDYGLIQIELTKAAFGCFGNWLATVEQRQEKETELELQMKLWMYNKKTQGFILNTKINMPHEDCITALCFCNAEKSEQPTLVTASKDGYFKVWILTDDSDIYKKAVGWTCDFVGSYHKYQATNCCFSEDGSLLAVSFEEIVTIWDSVTWELKCTFCQRAGKIRHLCFGRLTCSKYLLGATENGILCCWNLLSCALEWNAKLNVRVMEPDPNSENIAAISQSSVGSDLFVFKPSEPRPLYIQKGISREKVQWGVFVPRDVPESFTSEAYQWLNRSQFYFLTKSQSLLTFSTKSPEEKLTPTSKQLLAEESLPTTPFYFILGKHRQQQDEKLNETLENELVQLPLTENIPAISELLHTPAHVLPSAAFLCSMFVNSLLLSKETKSAKEIPEDVDMEEEKESEDSDEENDFTEKVQDTSNTGLGEDIIHQLSKSEEKELRKFRKIDYSWIAAL

SEQ ID NO: 885415 - protein, 395 aa, Homo sapiens
PGSTKEVQGGTRDWPFRYCAKMVEEENIRVVRCGGSELNFRRAVFSADSKYIFCVSGDFVKVYSTVTEECVHILHGHRNLVTGIQLNPNNHLQLYSCSLDGTIKLWDYIDGILIKTFIVGCKLHALFTLAQAEDSVFVIVNKEKPDIFQLVSVKLPKSSSQEVEAKELSFVLDYINQSPKCIAFGNEGVYVAAVREFYLSVYFFKKKTTSRFTLSSSRNKKHAKNNFTCVACHPTEDCIASGHMDGKIRLWRNFYDDKKYTYTCLHWHHDMVMDLAFSVTGTSLLSGGRESVLVEWRDATEKNKEFLPRLGATIEHISVSPAGDLFCTSHSDNKIIIIHRNLEASAVIQGLVKDRSIFTGLMIDPRTKALVLNGKPGHLQFYSLQSDKQLYNVYS

SEQ ID NO: 885416 - protein, 701 aa, Homo sapiens
VLPSAAFLCSMFVNSLLLSFVLDYINQSPKCIAFGNEGVYVAAVREFYLSVYFFKKKTTSRFTLSSSRNKKHAKNNFTCVACHPTEDCIASGHMDGKIRLWRNFYDDKKYTYTCLHWHHDMVMDLAFSVTGTSLLSGGRESVLVEWRDATEKNKEFLPRLGATIEHISVSPAGDLFCTSHSDNKIIIIHRNLEASAVIQGLVKDRSIFTGLMIDPRTKALVLNGKPGHLQFYSLQSDKQLYNLDIIQQEYINDYGLIQIELTKAAFGCFGNWLATVEQRQEKETELELQMKLWMYNKKTQGFILNTKINMPHEDCITALCFCNAEKSEQPTLVTASKDGYFKVWILTDDSDIYKKAVGWTCDFVGSYHKYQATNCCFSEDGSLLAVSFEEIVTIWDSVTWELKCTFCQRAGKIRHLCFGRLTCSKYLLGATENGILCCWNLLSCALEWNAKLNVRVMEPDPNSENIAAISQSSVGSDLFVFKPSEPRPLYIQKGISREKVQWGVFVPRDVPESFTSEAYQWLNRSQFYFLTKSQSLLTFSTKSPEEKLTPTSKQLLAEESLPTTPFYFILGKHRQQQDEKLNETLENELVQLPLTENIPAISELLHTPAHVLPSAAFLCSMFVNSLLLSKETKSAKEIPEDVDMEEEKESEDSDEENDFTEKVQDTSNTGLGEDIIHQLSKSEEKELRKFRKIDYSWIAAL

SEQ ID NO: 885417 - protein, 784 aa, Homo sapiens
PGSTKEVQGGTRDWPFRYCAKMVEEENIRVVRCGGSELNFRRAVFSADSKYIFCVSGDFVKVYSTVTEECVHILHGHRNLVTGIQLNPNNHLQLYSCSLDGTIKLWDYIDGILIKTFIVGCKLHALFTLAQAEDSVFVIVNKEKPDIFQLVSVKLPKSSSQEVEAKELSFVLDYINQSPKCIAFGNEGVYVAAVREFYLSVYFFKKKTTSRFTLSSSRNKKHAKNNFTCVACHPTEDCIASGHMDGKIRLWRNFYDDKKYTYTCLHWHHDMVMDLAFSVTGTSLLSGGRESVLVEWRDATEKNKEFLPRLGATIEHISVSPAGDLFCTSHSDNKIIIIHRNLEASAVIQGLVKDRSIFTGLMIDPRTKALVLNGKPGHLQFYSLQSDKQLYNLDIIQQEYINDYGLIQIELTKAAFGCFGNWLATVEQRQEKETELELQMKLWMYNKKTQGFILNTKINMPHEDCITALCFCNAEKSEQPTLVTASKDGYFKVWILTDDSDIYKKAVGWTCDFVGSYHKYQATNCCFSEDGSLLAVSFEEIVTIWDSVTWELKCTFCQRAGKIRHLCFGRLTCSKYLLGATENGILCCWNLLSCALEWNAKLNVRVMEPDPNSENIAAISQSSVGSDLFVFKPSEPRPLYIQKGISREKVQWGVFVPRDVPESFTSEAYQWLNRSQFYFLTKSQSLLTFSTKSPEEKLTPTSKQLLAEESLPTTPFYFILGKHRQQQDEKLNETLENELVQLPLTENIPAISELLHTPAHVLPSAAFLCSMFVNSLLLSKETKR

SEQ ID NO: 885418 - protein, 234 aa, Homo sapiens [sequence omitted]

SEQ ID NO: 885419 - protein, 208 aa, Homo sapiens
PGSTKEVQGGTRDWPFRYCAKMVEEENIRVVRCGGSELNFRRAVFSADSKYIFCVSGDFVKVYSTVTEECVHILHGHRNLVTGIQLNPNNHLQLYSCSLDGTIKLWDYIDGILIKTFIVGCKLHALFTLAQAEDSVFVIVNKEKPDIFQLVSVKLPKSSSQEVEAKELSFVLDYINQSPKCIAFGNEVNFVLFVFCFVPKISFLQSLF

SEQ ID NO: 885420 - protein, 154 aa, Homo sapiens
MAQSINITELNLPQLEMLKNQLDQEVEFLSTSIAQLKVVQTKYVEAKDCLNVLNKSNEGKELLVPLTSSMYVPGKLHDVEHVLIDVGTGYYVEKTAEDAKDFFKRKIDFLTKQMEKIQPALQEKHAMKQAVMEMMSQKIQQLTALGAAQATAKA

SEQ ID NO: 885421 - protein, 154 aa, Homo sapiens; identical to SEQ ID NO: 885420

SEQ ID NO: 885422 - protein, 166 aa, Homo sapiens
RLVEAGVNRPRHMAQSINITELNLPQLEMLKNQLDQEVEFLSTSIAQLKVVQTKYVEAKDCLNVLNKSNEGKELLVPLTSSMYVPGKLHDVEHVLIDVGTGYYVEKTAEDAKDFFKRKIDFLTKQMEKIQPALQEKHAMKQAVMEMMSQKIQQLTALGAAQATAKA

SEQ ID NO: 885423 - protein, 120 aa, Homo sapiens
PIFLLYCKYVEAKDCLNVLNKSNEGKELLVPLTSSMYVPGKLHDVEHVLIDVGTGYYVEKTAEDAKDFFKRKIDFLTKQMEKIQPALQEKHAMKQAVMEMMSQKIQQLTALGAAQATAKA

SEQ ID NO: 885424 - protein, 154 aa, Homo sapiens; identical to SEQ ID NO: 885420

SEQ ID NO: 885425 - protein, 154 aa, Homo sapiens; identical to SEQ ID NO: 885420

SEQ ID NO: 885426 - protein, 154 aa, Homo sapiens; identical to SEQ ID NO: 885420

SEQ ID NO: 885427 - protein, 154 aa, Homo sapiens; identical to SEQ ID NO: 885420

SEQ ID NO: 885428 - protein, 167 aa, Homo sapiens
MGVDVMTVVGLPNMAQSINITELNLPQLEMLKNQLDQEVEFLSTSIAQLKVVQTKYVEAKDCLNVLNKSNEGKELLVPLTSSMYVPGKLHDVEHVLIDVGTGYYVEKTAEDAKDFFKRKIDFLTKQMEKIQPALQEKHAMKQAVMEMMSQKIQQLTALGAAQATAKA

SEQ ID NO: 885429 - protein, 158 aa, Homo sapiens
DLTFVKSSIAKLPADLPQLEMLKNQLDQEVEFLSTSIAQLKVVQTKYVEAKDCLNVLNKSNEGKELLVPLTSSMYVPGKLHDVEHVLIDVGTGYYVEKTAEDAKDFFKRKIDFLTKQMEKIQPALQEKHAMKQAVMEMMSQKIQQLTALGAAQATAKA

SEQ ID NO: 885430 - protein, 154 aa, Homo sapiens; identical to SEQ ID NO: 885420

SEQ ID NO: 885431 - protein, 154 aa, Homo sapiens; identical to SEQ ID NO: 885420

SEQ ID NO: 885432 - protein, 154 aa, Homo sapiens; identical to SEQ ID NO: 885420

SEQ ID NO: 885433 - protein, 167 aa, Homo sapiens; identical to SEQ ID NO: 885428

SEQ ID NO: 885434 - protein, 66 aa, Homo sapiens
MAQSINITELNLPQLEMLKNQLDQEVEFLSTSIAQLKVVQTKYVEAKDCLNVLNKSNEDVCPWEAA

SEQ ID NO: 885435 - protein, 122 aa, Homo sapiens
MGVDVMTVVGLPNMAQSINITELNLPQLEMLKNQLDQMYVPGKLHDVEHVLIDVGTGYYVEKTAEDAKDFFKRKIDFLTKQMEKIQPALQEKHAMKQAVMEMMSQKIQQLTALGAAQATAKA

SEQ ID NO: 885436 - protein, 149 aa, Homo sapiens
MGVDVMTVVGLPNMAQSINITELNLPQLEMLKNQLDQEVEFLSTSIAQLKVVQTKYVEAKDCLNVLNKSNEGKELLVPLTSSMYVPGKLHDVEHVLIDVGTGYYVEKTAEDAKDFFKRKIDFLTKQMEMMSQKIQQLTALGAAQATAKA

SEQ ID NO: 885437 - protein, 122 aa, Homo sapiens; identical to SEQ ID NO: 885435

SEQ ID NO: 885438 - protein, 88 aa, Homo sapiens
DLTFVKSSIAETSGSAAARNAQEPAGPETAEDAKDFFKRKIDFLTKQMEKIQPALQEKHAMKQAVMEMMSQKIQQLTALGAAQATAKA

SEQ ID NO: 885439 - protein, 109 aa, Homo sapiens
MAQSINITELNLPQLEMLKNQLDQMYVPGKLHDVEHVLIDVGTGYYVEKTAEDAKDFFKRKIDFLTKQMEKIQPALQEKHAMKQAVMEMMSQKIQQLTALGAAQATAKA

SEQ ID NO: 885440 - protein, 109 aa, Homo sapiens; identical to SEQ ID NO: 885439

SEQ ID NO: 885441 - protein, 170 aa, Homo sapiens
WFENHGVGTSGVRIDLPQLEMLKNQLDQEVEFLSTSIAQLKVVQTKYVEAKDCLNVLNKSNEGNRSLEPLTKQSVNISLSGCQPAPEGYSPTRYWLQQQRAQFLTCPQDVNKHRSHWKLQQVDSNVTMAKSSDEEGWKKFLLGKKYVLTGLLDQPQMKSPGIKYVQRRRP

SEQ ID NO: 885442 - protein, 167 aa, Homo sapiens; identical to SEQ ID NO: 885428

SEQ ID NO: 885443 - protein, 154 aa, Homo sapiens; identical to SEQ ID NO: 885420

SEQ ID NO: 885444 - protein, 167 aa, Homo sapiens; identical to SEQ ID NO: 885428

SEQ ID NO: 885445 - protein, 167 aa, Homo sapiens; identical to SEQ ID NO: 885428

SEQ ID NO: 885446 - protein, 154 aa, Homo sapiens; identical to SEQ ID NO: 885420

SEQ ID NO: 885447 - protein, 108 aa, Homo sapiens
LLLLYGCDMTTEGKELLVPLTSSMYVPGKLHDVEHVLIDVGTGYYVEKTAEDAKDFFKRKIDFLTKQMEKIQPALQEKHAMKQAVMEMMSQKIQQLTALGAAQATAKA

SEQ ID NO: 885448 - protein, 122 aa, Homo sapiens; identical to SEQ ID NO: 885435

SEQ ID NO: 885449 - protein, 72 aa, Homo sapiens
RGYSLSWKKRVFGGQAGWLAESWLMLGWLVFPLILASQMYVPGKLHDVEHVLIDVGTGYYVEKVSESMWMPL

SEQ ID NO: 885450 - protein, 88 aa, Homo sapiens; identical to SEQ ID NO: 885438

SEQ ID NO: 885451 - protein, 165 aa, Homo sapiens
MTKLRGCRHEGVEQGARGAVRSGWLHLDCELLFRGCWWWRWRTAAPWCGEPRRPWTGVSSLKTGPTPAALPTSCATVSTETCGSEASSSVRLASSEVTSWSILSDPLRFHAHYIAQCWAPEDTIPLQDLVAAGRLGTSVRKTLLLCSPQPDGKVVYTSLQWASLQ

SEQ ID NO: 885452 - protein, 249 aa, Homo sapiens
MLVVEVANGRSLVWGAEAVQALRERLGVGGRTVGALPRGPRQNSRLGLPLLLMPEEARLLAEIGAVTLVSAPRPDSRHHSLALTSFKRQQEESFQEQSALAAEARETRRQELLEKITEGQAAKKQKLEQASGASSSQEAGSSQAAKEDETSDGQASGEQEEAGPSSSQAGPSNGVAPLPRSALLVQLATARPRPVKARPLDWRVQSKDWPHAGRPAHELRYSIYRDLWERGFFLSAAGKFGGDFLVYPE

SEQ ID NO: 885453 - protein, 274 aa, Homo sapiens
MLVVEVANGRSLVWGAEAVQALRERLGVGGRTVGALPRGPRQNSRLGLPLLLMPEEARLLAEIGAVTLVSAPRPDSRHHSLALTSFKRQQEESFQEQSALAAEARETRRQELLEKITEGQAAKKQKLEQASGASSSQEAGSSQAAKEDETSDGQASGEQEEAGPSSSQAGPSNGVAPLPRSALLVQLATARPRPVKARPLDWRVQSKDWPHAGRPAHELRYSIYRDLWERGFFLSAAGKFGGDFLVYPDPSVHAHILLVLAPEAFHPRLCGAWP

SEQ ID NO: 885454 - protein, 286 aa, Homo sapiens
RPRGGASPRPRRLWVRCSGLRRAAVSVTALPPGSRRRMLVVEVANGRSLVWGAEAVQALRERLGVGGRTVGALPRGPRQNSRLGLPLLLMPEEARLLAEIGAVTLVSAPRPDSRHHSLALTSFKRQQEESFQEQSALAAEARETRRQELLEKITEGQAAKKQKLEQASGASSSQEAGSSQAAKEDETSDGQASGEQEEAGPSSSQAGPSNGVAPLPRSALLVQLATARPRPVKARPLDWRVQSKDWPHAGRPAHELRYSIYRDLWERGFFLSAAGKFGGDFLVYPE

SEQ ID NO: 885455 - protein, 286 aa, Homo sapiens; identical to SEQ ID NO: 885454

SEQ ID NO: 885456 - protein, 249 aa, Homo sapiens; identical to SEQ ID NO: 885452

SEQ ID NO: 885457 - protein, 274 aa, Homo sapiens; identical to SEQ ID NO: 885453

SEQ ID NO: 885458 - protein, 249 aa, Homo sapiens; identical to SEQ ID NO: 885452

SEQ ID NO: 885459 - protein, 300 aa, Homo sapiens
MLVVEVANGRSLVWGAEAVQALRERLGVGGRTVGALPRGPRQNSRLGLPLLLMPEEARLLAEIGAVTLVSAPRPDSRHHSLALTSFKRQQEESFQEQSALAAEARETRRQELLEKITEGQAAKKQKLEQASGASSSQEAGSSQAAKEDETSDGQASGEQEEAGPSSSQAGPSNGVAPLPRSALLVQLATARPRPVKARPLDWRVQSKDWPHAGRPAHELRYSIYRDLWERGFFLSAAGKFGGDFLVYPDWSSGPSFSLLSVGLELLRLCWLPETAFHVRYPSGPAGVAGLGPRGLSPRFL

SEQ ID NO: 885460 - protein, 280 aa, Homo sapiens
ASCRFGTRVRCSGLRRAAVSVTALPPGSRRRMLVVEVANGRSLVWGAEAVQALRERLGVGGRTVGALPRGPRQNSRLGLPLLLMPEEARLLAEIGAVTLVSAPRPDSRHHSLALTSFKRQQEESFQEQSALAAEARETRRQELLEKITEGQAAKKQKLEQASGASSSQEAGSSQAAKEDETSDGQASGEQEEAGPSSSQAGPSNGVAPLPRSALLVQLATARPRPVKARPLDWRVQSKDWPHAGRPAHELRYSIYRDLWERGFFLSAAGKFGGDFLVYPE

SEQ ID NO: 885461 - protein, 249 aa, Homo sapiens; identical to SEQ ID NO: 885452

SEQ ID NO: 885462 - protein, 120 aa, Homo sapiens
MLVVEVANGRSLVWGAEAVQALRERLGVGGRTVGALPRGPRQNSRLGLPLLLMPEEARLLAEIGAVTLVSAPRPDSRHHSLALTSFKRQQEESFQEQKTRTGFRGQLKPGGRLEPGCQRG

SEQ ID NO: 885463 - protein, 230 aa, Homo sapiens
MLVVEVANGRSLVWGAEAVQALRERLGVGGRTVGALPRGPRQNSRLGLPLLLMPEEARLLAEIGAVTLVSAPRPDSRHHSLALTSFKRQQEESFQEQSALAAEARETRRQELLEKITEGQAAKKQKLEQASGASSSQEAGSSQGPSSSQAGPSNGVAPLPRSALLVQLATARPRPVKARPLDWRVQSKDWPHAGRPAHELRYSIYRDLWERGFFLSAAGKFGGDFLVYPE

SEQ ID NO: 885464 - protein, 215 aa, Homo sapiens
RGCWVNGIRRLIVSRRGDEEEFFEIRTEWSDRSVLYLHRSLADLGRLWQRLRDAFPEDRSELAQGPLRQGLVAIKEAHDIETRLNEVEKLLKTIISMPCKYSRSEVVLTFFERSPLDQVLKNDNVHKIQPSFQSPVKISEIMRSNGFCLANTETIVIDHSIPNGRDQHLGVDPTEHLFENGSEFPSELEDGDDPAAYVTNLSYYHLVPFETDIWD

SEQ ID NO: 885465 - protein, 140 aa, Homo sapiens
RGCWVNGIRRLIVSRRGDEEEFFEIRTEWSDRSVLYLHRSLADLGRLWQRLRDAFPEDRSELAQGPLRQGLVAIKEAHDIETRLNEVEKLLKTIISMPCKYSRSEVVLTFFERSPLDQVLKNDNVHKIQPSFQSPVKISE

SEQ ID NO: 885466 - protein, 215 aa, Homo sapiens; identical to SEQ ID NO: 885464

SEQ ID NO: 885467 - protein, 215 aa, Homo sapiens; identical to SEQ ID NO: 885464

SEQ ID NO: 885468 - protein, 178 aa, Homo sapiens
ASRGIEPVMGRLLLCASHGEIEKHPSLHASSYGLVAIKEAHDIETRLNEVEKLLKTIISMPCKYSRSEVVLTFFERSPLDQVLKNDNVHKIQPSFQSPVKISEIMRSNGFCLANTETIVIDHSIPNGRDQHLGVDPTEHLFENGSEFPSELEDGDDPAAYVTNLSYYHLVPFETDIWD

SEQ ID NO: 885469 - protein, 215 aa, Homo sapiens; identical to SEQ ID NO: 885464

SEQ ID NO: 885470 - protein, 464 aa, Homo sapiens
MSDGNPELLSTSQTYNGQSENNEDYEIPPITPPNLPEPSLLHLGDHEASYHSLCHGLTPNGLLPAYSYQAMDLPAIMVSNMLAQDSHLLSGQLPTIQEMVHSEVAAYDSGRPGPLLGRPAMLASHMSALSQSQLISQMGIRSSIAHSSPSPPGSKSATPSPSSSTQEEESEVHFKISGEKRPSADPGKKAKNPKKKKKKDPNEPQKPVSAYALFFRDTQAAIKGQNPSATFGDVSKIVASMWDSLGEEQKQAYKRKTEAAKKEYLKALAAYRASLVSKSSPDQGETKSTQANPPAKMLPPKQPMYAMPGLASFLTPSDLQAFRSGASPASLARTLGSKSLLPGLSASPPPPPSFPLSPTLHQQLSLPPHAQGALLSPPVSMSPAPQPPVLPTPMALQVQLAMSPSPPGPQDFPHISEFPSSSGSCSPGPSNPTSSGDWDSSYPSGECGISTCSLLPRDKSLYLT

SEQ ID NO: 885471 - protein, 511 aa, Homo sapiens
AAAPAMDVRLYPSAPAVGARPGAEPAGLAHLDYYHGGKFDGDSAYVGMSDGNPELLSTSQTYNGQSENNEDYEIPPITPPNLPEPSLLHLGDHEASYHSLCHGLTPNGLLPAYSYQAMDLPAIMVSNMLAQDSHLLSGQLPTIQEMVHSEVAAYDSGRPGPLLGRPAMLASHMSALSQSQLISQMGIRSSIAHSSPSPPGSKSATPSPSSSTQEEESEVHFKISGEKRPSADPGKKAKNPKKKKKKDPNEPQKPVSAYALFFRDTQAAIKGQNPSATFGDVSKIVASMWDSLGEEQKQAYKRKTEAAKKEYLKALAAYRASLVSKSSPDQGETKSTQANPPAKMLPPKQPMYAMPGLASFLTPSDLQAFRSGASPASLARTLGSKSLLPGLSASPPPPPSFPLSPTLHQQLSLPPHAQGALLSPPVSMSPAPQPPVLPTPMALQVQLAMSPSPPGPQDFPHISEFPSSSGSCSPGPSNPTSSGDWDSSYPSGECGISTCSLLPRDKSLYLT

SEQ ID NO: 885472 - protein, 369 aa, Homo sapiens
RSPGADAWAPWRCGFDGDSAYVGMSDGNPELLSTSQTYNGQSENNEDYEIPPITPPNLPEPSLLHLGDHEASYHSLCHGLTPNGLLPAYSYQAMDLPAIMVSNMLAQDSHLLSGQLPTIQEMVHSEVAAYDSGRPGPLLGRPAMLASHMSALSQSQLISQMGIRSSIAHSSPSPPGSKSATPSPSSSTQEEESEVHFKISGEKRPSADPGKKAKNPKKKKKKDPNEPQKPVSAYALFFRDTQAAIKGQNPSATFGDVSKIVASMWDSLGEEQKQAYKRKTEAAKKEYLKALAAYRASLVSKSSPDQGETKSTQANPPAKMLPPKQPMYAMPGLASFLTPSDLQAFRSGASPASLARTLGSKSLLPGLSA

SEQ ID NO: 885473 - protein, 487 aa, Homo sapiens
RSPGADAWAPWRCGFDGDSAYVGMSDGNPELLSTSQTYNGQSENNEDYEIPPITPPNLPEPSLLHLGDHEASYHSLCHGLTPNGLLPAYSYQAMDLPAIMVSNMLAQDSHLLSGQLPTIQEMVHSEVAAYDSGRPGPLLGRPAMLASHMSALSQSQLISQMGIRSSIAHSSPSPPGSKSATPSPSSSTQEEESEVHFKISGEKRPSADPGKKAKNPKKKKKKDPNEPQKPVSAYALFFRDTQAAIKGQNPSATFGDVSKIVASMWDSLGEEQKQAYKRKTEAAKKEYLKALAAYRASLVSKSSPDQGETKSTQANPPAKMLPPKQPMYAMPGLASFLTPSDLQAFRSGASPASLARTLGSKSLLPGLSASPPPPPSFPLSPTLHQQLSLPPHAQGALLSPPVSMSPAPQPPVLPTPMALQVQLAMSPSPPGPQDFPHISEFPSSSGSCSPGPSNPTSSGDWDSSYPSGECGISTCSLLPRDKSLYLT

SEQ ID NO: 885474 - protein, 464 aa, Homo sapiens; identical to SEQ ID NO: 885470

SEQ ID NO: 885475 - protein, 43 aa, Homo sapiens
MRQERGVPARIPGPPGLGLPECALRPQGSGFWQSLPAVRQGQQ

SEQ ID NO: 885476 - protein, 596 aa, Homo sapiens
MPPPFSSARGFGAPRPRPSPRERSGRRGRARGERPRGVDDLRPAATSSAAETRSHPPAGEPGPRAAPETAVAGCAGASLPGGAAAAAWKMAAPCGSELPANSPLKIPKMEVLSPASPGGLSDGNPSLSDPSTPRGASPLGPGSAAGSGAAASGGLGLGLGGRSAASSSVSFSPGGGGGGAAAAAAAACRGMSWTPAETNALIAVWGNERLVEARYQQLEGAGTVFGSKAPGPAMYERVSRALAELGYERTPSQCRERIKELESDGSTMEDYSQEDWGNHSQDLHGYPTDQELDEIPVTKRTLKIKQESSEEAQKRDIMQNIVQILESVQLKWELFQSWTDFSRLHLSNKLAIFGIGYNTRWKEDIRYHYAEISSQVPLGKRLREYFNSEKPEGRIIMTRVQKMNWKNVYYKFLEITISEARCLELHMEIDWIPIAHSKPTGGNVVQYLLPGGIPKSPGLYAIGYEECIERPLSPHMEQSSLDPGKEGRVDLETLSAQASLQVEIEPTRIIYCYLGIAEVRTLQQCLFLHFQANTKTFSKDWVGINGFLSQNCIVDPGVSPKSIYIKFVEVERDFLSAGSLVECLEKAIGYPLKFNN

SEQ ID NO: 885477 - protein, 279 aa, Homo sapiens [sequence omitted]

SEQ ID NO: 885478 - protein, 329 aa, Homo sapiens
MEDYSQEDWGNHSQDLHGYPTDQELDEIPVTKRTLKIKQESSEEAQKRDIMQNIVQILESVQLKWELFQSWTDFSRLHLSNKLAIFGIGYNTRWKEDIRYHYAEISSQVPLGKRLREYFNSEKPEGRIIMTRVQKMNWKNVYYKFLEITISEARCLELHMEIDWIPIAHSKPTGGNVVQYLLPGGIPKSPGLYAIGYEECIERPLSPHMEQSSLDPGKEGRVDLETLSAQASLQVEIEPTRIIYCYLGIAEVRTLQQCLFLHFQANTKTFSKDWVGINGFLSQNCIVDPGVSPKSIYIKFVEVERDFLSAGSLVECLEKAIGYPLKFNN

SEQ ID NO: 885479 - protein, 944 aa, Homo sapiens
MALLGKRCDVPTNGCGPDRWNSAFTRKDEIITSLVSALDSMCSALSKLNAEVACVAVHDESAFVVGTEKGRMFLNARKELQSDFLRFCRGPPWKDPEAEHPKKVQRGEGGGRSLPRSSLEHGSDVYLLRKMVEEVFDVLYSEALGRASVVPLPYERLLREPGLLAVQGLPEGLAFRRPAEYDPKALMAILEHSHRIRFKLKRPLEDGGRDSKALVELNGVSLIPKGSRDCGLHGQAPKVPPQDLPPTATSSSMASFLYSTALPNHAIRELKQEAPSCPLAPSDLGLSRPMPEPKATGAQDFSDCCGQKPTGPGGPLIQNVHASKRILFSIVHDKSEKWDAFIKETEDINTLRECVQILFNSRYAEALGLDHMVPVPYRKIACDPEAVEIVGIPDKIPFKRPCTYGVPKLKRILEERHSIHFIIKRMFDERIFTGNKFTKDTTKLEPASPPEDTSAEVSRATVLDLAGNARSDKGSMSEDCGPGTSGELGGLRPIKIEPEDLDIIQVTVPDPSPTSEEMTDSMPGHLPSEDSGYGMEMLTDKGLSEDARPEERPVEDSHGDVIRPLRKQVELLFNTRYAKAIGISEPVKVPYSKFLMHPEELFVVGLPEGISLRRPNCFGIAKLRKILEASNSIQFVIKRPELLTEGVKEPIMDSQERDSGDPLVDESLKRQGFQENYDARLSRIDIANTLREQVQDLFNKKYGEALGIKYPVQVPYKRIKSNPGSVIIEGLPPGIPFRKPCTFGSQNLERILAVADKIKFTVTRPFQGLIPKPDEDDANRLGEKVILREQVKELFNEKYGEALGLNRPVLVPYKLIRDSPDAVEVTGLPDDIPFRNPNTYDIHRLEKILKAREHVRMVIINQLQPFAEICNDAKVPAKDSSIPKRKRKRVSEGNSVSSSSSSSSSSSSNPDSVASANQISLVQWPMYMVDYAGLNVQLPGPLNY

SEQ ID NO: 885480 - protein, 95 aa, Homo sapiens
EHFSRELRRLRQKSLSFQCQQPFPLLPAKDSSIPKRKRKRVSEGNSVSSSSSSSSSSSSNPDSVASANQISLVQWPMYMVDYAGLNVQLPGPLNY

SEQ ID NO: 885481 - protein, 606 aa, Homo sapiens
MALLGKRCDVPTNGCGPDRWNSAFTRKDEIITSLVSALDSMCSALSKLNAEVACVAVHDESAFVVGTEKGRMFLNARKELQSDFLRFCRGPPWKDPEAEHPKKVQRGEGGGRSLPRSSLEHGSDVYLLRKMVEEVFDVLYSEALGRASVVPLPYERLLREPGLLAVQGLPEGLAFRRPAEYDPKALMAILEHSHRIRFKLKRPLEDGGRDSKALVELNGVSLIPKGSRDCGLHGQAPKVPPQDLPPTATSSSMASFLYSTALPNHAIRELKQEAPSCPLAPSDLGLSRPMPEPKATGAQDFSDCCGQKPTGPGGPLIQNVHASKRILFSIVHDKSEKWDAFIKETEDINTLRECVQILFNSRYAEALGLDHMVPVPYRKIACDPEAVEIVGIPDKIPFKRPCTYGVPKLKRILEERHSIHFIIKRMFDERIFTGNKFTKDTTKLEPASPPEDTSAEVSRATVLDLAGNARSDKGSMSEDCGPGTSGELGGLRPIKIEPEDLDIIQVTVPDPSPTSEEMTDSMPGHLPSEDSGYGMEMLTDKGLSEDARPEERPVEDSHGDVIRPLRKQVELLFNTRYGPSCSLRESKSPSWIVKRGIPGTLWWTRA

SEQ ID NO: 885482 - protein, 417 aa, Homo sapiens
ESARSFQSGDLTDKGLSEDARPEERPVEDSHGDVIRPLRKQVELLFNTRYAKAIGISEPVKVPYSKFLMHPEELFVVGLPEGISLRRPNCFGIAKLRKILEASNSIQFVIKRPELLTEGVKEPIMDSQERDSGDPLVDESLKRQGFQENYDARLSRIDIANTLREQVQDLFNKKYGEALGIKYPVQVPYKRIKSNPGSVIIEGLPPGIPFRKPCTFGSQNLERILAVADKIKFTVTRPFQGLIPKPDEDDANRLGEKVILREQVKELFNEKYGEALGLNRPVLVPYKLIRDSPDAVEVTGLPDDIPFRNPNTYDIHRLEKILKAREHVRMVIINQLQPFAEICNDAKVPAKDSSIPKRKRKRVSEGNSVSSSSSSSSSSSSNPDSVASANQISLVQWPMYMVDYAGLNVQLPGPLNY

SEQ ID NO: 885483 - protein, 358 aa, Homo sapiens
MALLGKRCDVPTNGCGPDRWNSAFTRKDEIITSLVSALDSMCSALSKLNAEVACVAVHDESAFVVGTEKGRMFLNARKELQSDFLRFCRGPPWKDPEAEHPKKVQRGEGGGRSLPRSSLEHGSDVYLLRKMVEEVFDVLYSEALGRASVVPLPYERLLREPGLLAVQGLPEGLAFRRPAEYDPKALMAILEHSHRIRFKLKRPLEDGGRDSKALVELNGVSLIPKGSRDCGLHGQAPKVPPQDLPPTATSSSMASFLYSTALPNHAIRELKQEAPSCPLAPSDLGLSRPMPEPKATGAQDFSDCCGNIAAGISKSRGWDRGHSCRGQPPRAGQDAWALLGWKEPCLGMGVGLDRWCPG

SEQ ID NO: 885484 - protein, 50 aa, Homo sapiens
CDFLCPLGEALGLNRPVLVPYKLIRDSPDAVEVTGLPDDIPFRNPNTYDI

SEQ ID NO: 885485 - protein, 166 aa, Homo sapiens
GTSGHERHEDPAGVELFNEKYGEALGLNRPVLVPYKLIRDSPDAVEVTGLPDDIPFRNPNTYDIHRLEKILKAREHVRMVIINQLQPFAEICNDAKVPAKDSSIPKRKRKRVSEGNSVSSSSSSSSSSSSNPDSVASANQISLVQWPMYMVDYAGLNVQLPGPLNY

SEQ ID NO: 885486 - protein, 959 aa, Homo sapiens
MALLGKRCDVPTNGCGPDRWNSAFTRKDEIITSLVSALDSMCSALSKLNAEVACVAVHDESAFVVGTEKGRMFLNARKELQSDFLRFCRGPPWKDPEAEHPKKVQRGEGGGRSLPRSSLEHGSDVYLLRKMVEEVFDVLYSEALGRASVVPLPYERLLREPGLLAVQGLPEGLAFRRPAEYDPKALMAILEHSHRIRFKLKRPLEDGGRDSKALVELNGVSLIPKGSRDCGLHGQAPKVPPQDLPPTATSSSMASFLYSTALPNHAIRELKQEAPSCPLAPSDLGLSRPMPEPKATGAQDFSDCCGQKPTGPGGPLIQNVHASKRILFSIVHDKSEKWDAFIKETEDINTLRECVQILFNSRYAEALGLDHMVPVPYRKIACDPEAVEIVGIPDKIPFKRPCTYGVPKLKRILEERHSIHFIIKRMFDERIFTGNKFTKDTTKLEPASPPEDTSAEVSRATVLDLAGNARSDKGSMSEDCGPGTSGELGGLRPIKIEPEDLDIIQVTVPDPSPTSEEMTDSMPGHLPSEDSGYGMEMLTDKGLSEDARPEERPVEDSHGDVIRPLRKQVELLFNTRYAKAIGISEPVKVPYSKFLMHPEELFVVGLPEGISLRRPNCFGIAKLRKILEASNSIQFVIKRPELLTEGVKEPIMDSQGTASSLGFSPPALPPERDSGDPLVDESLKRQGFQENYDARLSRIDIANTLREQVQDLFNKKYGEALGIKYPVQVPYKRIKSNPGSVIIEGLPPGIPFRKPCTFGSQNLERILAVADKIKFTVTRPFQGLIPKPDEDDANRLGEKVILREQVKELFNEKYGEALGLNRPVLVPYKLIRDSPDAVEVTGLPDDIPFRNPNTYDIHRLEKILKAREHVRMVIINQLQPFAEICNDAKVPAKDSSIPKRKRKRVSEGNSVSSSSSSSSSSSSNPDSVASANQISLVQWPMYMVDYAGLNVQLPGPLNY

SEQ ID NO: 885487 - protein, 641 aa, Homo sapiens
MALLGKRCDVPTNGCGPDRWNSAFTRKDEIITSLVSALDSMCSALSKLNAEVACVAVHDESAFVVGTEKGRMFLNARKELQSDFLRFCRGPPWKDPEAEHPKKVQRGEGGGRSLPRSSLEHGSDVYLLRKMVEEVFDVLYSEALGRASVVPLPYERLLREPGLLAVQGLPEGLAFRRPAEYDPKALMAILEHSHRIRFKLKRPLEDGGRDSKALVELNGVSLIPKGSRDCGLHGQAPKVPPQDLPPTATSSSMASFLYSTALPNHAIRELKQEAPSCPLAPSDLGLSRPMPEPKATGAQDFSDCCGQKPTGPGGPLIQNVHASKRILFSIVHDKSEKWDAFIKETEDINTLRECVQILFNSRYAEALGLDHMVPVPYRKIACDPEAVEIVGIPDKIPFKRPCTYGVPKLKRILEERHSIHFIIKRMFDERIFTGNKFTKDTTKLEPASPPEDTSAEVSRATVLDLAGNARSDKGSMSEDCGPGTSGELGGLRPIKIEPEDLDIIQVTVPDPSPTSEEMTDSMPGHLPSEDSGYGMEMLTDKGLSEDARPEERPVEDSHGDVIRPLRKQVELLFNTRYAKAIGISEPVKVPYSKFLMHPEELFVVGLPEGISLRRPNCFGIAKLRKILEASNSIQFVIKRKL

SEQ ID NO: 885488 - protein, 975 aa, Homo sapiens
MALLGKRCDVPTNGCGPDRWNSAFTRKDEIITSLVSALDSMCSALSKLNAEVACVAVHDESAFVVGTEKGRMFLNARKELQSDFLRFCRGPPWKDPEAEHPKKVQRGEGGGRSLPRSSLEHGSDVYLLRKMVEEVFDVLYSEALGRASVVPLPYERLLREPGLLAVQGLPEGLAFRRPAEYDPKALMAILEHSHRIRFKLKRPLEDGGRDSKALVELNGVSLIPKGSRDCGLHGQAPKVPPQDLPPTATSSSMASFLYSTALPNHAIRELKQEAPSCPLAPSDLGLSRPMPEPKATGAQDFSDCCGQKPTGPGGPLIQNVHASKRILFSIVHDKSEKWDAFIKETEDINTLRECVQILFNSRYAEALGLDHMVPVPYRKIACDPEAVEIVGIPDKIPFKRPCTYGVPKLKRILEERHSIHFIIKRMFDERIFTGNKFTKDTTKLEPASPPEDTSAEVSRATVLDLAGNARSDKGSMSEDCGPGTSGELGGLRPIKIEPEDLDIIQVTVPDPSPTSEEMTDSMPGHLPSEDSGYGMEMLTDKGLSEDARPEERPVEDSHGDVIRPLRKQVELLFNTRYAKAIGISEPVKVPYSKFLMHPEELFVVGLPEGISLRRPNCFGIAKLRKILEASNSIQFVIKRPELLTEGVKEPIMDSQGTASSLGFSPPALPPERDSGDPLVDESLKRQGFQENYDARLSRIDIANTLREQVQDLFNKKYGEALGIKYPVQVPYKRIKSNPGSVIIEGLPPGIPFRKPCTFGSQNLERILAVADKIKFTVTRPFQGLIPKPDEDDANRLGEKVILREQVKELFNEKYGEALGLNRPVLVPYKLIRDSPDAVEVTGLPDDIPFRNPNTYDIHRLEKILKAREHVRMVIINQLQPFAEICNDAKVPAKDSSIPKRKRKRVSEGNSVSSSSSSSSSSSSNPDSVASANQISLVVKLHRFGLRHSSLWPSPLCLAGPSTLGCGPRGRGGTGL

SEQ ID NO: 885489 - protein, 111 aa, Homo sapiens
EHFSRELRRLRQKSLSFQCQQPFPLLPAKDSSIPKRKRKRVSEGNSVSSSSSSSSSSSSNPDSVASANQISLVVKLHRFGLRHSSLWPSPLCLAGPSTLGCGPRGRGGTGL

SEQ ID NO: 885490 - protein, 505 aa, Homo sapiens
MSRSYNDELQFLEKINKNCWRIKKGFVPNMQVEGVFYVNDALEKLMFEELRNACRGGGVGGFLPAMKQIGNVAALPGIVHRSIGLPDVHSGYGFAIGNMAAFDMNDPEAVVSPGGVGFDINCGVRLLRTNLDESDVQPVKEQLAQAMFDHIPVGVGSKGVIPMNAKDLEEALEMGVDWSLREGYAWAEDKEHCEEYGRMLQADPNKVSARAKKRGLPQLGTLGAGNHYAEIQVVDEIFNEYAAKKMGIDHKGQVCVMIHSGSRGLGHQVATDALVAMEKAMKRDKIIVNDRQLACARIASPEGQDYLKGMAAAGNYAWVNRSSMTFLTRQAFAKVFNTTPDDLDLHVIYDVSHNIAKVEQHVVDGKERTLLVHRKGSTRAFPPHHPLIAVDYQLTGQPVLIGGTMGTCSYVLTGTEQGMTETFGTTCHGAGRALSRAKSRRNLDFQDVLDKLADMGIAIRVASPKLVMEEAPESYKNVTDVVNTCHDAGISKKAIKLRPIAVIKG

SEQ ID NO: 885491 - protein, 538 aa, Homo sapiens
ALWFLEGGALRSRTTRQRLFKAEPGVFATVFATMSRSYNDELQFLEKINKNCWRIKKGFVPNMQVEGVFYVNDALEKLMFEELRNACRGGGVGGFLPAMKQIGNVAALPGIVHRSIGLPDVHSGYGFAIGNMAAFDMNDPEAVVSPGGVGFDINCGVRLLRTNLDESDVQPVKEQLAQAMFDHIPVGVGSKGVIPMNAKDLEEALEMGVDWSLREGYAWAEDKEHCEEYGRMLQADPNKVSARAKKRGLPQLGTLGAGNHYAEIQVVDEIFNEYAAKKMGIDHKGQVCVMIHSGSRGLGHQVATDALVAMEKAMKRDKIIVNDRQLACARIASPEGQDYLKGMAAAGNYAWVNRSSMTFLTRQAFAKVFNTTPDDLDLHVIYDVSHNIAKVEQHVVDGKERTLLVHRKGSTRAFPPHHPLIAVDYQLTGQPVLIGGTMGTCSYVLTGTEQGMTETFGTTCHGAGRALSRAKSRRNLDFQDVLDKLADMGIAIRVASPKLVMEEAPESYKNVTDVVNTCHDAGISKKAIKLRPIAVIKG

SEQ ID NO: 885492 - protein, 261 aa, Homo sapiens
PKRERRAPRGESDEAQRKHRLGPQVATDALVAMEKAMKRDKIIVNDRQLACARIASPEGQDYLKGMAAAGNYAWVNRSSMTFLTRQAFAKVFNTTPDDLDLHVIYDVSHNIAKVEQHVVDGKERTLLVHRKGSTRAFPPHHPLIAVDYQLTGQPVLIGGTMGTCSYVLTGTEQGMTETFGTTCHGAGRALSRAKSRRNLDFQDVLDKLADMGIAIRVASPKLVMEEAPESYKNVTDVVNTCHDAGISKKAIKLRPIAVIKG

SEQ ID NO: 885493 - protein, 348 aa, Homo sapiens
MSRSYNDELQFLEKINKNCWRIKKGFVPNMQVEGVFYVNDALEKLMFEELRNACRGGGVGGFLPAMKQIGNVAALPGIVHRSIGLPDVHSGYGFAIGNMAAFDMNDPEAVVSPGGVGFDINCGVRLLRTNLDESDVQPVKEQLAQAMFDHIPVGVGSKGVIPMNAKDLEEALEMGVDWSLREGYAWAEDKEHCEEYGRMLQADPNKVSARAKKRGLPQLGTLGAGNHYAEIQVVDEIFNEYAAKKMGIDHKGQVCVMIHSGSRGLGHQVATDALVAMEKAMKRDKIIVNDRQLACARIASPEGQDYLKGMAAAGNYAWVNRSSMTFLTRQLGQQGCLTPPTLSEVEVD

SEQ ID NO: 885494 - protein, 351 aa, Homo sapiens
MSRSYNDELQFLEKINKNCWRIKKGFVPNMQVEGVFYVNDALEKLMFEELRNACRGGGVGGFLPAMKQIGNVAALPGIVHRSIGLPDVHSGYGFAIGNMAAFDMNDPEAVVSPGGVGFDINCGVRLLRTNLDESDVQPVKEQLAQAMFDHIPVGVGSKGVIPMNAKDLEEALEMGVDWSLREGYAWAEDKEHCEEYGRMLQADPNKVSARAKKRGLPQLGTLGAGNHYAEIQVVDEIFNEYAAKKMGIDHKGQVCVMIHSGSRGLGHQVATDALVAMEKAMKRDKIIVNDRQLACARIASPEGQDYLKGMAAAGNYAWVNRSSMTFLTRQLGDGGGLVLKKGYAWPEDKEH

SEQ ID NO: 885495 - protein, 166 aa, Homo sapiens
MSRSYNDELQFLEKINKNCWRIKKGFVPNMQVEGVFYVNDALEKLMFEELRNACRGGGVGGFLPAMKQIGNVAALPGIVHRSIGLPDVHSGYGFAIGNMAAFDMNDPEAVVSPGGVGFDINCGVRLLRTNLDESDVQPVKEQLAQAMFDHIPVGVGSKGVIPMNAK

SEQ ID NO: 885496 - protein, 166 aa, Homo sapiens; identical to SEQ ID NO: 885495

SEQ ID NO: 885497 - protein, 118 aa, Homo sapiens
MSRSYNDELQFLEKINKNCWRIKKGFVPNMQVEGVFYVNDALEKLMFEELRNACRGGGVGGFLPAMKQIGNVAALPGIVHRSIGLPDVHSGYGFAIGNMAAFDMNDPEAVVSPAAILA

SEQ ID NO: 885498 - protein, 135 aa, Homo sapiens
LRSRTTRQRLFKAEPGVFATVFATMSRSYNDELQFLEKINKNCWRIKKGFVPNMQVRQESKWRGLPCSVPGPAGVHCALWTSPDHWVRPGPLQSFPHPVLLPSRFWGRPTCSGTTSRQERSPNHEDKLSAVDMGI

SEQ ID NO: 885499 - protein, 505 aa, Homo sapiens; identical to SEQ ID NO: 885490

SEQ ID NO: 885500 - protein, 332 aa, Homo sapiens
MGVDWSLREGYAWAEDKEHCEEYGRMLQADPNKVSARAKKRGLPQLGTLGAGNHYAEIQVVDEIFNEYAAKKMGIDHKGQVCVMIHSGSRGLGHQVATDALVAMEKAMKRDKIIVNDRQLACARIASPEGQDYLKGMAAAGNYAWVNRSSMTFLTRQAFAKVFNTTPDDLDLHVIYDVSHNIAKVEQHVVDGKERTLLVHRKGSTRAFPPHHPLIAVDYQLTGQPVLIGGTMGTCSYVLTGTEQGMTETFGTTCHGAGRALSRAKSRRNLDFQDVLDKLADMGIAIRVASPKLVMEEAPESYKNVTDVVNTCHDAGISKKAIKLRPIAVIKG

SEQ ID NO: 885501 - protein, 235 aa, Homo sapiens
MSRSYNDELQFLEKINKNCWRIKKGFVPNMQVEGVFYVNDALEKLMFEELRNACRGGGVGGFLPAMKQIGNVAALPGIVHRSIGLPDVHSGYGFAIGNMAAFDMNDPEAVVSPGGVGFDINCGVRLLRTNLDESDVQPVKEQLAQAMFDHIPVGVGSKGVIPMNAKDLEEALEMGVDWSLREGYAWAEDKEHCEEYGRMLQADPNKVSARAKKRGLPQWGPWAAPLRTVGAIPGS

SEQ ID NO: 885502 - protein, 166 aa, Homo sapiens; identical to SEQ ID NO: 885495

SEQ ID NO: 885503 - protein, 103 aa, Homo sapiens
MSRSYNDELQFLEKINKNCWRIKKGFVPNMQVEGVFYVNDALEKLMFEELRNACRGGGVGGFLPAMKQIGNVAALPGIVHVSQSQNFNHLYFLKSIEWMNGHA

SEQ ID NO: 885504 - protein, 835 aa, Homo sapiens
PEACVWREHSPSSYPQTSGAEVTAGAEVILHGCPGLLQFPPFALLLPVSPSYSTLDQLCPLSTLLFSISPSSPSLPFPPFLSLPLGSRIFPSAAGGSDIMLRLLRPLLLLLLLPPPGSPEPPGLTQLSPGAPPQAPDLLYADGLRAYAAGAWAPAVALLREALRSQAALGRVRLDCGASCAADPGAALPAVLLGAPEPDSGPGPTQGSWERQLLRAALRRADCLTQCAARRLGPGGAARLRVGSALRDAFRRREPYNYLQRAYYQLKKLDLAAAAAHTFFVANPMHLQMREDMAKYRRMSGVRPQSFRDLETPPHWAAYDTGLELLGRQEAGLALPRLEEALQGSLAQMESCRADCEGPEEQQGAEEEEDGAASQGGLYEAIAGHWIQVLQCRQRCVGETATRPGRSFPVPDFLPNQLRRLHEAHAQVGNLSQAIENVLSVLLFYPEDEAAKRALNQYQAQLGEPRPGLGPREDIQRFILRSLGEKRQLYYAMEHLGTSFKDPDPWTPAALIPEALREKLREDQEKRPWDHEPVKPKPLTYWKDVLLLEGVTLTQDSRQLNGSERAVLDGLLTPAECGVLLQLAKDAAGAGARSGYRGRRSPHTPHERFEGLTVLKAAQLARAGTVGSQGAKLLLEVSERVRTLTQAYFSPERPLHLSFTHLVCRSAIEGEQEQRMDLSHPVHADNCVLDPDTGECWREPPAYTYRDYSGLLYLNDDFQGGDLFFTEPNALTVTARVRPRCGRLVAFSSGVENPHGVWAVTRGRRCALALWHTWAPEHREQEWIEAKELLQESQEEEEEEEEEMPSKDPSPEPPSRRHQRVQDKTGRAPRVREEL

SEQ ID NO: 885505 - protein, 696 aa, Homo sapiens
PEACVWREHSPSSYPQTSGAEVTAGAEVILHGCPGLLQFPPFALLLPVSPSYSTLDQLCPLSTLLFSISPSSPSLPFPPFLSLPLGSRIFPSAAGGSDIMLRLLRPLLLLLLLPPPGSPEPPGLTQLSPGAPPQAPDLLYNYLQRAYYQMREDMAKYRRMSGVRPQSFRDLETPPHWAAYDTGLELLGRQEAGLALPRLEEALQGSLAQMESCRADCEGPEEQQGAEEEEDGAASQGGLYEAIAGHWIQVLQCRQRCVGETATRPGRSFPVPDFLPNQLRRLHEAHAQVGNLSQAIENVLSVLLFYPEDEAAKRALNQYQAQLGEPRPGLGPREDIQRFILRSLGEKRQLYYAMEHLGTSFKDPDPWTPAALIPEALREKLREDQEKRPWDHEPVKPKPLTYWKDVLLLEGVTLTQDSRQLNGSERAVLDGLLTPAECGVLLQLAKDAAGAGARSGYRGRRSPHTPHERFEGLTVLKAAQLARAGTVGSQGAKLLLEVSERVRTLTQAYFSPERPLHLSFTHLVCRSAIEGEQEQRMDLSHPVHADNCVLDPDTGECWREPPAYTYRDYSGLLYLNDDFQGGDLFFTEPNALTVTARVRPRCGRLVAFSSGVENPHGVWAVTRGRRCALALWHTWAPEHREQEWIEAKELLQESQEEEEEEEEEMPSKDPSPEPPSRRHQRVQDKTGRAPRVREEL

SEQ ID NO: 885506 - protein, 423 aa, Homo sapiens
SSSHPQDIQRFILRSLGEKRQLYYAMEHLGTSFKDPFDPLPRAPDIESRAFPTSVFLSGNRRTLMRYFSSNVRDFQGLTLVGDDAFLDCLQDPWTPAALIPEALREKLREDQEKRPWDHEPVKPKPLTYWKDVLLLEGVTLTQDSRQLNGSERAVLDGLLTPAECGVLLQLAKDAAGAGARSGYRGRRSPHTPHERFEGLTVLKAAQLARAGTVGSQGAKLLLEVSERVRTLTQAYFSPERPLHLSFTHLVCRSAIEGEQEQRMDLSHPVHADNCVLDPDTGECWREPPAYTYRDYSGLLYLNDDFQGGDLFFTEPNALTVTARVRPRCGRLVAFSSGVENPHGVWAVTRGRRCALALWHTWAPEHREQEWIEAKELLQESQEEEEEEEEEMPSKDPSPEPPSRRHQRVQDKTGRAPRVREEL

SEQ ID NO: 885507 - protein, 341 aa, Homo sapiens
WEGLGPSWEAGSGLSWAPTERISQPLREDQEKRPWDHEPVKPKPLTYWKDVLLLEGVTLTQDSRQLNGSERAVLDGLLTPAECGVLLQLAKDAAGAGARSGYRGRRSPHTPHERFEGLTVLKAAQLARAGTVGSQGAKLLLEVSERVRTLTQAYFSPERPLHLSFTHLVCRSAIEGEQEQRMDLSHPVHADNCVLDPDTGECWREPPAYTYRDYSGLLYLNDDFQGGDLFFTEPNALTVTARVRPRCGRLVAFSSGVENPHGVWAVTRGRRCALALWHTWAPEHREQEWIEAKELLQESQEEEEEEEEEMPSKDPSPEPPSRRHQRVQDKTGRAPRVREEL

SEQ ID NO: 885508 - protein, 147 aa, Homo sapiens
PEACVWREHSPSSYPQTSGAEVTAGAEVILHGCPGLLQFPPFALLLPVSPSYSTLDQLCPLSTLLFSISPSSPSLPFPPFLSLPLGSRIFPSAAGGSDIMLRLLRPLLLLLLLPPPGSPEPPGLTQLSPGAPPQAPDLLYRTPLPQR

SEQ ID NO: 885509 - protein, 462 aa, Homo sapiens
MLRLLRPLLLLLLLPPPGSPEPPGLTQLSPGAPPQAPDLLYADGLRAYAAGAWAPAVALLREALRSQAALGRVRLDCGASCAADPGAALPAVLLGAPEPDSGPGPTQGSWERQLLRAALRRADCLTQCAARRLGPGGAARLRVGSALRDAFRRREPYNYLQRAYYQLKKLDLAAAAAHTFFVANPMHLQMREDMAKYRRMSGVRPQSFRDLETPPHWAAYDTGLELLGRQEAGLALPRLEEALQGSLAQMESCRADCEGPEEQQGAEEEEDGAASQGGLYEAIAGHWIQVLQCRQRCVGETATRPGRSFPVPDFLPNQLRRLHEAHAQVGNLSQAIENVLSVLLFYPEDEAAKRALNQYQAQLGEPRPGLGPREDIQRFILRSLGEKRQLYYAMEHLGTSFKDPDPWTPAALIPEALREKLRCPSPGGCDLDPGFQAAEWVGAGGVGWAAHPSRVWGAAAAG

SEQ ID NO: 885510 - protein, 580 aa, Homo sapiens
SDALLPSPPQLKKLDLAAAAAHTFFVANPMHLQMREDMAKYRRMSGVRPQSFRDLETPPHWAAYDTGLELLGRQEAGLALPRLEEALQGSLAQMESCRADCEGPEEQQGAEEEEDGAASQGGLYEAIAGHWIQVLQCRQRCVGETATRPGRSFPVPDFLPNQLRRLHEAHAQVGNLSQAIENVLSVLLFYPEDEAAKRALNQYQAQLGEPRPGLGPREDIQRFILRSLGEKRQLYYAMEHLGTSFKDPDPWTPAALIPEALREKLREDQEKRPWDHEPVKPKPLTYWKDVLLLEGVTLTQDSRQLNGSERAVLDGLLTPAECGVLLQLAKDAAGAGARSGYRGRRSPHTPHERFEGLTVLKAAQLARAGTVGSQGAKLLLEVSERVRTLTQAYFSPERPLHLSFTHLVCRSAIEGEQEQRMDLSHPVHADNCVLDPDTGECWREPPAYTYRDYSGLLYLNDDFQGGDLFFTEPNALTVTARVRPRCGRLVAFSSGVENPHGVWAVTRGRRCALALWHTWAPEHREQEWIEAKELLQESQEEEEEEEEEMPSKDPSPEPPSRRHQRVQDKTGRAPRVREEL

SEQ ID NO: 885511 - protein, 577 aa, Homo sapiens
HTSSLVGLKKLDLAAAAAHTFFVANPMHLQMREDMAKYRRMSGVRPQSFRDLETPPHWAAYDTGLELLGRQEAGLALPRLEEALQGSLAQMESCRADCEGPEEQQGAEEEEDGAASQGGLYEAIAGHWIQVLQCRQRCVGETATRPGRSFPVPDFLPNQLRRLHEAHAQVGNLSQAIENVLSVLLFYPEDEAAKRALNQYQAQLGEPRPGLGPREDIQRFILRSLGEKRQLYYAMEHLGTSFKDPDPWTPAALIPEALREKLREDQEKRPWDHEPVKPKPLTYWKDVLLLEGVTLTQDSRQLNGSERAVLDGLLTPAECGVLLQLAKDAAGAGARSGYRGRRSPHTPHERFEGLTVLKAAQLARAGTVGSQGAKLLLEVSERVRTLTQAYFSPERPLHLSFTHLVCRSAIEGEQEQRMDLSHPVHADNCVLDPDTGECWREPPAYTYRDYSGLLYLNDDFQGGDLFFTEPNALTVTARVRPRCGRLVAFSSGVENPHGVWAVTRGRRCALALWHTWAPEHREQEWIEAKELLQESQEEEEEEEEEMPSKDPSPEPPSRRHQRVQDKTGRAPRVREEL

SEQ ID NO: 885512 - protein, 462 aa, Homo sapiens; identical to SEQ ID NO: 885509

SEQ ID NO: 885513 - protein, 820 aa, Homo sapiens
PEACVWREHSPSSYPQTSGAEVTAGAEVILHGCPGLLQFPPFALLLPVSPSYSTLDQLCPLSTLLFSISPSSPSLPFPPFLSLPLGSRIFPSAAGGSDIMLRLLRPLLLLLLLPPPGSPEPPGLTQLSPGAPPQAPDLLYADGLRAYAAGAWAPAVALLREALRSQAALGRVRLDCGASCAADPGAALPAVLLGAPEPDSGPGPTQGSWERQLLRAALRRADCLTQCAARRLGPGGAARLRVGSALRDAFRRREPYNYLQRAYYQLKKLDLAAAAAHTFFVANPMHLQMREDMAKYRRMSGVRPQSFRDLETPPHWAAYDTGLELLGRQEAGLALPRLEEALQGSLAQMESCRADCEGPEEQQGAEEEEDGAASQGGLYEAIAGHWIQVLQCRQRCVGETATRPGRSFPVPDFLPNQLRRLHEAHAQVGNLSQAIENVLSVLLFYPEDEAAKRALNQYQAQLGEPRPGLGPREDIQRFILRSLGEKRQLYYAMEHLGTSFKDPDPWTPAALIPEALREKLREDQEKRPWDHEPVKPKPLTYWKDVLLLEGVTLTQDSRQLNGSERAVLDGLLTPAECGVLLQLAKDAAGAGARSGYRGRRSPHTPHERFEGLTVLKAAQLARAGTVGSQGAKLLLEVSERVRTLTHLVCRSAIEGEQEQRMDLSHPVHADNCVLDPDTGECWREPPAYTYRDYSGLLYLNDDFQGGDLFFTEPNALTVTARVRPRCGRLVAFSSGVENPHGVWAVTRGRRCALALWHTWAPEHREQEWIEAKELLQESQEEEEEEEEEMPSKDPSPEPPSRRHQRVQDKTGRAPRVREEL

SEQ ID NO: 885514 - protein, 239 aa, Homo sapiens
ADYYYYYYYYIRGRSTTVLKAAALARAGTVGSQGAKLLLEVSERVRTLTQAYFSPERPLHLSFTHLVCRSAIEGEQEQRMDLSHPVHADNCVLDPDTGECWREPPAYTYRDYSGLLYLNDDFQGGDLFFTEPNALTVTARVRPRCGRLVAFSSGVENPHGVWAVTRGRRCALALWHTWAPEHREQEWIEAKELLQESQEEEEEEEEEMPSKDPSPEPPSRRHQRVQDKTGRAPRVREEL

SEQ ID NO: 885515 - protein, 687 aa, Homo sapiens
PEACVWREHSPSSYPQTSGAEVTAGAEVILHGCPGLLQFPPFALLLPVSPSYSTLDQLCPLSTLLFSISPSSPSLPFPPFLSLPLGSRIFPSAAGGSDIMLRLLRPLLLLLLLPPPGSPEPPGLTQLSPGAPPQAPDLLYADGLRAYAAGAWAPAVALLREALRSQAALGRVRLDCGASCAADPGAALPAVLLGAPEPDSGPGPTQGSWERQLLRAALRRADCLTQCAARRLGPGGAARLRVGSALRDAFRRREPYNYLQRAYYQLKKLDLAAAAAHTFFVANPMHLQMREDMAKYRRMSGVRPQSFRDLETPPHWAAYDTGLELLGRQEAGLALPRLEEALQGSLAQMESCRADCEGPEEQQGAEEEEDGAASQGGLYEAIAGHWIQVLQCRQRCVGETATRPGRSFPVPDFLPNQLRRLHEAHAQVGNLSQAIENVLSVLLFYPEDEAAKRALNQYQAQLGEPRPGLGPREDIQRFILRSLGEKRQLYYAMEHLGTSFKDPDPWTPAALIPEALREKLREDQEKRPWDHEPVKPKPLTYWKDVLLLEGVTLTQDSRQLNGSERAVLDGLLTPAECGVLLQLAKDAAGAGARSGYRGRRSPHTPHERFEGLTVLKAAQVSTGGTRARLMPRPGGEAVQEAGPQGLGFCEGAFLGPRLPDRTQRGEKGCSESWGRGCCHGERRSSLG

SEQ ID NO: 885516 - protein, 69 aa, Homo sapiens
EGVTLTQDSRQLNGSERAVLDGLLTPAECGVLLQLAKVGRPASSSARSRLLDTITCSLALGLPPSFCLS

SEQ ID NO: 885517 - protein, 292 aa, Homo sapiens
DGRECVGGGGAGARAERRPPGPAGAEYPGTFFCLSAAKVFPGSSERTEFKKCNMARGCLCCLKYMMFLFNLIFWLCGCGLLGVGIWLSVSQGNFATFSPSFPSLSAANLVIAIGTIVMVTGFLGCLGAIKENKCLLLSFFIVLLVILLAELILLILFFVYMDKVNENAKKDLKEGLLLYHTENNVGLKNAWNIIQAEMRCCGVTDYTDWYPVLGENTVPDRCCMENSQGCGRNATTPLWRTGCYEKVKMWFDDNKHVLGTVGMCILIMQILGMAFSMTLFQHIHRTGKKYDA

SEQ ID NO: 885518 - protein, 292 aa, Homo sapiens; identical to SEQ ID NO: 885517

SEQ ID NO: 885519 - protein, 116 aa, Homo sapiens
MVTGFLGCLGAIKENKCLLLSFFIVLLVILLAELILLILFFVYMDKVNENAKKDLKEGLLLYHTENNVGLKNAWNIIQAEMRCCGVTDYTDWYPGLGCAPEEPPALMGFCPCPSSH

SEQ ID NO: 885520 - protein, 292 aa, Homo sapiens; identical to SEQ ID NO: 885517

SEQ ID NO: 885521 - protein, 292 aa, Homo sapiens; identical to SEQ ID NO: 885517

SEQ ID NO: 885522 - protein, 135 aa, Homo sapiens
MVTGFLGCLGAIKENKCLLLSFFIVLLVILLAELILLILFFVYMDKVNENAKKDLKEGLLLYHTENNVGLKNAWNIIQAEMRCCGVTDYTDWYPVLGENTVPDRCCMENSQGCGRNATTPLWRTVRLGMDRLGPR

SEQ ID NO: 885523 - protein, 157 aa, Homo sapiens
MWGRPTFEQSCPALVPWPGFLVRSFSRLRRNPQSADSGADTSGRRDSADKCCSCTVGPGASCVFCCGWGGWVGLCLSMQFLIFVNINSKSLVHWEMCNLPENLFCFWSTSGVASGPRAFATVLPPAPTSSVCLQSLIYRSPRCLLYSLCAWPFCYLA

SEQ ID NO: 885524 - protein, 175 aa, Homo sapiens
MVTGFLGCLGAIKENKCLLLSFFIVLLVILLAELILLILFFVYMDKVNENAKKDLKEGLLLYHTENNVGLKNAWNIIQAEMRCCGVTDYTDWYPVLGENTVPDRCCMENSQGCGRNATTPLWRTGCYEKVKMWFDDNKHVLGTVGMCILIMQILGMAFSMTLFQHIHRTGKKYDA

SEQ ID NO: 885525 - protein, 292 aa, Homo sapiens; identical to SEQ ID NO: 885517

SEQ ID NO: 885526 - protein, 292 aa, Homo sapiens; identical to SEQ ID NO: 885517

SEQ ID NO: 885527 - protein, 195 aa, Homo sapiens
DGRECVGGGGAGARAERRPPGPAGAEYPGTFFCLSAAKVFPGSSERTEFKKCNMARGCLCCLKYMMFLFNLIFWLCGCGLLGVGIWLSVSQGNFATFSPSFPSLSAANLVIAIGTIVMVTGFLGCLGAIKENKCLLLSFFIVLLVILLAELILLILFFVYMDKVNENAKKDLKEGLLLYHTPTCLPPGSTGGRAG

SEQ ID NO: 885528 - protein, 327 aa, Homo sapiens
MVRSRQMCNTNMSVPTDGAVTTSQIPASEQETLVRPKPLLLKLLKSVGAQKDTYTMKEDLDAGVSEHSGDWLDQDSVSDQFSVEFEVESLDSEDYSLSEEGQELSDEDDEVYQVTVYQAGESDTDSFEEDPEISLADYWKCTSCNEMNPPLPSHCNRCWALRENWLPEDKGKDKGEISEKAKLENSTQAEEGFDVPDCKKTIVNDSRESCVEENDDKITQASQSQESEDYSQPSTSSSIIYSSQEDVKEFEREETQDKEESVESSLPLNAIEPCVICQGRPKNGCIVHGKTGHLMACFTCAKKLKKRNKPCPVCRQPIQMIVLTYFP

SEQ ID NO: 885529 - protein, 302 aa, Homo sapiens
MVRSRQMCNTNMSVPTDGAVTTSQIPASEQETLDLDAGVSEHSGDWLDQDSVSDQFSVEFEVESLDSEDYSLSEEGQELSDEDDEVYQVTVYQAGESDTDSFEEDPEISLADYWKCTSCNEMNPPLPSHCNRCWALRENWLPEDKGKDKGEISEKAKLENSTQAEEGFDVPDCKKTIVNDSRESCVEENDDKITQASQSQESEDYSQPSTSSSIIYSSQEDVKEFEREETQDKEESVESSLPLNAIEPCVICQGRPKNGCIVHGKTGHLMACFTCAKKLKKRNKPCPVCRQPIQMIVLTYFP

SEQ ID NO: 885530 - protein, 81 aa, Homo sapiens
ARTEAPRELGCFWGLCGPVCRKDGARSRARGAAATPLTEILLLSQPGAPSLPGLVRTSAQCPGPESGMIPEAQGVVLPRAP

SEQ ID NO: 885531 - protein, 130 aa, Homo sapiens
MFIERLNCIRVCVRLIAYLLSSAPPPPAHHQVSDPFSFLSESSDSGTSVSENRCHLEGGSDQKDLVQELQEEKPSSSHLVSRPSTSSRRRAISETGIYEYLFDAFTQLFDILSLMKLVLLDLIKLFPFFG

SEQ ID NO: 885532 - protein, 490 aa, Homo sapiens
MVRSRQMCNTNMSVPTDGAVTTSQIPASEQETLVRPKPLLLKLLKSVGAQKDTYTMKEVLFYLGQYIMTKRLYDEKQQHIVYCSNDLLGDLFGVPSFSVKEHRKIYTMIYRNLVVVNQQESSDSGTSVSENRCHLEGGSDQKDLVQELQEEKPSSSHLVSRPSTSSRRRAISETEENSDELSGERQRKRHKSDSISLSFDESLALCVIREICCERSSSSESTGTPSNPDLDAGVSEHSGDWLDQDSVSDQFSVEFEVESLDSEDYSLSEEGQELSDEDDEVYQVTVYQAGESDTDSFEEDPEISLADYWKCTSCNEMNPPLPSHCNRCWALRENWLPEDKGKDKGEISEKAKLENSTQAEEGFDVPDCKKTIVNDSRESCVEENDDKITQASQSQESEDYSQPSTSSSIIYSSQEDVKEFEREETQDKEESVESSLPLNAIEPCVICQGRPKNGCIVHGKTGHLMACFTCAKKLKKRNKPCPVCRQPIQL

SEQ ID NO: 885533 - protein, 181 aa, Homo sapiens [sequence omitted]

SEQ ID NO: 885534 - protein, 276 aa, Homo sapiens
MVRSRQMCNTNMSVPTDGAVTTSQIPASEQETLDLDAGVSEHSGDWLDQDSVSDQFSVEFEVESLDSEDYSLSEEGQELSDEDDEDYWKCTSCNEMNPPLPSHCNRCWALRENWLPEDKGKDKGEISEKAKLENSTQAEEGFDVPDCKKTIVNDSRESCVEENDDKITQASQSQESEDYSQPSTSSSIIYSSQEDVKEFEREETQDKEESVESSLPLNAIEPCVICQGRPKNGCIVHGKTGHLMACFTCAKKLKKRNKPCPVCRQPIQMIVLTYFP

SEQ ID NO: 885535 - protein, 249 aa, Homo sapiens
MVRSRQMCNTNMSVPTDGAVTTSQIPASEQETLVRPKPLLLKLLKSVGAQKDTYTMKEDYWKCTSCNEMNPPLPSHCNRCWALRENWLPEDKGKDKGEISEKAKLENSTQAEEGFDVPDCKKTIVNDSRESCVEENDDKITQASQSQESEDYSQPSTSSSIIYSSQEDVKEFEREETQDKEESVESSLPLNAIEPCVICQGRPKNGCIVHGKTGHLMACFTCAKKLKKRNKPCPVCRQPIQMIVLTYFP

SEQ ID NO: 885536 - protein, 181 aa, Homo sapiens [sequence omitted]

SEQ ID NO: 885537 - protein, 528 aa, Homo sapiens
MVRSRQMCNTNMSVPTDGAVTTSQIPASEQETLVRPKPLLLKLLKSVGAQKDTYTMKERWSFTMLPRLVWNSWAQGICLPRPPKVLDLQVLFYLGQYIMTKRLYDEKQQHIVYCSNDLLGDLFGVPSFSVKEHRKIYTMIYRNLVVVNQQESSDSGTSVSENRCHLEGGSDQKDLVQELQEEKPSSSHLVSRPSTSSRRRAISETEENSDELSGERQRKRHKSDSISLSFDESLALCVIREICCERSSSSESTGTPSNPDLDAGVSEHSGDWLDQDSVSDQFSVEFEVESLDSEDYSLSEEGQELSDEDDEVYQVTVYQAGESDTDSFEEDPEISLADYWKCTSCNEMNPPLPSHCNRCWALRENWLPEDKGKDKGEISEKAKLENSTQAEEGFDVPDCKKTIVNDSRESCVEENDDKITQASQSQESEDYSQPSTSSSIIYSSQEDVKEFEREETQDKEESVESSLPLNAIEPCVICQGRPKNGCIVHGKTGHLMACFTCAKKLKKRNKPCPVCRQPIQMIVLTYFP

SEQ ID NO: 885538 - protein, 430 aa, Homo sapiens
MTKRLYDEKQQHIVYCSNDLLGDLFGVPSFSVKEHRKIYTMIYRNLVVVNQQESSDSGTSVSENRCHLEGGSDQKDLVQELQEEKPSSSHLVSRPSTSSRRRAISETEENSDELSGERQRKRHKSDSISLSFDESLALCVIREICCERSSSSESTGTPSNPDLDAGVSEHSGDWLDQDSVSDQFSVEFEVESLDSEDYSLSEEGQELSDEDDEVYQVTVYQAGESDTDSFEEDPEISLADYWKCTSCNEMNPPLPSHCNRCWALRENWLPEDKGKDKGEISEKAKLENSTQAEEGFDVPDCKKTIVNDSRESCVEENDDKITQASQSQESEDYSQPSTSSSIIYSSQEDVKEFEREETQDKEESVESSLPLNAIEPCVICQGRPKNGCIVHGKTGHLMACFTCAKKLKKRNKPCPVCRQPIQMIVLTYFP

SEQ ID NO: 885539 - protein, 81 aa, Homo sapiens; identical to SEQ ID NO: 885530

SEQ ID NO: 885540 - protein, 390 aa, Homo sapiens
MIYRNLVVVNQQESSDSGTSVSENRCHLEGGSDQKDLVQELQEEKPSSSHLVSRPSTSSRRRAISETEENSDELSGERQRKRHKSDSISLSFDESLALCVIREICCERSSSSESTGTPSNPDLDAGVSEHSGDWLDQDSVSDQFSVEFEVESLDSEDYSLSEEGQELSDEDDEVYQVTVYQAGESDTDSFEEDPEISLADYWKCTSCNEMNPPLPSHCNRCWALRENWLPEDKGKDKGEISEKAKLENSTQAEEGFDVPDCKKTIVNDSRESCVEENDDKITQASQSQESEDYSQPSTSSSIIYSSQEDVKEFEREETQDKEESVESSLPLNAIEPCVICQGRPKNGCIVHGKTGHLMACFTCAKKLKKRNKPCPVCRQPIQMIVLTYFP

SEQ ID NO: 885541 - protein, 145 aa, Homo sapiens
MVRSRQMCNTNMSVPTDGAVTTSQIPASEQETLVRPKPLLLKLLKSVGAQKDTYTMKEDLDAGVSEHSGDWLDQDSVSDQFSVEFEVESLDSEDYSLSEEGQELSDEDDEVYQVTVYQAGESDTDSFEEDPEISLAMCKEAKEKE

SEQ ID NO: 885542 - protein, 181 aa, Homo sapiens [sequence omitted]

SEQ ID NO: 885543 - protein, 81 aa, Homo sapiens; identical to SEQ ID NO: 885530

SEQ ID NO: 885544 - protein, 81 aa, Homo sapiens; identical to SEQ ID NO: 885530

SEQ ID NO: 885545 - protein, 81 aa, Homo sapiens; identical to SEQ ID NO: 885530

SEQ ID NO: 885546 - protein, 81 aa, Homo sapiens; identical to SEQ ID NO: 885530

SEQ ID NO: 885547 - protein, 181 aa, Homo sapiens [sequence omitted]

SEQ ID NO: 885548 - protein, 497 aa, Homo sapiens; identical to SEQ ID NO: 780495

SEQ ID NO: 885549 - protein, 224 aa, Homo sapiens
MVRSRQMCNTNMSVPTDGAVTTSQIPASEQETLDYWKCTSCNEMNPPLPSHCNRCWALRENWLPEDKGKDKGEISEKAKLENSTQAEEGFDVPDCKKTIVNDSRESCVEENDDKITQASQSQESEDYSQPSTSSSIIYSSQEDVKEFEREETQDKEESVESSLPLNAIEPCVICQGRPKNGCIVHGKTGHLMACFTCAKKLKKRNKPCPVCRQPIQMIVLTYFP

SEQ ID NO: 885550 - protein, 108 aa, Homo sapiens
MVRSRQMCNTNMSVPTDGAVTTSQIPASEQETLVRPKPLLLKLLKSVGAQKDTYTMKEVLFYLGQYIMTKRLYDEKQQHIVNDCANLFPLVDLSIRELYISNYITLGI

SEQ ID NO: 885551 - protein, 199 aa, Homo sapiens
MPQIPRDNKAAALLMLTKNVDFVKDAHEEMEQAVEECDPYSGLLNDTEENNSDNHNHEDDVLGFPSNQDLYWSEDDQELIIPCLALVRASKACLKKIRMLVAENGKKDQVAQLDDIVDISDEISPSVDDLALSIYPPMCHLTVRINSAKLVSVLKKALEITKASHVTPQPEDSWIPLLINAIDHCMNRIKELTQSELEL

SEQ ID NO: 885552 - protein, 360 aa, Homo sapiens
MASATAPAAAVPTLASPLEQLRHLAEELRLLLPRVRVGEAQETTEEFNREMFWRRLNEAAVTVSREATTLTIVFSQLPLPSPQETQKFCEQVHAAIKAFIAVYYLLPKDQGITLRKLVRGATLDIVDGMAQLMEVLSVTPTQSPENNDLISYNSVWVACQQMPQIPRDNKAAALLMLTKNVDFVKDAHEEMEQAVEECDPYSGLLNDTEENNSDNHNHEDDVLGFPSNQDLYWSEDDQELIIPCLALVRASKACLKKIRMLVAENGKKDQVAQLDDIVDISDEISPSVDDLALSIYPPMCHLTVRINSAKLVSVLKKALEITKASHVTPQPEDSWIPLLINAIDHCMNRIKELTQSELEL

SEQ ID NO: 885553 - protein, 360 aa, Homo sapiens; identical to SEQ ID NO: 885552

SEQ ID NO: 885554 - protein, 360 aa, Homo sapiens; identical to SEQ ID NO: 885552

SEQ ID NO: 885555 - protein, 232 aa, Homo sapiens
MAQLMEVLSVTPTQSPENNDLISYNSVWVACQQMPQIPRDNKAAALLMLTKNVDFVKDAHEEMEQAVEECDPYSGLLNDTEENNSDNHNHEDDVLGFPSNQDLYWSEDDQELIIPCLALVRASKACLKKIRMLVAENGKKDQVAQLDDIVDISDEISPSVDDLALSIYPPMCHLTVRINSAKLVSVLKKALEITKASHVTPQPEDSWIPLLINAIDHCMNRIKELTQSELEL

SEQ ID NO: 885556 - protein, 432 aa, Homo sapiens
PVLASESGMVGAVPQGTGRGGRRRGQAWSLITGWVVLDLGRGRASWREEAGQGLWDGAGRLVDGNEPLTLWPGSGAAVAVRLRQWQRRPVFAAFGKRLRWRAQLHLQPQSPPWLRLWSSSGTWRRSCGCSCLECGSAKPRRPPRSLIERCSGEDSETQKFCEQVHAAIKAFIAVYYLLPKDQGITLRKLVRGATLDIVDGMAQLMEVLSVTPTQSPENNDLISYNSVWVACQQMPQIPRDNKAAALLMLTKNVDFVKDAHEEMEQAVEECDPYSGLLNDTEENNSDNHNHEDDVLGFPSNQDLYWSEDDQELIIPCLALVRASKACLKKIRMLVAENGKKDQVAQLDDIVDISDEISPSVDDLALSIYPPMCHLTVRINSAKLVSVLKKALEITKASHVTPQPEDSWIPLLINAIDHCMNRIKELTQSELEL

SEQ ID NO: 885557 - protein, 412 aa, Homo sapiens
PVLASESGMVGAVPQGTGRGGRRRGQAWSLITGWVVLDLGRGRASWREEAGQGLWDGAGRLVDGNEPLTLWPGSGAAVAVRLRQWQRRPVFAAFGKRLRWRAQLHLQPQSPPWLRLWSSSGTWRRSCGCSCLECGETQKFCEQVHAAIKAFIAVYYLLPKDQGITLRKLVRGATLDIVDGMAQLMEVLSVTPTQSPENNDLISYNSVWVACQQMPQIPRDNKAAALLMLTKNVDFVKDAHEEMEQAVEECDPYSGLLNDTEENNSDNHNHEDDVLGFPSNQDLYWSEDDQELIIPCLALVRASKACLKKIRMLVAENGKKDQVAQLDDIVDISDEISPSVDDLALSIYPPMCHLTVRINSAKLVSVLKKALEITKASHVTPQPEDSWIPLLINAIDHCMNRIKELTQSELEL

SEQ ID NO: 885558 - protein, 309 aa, Homo sapiens
MASATAPAAAVPTLASPLEQLRHLAEELRLLLPRVRVGEAQETTEEFNREMFWRRLNEAAVTVSREATTLTIVFSQLPLPSPQETQKFCEQVHAAIKAFIAVYYLLPKDQGITLRKLVRGATLDIVDGMAQLMEVLSVTPTQSPENNDLISYNSVWVACQQMPQIPRDNKAAALLMLTKNVDFVKDAHEEMEQAVEECDPYSGLLNDTEENNSDNHNHEDDVLGFPSNQDLYWSEDDQELIIPCLALVRASKACLKKIRMLVAENGKKDQVAQLDDIVDISDEISPSVDDLALSIYPPMCHLTVRINEP

SEQ ID NO: 885559 - protein, 309 aa, Homo sapiens; identical to SEQ ID NO: 885558

SEQ ID NO: 885560 - protein, 323 aa, Homo sapiens
MASATAPAAAVPTLASPLEQLRHLAEELRLLLPRVRVGEAQETTEEFNREMFWRRLNEAAVTVSREATTLTIVFSQLPLPSPQETQKFCEQVHAAIKAFIAVYYLLPKDQGITLRKLVRGATLDIVDGMAQLMEVLSVTPTQSPENNDLISYNSVWVACQQMPQIPRDNKAAALLMLTKNVDFVKDAHEEMEQAVEECDPYSGLLNDTEENNSDNHNHEDDVLGFPSNQDLYWSEDDQELIIPCLALVRASKACLKKIRMLVAENGKKDQVAQLDDIVDISDEISPSVDDLALSIYPPMCHLTVRINSAKLVSVLKKALEITK

SEQ ID NO: 885561 - protein, 199 aa, Homo sapiens; identical to SEQ ID NO: 885551

SEQ ID NO: 885562 - protein, 309 aa, Homo sapiens; identical to SEQ ID NO: 885558

SEQ ID NO: 885563 - protein, 199 aa, Homo sapiens; identical to SEQ ID NO: 885551

SEQ ID NO: 885564 - protein, 199 aa, Homo sapiens; identical to SEQ ID NO: 885551

SEQ ID NO: 885565 - protein, 199 aa, Homo sapiens; identical to SEQ ID NO: 885551

SEQ ID NO: 885566 - protein, 360 aa, Homo sapiens; identical to SEQ ID NO: 885552

SEQ ID NO: 885567 - protein, 342 aa, Homo sapiens
MASATAPAAAVPTLASPLEQLRHLAEELRLLLPRVRVGEAQETTEEFNREMFWRRLNEAAVTVSREATTLTIVFSQLPLPSPQETQKFCEQVHAAIKAFIAVYYLLPKDQGITLRKLVRGATLDIVDGMAQLMEVLSVTPTQSPENNDLISYNSVWVACQQMPQIPRDNKAAALLMLTKNVDFVKDAHEEMEQAVEECDPYSGLLNDTEENNSDNHNHEDDVLGFPSNQDLYWSEDDQELIIPCLALVRASKACLKKIRMLVAENGKKDQVAQLDDIVDISDEISPSVDDLALSIYPPMCHLTVRINSAKLVSVLKKALEITNAIDHCMNRIKELTQSELEL

SEQ ID NO: 885568 - protein, 309 aa, Homo sapiens; identical to SEQ ID NO: 885558

SEQ ID NO: 885569 - protein, 333 aa, Homo sapiens
MASATAPAAAVPTLASPLEQLRHLAEELRLLLPRVRVGEAQETTEEFNREMFWRRLNEAAVTVSREATTLTIVFSQLPLPSPQETQKFCEQVHAAIKAFIAVYYLLPKDQGITLRKLVRGATLDIVDGMAQLMEVLSVTPTQSPENNDLISYNSVWVACQQMPQIPRDNKAAALLMLTKNVDFVKDAHEEMEQAVEECDPYSGLLNDTEENNSDNHNHEDDVLGFPSNQDLYWSEDDQELIIPCLALVRASKACLKKIRMLVAENGKKDQVAQLDDIVDISDEISPSVDDLALSIYPPMCHLTVRINVSTGFEGIATEQMGRISLITSISCKL

SEQ ID NO: 885570 - protein, 148 aa, Homo sapiens
MPQIPRDNKAAALLMLTKNVDFVKDAHEEMEQAVEECDPYSGLLNDTEENNSDNHNHEDDVLGFPSNQDLYWSEDDQELIIPCLALVRASKACLKKIRMLVAENGKKDQVAQLDDIVDISDEISPSVDDLALSIYPPMCHLTVRINEP

SEQ ID NO: 885571 - protein, 84 aa, Homo sapiens
RTWRAHIPLEELSVIDKPRSTSPPLLSLYTAIFSKALMKATKKRKYPRKDVRSTWPGRPIRVNLNYDFSGSFVLSSPLIVMVRL

SEQ ID NO: 885572 - protein, 159 aa, Homo sapiens
PVLASESGMVGAVPQGTGRGGRRRGQAWSLITGWVVLDLGRGRASWREEAGQGLWDGAGRLVDGNEPLTLWPGSGAAVAVRLRQWQRRPVFAAFGKRLRWRAQLHLQPQSPPWLRLWSSSGTWRRSCGCSCLECGSAKPRRPPRSLIERCSGEDSMRQL

SEQ ID NO: 885573 - protein, 393 aa, Homo sapiens
MSCSESPAANSFLVDSLISSGRGEAGGGGGGAGGGGGGGYYAHGGVYLPPAADLPYGLQSCGLFPTLGGKRNEAASPGSGGGGGGLGPGAHGYGPSPIDLWLDAPRSCRMEPPDGPPPPPQQQPPPPPQPPQPAPQATSCSFAQNIKEESSYCLYDSADKCPKVSATAAELAPFPRGPPPDGCALGTSSGVPVPGYFRLSQAYGTAKGYGSGGGGAQQLGAGPFPAQPPGRGFDLPPALASGSADAARKERALDSPPPPTLACGSGGGSQGDEEAHASSSAAEELSPAPSESSKASPEKDSLGNSKGENAANWLTAKSGRKKRCPYTKHQTLELEKEFLFNMYLTRERRLEISRSVHLTDRQVKIWFQNRRMKLKKMNRENRIRELTANFNFS

SEQ ID NO: 885574 - protein, 393 aa, Homo sapiens; identical to SEQ ID NO: 885573

SEQ ID NO: 885575 - protein, 109 aa, Homo sapiens
MLFSKLLRGGNLRCGKKKGNSKGENAANWLTAKSGRKKRCPYTKHQTLELEKEFLFNMYLTRERRLEISRSVHLTDRQVKIWFQNRRMKLKKMNRENRIRELTANFNFS

SEQ ID NO: 885576 - protein, 393 aa, Homo sapiens; identical to SEQ ID NO: 885573

SEQ ID NO: 885577 - protein, 288 aa, Homo sapiens
MSCSESPAANSFLVDSLISSGRGEAGGGGGGAGGGGGGGYYAHGGVYLPPAADLPYGLQSCGLFPTLGGKRNEAASPGSGGGGGGLGPGAHGYGPSPIDLWLDAPRSCRRRAATRGWPVPAQPPGRGFDLPPALASGSADAARKERALDSPPPPTLACGSGGGSQGDEEAHASSSAAEELSPAPSESSKASPEKDSLGNSKGENAANWLTAKSGRKKRCPYTKHQTLELEKEFLFNMYLTRERRLEISRSVHLTDRQVKIWFQNRRMKLKKMNRENRIRELTANFNFS

SEQ ID NO: 885578 - protein, 393 aa, Homo sapiens; identical to SEQ ID NO: 885573

SEQ ID NO: 885579 - protein, 94 aa, Homo sapiens
MCQVDREKQPSEGAFSENNAENESGGDKPPIDPNNPAANWLHARSTRKKRCPYTKHQTLELEKEFLFNMYLTRDRRYEVARLLNLTERQVKIWF

SEQ ID NO: 885580 - protein, 217 aa, Homo sapiens
MEVENEASCSPGSASGGSREYKVVMLGAGGVGKSAMTMQFISHQFPDYHDPTIEDAYKTQVRIDNEPAYLDILDTAGQAEFTAMREQYMRGGEGFIICYSVTDRQSFQEAAKFKELIFQVRHTYEIPLVLVGNKIDLEQFRQVSTEEGLSLAQEYNCGFFETSAALRFCIDDAFHGLVREIRKKESMPSLMEKKLKRKDSLWKKLKGSLKKKRENMT

SEQ ID NO: 885581 - protein, 153 aa, Homo sapiens
MEVENEASCSPGSASGGSREYKVVMLGAGGVGKSAMTMQFISHQFPDYHDPTIEDAYKTQVRIDNEPAYLDILDTAGQAEFTAMREQYMRGGEGFIICYSVTDRQSFQEAAKFKELIFQVRHTYEIPLVLVGNKIDLEQFRQPTLKEFGREEF

SEQ ID NO: 885582 - protein, 238 aa, Homo sapiens
MEVENEASCSPGSASGGSREYKVVMLGAGGVGKSAMTMQFISHQFPDYHDPTIEDAYKTQVRIDNEPAYLDILDTAGQLCDWLKHRWEVELWEIRRTEEAEFTAMREQYMRGGEGFIICYSVTDRQSFQEAAKFKELIFQVRHTYEIPLVLVGNKIDLEQFRQVSTEEGLSLAQEYNCGFFETSAALRFCIDDAFHGLVREIRKKESMPSLMEKKLKRKDSLWKKLKGSLKKKRENMT

SEQ ID NO: 885583 - protein, 93 aa, Homo sapiens
AEGPQGRELSLGSGYHILVSTEEGLSLAQEYNCGFFETSAALRFCIDDAFHGLVREIRKKESMPSLMEKKLKRKDSLWKKLKGSLKKKRENMT

SEQ ID NO: 885584 - protein, 217 aa, Homo sapiens; identical to SEQ ID NO: 885580

SEQ ID NO: 885585 - protein, 96 aa, Homo sapiens
TNLPPPSIPSPNTEPSVYHTAVSTEEGLSLAQEYNCGFFETSAALRFCIDDAFHGLVREIRKKESMPSLMEKKLKRKDSLWKKLKGSLKKKRENMT

SEQ ID NO: 885586 - protein, 71 aa, Homo sapiens
AEFTAMREQYMRGGEGFIICYSVTDRQSFQEAAKFKELIFQVRHTYEIPLVLVGNKIDLEQFRQVSADFIW

SEQ ID NO: 885587 - protein, 448 aa, Homo sapiens
AALPPAGAWALRRVRERCRTGRGRREYYGLWVPLSKMELSAVGERVFAAESIIKRRIRKGRIEYLVKWKGWAIKYSTWEPEENILDSRLIAAFEQKERERELYGPKKRGPKPKTFLLKARAQAEALRISDVHFSVKPSASASSPKLHSSAAVHRLKKDIRRCHRMSRRPLPRPDPQGGSPGLRPPISPFSETVRIINRKVKPREPKRNRIILNLKVIDKGAGGGGAGQGAGALARPKVPSRNRVIGKSKKFSESVLRTQIRHMKFGAFALYKPPPAPLVAPSPGKAEASAPGPGLLLAAPAAPYDARSSGSSGCPSPTPQSSDPDDTPPKLLPETVSPSAPSWREPEVLDLSLPPESAATSKRAPPEVTAAAGPAPPTAPEPAGASSEPEAGDWRPEMSPCSNVVVTDVTSNLLTVTIKEFCNPEDFEKVAAGVAGAAGGGGSIGASK

SEQ ID NO: 885588 - protein, 448 aa, Homo sapiens; identical to SEQ ID NO: 885587

SEQ ID NO: 885589 - protein, 448 aa, Homo sapiens; identical to SEQ ID NO: 885587

SEQ ID NO: 885590 - protein, 448 aa, Homo sapiens; identical to SEQ ID NO: 885587

SEQ ID NO: 885591 - protein, 430 aa, Homo sapiens
AALPPAGAWALRRVRERCRTGRGRREYYGLWVPLSKMELSAVGERVFAAESIIKRRIRKGRIEYLVKWKGWAIKYSTWEPEENILDSRLIAAFEQKERERELYGPKKRGPKPKTFLLKPSASASSPKLHSSAAVHRLKKDIRRCHRMSRRPLPRPDPQGGSPGLRPPISPFSETVRIINRKVKPREPKRNRIILNLKVIDKGAGGGGAGQGAGALARPKVPSRNRVIGKSKKFSESVLRTQIRHMKFGAFALYKPPPAPLVAPSPGKAEASAPGPGLLLAAPAAPYDARSSGSSGCPSPTPQSSDPDDTPPKLLPETVSPSAPSWREPEVLDLSLPPESAATSKRAPPEVTAAAGPAPPTAPEPAGASSEPEAGDWRPEMSPCSNVVVTDVTSNLLTVTIKEFCNPEDFEKVAAGVAGAAGGGGSIGASK

SEQ ID NO: 885592 - protein, 448 aa, Homo sapiens; identical to SEQ ID NO: 885587

SEQ ID NO: 885593 - protein, 448 aa, Homo sapiens; identical to SEQ ID NO: 885587

SEQ ID NO: 885594 - protein, 448 aa, Homo sapiens; identical to SEQ ID NO: 885587

SEQ ID NO: 885595 - protein, 168 aa, Homo sapiens
MVGTEIERETPFQAPSSSRCLGRMLKNPFPRASRLVPAPLLLLTTEAFSQPSLPEAKEAPVSWAASVSLCCLGAEAPVPVAEATAPALGQALGGQAGKGETRGSVFSRRMRVLVPELGPGPRWPALGHFPGLHCAWVACSRRGWSWLPGCAAMGPSLRSTLAGGRSEP

SEQ ID NO: 885596 - protein, 203 aa, Homo sapiens
AALPPAGAWALRRVRERCRTGRGRREYYGLWVPLSKMELSAVGERVFAAESIIKRRIRKGRIEYLVKWKGWAIKYSTWEPEENILDSRLIAAFEQKERERELYGPKKRGPKPKTFLLKARAQAEALRISDVHFSVKPSASASSPKLHSSAAVHRLKKDIRRCHFPGLHCAWVACSRRGWSWLPGCAAMGPSLRSTLAGGRSEP

SEQ ID NO: 885597 - protein, 89 aa, Homo sapiens
DSTEEVDSTEEVDSTVEGARTPGEGLPDSSLADGHQDAEIGRWLVGAKDAPSQAFVVPSSAPCNLWRSQCLTPAVSAYCMQVVSQAKRD

SEQ ID NO: 885598 - protein, 485 aa, Homo sapiens
MELEVRRVRQAFLSGRSRPLRFRLQQLEALRRMVQEREKDILTAIAADLCKSEFNVYSQEVITVLGEIDFMLENLPEWVTAKPVKKNVLTMLDEAYIQPQPLGVVLIIGAWNYPFVLTIQPLIGAIAAGNAVIIKPSELSENTAKILAKLLPQYLDQDLYIVINGGVEETTELLKQRFDHIFYTGNTAVGKIVMEAAAKHLTPVTLELGGKSPCYIDKDCDLDIVCRRITWGKYMNCGQTCIAPDYILCEASLQNQIVWKIKETVKEFYGENIKESPDYERIINLRHFKRILSLLEGQKIAFGGETDEATRYIAPTVLTDVDPKTKVMQEEIFGPILPIVPVKNVDEAINFINEREKPLALYVFSHNHKLIKRMIDETSSGGVTGNDVIMHFTLNSFPFGGVGSSGMGAYHGKHSFDTFSHQRPCLLKSLKREGANKLRYPPNSQSKVDWGKFFLLKRFNKEKLGLLLLTFLGIVAAVLVKAEYY

SEQ ID NO: 885599 - protein, 485 aa, Homo sapiens; identical to SEQ ID NO: 885598

SEQ ID NO: 885600 - protein, 521 aa, Homo sapiens
MELEVRRVRQAFLSGRSRPLRFRLQQLEALRRMVQEREKDILTAIAADLCKSEFNVYSQEVITVLGEIDFMLENLPEWVTAKPVKKNVLTMLDEAYIQPQPLGVVLIIGAWNYPFVLTIQPLIGAIAAGNAVIIKPSELSENTAKILAKLLPQYLDQPFCSNSCDDPIKKDEMEDSEMSRIEEDVEPEDRGVKDLYIVINGGVEETTELLKQRFDHIFYTGNTAVGKIVMEAAAKHLTPVTLELGGKSPCYIDKDCDLDIVCRRITWGKYMNCGQTCIAPDYILCEASLQNQIVWKIKETVKEFYGENIKESPDYERIINLRHFKRILSLLEGQKIAFGGETDEATRYIAPTVLTDVDPKTKVMQEEIFGPILPIVPVKNVDEAINFINEREKPLALYVFSHNHKLIKRMIDETSSGGVTGNDVIMHFTLNSFPFGGVGSSGMGAYHGKHSFDTFSHQRPCLLKSLKREGANKLRYPPNSQSKVDWGKFFLLKRFNKEKLGLLLLTFLGIVAAVLVKAEYY

SEQ ID NO: 885601 - protein, 485 aa, Homo sapiens; identical to SEQ ID NO: 885598

SEQ ID NO: 885602 - protein, 485 aa, Homo sapiens; identical to SEQ ID NO: 885598

SEQ ID NO: 885603 - protein, 485 aa, Homo sapiens; identical to SEQ ID NO: 885598

SEQ ID NO: 885604 - protein, 493 aa, Homo sapiens
MELEVRRVRQAFLSGRSRPLRFRLQQLEALRRMVQEREKDILTAIAADLCKSEFNVYSQEVITVLGEIDFMLENLPEWVTAKPVKKNVLTMLDEAYIQPQPLGVVLIIGAWNYPFVLTIQPLIGAIAAGNAVIIKPSELSENTAKILAKLLPQYLDQDLYIVINGGVEETTELLKQRFDHIFYTGNTAVGKIVMEAAAKHLTPVTLELGGKSPCYIDKDCDLDIVCSCSGCFPLRRITWGKYMNCGQTCIAPDYILCEASLQNQIVWKIKETVKEFYGENIKESPDYERIINLRHFKRILSLLEGQKIAFGGETDEATRYIAPTVLTDVDPKTKVMQEEIFGPILPIVPVKNVDEAINFINEREKPLALYVFSHNHKLIKRMIDETSSGGVTGNDVIMHFTLNSFPFGGVGSSGMGAYHGKHSFDTFSHQRPCLLKSLKREGANKLRYPPNSQSKVDWGKFFLLKRFNKEKLGLLLLTFLGIVAAVLVKAEYY

SEQ ID NO: 885605 - protein, 503 aa, Homo sapiens
MELEVRRVRQAFLSGRSRPLRFRLQQLEALRRMVQEREKDILTAIAADLCKSEFNVYSQEVITVLGEIDFMLENLPEWVTAKPVKKNVLTMLDEAYIQPQPLGVVLIIGAWNYPFVLTIQPLIGAIAAGNAVIIKPSELSENTAKILAKLLPQYLDQDLYIVINGGVEETTELLKQRFDHIFYTGNTAVGKIVMEAAAKHLTPVTLELGGKSPCYIDKDCDLDIVCRRITWGKYMNCGQTCIAPDYILCEASLQNQIVWKIKETVKEFYGENIKESPDYERIINLRHFKRILSLLEGQKIAFGGETDEATRYIAPTVLTDVDPKTKVMQEEIFGPILPIVPVKNVDEAINFINEREKPLALYVFSHNHKLIKRMIDETSSGGVTGNDVIMHFTLNSFPFGGVGSSGMGAYHGKHSFDTFSHQRPCLLKSLKREGANKLRYPPNSQSKVDWGKFFLLKRFNKEKLGLLLLTFLGIVAAVLVKFTDCVGPVSRDEHQISKPSPVC

SEQ ID NO: 885606 - protein, 331 aa, Homo sapiens
MELEVRRVRQAFLSGRSRPLRFRLQQLEALRRMVQEREKDILTAIAADLCKSEFNVYSQEVITVLGEIDFMLENLPEWVTAKPVKKNVLTMLDEAYIQPQPLGVVLIIGAWNYPFVLTIQPLIGAIAAGNAVIIKPSELSENTAKILAKLLPQYLDQDLYIVINGGVEETTELLKQRFDHIFYTGNTAVGKIVMEAAAKHLTPVTLELGGKSPCYIDKDCDLDIVCRRITWGKYMNCGQTCIAPDYILCEASLQNQIVWKIKETVKEFYGENIKESPDYERIINLRHFKRILSLLEGQKIAFGGETDEATRYIGNGNSPFPMGRWQFGSFC

SEQ ID NO: 885607 - protein, 485 aa, Homo sapiens; identical to SEQ ID NO: 885598

SEQ ID NO: 885608 - protein, 485 aa, Homo sapiens; identical to SEQ ID NO: 885598

SEQ ID NO: 885609 - protein, 485 aa, Homo sapiens; identical to SEQ ID NO: 885598

SEQ ID NO: 885610 - protein, 508 aa, Homo sapiens
MELEVRRVRQAFLSGRSRPLRFRLQQLEALRRMVQEREKDILTAIAADLCKSEFNVYSQEVITVLGEIDFMLENLPEWVTAKPVKKNVLTMLDEAYIQPQPLGVVLIIGAWNYPFVLTIQPLIGAIAAGNAVIIKPSELSENTAKILAKLLPQYLDQDLYIVINGGVEETTELLKQRFDHIFYTGNTAVGKIVMEAAAKHLTPVTLELGGKSPCYIDKDCDLDIVCRRITWGKYMNCGQTCIAPDYILCEASLQNQIVWKIKETVKEFYGENIKESPDYERIINLRHFKRILSLLEGQKIAFGGETDEATRYIAPTVLTDVDPKTKVMQEEIFGPILPIVPVKNVDEAINFINEREKPLALYVFSHNHKLIKRMIDETSSGGVTGNDVIMHFTLNSFPFGGVGSSGMGAYHGKHSFDTFSHQRPCLLKSLKREGANKLRYPPNSQSKVDWGKFFLLKRFNKEKLGLLLLTFLGIVAAVLVKKYQAVLRRKALLIFLVVHRLRWSSKQR

SEQ ID NO: 885611 - protein, 485 aa, Homo sapiens; identical to SEQ ID NO: 885598

SEQ ID NO: 885612 - protein, 403 aa, Homo sapiens
MELEVRRVRQAFLSGRSRPLRFRLQQLEALRRMVQEREKDILTAIAADLCKSEFNVYSQEVITVLGEIDFMLENLPEWVTAKPVKKNVLTMLDEAYIQPQPLGVVLIIGAWNYPFVLTIQPLIGAIAAGNAVIIKPSELSENTAKILAKLLPQYLDQDLYIVINGGVEETTELLKQRFDHIFYTGNTAVGKIVMEAAAKHLTPVTLELGGKSPCYIDKDCDLDIVCRRITWGKYMNCGQTCIAPDYILCEASLQNQIVWKIKETVKEFYGENIKESPDYERIINLRHFKRILSLLEGQKIAFGGETDEATRYIAPTVLTDVDPKTKVMQEEIFGPILPIVPVKNVDEAINFINEREKPLALYVFSHNHKLIKRMIDETSSGGVTGNDVIMHFTLNSFPFGGVG

SEQ ID NO: 885613 - protein, 182 aa, Homo sapiens
MELEVRRVRQAFLSGRSRPLRFRLQQLEALRRMVQEREKDILTAIAADLCKSEFNVYSQEVITVLGEIDFMLENLPEWVTAKPVKKNVLTMLDEAYIQPQPLGVVLIIGAWNYPFVLTIQPLIGAIAAGNAVIIKPSELSENTAKILAKLLPQYLDQPFCSNSCDDPIKKDEMEDSEMSRIE

SEQ ID NO: 885614 - protein, 151 aa, Homo sapiens
MELEVRRVRQAFLSGRSRPLRFRLQQLEALRRMVQEREKDILTAIAADLCKSEFNVYSQEVITVLGEIDFMLENLPEWVTAKPVKKNVLTMLDEAYIQPQPLGVVLIIGAWNYPFVLTIQPLIGAIAAGNAVIIKPSELSVYIWINRGVEE

SEQ ID NO: 885615 - protein, 267 aa, Homo sapiens
ADRAAAAAGRRARGGGGGRAAGSQSGGGGGGGGDAAAPLSPPAPGAGSQPREAARAGRQHADGEELDGFEGEASSTSMISGASSPYQPTTEPVSQRRGLAGLRCDPDYLRGALGRLKVAQVILALIAFICIETIMACSPCEGLYFFEFVSCSAFVVTGVLLIMFSLNLHMRIPQINWNLTDLVNTGLSAFLFFIASIVLAALNHRAGAEIAAVIFGFLATAAYAVNTFLAVQKWRVSVRQQSTNDYIRARTESRDVDSRPEIQRLDT

SEQ ID NO: 885616 - protein, 293 aa, Homo sapiens
ADRAAAAAGRRARGGGGGRAAGSQSGGGGGGGGDAAAPLSPPAPGAGSQPREAARAGRQHADGEELDGFEGEASSTSMISGASSPYQPTTEPVSQRRGLAGLRCDPDYLRGALGRLKVAQVILALIAFICIETIMACSPCEGLYFFEFVSCSAFVVTGVLLIMFSLNLHMRIPQINWNLTDLVNTGLSAFLFFIASIVLAALNHRAGAEIAAVIFGFLATAAYAVNTFLAVQKWRVSVRQQSTNDYIRARTESRDVDSRPEIQRLDTFSYSTNVTVRKKSPTNLLSLNHWQLA

SEQ ID NO: 885617 - protein, 874 aa, Homo sapiens
MDEEEDNLSLLTALLEENESALDCNSEENNFLTRENGEPDAFDELFDADGDGESYTEEADDGETGETRDEKENLATLFGDMEDLTDEEEVPASQSTENRVLPAPAPRREKTNEELQEELRNLQEQMKALQEQLKVTTIKQTASPARLQKSPEKSPRPPLKERRVQRIQESTCFSAELDVPALPRTKRVARTPKASPPDPKSSSSRMTSAPSQPLQTISRNKPSGITRGQIVGTPGSSGETTQPICVEAFSGLRLRRPRVSSTEMNKKMTGRKLIRLSQIKEKMAREKLEEIDWVTFGVILKKVTPQSVNSGKTFSIWKLNDLRDLTQCVSLFLFGEVHKALWKTEQGTVVGILNANPMKPKDGSEEVCLSIDHPQKVLIMGEALDLGTCKAKKKNGEPCTQTVNLRDCEYCQYHVQAQYKKLSAKRADLQSTFSGGRIPKKFARRGTSLKERLCQDGFYYGGVSSASYAASIAAAVAPKKKIQTTLSNLVVKGTNLIIQETRQKLGIPQKSLSCSEEFKELMDLPTCGARNLKQHLAKATASGIMGSPKPAIKSISASALLKQQKQRMLEMRRRKSEEIQKRFLQSSSEVESPAVPSSSRQPPAQPPRTGSEFPRLEGAPATMTPKLGRGVLEGDDVLFYDESPPPRPKLSALAEAKKLAAITKLRAKGQVLTKTNPNSIKKKQKDPQDILEVKERVEKNTMFSSQAEDELEPARKKRREQLAYLESEEFQKILKAKSKHTGILKEAEAEMQERYFEPLVKKEQMEEKMRNIREVKCRVVTCKTCAYTHFKLLETCVSEQHEYHWHDGVKRFFKCPCGNRSISLDRLPNKHCSNCGLYKWERDGMLKEKTGPKIGGETLLPRGEEHAKFLNSLK

SEQ ID NO: 885618 - protein, 874 aa, Homo sapiens; identical to SEQ ID NO: 885617

SEQ ID NO: 885619 - protein, 855 aa, Homo sapiens
MDEEEDNLSLLTALLEENESALDCNSEENNFLTRENGEPDAFDELFDADGDGESYTEEADDGETGETRDEKENLATLFGDMEDLTDEEEVPASQSTENRVLPAPAPRREKTNEELQEELRNLQEQMKALQEQLKVTTIKQTASPARLQKSPEKSPRPPLKERRVQRIQESTCFSAELDVPALPRTKRVARTPKASPPDPKSSSSRMTSAPSQPLQTISRNKPSGITRGQIVGTPGSSGETTQPICVEAFSGLRLRRPRVSSTEMNKKMTGRKLIRLSQIKEKMAREKLEEIDWVTFGVILKKVTPQSVNSGKTFSIWKLNDLRDLTQCVSLFLFGEVHKALWKTEQGTVVGILNANPMKPKDGSEEVCLSIDHPQKVLIMGEALDLGTCKAKKKNGEPCTQTVNLRDCEYCQYHVQAQYKKLSAKRADLQSTFSGGRIPKKFARRGTSLKERLCQDGFYYGGVSSASYAASIAAAVAPKKKIQTTLSNLVVKGTNLIIQETRQKLGIPQKSLSCSEEFKELMDLPTCGARNLKQHLAKATASGIMGSPKPAIKSISASALLKQQKQRMLEMRRRKSEEIQKRFLQSSSEVESPAVPSSSRQPPAQPPRTGSEFPRLEGAPATMTPKLGRGVLEGDDVLFYDESPPPRPKLSALAEAKKLAAITKLRAKGQVLTKTNPNSIKKKQKDPQDILEVKERVEKNTMFSSQAEDELEPARKKRREQLAYLESEEFQKILKAKSKHTGILKEAEAEMQERYFEPLVKKEQMEEKMRNIREVKCRVVTCKTCAYTHFKLLETCVSEQHEYHWHDGVKRFFKCPCGNRSISLDRLPNKHCSNCGLYKWERDGMLKVCHLRTNF

SEQ ID NO: 885620 - protein, 913 aa, Homo sapiens
QRPSKLKRAEFYFFLSLVSPVSPSSASFEVSCHNCPLDSMDEEEDNLSLLTALLEENESALDCNSEENNFLTRENGEPDAFDELFDADGDGESYTEEADDGETGETRDEKENLATLFGDMEDLTDEEEVPASQSTENRVLPAPAPRREKTNEELQEELRNLQEQMKALQEQLKVTTIKQTASPARLQKSPEKSPRPPLKERRVQRIQESTCFSAELDVPALPRTKRVARTPKASPPDPKSSSSRMTSAPSQPLQTISRNKPSGITRGQIVGTPGSSGETTQPICVEAFSGLRLRRPRVSSTEMNKKMTGRKLIRLSQIKEKMAREKLEEIDWVTFGVILKKVTPQSVNSGKTFSIWKLNDLRDLTQCVSLFLFGEVHKALWKTEQGTVVGILNANPMKPKDGSEEVCLSIDHPQKVLIMGEALDLGTCKAKKKNGEPCTQTVNLRDCEYCQYHVQAQYKKLSAKRADLQSTFSGGRIPKKFARRGTSLKERLCQDGFYYGGVSSASYAASIAAAVAPKKKIQTTLSNLVVKGTNLIIQETRQKLGIPQKSLSCSEEFKELMDLPTCGARNLKQHLAKATASGIMGSPKPAIKSISASALLKQQKQRMLEMRRRKSEEIQKRFLQSSSEVESPAVPSSSRQPPAQPPRTGSEFPRLEGAPATMTPKLGRGVLEGDDVLFYDESPPPRPKLSALAEAKKLAAITKLRAKGQVLTKTNPNSIKKKQKDPQDILEVKERVEKNTMFSSQAEDELEPARKKRREQLAYLESEEFQKILKAKSKHTGILKEAEAEMQERYFEPLVKKEQMEEKMRNIREVKCRVVTCKTCAYTHFKLLETCVSEQHEYHWHDGVKRFFKCPCGNRSISLDRLPNKHCSNCGLYKWERDGMLKEKTGPKIGGETLLPRGEEHAKFLNSLK

SEQ ID NO: 885621 - protein, 913 aa, Homo sapiens; identical to SEQ ID NO: 885620

SEQ ID NO: 885622 - protein, 913 aa, Homo sapiens; identical to SEQ ID NO: 885620

SEQ ID NO: 885623 - protein, 248 aa, Homo sapiens
MAAGTAVGAWVLVLSLWGAVVGAQNITARIGEPLVLKCKGAPKKPPQRLEWKLNTGRTEAWKVLSPQGGGPWDSVARVLPNGSLFLPAVGIQDEGIFRCQAMNRNGKETKSNYRVRVYQIPGKPEIVDSASELTAGVPNKVGTCVSEGSYPAGTLSWHLDGKPLVPNEKGVSVKEQTRRHPETGLFTLQSELMVTPARGGDPRPTFSCSFSPGLPRHRALRTAPSSPVSGSLCLWRRSNWWWSQKVEQ

SEQ ID NO: 885624 - protein, 248 aa, Homo sapiens; identical to SEQ ID NO: 885623

SEQ ID NO: 885625 - protein, 248 aa, Homo sapiens; identical to SEQ ID NO: 885623

SEQ ID NO: 885626 - protein, 265 aa, Homo sapiens
MAAGTAVGAWVLVLSLWGAVVGAQNITARIGEPLVLKCKGAPKKPPQRLEWKLNTGRTEAWKVLSPQGGGPWDSVARVLPNGSLFLPAVGIQDEGIFRCQAMNRNGKETKSNYRVRVYQFENLHNYSPDWIFPPSEIPGKPEIVDSASELTAGVPNKVGTCVSEGSYPAGTLSWHLDGKPLVPNEKGVSVKEQTRRHPETGLFTLQSELMVTPARGGDPRPTFSCSFSPGLPRHRALRTAPSSPVSGSLCLWRRSNWWWSQKVEQ

SEQ ID NO: 885627 - protein, 234 aa, Homo sapiens
MAAGTAVGAWVLVLSLWGAVVGAQNITARIGEPLVLKCKGAPKKPPQRLEWKLGGGPWDSVARVLPNGSLFLPAVGIQDEGIFRCQAMNRNGKETKSNYRVRVYQIPGKPEIVDSASELTAGVPNKVGTCVSEGSYPAGTLSWHLDGKPLVPNEKGVSVKEQTRRHPETGLFTLQSELMVTPARGGDPRPTFSCSFSPGLPRHRALRTAPSSPVSGSLCLWRRSNWWWSQKVEQ

SEQ ID NO: 885628 - protein, 343 aa, Homo sapiens
TERWGLERGCRPHLGRRPQQGEGQTEPGPWKEAGWQPEQQLEPGCWSSVCGVSHSLNPTDPPCRKHFNPTPQSSSELFPEPEEVPFKVPHPPCPNFVSPHSLPTPLPWCYLPGAVVGAQNITARIGEPLVLKCKGAPKKPPQRLEWKLNTGRTEAWKVLSPQGGGPWDSVARVLPNGSLFLPAVGIQDEGIFRCQAMNRNGKETKSNYRVRVYQIPGKPEIVDSASELTAGVPNKVGTCVSEGSYPAGTLSWHLDGKPLVPNEKGVSVKEQTRRHPETGLFTLQSELMVTPARGGDPRPTFSCSFSPGLPRHRALRTAPSSPVSGSLCLWRRSNWWWSQKVEQ

SEQ ID NO: 885629 - protein, 264 aa, Homo sapiens
MAAGTAVGAWVLVLSLWGAVVGAQNITARIGEPLVLKCKGAPKKPPQRLEWKLNTGRTEAWKVLSPQGGGPWDSVARVLPNGSLFLPAVGIQDEGIFRCQAMNRNGKETKSNYRVRVYQIPGKPEIVDSASELTAGVPNKVVEESRRSRKRPCEQEVGTCVSEGSYPAGTLSWHLDGKPLVPNEKGVSVKEQTRRHPETGLFTLQSELMVTPARGGDPRPTFSCSFSPGLPRHRALRTAPSSPVSGSLCLWRRSNWWWSQKVEQ

SEQ ID NO: 885630 - protein, 374 aa, Homo sapiens
MEESDSEKTTEKENLGPRMDPPLGEPEGSLGWVLPNTAMKKKVLLMGKSGSGKTSMRSIIFANYIARDTRRLGATILDRIHSLQINSSLSTYSLVDSVGNTKTFDVEHSHVRFLGNLVLNLWDCGGQDTFMENYFTSQRDNIFRNVEVLIYVFDVESRELEKDMHYYQSCLEAILQNSPDAKIFCLVHKMDLVQEDQRDLIFKEREEDLRRLSRPLECSCFRTSIWDETLYKAWSSIVYQLIPNVQQLEMNLRNFAEIIEADEVLLFERATFLVISHYQCKEQRDAHRFEKISNIIKQFKLSCSKLAASFQSMEVRNSNFAAFIDIFTSNTYVMVVMSDPSIPSAATLINIRNARKHFEKLERVDGPKQCLLMR

SEQ ID NO: 885631 - protein, 308 aa, Homo sapiens
MKKKVLLMGKSGSGKTSMRSIIFANYIARDTRRLGATIDVEHSHVRFLGNLVLNLWDCGGQDTFMENYFTSQRDNIFRNVEVLIYVFDVESRELEKDMHYYQSCLEAILQNSPDAKIFCLVHKMDLVQEDQRDLIFKEREEDLRRLSRPLECSCFRTSIWDETLYKAWSSIVYQLIPNVQQLEMNLRNFAEIIEADEVLLFERATFLVISHYQCKEQRDAHRFEKISNIIKQFKLSCSKLAASFQSMEVRNSNFAAFIDIFTSNTYVMVVMSDPSIPSAATLINIRNARKHFEKLERVDGPKQCLLMR

SEQ ID NO: 885632 - protein, 194 aa, Homo sapiens
MEESDSEKTTEKENLGPRMDPPLGEPEGSLGWVLPNTAMKKKVLLMGKSGSGKTSMRSIIFANYIARDTRRLGATIDVEHSHVRFLGNLVLNLWDCGGQDTFMENYFTSQRDNIFRNVEVLIYVFDVESRELEKDMHYYQSCLEAILQNSPDAKIFCLVHKMDLVQEDQRDLVRNRRSAAPNARHALQTYFVEV

SEQ ID NO: 885633 - protein, 344 aa, Homo sapiens
YTHKPEQINVGLWWRYFFMPTVAGTFNTVHSWFNILWSEFQLVLTNIDVRQHSLSGETDDDNYLALSSSKGEFLLHGQLCSHQWPKGKFALGMLWYSTVGPSTAVERINSTDRIEQELLLQVWSVESRELEKDMHYYQSCLEAILQNSPDAKIFCLVHKMDLVQEDQRDLIFKEREEDLRRLSRPLECSCFRTSIWDETLYKAWSSIVYQLIPNVQQLEMNLRNFAEIIEADEVLLFERATFLVISHYQCKEQRDAHRFEKISNIIKQFKLSCSKLAASFQSMEVRNSNFAAFIDIFTSNTYVMVVMSDPSIPSAATLINIRNARKHFEKLERVDGPKQCLLMR

SEQ ID NO: 885634 - protein, 346 aa, Homo sapiens
MEESDSEKTTEKENLGPRMDPPLGEPEGSLGWVLPNTAMKKKVLLMGKSGSGKTSMRSIIFANYIARDTRRLGATIDVEHSHVRFLGNLVLNLWDCGGQDTFMENYFTSQRDNIFRNVEVLIYVFDVESRELEKDMHYYQSCLEAILQNSPDAKIFCLVHKMDLVQEDQRDLIFKEREEDLRRLSRPLECSCFRTSIWDETLYKAWSSIVYQLIPNVQQLEMNLRNFAEIIEADEVLLFERATFLVISHYQCKEQRDAHRFEKISNIIKQFKLSCSKLAASFQSMEVRNSNFAAFIDIFTSNTYVMVVMSDPSIPSAATLINIRNARKHFEKLERVDGPKQCLLMR

SEQ ID NO: 885635 - protein, 213 aa, Homo sapiens
MEESDSEKTTEKENLGPRMDPPLGEPEGSLGWVLPNTAMKKKVLLMGKSGSGKTSMRSIIFANYIARDTRRLGATIDVEHSHVRFLGNLVLNLWDCGGQDTFMENYFTSQRDNIFRNVEVLIYVFDVESRELEKDMHYYQSCLEAILQNSPDAKIFCLVHKMDLVQEDQRDLIFKEREEDLRRLSRPLECSCFRTSIWDETLYKAWSSNSLSD

SEQ ID NO: 885636 - protein, 689 aa, Homo sapiens
EREVGDGAGLAAGAGTRSGKMAAAQEADGARSAVVAAGGGSSGQVTSNGSIGRDPPAETQPQNPPAQPAPNAWQVIKGVLFRIFIIWAISSWFRRGPAPQDQAGPGGAPRVASRNLFPKDTLMNLHVYISEHEHFTDFNATSALFWEQHDLVYGDWTSGENSDGCYEHFAELDIPQSVQQNGSIYIHVYFTKSGFHPDPRQKALYRRLATVHMSRMINKYKRRRFQKTKNLLTGETEADPEMIKRAEDYGPVEVISHWHPNITINIVDDHTPWVKGSVPPPLDQYVKFDAVSGDYYPIIYFNDYWNLQKDYYPINESLASLPLRVSFCPLSLWRWQLYAAQSTKSPWNFLGDELYEQSDEEQDSVKVALLETNPYLLALTIIVSIVHSVFEFLAFKNDIQFWNSRQSLEGLSVRSVFFGVFQSFVVLLYILDNETNFVVQVSVFIGVLIDLWKITKVMDVRLDREHRVAGIFPRLSFKDKSTYIESSTKVYDDMAFRYLSWILFPLLGCYAVYSLLYLEHKGWYSWVLSMLYGFLLTFGFITMTPQLFINYKLKSVAHLPWRMLTYKALNTFIDDLFAFVIKMPVMYRIGCLRDDVVFFIYLYQRWIYRVDPTRVNEFGMSGEDPTAAAPVAEVPTAAGALTPTPAPTTTTATREEASTSLPTKPTQGASSASEPQEAPPKPAEDKKKD

SEQ ID NO: 885637 - protein, 689 aa, Homo sapiens; identical to SEQ ID NO: 885636

SEQ ID NO: 885638 - protein, 689 aa, Homo sapiens; identical to SEQ ID NO: 885636

SEQ ID NO: 885639 - protein, 674 aa, Homo sapiens
PGLELYEDTQLMKNCGILRAREASAHGCEVTSNGSIGRDPPAETQPQNPPAQPAPNAWQVIKGVLFRIFIIWAISSWFRRGPAPQDQAGPGGAPRVASRNLFPKDTLMNLHVYISEHEHFTDFNATSALFWEQHDLVYGDWTSGENSDGCYEHFAELDIPQSVQQNGSIYIHVYFTKSGFHPDPRQKALYRRLATVHMSRMINKYKRRRFQKTKNLLTGETEADPEMIKRAEDYGPVEVISHWHPNITINIVDDHTPWVKGSVPPPLDQYVKFDAVSGDYYPIIYFNDYWNLQKDYYPINESLASLPLRVSFCPLSLWRWQLYAAQSTKSPWNFLGDELYEQSDEEQDSVKVALLETNPYLLALTIIVSIVHSVFEFLAFKNDIQFWNSRQSLEGLSVRSVFFGVFQSFVVLLYILDNETNFVVQVSVFIGVLIDLWKITKVMDVRLDREHRVAGIFPRLSFKDKSTYIESSTKVYDDMAFRYLSWILFPLLGCYAVYSLLYLEHKGWYSWVLSMLYGFLLTFGFITMTPQLFINYKLKSVAHLPWRMLTYKALNTFIDDLFAFVIKMPVMYRIGCLRDDVVFFIYLYQRWIYRVDPTRVNEFGMSGEDPTAAAPVAEVPTAAGALTPTPAPTTTTATREEASTSLPTKPTQGASSASEPQEAPPKPAEDKKKD

SEQ ID NO: 885640 - protein, 670 aa, Homo sapiens
WNEKDAKNRQGEADRMSRKAHITEKVTSNGSIGRDPPAETQPQNPPAQPAPNAWQVIKGVLFRIFIIWAISSWFRRGPAPQDQAGPGGAPRVASRNLFPKDTLMNLHVYISEHEHFTDFNATSALFWEQHDLVYGDWTSGENSDGCYEHFAELDIPQSVQQNGSIYIHVYFTKSGFHPDPRQKALYRRLATVHMSRMINKYKRRRFQKTKNLLTGETEADPEMIKRAEDYGPVEVISHWHPNITINIVDDHTPWVKGSVPPPLDQYVKFDAVSGDYYPIIYFNDYWNLQKDYYPINESLASLPLRVSFCPLSLWRWQLYAAQSTKSPWNFLGDELYEQSDEEQDSVKVALLETNPYLLALTIIVSIVHSVFEFLAFKNDIQFWNSRQSLEGLSVRSVFFGVFQSFVVLLYILDNETNFVVQVSVFIGVLIDLWKITKVMDVRLDREHRVAGIFPRLSFKDKSTYIESSTKVYDDMAFRYLSWILFPLLGCYAVYSLLYLEHKGWYSWVLSMLYGFLLTFGFITMTPQLFINYKLKSVAHLPWRMLTYKALNTFIDDLFAFVIKMPVMYRIGCLRDDVVFFIYLYQRWIYRVDPTRVNEFGMSGEDPTAAAPVAEVPTAAGALTPTPAPTTTTATREEASTSLPTKPTQGASSASEPQEAPPKPAEDKKKD

SEQ ID NO: 885641 - protein, 567 aa, Homo sapiens
MNLHVYISEHEHFTDFNATSALFWEQHDLVYGDWTSGENSDGCYEHFAELDIPQSVQQNGSIYIHVYFTKSGFHPDPRQKALYRRLATVHMSRMINKYKRRRFQKTKNLLTGETEADPEMIKRAEDYGPVEVISHWHPNITINIVDDHTPWVKGSVPPPLDQYVKFDAVSGDYYPIIYFNDYWNLQKDYYPINESLASLPLRVSFCPLSLWRWQLYAAQSTKSPWNFLGDELYEQSDEEQDSVKVALLETNPYLLALTIIVSIVHSVFEFLAFKNDIQFWNSRQSLEGLSVRSVFFGVFQSFVVLLYILDNETNFVVQVSVFIGVLIDLWKITKVMDVRLDREHRVAGIFPRLSFKDKSTYIESSTKVYDDMAFRYLSWILFPLLGCYAVYSLLYLEHKGWYSWVLSMLYGFLLTFGFITMTPQLFINYKLKSVAHLPWRMLTYKALNTFIDDLFAFVIKMPVMYRIGCLRDDVVFFIYLYQRWIYRVDPTRVNEFGMSGEDPTAAAPVAEVPTAAGALTPTPAPTTTTATREEASTSLPTKPTQGASSASEPQEAPPKPAEDKKKD

SEQ ID NO: 885642 - protein, 685 aa, Homo sapiens
EREVGDGAGLAAGAGTRSGKMAAAQEADGARSAVVAAGGGSSGQVTSNGSIGRDPPAETQPQNPPAQPAPNAWQVIKGVLFRIFIIWAISSWFRRGPAPQDQAGPGGAPRVASRNLFPKDTLMNLHVYISEHEHFTDFNATSALFWEQHDLVYGDWTSGENSDGCYEHFAELDIPQSVQQNGSIYIHVYFTKSGFHPDPRQKALYRRLATVHMSRMINKYKRRRFQKTKNLLTGETEADPEMIKRAEDYGPVEVISHWHPNITINIVDDHTPWVKGSVPPPLDQYVKFDAVSGDYYPIIYFNDYWNLQKDYYPINESLASLPLRVSFCPLSLWRWQLYAAQSTKSPWNFLGDELYEQSDEEQDSVKVALLETNPYLLALTIIVSIVHSVFEFLAFKNDIQFWNSRQSLEGLSVRSVFFGVFQSFVVLLYILDNETNFVVQVSVFIGVLIDLWKITKVMDVRLDREHRVAGIFPRLSFKDKSTYIESSTKVYDDMAFRYLSWILFPLLGCYAVYSLLYLEHKGWYSWVLSMLYGFLLTFGFITMTPQLFINYKLKSVAHLPWRMLTYKALNTFIDDLFAFVIKMPVMYRIGCLRDDVVFFIYLYQRWIYRVDPTRVNEFGMSGEDPTAAAPVAEVPTAAGALTPTPAPTTTTATRVGWAGVGPGPPTGCPRPFIILSLVPLPHSPS

SEQ ID NO: 885643 - protein, 597 aa, Homo sapiens
EREVGDGAGLAAGAGTRSGKMAAAQEADGARSAVVAAGGGSSGQVTSNGSIGRDPPAETQPQNPPAQPAPNAWQVIKGVLFRIFIIWAISSWFRRGPAPQDQAGPGGAPRVASRNLFPKDTLMNLHVYISEHEHFTDFNATSALFWEQHDLVYGDWTSGENSDGCYEHFAELDIPQSVQQNGSIYIHVYFTKSGFHPDPRQKALYRRLATVHMSRMINKYKRRRFQKTKNLLTGETEADPEMIKRAEDYGPVEVISHWHPNITINIVDDHTPWVKGSVPPPLDQYVKFDAVSGDYYPIIYFNDYWNLQKDYYPINESLASLPLRVSFCPLSLWRWQLYAAQSTKSPWNFLGDELYEQSDEEQDSVKVALLETNPYLLALTIIVSIVHSVFEFLAFKNDIQFWNSRQSLEGLSVRSVFFGVFQSFVVLLYILDNETNFVVQVSVFIGVLIDLWKITKVMDVRLDREHRVAGIFPRLSFKDKSTYIESSTKVYDDMAFRYLSWILFPLLGCYAVYSLLYLEHKGWYSWVLSMLYGFLLTFGFITMTPQLFINYKLKSVAHLPWRMLTYKALNTFIDDLFADCHLRAEMTVGKILWTQQF

SEQ ID NO: 885644 - protein, 129 aa, Homo sapiens
MISSSGTAGSPWRACPCAPSSSAFSSHSWSSSTSWTTRPTSWSRSASSLGSSSTSGRSPRSWTSGWTESTGWQESSPAYPSRTSPRISSPRPKCMMIWHSGTCPGSSSRSGCPRPFIILSLVPLPHSPS

SEQ ID NO: 885645 - protein, 524 aa, Homo sapiens
EREVGDGAGLAAGAGTRSGKMAAAQEADGARSAVVAAGGGSSGQVTSNGSIGRDPPAETQPQNPPAQPAPNAWQVIKGVLFRIFIIWAISSWFRRGPAPQDQAGPGGAPRVASRNLFPKDTLMNLHVYISEHEHFTDFNATSALFWEQHDLVYGDWTSGENSDGCYEHFAELDIPQSVQQNGSIYIHVYFTKSGFHPDPRQKALYRRLATVHMSRMINKYKRRRFQKTKNLLTGETEADPEMIKRAEDYGPVEVISHWHPNITINIVDDHTPWVKGSVPPPLDQYVKFDAVSGDYYPIIYFNDYWNLQKDYYPINESLASLPLRVSFCPLSLWRWQLYAAQSTKSPWNFLGDELYEQSDEEQDSVKVALLETNPYLLALTIIVSIVHSVFEFLAFKNDIQFWNSRQSLEGLSVRSVFFGVFQSFVVLLYILDNETNFVVQVSVFIGVLIDLWKITKVMDVRWTRGKVEDLPAYLRQSGIESDKGENGSDRRPLRTGEPKARTGRGLGQGRPEWYKTLTTLPGPK

SEQ ID NO: 885646 - protein, 297 aa, Homo sapiens
EREVGDGAGLAAGAGTRSGKMAAAQEADGARSAVVAAGGGSSGQVTSNGSIGRDPPAETQPQNPPAQPAPNAWQVIKGVLFRIFIIWAISSWFRRGPAPQDQAGPGGAPRVASRNLFPKDTLMNLHVYISEHEHFTDFNATSALFWEQHDLVYGDWTSGENSDGCYEHFAELDIPQSVQQNGSIYIHVYFTKSGFHPDPRQKALYRRLATVHMSRMINKYKRRRFQKTKNLLTGETEADPEMIKRAEDYGPVEVISHWHPNITINIVDDHTPWVKGSVPPPLDQCKLPSPASCLQSL

SEQ ID NO: 885647 - protein, 706 aa, Homo sapiens
EREVGDGAGLAAGAGTRSGKMAAAQEADGARSAVVAAGGGSSGQVTSNGSIGRDPPAETQPQNPPAQPAPNAWQVIKGVLFRIFIIWAISSWFRRGPAPQDQAGPGGAPRVASRNLFPKDTLMNLHVYISEHEHFTDFNATSALFWEQHDLVYGDWTSGENSDGCYEHFAELDIPQSVQQNGSIYIHVYFTKSGFHPDPRQKALYRRLATVHMSRMINKYKRRRFQKTKNLLTGETEADPEMIKRAEDYGPVEVISHWHPNITINIVDDHTPWVKGSVPPPLDQYVKFDAVSGDYYPIIYFNDYWNLQKDYYPINESLASLPLRVSFCPLSLWRWQLYAAQSTKSPWNFLGDELYEQSDEEQDSVKVALLETNPYLLALTIIVSIVHSVFEFLAFKNDIQFWNSRQSLEGLSVRSVFFGVFQSFVVLLYILDNETNFVVQVSVFIGVLIDLWKITKVMDVRLDREHRVAGIFPRLSFKDKSTYIESSTKVYDDMAFRYLSWILFPLLGCYAVYSLLYLEHKGWYSWVLSMLYGFLLTFGFITMTPQLFINYKLKSVAHLPWRMLTYKALNTFIDDLFAFVIKMPVMYRIGCLRDDVVFFIYLYQRWIYRVDPTRVNEFGMSGEDPTAAAPVAEVPTAAGALTPTPAPTTTTATREEASTSLPTKPTQGASSASEPQGLFVEALSVPLSLCVSSHLALPAQHHWESW

SEQ ID NO: 885648 - protein, 686 aa, Homo sapiens
PRPSTPFYELSLSTPGLMAAAQEADGARSAVVAAGGGSSGQVTSNGSIGRDPPAETQPQNPPAQPAPNAWQVIKGVLFRIFIIWAISSWFRRGPAPQDQAGPGGAPRVASRNLFPKDTLMNLHVYISEHEHFTDFNATSALFWEQHDLVYGDWTSGENSDGCYEHFAELDIPQSVQQNGSIYIHVYFTKSGFHPDPRQKALYRRLATVHMSRMINKYKRRRFQKTKNLLTGETEADPEMIKRAEDYGPVEVISHWHPNITINIVDDHTPWVKGSVPPPLDQYVKFDAVSGDYYPIIYFNDYWNLQKDYYPINESLASLPLRVSFCPLSLWRWQLYAAQSTKSPWNFLGDELYEQSDEEQDSVKVALLETNPYLLALTIIVSIVHSVFEFLAFKNDIQFWNSRQSLEGLSVRSVFFGVFQSFVVLLYILDNETNFVVQVSVFIGVLIDLWKITKVMDVRLDREHRVAGIFPRLSFKDKSTYIESSTKVYDDMAFRYLSWILFPLLGCYAVYSLLYLEHKGWYSWVLSMLYGFLLTFGFITMTPQLFINYKLKSVAHLPWRMLTYKALNTFIDDLFAFVIKMPVMYRIGCLRDDVVFFIYLYQRWIYRVDPTRVNEFGMSGEDPTAAAPVAEVPTAAGALTPTPAPTTTTATREEASTSLPTKPTQGASSASEPQEAPPKPAEDKKKD

SEQ ID NO: 885649 - protein, 759 aa, Homo sapiens
EREVGDGAGLAAGAGTRSGKMAAAQEADGARSAVVAAGGGSSGQVTSNGSIGRDPPAETQPQNPPAQPAPNAWQVIKGVLFRIFIIWAISSWFRRGPAPQDQAGPGGAPRVASRNLFPKDTLMNLHVYISEHEHFTDFNATSALFWEQHDLVYGDWTSGENSDGCYEHFAELDIPQSVQQNGSIYIHVYFTKSGFHPDPRQKALYRRLATVHMSRMINKYKRRRFQKTKNLLTGETEADPEMIKRAEDYGPVEVISHWHPNITINIVDDHTPWVKGSVPPPLDQYVKFDAVSGDYYPIIYFNDYWNLQKDYYPINESLASLPLRVSFCPLSLWRWQLYAAQSTKSPWNFLGDELYEQSDEEQDSVKVALLETNPYLLALTIIVSIVHSVFEFLAFKNDIQFWNSRQSLEGLSVRSVFFGVFQSFVVLLYILDNETNFVVQVSVFIGVLIDLWKITKVMDVRLDREHRVAGIFPRLSFKDKSTYIESSTKVYDDMAFRYLSWILFPLLGCYAVYSLLYLEHKGWYSWVLSMLYGFLLTFGFITMTPQLFINYKLKSVAHLPWRMLTYKALNTFIDDLFAFVIKMPVMYRIGCLRDGPPGCGRASPTSHCLPPLSRCGFLHLPLPTVDLPRRPHPSQRVWHEWRRPHSCRPRGRGSHSSRGPHAHTCTHHDHRHQGGGLHVPAHQAHPGGQLCQRAPGSPSKASRGQEKGLVETGPHLLRLLATTTPASRPPRLPSLSPFPWTDQAGAVGGPPQVRAQRVT

SEQ ID NO: 885650 - protein, 497 aa, Homo sapiens
EREVGDGAGLAAGAGTRSGKMAAAQEADGARSAVVAAGGGSSGQVTSNGSIGRDPPAETQPQNPPAQPAPNAWQVIKGVLFRIFIIWAISSWFRRGPAPQDQAGPGGAPRVASRNLFPKDTLMNLHVYISEHEHFTDFNATSALFWEQHDLVYGDWTSGENSDGCYEHFAELDIPQSVQQNGSIYIHVYFTKSGFHPDPRQKALYRRLATVHMSRMINKYKRRRFQKTKNLLTGETEADPEMIKRAEDYGPVEVISHWHPNITINIVDDHTPWVKGSVPPPLDQYVKFDAVSGDYYPIIYFNDYWNLQKDYYPINESLASLPLRVSFCPLSLWRWQLYAAQSTKSPWNFLGDELYEQSDEEQDSVKVALLETNPYLLALTIIVSIVHSVFEFLAFKNDIQFWNSRQSLEGLSVRSVFFGVFQSFVVLLYILDNETNFVVQVSVFIGVLIDLWKITKVMDVRLDREHRVAGIFPRLSFKDKSTYIESSTKVYDDASSP

SEQ ID NO: 885651 - protein, 449 aa, Homo sapiens
MLPQRAEDYGPVEVISHWHPNITINIVDDHTPWVKGSVPPPLDQYVKFDAVSGDYYPIIYFNDYWNLQKDYYPINESLASLPLRVSFCPLSLWRWQLYAAQSTKSPWNFLGDELYEQSDEEQDSVKVALLETNPYLLALTIIVSIVHSVFEFLAFKNDIQFWNSRQSLEGLSVRSVFFGVFQSFVVLLYILDNETNFVVQVSVFIGVLIDLWKITKVMDVRLDREHRVAGIFPRLSFKDKSTYIESSTKVYDDMAFRYLSWILFPLLGCYAVYSLLYLEHKGWYSWVLSMLYGFLLTFGFITMTPQLFINYKLKSVAHLPWRMLTYKALNTFIDDLFAFVIKMPVMYRIGCLRDDVVFFIYLYQRWIYRVDPTRVNEFGMSGEDPTAAAPVAEVPTAAGALTPTPAPTTTTATREEASTSLPTKPTQGASSASEPQEAPPKPAEDKKKD

SEQ ID NO: 885652 - protein, 592 aa, Homo sapiens
EREVGDGAGLAAGAGTRSGKMAAAQEADGARSAVVAAGGGSSGQVTSNGSIGRDPPAETQPQNPPAQPAPNAWQVIKGVLFRIFIIWAISSWFRRGPAPQDQAGPGGAPRVASRNLFPKDTLMNLHVYISEHEHFTDFNATSALFWEQHDLVYGDWTSGENSDGCYEHFAELDIPQSVQQNGSIYIHVYFTKSGFHPDPRQKALYRRLATVHMSRMINKYKRRRFQKTKNLLTGETEADPEMIKRAEDYGPVEVISHWHPNITINIVDDHTPWVKGSVPPPLDQYVKFDAVSGDYYPIIYFNDYWNLQKDYYPINESLASLPLRVSFCPLSLWRWQLYAAQSTKSPWNFLGDELYEQSDEEQDSVKVALLETNPYLLALTIIVSIVHSVFEFLAFKNDIQFWNSRQSLEGLSVRSVFFGVFQSFVVLLYILDNETNFVVQVSVFIGVLIDLWKITKVMDVRLDREHRVAGIFPRLSFKDKSTYIESSTKVYDDMAFRYLSWILFPLLGCYAVYSLLYLEHKGWYSWVLSMLYGFLLTFGTGHARRNVYKKEKARVITEEEKNFKAFASLRMARANARLFGIRAKRAKEAAPR

SEQ ID NO: 885653 - protein, 246 aa, Homo sapiens
SVPTTPIDQEITKVMDVRLDREHRVAGIFPRLSFKDKSTYIESSTKVYDDMAFRYLSWILFPLLGCYAVYSLLYLEHKGWYSWVLSMLYGFLLTFGFITMTPQLFINYKLKSVAHLPWRMLTYKALNTFIDDLFAFVIKMPVMYRIGCLRDDVVFFIYLYQRWIYRVDPTRVNEFGMSGEDPTAAAPVAEVPTAAGALTPTPAPTTTTATREEASTSLPTKPTQGASSASEPQEAPPKPAEDKKKD

SEQ ID NO: 885654 - protein, 270 aa, Homo sapiens
EREVGDGAGLAAGAGTRSGKMAAAQEADGARSAVVAAGGGSSGQVTSNGSIGRDPPAETQPQNPPAQPAPNAWQVIKGVLFRIFIIWAISSWFRRGPAPQDQAGPGGAPRVASRNLFPKDTLMNLHVYISEHEHFTDFNATSALFWEQHDLVYGDWTSGENSDGCYEHFAELDIPQSVQQNGSIYIHVYFTKSGFHPDPRQKALYRRLATVHMSRMINKYKRRRFQKTKNLLTGETEADPEMIKRAEDYGPVEVISHWHPNTITSVDFKS

SEQ ID NO: 885655 - protein, 242 aa, Homo sapiens
MSNYVNDMWPGSPQEKDSPSTSRSGGSSRLSSRSRSRSFSRSSRSHSRVSSRFSSRSRRSKSRSRSRRRHQRKYRRYSRSYSRSRSRSRSRRYRERRYGFTRRYYRSPSRYRSRSRSRSRSRGRSYCGRAYAIARGQRYYGFGRTVYPEEHSRWRDRSRTRSRSRTPFRLSEKDRMELLEIAKTNAAKALGTTNIDLPASLRTVPSAKETSRGIGVSSNGAKPEVSILGLSEQNFQKANCQI

SEQ ID NO: 885656 - protein, 255 aa, Homo sapiens
MSNYVNDMWPGSPQEKDSPSTSRSGGSSRLSSRSRSRSFSRSSRSHSRVSSRFSSRSRRSKSRSRSRRRHQRKYRRYSRSYSRSRSRSRSRRYRERRYGFTRRYYRSPSRYRSRSRSRSRSRGRSYCGRAYAIARGQRYYGFGRTVYPEEHSRWRDRSRTRSRSRTPFRLSEKGGWVIYLSICGNVWWQYMSRLGNQRCCVVSILVPLVPEIFLEERGRTLPVFKWTAFSLGLKVNWMLNGSGCRELFFLLADCS

SEQ ID NO: 885657 - protein, 255 aa, Homo sapiens; identical to SEQ ID NO: 885656

SEQ ID NO: 885658 - protein, 242 aa, Homo sapiens; identical to SEQ ID NO: 885655

SEQ ID NO: 885659 - protein, 255 aa, Homo sapiens; identical to SEQ ID NO: 885656

SEQ ID NO: 885660 - protein, 242 aa, Homo sapiens; identical to SEQ ID NO: 885655

SEQ ID NO: 885661 - protein, 242 aa, Homo sapiens; identical to SEQ ID NO: 885655

SEQ ID NO: 885662 - protein, 290 aa, Homo sapiens
MSNYVNDMWPGSPQEKDSPSTSRSGGSSRLSSRSRSRSFSRSSRSHSRVSSRFSSRSRRSKSRSRSRRRHQRKYRRYSRSYSRSRSRSRSRRYRERRYGFTRRYYRSPSRYRSRSRSRSRSRGRSYCGRAYAIARGQRYYGFGRTVYPEEHSRWRDRSRTRSRSRTPFRLSEKDRMELLEIAKTNAAKALGTTNIDLPASLRTVPSAKETSRGIGVSSNGAKPELSEKVTEDGTRNPNEKPTQQRSIAFSSNNSVAKPIQKSAKAATEEASSRSPKIDQKKSPYGLWIPI

SEQ ID NO: 885663 - protein, 226 aa, Homo sapiens
MSNYVNDMWPGSPQEKDSPSTSRSGGSSRLSSRSRSRSFSRSSRSHSRVSSRFSSRSRRSKSRSRSRRRHQRKYRRYSRSYSRSRSRSRSRRYRERRYGFTRRYYRSPSRYRSRSRSRSRSRGRSYCGRAYAIARGQRYYGFGRTVYPEEHSRWRDRSRTRSRSRTPFRLSEKDRMELLEIAKTNAAKALGTTNIDLPASLRTVPSAKETSRGIGVSSNGAKPEKS

SEQ ID NO: 885664 - protein, 226 aa, Homo sapiens; identical to SEQ ID NO: 885663

SEQ ID NO: 885665 - protein, 242 aa, Homo sapiens; identical to SEQ ID NO: 885655

SEQ ID NO: 885666 - protein, 226 aa, Homo sapiens; identical to SEQ ID NO: 885663

SEQ ID NO: 885667 - protein, 242 aa, Homo sapiens; identical to SEQ ID NO: 885655

SEQ ID NO: 885668 - protein, 112 aa, Homo sapiens
MDRGPGYSYPVDWWSLGITAYELLRGWVRQAPVRYTRGAVQWGLTLYLDGQSRQGPRCRKEHWGSHCPPGFSPDACVPPMNALNFWSNPLIVQMGKRHSVGEGLTQRPTADQ

SEQ ID NO: 885669 - protein, 90 aa, Homo sapiens
SLSFCAPRYSFQDEEDMFMVVDLLLGGDLRYHLQQNVHFTEGTVKLYICELALALEYLQRYHIIHSIFMNLKQMLQTLSLNSSFLFPWTT

SEQ ID NO: 885670 - protein, 414 aa, Homo sapiens
MGGNHSHKPPVFDENEEVNFDHFQILRAIGKGSFGKVCIVQKRDTKKMYAMKYMNKQKCIERDEVRNVFRELQIMQGLEHPFLVNLWYSFQDEEDMFMVVDLLLGGDLRYHLQQNVHFTEGTVKLYICELALALEYLQRYHIIHRDIKPDNILLDEHGHVHITDFNIATVVKGAERASSMAGTKPYMAPEVFQVYMDRGPGYSYPVDWWSLGITAYELLRGWRPYEIHSVTPIDEILNMFKVERVHYSSTWCKGMVALLRKLLTKDPESRVSSLHDIQSVPYLADMNWDAVFKKALMPGFVPNKGRLNCDPTFELEEMILESKPLHKKKKRLAKNRSRDGTKDSCPLNGHLQHCLETVREEFIIFNREKLRRQQGQGSQLLDTDSRGGGQAQSKLQDGCNNNLLTHTCTRGCSS

SEQ ID NO: 885671 - protein, 176 aa, Homo sapiens
MFKVERVHYSSTWCKGMVALLRKLLTKDPESRVSSLHDIQSVPYLADMNWDAVFKKALMPGFVPNKGRLNCDPTFELEEMILESKPLHKKKKRLAKNRSRDGTKDSCPLNGHLQHCLETVREEFIIFNREKLRRQQGQGSQLLDTDSRGGGQAQSKLQDGCNNNLLTHTCTRGCSS

SEQ ID NO: 885672 - protein, 219 aa, Homo sapiens
MDRGPGYSYPVDWWSLGITAYELLRGWRPYEIHSVTPIDEILNMFKVERVHYSSTWCKGMVALLRKLLTKDPESRVSSLHDIQSVPYLADMNWDAVFKKALMPGFVPNKGRLNCDPTFELEEMILESKPLHKKKKRLAKNRSRDGTKDSCPLNGHLQHCLETVREEFIIFNREKLRRQQGQGSQLLDTDSRGGGQAQSKLQDGCNNNLLTHTCTRGCSS

SEQ ID NO: 885673 - protein, 918 aa, Homo sapiens
MGKRAYSDSDLVTQIRFFATTTCVTVKLRSIFCVDRFLFLPVNLPYYHYLYPVRYLLVRPRKYLFMWITKETLKFLFLAYLNAIKYKNSYCLHRTDLSYCCNVFSWLICYIGNYYIVPLKYFINFFKKLKIFNDVKVGSAEYLKFLIYNFFSLSQDNLEFCSIFHLQILGLEMDSDGSNQSTLAYILKMVSIHKVKNKLINDPCLVNTSDQDVPWQGILTWFSFGPVCAQGSGILQDWVQRDENSQIGLYQNSHRFWSAFSQNRLQDFFFCVILESRLDLDYFRGYDKRLILSGIYTKEVFLLQSFLRRFLLFLKCDIYQSEVMLPYIPQTLNFSIIYFCPFLVRIVPVYLYNILVYFLFIRYFLLVYIVFLIEAVGKEFSSNLKSPYLFADVCQSNILLTVIKHFSNAVCIYYEMNDRVTHGLSPRLECSGIIIAHFSLKLLGLSVIPAFLATFFNFYYFYRDSILLCCPGWSQTPGSKVILPLLPPKVLRLQAEQCFKLTLVYLHRLLLCTCGNNLTYKCILSKKFPRSEIAFEHGSSFFFFFFFFLSKKRVLKGQFYLQINIIFFIEVKSHNINHFKVNSLGGTLYIHNVVQTTSSNSRMCSLPQKETLYPLSSYSVFPSSLIPSKRHLLSVSNLSQHRGRVLCTIEIAEKTWDVIVRNKKPPNSLHASLSTVDMLPGTLYGRKVETHRSLQFCLGSPQRVLLKLLGLICIFFIGLLELKFNVLYKCEQLILGLLSRTCLPFEVFLMYEKKLGIFTKDLFEVTLGNDFQNLKLFDPCESNFMTILFSSSLRIFRVLICVDSAFNPLLNEVLETLILALYLITSKNMNSVTRQLFSKLFWIVLIGWLRETKLVFFFLSRIKGNKLGLSELLLRLTFPFGALEIYCYLKFKMVLYLIELKLKIYEKQKSLYVLSKYF

SEQ ID NO: 885674 - protein, 98 aa, Homo sapiens
KGTRTTSDWAAEDEEEEEEAEQQDGPCCRSSLSSSRWEAGGGAGGGGGSRGPAAWDRIRVNGGLGGGGGCRGGGDGRGDSELRGAAARTSAVIFHTMC

SEQ ID NO: 885675 - protein, 81 aa, Homo sapiens
KLDDDGTKDRTPCFWPLSALGREHTFRGAAARSLRTKLEMSVMKAFTGKFCKWQRGSIPCVSLELAQAHGHGEAAFPLELI

SEQ ID NO: 885676 - protein, 544 aa, Homo sapiens
MSRCAQAAEVAATVPGAGVGNVGLRPPMVPRQASFFPPPVPNPFVQQTQIGSARRVQIVLLGIILLPIRVLLVALILLLAWPFAAISTVCCPEKLTHPITGWRRKITQTALKFLGRAMFFSMGFIVAVKGKIASPLEAPVFVAAPHSTFFDGIACVVAGLPSMVSRNENAQVPLIGRLLRAVQPVLVSRVDPDSRKNTINEIIKRTTSGGEWPQILVFPEGTCTNRSCLITFKPGAFIPGVPVQPVLLRYPNKLDTVTWTWQGYTFIQLCMLTFCQLFTKVEVEFMPVQVPNDEEKNDPVLFANKVRNLMAEALGIPVTDHTYEDCRLMISAGQLTLPMEAGLVEFTKISRKLKLDWDGVRKHLDEYASIASSSKGGRIGIEEFAKYLKLPVSDVLRQLFALFDRNHDGSIDFREYVIGLAVLCNPSNTEEIIQVAFKLFDVDEDGYITEEEFSTILQASLGVPDLDVSGLFKEIAQGDSISYEEFKSFALKHPEYAKIFTTYLDLQTCHVFSLPKEVQTTPSTASNKVSPEKHEESTSDKKDD

SEQ ID NO: 885677 - protein, 104 aa, Homo sapiens
MSRCAQAAEVAATVPGAGVGNVGLRPPMVPRQASFFPPPVPNPFVQQTQIGSARRVQIVLLGIILLPIRVLLVALILLLAWPFAAISTVCCPEKLTHPITGWRR

SEQ ID NO: 885678 - protein, 544 aa, Homo sapiens; identical to SEQ ID NO: 885676

SEQ ID NO: 885679 - protein, 271 aa, Homo sapiens
AASLVTKVEVEFMPVQVPNDEEKNDPVLFANKVRNLMAEALGIPVTDHTYEDCRLMISAGQLTLPMEAGLVEFTKISRKLKLDWDGVRKHLDEYASIASSSKGGRIGIEEFAKYLKLPVSDVLRQLFALFDRNHDGSIDFREYVIGLAVLCNPSNTEEIIQVAFKLFDVDEDGYITEEEFSTILQASLGVPDLDVSGLFKEIAQGDSISYEEFKSFALKHPEYAKIFTTYLDLQTCHVFSLPKEVQTTPSTASNKVSPEKHEESTSDKKDD

SEQ ID NO: 885680 - protein, 330 aa, Homo sapiens
MSRCAQAAEVAATVPGAGVGNVGLRPPMVPRQASFFPPPVPNPFVQQTQIGSARRVQIVLLGIILLPIRVLLVALILLLAWPFAAISTVCCPEKLTHPITGWRRKITQTALKFLGRAMFFSMGFIVAVKGKIASPLEAPVFVAAPHSTFFDGIACVVAGLPSMVSRNENAQVPLIGRLLRAVQPVLVSRVDPDSRKNTINEIIKRTTSGGEWPQILVFPEGTCTNRSCLITFKPGAFIPGVPVQPVLLRYPNKLDTVTWTWQGYTFIQLCMLTFCQLFTKVEVEMFLFFWEGSSKHCLKISSFFCIFSLRRFKRRITQRTRTAHLLRLSF

SEQ ID NO: 885681 - protein, 407 aa, Homo sapiens
MSRCAQAAEVAATVPGAGVGNVGLRPPMVPRQASFFPPPVPNPFVQQTQIGSARRVQIVLLGIILLPIRVLLVALILLLAWPFAAISTVCCPEKLTHPITGWRRKITQTALKFLGRAMFFSMGFIVAVKGKIASPLEAPVFVAAPHSTFFDGIACVVAGLPSMVSRNENAQVPLIGRLLRAVQPVLVSRVDPDSRKNTINEIIKRTTSGGEWPQILVFPEGTCTNRSCLITFKPGAFIPGVPVQPVLLRYPNKLDTVTWTWQGYTFIQLCMLTFCQLFTKVEVEFMPVQVPNDEEKNDPVLFANKVRNLMAEALGIPVTDHTYEDCRLMISAGQLTLPMEAGLVEFTKISRKLKLDWDGVRKHLDEYASIASSSKGGRIGIEEFAKYLKLPVSDVLRQLFALFDRVC

SEQ ID NO: 885682 - protein, 190 aa, Homo sapiens
CCFSLGYPNKLDTVTWTWQGYTFIQLCMLTFCQLFTKVEVEFMPVQVPNDEEKNDPVLFANKVRNLMAEALGIPVTDHTYEDCRLMISAGQLTLPMEAGLVEFTKISRKLKLDWDGVRKHLDEYASIASSSKGGRIGIEEFAKYLKLPVSDVLRQLFALFDRALLEGADRGLGEALGGLFGGGGQRREGG

SEQ ID NO: 885683 - protein, 259 aa, Homo sapiens [sequence omitted]

SEQ ID NO: 885684 - protein, 544 aa, Homo sapiens; identical to SEQ ID NO: 885676

SEQ ID NO: 885685 - protein, 224 aa, Homo sapiens
LGSMVNTCQNPEIFKEMNNAFAHLPQGVIWKCQCSHWPKDVHLAANVKIVDWLPQSDLLAHPSIRLFVTHGGQNSIMEAIQHGVPMVGIPLFGDQPENMVRVEAKKFGVSIQLKKLKAETLALKMKQIMEDKRYKSAAVAASVILRSHPLSPTQRLVGWIDHVLQTGGATHLKPYVFQQPWHEQYLLDVFVFLLGLTLGTLWLCGKLLGMAVWWLRGARKVKET

SEQ ID NO: 885686 - protein, 224 aa, Homo sapiens; identical to SEQ ID NO: 885685

SEQ ID NO: 885687 - protein, 351 aa, Homo sapiens
MIVQRVVLNSRPGKNGNPVAENFRMEEVYLPDNINEGQVQVRTLYLSVDPYMRCRMNEDTGTDYITPWQLSQVVDGGGIGIIEESKHTNLTKGDFVTSFYWPWQTKVILDGNSLEKVDPQLVDGHLSYFLGAIGMPGLTSLIGIQEKGHITAGSNKTMVVSGAAGACGSVAGQIGHFLGCSRVVGICGTHEKCILLTSELGFDAAINYKKDNVAEQLRESCPAGVDVYFDNVGGNISDTVISQMNENSHIILCGQISQYNKDVPYPPPLSPAIEAIQKERNITRERFLVLNYKDKFEPGILQLSQWFKEGKLKIKETVINGLENMGAAFQSMMTGGNIGKQIVCISEEISL

SEQ ID NO: 885688 - protein, 351 aa, Homo sapiens; identical to SEQ ID NO: 885687

SEQ ID NO: 885689 - protein, 351 aa, Homo sapiens; identical to SEQ ID NO: 885687

SEQ ID NO: 885690 - protein, 109 aa, Homo sapiens
MAPRLQLEKAAWRWAETVRPEEVSQEHIETAYRIWLEPCIRGVCRRNCKGNPNCLVGIGEHIWLGEIDENSFHNIDDPNCERRKKVNHHFLSDCYMLFFVFVFAFVLGL

SEQ ID NO: 885691 - protein, 485 aa, Homo sapiens
MAPRLQLEKAAWRWAETVRPEEVSQEHIETAYRIWLEPCIRGVCRRNCKGNPNCLVGIGEHIWLGEIDENSFHNIDDPNCERRKKNSFVGLTNLGATCYVNTFLQVWFLNLELRQALYLCPSTCSDYMLGDGIQEEKDYEPQTICEHLQYLFALLQNSNRRYIDPSGFVKALGLDTGQQQDAQEFSKLFMSLLEDTLSKQKNPDVRNIVQQQFCGEYAYVTVCNQCGRESKLLSKFYELELNIQGHKQLTDCISEFLKEEKLEGDNRYFCENCQSKQNATRKIRLLSLPCTLNLQLMRFVFDRQTGHKKKLNTYIGFSEILDMEPYVEHKGGSYVYELSAVLIHRGVSAYSGHYIAHVKDPQSGEWYKFNDEDIEKMEGKKLQLGIEEDLAEPSKSQTRKPKCGKGTHCSRNAYMLVYRLQTQEKPNTTVQVPAFLQELVDRDNSKFEEWCIEMAEMRKQSVDKGKAKHEEVKELYQRLPAGAGL

SEQ ID NO: 885692 - protein, 289 aa, Homo sapiens
MLVYRLQTQEKPNTTVQVPAFLQELVDRDNSKFEEWCIEMAEMRKQSVDKGKAKHEEVKELYQRLPAGAEPYEFVSLEWLQKWLDESTPTKPIDNHACLCSHDKLHPDKISIMKRISEYAADIFYSRYGGGPRLTVKALCKECVVERCRILRLKNQLNEDYKTVNNLLKAAVKGSDGFWVGKSSLRSWRQLALEQLDEQDGDAEQSNGKMNGSTLNKDESKEERKEEEELNFNEDILCPHGELCISENERRLVSKEAWSKLQQYFPKAPEFPSYKECCSQCKILEREGE

SEQ ID NO: 885693 - protein, 686 aa, Homo sapiens
MAPRLQLEKAAWRWAETVRPEEVSQEHIETAYRIWLEPCIRGVCRRNCKGNPNCLVGIGEHIWLGEIDENSFHNIDDPNCERRKKNSFVGLTNLGATCYVNTFLQVWFLNLELRQALYLCPSTCSDYMLGDGIQEEKDYEPQTICEHLQYLFALLQNSNRRYIDPSGFVKALGLDTGQQQDAQEFSKLFMSLLEDTLSKQKNPDVRNIVQQQFCGEYAYVTVCNQCGRESKLLSKFYELELNIQGHKQLTDCISEFLKEEKLEGDNRYFCENCQSKQNATRKIRLLSLPCTLNLQLMRFVFDRQTGHKKKLNTYIGFSEILDMEPYVEHKGGSYVYELSAVLIHRGVSAYSGHYIAHVKDPQSGEWYKFNDEDIEKMEGKKLQLGIEEDLAEPSKSQTRKPKCGKGTHCSRNAYMLVYRLQTQEKPNTTVQVPAFLQELVDRDNSKFEEWCIEMAEMRKQSVDKGKAKHEEVKELYQRLPAGAEPYEFVSLEWLQKWLDESTPTKQISIMKRISEYAADIFYSRYGGGPRLTVKALCKECVVERCRILRLKNQLNEDYKTVNNLLKAAVKGSDGFWVGKSSLRSWRQLALEQLDEQDGDAEQSNGKMNGSTLNKDESKEERKEEEELNFNEDILCPHGELCISENERRLVSKEAWSKLQQYFPKAPEFPSYKECCSQCKILEREGE

SEQ ID NO: 885694 - protein, 392 aa, Homo sapiens
MAPRLQLEKAAWRWAETVRPEEVSQEHIETAYRIWLEPCIRGVCRRNCKGNPNCLVGIGEHIWLGEIDENSFHNIDDPNCERRKKNSFVGLTNLGATCYVNTFLQVWFLNLELRQALYLCPSTCSDYMLGDGIQEEKDYEPQTICEHLQYLFALLQNSNRRYIDPSGFVKALGLDTGQQQDAQEFSKLFMSLLEDTLSKQKNPDVRNIVQQQFCGEYAYVTVCNQCGRESKLLSKFYELELNIQGHKQLTDCISEFLKEEKLEGDNRYFCENCQSKQNATRKIRLLSLPCTLNLQLMRFVFDRQTGHKKKLNTYIGFSEILDMEPYVEHKGGSYVYELSAVLIHRGVSAYSGHYIAHVKDPQSGEWYKLILNTNYHLPPSPKPIKIKNYNKP

SEQ ID NO: 885695 - protein, 703 aa, Homo sapiens
MAPRLQLEKAAWRWAETVRPEEVSQEHIETAYRIWLEPCIRGVCRRNCKGNPNCLVGIGEHIWLGEIDENSFHNIDDPNCERRKKNSFVGLTNLGATCYVNTFLQVWFLNLELRQALYLCPSTCSDYMLGDGIQEEKDYEPQTICEHLQYLFALLQNSNRRYIDPSGFVKALGLDTGQQQDAQEFSKLFMSLLEDTLSKQKNPDVRNIVQQQFCGEYAYVTVCNQCGRESKLLSKFYELELNIQGHKQLTDCISEFLKEEKLEGDNRYFCENCQSKQNATRKIRLLSLPCTLNLQLMRFVFDRQTGHKKKLNTYIGFSEILDMEPYVEHKGGSYVYELSAVLIHRGVSAYSGHYIAHVKDPQSGEWYKFNDEDIEKMEGKKLQLGIEEDLAEPSKSQTRKPKCGKGTHCSRNAYMLVYRLQTQEKPNTTVQVPAFLQELVDRDNSKFEEWCIEMAEMRKQSVDKGKAKHEEVKELYQRLPAGAEPYEFVSLEWLQKWLDESTPTKPIDNHACLCSHDKLHPDKISIMKRISEYAADIFYSRYGGGPRLTVKALCKECVVERCRILRLKNQLNEDYKTVNNLLKAAVKGSDGFWVGKSSLRSWRQLALEQLDEQDGDAEQSNGKMNGSTLNKDESKEERKEEEELNFNEDILCPHGELCISENERRLVSKEAWSKLQQYFPKAPEFPSYKECCSQCKILEREGE

SEQ ID NO: 885696 - protein, 485 aa, Homo sapiens; identical to SEQ ID NO: 885691

SEQ ID NO: 885697 - protein, 185 aa, Homo sapiens
PRVRKLHPDKMSAAYSDILFIIDMEEVQDYTVKALCKECVVERCRILRLKNQLNEDYKTVNNLLKAAVKGSDGFWVGKSSLRSWRQLALEQLDEQDGDAEQSNGKMNGSTLNKDESKEERKEEEELNFNEDILCPHGELCISENERRLVSKEAWSKLQQYFPKAPEFPSYKECCSQCKILEREGE

SEQ ID NO: 885698 - protein, 518 aa, Homo sapiens
MLRVVSWNINGIRRPLQGVANQEPSNCAAVAVGRILDELDADIVCLQETKVTRDALTEPLAIVEGYNSYFSFSRNRSGYSGVATFCKDNATPVAAEEGLSGLFATQNGDVGCYGNMDEFTQEELRALDSEGRALLTQHKIRTWEGKEKTLTLINVYCPHADPGRPERLVFKMRFYRLLQIRAEALLAAGSHVIILGDLNTAHRPIDHWDAVNLECFEEDPGRKWMDSLLSNLGCQSASHVGPFIDSYRCFQPKQEGAFTCWSAVTGARHLNYGSRLDYVLGDRTLVIDTFQASFLLPEVMGSDHCPVGAVLSVSSVPAKQCPPLCTRFLPEFAGTQLKILRFLVPLEQSPVLEQSTLQHNNQTRVQTCQNKAQVRSTRPQPSQVGSSRGQKNLKSYFQPSPSCPQASPDIELPSLPLMSALMTPKTPEEKAVAKVVKGQAKTSEAKDEKELRTSFWKSVLAGPLRTPLCGGHREPCVMRTVKKPGPNLGRRFYMCARPRGPPTDPSSRCNFFLWSRPS

SEQ ID NO: 885699 - protein, 347 aa, Homo sapiens
MRFYRLLQIRAEALLAAGSHVIILGDLNTAHRPIDHWDAVNLECFEEDPGRKWMDSLLSNLGCQSASHVGPFIDSYRCFQPKQEGAFTCWSAVTGARHLNYGSRLDYVLGDRTLVIDTFQASFLLPEVMGSDHCPVGAVLSVSSVPAKQCPPLCTRFLPEFAGTQLKILRFLVPLEQSPVLEQSTLQHNNQTRVQTCQNKAQVRSTRPQPSQVGSSRGQKNLKSYFQPSPSCPQASPDIELPSLPLMSALMTPKTPEEKAVAKVVKGQAKTSEAKDEKELRTSFWKSVLAGPLRTPLCGGHREPCVMRTVKKPGPNLGRRFYMCARPRGPPTDPSSRCNFFLWSRPS

SEQ ID NO: 885700 - protein, 337 aa, Homo sapiens
GRVGQPTRPHVIILGDLNTAHRPIDHWDAVNLECFEEDPGRKWMDSLLSNLGCQSASHVGPFIDSYRCFQPKQEGAFTCWSAVTGARHLNYGSRLDYVLGDRTLVIDTFQASFLLPEVMGSDHCPVGAVLSVSSVPAKQCPPLCTRFLPEFAGTQLKILRFLVPLEQSPVLEQSTLQHNNQTRVQTCQNKAQVRSTRPQPSQVGSSRGQKNLKSYFQPSPSCPQASPDIELPSLPLMSALMTPKTPEEKAVAKVVKGQAKTSEAKDEKELRTSFWKSVLAGPLRTPLCGGHREPCVMRTVKKPGPNLGRRFYMCARPRGPPTDPSSRCNFFLWSRPS

SEQ ID NO: 885701 - protein, 294 aa, Homo sapiens
MDSLLSNLGCQSASHVGPFIDSYRCFQPKQEGAFTCWSAVTGARHLNYGSRLDYVLGDRTLVIDTFQASFLLPEVMGSDHCPVGAVLSVSSVPAKQCPPLCTRFLPEFAGTQLKILRFLVPLEQSPVLEQSTLQHNNQTRVQTCQNKAQVRSTRPQPSQVGSSRGQKNLKSYFQPSPSCPQASPDIELPSLPLMSALMTPKTPEEKAVAKVVKGQAKTSEAKDEKELRTSFWKSVLAGPLRTPLCGGHREPCVMRTVKKPGPNLGRRFYMCARPRGPPTDPSSRCNFFLWSRPS

SEQ ID NO: 885702 - protein, 111 aa, Homo sapiens
NSGLRHKKLTNKELGRKESEEERAEKRKRRVGDFEGEAKDEKELRTSFWKSVLAGPLRTPLCGGHREPCVMRTVKKPGPNLGRRFYMCARPRGPPTDPSSRCNFFLWSRPS

SEQ ID NO: 885703 - protein, 518 aa, Homo sapiens; identical to SEQ ID NO: 885698

SEQ ID NO: 885704 - protein, 421 aa, Homo sapiens
HAARRPRWNRTRVGCYGNMDEFTQEELRALDSEGRALLTQHKIRTWEGKEKTLTLINVYCPHADPGRPERLVFKMRFYRLLQIRAEALLAAGSHVIILGDLNTAHRPIDHWDAVNLECFEEDPGRKWMDSLLSNLGCQSASHVGPFIDSYRCFQPKQEGAFTCWSAVTGARHLNYGSRLDYVLGDRTLVIDTFQASFLLPEVMGSDHCPVGAVLSVSSVPAKQCPPLCTRFLPEFAGTQLKILRFLVPLEQSPVLEQSTLQHNNQTRVQTCQNKAQVRSTRPQPSQVGSSRGQKNLKSYFQPSPSCPQASPDIELPSLPLMSALMTPKTPEEKAVAKVVKGQAKTSEAKDEKELRTSFWKSVLAGPLRTPLCGGHREPCVMRTVKKPGPNLGRRFYMCARPRGPPTDPSSRCNFFLWSRPS

SEQ ID NO: 885705 - protein, 479 aa, Homo sapiens
MLRVVSWNINGIRRPLQGVANQEPSNCAAVAVGRILDELDADIVCLQETKVTRDALTEPLAIVEGYNSYFSFSRNRSGYSGVATFCKDNATPVAAEEGLSGLFATQNGDVGCYGNMDEFTQEELRALDSEGRALLTQHKIRNNPTLCFSAIHVIILGDLNTAHRPIDHWDAVNLECFEEDPGRKWMDSLLSNLGCQSASHVGPFIDSYRCFQPKQEGAFTCWSAVTGARHLNYGSRLDYVLGDRTLVIDTFQASFLLPEVMGSDHCPVGAVLSVSSVPAKQCPPLCTRFLPEFAGTQLKILRFLVPLEQSPVLEQSTLQHNNQTRVQTCQNKAQVRSTRPQPSQVGSSRGQKNLKSYFQPSPSCPQASPDIELPSLPLMSALMTPKTPEEKAVAKVVKGQAKTSEAKDEKELRTSFWKSVLAGPLRTPLCGGHREPCVMRTVKKPGPNLGRRFYMCARPRGPPTDPSSRCNFFLWSRPS

SEQ ID NO: 885706 - protein, 211 aa, Homo sapiens
SISCLQQTLAPSRNPISSQIPTHFSGPKLSPLNFLLVPLEQSPVLEQSTLQHNNQTRVQTCQNKAQVRSTRPQPSQVGSSRGQKNLKSYFQPSPSCPQASPDIELPSLPLMSALMTPKTPEEKAVAKVVKGQAKTSEAKDEKELRTSFWKSVLAGPLRTPLCGGHREPCVMRTVKKPGPNLGRRFYMCARPRGPPTDPSSRCNFFLWSRPS

SEQ ID NO: 885707 - protein, 206 aa, Homo sapiens
AERRVLCLLFAVPAAAAFGMEEIYAKFVSQKISKTRWRPLPPGSLQTAETFATGSWDNEENYISLWSIGDFGNLDSDGGFEGDHQLLCDIRHHGDVMDLQFFDQERIVAASSTGCVTVFLHHPNNQTLSVNQQWTTAHYHTGPGSPSYSSAPCTGVVCNNPEIVTVGEDGRINLFRADHKEAVRTIGLVTECHSTVLIDIPTNSML

SEQ ID NO: 885708 - protein, 336 aa, Homo sapiens
AERRVLCLLFAVPAAAAFGMEEIYAKFVSQKISKTRWRPLPPGSLQTAETFATGSWDNEENYISLWSIGDFGNLDSDGGFEGDHQLLCDIRHHGDVMDLQFFDQERIVAASSTGCVTVFLHHPNNQTLSVNQQWTTAHYHTGPGSPSYSSAPCTGVVCNNPEIVTVGEDGRINLFRADHKEAVRTIDNADSSTLHAVTFLRTPEILTVNSIGQLKIWDFRQQGNEPSQILSLTGDRVPLHCVDRHPNQQHVVATGGQDGMLSIWDVRQGTMPVSLLKAHEAEMWEVHFHPSNPEHLFTCSEDGSLWHWDASTDVPEKSSLFHQASKSNVKCRGSKR

SEQ ID NO: 885709 - protein, 336 aa, Homo sapiens; identical to SEQ ID NO: 885708

SEQ ID NO: 885710 - protein, 336 aa, Homo sapiens; identical to SEQ ID NO: 885708

SEQ ID NO: 885711 - protein, 336 aa, Homo sapiens; identical to SEQ ID NO: 885708

SEQ ID NO: 885712 - protein, 336 aa, Homo sapiens; identical to SEQ ID NO: 885708

SEQ ID NO: 885713 - protein, 399 aa, Homo sapiens
AERRVLCLLFAVPAAAAFGMEEIYAKFVSQKISKTRWRPLPPGSLQTAETFATGSWDNEENYISLWSIGDFGNLDSDGGFEGDHQLLCDIRHHGDVMDLQFFDQERIVAASSTGCVTVFLHHPNNQTLSVNQQWTTAHYHTGPGSPSYSSAPCTGVVCNNPEIVTVGEDGRINLFRADHKEAVRTIDNADSSTLHAVTFLRTPEILTVNSIGQLKIWDFRQQGNEPSQILSLTGDRVPLHCVDRHPNQQHVVATGGQDGMLSIWDVRQGTMPVSLLKAHEAEMWEVHFHPSNPEHLFTCSEDGSLWHWDASTDVPEKSSLFHQGGRSSTFLSHSISNQANVHQSVISSWLSTDPAKDRIEITSLLPSRSLSVNTLDVLGPCLVCGTDAEAIYVTRHLFS

SEQ ID NO: 885714 - protein, 303 aa, Homo sapiens
MDLQFFDQERIVAASSTGCVTVFLHHPNNQTLSVNQQWTTAHYHTGPGSPSYSSAPCTGVVCNNPEIVTVGEDGRINLFRADHKEAVRTIDNADSSTLHAVTFLRTPEILTVNSIGQLKIWDFRQQGNEPSQILSLTGDRVPLHCVDRHPNQQHVVATGGQDGMLSIWDVRQGTMPVSLLKAHEAEMWEVHFHPSNPEHLFTCSEDGSLWHWDASTDVPEKSSLFHQGGRSSTFLSHSISNQANVHQSVISSWLSTDPAKDRIEITSLLPSRSLSVNTLDVLGPCLVCGTDAEAIYVTRHLFS

SEQ ID NO: 885715 - protein, 336 aa, Homo sapiens; identical to SEQ ID NO: 885708

SEQ ID NO: 885716 - protein, 327 aa, Homo sapiens
AERRVLCLLFAVPAAAAFGMEEIYAKFVSQKISKTRWRPLPPGSLQTAETFATGSWDNEENYISLWSIGDFGNLDSDGGFEGDHQLLCDIRHHGDVMDLQFFDQERIVAASSTGCVTVFLHHPNNQTLSVNQQWTTAHYHTGPGSPSYSSAPCTGVVCNNPEIVTVGEDGRINLFRADHKEAVRTIDNADSSTLHAVTFLRTPEILTVNSIGQLKIWDFRQQGNEPSQILSLTGDRVPLHCVDRHPNQQHVVATGGQDGMLSIWDVRQGTMPVSLLKAHEAEMWEVHFHPSNPEHLFTCSEDGSLWHWDASTDVPEKSSLFHQGKTF

SEQ ID NO: 885717 - protein, 947 aa, Homo sapiens
MWQKIEDVEWRPQTYLELEGLPCILIFSGMDPHGESLPRSLRYCDLRLINSSCLVRTALEQELGLAAYFVSNEVPLEKGARNEALESDAEKLSSTDNEDEELGTEGSTSEKRSPMKRERSRSHDSASSSLSSKASGSALGGESSAQPTALPQGEHARSPQPRGPAEEGRAPGEKQRPRASQGPPSAISRHSPGPTPQPDCSLRTGQRSVQVSVTSSCSQLSSSSGSSSSSVAPAAGTWVLQASQCSLTKACRQPPIVFLPKLVYDMVVSTDSSGLPKAASLLPSPSVMWASSFRPLLSKTMTSTEQSLYYRQWTVPRPSHMDYGNRAEGRVDGFHPRRLLLSGPPQIGKTGAYLQFLSVLSRMLVRLTEVDVYDEEEININLREESDWHYLQLSDPWPDLELFKKLPFDYIIHDPKYEDASLICSHYQGIKSEDRGMSRKPEDLYVRRQTARMRLSKYAAYNTYHHCEQCHQYMGFHPRYQLYESTLHAFAFSYSMLGEEIQLHFIIPKSKEHHFVFSQPGGQLESMRLPLVTDKSHEYIKSPTFTPTTGRHEHGLFNLYHAMDGASHLHVLVVKEYEMAIYKKYWPNHIMLVLPSIFNSAGVGAAHFLIKELSYHNLELERNRQEELGIKPQDIWPFIVISDDSCVMWNVVDVNSAGERSREFSWSERNVSLKHIMQHIEAAPDIMHYALLGLRKWSSKTRASEVQEPFSRCHVHNFIILNVDLTQNVQYNQNRFLCDDVDFNLRVHSAGLLLCRFNRFSVMKKQIVVGGHRSFHITSKVSDNSAAVVPAQYICAPDSKHTFLAAPAQLLLEKFLQHHSHLFFPLSLKNHDHPVLSVDCYLNLGSQISVCYVSSRPHSLNISCSDLLFSGLLLYLCDSFVGASFLKKFHFLKGATLCVICQDRSSLRQTVVRLELEDEWQFRLRDEFQTANAREDRPLFFLTGRHI

SEQ ID NO: 885718 - protein, 348 aa, Homo sapiens
MPTAGAAHFLIKELSYHNLELERNRQEELGIKPQDIWPFIVISDDSCVMWNVVDVNSAGERSREFSWSERNVSLKHIMQHIEAAPDIMHYALLGLRKWSSKTRASEVQEPFSRCHVHNFIILNVDLTQNVQYNQNRFLCDDVDFNLRVHSAGLLLCRFNRFSVMKKQIVVGGHRSFHITSKVSDNSAAVVPAQYICAPDSKHTFLAAPAQLLLEKFLQHHSHLFFPLSLKNHDHPVLSVDCYLNLGSQISVCYVSSRPHSLNISCSDLLFSGLLLYLCDSFVGASFLKKFHFLKGATLCVICQDRSSLRQTVVRLELEDEWQFRLRDEFQTANAREDRPLFFLTGRHI

SEQ ID NO: 885719 - protein, 383 aa, Homo sapiens
MWQKIEDVEWRPQTYLELEGLPCILIFSGMDPHGESLPRSLRYCDLRLINSSCLVRTALEQELGLAAYFVSNEVPLEKGARNEALESDAEKLSSTDNEDEELGTEGSTSEKRSPMKRERSRSHDSASSSLSSKASGSALGGESSAQPTALPQGEHARSPQPRGPAEEGRAPGEKQRPRASQGPPSAISRHSPGPTPQPDCSLRTGQRSVQVSVTSSCSQLSSSSGSSSSSVAPAAGTWVLQASQCSLTKACRQPPIVFLPKLVYDMVVSTDSSGLPKAASLLPSPSVMWASSFRPLLSKTMTSTEQSLYYRQWTVPRPSHMDYGNRAEGRVDGFHPRRLLLSGPPQIGKTGAYLQFLSVLSRMLVRLTEVDVYDEEEINISLR

SEQ ID NO: 885720 - protein, 653 aa, Homo sapiens
MWQKIEDVEWRPQTYLELEGLPCILIFSGMDPHGESLPRSLRYCDLRLINSSCLVRTALEQELGLAAYFVSNEVPLEKGARNEALESDAEKLSSTDNEDEELGTEGSTSEKRSPMKRERSRSHDSASSSLSSKASGSALGGESSAQPTALPQGEHARSPQPRGPAEEGRAPGEKQRPRASQGPPSAISRHSPGPTPQPDCSLRTGQRSVQVSVTSSCSQLSSSSGSSSSSVAPAAGTWVLQASQCSLTKACRQPPIVFLPKLVYDMVVSTDSSGLPKAASLLPSPSVMWASSFRPLLSKTMTSTEQSLYYRQWTVPRPSHMDYGNRAEGRVDGFHPRRLLLSGPPQIGKTGAYLQFLSVLSRMLVRLTEVDVYDEEEININLREESDWHYLQLSDPWPDLELFKKLPFDYIIHDPKYEDASLICSHYQGIKSEDRGMSRKPEDLYVRRQTARMRLSKYAAYNTYHHCEQCHQYMGFHPRYQLYESTLHAFAFSYSMLGEEIQLHFIIPKSKEHHFVFSQPGGQLESMRLPLVTDKSHEYIKSPTFTPTTGRHEHGLFNLYHAMDGASHLHVLVVKEYEMAIYKKYWPNHIMLVLPSIFNSAGVGAAHFLIKELSYHNLELERNRQESLDKAFRFPQTRTERNRTCQNFSGGKE

SEQ ID NO: 885721 - protein, 186 aa, Homo sapiens
HFEIILGSPSSGVTVGKHFVKQLRMWQKIEDVEWRPQTYLELEGLPCILIFSGMDPHGESLPRSLRYCDLRLINSSCLVRTALEQELGLAAYFVSNEVPLEKGARNEALESDAEKLSSTDNEDEELGTEGSTSEKRSPMKRERSRSHDSASSSLSSKASGSALGGESSAQPTALPQGKPPPKQAAS

SEQ ID NO: 885722 - protein, 348 aa, Homo sapiens; identical to SEQ ID NO: 885718

SEQ ID NO: 885723 - protein, 74 aa, Homo sapiens
CGCRSVLSPGALPTAGAAHFLIKELSYHNLELERNRQEELGIKPQDIWPFIVISDDSCVMWNVVDVNSAGERSR

SEQ ID NO: 885724 - protein, 236 aa, Homo sapiens
MSGALDVLQMKEEDVLKFLAAGTHLGGTNLDFQMEQYIYKRKSDGIYIINLKRTWEKLLLAARAIVAIENPADVSVISSRNTGQRAVLKFAAATGATPIAGRFTPGTFTNQIQAAFREPRLLVVTDPRADHQPLTEASYVNLPTIALCNTDSPLRYVDIAIPCNNKGAHSVGLMWWMLAREVLRMRGTISREHPWEVMPDLYFYRDPEEIEKEEQAAAEKAVTKEEFQGEWTGPAS

SEQ ID NO: 885725 - protein, 236 aa, Homo sapiens; identical to SEQ ID NO: 885724

SEQ ID NO: 885726 - protein, 345 aa, Homo sapiens
PRGCRRRARAHPPARCPAHPVAPRAPGPDRGASPVRPSTSCSGGFNETPTAAVGPAGSSTATGTGAGRWSQNRNHDVTPPPGTREVCVDPEFHQVRRVMTILFLTMVISYFGCMKAAPMKEANIRGQGGLAYPGVRTHGTLESVNGPKAGSRGLTSLADTFEHVIEELLDEDQKVRPNEENNKDADLYTSRVMLSSQVPLEPPLLFLLEEYKNYLDAANMSMRVRRHSDPARRGELSVCDSISEWVTAADKKTAVDMSGGTVTVLEKVPVSKGQLKQYFYETKCNPMGYTKEGCRGIDKRHWNSQCRTTQSYVRALTMDSKKRIGWRFIRIDTSCVCTLTIKRGR

SEQ ID NO: 885727 - protein, 247 aa, Homo sapiens
MTILFLTMVISYFGCMKAAPMKEANIRGQGGLAYPGVRTHGTLESVNGPKAGSRGLTSLADTFEHVIEELLDEDQKVRPNEENNKDADLYTSRVMLSSQVPLEPPLLFLLEEYKNYLDAANMSMRVRRHSDPARRGELSVCDSISEWVTAADKKTAVDMSGGTVTVLEKVPVSKGQLKQYFYETKCNPMGYTKEGCRGIDKRHWNSQCRTTQSYVRALTMDSKKRIGWRFIRIDTSCVCTLTIKRGR

SEQ ID NO: 885728 - protein, 247 aa, Homo sapiens; identical to SEQ ID NO: 885727

SEQ ID NO: 885729 - protein, 255 aa, Homo sapiens
MFHQVRRVMTILFLTMVISYFGCMKAAPMKEANIRGQGGLAYPGVRTHGTLESVNGPKAGSRGLTSLADTFEHVIEELLDEDQKVRPNEENNKDADLYTSRVMLSSQVPLEPPLLFLLEEYKNYLDAANMSMRVRRHSDPARRGELSVCDSISEWVTAADKKTAVDMSGGTVTVLEKVPVSKGQLKQYFYETKCNPMGYTKEGCRGIDKRHWNSQCRTTQSYVRALTMDSKKRIGWRFIRIDTSCVCTLTIKRGR

SEQ ID NO: 885730 - protein, 247 aa, Homo sapiens; identical to SEQ ID NO: 885727

SEQ ID NO: 885731 - protein, 262 aa, Homo sapiens
MQSREEEWFHQVRRVMTILFLTMVISYFGCMKAAPMKEANIRGQGGLAYPGVRTHGTLESVNGPKAGSRGLTSLADTFEHVIEELLDEDQKVRPNEENNKDADLYTSRVMLSSQVPLEPPLLFLLEEYKNYLDAANMSMRVRRHSDPARRGELSVCDSISEWVTAADKKTAVDMSGGTVTVLEKVPVSKGQLKQYFYETKCNPMGYTKEGCRGIDKRHWNSQCRTTQSYVRALTMDSKKRIGWRFIRIDTSCVCTLTIKRGR

SEQ ID NO: 885732 - protein, 265 aa, Homo sapiens
MLQTLSSLSPLFHQVRRVMTILFLTMVISYFGCMKAAPMKEANIRGQGGLAYPGVRTHGTLESVNGPKAGSRGLTSLADTFEHVIEELLDEDQKVRPNEENNKDADLYTSRVMLSSQVPLEPPLLFLLEEYKNYLDAANMSMRVRRHSDPARRGELSVCDSISEWVTAADKKTAVDMSGGTVTVLEKVPVSKGQLKQYFYETKCNPMGYTKEGCRGIDKRHWNSQCRTTQSYVRALTMDSKKRIGWRFIRIDTSCVCTLTIKRGR

SEQ ID NO: 885733 - protein, 247 aa, Homo sapiens; identical to SEQ ID NO: 885727

SEQ ID NO: 885734 - protein, 167 aa, Homo sapiens
MTILFLTMVISYFGCMKAAPMKEANIRGQGGLAYPGVRTHGTLESVNGPKAGSRGLTSLADTFEHVIEELLDEDQKVRPNEENNKDADLYTSRVMLSSQVPLEPPLLFLLEEYKNYLDAANMSMRVRRHSDPARRGELSVCDSISEWVTAADKKTADRHFLCMYIDH

SEQ ID NO: 885735 - protein, 248 aa, Homo sapiens
MFLAKALLEGADRGLGEALGGLFGGGGQRREGGGRNIGGIVGGIVNFISEAAAAQYTPEPPPTQQHFTSVEASESEEVRRFRQQFTQLAGPDMEVGATDLMNILNKVLSKHKDLKTDGFSLDTCRSIVSVMDSDTTGKLGFEEFKYLWNNIKKWQCVYKQYDRDHSGSLGSSQLRGALQAAGFQLNEQLYQMIVRRYANEDGDMDFNNFISCLVRLDAMFRAFKSLDRDRDGLIQVSIKEWLQLTMYS

SEQ ID NO: 885736 - protein, 685 aa, Homo sapiens
MAEDKSKRDSIEMSMKGCQTNNGFVHNEDILEQTPDPGSSTDNLKHSTRGILGSQEPDFKGVQPYAGMPKEVLFQFSGQARYRIPREILFWLTVASVLVLIAATIAIIALSPKCLDWWQEGPMYQIYPRSFKDSNKDGNGDLKGIQDKLDYITALNIKTVWITSFYKSSLKDFRYGVEDFREVDPIFGTMEDFENLVAAIHDKGLKLIIDFIPNHTSDKHIWFQLSRTRTGKYTDYYIWHDCTHENGKTIPPNNWLSVYGNSSWHFDEVRNQCYFHQFMKEQPDLNFRNPDVQEEIKEILRFWLTKGVDGFSLDAVKFLLEAKHLRDEIQVNKTQIPDTVTQYSELYHDFTTTQVGMHDIVRSFRQTMDQYSTEPGRYRFMGTEAYAESIDRTVMYYGLPFIQEADFPFNNYLSMLDTVSGNSVYEVITSWMENMPEGKWPNWMIGGPDSSRLTSRLGNQYVNVMNMLLFTLPGTPITYYGEEIGMGNIVAANLNESYDINTLRSKSPMQWDNSSNAGFSEASNTWLPTNSDYHTVNVDVQKTQPRSALKLYQDLSLLHANELLLNRGWFCHLRNDSHYVVYTRELDGIDRIFIVVLNFGESTLLNLHNMISGLPAKIRIRLSTNSADKGSKVDTSGIFLDKGEGLIFEHNTKNLLHRQTAFRDRCFVSNRACYSSVLNILYTSC

SEQ ID NO: 885737 - protein, 564 aa, Homo sapiens
MAEDKSKRDSIEMSMKGCQTNNGFVHNEDILEQTPDPGSSTDNLKHSTRGILGSQEPDFKGVQPYAGMPKEVLFQFSGQARYRIPREILFWLTVASVLVLIAATIAIIALSPKCLDWWQEGPMYQIYPRSFKDSNKDGNGDLKGIQDKLDYITALNIKTVWITSFYKSSLKDFRYGVEDFREVDPIFGTMEDFENLVAAIHDKGLKLIIDFIPNHTSDKHIWFQLSRTRTGKYTDYYIWHDCTHENGKTIPPNNWLSVYGNSSWHFDEVRNQCYFHQFMKEQPDLNFRNPDVQEEIKEILRFWLTKGVDGFSLDAVKFLLEAKHLRDEIQVNKTQIPDTVTQYSELYHDFTTTQVGMHDIVRSFRQTMDQYSTEPGRYRFMGTEAYAESIDRTVMYYGLPFIQEADFPFNNYLSMLDTVSGNSVYEVITSWMENMPEGKWPNWMIGGPDSSRLTSRLGNQYVNVMNMLLFTLPGTPITYYGEEIGMGNIVAANLNESYDINTLRSKSPMQWDNSSNAGFSEASNTWLPTNSDYHTVNVDSCSVTHARVQWRDLGTLQPLLPGFK

SEQ ID NO: 885738 - protein, 564 aa, Homo sapiens; identical to SEQ ID NO: 885737

SEQ ID NO: 885739 - protein, 597 aa, Homo sapiens
MAEDKSKRDSIEMSMKGCQTNNGFVHNEDILEQTPDPGSSTDNLKHSTRGILGSQEPDFKGVQPYAGMPKEVLFQFSGQARYRIPREILFWLTVASVLVLIAATIAIIALSPKCLDWWQEGPMYQIYPRSFKDSNKDGNGDLKGIQDKLDYITALNIKTVWITSFYKSSLKDFRYGVEDFREVDPIFGTMEDFENLVAAIHDKGLKLIIDFIPNHTSDKHIWFQLSRTRTGKYTDYYIWHDCTHENGKTIPPNNWLSVYGNSSWHFDEVRNQCYFHQFMKEQPDLNFRNPDVQEEIKEILRFWLTKGVDGFSLDAVKFLLEAKHLRDEIQVNKTQIPDTVTQYSELYHDFTTTQVGMHDIVRSFRQTMDQYSTEPGRYRVMGDLNLIHRVLARTVEVLWDRHLIQESCFFPLTSCLNNATILDSWEQVLYKGLPHPWVVTCCQKGIMGLAGVDWVSHDHASGCSWEWWWTRSVSGIEHNLVVPPRWELLILDHGKNTVNGETCEGEELWMNVCDVLSGYARIVLMYVREYMWKSGDVSNINDICRAEYVWNSQSGCLGWKTERAFLKELVVRVEELVAECAAVRVWLRRVVDNPVLV

SEQ ID NO: 885740 - protein, 564 aa, Homo sapiens
MAEDKSKRDSIEMSMKGCQTNNGFVHNEDILEQTPDPGSSTDNLKHSTRGILGSQEPDFKGVQPYAGMPKEVLFQFSGQARYRIPREILFWLTVASVLVLIAATIAIIALSPKCLDWWQEGPMYQIYPRSFKDSNKDGNGDLKGIQDKLDYITALNIKTVWITSFYKSSLKDFRYGVEDFREVDPIFGTMEDFENLVAAIHDKGLKLIIDFIPNHTSDKHIWFQLSRTRTGKYTDYYIWHDCTHENGKTIPPNNWLSVYGNSSWHFDEVRNQCYFHQFMKEQPDLNFRNPDVQEEIKEILRFWLTKGVDGFSLDAVKFLLEAKHLRDEIQVNKTQIPDTVTQYSELYHDFTTTQVGMHDIVRSFRQTMDQYSTEPGRYRFMGTEAYAESIDRTVMYYGLPFIQEADFPFNNYLSMLDTVSGNSVYEVITSWMENMPEGKWPNWMIGGPDSSRLTSRLGNQYVNVMNMLLFTLPGTPITYYGEEIGMGNIVAANLNESYDINTLRSKSPMQWDNSSNAGFSEASNTWLPTNSDYHTVNVDVSISENFMLILETKKWVSTESTHSP

SEQ ID NO: 885741 - protein, 502 aa, Homo sapiens
MAEDKSKRDSIEMSMKGCQTNNGFVHNEDILEQTPDPGSSTDNLKHSTRGILGSQEPDFKGVQPYAGMPKEVLFQFSGQARYRIPREILFWLTVASVLVLIAATIAIIALSPKCLDWWQEGPMYQIYPRSFKDSNKDGNGDLKGIQDKLDYITALNIKTVWITSFYKSSLKDFRYGVEDFREVDPIFGTMEDFENLVAAIHDKGLKLIIDFIPNHTSDKHIWFQLSRTRTGKYTDYYIWHDCTHENGKTIPPNNWLSVYGNSSWHFDEVRNQCYFHQFMKEQPDLNFRNPDVQEEIKEILRFWLTKGVDGFSLDAVKFLLEAKHLRDEIQVNKTQIPDTVTQYSELYHDFTTTQVGMHDIVRSFRQTMDQYSTEPGRYRFMGTEAYAESIDRTVMYYGLPFIQEADFPFNNYLSMLDTVSGNSVYEVITSWMENMPEGKWPNWMIGGPDSSRLTSRLGNQYVNVMNMLLFTLPGTPITYYGEEIGMGNIVAANLNESYDIVS

SEQ ID NO: 885742 - protein, 391 aa, Homo sapiens
MAEDKSKRDSIEMSMKGCQTNNGFVHNEDILEQTPDPGSSTDNLKHSTRGILGSQEPDFKGVQPYAGMPKEVLFQFSGQARYRIPREILFWLTVASVLVLIAATIAIIALSPKCLDWWQEGPMYQIYPRSFKDSNKDGNGDLKGIQDKLDYITALNIKTVWITSFYKSSLKDFRYGVEDFREVDPIFGTMEDFENLVAAIHDKGLKLIIDFIPNHTSDKHIWFQLSRTRTGKYTDYYIWHDCTHENGKTIPPNNWLSVYGNSSWHFDEVRNQCYFHQFMKEQPDLNFRNPDVQEEIKEILRFWLTKGVDGFSLDAVKFLLEAKHLRDEIQVNKTQIPDTVTQYSELYHDFTTTQVGMHDIVRSFRQTMDQYSTEPGRYRLTTAYALISSQA

SEQ ID NO: 885743 - protein, 482 aa, Homo sapiens
MPPSPLDDRVVVALSRPVRPQDLNLCLDSSYLGSANPGSNSHPPVIATTVVSLKAANLTYMPSSSGSARSLNCGCSSASCCTVATYDKDNQAQTQAIAAGTTTTAIGTSTTCPANQMVNNNENTGSLSPSSGVGSPVSGTPKQLASIKIIYPNDLAKKMTKCSKSHLPSQGPVIIDCRPFMEYNKSHIQGAVHINCADKISRRRLQQGKITVLDLISCREGKDSFKRIFSKEIIVYDENTNEPSRVMPSQPLHIVLESLKREGKEPLVLKGGLSSFKQNHENLCDNSLQLQECREVGGGASAASSLLPQPIPTTPDIENAELTPILPFLFLGNEQDAQDLDTMQRLNIGYVINVTTHLPLYHYEKGLFNYKRLPATDSNKQNLRQYFEEAFEFIEEAHQCGKGLLIHCQAGVSRSATIVIAYLMKHTRMTMTDAYKFVKGKRPIISPNLNFMGQLLEFEEDLNNGVTPRILTPKLMGVETVV

SEQ ID NO: 885744 - protein, 482 aa, Homo sapiens; identical to SEQ ID NO: 885743

SEQ ID NO: 885745 - protein, 140 aa, Homo sapiens
MQRLNIGYVINVTTHLPLYHYEKGLFNYKRLPATDSNKQNLRQYFEEAFEFIEEAHQCGKGLLIHCQAGVSRSATIVIAYLMKHTRMTMTDAYKFVKGKRPIISPNLNFMGQLLEFEEDLNNGVTPRILTPKLMGVETVV

SEQ ID NO: 885746 - protein, 140 aa, Homo sapiens; identical to SEQ ID NO: 885745

SEQ ID NO: 885747 - protein, 140 aa, Homo sapiens; identical to SEQ ID NO: 885745

SEQ ID NO: 885748 - protein, 302 aa, Homo sapiens
MEYNKSHIQGAVHINCADKISRRRLQQGKITVLDLISCREGKDSFKRIFSKEIIVYDENTNEPSRVMPSQPLHIVLESLKREGKEPLVLKGGLSSFKQNHENLCDNSLQLQECREVGGGASAASSLLPQPIPTTPDIENAELTPILPFLFLGNEQDAQDLDTMQRLNIGYVINVTTHLPLYHYEKGLFNYKRLPATDSNKQNLRQYFEEAFEFIEEAHQCGKGLLIHCQAGVSRSATIVIAYLMKHTRMTMTDAYKFVKGKRPIISPNLNFMGQLLEFEEDLNNGVTPRILTPKLMGVETVV

SEQ ID NO: 885749 - protein, 257 aa, Homo sapiens
MPQWGGAGHTADLTTGRPGQPLRGLVIFELVRHRGSRLGRCSGGRGGLSSFKQNHENLCDNSLQLQECREVGGGASAASSLLPQPIPTTPDIENAELTPILPFLFLGNEQDAQDLDTMQRLNIGYVINVTTHLPLYHYEKGLFNYKRLPATDSNKQNLRQYFEEAFEFIEEAHQCGKGLLIHCQAGVSRSATIVIAYLMKHTRMTMTDAYKFVKGKRPIISPNLNFMGQLLEFEEDLNNGVTPRILTPKLMGVETVV

SEQ ID NO: 885750 - protein, 140 aa, Homo sapiens; identical to SEQ ID NO: 885745

SEQ ID NO: 885751 - protein, 1515 aa, Homo sapiens
MTEVQAMVEFSVELNKFYNVDLFQRGFYQIRASMKIPSRIPHRVEASLLHATGMTLAFPASVHDSLICSKTFQILYKNEEVVLNDVMIFKVKMLLDERKIEETLEEMNFLLSLDLHFTDGDYSADDLNALQLISSRTLKLHFSPHRGLHHHVNVMFDYFHLSVVSVTVHASLVALHQPLISFPRPVKTTWLNRNAPAQNKDSVIPTLESVVFGINYTKQLSPDGCSFIIADSFLHHAYRFHYTLCATLLLAFKGLHSYFITVTEEIPSCQKLELEEMDVEARLTELCEEVKKIENPDELAELINMNLAQLCSLLMALWGQFLEVITLHEELRILLAQEHHTLRVRRFSEAFFCFEHPREAAIAYQELHAQSHLQMCTAIKNTSFCSSLPPLPIECSELDGDLNSLPIIFEDRYLDSVTEDLDAPWMGIQNLQRSESSKMDKYETEESSVAGLSSPELKVRPAGASSIWYTEGEKQLTKSLKGKNEESNKSKVKVTKLMKTMKSENTKKLIKQNSKDSVVLVGYKCLKSTASNDLIKCFEGNPSHSQKEGLDPTICGYNFDPKTYMRQTSQKEASCLPTNTERTEQKSPDIENVQPDQFDPLNSGNLNLCANLSISGKLDISQDDSEITQMEHNLASRRSSDDCHDHQTTPSLGVRTIEIKPSNKDPFSGENITVKLGPWTELRQEEILVDNLLPNFESLESNGKSKSIEITFEKEALQEAKCLSIGESLTKLRSNLPAPSTKEYHVVVSGDTIKLPDISATYASSRFSDSGVESEPSSFATHPNTDLVFETVQGQGPCNSERLFPQLLMKPDYNVKFSLGNHCTESTSAISEIQSSLTSINSLPSDDELSPDENSKKSVVPECHLNDSKTVLNLGTTDLPKCDDTKKSSITLQQQSVVFSGNLDNETVAIHSLNSSIKDPLQFVFSDEETSSDVKSSCSSKPNLDTMCKGFQSPDKSNNSTGTAITLNSKLICLGTPCVISGSISSNTDVSEDRTMKKNSDVLNLTQMYSEIPTVESETHLGTSDPFSASTDIVKQGLVENYFGSQSSTDISDTCAVSYSNALSPQKETSEKEISNLQQEQDKEDEEEEQDQQMVQNGYYEETDYSALDGTINAHYTSRDELMEERLTKSEKINSDYLRDGINMPTVCTSGCLSFPSAPRESPCNVKYSSKSKFDAITKQPSSTSYNFTSSISWYESSPKPQIQAFLQAKEELKLLKLPGFMYSEVPLLASSVPYFSVEEEDGSEDGVHLIVCVHGLDGNSADLRLVKTYIELGLPGGRIDFLMSERNQNDTFADFDSMTDRLLDEIIQYIQIYSLTVSKISFIGHSLGNLIIRSVLTRPRFKYYLNKLHTFLSLSGPHLGTLYNSSALVNTGLWFMQKWKKSGSLLQLTCRDHSDPRQTFLYKLSNKAGLHYFKNVVLVGSLQDRYVPYHSARIEMCKTALKDKQSGQIYSEMIHNLLRPVLQSKDCNLVRYNVINALPNTADSLIGRAAHIAVLDSEIFLEKFFLVAALKYFQ

SEQ ID NO: 885752 - protein, 105 aa, Homo sapiens
LCADPYELAKANMQLLYERLLRRKQLRTQKDNHLEEMDVEARLTELCEEVKKIENPDELAELINMNLAQLCSLLMALWGQFLEVITLHEELRILLAQEHHTLRVS

SEQ ID NO: 885753 - protein, 1470 aa, Homo sapiens
MTEVQAMVEFSVELNKFYNVDLFQRGFYQIRASMKIPSRIPHRVEASLLHATGMTLAFPASVHDSLICSKTFQILYKNEEVVLNDVMIFKVKMLLDERKIEETLEEMNFLLSLDLHFTDGDYSSCIIGCTTPATNKLSSPCEDNLVKRNAPAQNKDSVIPTLESVVFGINYTKQLSPDGCSFIIADSFLHHAYRFHYTLCATLLLAFKGLHSYFITVTEEIPSCQKLELEEMDVEARLTELCEEVKKIENPDELAELINMNLAQLCSLLMALWGQFLEVITLHEELRILLAQEHHTLRVRRFSEAFFCFEHPREAAIAYQELHAQSHLQMCTAIKNTSFCSSLPPLPIECSELDGDLNSLPIIFEDRYLDSVTEDLDAPWMGIQNLQRSESSKMDKYETEESSVAGLSSPELKVRPAGASSIWYTEGEKQLTKSLKGKNEESNKSKVKVTKLMKTMKSENTKKLIKQNSKDSVVLVGYKCLKSTASNDLIKCFEGNPSHSQKEGLDPTICGYNFDPKTYMRQTSQKEASCLPTNTERTEQKSPDIENVQPDQFDPLNSGNLNLCANLSISGKLDISQDDSEITQMEHNLASRRSSDDCHDHQTTPSLGVRTIEIKPSNKDPFSGENITVKLGPWTELRQEEILVDNLLPNFESLESNGKSKSIEITFEKEALQEAKCLSIGESLTKLRSNLPAPSTKEYHVVVSGDTIKLPDISATYASSRFSDSGVESEPSSFATHPNTDLVFETVQGQGPCNSERLFPQLLMKPDYNVKFSLGNHCTESTSAISEIQSSLTSINSLPSDDELSPDENSKKSVVPECHLNDSKTVLNLGTTDLPKCDDTKKSSITLQQQSVVFSGNLDNETVAIHSLNSSIKDPLQFVFSDEETSSDVKSSCSSKPNLDTMCKGFQSPDKSNNSTGTAITLNSKLICLGTPCVISGSISSNTDVSEDRTMKKNSDVLNLTQMYSEIPTVESETHLGTSDPFSASTDIVKQGLVENYFGSQSSTDISDTCAVSYSNALSPQKETSEKEISNLQQEQDKEDEEEEQDQQMVQNGYYEETDYSALDGTINAHYTSRDELMEERLTKSEKINSDYLRDGINMPTVCTSGCLSFPSAPRESPCNVKYSSKSKFDAITKQPSSTSYNFTSSISWYESSPKPQIQAFLQAKEELKLLKLPGFMYSEVPLLASSVPYFSVEEEDGSEDGVHLIVCVHGLDGNSADLRLVKTYIELGLPGGRIDFLMSERNQNDTFADFDSMTDRLLDEIIQYIQIYSLTVSKISFIGHSLGNLIIRSVLTRPRFKYYLNKLHTFLSLSGPHLGTLYNSSALVNTGLWFMQKWKKSGSLLQLTCRDHSDPRQTFLYKLSNKAGLHYFKNVVLVGSLQDRYVPYHSARIEMCKTALKDKQSGQIYSEMIHNLLRPVLQSKDCNLVRYNVINALPNTADSLIGRAAHIAVLDSEIFLEKFFLVAALKYFQ

SEQ ID NO: 885754 - protein, 1470 aa, Homo sapiens; identical to SEQ ID NO: 885753

SEQ ID NO: 885755 - protein, 458 aa, Homo sapiens
MTEVQAMVEFSVELNKFYNVDLFQRGFYQIRASMKIPSRIPHRVEASLLHATGMTLAFPASVHDSLICSKTFQILYKNEEVVLNDVMIFKVKMLLDERKIEETLEEMNFLLSLDLHFTDGDYSADDLNALQLISSRTLKLHFSPHRGLHHHVNVMFDYFHLSVVSVTVHASLVALHQPLISFPRPVKTTWLNRNAPAQNKDSVIPTLESVVFGINYTKQLSPDGCSFIIADSFLHHAYRFHYTLCATLLLAFKGLHSYFITVTEEIPSCQKLELAKANMQLLYERLLRRKQLRTQKDNHLEEMDVEARLTELCEEVKKIENPDELAELINMNLAQLCSLLMALWGQFLEVITLHEELRILLAQEHHTLRVRRFSEAFFCFEHPREAAIAYQELHAQSHLQMCTAIKNTSFCSSLPPLPIECSELDGDLNSLPIIFEDRYLDSVTEGKCNLTKIYKLCV

SEQ ID NO: 885756 - protein, 1424 aa, Homo sapiens
MTEVQAMVEFSVELNKFYNVDLFQRGFYQIRASMKIPSRIPHRVEASLLHATGMTLAFPASVHDSLICSKTFQILYKNEEVVLNDVMIFKVKMLLDERKIEETLEEMNFLLSLDLHFTDGDYSSCIIGCTTPATNKLSSPCEDNLVKRNAPAQNKDSVIPTLESVVFGINYTKQLSPDGCSFIIADSFLHHAYRFHYTLCATLLLAFKGLHSYFITVTEEIPSCQKLELEEMDVEARLTELCEEVKKIENPDELAELINMNLAQLCSLLMALWGQFLEVITLHEELRILLAQEHHTLRVRRFSEAFFCFEHPREAAIAYQELHAQSHLQMCTAIKNTSFCSSLPPLPIECSELDGDLNSLPIIFEDRYLDSVTEDLDAPWMGIQNLQRSESSKMDKYETEESSVAGLSSPELKVRPAGASSIWYTEGEKQLTKSLKGKNEESNKSKVKVTKLMKTMKSENTKKLIKQNSKDSVVLVGYKCLKSTASNDLIKCFEGNPSHSQKEGLDPTICGYNFDPKTYMRQTSQKEASCLPTNTERTEQKSPDIENVQPDQFDPLNSGNLNLCANLSISGKLDISQDDSEITQMEHNLASRRSSDDCHDHQTTPSLGVRTIEIKPSNKDPFSGENITVKLGPWTELRQEEILVDNLLPNFESLESNGKSKSIEITFEKEALQEAKCLSIGESLTKLRSNLPAPSTKEYHVVVSGDTIKLPDISATYASSRFSDSGVESEPSSFATHPNTDLVFETVQGQGPCNSERLFPQLLMKPDYNVKFSLGNHCTESTSAISEIQSSLTSINSLPSDDELSPDENSKKSVVPECHLNDSKTVLNLGTTDLPKCDDTKKSSITLQQQSVVFSGNLDNETVAIHSLNSSIKDPLQFVFSDEETSSDVKSSCSSKPNLDTMCKGFQSPDKSNNSTGTAITLNSKLICLGTPCVISGSISSNTDVSEDRTMKKNSDVLNLTQMYSEIPTVESETHLGTSDPFSASTDIVKQGLVENYFGSQSSTDISDTCAVSYSNALSPQKETSEKEISNLQQEQDKEDEEEEQDQQMVQNGYYEETDYSALDGTINAHYTSRDELMEERLTKSEKINSDYLRDGINMPTVCTSGCLSFPSAPRESPCNVKYSSKSKFDAITKQPSSTSYNFTSSISWYESSPKPQIQAFLQAKEELKLLKLPGFMYSEVPLLASSVPYFSVEEEDGSEDGVHLIVCVHGLDGNSADLRLVKTYIELGLPGGRIDFLMSERNQNDTFADFDSMTDRLLDEIIQYIQIYSLTVSKISFIGHSLGNLIIRSVLTRPRFKYYLNKLHTFLSLSGPHLGTLYNSSALVNTGLWFMQKWKKSGSLLQLTCRDHSDPRQTFLYKLSNKAGLHYFKNVVLVGSLQDRYVPYHSARIEMCKTALKDKQSGNGIKLFQRVIGINELFPKFFL

SEQ ID NO: 885757 - protein, 1387 aa, Homo sapiens
MTEVQAMVEFSVELNKFYNVDLFQRGFYQIRASMKIPSRIPHRVEASLLHATGMTLAFPASVHDSLICSKTFQILYKNEEVVLNDVMIFKVKMLLDERKIEETLEEMNFLLSLDLHFTDGDYSSCIIGCTTPATNKLSSPCEDNLVKRNAPAQNKDSVIPTLESVVFGINYTKQLSPDGCSFIIADSFLHHAYRFHYTLCATLLLAFKGLHSYFITVTEEIPSCQKLELEEMDVEARLTELCEEVKKIENPDELAELINMNLAQLCSLLMALWGQFLEVITLHEELRILLAQEHHTLRVRRFSEAFFCFEHPREAAIAYQELHAQSHLQMCTAIKNTSFCSSLPPLPIECSELDGDLNSLPIIFEDRYLDSVTEDLDAPWMGIQNLQRSESSKMDKYETEESSVAGLSSPELKVRPAGASSIWYTEGEKQLTKSLKGKNEESNKSKVKVTKLMKTMKSENTKKLIKQNSKDSVVLVGYKCLKSTASNDLIKCFEGNPSHSQKEGLDPTICGYNFDPKTYMRQTSQKEASCLPTNTERTEQKSPDIENVQPDQFDPLNSGNLNLCANLSISGKLDISQDDSEITQMEHNLASRRSSDDCHDHQTTPSLGVRTIEIKPSNKDPFSGENITVKLGPWTELRQEEILVDNLLPNFESLESNGKSKSIEITFEKEALQEAKCLSIGESLTKLRSNLPAPSTKEYHVVVSGDTIKLPDISATYASSRFSDSGVESEPSSFATHPNTDLVFETVQGQGPCNSERLFPQLLMKPDYNVKFSLGNHCTESTSAISEIQSSLTSINSLPSDDELSPDENSKKSVVPECHLNDSKTVLNLGTTDLPKCDDTKKSSITLQQQSVVFSGNLDNETVAIHSLNSSIKDPLQFVFSDEETSSDVKSSCSSKPNLDTMCKGFQSPDKSNNSTGTAITLNSKLICLGTPCVISGSISSNTDVSEDRTMKKNSDVLNLTQMYSEIPTVESETHLGTSDPFSASTDIVKQGLVENYFGSQSSTDISDTCAVSYSNALSPQKETSEKEISNLQQEQDKEDEEEEQDQQMVQNGYYEETDYSALDGTINAHYTSRDELMEERLTKSEKINSDYLRDGINMPTVCTSGCLSFPSAPRESPCNVKYSSKSKFDAITKQPSSTSYNFTSSISWYESSPKPQIQAFLQAKEELKLLKLPGFMYSEVPLLASSVPYFSVEEEDGSEDGVHLIVCVHGLDGNSADLRLVKTYIELGLPGGRIDFLMSERNQNDTFADFDSMTDRLLDEIIQYIQIYSLTVSKISFIGHSLGNLIIRSVLTRPRFKYYLNKLHTFLSLSGPHLGTLYNSSALVNTGLWFMQKWKKSGSLLQLTCRDHSDPRQTFLYKLSNKAGLHYFMVCQWDPYHEDSGGPPFF

SEQ ID NO: 885758 - protein, 640 aa, Homo sapiens
MLRSTLAQQGTPVYSVAWGPDSEKVLYTAGKQLIIKPLQPNAKVLQWKAHDGIILKVDWNSVNDLILSAGEDCKYKVWDSYGRPLYNSQPHEHPITSVAWAPDGELFAVGSFHTLRLCDKTGWSYALEKPNTGSIFNIAWSIDGTQIAGACGNGHVVFAHVVEQHWEWKNFQVTLTKRRAMQVRNVLNDAVDLLEFRDRVIKASLNYAHLVVSTSLQCYVFSTKNWNTPIIFDLKEGTVSLILQAERHFLLVDGSSIYLYSYEGRFISSPKFPGMRTDILNAQTVSLSNDTIAIRDKADEKIIFLFEASTGKPLGDGKFLSHKNEILEIALDQKGLTNDRKIAFIDKNRDLCITSVKRFGKEEQIIKLGTMVHTLAWNDTCNILCGLQDTRFIVWYYPNTVYVDRDILPKTLYERDASEFSKNPHIVSFVGNQVTIRRADGSLVHISITPYPAILHEYVSSSKWEDAVRLCRFVKEQTMWACLAAMAVANRDMTTAEIAYAAIGEIDKVQYINSIKNLPSKESKMAHILLFSGNIQEAEIVLLQAGLVYQAIQININLYNWERALELAVKYKTHVDTVLAYRQKFLETFGKQETNKRYLHYAEGLQIDWEKIKAKIEMEITKEREQSSSSQSSKSIGLKP

SEQ ID NO: 885759 - protein, 640 aa, Homo sapiens; identical to SEQ ID NO: 885758

SEQ ID NO: 885760 - protein, 640 aa, Homo sapiens; identical to SEQ ID NO: 885758

SEQ ID NO: 885761 - protein, 640 aa, Homo sapiens; identical to SEQ ID NO: 885758

SEQ ID NO: 885762 - protein, 460 aa, Homo sapiens
MQVRNVLNDAVDLLEFRDRVIKASLNYAHLVVSTSLQCYVFSTKNWNTPIIFDLKEGTVSLILQAERHFLLVDGSSIYLYSYEGRFISSPKFPGMRTDILNAQTVSLSNDTIAIRDKADEKIIFLFEASTGKPLGDGKFLSHKNEILEIALDQKGLTNDRKIAFIDKNRDLCITSVKRFGKEEQIIKLGTMVHTLAWNDTCNILCGLQDTRFIVWYYPNTVYVDRDILPKTLYERDASEFSKNPHIVSFVGNQVTIRRADGSLVHISITPYPAILHEYVSSSKWEDAVRLCRFVKEQTMWACLAAMAVANRDMTTAEIAYAAIGEIDKVQYINSIKNLPSKESKMAHILLFSGNIQEAEIVLLQAGLVYQAIQININLYNWERALELAVKYKTHVDTVLAYRQKFLETFGKQETNKRYLHYAEGLQIDWEKIKAKIEMEITKEREQSSSSQSSKSIGLKP

SEQ ID NO: 885763 - protein, 331 aa, Homo sapiens
AAAPTSEWKFLSHKNEILEIALDQKGLTNDRKIAFIDKNRDLCITSVKRFGKEEQIIKLGTMVHTLAWNDTCNILCGLQDTRFIVWYYPNTVYVDRDILPKTLYERDASEFSKNPHIVSFVGNQVTIRRADGSLVHISITPYPAILHEYVSSSKWEDAVRLCRFVKEQTMWACLAAMAVANRDMTTAEIAYAAIGEIDKVQYINSIKNLPSKESKMAHILLFSGNIQEAEIVLLQAGLVYQAIQININLYNWERALELAVKYKTHVDTVLAYRQKFLETFGKQETNKRYLHYAEGLQIDWEKIKAKIEMEITKEREQSSSSQSSKSIGLKP

SEQ ID NO: 885764 - protein, 640 aa, Homo sapiens; identical to SEQ ID NO: 885758

SEQ ID NO: 885765 - protein, 640 aa, Homo sapiens; identical to SEQ ID NO: 885758

SEQ ID NO: 885766 - protein, 304 aa, Homo sapiens
MLRSTLAQQGTPVYSVAWGPDSEKVLYTAGKQLIIKPLQPNAKVLQWKAHDGIILKVDWNSVNDLILSAGEDCKYKVWDSYGRPLYNSQPHEHPITSVAWAPDGELFAVGSFHTLRLCDKTGWSYALEKPNTGSIFNIAWSIDGTQIAGACGNGHVVFAHVVEQHWEWKNFQVTLTKRRAMQVRNVLNDAVDLLEFRDRVIKASLNYAHLVVSTSLQCYVFSTKNWNTPIIFDLKEGTVSLILQAERHFLLVDGSSIYLYSYEGRFISSPKFPGMRTDILNAQTVSLSNDTIAIRDKADEKSFL

SEQ ID NO: 885767 - protein, 252 aa, Homo sapiens
MLRSTLAQQGTPVYSVAWGPDSEKVLYTAGKQLIIKPLQPNAKVLQWKAHDGIILKVDWNSVNDLILSAGEDCKYKVWDSYGRPLYNSQPHEHPITSVAWAPDGELFAVGSFHTLRLCDKTGWSYALEKPNTGSIFNIAWSIDGTQIAGACGNGHVVFAHVVEQHWEWKNFQVTLTKRRAMQVRNVLNDAVDLLEFRDRVIKASLNYAHLVVSTSLQCYVFSTKNWNTPIIFDLKEGTVSLILQAESLFIFI

SEQ ID NO: 885768 - protein, 501 aa, Homo sapiens
MIISHFPKCVAVFALLALSVGALDTFIAAVYEHAVILPNRTETPVSKEEALLLMNKNIDVLEKAVKLAAKQGAHIIVTPEDGIYGWIFTRESIYPYLEDIPDPGVNWIPCRDPWRFGNTPVQQRLSCLAKDNSIYVVANIGDKKPCNASDSQCPPDGRYQYNTDVVFDSQGKLLARYHKYNLFAPEIQFDFPKDSELVTFDTPFGKFGIFTCFDIFSHDPAAVVVDEVSIDSILYPTAWYNTLPLLSAVPFHSAWAKAMGVNLLAANTHNTSMHMTGSGIYAPEAVKVYHYDMETESGQLLLSELKSRPRREPTYPAAVDWHAYASSVKPFSSEQSDFLGMIYFDEFTFTKLKRNTGNYTACQKDLCCHLTYKMSEKRTDEIYALGAFDGLHTVEGQYYLQICALLKCQTTDLETCGEPVGSAFTKFEDFSLSGTFGTRYVFPQIILSGSQLAPERHYEISRDGRLRSRSGAPLPVLVMALYGRVFEKDPPRLGQGSGKFQ

SEQ ID NO: 885769 - protein, 517 aa, Homo sapiens
MIISHFPKCVAVFALLALSVGALDTFIAAVYEHAVILPNRTETPVSKEEALLLMNKNIDVLEKAVKLAAKQGAHIIVTPEDGIYGWIFTRESIYPYLEDIPDPGVNWIPCRDPWRNHYKYSKFEEMSIELGFGNTPVQQRLSCLAKDNSIYVVANIGDKKPCNASDSQCPPDGRYQYNTDVVFDSQGKLLARYHKYNLFAPEIQFDFPKDSELVTFDTPFGKFGIFTCFDIFSHDPAAVVVDEVSIDSILYPTAWYNTLPLLSAVPFHSAWAKAMGVNLLAANTHNTSMHMTGSGIYAPEAVKVYHYDMETESGQLLLSELKSRPRREPTYPAAVDWHAYASSVKPFSSEQSDFLGMIYFDEFTFTKLKRNTGNYTACQKDLCCHLTYKMSEKRTDEIYALGAFDGLHTVEGQYYLQICALLKCQTTDLETCGEPVGSAFTKFEDFSLSGTFGTRYVFPQIILSGSQLAPERHYEISRDGRLRSRSGAPLPVLVMALYGRVFEKDPPRLGQGSGKFQ

SEQ ID NO: 885770 - protein, 147 aa, Homo sapiens
MIISHFPKCVAVFALLALSVGALDTFIAAVYEHAVILPNRTETPVSKEEALLLMNKNIDVLEKAVKLAAKQGAHIIVTPEDGIYGWIFTRESIYPYLEDIPDPGVNWIPCRDPWRKSKKMNEPVSKELCYHCHSECNQYGQWKLYRT

SEQ ID NO: 885771 - protein, 535 aa, Homo sapiens
MEEGARHRNNTEKKHPGGGESDASPEAGSGGGGVALKKEIGLVSACGIIVGNIIGSGIFVSPKGVLENAGSVGLALIVWIVTGFITVVGALCYAELGVTIPKSGGDYSYVKDIFGGLAGFLRLWIAVLVIYPTNQAVIALTFSNYVLQPLFPTCFPPESGLRLLAAICLLLLTWVNCSSVRWATRVQDIFTAGKLLALALIIIMGIVQICKGEYFWLEPKNAFENFQEPDIGLVALAFLQGSFAYGGWNFLNYVTEELVDPYKNLPRAIFISIPLVTFVYVFANVAYVTAMSPQELLASNAVAVTFGEKLLGVMAWIMPISVALSTFGGVNGSLFTSSRLFFAGAREGHLPSVLAMIHVKRCTPIPALLFTCISTLLMLVTSDMYTLINYVGFINYLFYGVTVAGQIVLRWKKPDIPRPIKINLLFPIIYLLFWAFLLVFSLWSEPVVCGIGLAIMLTGVPVYFLGVYWQHKPKCFSDFIELLTLVSQKMCVVVYPEVERGSGTEEANEDMEEQQQPMYQPTPTKDKDVAGQPQP

SEQ ID NO: 885772 - protein, 151 aa, Homo sapiens
MEEGARHRNNTEKKHPGGGESDASPEAGSGGGGVALKKEIGLVSACGIIVGNIIGSGIFVSPKGAALWGDRLKQFCPHQGVSWRDPRPYLFTRDPKSKGMLPSALFPAPPHHTCTHPSQGSLSRIRFSSGRQLPELRTKEKNSLSTPKPGG

SEQ ID NO: 885773 - protein, 394 aa, Homo sapiens
LLLQLEGRESVGAGQSVAEGREVNAPAKVLLTWVNCSSVRWATRVQDIFTAGKLLALALIIIMGIVQICKGEYFWLEPKNAFENFQEPDIGLVALAFLQGSFAYGGWNFLNYVTEELVDPYKNLPRAIFISIPLVTFVYVFANVAYVTAMSPQELLASNAVAVTFGEKLLGVMAWIMPISVALSTFGGVNGSLFTSSRLFFAGAREGHLPSVLAMIHVKRCTPIPALLFTCISTLLMLVTSDMYTLINYVGFINYLFYGVTVAGQIVLRWKKPDIPRPIKINLLFPIIYLLFWAFLLVFSLWSEPVVCGIGLAIMLTGVPVYFLGVYWQHKPKCFSDFIELLTLVSQKMCVVVYPEVERGSGTEEANEDMEEQQQPMYQPTPTKDKDVAGQPQP

SEQ ID NO: 885774 - protein, 535 aa, Homo sapiens; identical to SEQ ID NO: 885771

SEQ ID NO: 885775 - protein, 535 aa, Homo sapiens; identical to SEQ ID NO: 885771

SEQ ID NO: 885776 - protein, 512 aa, Homo sapiens
MEEGARHRNNTEKKHPGGGESDASPEAGSGGGGVALKKEIGLVSACGIIVGNIIGSGIFVSPKGVLENAGSVGLALIVWIVTGFITVVGALCYAELGVTIPKSGGDYSYVKDIFGGLAGFLRLWIAVLVIYPTNQAVIALTFSNYVLQPLFPTCFPPESGLRLLAAICLLLLTWVNCSSVRWATRVQDIFTAGKLLALALIIIMGIVQICKGEYFWLEPKNAFENFQEPDIGLVALAFLQGSFAYGGWNFLNYVTEELVDPYKNLPRAIFISIPLVTFVYVFANVAYVTAMSPQELLASNAVAVTFGEKLLGVMAWIMPISVALSTFGGVNGSLFTSSRLFFAGAREGHLPSVLAMIHVKRCTPIPALLFTCISTLLMLVTSDMYTLINYVGFINYLFYGVTVAGQIVLRWKKPDIPRPIKINLLFPIIYLLFWAFLLVFSLWSEPVVCGIGLAIMLTGVPVYFLGVYWQHKPKCFSDFIGELLEALAGFRASWAGMQWSVMGLGSHQGQEI

SEQ ID NO: 885777 - protein, 289 aa, Homo sapiens
MEEGARHRNNTEKKHPGGGESDASPEAGSGGGGVALKKEIGLVSACGIIVGNIIGSGIFVSPKGVLENAGSVGLALIVWIVTGFITVVGALCYAELGVTIPKSGGDYSYVKDIFGGLAGFLRLWIAVLVIYPTNQAVIALTFSNYVLQPLFPTCFPPESGLRLLAAICLLLLTWVNCSSVRWATRVQDIFTAGKLLALALIIIMGIVQICKGEYFWLEPKNAFENFQEPDIGLVALAFLQGSFAYGGWNFLNYVTEELVDPYKAANPGEPEDVCGRVPRGGAGLRDRGG

SEQ ID NO: 885778 - protein, 119 aa, Homo sapiens
MEEGARHRNNTEKKHPGGGESDASPEAGSGGGGVALKKEIGLVSACGIIVGNIIGSGIFVSPKGVLENAGSVGLALIVWIVTGFITVVGALCYAELGVTIPKSGGDYSYVKDIFGGLAG

SEQ ID NO: 885779 - protein, 547 aa, Homo sapiens
MEEGARHRNNTEKKHPGGGESDASPEAGSGGGGVALKKEIGLVSACGIIVGNIIGSGIFVSPKGVLENAGSVGLALIVWIVTGFITVVGALCYAELGVTIPKSGGDYSYVKDIFGGLAGFLRLWIAVLVIYPTNQAVIALTFSNYVLQPLFPTCFPPESGLRLLAAICLLLLTWVNCSSVRWATRVQDIFTAGKLLALALIIIMGIVQICKGEYFWLEPKNAFENFQEPDIGLVALAFLQGSFAYGGWNFLNYVTEELVDPYKNLPRAIFISIPLVTFVYVFANVAYVTAMSPQELLASNAVAVTFGEKLLGVMAWIMPISVALSTFGGVNGSLFTSSRLFFAGAREGHLPSVLAMIHVKRCTPIPALLFTCISTLLMLVTSDMYTLINYVGFINYLFYGVTVAGQIVLRWKKPDIPRPIKINLLFPIIYLLFWAFLLVFSLWSEPVVCGIGLAIMLTGVPVYFLGVYWQHKPKCFSDFIELLTLVSQKMCVVVYPEVERGSGTEEANEDMEEQQQPMYQPTPTKDKDVAGQPLCFCQAVVGLWCGW

SEQ ID NO: 885780 - protein, 243 aa, Homo sapiens [sequence omitted]

SEQ ID NO: 885781 - protein, 449 aa, Homo sapiens
MEEGARHRNNTEKKHPGGGESDASPEAGSGGGGVALKKEIGLVSACGIIVGNIIGSGIFVSPKGVLENAGSVGLALIVWIVTGFITVVGALCYAELGVTIPKSGGDYSYVKDIFGGLAGFLRLWIAVLVIYPTNQAVIALTFSNYVLQPLFPTCFPPESGLRLLAAICLLLLTWVNCSSVRWATRVQDIFTAGKLLALALIIIMGIVQICKGEYFWLEPKNAFENFQEPDIGLVALAFLQGSFAYGGWNFLNYVTEELVDPYKNLPRAIFISIPLVTFVYVFANVAYVTAMSPQELLASNAVAVTFGEKLLGVMAWIMPISVALSTFGGVNGSLFTSSRLFFAGAREGHLPSVLAMIHVKRCTPIPALLFTCISTLLMLVTSDMYTLINYVGFINYLFYGVTVAGQIVLRWKKPDIPRPIKINRITRSTASPVQPHHPFNRITRSTASR

SEQ ID NO: 885782 - protein, 971 aa, Homo sapiens
KVALVKCRDLHWAMMAHRDQRDVSLSSLRMLIVTDGANPWSVSSCDAFLSLFQSHGLKPEAICPCATSAEAMTVAIRRPGVPGAPLPGRAILSMNGLSYGVIRVNTEDKNSALTVQDVGHVMPGGMMCIVKPDGPPQLCKTDEIGEICVSSRTGGMMYFGLAGVTKNTFEVIPVNSAGSPVGDVPFIRSGLLGFVGPGSLVFVVGKMDGLLMVSGRRHNADDIVATGLAVESIKTVYRGRIAVFSVSVFYDERIVVVAEQRPDASEEDSFQWMSRVLQAIDSIHQVGVYCLALVPANTLPKTPLGGIHISQTKQLFLEGSLHPCNILMCPHTCVTNLPKPRQKQPGVGPASVMVGNLVAGKRIAQAAGRDLGQIEENDLVRKHQFLAEILQWRAQATPDHVLFMLLNAKGTTVCTASCLQLHKRAERIASVLGDKGHLNAGDNVVLLYPPGIELIAAFYGCLYAGCIPVTVRPPHAQNLTATLPTVRMIVDVSKAACILTSQTLMRLLRSREAAAAVDVKTWPTIIDTDDLPRKRLPQLYKPPTPEMLAYLDFSVSTTGMLTGVKMSHSAVNALCRAIKLQCELYSSRQIAICLDPYCGLGFALWCLCSVYSGHQSVLIPPMELENNLFLWLSTVNQYKIRDTFCSYSVMELCTKGLGNQVEVLKTRGINLSCVRTCVVVAEERPRVALQQSFSKLFKDIGLSPRAVSTTFGSRVNVAICLQGTSGPDPTTVYVDLKSLRHDRVRLVERGAPQSLLLSESGKILPGVKVVIVNPETKGPVGDSHLGEIWVNSPHTASGYYTIYDSETLQADHFNTRLSFGDAAQTLWARTGYLGFVRRTELTAATGERHDALYVVGALDETLELRGLRYHPIDIETSVSRIHRSIAECAVFTWTNLLVVVVELCGSEQEALDLVPLVTNVVLEEHYLIVGVVVVVDPGVIPINSRGEKQRMHLRDSFLADQLDPIYVAYNM

SEQ ID NO: 885783 - protein, 971 aa, Homo sapiens; identical to SEQ ID NO: 885782

SEQ ID NO: 885784 - protein, 846 aa, Homo sapiens
MMCIVKPDGPPQLCKTDEIGEICVSSRTGGMMYFGLAGVTKNTFEVIPVNSAGSPVGDVPFIRSGLLGFVGPGSLVFVVGKMDGLLMVSGRRHNADDIVATGLAVESIKTVYRGRIAVFSVSVFYDERIVVVAEQRPDASEEDSFQWMSRVLQAIDSIHQVGVYCLALVPANTLPKTPLGGIHISQTKQLFLEGSLHPCNILMCPHTCVTNLPKPRQKQPGVGPASVMVGNLVAGKRIAQAAGRDLGQIEENDLVRKHQFLAEILQWRAQATPDHVLFMLLNAKGTTVCTASCLQLHKRAERIASVLGDKGHLNAGDNVVLLYPPGIELIAAFYGCLYAGCIPVTVRPPHAQNLTATLPTVRMIVDVSKAACILTSQTLMRLLRSREAAAAVDVKTWPTIIDTDDLPRKRLPQLYKPPTPEMLAYLDFSVSTTGMLTGVKMSHSAVNALCRAIKLQCELYSSRQIAICLDPYCGLGFALWCLCSVYSGHQSVLIPPMELENNLFLWLSTVNQYKIRDTFCSYSVMELCTKGLGNQVEVLKTRGINLSCVRTCVVVAEERPRVALQQSFSKLFKDIGLSPRAVSTTFGSRVNVAICLQGTSGPDPTTVYVDLKSLRHDRVRLVERGAPQSLLLSESGKILPGVKVVIVNPETKGPVGDSHLGEIWVNSPHTASGYYTIYDSETLQADHFNTRLSFGDAAQTLWARTGYLGFVRRTELTAATGERHDALYVVGALDETLELRGLRYHPIDIETSVSRIHRSIAECAVFTWTNLLVVVVELCGSEQEALDLVPLVTNVVLEEHYLIVGVVVVVDPGVIPINSRGEKQRMHLRDSFLADQLDPIYVAYNM

SEQ ID NO: 885785 - protein, 971 aa, Homo sapiens; identical to SEQ ID NO: 885782

SEQ ID NO: 885786 - protein, 971 aa, Homo sapiens; identical to SEQ ID NO: 885782

SEQ ID NO: 885787 - protein, 605 aa, Homo sapiens
KVALVKCRDLHWAMMAHRDQRDVSLSSLRMLIVTDGANPWSVSSCDAFLSLFQSHGLKPEAICPCATSAEAMTVAIRRPGVPGAPLPGRAILSMNGLSYGVIRVNTEDKNSALTVQDVGHVMPGGMMCIVKPDGPPQLCKTDEIGEICVSSRTGGMMYFGLAGVTKNTFEVIPVNSAGSPVGDVPFIRSGLLGFVGPGSLVFVVGKMDGLLMVSGRRHNADDIVATGLAVESIKTVYRGRIAVFSVSVFYDERIVVVAEQRPDASEEDSFQWMSRVLQAIDSIHQVGVYCLALVPANTLPKTPLGGIHISQTKQLFLEGSLHPCNILMCPHTCVTNLPKPRQKQPGVGPASVMVGNLVAGKRIAQAAGRDLGQIEENDLVRKHQFLAEILQWRAQATPDHVLFMLLNAKGTTVCTASCLQLHKRAERIASVLGDKGHLNAGDNVVLLYPPGIELIAAFYGCLYAGCIPVTVRPPHAQNLTATLPTVRMIVDVSKAACILTSQTLMRLLRSREAAAAVDVKTWPTIIDTDDLPRKRLPQLYKPPTPEMLAYLDFSVSTTGMLTGVKVRCMLEKCHICQKIEMTTAPETIDAEAKWLYQRPVGRVKI

SEQ ID NO: 885788 - protein, 118 aa, Homo sapiens [sequence omitted]

SEQ ID NO: 885789 - protein, 113 aa, Homo sapiens
ASVNLLLAILFNHILSGKCTFQVVSRVHLLSSWDYRCTPPHLANCFVETAFRHVAQAGLELLDSGSPPASTSQSARITGVSHHTQSHSFLFILGYTIGFKPVITSHLNYCSLS

SEQ ID NO: 885790 - protein, 900 aa, Homo sapiens
MTVAIRRPGVPGAPLPGRAILSMNGLSYGVIRVNTEDKNSALTVQDVGHVMPGGMMCIVKPDGPPQLCKTDEIGEICVSSRTGGMMYFGLAGVTKNTFEVIPVNSAGSPVGDVPFIRSGLLGFVGPGSLVFVVGKMDGLLMVSGRRHNADDIVATGLAVESIKTVYRGRIAVFSVSVFYDERIVVVAEQRPDASEEDSFQWMSRVLQAIDSIHQVGVYCLALVPANTLPKTPLGGIHISQTKQLFLEGSLHPCNILMCPHTCVTNLPKPRQKQPGVGPASVMVGNLVAGKRIAQAAGRDLGQIEENDLVRKHQFLAEILQWRAQATPDHVLFMLLNAKGTTVCTASCLQLHKRAERIASVLGDKGHLNAGDNVVLLYPPGIELIAAFYGCLYAGCIPVTVRPPHAQNLTATLPTVRMIVDVSKAACILTSQTLMRLLRSREAAAAVDVKTWPTIIDTDDLPRKRLPQLYKPPTPEMLAYLDFSVSTTGMLTGVKMSHSAVNALCRAIKLQCELYSSRQIAICLDPYCGLGFALWCLCSVYSGHQSVLIPPMELENNLFLWLSTVNQYKIRDTFCSYSVMELCTKGLGNQVEVLKTRGINLSCVRTCVVVAEERPRVALQQSFSKLFKDIGLSPRAVSTTFGSRVNVAICLQGTSGPDPTTVYVDLKSLRHDRVRLVERGAPQSLLLSESGKILPGVKVVIVNPETKGPVGDSHLGEIWVNSPHTASGYYTIYDSETLQADHFNTRLSFGDAAQTLWARTGYLGFVRRTELTAATGERHDALYVVGALDETLELRGLRYHPIDIETSVSRIHRSIAECAVFTWTNLLVVVVELCGSEQEALDLVPLVTNVVLEEHYLIVGVVVVVDPGVIPINSRGEKQRMHLRDSFLADQLDPIYVAYNM

SEQ ID NO: 885791 - protein, 971 aa, Homo sapiens; identical to SEQ ID NO: 885782

SEQ ID NO: 885792 - protein, 971 aa, Homo sapiens; identical to SEQ ID NO: 885782

SEQ ID NO: 885793 - protein, 109 aa, Homo sapiens
MAAPGERGRFHGGNLFFLPGGARSEMMDDLATDARGRGAGRRDAAASASTPAQAPTSDSPVAEDASRRRPCRACVDFKTWMRTQQKAVQEPPRHPHPGMLHTVAVPPAQ

SEQ ID NO: 885794 - protein, 205 aa, Homo sapiens
MAAPGERGRFHGGNLFFLPGGARSEMMDDLATDARGRGAGRRDAAASASTPAQAPTSDSPVAEDASRRRPCRACVDFKTWMRTQQKRDTKFREDCPPDREELGRHSWAVLHTLAAYYPDLPTPEQQQDMAQFIHLFSKFYPCEECAEDLRKRLCRNHPDTRTRACFTQWLCHLHNEVNRKLGKPDFDCSKVDERWRDGWKDGSCD

SEQ ID NO: 885795 - protein, 201 aa, Homo sapiens
QALPIHHNLGYNLQTHIGWYYLPHNDVHFVLVEVCGLAGAAASASTPAQAPTSDSPVAEDASRRRPCRACVDFKTWMRTQQKRDTKFREDCPPDREELGRHSWAVLHTLAAYYPDLPTPEQQQDMAQFIHLFSKFYPCEECAEDLRKRLCRNHPDTRTRACFTQWLCHLHNEVNRKLGKPDFDCSKVDERWRDGWKDGSCD

SEQ ID NO: 885796 - protein, 205 aa, Homo sapiens; identical to SEQ ID NO: 885794

SEQ ID NO: 885797 - protein, 206 aa, Homo sapiens
PRAGLEADLEAHLEAELTRQALRGQHGGARRAGPLPRREPLLPAGGRALRDDGRPGDRRAGPGRGAERRGRLGLDASPGADLRFSCRRGRLPEAAVPGLRRLQDVDADAAEGAVPCPISPSPAQPLSPPPPRYPGRASQGCLSLNLAPRVGPALQPSSARGLDRLQDFGRSPVGHRLGRTVGSFGRLCSENELTLGRPASAAGHQV

SEQ ID NO: 885798 - protein, 136 aa, Homo sapiens
MESEETAGSRRVGQRWRRLSAARWGVTGTQPLGLPSQSSPATVCPVVIKLQGPLSSRSLSLSLGAGPPWHGRLRPPWRELLCPHQIGPVRLLASVEAAQRGQVAQIREGRWGAARRGGVPSSPRHSALLSGLSRGL

SEQ ID NO: 885799 - protein, 192 aa, Homo sapiens
MLLSVVLVLFRTGAAPVLVVACPGYNLFFLPGGARSEMMDDLATDARGRGAGRRDAAASASTPAQAPTSDSPVAEDASRRRPCRACVDFKTWMRTQQKTLAAYYPDLPTPEQQQDMAQFIHLFSKFYPCEECAEDLRKRLCRNHPDTRTRACFTQWLCHLHNEVNRKLGKPDFDCSKVDERWRDGWKDGSCD

SEQ ID NO: 885800 - protein, 217 aa, Homo sapiens
MLLSVVLVLFRTGAAPVLVVACPGYNLFFLPGGARSEMMDDLATDARGRGAGRRDAAASASTPAQAPTSDSPVAEDASRRRPCRACVDFKTWMRTQQKRDTKFREDCPPDREELGRHSWAVLHTLAAYYPDLPTPEQQQDMAQFIHLFSKFYPCEECAEDLRKRLCRNHPDTRTRACFTQWLCHLHNEVNRKLGKPDFDCSKVDERWRDGWKDGSCD

SEQ ID NO: 885801 - protein, 205 aa, Homo sapiens; identical to SEQ ID NO: 885794

SEQ ID NO: 885802 - protein, 320 aa, Homo sapiens
PRAGLEADLEAHLEAELTRQALRGQHGGARRAGPLPRREPLLPAGGRALRDDGRPGDRRAGPGRGAERRGRLGLDASPGADLRFSCRRGRLPEAAVPGLRRLQDVDADAAEGAVPCPISPSPAQPLSPPPPRYPGRASQGCLSLNLAPRVGPALQPSSRVGWIVCRTLAGVQWATGWAVQWGALGAFVRRMNSLSVGLLPQRDTKFREDCPPDREELGRHSWAVLHTLAAYYPDLPTPEQQQDMAQFIHLFSKFYPCEECAEDLRKRLCRNHPDTRTRACFTQWLCHLHNEVNRKLGKPDFDCSKVDERWRDGWKDGSCD

SEQ ID NO: 885803 - protein, 206 aa, Homo sapiens; identical to SEQ ID NO: 885797

SEQ ID NO: 885804 - protein, 931 aa, Homo sapiens
MLLFFTLGLLIHFVFFASIFDIYFTSPLVHGMTPQFTPLPPPARRLVLFVADGLRADALYELDENGNSRAPFIRNIIMHEGSWGISHTRVPTESRPGHVALIAGFYEDVSAVAKGWKENPVEFDSLFNESKYTWSWGSPDILPMFAKGASGDHVYTYSYDAKREDFGAQDATKLDTWVFDNVKDFFHHARNNQSLFSKINEEKIVFFLHLLGIDTNGHAHRPSSRDYKHNIKKVDDGVKEIVSMFNHFYGNDGKTTFIFTSDHGMTDWGSHGAGHPSETLTPLVTWGAGIKYPQRVSAQQFDDAFLKEWRLENWKRLDVNQADIAPLMTSLIGVPFPLNSVGILPVDYLNNTDLFKAESMFTNAVQILEQFKVKMTQKKEVTLPFLFTPFKLLSDSKQFNILRKARSYIKHRKFDEVVSLCKELIHLALKGLSYYHTYDRFFLGVNVVIGFVGWISYASLLIIKSHSNLIKGVSKEVKKPSHLLPCSFVAIGILVAFFLLIQACPWTYYVYGLLPLPIWYAVLREFQVIQDLVVSVLTYPLSHFVGYLLAFTLGIEVLVLSFFYRYMLTAGLTAFAAWPFLTRLWTRAKMTSLSWTFFSLLLAVFPLMPVVGRKPDISLVMGAGLLVLLLSLCVVTSLMKRKDSFIKEELLVHLLQVLSTVLSMYVVYSTQSSLLRKQGLPLMNQIISWATLASSLVVPLLSSPVLFQRLFSILLSLMSTYLLLSTGYEALFPLVLSCLMFVWINIEQETLQQSGVCCKQKLTSIQFSYNTDITQFRQLYLDDIRRAFFLVFFLVTAFFGTGNIASINSFDLASVYCFLTVFSPFMMGALMMWKILIPFVLVMCAFEAVQLTTQLSSKSLFLIVLVISDIMALHFFFLVKDYGSWLDIGTSISHYVIVMSMTIFLVFLNGLAQLLTTKKLRLCGKPKSHFM

SEQ ID NO: 885805 - protein, 931 aa, Homo sapiens; identical to SEQ ID NO: 885804

SEQ ID NO: 885806 - protein, 931 aa, Homo sapiens; identical to SEQ ID NO: 885804

SEQ ID NO: 885807 - protein, 271 aa, Homo sapiens
MLTAGLTAFAAWPFLTRLWTRAKMTSLSWTFFSLLLAVFPLMPVVGRKPDISLVMGAGLLVLLLSLCVVTSLMKRKDSFIKEELLVHLLQVLSTVLSMYVVYSTQSSLLRKQGLPLMNQIISWATLASSLVVPLLSSPVLFQRLFSILLSLMSTYLLLSTGYEALFPLVLSCLMFVWINIEQETLQQSGVCCKQKLTSIQFSYNTDITQFRQLYLDDIRRAFFLVFFLVTAFFGTGNIASINSFDLASVYCFLTVFSPFMMGALMMWKQFS

SEQ ID NO: 885808 - protein, 197 aa, Homo sapiens
NLPNSHKNRPESKSGRLQRLSYFPPLQLTSIQFSYNTDITQFRQLYLDDIRRAFFLVFFLVTAFFGTGNIASINSFDLASVYCFLTVFSPFMMGALMMWKILIPFVLVMCAFEAVQLTTQLSSKSLFLIVLVISDIMALHFFFLVKDYGSWLDIGTSISHYVIVMSMTIFLVFLNGLAQLLTTKKLRLCGKPKSHFM

SEQ ID NO: 885809 - protein, 395 aa, Homo sapiens
MLLFFTLGLLIHFVFFASIFDIYFTSPLVHGMTPQFTPLPPPARRLVLFVADGLRADALYELDENGNSRAPFIRNIIMHEGSWGISHTRVPTESRPGHVALIAGFYEDVSAVAKGWKENPVEFDSLFNESKYTWSWGSPDILPMFAKGASGDHVYTYSYDAKREDFGAQDATKLDTWVFDNVKDFFHHARNNQSLFSKINEEKIVFFLHLLGIDTNGHAHRPSSRDYKHNIKKVDDGVKEIVSMFNHFYGNDGKTTFIFTSDHGMTDWGSHGAGHPSETLTPLVTWGAGIKYPQRVSAQQFDDAFLKEWRLENWKRLDVNQADIAPLMTSLIGVPFPLNSVGILPVDYLNNTDLFKAESMFTNAVQILEQFKVKMTQKKEVTLPFLFTPFNCAGS

SEQ ID NO: 885810 - protein, 931 aa, Homo sapiens; identical to SEQ ID NO: 885804

SEQ ID NO: 885811 - protein, 931 aa, Homo sapiens; identical to SEQ ID NO: 885804

SEQ ID NO: 885812 - protein, 931 aa, Homo sapiens; identical to SEQ ID NO: 885804

SEQ ID NO: 885813 - protein, 903 aa, Homo sapiens
MLLFFTLGLLIHFVFFASIFDIYFTSPLVHGMTPQFTPLPPPARRLVLFVADGLRADALYELDENGNSRAPFIRNIIMHEGSWGISHTRVPTESRPGHVALIAGFYEDVSAVAKGWKENPVEFDSLFNESKYTWSWGSPDILPMFAKGASGDHVYTYSYDAKREDFGAQDATKLDTWVFDNVKEVDTNGHAHRPSSRDYKHNIKKVDDGVKEIVSMFNHFYGNDGKTTFIFTSDHGMTDWGSHGAGHPSETLTPLVTWGAGIKYPQRVSAQQFDDAFLKEWRLENWKRLDVNQADIAPLMTSLIGVPFPLNSVGILPVDYLNNTDLFKAESMFTNAVQILEQFKVKMTQKKEVTLPFLFTPFKLLSDSKQFNILRKARSYIKHRKFDEVVSLCKELIHLALKGLSYYHTYDRFFLGVNVVIGFVGWISYASLLIIKSHSNLIKGVSKEVKKPSHLLPCSFVAIGILVAFFLLIQACPWTYYVYGLLPLPIWYAVLREFQVIQDLVVSVLTYPLSHFVGYLLAFTLGIEVLVLSFFYRYMLTAGLTAFAAWPFLTRLWTRAKMTSLSWTFFSLLLAVFPLMPVVGRKPDISLVMGAGLLVLLLSLCVVTSLMKRKDSFIKEELLVHLLQVLSTVLSMYVVYSTQSSLLRKQGLPLMNQIISWATLASSLVVPLLSSPVLFQRLFSILLSLMSTYLLLSTGYEALFPLVLSCLMFVWINIEQETLQQSGVCCKQKLTSIQFSYNTDITQFRQLYLDDIRRAFFLVFFLVTAFFGTGNIASINSFDLASVYCFLTVFSPFMMGALMMWKILIPFVLVMCAFEAVQLTTQLSSKSLFLIVLVISDIMALHFFFLVKDYGSWLDIGTSISHYVIVMSMTIFLVFLNGLAQLLTTKKLRLCGKPKSHFM

SEQ ID NO: 885814 - protein, 490 aa, Homo sapiens
MLLFFTLGLLIHFVFFASIFDIYFTSPLVHGMTPQFTPLPPPARRLVLFVADGLRADALYELDENGNSRAPFIRNIIMHEGSWGISHTRVPTESRPGHVALIAGFYEDVSAVAKGWKENPVEFDSLFNESKYTWSWGSPDILPMFAKGASGDHVYTYSYDAKREDFGAQDATKLDTWVFDNVKDFFHHARNNQSLFSKINEEKIVFFLHLLGIDTNGHAHRPSSRDYKHNIKKVDDGVKEIVSMFNHFYGNDGKTTFIFTSDHGMTDWGSHGAGHPSETLTPLVTWGAGIKYPQRVSAQQFDDAFLKEWRLENWKRLDVNQADIAPLMTSLIGVPFPLNSVGILPVDYLNNTDLFKAESMFTNAVQILEQFKVKMTQKKEVTLPFLFTPFKLLSDSKQFNILRKARSYIKHRKFDEVVSLCKELIHLALKGLSYYHTYDRFFLGVNVVIGFVGWISYASLLIIKSHSNLIKGVSKEVKVRLENVRIQMMV

SEQ ID NO: 885815 - protein, 198 aa, Homo sapiens
MLLFFTLGLLIHFVFFASIFDIYFTSPLVHGMTPQFTPLPPPARRLVLFVADGLRADALYELDENGNSRAPFIRNIIMHEGSWGISHTRVPTESRPGHVALIAGFYEDVSAVAKGWKENPVEFDSLFNESKYTWSWGSPDILPMFAKGASGDHVYTYSYDAKREDFGAQDATKLDTWVFDNVKVCAIEWLIYKKHIFT

SEQ ID NO: 885816 - protein, 335 aa, Homo sapiens
NRLGRGLVLLGRGRFLRGLLTLLLPPPPLYTRHRMLGPESVPPPKRSRSKLMAPPRIGTHNGTFHCDEALACALLRLLPEYRDAEIVRTRDPEKLASCDIVVDVGGEYDPRRHRYDHHQRSFTETMSSLSPGKPWQTKLSSAGLIYLHFGHKLLAQLLGTSEEDSMVGTLYDKAGFKRAMDLVQEEFLQRLDFYQHSWLPARALVEEALAQRFQVDPSGEIVELAKGACPWKEHLYHLESGLSPPVAIFFVIYTDQAGQWRIQCVPKEPHSFQSRLPLPEPWRGLRDEALDQVSGIPGCIFVHASGFIGGHRTREGALSMARATLAQRSYLPQIS

SEQ ID NO: 885817 - protein, 388 aa, Homo sapiens
GSALLPPCRELLMGHRFLRGLLTLLLPPPPLYTRHRMLGPESVPPPKRSRSKLMAPPRIGTHNGTFHCDEALACALLRLLPEYRDAEIVRTRDPEKLASCDIVVDVGGEYDPRRHRYDHHQRSFTETMSSLSPGKPWQTKLSSAGLIYLHFGHKLLAQLLGTSEEDSMVGTLYDKMYENFVEEVDAVDNGISQWAEGEPRYALTTTLSARVARLNPTWNHPDQDTEAGFKRAMDLVQEEFLQRLDFYQHSWLPARALVEEALAQRFQVDPSGEIVELAKGACPWKEHLYHLESGLSPPVAIFFVIYTDQAGQWRIQCVPKEPHSFQSRLPLPEPWRGLRDEALDQVSGIPGCIFVHASGFIGGHRTREGALSMARATLAQRSYLPQIS

SEQ ID NO: 885818 - protein, 261 aa, Homo sapiens
MSSLSPGKPWQTKLSSAGLIYLHFGHKLLAQLLGTSEEDSMVGTLYDKMYENFVEEVDAVDNGISQWAEGEPRYALTTTLSARVARLNPTWNHPDQDTEAGFKRAMDLVQEEFLQRLDFYQHSWLPARALVEEALAQRFQVDPSGEIVELAKGACPWKEHLYHLESGLSPPVAIFFVIYTDQAGQWRIQCVPKEPHSFQSRLPLPEPWRGLRDEALDQVSGIPGCIFVHASGFIGGHRTREGALSMARATLAQRSYLPQIS

SEQ ID NO: 885819 - protein, 424 aa, Homo sapiens
GSALLPPCRELLMGHRFLRGLLTLLLPPPPLYTRHRMLGPESVPPPKRSRSKLMAPPRIGTHNGTFHCDEALACALLRLLPEYRDAEIVRTRDPEKLASCDIVVDVGGEYDPRRHRYDHHQRSFTETMSSLSPGKPWQTKLSSAGLIYLHFGHKLLAQLLGTSEEDSMVGTLYDKMYENFVEEVDAVDNGISQWAEGEPRYALTTTLSARVARLNPTWNHPDQDTEAGFKRAMDLVQEEFLQRLDFYQHSWLPARALVEEALAQRFQVDPSGEIVELAKGACPWKEHLYHLESGLSPPVAIFFVIYTDQAGQWRIQCVPKEPHSFQSRLPLPEPWRGLRDEALDQVSGIPGCIFVHASGFIGGHRTREGALSMAQLLGTSEEDSMVGTLYDKMYENFVEEVDAVDNGISQWAEGEPRYALTTTP

SEQ ID NO: 885820 - protein, 328 aa, Homo sapiens
GSALLPPCRELLMGHRFLRGLLTLLLPPPPLYTRHRMLGPESVPPPKRSRSKLMAPPRIGTHNGTFHCDEALACALLRLLPEYRDAEIVRTRDPEKLASCDIVVDVGGEYDPRRHRYDHHQRSFTETMSSLSPGKPWQTKLSSAGLIYLHFGHKLLAQLLGTSEEDSMVGTLYDKMYENFVEEVDAVDNGISQWAEGEPRYALTTTLSARVARLNPTWNHPDQDTEAGFKRAMDLVQEEFLQRLDFYQHSWLPARALVEEALAQRFQVDPSGEIVELAKGACPWKEHLYHLESGLSPPVAIFFVIYTDQAGQWRIQCVPKEPHSFQSR

SEQ ID NO: 885821 - protein, 100 aa, Homo sapiens
RVGAPASLQGAAYGTPLPARPLNAAAAAATPVYPAPHARSRVRPAPKTIPQQTHGTAPNRDAQWHLPLRRGTGMRTASPPAGVPGCRDCADPGSRKTRFL

SEQ ID NO: 885822 - protein, 297 aa, Homo sapiens
GSALLPPCRELLMGHRFLRGLLTLLLPPPPLYTRHRMLGPESVPPPKRSRSKLMAPPRIGTHNGTFHCDEALACALLRLLPEYRDAEIVRTRDPEKLASCDIVVDVGGEYDPRRHRYDHHQRSFTETMSSLSPGKPWQTKLSSAGLIYLHFGHKLLAQLLGTSEEDSMVGTLYDKMYENFVEEVDAVDNGISQWAEGEPRYALTTTLSARVARLNPTWNHPDQDTEAGFKRAMDLVQEEFLQRLDFYQHSWLPARALVEEALAQRFQVDPSGEIVELAASSSMQAASLAVTAPERVP

SEQ ID NO: 885823 - protein, 192 aa, Homo sapiens
GSALLPPCRELLMGHRFLRGLLTLLLPPPPLYTRHRMLGPESVPPPKRSRSKLMAPPRIGTHNGTFHCDEALACALLRLLPEYRDAEIVRTRDPEKLASCDIVVDVGGEYDPRRHRYDHHQRSFTETMSSLSPGKPWQTKLSSAGLIYLHFGHKLLAQLLGTSEEDSMVGTLYDKMYENFVKREQTRILRVT

SEQ ID NO: 885824 - protein, 388 aa, Homo sapiens; identical to SEQ ID NO: 885817

SEQ ID NO: 885825 - protein, 127 aa, Homo sapiens
MLSLFQVDPSGEIVELAKGACPWKEHLYHLESGLSPPVAIFFVIYTDQAGQWRIQCVPKEPHSFQSRLPLPEPWRGLRDEALDQVSGIPGCIFVHASGFIGGHRTREGALSMARATLAQRSYLPQIS

SEQ ID NO: 885826 - protein, 364 aa, Homo sapiens
VTLGLRACMPPGWMAFRQQGHSDSARQPKHPSYPSCLPEVQHYIPYPATPGSPFTPVYLADAEIVRTRDPEKLASCDIVVDVGGEYDPRRHRYDHHQRSFTETMSSLSPGKPWQTKLSSAGLIYLHFGHKLLAQLLGTSEEDSMVGTLYDKMYENFVEEVDAVDNGISQWAEGEPRYALTTTLSARVARLNPTWNHPDQDTEAGFKRAMDLVQEEFLQRLDFYQHSWLPARALVEEALAQRFQVDPSGEIVELAKGACPWKEHLYHLESGLSPPVAIFFVIYTDQAGQWRIQCVPKEPHSFQSRLPLPEPWRGLRDEALDQVSGIPGCIFVHASGFIGGHRTREGALSMARATLAQRSYLPQIS

SEQ ID NO: 885827 - protein, 311 aa, Homo sapiens
PPCSLFTALGRGRGLAASCEPVDRQLLRIYDQWDCCQDGSATHQGSFTETMSSLSPGKPWQTKLSSAGLIYLHFGHKLLAQLLGTSEEDSMVGTLYDKMYENFVEEVDAVDNGISQWAEGEPRYALTTTLSARVARLNPTWNHPDQDTEAGFKRAMDLVQEEFLQRLDFYQHSWLPARALVEEALAQRFQVDPSGEIVELAKGACPWKEHLYHLESGLSPPVAIFFVIYTDQAGQWRIQCVPKEPHSFQSRLPLPEPWRGLRDEALDQVSGIPGCIFVHASGFIGGHRTREGALSMARATLAQRSYLPQIS

SEQ ID NO: 885828 - protein, 359 aa, Homo sapiens
GSALLPPCRELLMGHRFLRGLLTLLLPPPPLYTRHRMLGPESVPPPKRSRSKLMAPPRIGTHNGTFHCDEALACALLRLLPEYRDAEIVRTRDPEKLASCDIVVDVGGEYDPRRHRYDHHQRSFTETMSSLSPGKPWQTKLSSAGLIYLHFGHKLLAQLLGTSEEDSMVGTLYDKMYENFVEEVDAVDNGISQWAEGEPRYALTTTLSARVARLNPTWNHPDQDTEAGFKRAMDLVQEEFLQRLDFYQHSWLPARALVEEALAQRFQVDPSGEIVELAKGACPWKEHLYHLESGLSPPVAIFFVIYTDQAGQWRIQCCPCQSHGGVFGTRPWTRSVGSLAASSSMQAASLAVTAPERVP

SEQ ID NO: 885829 - protein, 100 aa, Homo sapiens; identical to SEQ ID NO: 885821

SEQ ID NO: 885830 - protein, 178 aa, Homo sapiens
GSALLPPCRELLMGHRFLRGLLTLLLPPPPLYTRHRMLGPESVPPPKRSRSKLMAPPRIGTHNGTFHCDEALACALLRLLPEYRDAEIVRTRDPEKLASCDIVVDVGGEYDPRRHRYDHHQRSFSRDHEAPCPLGEARGTNQRLTQLAGNSILNPWPPFPGSHQRLGLGAPRWPGGPP

SEQ ID NO: 885831 - protein, 168 aa, Homo sapiens
SSVELITPTVELRWPEMPAHSLVMSSPALPAFLLCSTLLVIKMYVVAIITGQVRLRKKAFANPEDALRHGGPQYCRSDPDVERCLRAHRNDMETIYPFLFLGFVYSFLGPNPFVAWMHFLVFLVGRVAHTVAYLGKLRAPIRSVTYTLAQLPCASMALQILWEAARHL

SEQ ID NO: 885832 - protein, 168 aa, Homo sapiens; identical to SEQ ID NO: 885831

SEQ ID NO: 885833 - protein, 168 aa, Homo sapiens; identical to SEQ ID NO: 885831

SEQ ID NO: 885834 - protein, 168 aa, Homo sapiens; identical to SEQ ID NO: 885831

SEQ ID NO: 885835 - protein, 209 aa, Homo sapiens
SSVELITPTVELRWPEMPAHSLVMSSPALPAFLLCSTLLVIKMYVVAIITGQVRLRKKSLALLPRLECSGKITAHCSLDLPGSSNPPASALLPSSWDQQAFANPEDALRHGGPQYCRSDPDVERCLRAHRNDMETIYPFLFLGFVYSFLGPNPFVAWMHFLVFLVGRVAHTVAYLGKLRAPIRSVTYTLAQLPCASMALQILWEAARHL

SEQ ID NO: 885836 - protein, 168 aa, Homo sapiens; identical to SEQ ID NO: 885831

SEQ ID NO: 885837 - protein, 139 aa, Homo sapiens [sequence omitted]

SEQ ID NO: 885838 - protein, 934 aa, Homo sapiens
MSSDEKGISPAHKTSTPTHRSASSSTSSQRDSRQSIHILERTASSSTEPSVSRQLLEPEPVPLSKEADSWEIIEGLKIGQTNVQKPDKHEGFMLKKRKWPLKGWHKRFFVLDNGMLKYSKAPLDIQKGKVHGSIDVGLSVMSIKKKARRIDLDTEEHIYHLKVKSQDWFDAWVSKLRHHRLYRQNEIVRSPRDASFHIFPSTSTAESSPAANVSVMDGKMQPNSFPWQSPLPCSNSLPATCTTGQSKVAAWLQDSEEMDRCAEDLAHCQSNLVELSKLLQNLEILQRTQSAPNFTDMQANCVDISKKDKRVTRRWRTKSVSKDTKIQLQVPFSATMSPVRLHSSNPNLCADIEFQTPPSHLTDPLESSTDYTKLQEEFCLIAQKVHSLLKSAFNSIAIEKEKLKQMVSEQDHSKGHSTQMARLRQSLSQALNQNAELRSRLNRIHSESIICDQVVSVNIIPSPDEAGEQIHVSLPLSQQVANESRLSMSESVSEFFDAQEVLLSASSSENEASDDESYISDVSDNISEDNTSVADNISRQILNGELTGGAFRNGRRACLPAPCPDTSNINLWNILRNNIGKDLSKVSMPVELNEPLNTLQHLCEEMEYSELLDKASETDDPYERMVLVAAFAVSGYCSTYFRAGSKPFNPVLGETYECIREDKGFRFFSEQVSHHPPISACHCESKNFVFWQDIRWKNKFWGKSMEILPVGTLNVMLPKYGDYYVWNKVTTCIHNILSGRRWIEHYGEVTIRNTKSSVCICKLTFVKVNYWNSNMNEVQGVVIDQEGKAVYRLFGKWHEGLYCGVAPSAKCIWRPGSMPTNYELYYGFTRFAIELNELDPVLKDLLPPTDARFRPDQRFLEEGNLEAAASEKQRVEELQRSRRRYMEENNLEHIPKFFKKVIDANQREAWVSNDTYWELRKDPGFSKVDSPVLW

SEQ ID NO: 885839 - protein, 898 aa, Homo sapiens
MSSDEKGISPAHKTSTPTHRSASSSTSSQRDSRQSIHILERTASSSTEPSVSRQLLEPEPVPLSKEADSWEIIEGLKIGQTNVQKPDKHEGFMLKKRKWPLKGWHKRFFVLDNGMLKYSKAPLDIQKGKVHGSIDVGLSVMSIKKKARRIDLDTEEHIYHLKVKSQDWFDAWVSKLRHHRLYRQNEIVRSPRDASFHIFPSTSTAESSPAANVSVMDGKMQPNSFPWQSPLPCSNSLPATCTTGQSKVAAWLQDSEEMDRCAEDLAHCQSNLVELSKLLQNLEILQRTQSAPNFTDMQANCVDISKKDKRVTRRWRTKSVSKDTKIQLQVPFSATMSPVRLHSSNPNLCADIEFQTPPSHLTDPLESSTDYTKLQEEFCLIAQKVHSLLKSAFNSIAIEKEKLKQMVSEQDHSKGHSTQMARLRQSLSQAGEQIHVSLPLSQQVANESRLSMSESVSEFFDAQEVLLSASSSENEASDDESYISDVSDNISEDNTSVADNISRQILNGELTGGAFRNGRRACLPAPCPDTSNINLWNILRNNIGKDLSKVSMPVELNEPLNTLQHLCEEMEYSELLDKASETDDPYERMVLVAAFAVSGYCSTYFRAGSKPFNPVLGETYECIREDKGFRFFSEQVSHHPPISACHCESKNFVFWQDIRWKNKFWGKSMEILPVGTLNVMLPKYGDYYVWNKVTTCIHNILSGRRWIEHYGEVTIRNTKSSVCICKLTFVKVNYWNSNMNEVQGVVIDQEGKAVYRLFGKWHEGLYCGVAPSAKCIWRPGSMPTNYELYYGFTRFAIELNELDPVLKDLLPPTDARFRPDQRFLEEGNLEAAASEKQRVEELQRSRRRYMEENNLEHIPKFFKKVIDANQREAWVSNDTYWELRKDPGFSKVDSPVLW

SEQ ID NO: 885840 - protein, 479 aa, Homo sapiens; identical to SEQ ID NO: 739431

SEQ ID NO: 885841 - protein, 479 aa, Homo sapiens; identical to SEQ ID NO: 739431

SEQ ID NO: 885842 - protein, 479 aa, Homo sapiens; identical to SEQ ID NO: 739431

SEQ ID NO: 885843 - protein, 391 aa, Homo sapiens
MERTQSSNMETRLDAMKELAKLSADVTFATEFINMDGIIVLTRLVESGTKLLSHYSEMLAFTLTAFLELMDHGIVSWDMVSITFIKQIAGYVSQPMVDVSILQRSLAILESMVLNSQSLYQKIAEEITVGQLISHLQVSNQEIQTYAIALINALFLKAPEDKRQDMANAFAQKHLRSIILNHVIRGNRPIKTEMAHQLYVLQVLTFNLLEERMMTKMDPNDQAQRDIIFELRRIAFDAESDPSNAPGSGTEKRKAMYTKDYKMLGFTNHINPAMDFTQTPPGMLALDNMLYLAKVHQDTYIRIVLENSSREDKHECPFGRSAIELTKMLCEILQVGELPNEGRNDYHPMFFTHDRAFEELFGICIQLLNKTWKEMRATAEDFNKVSVSGLL

SEQ ID NO: 885844 - protein, 459 aa, Homo sapiens
MDLVFNSGSSELKEHSYTLRWSLPNPEYYTLRYADGPQLYITEQTRSDIKNGTILQLAISPSRAARQLMERTQSSNMETRLDAMKELAKLSADVTFATEFINMDGIIVLTRLVESGTKLLSHYSEMLAFTLTAFLELMDHGIVSWDMVSITFIKQIAGYVSQPMVDVSILQRSLAILESMVLNSQSLYQKIAEEITVGQLISHLQVSNQEIQTYAIALINALFLKAPEDKRQDMANAFAQKHLRSIILNHVIRGNRPIKTEMAHQLYVLQVLTFNLLEERMMTKMDPNDQAQRDIIFELRRIAFDAESDPSNAPGSGTEKRKAMYTKDYKMLGFTNHINPAMDFTQTPPGMLALDNMLYLAKVHQDTYIRIVLENSSREDKHECPFGRSAIELTKMLCEILQVGELPNEGRNDYHPMFFTHDRAFEELFGICIQLLNKTWKEMRATAEDFNKVSVSGLL

SEQ ID NO: 885845 - protein, 374 aa, Homo sapiens
MAHQLYVLQVLTFNLLEERMMTKMDPNDQAQRDIIFELRRIAFDAESDPSNAPGSGTEKRKAMYTKDYKMLGFTNHINPAMDFTQTPPGMLALDNMLYLAKVHQDTYIRIVLENSSREDKHECPFGRSAIELTKMLCEILQVGELPNEGRNDYHPMFFTHDRAFEELFGICIQLLNKTWKEMRATAEDFNKVMQVVREQITRALPSKPNSLDQFKSKLRSLSYSEILRLRQSERMSQDDFQSPPIVELREKIQPEILELIKQQRLNRLCEGSSFRKIGNRRRQERFWYCRLALNHKVLHYGDLDDNPQGEVTFESLQEKIPVADIKAIVTGKDCPHMKEKSALKQNKEVLGIGLLPSCMNPDETFNFIAPNKYE

SEQ ID NO: 885846 - protein, 660 aa, Homo sapiens
MPPPSDIVKVAIEWPGANAQLLEIDQKRPLASIIKEVCDGWSLPNPEYYTLRYADGPQLYITEQTRSDIKNGTILQLAISPSRAARQLMERTQSSNMETRLDAMKELAKLSADVTFATEFINMDGIIVLTRLVESGTKLLSHYSEMLAFTLTAFLELMDHGIVSWDMVSITFIKQIAGYVSQPMVDVSILQRSLAILESMVLNSQSLYQKIAEEITVGQLISHLQVSNQEIQTYAIALINALFLKAPEDKRQDMANAFAQKHLRSIILNHVIRGNRPIKTEMAHQLYVLQVLTFNLLEERMMTKMDPNDQAQRDIIFELRRIAFDAESDPSNAPGSGTEKRKAMYTKDYKMLGFTNHINPAMDFTQTPPGMLALDNMLYLAKVHQDTYIRIVLENSSREDKHECPFGRSAIELTKMLCEILQVGELPNEGRNDYHPMFFTHDRAFEELFGICIQLLNKTWKEMRATAEDFNKVMQVVREQITRALPSKPNSLDQFKSKLRSLSYSEILRLRQSERMSQDDFQSPPIVELREKIQPEILELIKQQRLNRLCEGSSFRKIGNRRRQERFWYCRLALNHKVLHYGDLDDNPQGEVTFESLQEKIPVADIKAIVTGKDCPHMKEKSALKQNKVSREASLSSWPSDTWRVPLVVVFSRCILGIFP

SEQ ID NO: 885847 - protein, 343 aa, Homo sapiens
MHWFQWGKAFPYGRVLGPWLGEVQWFWFQIGHSSIVSMEFCQLENHINPAMDFTQTPPGMLALDNMLYLAKVHQDTYIRIVLENSSREDKHECPFGRSAIELTKMLCEILQVGELPNEGRNDYHPMFFTHDRAFEELFGICIQLLNKTWKEMRATAEDFNKVMQVVREQITRALPSKPNSLDQFKSKLRSLSYSEILRLRQSERMSQDDFQSPPIVELREKIQPEILELIKQQRLNRLCEGSSFRKIGNRRRQERFWYCRLALNHKVLHYGDLDDNPQGEVTFESLQEKIPVADIKAIVTGKDCPHMKEKSALKQNKEVLGIGLLPSCMNPDETFNFIAPNKY

SEQ ID NO: 885848 - protein, 121 aa, Homo sapiens
NHINPAMDFTQTPPGMLALDNMLYLAKVHQDTYIRVKAGELAFSVLVPHLLPSSFISLILPFSSPDRLSWRTVAGKTNMNAPLAAVPLSSPKCSVKSCRLGNYVSLCSSLFFSHSLSSRAQ

SEQ ID NO: 885849 - protein, 479 aa, Homo sapiens; identical to SEQ ID NO: 739431

SEQ ID NO: 885850 - protein, 296 aa, Homo sapiens
MVDVSILQRSLAILESMVLNSQSLYQKIAEEITVGQLISHLQVSNQEIQTYAIALINALFLKAPEDKRQDMANAFAQKHLRSIILNHVIRGNRPIKTEMAHQLYVLQVLTFNLLEERMMTKMDPNDQAQRDIIFELRRIAFDAESDPSNAPGSGTEKRKAMYTKDYKMLGFTNHINPAMDFTQTPPGMLALDNMLYLAKVHQDTYIRIVLENSSREDKHECPFGRSAIELTKMLCEILQVGELPNEGRNDYHPMFFTHDRAFEELFGICIQLLNKTWKEMRATAEDFNKVSVSGLL

SEQ ID NO: 885851 - protein, 391 aa, Homo sapiens; identical to SEQ ID NO: 885843

SEQ ID NO: 885852 - protein, 655 aa, Homo sapiens
MPPPSDIVKVAIEWPGANAQLLEIDQKRPLASIIKEVCDGWSLPNPEYYTLRYADGPQLYITEQTRSDIKNGTILQLAISPSRAARQLMERTQSSNMETRLDAMKELAKLSADVTFATEFINMDGIIVLTRLVESGTKLLSHYSEMLAFTLTAFLELMDHGIVSWDMVSITFIKQIAGYVSQPMVDVSILQRSLAILESMVLNSQSLYQKIAEEITVGQLISHLQVSNQEIQTYAIALINALFLKAPEDKRQDMANAFAQKHLRSIILNHVIRGNRPIKTEMAHQLYVLQVLTFNLLEERMMTKMDPNDQAQRDIIFELRRIAFDAESDPSNAPGSGTEKRKAMYTKDYKMLGFTNHINPAMDFTQTPPGMLALDNMLYLAKVHQDTYIRIVLENSSREDKHECPFGRSAIELTKMLCEILQVGELPNEGRNDYHPMFFTHDRAFEELFGICIQLLNKTWKEMRATAEDFNKVMQVVREQITRALPSKPNSLDQFKSKLRSLSYSEILRLRQSERMSQDDFQSPPIVELREKIQPEILELIKQQRLNRLCEGSSFRKIGNRRRQERFWYCRLALNHKVLHYGDLDDNPQGEVTFESLQEKIPVADIKAIVTGKDCPHMKEKSALKQNKEVLGIGLLPSCMNPDETFNFIAPNKYE

SEQ ID NO: 885853 - protein, 387 aa, Homo sapiens
MHVIRGNRPIKTEMAHQLYVLQVLTFNLLEERMMTKMDPNDQAQRDIIFELRRIAFDAESDPSNAPGSGTEKRKAMYTKDYKMLGFTNHINPAMDFTQTPPGMLALDNMLYLAKVHQDTYIRIVLENSSREDKHECPFGRSAIELTKMLCEILQVGELPNEGRNDYHPMFFTHDRAFEELFGICIQLLNKTWKEMRATAEDFNKVMQVVREQITRALPSKPNSLDQFKSKLRSLSYSEILRLRQSERMSQDDFQSPPIVELREKIQPEILELIKQQRLNRLCEGSSFRKIGNRRRQERFWYCRLALNHKVLHYGDLDDNPQGEVTFESLQEKIPVADIKAIVTGKDCPHMKEKSALKQNKEVLGIGLLPSCMNPDETFNFIAPNKYE

SEQ ID NO: 885854 - protein, 145 aa, Homo sapiens
MPPPSDIVKVAIEWPGANAQLLEIDQKRPLASIIKEVCDGWSLPNPEYYTLRYADGPQLYITEQTRSDIKNGTILQLAISPSRAARQLMERTQSSNMETRLDAMKELAKLSADVTFATEFINMDGIIVLTRLVESGTKLLSQYLG

SEQ ID NO: 885855 - protein, 71 aa, Homo sapiens
AVSVFLSRRIRAHWERCHHRQTLSKWPLSGQVLTPSSLKSTRYAPEVRSSGSRKGTWGVHGRGHLEGWGPP

SEQ ID NO: 885856 - protein, 105 aa, Homo sapiens
MQITTDWFWHTNNSLIDSTNIYLATPKLCEKTSSASGLDVHRRASVSYPQSSNLLQGADGTYLVPGLLVPGCTPADGEDPVIQHGDPAGCHEGAGQALCRRDFRY

SEQ ID NO: 885857 - protein, 479 aa, Homo sapiens
MAVLGVQLVVTLLTATLMHRLAPHCSFARWLLCNGSLFRYKHPSEEELRALAGKPRPRGRKERWANGLSEEKPLSVPRDAPFQLETCPLTTVDALVLRFFLEYQWFVDFAVYSGGVYLFTEAYYYMLGPAKETNIAVFWCLLTVTFSIKMFLTVTRLYFSAEEGGERSVCLTFAFLFLLLAMLVQVVREETLELGLEPGLASMTQNLEPLLKKQGWDWALPVAKLAIRVGLAVVGSVLGAFLTFPGLRLAQTHRDALTMSEDRPMLQFLLHTSFLSPLFILWLWTKPIARDFLHQPPFGETRFSLLSDSAFDSGRLWLLVVLCLLRLAVTRPHLQAYLCLAKARVEQLRREAGRIEAREIQQRVVRVYCYVTVVSLQYLTPLILTLNCTLLLKTLGGYSWGLGPAPLLSPDPSSASAAPIGSGEDEVQQTAARIAGALGGLLTPLFLRGVLAYLIWWTAACQLLASLFGLYFHQHLAGS

SEQ ID NO: 885858 - protein, 477 aa, Homo sapiens
MAVLGVQLVVTLLTATLMHRLAPHCSFARWLLCNGSLFRYKHPSEEELRALAGKPRPRGRKERWANGLSEEKPLSVPRDAPFQLETCPLTTVDALVLRFFLEYQWFVDFAVYSGGVYLFTEAYYYMLGPAKETNIAVFWCLLTVTFSIKMFLTVTRLYFSAEEGGERSVCLTFAFLFLLLAMLVQVVREETLELGLEPGLASMTQNLEPLLKKQGWDWALPVAKLAIRVGLAVVGSVLGAFLTFPGLRLAQTHRDALTMSEDRPMLQFLLHTSFLSPLFILWLWTKPIARDFLHQPPFGETRFSLLSDSAFDSGRLWLLVVLCLLRLAVTRPHLQAYLCLAKARVEQLRREAGRIEAREIQQRVVRVYCYVTVVSLQYLTPLILTLNCTLLLKTLGGYSWGLGPAPLLSPDPSSASAAPIGSGEDEVQQTAARIAGALGGLLTPLFLRGVLAYLICGGAAVSQLWLTSQHWSPTAGL

SEQ ID NO: 885859 - protein, 450 aa, Homo sapiens
MPVLALSLFRYKHPSEEELRALAGKPRPRGRKERWANGLSEEKPLSVPRDAPFQLETCPLTTVDALVLRFFLEYQWFVDFAVYSGGVYLFTEAYYYMLGPAKETNIAVFWCLLTVTFSIKMFLTVTRLYFSAEEGGERSVCLTFAFLFLLLAMLVQVVREETLELGLEPGLASMTQNLEPLLKKQGWDWALPVAKLAIRVGLAVVGSVLGAFLTFPGLRLAQTHRDALTMSEDRPMLQFLLHTSFLSPLFILWLWTKPIARDFLHQPPFGETRFSLLSDSAFDSGRLWLLVVLCLLRLAVTRPHLQAYLCLAKARVEQLRREAGRIEAREIQQRVVRVYCYVTVVSLQYLTPLILTLNCTLLLKTLGGYSWGLGPAPLLSPDPSSASAAPIGSGEDEVQQTAARIAGALGGLLTPLFLRGVLAYLIWWTAACQLLASLFGLYFHQHLAGS

SEQ ID NO: 885860 - protein, 459 aa, Homo sapiens
SPRPVGECTAFSHASCLFRYKHPSEEELRALAGKPRPRGRKERWANGLSEEKPLSVPRDAPFQLETCPLTTVDALVLRFFLEYQWFVDFAVYSGGVYLFTEAYYYMLGPAKETNIAVFWCLLTVTFSIKMFLTVTRLYFSAEEGGERSVCLTFAFLFLLLAMLVQVVREETLELGLEPGLASMTQNLEPLLKKQGWDWALPVAKLAIRVGLAVVGSVLGAFLTFPGLRLAQTHRDALTMSEDRPMLQFLLHTSFLSPLFILWLWTKPIARDFLHQPPFGETRFSLLSDSAFDSGRLWLLVVLCLLRLAVTRPHLQAYLCLAKARVEQLRREAGRIEAREIQQRVVRVYCYVTVVSLQYLTPLILTLNCTLLLKTLGGYSWGLGPAPLLSPDPSSASAAPIGSGEDEVQQTAARIAGALGGLLTPLFLRGVLAYLIWWTAACQLLASLFGLYFHQHLAGS

SEQ ID NO: 885861 - protein, 454 aa, Homo sapiens
MAVLGVQLVVTLLTATLMHRLAPHCSFARWLLCNGSLFRYKHPSEEELRALAGKPRPRGRKERWANGLSEEKPLSVPRDAPFQLETCPLTTVDALEAYYYMLGPAKETNIAVFWCLLTVTFSIKMFLTVTRLYFSAEEGGERSVCLTFAFLFLLLAMLVQVVREETLELGLEPGLASMTQNLEPLLKKQGWDWALPVAKLAIRVGLAVVGSVLGAFLTFPGLRLAQTHRDALTMSEDRPMLQFLLHTSFLSPLFILWLWTKPIARDFLHQPPFGETRFSLLSDSAFDSGRLWLLVVLCLLRLAVTRPHLQAYLCLAKARVEQLRREAGRIEAREIQQRVVRVYCYVTVVSLQYLTPLILTLNCTLLLKTLGGYSWGLGPAPLLSPDPSSASAAPIGSGEDEVQQTAARIAGALGGLLTPLFLRGVLAYLIWWTAACQLLASLFGLYFHQHLAGS

SEQ ID NO: 885862 - protein, 513 aa, Homo sapiens
MAVLGVQLVVTLLTATLMHRLAPHCSFARWLLCNGSLFRYKHPSEEELRALAGKPRPRGRKERWANGLSEEKPLSVPRDAPFQLETCPLTTVDALVLRFFLEYQWFVDFAVYSGGVYLFTEAYYYMLGPAKETNIAVFWCLLTVTFSIKMFLTVTRLYFSAEEGGERSVCLTFAFLFLLLAMLVQVVREETLELGLEPGLASMTQNLEPLLKKQGWDWALPVAKLAIRVGLAVVGSVLGAFLTFPGLRLAQTHRDALTMSEDRPMLQLSGSLGGWGDRELKGETRGEGVPRPHSLLPSPPRFLLHTSFLSPLFILWLWTKPIARDFLHQPPFGETRFSLLSDSAFDSGRLWLLVVLCLLRLAVTRPHLQAYLCLAKARVEQLRREAGRIEAREIQQRVVRVYCYVTVVSLQYLTPLILTLNCTLLLKTLGGYSWGLGPAPLLSPDPSSASAAPIGSGEDEVQQTAARIAGALGGLLTPLFLRGVLAYLIWWTAACQLLASLFGLYFHQHLAGS

SEQ ID NO: 885863 - protein, 364 aa, Homo sapiens
MFLTVTRLYFSAEEGGERSVCLTFAFLFLLLAMLVQVVREETLELGLEPGLASMTQNLEPLLKKQGWDWALPVAKLAIRVGLAVVGSVLGAFLTFPGLRLAQTHRDALTMSEDRPMLQLSGSLGGWGDWELKGETRGEGVPRPHSLLPSPPRFLLHTSFLSPLFILWLWTKPIARDFLHQPPFGETRFSLLSDSAFDSGRLWLLVVLCLLRLAVTRPHLQAYLCLAKARVEQLRREAGRIEAREIQQRVVRVYCYVTVVSLQYLTPLILTLNCTLLLKTLGGYSWGLGPAPLLSPDPSSASAAPIGSGEDEVQQTAARIAGALGGLLTPLFLRGVLAYLIWWTAACQLLASLFGLYFHQHLAGS

SEQ ID NO: 885864 - protein, 112 aa, Homo sapiens
LKLLISDDPPASASQSAGITGVNHHSNLVSCKKYCVTRAQNCPCAWLRAWQTLVHSYLGSKRMPEGWGVREQSGLRDPRNSLYSVLFLSSPGLASMTQNLEPLLKKQGWDWA

SEQ ID NO: 885865 - protein, 479 aa, Homo sapiens; identical to SEQ ID NO: 885857

SEQ ID NO: 885866 - protein, 484 aa, Homo sapiens
MSPTRQAVLGVQLVVTLLTATLMHRLAPHCSFARWLLCNGSLFRYKHPSEEELRALAGKPRPRGRKERWANGLSEEKPLSVPRDAPFQLETCPLTTVDALVLRFFLEYQWFVDFAVYSGGVYLFTEAYYYMLGPAKETNIAVFWCLLTVTFSIKMFLTVTRLYFSAEEGGERSVCLTFAFLFLLLAMLVQVVREETLELGLEPGLASMTQNLEPLLKKQGWDWALPVAKLAIRVGLAVVGSVLGAFLTFPGLRLAQTHRDALTMSEDRPMLQFLLHTSFLSPLFILWLWTKPIARDFLHQPPFGETRFSLLSDSAFDSGRLWLLVVLCLLRLAVTRPHLQAYLCLAKARVEQLRREAGRIEAREIQQRVVRVYCYVTVVSLQYLTPLILTLNCTLLLKTLGGYSWGLGPAPLLSPDPSSASAAPIGSGEDEVQQTAARIAGALGGLLTPLFLRGVLAYLIWWTAACQLLASLFGLYFHQHLAGS

SEQ ID NO: 885867 - protein, 354 aa, Homo sapiens
MLGPAKETNIAVFWCLLTVTFSIKMFLTVTRLYFSAEEGGERSVCLTFAFLFLLLAMLVQVVREETLELGLEPGLASMTQNLEPLLKKQGWDWALPVAKLAIRVGLAVVGSVLGAFLTFPGLRLAQTHRDALTMSEDRPMLQFLLHTSFLSPLFILWLWTKPIARDFLHQPPFGETRFSLLSDSAFDSGRLWLLVVLCLLRLAVTRPHLQAYLCLAKARVEQLRREAGRIEAREIQQRVVRVYCYVTVVSLQYLTPLILTLNCTLLLKTLGGYSWGLGPAPLLSPDPSSASAAPIGSGEDEVQQTAARIAGALGGLLTPLFLRGVLAYLIWWTAACQLLASLFGLYFHQHLAGS

SEQ ID NO: 885868 - protein, 475 aa, Homo sapiens
SPRPVGECTAFSHASCLFRYKHPSEEELRALAGKPRPRGRKERWANGLSEEKPLSVPRDAPFQLETCPLTTVDALGGELSWAPGLSRVPPTVLRFFLEYQWFVDFAVYSGGVYLFTEAYYYMLGPAKETNIAVFWCLLTVTFSIKMFLTVTRLYFSAEEGGERSVCLTFAFLFLLLAMLVQVVREETLELGLEPGLASMTQNLEPLLKKQGWDWALPVAKLAIRVGLAVVGSVLGAFLTFPGLRLAQTHRDALTMSEDRPMLQFLLHTSFLSPLFILWLWTKPIARDFLHQPPFGETRFSLLSDSAFDSGRLWLLVVLCLLRLAVTRPHLQAYLCLAKARVEQLRREAGRIEAREIQQRVVRVYCYVTVVSLQYLTPLILTLNCTLLLKTLGGYSWGLGPAPLLSPDPSSASAAPIGSGEDEVQQTAARIAGALGGLLTPLFLRGVLAYLIWWTAACQLLASLFGLYFHQHLAGS

SEQ ID NO: 885869 - protein, 528 aa, Homo sapiens
MAVLGVQLVVTLLTATLMHRLAPHCSFARWLLCNGSLFRYKHPSEEELRALAGKPRPRGRKERWANGLSEEKPLSVPRDAPFQLETCPLTTVDALGNSPVPSLNSTPSALKVSTPSGGGEDLKEECSIRRGASWAPGLSRVPPTVLRFFLEYQWFVDFAVYSGGVYLFTEAYYYMLGPAKETNIAVFWCLLTVTFSIKMFLTVTRLYFSAEEGGERSVCLTFAFLFLLLAMLVQVVREETLELGLEPGLASMTQNLEPLLKKQGWDWALPVAKLAIRVGLAVVGSVLGAFLTFPGLRLAQTHRDALTMSEDRPMLQFLLHTSFLSPLFILWLWTKPIARDFLHQPPFGETRFSLLSDSAFDSGRLWLLVVLCLLRLAVTRPHLQAYLCLAKARVEQLRREAGRIEAREIQQRVVRVYCYVTVVSLQYLTPLILTLNCTLLLKTLGGYSWGLGPAPLLSPDPSSASAAPIGSGEDEVQQTAARIAGALGGLLTPLFLRGVLAYLIWWTAACQLLASLFGLYFHQHLAGS

SEQ ID NO: 885870 - protein, 349 aa, Homo sapiens
MEAHNASAPFNFTLPPNFGKRPTDLALSVILVFMLFFIMLSLGCTMEFSKIKAHLWKPKGLAIALVAQYGIMPLTAFVLGKVFRLKNIEALAILVCGCSPGGNLSNVFSLAMKGDMNLSIVMTTCSTFCALGMMPLLLYIYSRGIYDGDLKDKVPYKGIVISLVLVLIPCTIGIVLKSKRPQYMRYVIKGGMIIILLCSVAVTVLSAINVGKSIMFAMTPLLIATSSLMPFIGFLLGYVLSALFCLNGRCRRTVSMETGCQNVQLCSTILNVAFPPEVIGPLFFFPLLYMIFQLGEGLLLIAIFWCYEKFKTPKDKTKMIYTAATTEETIPGALGNGTYKGEDCSPCTA

SEQ ID NO: 885871 - protein, 283 aa, Homo sapiens
PENALHLAEAGGLCGESRARGQQRLLHSGGPGFGRPPIGLADWLTDTPRLPPPPPVPRPASSLPPLPGLGGRRQTEAPLSPRPSPRPFLFPAPRLLPGSGSSCVGGPHSSERREEAASRMKCKPNQTRTYDPEGFKKRAACLCFRSEREDEVLLVSSSRYPDRWIVPGGGMEPEEEPGGAAVREVYEEAGVKGKLGRLLGVFEQNQDPKHRTYVYVLTVTELLEDWEDSVSIGRKREWFKVEDAIKVLQCHKPVHAEYLEKLKLGGSPTNGNSMAPSSPDSDP

SEQ ID NO: 885872 - protein, 283 aa, Homo sapiens; identical to SEQ ID NO: 885871

SEQ ID NO: 885873 - protein, 265 aa, Homo sapiens
MPTTTKFAAASTLRALCPVTGIERCRLKTPSVSDAVAMAICQFFLQGRCRFGDRCWNEHPGARGAGGGRQQPQQQPSGNNRRGWNTTSQRYSNVIQPSSFSKSTPWGGSRDQEKPYFSSFDSGASTNRKEGFGLSENPFASLSPDEQKDEKKLLEGIVKDMEVWESSGQWMFSVYSPVKKKPNISGFTDISPEELRLEYHNFLTSNNLQSYLNSVQRLINQWRNRVNELKSLNISTKVALKCLWKIYTHLSPKIYGPDCGKFIIF

SEQ ID NO: 885874 - protein, 460 aa, Homo sapiens
PPTTTKFAAASTLRALCPVTGIERCRLKTPSVSDAVAMAICQFFLQGRCRFGDRCWNEHPGARGAGGGRQQPQQQPSGNNRRGWNTTSQRYSNVIQPSSFSKSTPWGGSRDQEKPYFSSFDSGASTNRKEGFGLSENPFASLSPDEQKDEKKLLEGIVKDMEVWESSGQWMFSVYSPVKKKPNISGFTDISPEELRLEYHNFLTSNNLQSYLNSVQRLINQWRNRVNELKSLNISTKVALLSDVKDGVNQAAPAFGFGSSQAATFMSPGFPVNNSSSDNAQNFSFKTNSGFAAASSGSPAGFGSSPAFGAAASTSSGISTSAPAFGFGKPEVTSAASFSFKSPAASSFGSPGFSGLPASLATGPVRAPVAPAFGGGSSVAGFGSPGSHSHTAFSKPSSDTFGNSSISTSLSASSSIIATDNVLFTPRDKLTVEELEQFQSKKFTLGKIPLKPPPLELLNV

SEQ ID NO: 885875 - protein, 482 aa, Homo sapiens
PPTTTKFAAASTLRALCPVTGIERCRLKTPSVSDAVAMAICQFFLQGRCRFGDRCWNEHPGARGAGGGRQQPQQQPSGNNRRGWNTTSQRYSNVIQPSSFSKSTPWGGSRDQEKPYFSSFDSGASTNRKEGFGLSENPFASLSPDEQKDEKKLLEGIVKDMEVWESSGQWMFSVYSPVKKKPNISGFTDISPEELRLEYHNFLTSNNLQSYLNSVQRLINQWRNRVNELKSLNISTKVALKCLWKIYTHLSPKIYGPDCGKFLSDVKDGVNQAAPAFGFGSSQAATFMSPGFPVNNSSSDNAQNFSFKTNSGFAAASSGSPAGFGSSPAFGAAASTSSGISTSAPAFGFGKPEVTSAASFSFKSPAASSFGSPGFSGLPASLATGPVRAPVAPAFGGGSSVAGFGSPGSHSHTAFSKPSSDTFGNSSISTSLSASSSIIATDNVLFTPRDKLTVEELEQFQSKKFTLGKIPLKPPPLELLNV

SEQ ID NO: 885876 - protein, 179 aa, Homo sapiens
MAICQFFLQGRCRFGDRCWNEHPGARGAGGGRQQPQQQPSGNNRRGWNTTSQRYSNVIQPSSFSKSTPWGGSRDQEKPYFSSFDSGASTNRKEGFGLSENPFASLSPDEQKDEKKLLEGIVKDMEVWESSGQWMFSVYSPVKKKPNISDVFGVYSFWWGPWSRWLRSEAVDLRGECYGS

SEQ ID NO: 885877 - protein, 300 aa, Homo sapiens
MEVWESSGQWMFSVYSPVKKKPNISGFTDISPEELRLEYHNFLTSNNLQSYLNSVQRLINQWRNRVNELKSLNISTKVALLSDVKDGVNQAAPAFGFGSSQAATFMSPGFPVNNSSSDNAQNFSFKTNSGFAAASSGSPAGFGSSPAFGAAASTSSGISTSAPAFGFGKPEVTSAASFSFKSPAASSFGSPGFSGLPASLATGPVRAPVAPAFGGGSSVAGFGSPGSHSHTAFSKPSSDTFGNSSISTSLSASSSIIATDNVLFTPRDKLTVEELEQFQSKKFTLGKIPLKPPPLELLNV

SEQ ID NO: 885878 - protein, 164 aa, Homo sapiens
MAICQFFLQGRCRFGDRCWNEHPGARGAGGGRQQPQQQPSGNNRRGWNTTSQRYSNVIQPSSFSKSTPWGGSRDQEKPYFSSFDSGASTNRKEGFGLSENPFASLSPDEQKDEKKLLEGIVKDMEVWESSGQWMFSVYSPVKKKPNISAKFCPTFNKSMEEQGK

SEQ ID NO: 885879 - protein, 475 aa, Homo sapiens
PPTTTKFAAASTLRALCPVTGIERCRLKTPSVSDAVAMAICQFFLQGRCRFGDRCWNEHPGARGAGGGRQQPQQQPSGNNRRGWNTTSQRYSNVIQPSSFSKSTPWGGSRDQEKPYFSSFDSGASTNRKEGFGLSENPFASLSPDEQKDEKKLLEGIVKDMEVWESSGQWMFSVYSPVKKKPNISGFTDISPEELRLEYHNFLTSNNLQSYLNSVQRLINQWRNRVNELKSLNISTKVALKCLWKIYTHLSPKIYGPDCGKFLSDVKDGVNQAAPAFGFGSSQAATFMSPGFPVNNSSSDNAQNFSFKTNSGFAAASSGSPAGFGSSPAFGAAASTSSGISTSAPAFGFGKPEVTSAASFSFKSPAASSFGSPGFSGLPASLATGPVRAPVAPAFGGGSSVAGFGSPGSHSHTAFSKPSSDTFGNSSISTSLSASSSIIATDNVLFTPRDKLTVEELEQFQSKKFTLGKIPLSSL

SEQ ID NO: 885880 - protein, 150 aa, Homo sapiens
MAICQFFLQGRCRFGDRCWNEHPGARGAGGGRQQPQQQPSGNNRRGWNTTSQRYSNVIQPSSFSKSTPWGGSRDQEKPYFSSFDSGASTNRKEGFGLSENPFASLSPDEQKDEKKLLEGIVKDMEVWESSGQWMFSVYSPVKKKPNISGN

SEQ ID NO: 885881 - protein, 155 aa, Homo sapiens
MAICQFFLQGRCRFGDRCWNEHPGARGAGGGRQQPQQQPSGNNRRGWNTTSQRYSNVIQPSSFSKSTPWGGSRDQEKPYFSSFDSGASTNRKEGFGLSENPFASLSPDEQKDEKKLLEGIVKDMEVWESSGQWMFSVYSPVKKKPNISVPKPFLG

SEQ ID NO: 885882 - protein, 423 aa, Homo sapiens
MAICQFFLQGRCRFGDRCWNEHPGARGAGGGRQQPQQQPSGNNRRGWNTTSQRYSNVIQPSSFSKSTPWGGSRDQEKPYFSSFDSGASTNRKEGFGLSENPFASLSPDEQKDEKKLLEGIVKDMEVWESSGQWMFSVYSPVKKKPNISGFTDISPEELRLEYHNFLTSNNLQSYLNSVQRLINQWRNRVNELKSLNISTKVALLSDVKDGVNQAAPAFGFGSSQAATFMSPGFPVNNSSSDNAQNFSFKTNSGFAAASSGSPAGFGSSPAFGAAASTSSGISTSAPAFGFGKPEVTSAASFSFKSPAASSFGSPGFSGLPASLATGPVRAPVAPAFGGGSSVAGFGSPGSHSHTAFSKPSSDTFGNSSISTSLSASSSIIATDNVLFTPRDKLTVEELEQFQSKKFTLGKIPLKPPPLELLNV

SEQ ID NO: 885883 - protein, 423 aa, Homo sapiens; identical to SEQ ID NO: 885882

SEQ ID NO: 885884 - protein, 179 aa, Homo sapiens; identical to SEQ ID NO: 885876

SEQ ID NO: 885885 - protein, 151 aa, Homo sapiens
FVLLFILGNNRRGWNTTSQRYSNVIQPSSFSKSTPWGGSRDQEKPYFSSFDSGASTNRKEGFGLSENPFASLSPDEQKDEKKLLEGIVKDMEVWESSGQWMFSVYSPVKKKPNISGFTDISPEELRLEYHNFLTSNNLQSYVSLFPINLLQ

SEQ ID NO: 885886 - protein, 195 aa, Homo sapiens
MSPGFPVNNSSSDNAQNFSFKTNSGFAAASSGSPAGFGSSPAFGAAASTSSGISTSAPAFGFGKPEVTSAASFSFKSPAASSFGSPGFSGLPASLATGPVRAPVAPAFGGGSSVAGFGSPGSHSHTAFSKPSSDTFGNSSISTSLSASSSIIATDNVLFTPRDKLTVEELEQFQSKKFTLGKIPLKPPPLELLNV

SEQ ID NO: 885887 - protein, 233 aa, Homo sapiens
MAICQFFLQGRCRFGDRCWNEHPGARGAGGGRQQPQQQPSGNNRRGWNTTSQRYSNVIQPSSFSKSTPWGGSRDQEKPYFSSFDSGASTNRKEGFGLSENPFASLSPDEQKDEKKLLEGIVKDMEVWESSGQWMFSVYSPVKKKPNISGFTDISPEELRLEYHNFLTSNNLQSYLNSVQRLINQWRNRVNELKSLNISTKVALLSDVKDGVNQAAPAFGFGSSQAATFMSPGK

SEQ ID NO: 885888 - protein, 341 aa, Homo sapiens
GIWRQGTSEEDSTAVYARWHGPRQKREGENCFLVVGHRGTGSSILSALQDLFSVTWLNRSKVEKQLQVISVLQWVLSFLVLGVACSAILMYIFCTDCWLIAVLYFTWLVFDWNTPKKGGRRSQWVRNWAVWRYFRDYFPIQLVKTHNLLTTRNYIFGYHPHGIMGLGAFCNFSTEATEVSKKFPGIRPYLATLAGNFRMPVLREYLMSGGICPVQRDTIELLRSNDRDWQAIIITAAEAGETLKPSREKAPREPRVVNRAPGRRHPGCPPNPWGEKKGQAGEFTEGTRSTASRQDPKNSSVPARTGEETSRRGGEHTPEGGDTTDKHNTHSISQTTVHAEI

SEQ ID NO: 885889 - protein, 43 aa, Homo sapiens
MREDEAATQQTPSTVRKAIRRKDRRVKEQQKNTETHSSGRISR

SEQ ID NO: 885890 - protein, 388 aa, Homo sapiens
MKTLIAAYSGVLRGERQAEADRSQRSHGGPALSREGSGRWGTGSSILSALQDLFSVTWLNRSKVEKQLQVISVLQWVLSFLVLGVACSAILMYIFCTDCWLIAVLYFTWLVFDWNTPKKGGRRSQWVRNWAVWRYFRDYFPIQLVKTHNLLTTRNYIFGYHPHGIMGLGAFCNFSTEATEVSKKFPGIRPYLATLAGNFRMPVLREYLMSGGICPVSRDTIDYLLSKNGSGNAIIIVVGGAAESLSSMPGKNAVTLRNRKGFVKLALRHGADLVPIYSFGENEVYKQVIFEEGSWGRWVQKKFQKYIGFAPCIFHGRGLFSSDTWGLVPYSKPITTVVGEPITIPKLEHPTQQDIDLYHTMYMEALVKLFDKHKTKFGLPETEVLEVN

SEQ ID NO: 885891 - protein, 297 aa, Homo sapiens
MYIFCTDCWLIAVLYFTWLVFDWNTPKKGGRRSQWVRNWAVWRYFRDYFPIQLVKTHNLLTTRNYIFGYHPHGIMGLGAFCNFSTEATEVSKKFPGIRPYLATLAGNFRMPVLREYLMSGGICPVSRDTIDYLLSKNGSGNAIIIVVGGAAESLSSMPGKNAVTLRNRKGFVKLALRHGADLVPIYSFGENEVYKQVIFEEGSWGRWVQKKFQKYIGFAPCIFHGRGLFSSDTWGLVPYSKPITTVVGEPITIPKLEHPTQQDIDLYHTMYMEALVKLFDKHKTKFGLPETEVLEVN

SEQ ID NO: 885892 - protein, 388 aa, Homo sapiens; identical to SEQ ID NO: 885890

SEQ ID NO: 885893 - protein, 388 aa, Homo sapiens; identical to SEQ ID NO: 885890

SEQ ID NO: 885894 - protein, 148 aa, Homo sapiens
HRPTAPEHVAVHFGTCSFPRQDGRSRGLCAARRWSLRCREQSDLPAASHVLVCWGLVLIRSEFTVYHELEGPNWDHLLPLEGPDGVSPLRLPLTHPPPLCRQGRKDNREEGVLLGDHLDNISPMASWIPVDYFELKTFHKMGMKDSFK

SEQ ID NO: 885895 - protein, 122 aa, Homo sapiens
MTAPGPHPQLWGKSGGGEGGCCSLSVGGRVWGEDPELSPQVTQEELRPREVQRLAQGCTASTGTDVALRGLGFQQGETRTPVIASRWIPEISDLPAASHVLVCWGLVLIRSEFTVYHELEGS

SEQ ID NO: 885896 - protein, 132 aa, Homo sapiens
WRQLARGWGALSRASCPALPRLANNTVRMAKGDPKKPKGKMSAYAFFVQTCREEHKKKNPEVPVNFAEFSKKCSERWKTMSGKESNLMNGKQISRYDRNEDMATRRQREVYLQSPLISVCQIASHPTRIYWS

SEQ ID NO: 885897 - protein, 228 aa, Homo sapiens
WRQLARGWGALSRASCPALPRLANNTVRMAKGDPKKPKGKMSAYAFFVQTCREEHKKKNPEVPVNFAEFSKKCSERWKTMSGKEKSKFDEMAKADKVRYDREMKDYGPAKGGKKKKDPNAPKRPPSGFFLFCSEFRPKIKSTNPGISIGDVAKKLGEMWNNLNDSEKQPYITKAAKLKEKYEKDVADYKSKGKFDGAKGPAKVARKKVEEEDEEEEEEEEEEEEEEDE

SEQ ID NO: 885898 - protein, 217 aa, Homo sapiens
MEILPARKRNPFIIRIRMAKGDPKKPKGKMSAYAFFVQTCREEHKKKNPEVPVNFAEFSKKCSERWKTMSGKEKSKFDEMAKADKVRYDREMKDYGPAKGGKKKKDPNAPKRPPSGFFLFCSEFRPKIKSTNPGISIGDVAKKLGEMWNNLNDSEKQPYITKAAKLKEKYEKDVADYKSKGKFDGAKGPAKVARKKVEEEDEEEEEEEEEEEEEEDE

SEQ ID NO: 885899 - protein, 239 aa, Homo sapiens
ETYWQLAPPWEVSTGGARTRYYYRICQPSRLIVERSILRMAKGDPKKPKGKMSAYAFFVQTCREEHKKKNPEVPVNFAEFSKKCSERWKTMSGKEKSKFDEMAKADKVRYDREMKDYGPAKGGKKKKDPNAPKRPPSGFFLFCSEFRPKIKSTNPGISIGDVAKKLGEMWNNLNDSEKQPYITKAAKLKEKYEKDVADYKSKGKFDGAKGPAKVARKKVEEEDEEEEEEEEEEEEEEDE

SEQ ID NO: 885900 - protein, 117 aa, Homo sapiens
VDLEDPRICFHQATSGFFLFCSEFRPKIKSTNPGISIGDVAKKLGEMWNNLNDSEKQPYITKAAKLKEKYEKDVADYKSKGKFDGAKGPAKVARKKVEEEDEEEEEEEEEEEEEEDE

SEQ ID NO: 885901 - protein, 104 aa, Homo sapiens
INRACTGVIMHLSMIKSTNPGISIGDVAKKLGEMWNNLNDSEKQPYITKAAKLKEKYEKDVADYKSKGKFDGAKGPAKVARKKVEEEDEEEEEEEEEEEEEEDE

SEQ ID NO: 885902 - protein, 157 aa, Homo sapiens
MAKGDPKKPKGKMSAYAFFVQTCREEHKKKNPEVPVNFAEFSKKCSERWKTMSGKEKSKFDEMAKADKVRYDREMKDYGPAKGGKKKKDPNAPKRPPSGFFLFCSEFRPKIKSTNPGISIGDVAKKLGEMWNNLNDSEKQPYITKAAKLKEKYEKDE

SEQ ID NO: 885903 - protein, 179 aa, Homo sapiens
TSCQFLLAFPHCISLFLFYHIRMAKGDPKKPKGKMSAYAFFVQTCREEHKKKNPEVPVNFAEFSKKCSERWKTMSGKEKSKFDEMAKADKVRYDREMKDYGPAKGGKKKKDPNAPKRPPSGFFLFCSEFRPKIKSTNPGISIGDVAKKLGEMWNNLNDSEKQPYITKAAKLKEKYEKDE

SEQ ID NO: 885904 - protein, 228 aa, Homo sapiens; identical to SEQ ID NO: 885897

SEQ ID NO: 885905 - protein, 228 aa, Homo sapiens; identical to SEQ ID NO: 885897

SEQ ID NO: 885906 - protein, 228 aa, Homo sapiens; identical to SEQ ID NO: 885897

SEQ ID NO: 885907 - protein, 156 aa, Homo sapiens
MAKGDPKKPKGKMSAYAFFVQTCREEHKKKNPEVPVNFAEFSKKCSERWKTMSGKEKSKFDEMAKADKVRYDREMKDYGPAKGGKKKKDPNAPKRPPSGFFLFCSEFRPKIKSTNPGISIGDVAKKLGEMWNNLNDSEKQPYITKAAKLKEKYEKV

SEQ ID NO: 885908 - protein, 769 aa, Homo sapiens
LGWRECPVAAASGGWADWRQARRGAESRLRDRPRAMAASPGPAGVGGAGAVYGSGSSGFALDSGLEIKTRSVEQTLLPLVSQITTLINHKDNTKKSDKTLQAIQRVGQAVNLAVGRFVKVGEAIANENWDLKEEINIACIEAKQAGETIAALTDITNLNHLESDGQITIFTDKTGVIKAARLLLSSVTKVLLLADRVVIKQIITSRNKVLATMERLEKVNSFQEFVQIFSQFGNEMVEFAHLSGDRQNDLKDEKKKAKMAAARAVLEKCTMMLLTASKTCLRHPNCESAHKNKEGVFDRMKVALDKVIEIVTDCKPNGETDISSISIFTGIKEFKMNIEALRENLYFQSKENLSVTLEVILERMEDFTDSAYTSHEHRERILELSTQARMELQQLISVWIQAQSKKTKSIAEELELSILKISHSLNELKKELHSTATQLAADLLKYHADHVVLKALKLTGVEGNLEALAEYACKLSEQKEQLVETCRLLRHISGTEPLEITCIHAEETFQVTGQQIISAAETLTLHPSSKIAKENLDVFCEAWESQISDMSTLLREINDVFEGRRGEKYGYLSLPKPMKNNANLKSLKPDKPDSEEQAKIAKLGLKLGLLTSDADCEIEKWEDQENEIVQYGRNMSSMAYSLYLFTRGEGPLKTSQDLIHQLEVFAAEGLKLTSSVQAFSKQLKDDDKLMLLLEINKLIPLCHQLQTVTKTSLQNKVFLKVDKCITKTRSMMALLVQLLSLCYKLLKKLQMENNGWVSVTNKDTMDSKT

SEQ ID NO: 885909 - protein, 753 aa, Homo sapiens
LGWRECPVAAASGGWADWRQARRGAESRLRDRPRAMAASPGPAGVGGAGAVYGSGSSGFALDSGLEIKTRSVEQTLLPLVSQITTLINHKDNTKKSDKTLQAIQRVGQAVNLAVGRFVKVGEAIANENWDLKEEINIACIEAKQAGETIAALTDITNLNHLESDGQITIFTDKTGVIKAARLLLSSVTKVLLLADRVVIKQIITSRNKVLATMERLEKVNSFQEFVQIFSQFGNEMVEFAHLSGDRQNDLKDEKKKAKMAAARAVLEKCTMMLLTASKTCLRHPNCESAHKNKEGVFDRMKVALDKVIEIVTDCKPNGETDISSISIFTGIKEFKMNIEALRENLYFQSKENLSVTLEVILERMEDFTDSAYTSHEHRERILELSTQARMELQQLISVWIQAQSKKTKSIAEELELSILKISHSLNELKKELHSTATQLAADLLKYHADHVVLKALKLTGVEGNLEALAEYACKLSEQKEQLVETCRLLRHISGTEPLEITCIHAEETFQVTGQQIISAAETLTLHPSSKIAKENLDVFCEAWESQISDMSTLLREINDVFEGRRGEKYGYLSLPKPMKNNANLKSLKPDKPDSEEQAKIAKLGLKLGLLTSDADCEIEKWEDQENEIVQYGRNMSSMAYSLYLFTRGEGPLKTSQDLIHQLEVFAAEGLKLTSSVQAFSKQLKDDDKLMLLLEINKLIPLCHQLQTVTKTSLQNKVFLKVDKCITKTRSMMALLVQLLSLCYKLLKKSETRY

SEQ ID NO: 885910 - protein, 135 aa, Homo sapiens
MSSMAYSLYLFTRGEGPLKTSQDLIHQLEVFAAEGLKLTSSVQAFSKQLKDDDKLMLLLEINKLIPLCHQLQTVTKTSLQNKVFLKVDKCITKTRSMMALLVQLLSLCYKLLKKLQMENNGWVSVTNKDTMDSKT

SEQ ID NO: 885911 - protein, 245 aa, Homo sapiens
LGWRECPVAAASGGWADWRQARRGAESRLRDRPRAMAASPGPAGVGGAGAVYGSGSSGFALDSGLEIKTRSVEQTLLPLVSQITTLINHKDNTKKSDKTLQAIQRVGQAVNLAVGRFVKVGEAIANENWDLKEEINIACIEAKQAGETIAALTDITNLNHLESDGQITIFTDKTGVIKAARLLLSSVTKVLLLADRVVIKQIITSRNKVLTFLMLLYFCLSVLFKVLFMTLSGGLLGLCVDEECS

SEQ ID NO: 885912 - protein, 218 aa, Homo sapiens
LGWRECPVAAASGGWADWRQARRGAESRLRDRPRAMAASPGPAGVGGAGAVYGSGSSGFALDSGLEIKTRSVEQTLLPLVSQITTLINHKDNTKKSDKTLQAIQRVGQAVNLAVGRFVKVGEAIANENWDLKEEINIACIEAKQAGETIAALTDITNLNHLESDGQITIFTDKTGVIKAARLLLSSVTKVLLLADRVVIKQIITSRNKRLTIYNLRHS

SEQ ID NO: 885913 - protein, 189 aa, Homo sapiens
VKSGEEDEEILFKERAQLYRWDRDVSQWKERGEGEIHDVFEGRRGEKYGYLSLPKPMKNNANLKALKLTGVEGNLEALAEYACKLSEQKEQLVETCRLLRHISGTEPLEITCIHAEETFQVTGQQIISAAETLTLHPSSKIAKENLDVFCEAWESQISDMSTLLREINDVFEGRRGSMATLFTSKPNEE

SEQ ID NO: 885914 - protein, 685 aa, Homo sapiens
LGWRECPVAAASGGWADWRQARRGAESRLRDRPRAMAASPGPAGVGGAGAVYGSGSSGFALDSGLEIKTRSVEQTLLPLVSQITTLINHKDNTKKSDKTLQAIQRVGQAVNLAVGRFVKVGEAIANENWDLKEEINIACIEAKQAGETIAALTDITNLNHLESDGQITIFTDKTGVIKAARLLLSSVTKVLLLADRVVIKQIITSRNKVLATMERLEKVNSFQEFVQIFSQFGNEMVEFAHLSGDRQNDLKDEKKKAKMAAARAVLEKCTMMLLTASKTCLRHPNCESAHKNKEGVFDRMKVALDKVIEIVTDCKPNGETDISSISIFTGIKEFKMNIEALRENLYFQSKENLSVTLEVILERMEDFTDSAYTSHEHRERILELSTQARMELQQLISVWIQAQSKKTKSIAEELELSILKISHSLNELKKEIISAAETLTLHPSSKIAKENLDVFCEAWESQISDMSTLLREINDVFEGRRGEKYGYLSLPKPMKNNANLKSLKPDKPDSEEQAKIAKLGLKLGLLTSDADCEIEKWEDQENEIVQYGRNMSSMAYSLYLFTRGEGPLKTSQDLIHQLEVFAAEGLKLTSSVQAFSKQLKDDDKLMLLLEINKLIPLCHQLQTVTKTSLQNKVFLKVDKCITKTRSMMALLVQLLSLCYKLLKKLQMENNGWVSVTNKDTMDSKT

SEQ ID NO: 885915 - protein, 497 aa, Homo sapiens
MKRKRQKWQQLGQFLKAHKNKEGVFDRMKVALDKVIEIVTDCKPNGETDISSISIFTGIKEFKMNIEALRENLYFQSKENLSVTLEVILERMEDFTDSAYTSHEHRERILELSTQARMELQQLISVWIQAQSKKTKSIAEELELSILKISHSLNELKKELHSTATQLAADLLKYHADHVVLKALKLTGVEGNLEALAEYACKLSEQKEQLVETCRLLRHISGTEPLEITCIHAEETFQVTGQQIISAAETLTLHPSSKIAKENLDVFCEAWESQISDMSTLLREINDVFEGRRGEKYGYLSLPKPMKNNANLKSLKPDKPDSEEQAKIAKLGLKLGLLTSDADCEIEKWEDQENEIVQYGRNMSSMAYSLYLFTRGEGPLKTSQDLIHQLEVFAAEGLKLTSSVQAFSKQLKDDDKLMLLLEINKLIPLCHQLQTVTKTSLQNKVFLKVDKCITKTRSMMALLVQLLSLCYKLLKKLQMENNGWVSVTNKDTMDSKT

SEQ ID NO: 885916 - protein, 434 aa, Homo sapiens
MNIEALRENLYFQSKENLSVTLEVILERMEDFTDSAYTSHEHRERILELSTQARMELQQLISVWIQAQSKKTKSIAEELELSILKISHSLNELKKELHSTATQLAADLLKYHADHVVLKALKLTGVEGNLEALAEYACKLSEQKEQLVETCRLLRHISGTEPLEITCIHAEETFQVTGQQIISAAETLTLHPSSKIAKENLDVFCEAWESQISDMSTLLREINDVFEGRRGEKYGYLSLPKPMKNNANLKSLKPDKPDSEEQAKIAKLGLKLGLLTSDADCEIEKWEDQENEIVQYGRNMSSMAYSLYLFTRGEGPLKTSQDLIHQLEVFAAEGLKLTSSVQAFSKQLKDDDKLMLLLEINKLIPLCHQLQTVTKTSLQNKVFLKVDKCITKTRSMMALLVQLLSLCYKLLKKLQMENNGWVSVTNKDTMDSKT

SEQ ID NO: 885917 - protein, 751 aa, Homo sapiens
LGWRECPVAAASGGWADWRQARRGAESRLRDRPRAMAASPGPAGVGGAGAVYGSGSSGFALDSGLEIKTRSVEQTLLPLVSQITTLINHKDNTKKSDKTLQAIQRVGQAVNLAVGRFVKVGEAIANENWDLKEEINIACIEAKQAGETIAALTDITNLNHLESDGQITIFTDKTGVIKAARLLLSSVTKVLLLADRVVIKQIITSRNKVLATMERLEKVNSFQEFVQIFSQFGNEMVEFAHLSGDRQNDLKDEKKKAKMAAARAVLEKCTMMLLTASKTCLRHPNCESAHKNKEGVFDRMKVALDKVIEIVTDCKPNGETDISSISIFTGIKEFKMNIEALRENLYFQSKENLSVTLEVILERMEDFTDSAYTSHEHRERILELSTQARMELQQLISVWIQAQSKKTKSIAEELELSILKISHSLNELKKELHSTATQLAADLLKYHADHVVLKALISEQKEQLVETCRLLRHISGTEPLEITCIHAEETFQVTGQQIISAAETLTLHPSSKIAKENLDVFCEAWESQISDMSTLLREINDVFEGRRGEKYGYLSLPKPMKNNANLKSLKPDKPDSEEQAKIAKLGLKLGLLTSDADCEIEKWEDQENEIVQYGRNMSSMAYSLYLFTRGEGPLKTSQDLIHQLEVFAAEGLKLTSSVQAFSKQLKDDDKLMLLLEINKLIPLCHQLQTVTKTSLQNKVFLKVDKCITKTRSMMALLVQLLSLCYKLLKKLQMENNGWVSVTNKDTMDSKT

SEQ ID NO: 885918 - protein, 749 aa, Homo sapiens
LGWRECPVAAASGGWADWRQARRGAESRLRDRPRAMAASPGPAGVGGAGAVYGSGSSGFALDSGLEIKTRSVEQTLLPLVSQITTLINHKDNTKKSDKTLQAIQRVGQAVNLAVGRFVKVGEAIANENWDLKEEINIACIEAKQAGETIAALTDITNLNHLESDGQITIFTDKTGVIKAARLLLSSVTKVLLLADRVVIKQIITSRNKVLATMERLEKVNSFQEFVQIFSQFGNEMVEFAHLSGDRQNDLKDEKKKAKMAAARAVLEKCTMMLLTASKTCLRHPNCESAHKNKEGVFDRMKVALDKVIEIVTDCKPNGETDISSISIFTGIKEFKMNIEALRENLYFQSKENLSVTLEVILERMEDFTDSAYTSHEHRERILELSTQARMELQQLISVWIQAQSKKTKSIAEELELSILKISHSLNELKKELHSTATQLAADLLKYHADHVVLKALKLTGVEGNLEALAEYACKLSEQKEQLVETCRLLRHISGTEPLEITCIHAEETFQVTGQQIISAAETLTLHPSSMSTLLREINDVFEGRRGEKYGYLSLPKPMKNNANLKSLKPDKPDSEEQAKIAKLGLKLGLLTSDADCEIEKWEDQENEIVQYGRNMSSMAYSLYLFTRGEGPLKTSQDLIHQLEVFAAEGLKLTSSVQAFSKQLKDDDKLMLLLEINKLIPLCHQLQTVTKTSLQNKVFLKVDKCITKTRSMMALLVQLLSLCYKLLKKLQMENNGWVSVTNKDTMDSKT

SEQ ID NO: 885919 - protein, 769 aa, Homo sapiens; identical to SEQ ID NO: 885908

SEQ ID NO: 885920 - protein, 750 aa, Homo sapiens
LGWRECPVAAASGGWADWRQARRGAESRLRDRPRAMAASPGPAGVGGAGAVYGSGSSGFALDSGLEIKTRSVEQTLLPLVSQITTLINHKDNTKKSDKTLQAIQRVGQAVNLAVGRFVKVGEAIANENWDLKEEINIACIEAKQAGETIAALTDITNLNHLESDGQITIFTDKTGVIKAARLLLSSVTKVLLLADRVVIKQIITSRNKVLATMERLEKVNSFQEFVQIFSQFGNEMVEFAHLSGDRQNDLKDEKKKAKMAAARAVLEKCTMMLLTASKTCLRHPNCESAHKNKEGVFDRMKVALDKVIEIVTDCKPNGETDISSISIFTGIKEFKMNIEALRENLYFQSKENLSVTLEVILERMEDFTDSAYTSHEHRERILELSTQARMELQQLISVWIQAQSKKTKSIAEELELSILKISHSLNELKKELHSTATQLAADLLKYHADHVVLKALKLTGVEGNLEALAEYACKLSEQKEQLVETCRLLRHISGTEPLEITCIHAEETFQVTGQQIISAAETLTLHPSSKIAKENLDVFCEAWESQISDMSTLLREINDVFEGRRGEKYGYLSLPKPMKNNANLKSLKPDKPDSEEQAKIAKLGLKLGLLTSDADCEIEKWEDQENEIVQYGRNMSSMAYSLYLFTRGEGPLKTSQDLIHQLEVFAAEGLKLTSSVQAFSKQLKDDDKLMLLLEINKLIPLCHQLQTVTKTSLQNKVFLKVDKCITKTRSMMALLVQLLSLCYKLLKKVR

SEQ ID NO: 885921 - protein, 728 aa, Homo sapiens
LGWRECPVAAASGGWADWRQARRGAESRLRDRPRAMAASPGPAGVGGAGAVYGSGSSGFALDSGLEIKTRSVEQTLLPLVSQITTLINHKDNTKKSDKTLQAIQRVGQAVNLAVGRFVKVGEAIANENWDLKEEINIACIEAKQAGETIAALTDITNLNHLESDGQITIFTDKTGVIKAARLLLSSVTKVLLLADRVVIKQIITSRNKVLATMERLEKVNSFQEFVQIFSQFGNEMVEFAHLSGDRQNDLKDEKKKAKMAAARAVLEKCTMMLLTASKTCLRHPNCESAHKNKEGVFDRMKVALDKVIEIVTDCKPNGETDISSISIFTGIKEFKMNIEALRENLYFQSKENLSVTLEVILERMEDFTDSAYTSHEHRERILELSTQARMELQQLISVWIQAQSKKTKSIAEELELSILKISHSLNELKKELHSTATQLAADLLKYHADHVVLKALKLTGVEGNLEALAEYACKLSEQKEQLVETCRLLRHISGTEPLEITCIHAEETFQVTGQQIISAAETLTLHPSSKIAKENLDVFCEAWESQISDMSTLLREINDVFEGRRGEKYGYLSLPKPMKNNANLKSLKPDKPDSEEQAKIAKLGLKLGLLTSDADCEIEKWEDQENEIVQYGRNMSSMAYSLYLFTRGEGPLKTSQDLIHQLEVFAAEGLKLTSSVQAFSKQLKDDDKLMLLLEINKLIPLCHQLQTVTKTSLQNKVFLKLQCFETRS

SEQ ID NO: 885922 - protein, 379 aa, Homo sapiens
VKSGEEDEEILFKERAQLYRWDRDVSQWKERGEGEIHDVFEGRRGEKYGYLSLPKPMKNNANLKALKLTGVEGNLEALAEYACKLSEQKEQLVETCRLLRHISGTEPLEITCIHAEETFQVTGQQIISAAETLTLHPSSKIAKENLDVFCEAWESQISDMSTLLREINDVFEGRRGEKYGYLSLPKPMKNNANLKSLKPDKPDSEEQAKIAKLGLKLGLLTSDADCEIEKWEDQENEIVQYGRNMSSMAYSLYLFTRGEGPLKTSQDLIHQLEVFAAEGLKLTSSVQAFSKQLKDDDKLMLLLEINKLIPLCHQLQTVTKTSLQNKVFLKVDKCITKTRSMMALLVQLLSLCYKLLKKLQMENNGWVSVTNKDTMDSKT

SEQ ID NO: 885923 - protein, 220 aa, Homo sapiens
MSTLLREINDVFEGRRGEKYGYLSLPKPMKNNANLKSLKPDKPDSEEQAKIAKLGLKLGLLTSDADCEIEKWEDQENEIVQYGRNMSSMAYSLYLFTRGEGPLKTSQDLIHQLEVFAAEGLKLTSSVQAFSKQLKDDDKLMLLLEINKLIPLCHQLQTVTKTSLQNKVFLKVDKCITKTRSMMALLVQLLSLCYKLLKKLQMENNGWVSVTNKDTMDSKT

SEQ ID NO: 885924 - protein, 566 aa, Homo sapiens
LGWRECPVAAASGGWADWRQARRGAESRLRDRPRAMAASPGPAGVGGAGAVYGSGSSGFALDSGLEIKTRSVEQTLLPLVSQITTLINHKDNTKKSDKTLQAIQRVGQAVNLAVGRFVKVGEAIANENWDLKEEINIACIEAKQAGETIAALTDITNLNHLESDGQITIFTDKTGVIKAARLLLSSVTKVLLLADRVVIKQIITSRNKVLATMERLEKVNSFQEFVQIFSQFGNEMVEFAHLSGDRQNDLKDEKKKAKMAAARAVLEKCTMMLLTASKTCLRHPNCESAHKNKEGVFDRMKVALDKVIEIVTDCKPNGETDISSISIFTGIKEFKMNIEALRENLYFQSKENLSVTLEVILERMEDFTDSAYTSHEHRERILELSTQARMELQQLISVWIQAQSKKTKSIAEELELSILKISHSLNELKKELHSTATQLAADLLKYHADHVVLKALKLTGVEGNLEALAEYACKLSEQKEQLVETCRLLRHISGTEPLEITCIHAEETFQVTGQQIISAAETLTLHPSSKIAKENLDVFCEAWESQISDMSTLLREINDVFEGRRE

SEQ ID NO: 885925 - protein, 571 aa, Homo sapiens
LGWRECPVAAASGGWADWRQARRGAESRLRDRPRAMAASPGPAGVGGAGAVYGSGSSGFALDSGLEIKTRSVEQTLLPLVSQITTLINHKDNTKKSDKTLQAIQRVGQAVNLAVGRFVKVGEAIANENWDLKEEINIACIEAKQAGETIAALTDITNLNHLESDGQITIFTDKTGVIKAARLLLSSVTKVLLLADRVVIKQIITSRNKVLATMERLEKVNSFQEFVQIFSQFGNEMVEFAHLSGDRQNDLKDEKKKAKMAAARAVLEKCTMMLLTASKTCLRHPNCESAHKNKEGVFDRMKVALDKVIEIVTDCKPNGETDISSISIFTGIKEFKMNIEALRENLYFQSKENLSVTLEVILERMEDFTDSAYTSHEHRERILELSTQARMELQQLISVWIQAQSKKTKSIAEELELSILKISHSLNELKKELHSTATQLAADLLKYHADHVVLKALKLTGVEGNLEALAEYACKLSEQKEQLVETCRLLRHISGTEPLEITCIHAEETFQVTGQQIISAAETLTLHPSSKIAKENLDVFCEAWESQISDMSTLLREINDVFEGRRGEKLST

SEQ ID NO: 885926 - protein, 3011 aa, Homo sapiens
MAPPPPPVLPVLLLLAAAAALPAMGLRAAAWEPRVPGGTRAFALRPGCTYAVGAACTPRAPRELLDVGRDGRLAGRRRVSGAGRPLPLQVRLVARSAPTALSRRLRARTHLPGCGARARLCGTGARLCGALCFPVPGGCAAAQHSALAAPTTLPACRCPPRPRPRCPGRPICLPPGGSVRLRLLCALRRAAGAVRVGLALEAATAGTPSASPSPSPPLPPNLPEARAGPARRARRGTSGRGSLKFPMPNYQVALFENEPAGTLILQLHAHYTIEGEEERVSYYMEGLFDERSRGYFRIDSATGAVSTDSVLDRETKETHVLRVKAVDYSTPPRSATTYITVLVKDTNDHSPVFEQSEYRERVRENLEVGYEVLTIRASDRDSPINANLRYRVLGGAWDVFQLNESSGVVSTRAVLDREEAAEYQLLVEANDQGRNPGPLSATATVYIEVEDENDNYPQFSEQNYVVQVPEDVGLNTAVLRVQATDRDQGQNAAIHYSILSGNVAGQFYLHSLSGILDVINPLDFEDVQKYSLSIKAQDGGRPPLINSSGVVSVQVLDVNDNEPIFVSSPFQATVLENVPLGYPVVHIQAVDADSGENARLHYRLVDTASTFLGGGSAGPKNPAPTPDFPFQIHNSSGWITVCAELDREEVEHYSFGVEAVDHGSPPMSSSTSVSITVLDVNDNDPVFTQPTYELRLNEDAAVGSSVLTLQARDRDANSVITYQLTGGNTRNRFALSSQRGGGLITLALPLDYKQEQQYVLAVTASDGTRSHTAHVLINVTDANTHRPVFQSSHYTVSVSEDRPVGTSIATLSANDEDTGENARITYVIQDPVPQFRIDPDSGTMYTMMELDYENQVAYTLTIMAQDNGIPQKSDTTTLEILILDANDNAPQFLWDFYQGSIFEDAPPSTSILQVSATDRDSGPNGRLLYTFQGGDDGDGDFYIEPTSGVIRTQRRLDRENVAVYNLWALAVDRGSPTPLSASVEIQVTILDINDNAPMFEKDELELFVEENNPVGSVVAKIRANDPDEGPNAQIMYQIVEGDMRHFFQLDLLNGDLRAMVELDFEVRREYVLVVQATSAPLVSRATVHILLVDQNDNPPVLPDFQILFNNYVTNKSNSFPTGVIGCIPAHDPDVSDSLNYTFVQGNELRLLLLDPATGELQLSRDLDNNRPLEALMEVSVSDGIHSVTAFCTLRVTIITDDMLTNSITVRLENMSQEKFLSPLLALFVEGVAAVLSTTKDDVFVFNVQNDTDVSSNILNVTFSALLPGGVRGQFFPSEDLQEQIYLNRTLLTTISTQRVLPFDDNICLREPCENYMKCVSVLRFDSSAPFLSSTTVLFRPIHPINGLRCRCPPGFTGDYCETEIDLCYSDPCGANGRCRSREGGYTCECFEDFTGEHCEVDARSGRCANGVCKNGGTCVNLLIGGFHCVCPPGEYERPYCEVTTRSFPPQSFVTFRGLRQRFHFTISLTFATQERNGLLLYNGRFNEKHDFIALEIVDEQVQLTFSAGETTTTVAPKVPSGVSDGRWHSVQVQYYNKPNIGHLGLPHGPSGEKMAVVTVDDCDTTMAVRFGKDIGNYSCAAQGTQTGSKKSLDLTGPLLLGGVPNLPEDFPVHNRQFVGCMRNLSVDGKNVDMAGFIANNGTREGCAARRNFCDGRRCQNGGTCVNRWNMYLCECPLRFGGKNCEQAMPHPQLFSGESVVSWSDLNIIISVPWYLGLMFRTRKEDSVLMEATSGGPTSFRLQILNNYLQFEVSHGPSDVESVMLSGLRVTDGEWHHLLIELKNVKEDSEMKHLVTMTLDYGMDQNKADIGGMLPGLTVRSVVVGGASEDKVSVRRGFRGCMQGVRMGGTPTNVATLNMNNALKVRVKDGCDVDDPCTSSPCPPNSRCHDAWEDYSCVCDKGKNCVDACHLNPCENMGACVRSPGSPQGYVCECGPSHYGPYCENKLDLPCPRGWWGNPVCGPCHCAVSKGFDPDCNKTNGQCQCKENYYKLLAQDTCLPCDCFPHGSHSRTCDMATGQCACKPGVIGRQCNRCDNPFAEVTTLGCEVIYNGCPKAFEAGIWWPQTKFGQPAAVPCPKGSVGNAVRHCSGEKGWLPPELFNCTTISFVDLRAMNEKLSRNETQVDGARALQLVRALRSATQHTGTLFGNDVRTAYQLLGHVLQHESWQQGFDLAATQDADFHEDVIHSGSALLAPATRAAWEQIQRSEGGTAQLLRRLEGYFSNVARNVRRTYLRPFVIVTANMILAVDIFDKFNFTGARVPRFDTIHEEFPRELESSVSFPADFFRPPEEKEGPLLRPAGRRTTPQTTRPGPGTEREAPISRRRRHPDDAGQFAVALVIIYRTLGQLLPERYDPDRRSLRLPHRPIINTPMVSTLVYSEGAPLPRPLERPVLVEFALLEVEERTKPVCVFWNHSLAVGGTGGWSARGCELLSRNRTHVACQCSHTASFAVLMDISRRENGEVLPLKIVTYAAVSLSLAALLVAFVLLSLVRMLRSNLHSIHKHLAVALFLSQLVFVIGINQTENPFLCTVVAILLHYIYMSTFAWTLVESLHVYRMLTEVRNIDTGPMRFYYVVGWGIPAIVTGLAVGLDPQGYGNPDFCWLSLQDTLIWSFAGPIGAVIIINTVTSVLSAKVSCQRKHHYYGKKGIVSLLRTAFLLLLLISATWLLGLLAVNRDALSFHYLFAIFSGLQGPFVLLFHCVLNQEVRKHLKGVLGGRKLHLEDSATTRATLLTRSLNCNTTFGDGPDMLRTDLGESTASLDSIVRDEGIQKLGVSSGLVRGSHGEPDASLMPRSCKDPPGHDSDSDSELSLDEQSSSYASSHSSDSEDDGVGAEEKWDPARGAVHSTPKGDAVANHVPAGWPDQSLAESDSEDPSGKPRLKVETKVSVELHREEQGSHRGEYPPDQESGGAARLASSQPPEQRKGILKNKVTYPPPLTLTEQTLKGRLREKLADCEQSPTSSRTSSLGSGGPDCAITVKSPGREPGRDHLNGVAMNVRTGSAQADGSDSEKP

SEQ ID NO: 885927 - protein, 1397 aa, Homo sapiens
MAPPPPPVLPVLLLLAAAAALPAMGLRAAAWEPRVPGGTRAFALRPGCTYAVGAACTPRAPRELLDVGRDGRLAGRRRVSGAGRPLPLQVRLVARSAPTALSRRLRARTHLPGCGARARLCGTGARLCGALCFPVPGGCAAAQHSALAAPTTLPACRCPPRPRPRCPGRPICLPPGGSVRLRLLCALRRAAGAVRVGLALEAATAGTPSASPSPSPPLPPNLPEARAGPARRARRGTSGRGSLKFPMPNYQVALFENEPAGTLILQLHAHYTIEGEEERVSYYMEGLFDERSRGYFRIDSATGAVSTDSVLDRETKETHVLRVKAVDYSTPPRSATTYITVLVKDTNDHSPVFEQSEYRERVRENLEVGYEVLTIRASDRDSPINANLRYRVLGGAWDVFQLNESSGVVSTRAVLDREEAAEYQLLVEANDQGRNPGPLSATATVYIEVEDENDNYPQFSEQNYVVQVPEDVGLNTAVLRVQATDRDQGQNAAIHYSILSGNVAGQFYLHSLSGILDVINPLDFEDVQKYSLSIKAQDGGRPPLINSSGVVSVQVLDVNDNEPIFVSSPFQATVLENVPLGYPVVHIQAVDADSGENARLHYRLVDTASTFLGGGSAGPKNPAPTPDFPFQIHNSSGWITVCAELDREEVEHYSFGVEAVDHGSPPMSSSTSVSITVLDVNDNDPVFTQPTYELRLNEDAAVGSSVLTLQARDRDANSVITYQLTGGNTRNRFALSSQRGGGLITLALPLDYKQEQQYVLAVTASDGTRSHTAHVLINVTDANTHRPVFQSSHYTVSVSEDRPVGTSIATLSANDEDTGENARITYVIQDPVPQFRIDPDSGTMYTMMELDYENQVAYTLTIMAQDNGIPQKSDTTTLEILILDANDNAPQFLWDFYQGSIFEDAPPSTSILQVSATDRDSGPNGRLLYTFQGGDDGDGDFYIEPTSGVIRTQRRLDRENVAVYNLWALAVDRGSPTPLSASVEIQVTILDINDNAPMFEKDELELFVEENNPVGSVVAKIRANDPDEGPNAQIMYQIVEGDMRHFFQLDLLNGDLRAMVELDFEVRREYVLVVQATSAPLVSRATVHILLVDQNDNPPVLPDFQILFNNYVTNKSNSFPTGVIGCIPAHDPDVSDSLNYTFVQGNELRLLLLDPATGELQLSRDLDNNRPLEALMEVSVSDGIHSVTAFCTLRVTIITDDMLTNSITVRLENMSQEKFLSPLLALFVEGVAAVLSTTKDDVFVFNVQNDTDVSSNILNVTFSALLPGGVRGQFFPSEDLQEQIYLNRTLLTTISTQRVLPFDDNICLREPCENYMKCVSVLRFDSSAPFLSSTTVLFRPIHPINGLRCRCPPGFTGDYCETEIDLCYSDPCGANGRCRSREGGYTCECFEDFTEIS

SEQ ID NO: 885928 - protein, 3016 aa, Homo sapiens
MAPPPPPVLPVLLLLAAAAALPAMGLRAAAWEPRVPGGTRAFALRPGCTYAVGAACTPRAPRELLDVGRDGRLAGRRRVSGAGRPLPLQVRLVARSAPTALSRRLRARTHLPGCGARARLCGTGARLCGALCFPVPGGCAAAQHSALAAPTTLPACRCPPRPRPRCPGRPICLPPGGSVRLRLLCALRRAAGAVRVGLALEAATAGTPSASPSPSPPLPPNLPEARAGPARRARRGTSGRGSLKFPMPNYQVALFENEPAGTLILQLHAHYTIEGEEERVSYYMEGLFDERSRGYFRIDSATGAVSTDSVLDRETKETHVLRVKAVDYSTPPRSATTYITVLVKDTNDHSPVFEQSEYRERVRENLEVGYEVLTIRASDRDSPINANLRYRVLGGAWDVFQLNESSGVVSTRAVLDREEAAEYQLLVEANDQGRNPGPLSATATVYIEVEDENDNYPQFSEQNYVVQVPEDVGLNTAVLRVQATDRDQGQNAAIHYSILSGNVAGQFYLHSLSGILDVINPLDFEDVQKYSLSIKAQDGGRPPLINSSGVVSVQVLDVNDNEPIFVSSPFQATVLENVPLGYPVVHIQAVDADSGENARLHYRLVDTASTFLGGGSAGPKNPAPTPDFPFQIHNSSGWITVCAELDREEVEHYSFGVEAVDHGSPPMSSSTSVSITVLDVNDNDPVFTQPTYELRLNEDAAVGSSVLTLQARDRDANSVITYQLTGGNTRNRFALSSQRGGGLITLALPLDYKQEQQYVLAVTASDGTRSHTAHVLINVTDANTHRPVFQSSHYTVSVSEDRPVGTSIATLSANDEDTGENARITYVIQDPVPQFRIDPDSGTMYTMMELDYENQVAYTLTIMAQDNGIPQKSDTTTLEILILDANDNAPQFLWDFYQGSIFEDAPPSTSILQVSATDRDSGPNGRLLYTFQGGDDGDGDFYIEPTSGVIRTQRRLDRENVAVYNLWALAVDRGSPTPLSASVEIQVTILDINDNAPMFEKDELELFVEENNPVGSVVAKIRANDPDEGPNAQIMYQIVEGDMRHFFQLDLLNGDLRAMVELDFEVRREYVLVVQATSAPLVSRATVHILLVDQNDNPPVLPDFQILFNNYVTNKSNSFPTGVIGCIPAHDPDVSDSLNYTFVQGNELRLLLLDPATGELQLSRDLDNNRPLEALMEVSVSDGIHSVTAFCTLRVTIITDDMLTNSITVRLENMSQEKFLSPLLALFVEGVAAVLSTTKDDVFVFNVQNDTDVSSNILNVTFSALLPGGVRGQFFPSEDLQEQIYLNRTLLTTISTQRVLPFDDNICLREPCENYMKCVSVLRFDSSAPFLSSTTVLFRPIHPINGLRCRCPPGFTGDYCETEIDLCYSDPCGANGRCRSREGGYTCECFEDFTGEHCEVDARSGRCANGVCKNGGTCVNLLIGGFHCVCPPGEYERPYCEVTTRSFPPQSFVTFRGLRQRFHFTISLTFATQERNGLLLYNGRFNEKHDFIALEIVDEQVQLTFSAGETTTTVAPKVPSGVSDGRWHSVQVQYYNKPNIGHLGLPHGPSGEKMAVVTVDDCDTTMAVRFGKDIGNYSCAAQGTQTGSKKSLDLTGPLLLGGVPNLPEDFPVHNRQFVGCMRNLSVDGKNVDMAGFIANNGTREGCAARRNFCDGRRCQNGGTCVNRWNMYLCECPLRFGGKNCEQAMPHPQLFSGESVVSWSDLNIIISVPWYLGLMFRTRKEDSVLMEATSGGPTSFRLQILNNYLQFEVSHGPSDVESVMLSGLRVTDGEWHHLLIELKNVKEDSEMKHLVTMTLDYGMDQNKADIGGMLPGLTVRSVVVGGASEDKVSVRRGFRGCMQGVRMGGTPTNVATLNMNNALKVRVKDGCDVDDPCTSSPCPPNSRCHDAWEDYSCVCDKGKNCVDACHLNPCENMGACVRSPGSPQGYVCECGPSHYGPYCENKLDLPCPRGWWGNPVCGPCHCAVSKGFDPDCNKTNGQCQCKENYYKLLAQDTCLPCDCFPHGSHSRTCDMATGQCACKPGVIGRQCNRCDNPFAEVTTLGCEVIYNGCPKAFEAGIWWPQTKFGQPAAVPCPKGSVGNAVRHCSGEKGWLPPELFNCTTISFVDLRAMNEKLSRNETQVDGARALQLVRALRSATQHTGTLFGNDVRTAYQLLGHVLQHESWQQGFDLAATQDADFHEDVIHSGSALLAPATRAAWEQIQRSEGGTAQLLRRLEGYFSNVARNVRRTYLRPFVIVTANMILAVDIFDKFNFTGARVPRFDTIHEEFPRELESSVSFPADFFRPPEEKEGPLLRPAGRRTTPQTTRPGPGTEREAPISRRRRHPDDAGQFAVALVIIYRTLGQLLPERYDPDRRSLRLPHRPIINTPMVSTLVYSEGAPLPRPLERPVLVEFALLEVEERTKPVCVFWNHSLAVGGTGGWSARGCELLSRNRTHVACQCSHTASFAVLMDISRRENGEVLPLKIVTYAAVSLSLAALLVAFVLLSLVRMLRSNLHSIHKHLAVALFLSQLVFVIGINQTENPFLCTVVAILLHYIYMSTFAWTLVESLHVYRMLTEVRNIDTGPMRFYYVVGWGIPAIVTGLAVGLDPQGYGNPDFCWLSLQDTLIWSFAGPIGAVIIINTVTSVLSAKVSCQRKHHYYGKKGIVSLLRTAFLLLLLISATWLLGLLAVNRDALSFHYLFAIFSGLQGPFVLLFHCVLNQEVRKHLKGVLGGRKLHLEDSATTRATLLTRSLNCNTTFGDGPDMLRTDLGESTASLDSIVRDEGIQKLGVSSGLVRGSHGEPDASLMPRSCKDPPGHDSDSDSELSLDEQSSSYASSHSSDSEDDGVGAEEKWDPARGAVHSTPKGDAVANHVPAGWPDQSLAESDSEDPSGKPRLKVETKVSVELHREEQGSHRGEYPPDQESGGAARLASSQPPEQRKGILKNKVTYPPPLTLTEQTLKGRLREKLADCEQSPTSSRTSSLGSGGPDCAITVKSPGREPGRDHLNGVAMNVRTGSAQADGSDSEGSNETSI

SEQ ID NO: 885929 - protein, 1329 aa, Homo sapiens
MPHPQLFSGESVVSWSDLNIIISVPWYLGLMFRTRKEDSVLMEATSGGPTSFRLQILNNYLQFEVSHGPSDVESVMLSGLRVTDGEWHHLLIELKNVKEDSEMKHLVTMTLDYGMDQNKADIGGMLPGLTVRSVVVGGASEDKVSVRRGFRGCMQGVRMGGTPTNVATLNMNNALKVRVKDGCDVDDPCTSSPCPPNSRCHDAWEDYSCVCDKGKNCVDACHLNPCENMGACVRSPGSPQGYVCECGPSHYGPYCENKLDLPCPRGWWGNPVCGPCHCAVSKGFDPDCNKTNGQCQCKENYYKLLAQDTCLPCDCFPHGSHSRTCDMATGQCACKPGVIGRQCNRCDNPFAEVTTLGCEVIYNGCPKAFEAGIWWPQTKFGQPAAVPCPKGSVGNAVRHCSGEKGWLPPELFNCTTISFVDLRAMNEKLSRNETQVDGARALQLVRALRSATQHTGTLFGNDVRTAYQLLGHVLQHESWQQGFDLAATQDADFHEDVIHSGSALLAPATRAAWEQIQRSEGGTAQLLRRLEGYFSNVARNVRRTYLRPFVIVTANMILAVDIFDKFNFTGARVPRFDTIHEEFPRELESSVSFPADFFRPPEEKEGPLLRPAGRRTTPQTTRPGPGTEREAPISRRRRHPDDAGQFAVALVIIYRTLGQLLPERYDPDRRSLRLPHRPIINTPMVSTLVYSEGAPLPRPLERPVLVEFALLEVEERTKPVCVFWNHSLAVGGTGGWSARGCELLSRNRTHVACQCSHTASFAVLMDISRRENGEVLPLKIVTYAAVSLSLAALLVAFVLLSLVRMLRSNLHSIHKHLAVALFLSQLVFVIGINQTENPFLCTVVAILLHYIYMSTFAWTLVESLHVYRMLTEVRNIDTGPMRFYYVVGWGIPAIVTGLAVGLDPQGYGNPDFCWLSLQDTLIWSFAGPIGAVIIINTVTSVLSAKVSCQRKHHYYGKKGIVSLLRTAFLLLLLISATWLLGLLAVNRDALSFHYLFAIFSGLQGPFVLLFHCVLNQEVRKHLKGVLGGRKLHLEDSATTRATLLTRSLNCNTTFGDGPDMLRTDLGESTASLDSIVRDEGIQKLGVSSGLVRGSHGEPDASLMPRSCKDPPGHDSDSDSELSLDEQSSSYASSHSSDSEDDGVGAEEKWDPARGAVHSTPKGDAVANHVPAGWPDQSLAESDSEDPSGKPRLKVETKVSVELHREEQGSHRGEYPPDQESGGAARLASSQPPEQRKGILKNKVTYPPPLTLTEQTLKGRLREKLADCEQSPTSSRTSSLGSGGPDCAITVKSPGREPGRDHLNGVAMNVRTGSAQADGSDSEGSNETSI

SEQ ID NO: 885930 - protein, 1151 aa, Homo sapiens
GRGCVRVACSSPHQLAHSRSGRLHQHSSQGGWMVAGINCVDACHLNPCENMGACVRSPGSPQGYVCECGPSHYGPYCENKLDLPCPRGWWGNPVCGPCHCAVSKGFDPDCNKTNGQCQCKENYYKLLAQDTCLPCDCFPHGSHSRTCDMATGQCACKPGVIGRQCNRCDNPFAEVTTLGCEVIYNGCPKAFEAGIWWPQTKFGQPAAVPCPKGSVGNAVRHCSGEKGWLPPELFNCTTISFVDLRAMNEKLSRNETQVDGARALQLVRALRSATQHTGTLFGNDVRTAYQLLGHVLQHESWQQGFDLAATQDADFHEDVIHSGSALLAPATRAAWEQIQRSEGGTAQLLRRLEGYFSNVARNVRRTYLRPFVIVTANMILAVDIFDKFNFTGARVPRFDTIHEEFPRELESSVSFPADFFRPPEEKEGPLLRPAGRRTTPQTTRPGPGTEREAPISRRRRHPDDAGQFAVALVIIYRTLGQLLPERYDPDRRSLRLPHRPIINTPMVSTLVYSEGAPLPRPLERPVLVEFALLEVEERTKPVCVFWNHSLAVGGTGGWSARGCELLSRNRTHVACQCSHTASFAVLMDISRRENGEVLPLKIVTYAAVSLSLAALLVAFVLLSLVRMLRSNLHSIHKHLAVALFLSQLVFVIGINQTENPFLCTVVAILLHYIYMSTFAWTLVESLHVYRMLTEVRNIDTGPMRFYYVVGWGIPAIVTGLAVGLDPQGYGNPDFCWLSLQDTLIWSFAGPIGAVIIINTVTSVLSAKVSCQRKHHYYGKKGIVSLLRTAFLLLLLISATWLLGLLAVNRDALSFHYLFAIFSGLQGPFVLLFHCVLNQEVRKHLKGVLGGRKLHLEDSATTRATLLTRSLNCNTTFGDGPDMLRTDLGESTASLDSIVRDEGIQKLGVSSGLVRGSHGEPDASLMPRSCKDPPGHDSDSDSELSLDEQSSSYASSHSSDSEDDGVGAEEKWDPARGAVHSTPKGDAVANHVPAGWPDQSLAESDSEDPSGKPRLKVETKVSVELHREEQGSHRGEYPPDQESGGAARLASSQPPEQRKGILKNKVTYPPPLTLTEQTLKGRLREKLADCEQSPTSSRTSSLGSGGPDCAITVKSPGREPGRDHLNGVAMNVRTGSAQADGSDSEGSNETSI

SEQ ID NO: 885931 - protein, 82 aa, Homo sapiens
VRRTYLRPFVIVTANMSKALAALGVEPCYHQGCAPELGPHGVKQVGSRPPLGHALRKMIVRPGTVAHTCNPSTLGDRDRQTT

SEQ ID NO: 885932 - protein, 367 aa, Homo sapiens
MAPSGPGSSARRRCRRVLYWIPVVFITLLLGWSYYAYAIQLCIVSMENTGEQVVCLMAYHLLFAMFVWSYWKTIFTLPMNPSKEFHLSYAEKDLLEREPRGEAHQEVLRRAAKDLPIYTRTMSGAIRYCDRCQLIKPDRCHHCSVCDKCILKMDHHCPWVNNCVGFSNYKFFLLFLAYSLLYCLFIAATDLQYFIKFWTNGLPDTQAKFHIMFLFFAAAMFSVSLSSLFGYHCWLVSKNKSTLEAFRSPVFRHGTDKNGFSLGFSKNMRQVFGDEKKYWLLPIFSSLGDGCSFPTCLVNQDPEQASTPAGLNSTAKNLENHQFPAKPLRESQSHLLTDSQSWTESSINPGKCKAGMSNPALTMENET

SEQ ID NO: 885933 - protein, 367 aa, Homo sapiens; identical to SEQ ID NO: 885932

SEQ ID NO: 885934 - protein, 367 aa, Homo sapiens; identical to SEQ ID NO: 885932

SEQ ID NO: 885935 - protein, 777 aa, Homo sapiens
MTFYPFVASSSTRRVDNSNTRLAVQIERDPGNDDNNLNSIFYEHLTRTLQESLCGDLVLGRWGNYSSGDCFILASDDLNAFVHLIEIGNGLVTFQLRGLEFRGTYCQQREVEAIMEGDEEDRGCCCCKPGHLPHLLSCNAAFHLRWLTWEITQTQYILEGYSILDNNAATMLQVFDLRRILIRYYIKSIIYYMVTSPKLLSWIKNESLLKSLQPFAKWHYIERDLAMFNINIDDDYVPCLQGITRASFCNVYLEWIQHCARKRQEPSTTLDSDEDSPLVTLSFALCTLGRRALGTAAHNMAISLDSFLYGLHVLFKGDFRITARDEWVFADMDLLHKVVAPAIRMSLKLHQDQFTCPDEYEDPAVLYEAIQSFEKKVVICHEGDPAWRGAVLSNKEELLTLRHVVDEGADEYKVIMLHRSFLSFKVIKVNKECVRGLWAGQQQELIFLRNRNPERGSIQNNKQVLRNLINSSCDQPLGYPMYVSPLTTSYLGTHRQLKNIWGGPITLDRIRTWFWTKWVRMRKDCNARQHSGGNIEDVDGGGAPTTGGNNAPSGGSQESSAEQPRKGGAQHGVSSCEGTQRTGRRKGRSQSVQAHSALSQRPPMLSSSGPILESRQTFLQTSTSVHELAQRLSGSRLSLHASATSLHSQPPPVTTTGHLSVRERAEALIRSSLGSSTSSTLSFLFGKRSFSSALVISGLSAAEGGNTSDTQSSSSVNIVMGPSARAASQATRVRGWAGLTRTGWDGGTGSWPERGTCLAFPPFCLQNPIPFSMGLPE

SEQ ID NO: 885936 - protein, 777 aa, Homo sapiens; identical to SEQ ID NO: 885935

SEQ ID NO: 885937 - protein, 777 aa, Homo sapiens; identical to SEQ ID NO: 885935

SEQ ID NO: 885938 - protein, 789 aa, Homo sapiens [sequence omitted]

SEQ ID NO: 885939 - protein, 777 aa, Homo sapiens; identical to SEQ ID NO: 885935

SEQ ID NO: 885940 - protein, 309 aa, Homo sapiens
MYVSPLTTSYLGTHRQLKNIWGGPITLDRIRTWFWTKWVRMRKDCNARQHSGGNIEDVDGGGAPTTGGNNAPSGGSQESSAEQPRKGGAQHGVSSCEGTQRTGRRKGRSQSVQAHSALSQRPPMLSSSGPILESRQTFLQTSTSVHELAQRLSGSRLSLHASATSLHSQPPPVTTTGHLSVRERAEALIRSSLGSSTSSTLSFLFGKRSFSSALVISGLSAAEGGNTSDTQSSSSVNIVMGPSARAASQATRHLSEPCEPPDATEQGQLHDRCLAEAVADTLGVVCRRASQEDMGLDDTASQQSVSDEQ

SEQ ID NO: 885941 - protein, 739 aa, Homo sapiens
MTFYPFVASSSTRRVDNSNTRLAVQIERDPGNDDNNLNSIFYEHLTRTLQESLCGDLVLGRWGNYSSGDCFILASDDLNAFVHLIEIGNGLVTFQLRGLEFRGTYCQQREVEAIMEGDEEDRGCCCCKPGHLPHLLSCNAAFHLRWLTWEITQTQYILEGYSILDNNAATMLQVFDLRRILIRYYIKSIIYYMVTSPKLLSWIKNESLLKSLQPFAKWHYIERDLAMFNINIDDDYVPCLQGITRASFCNVYLEWIQHCARKRQEPSTTLDSDEDSPLVTLSFALCTLGRRALGTAAHNMAISLDSFLYGLHVLFKGDFRITARDEWVFADMDLLHKVVAPAIRMSLKLHQDQFTCPDEYEDPAVLYEAIQSFEKKVVICHEGDPAWRGAVLSNKEELLTLRHVVDEGADEYKVIMLHRSFLSFKVIKVNKECVRGLWAGQQQELIFLRNRNPERGSIQNNKQVLRNLINSSCDQPLGYPMYVSPLTTSYLGTHRQLKNIWGGPITLDRIRTWFWTKWVRMRKDCNARQHSGGNIEDVDGGGAPTTGGNNAPSGGSQESSAEQPRKGGAQHGVSSCEGTQRTGRRKGRSQSVQAHSALSQRPPMLSSSGPILESRQTFLQTSTSVHELAQRLSGSRLSLHASATSLHSQPPPVTTTGHLSVRERAEALIRSSLGSSTSSTLSFLFGKRSFSSALVISGLSAAEGGNTSDTQSSSSVNIVMGPSARAASQATRISLPPPR

SEQ ID NO: 885942 - protein, 104 aa, Homo sapiens
MPPSRGSFMTDVWLRLWRTLSGLSAGEQARRTWAWTTRPRSKVCQTSSDGRAAGRGGWLPHTSHLHCSPSCSPNHHNQPIPRSMRDSSCGKGELFQNTELISGF

SEQ ID NO: 885943 - protein, 789 aa, Homo sapiens [sequence omitted]

SEQ ID NO: 885944 - protein, 777 aa, Homo sapiens; identical to SEQ ID NO: 885935

SEQ ID NO: 885945 - protein, 717 aa, Homo sapiens
MTFYPFVASSSTRRVDNSNTRLAVQIERDPGNDDNNLNSIFYEHLTRTLQESLCGDLVLGRWGNYSSGDCFILASDDLNAFVHLIEIGNGLVTFQLRGLEFRGTYCQQREVEAIMEGDEEDRGCCCCKPGHLPHLLSCNAAFHLRWLTWEITQTQYILEGYSILDNNAATMLQVFDLRRILIRYYIKSIIYYMVTSPKLLSWIKNESLLKSLQPFAKWHYIERDLAMFNINIDDDYVPCLQGITRASFCNVYLEWIQHCARKRQEPSTTLDSDEDSPLVTLSFALCTLGRRALGTAAHNMAISLDSFLYGLHVLFKGDFRITARDEWVFADMDLLHKVVAPAIRMSLKLHQDQFTCPDEYEDPAVLYEAIQSFEKKVVICHEGDPAWRGAVLSNKEELLTLRHVVDEGADEYKVIMLHRSFLSFKVIKVNKECVRGLWAGQQQELIFLRNRNPERGSIQNNKQVLRNLINSSCDQPLGYPMYVSPLTTSYLGTHRQLKNIWGGPITLDRIRTWFWTKWVRMRKDCNARQHSGGNIEDVDGGGAPTTGGNNAPSGGSQESSAEQPRKGGAQHGVSSCEGTQRTGRRKGRSQSVQAHSALSQRPPMLSSSGPILESRQTFLQTSTSVHELAQRLSGSRLSLHASATSLHSQPPPVTTTGHLSVRERAEALIRSSLGSSTSSTLSFLFGKRSFSSALVISGLSRQPRECPPQPQPDIGHE

SEQ ID NO: 885946 - protein, 555 aa, Homo sapiens
MTFYPFVASSSTRRVDNSNTRLAVQIERDPGNDDNNLNSIFYEHLTRTLQESLCGDLVLGRWGNYSSGDCFILASDDLNAFVHLIEIGNGLVTFQLRGLEFRGTYCQQREVEAIMEGDEEDRGCCCCKPGHLPHLLSCNAAFHLRWLTWEITQTQYILEGYSILDNNAATMLQVFDLRRILIRYYIKSIIYYMVTSPKLLSWIKNESLLKSLQPFAKWHYIERDLAMFNINIDDDYVPCLQGITRASFCNVYLEWIQHCARKRQEPSTTLDSDEDSPLVTLSFALCTLGRRALGTAAHNMAISLDSFLYGLHVLFKGDFRITARDEWVFADMDLLHKVVAPAIRMSLKLHQDQFTCPDEYEDPAVLYEAIQSFEKKVVICHEGDPAWRGAVLSNKEELLTLRHVVDEGADEYKVIMLHRSFLSFKVIKVNKECVRGLWAGQQQELIFLRNRNPERGSIQNNKQVLRNLINSSCDQPLGYPMYVSPLTTSYLGTHRQLKNIWGGPITLDRIRTWFWTKWVRMRKDCNARQHSGGNIEPDSLPASYPVQFPKRTGTG

SEQ ID NO: 885947 - protein, 129 aa, Homo sapiens
MGDCTDTGWQQVVAQQEEVLQVVLQGVGWPQGDCTDTGWQQVVAQQEEVLQVVLQGVGWPQGGRQQGDCTDTGWQQVVAQQQGLHTTAVHDEGQQVMGRQQPSCREQGSQHTGRRQGSQMGRVQRGTQV

SEQ ID NO: 885948 - protein, 253 aa, Homo sapiens
KNKRALKTKEDRPRLQRKQEAVGPALSPAAGAPSSGMESVALYSFQATESDELAFNKGDTLKILNMEDDQNWYKAELRGVEGFIPKNYIRVKPHPWYSGRISRQLAEEILMKRNHLGAFLIRESESSPGEFSVSVNYGDQVQHFKVLREASGKYFLWEEKFNSLNELVDFYRTTTIAKKRQIFLRDEEPLLKSPGACFAQAQFDFSAQDPSQLSFRRGDIIEVLERPDPHWWRGRSCGRVGFFPRSYVQPVHL

SEQ ID NO: 885949 - protein, 276 aa, Homo sapiens
KNKRALKTKEDRPRLQRKQEAVGPALSPAAGAPSSGMESVALYSFQATESDELAFNKGDTLKILNMEDDQNWYKAELRGVEGFIPKNYIRVKPHPWYSGRISRQLAEEILMKRNHLGAFLIRESESSPGEFSVSVKWANRGQRGAMPDGDLPSGQLAPSYGDQVQHFKVLREASGKYFLWEEKFNSLNELVDFYRTTTIAKKRQIFLRDEEPLLKSPGACFAQAQFDFSAQDPSQLSFRRGDIIEVLERPDPHWWRGRSCGRVGFFPRSYVQPVHL

SEQ ID NO: 885950 - protein, 200 aa, Homo sapiens
KNKRALKTKEDRPRLQRKQEAVGPALSPAAGAPSSGMESVALYSFQATESDELAFNKGDTLKILNMEDDQNWYKAELRGVEGFIPKNYIRVKPHPHLGPALPRPSLTSQPRTPRSSASAVATSLRSWSAQTPTGGGAGPAGALASSHGVTCSPCTCEQPGGRSGQRAFLQELRSREDMDTPSSVRVTRGSVDGLGLNVGS

SEQ ID NO: 885951 - protein, 241 aa, Homo sapiens
KNKRALKTKEDRPRLQRKQEAVGPALSPAAGAPSSGMESVALYSFQATESDELAFNKGDTLKILNMEDDQNWYKAELRGVEGFIPKNYIRVKPHPWYSGRISRQLAEEILMKRNHLGAFLIRESESSPGEFSVSVNHLGPALPRPSLTSQPRTPRSSASAVATSLRSWSAQTPTGGGAGPAGALASSHGVTCSPCTCEQPGGRSGQRAFLQELRSREDMDTPSSVRVTRGSVDGLGLNVGS

SEQ ID NO: 885952 - protein, 235 aa, Homo sapiens
KNKRALKTKEDRPRLQRKQEAVGPALSPAAGAPSSGMESVALYSFQATESDELAFNKGDTLKILNMEDDQNWYKAELRGVEGFIPKNYIRVKPHPWYSGRISRQLAEEILMKRNHLGAFLIRESESSPGEFSVSVKAQRGPCLGTKITQQIGVEPERTRDSCASLGIPSTAREGLHPSRIRTQAEVSEAQAEIRLLLQRPSFQGLVKWAVPDDPQACHWLLFGSDTPNLTKHFHF

SEQ ID NO: 885953 - protein, 118 aa, Homo sapiens
CLHQCPAPPKLSLTLVPVCCEQVVPPLLFTDGQTEAREGPCLMEIAQRAVSTQVGPHVHKPWLGWWRGCPRAPAPTPALFFLSGLTLLPLLLLLLLLLLLLPPPGQKNSLGRTGCCQH

SEQ ID NO: 885954 - protein, 657 aa, Homo sapiens
PPPQSPPAPLLSGGGGARDREQRLWRSWRSEIRELCFSEKRVAFWTCFRPPTSQRERIASQRKTNSEVPMHRSAPSQTTKRSRSPFSTTRRSWDDSESSGTNLNIDNEDYSRYPPREYRASGSRRGMAYGHIDSYGADDSEEEGAGPVERPPVRGKTGKFKDDKLYDPEKGARSLAGPPPHFSSFSRDVREERDKLDPVPAARCSASRADFLPQSSVASQSSSEGKLATKGDSSERERREQNLPARPSRAPVSICGGGENTSKSAEEPVVRPKIRNLASPNCVKPKIFFDTDDDDDMPHSTSRWRDTANDNEGHSDGLARRGRGESSSGYPEPKYPEDKREARSDQVKPEKVPRRRRTMADPDFWTHSDDYYKYCDEDSDSDKEWIAALRRKYRSREQTLSSSGESWETLPGKEEREPPQAKVSASTGTSPGPGASASAGAGAGASAGSNGSNYLEEVREPSLQEEQASLEEGEIPWLQYHENDSSSEGDNDSGHELMQPGVFMLDGNNNLEDDSSVSEDLEVDWSLFDGFADGLGVAEAISYVDPQFLTYMALEERLAQAMETALAHLESLAVDVEVANPPASKESIDALPEILVTEDHGAVGQEMCCPICCSEYVKGEVATELPCHHYFHKPCVSIWLQKSGTCPVCRCMFPPPL

SEQ ID NO: 885955 - protein, 644 aa, Homo sapiens
MGQESSKPVWPNPTGGYQSNTGRRYGRRHAYVSFFRPPTSQRERIASQRKTNSEVPMHRSAPSQTTKRSRSPFSTTRRSWDDSESSGTNLNIDNEDYSRYPPREYRASGSRRGMAYGHIDSYGADDSEEEGAGPVERPPVRGKTGKFKDDKLYDPEKGARSLAGPPPHFSSFSRDVREERDKLDPVPAARCSASRADFLPQSSVASQSSSEGKLATKGDSSERERREQNLPARPSRAPVSICGGGENTSKSAEEPVVRPKIRNLASPNCVKPKIFFDTDDDDDMPHSTSRWRDTANDNEGHSDGLARRGRGESSSGYPEPKYPEDKREARSDQVKPEKVPRRRRTMADPDFWTHSDDYYKYCDEDSDSDKEWIAALRRKYRSREQTLSSSGESWETLPGKEEREPPQAKVSASTGTSPGPGASASAGAGAGASAGSNGSNYLEEVREPSLQEEQASLEEGEIPWLQYHENDSSSEGDNDSGHELMQPGVFMLDGNNNLEDDSSVSEDLEVDWSLFDGFADGLGVAEAISYVDPQFLTYMALEERLAQAMETALAHLESLAVDVEVANPPASKESIDALPEILVTEDHGAVGQEMCCPICCSEYVKGEVATELPCHHYFHKPCVSIWLQKSGTCPVCRCMFPPPL

SEQ ID NO: 885956 - protein, 628 aa, Homo sapiens
QAGGWLRGCTGWVTQSSSDAYLWAQHLLAPAESCTRPPPPSPPPLSPPLPPLSPQQLGLGAHLWVSLTPYLSLAREMVMSWYFSPTRLPGGDSREAGLRSLKLPLQQTETRGDTGAGPVERPPVRGKTGKFKDDKLYDPEKGARSLAGPPPHFSSFSRDVREERDKLDPVPAARCSASRADFLPQSSVASQSSSEGKLATKGDSSERERREQNLPARPSRAPVSICGGGENTSKSAEEPVVRPKIRNLASPNCVKPKIFFDTDDDDDMPHSTSRWRDTANDNEGHSDGLARRGRGESSSGYPEPKYPEDKREARSDQVKPEKVPRRRRTMADPDFWTHSDDYYKYCDEDSDSDKEWIAALRRKYRSREQTLSSSGESWETLPGKEEREPPQAKVSASTGTSPGPGASASAGAGAGASAGSNGSNYLEEVREPSLQEEQASLEEGEIPWLQYHENDSSSEGDNDSGHELMQPGVFMLDGNNNLEDDSSVSEDLEVDWSLFDGFADGLGVAEAISYVDPQFLTYMALEERLAQAMETALAHLESLAVDVEVANPPASKESIDALPEILVTEDHGAVGQEMCCPICCSEYVKGEVATELPCHHYFHKPCVSIWLQKSGTCPVCRCMFPPPL

SEQ ID NO: 885957 - protein, 474 aa, Homo sapiens
PPPQSPPAPLLSGGGGARDREQRLWRSWRSEIRELCFSEKRVAFWTCFRPPTSQRERIASQRKTNSEVPMHRSAPSQTTKRSRSPFSTTRRSWDDSESSGTNLNIDNEDYSRYPPREYRASGSRRGMAYGHIDSYGADDSEEEGAGPVERPPVRGKTGKFKDDKLYDPEKGARSLAGPPPHFSSFSRDVREERDKLDPVPAARCSASRADFLPQSSVASQSSSEGKLATKGDSSERERREQNLPARPSRAPVSICGGGENTSKSAEEPVVRPKIRNLASPNCVKPKIFFDTDDDDDMPHSTSRWRDTANDNEGHSDGLARRGRGESSSGYPEPKYPEDKREARSDQVKPEKVPRRRRTMADPDFWTHSDDYYKYCDEDSDSDKEWIAALRRKYRSREQTLSSSGESWETLPGKEEREPPQAKVMLAAMAAITLKKFENHLFRKSRHPWKKEKFLGSSTMRMTVAVRGIMILVTS

SEQ ID NO: 885958 - protein, 262 aa, Homo sapiens
PPPQSPPAPLLSGGGGARDREQRLWRSWRSEIRELCFSEKRVAFWTCFRPPTSQRERIASQRKTNSEVPMHRSAPSQTTKRSRSPFSTTRRSWDDSESSGTNLNIDNEDYSRYPPREYRASGSRRGMAYGHIDSYGADDSEEEGAGPVERPPVRGKTGKFKDDKLYDPEKGARSLAGPPPHFSSFSRDVREERDKLDPVPAARCSASRADFLPQSSVASQSSSEGKLATKGDSSERERREQNLPARALLKLTMEIKPISQLA

SEQ ID NO: 885959 - protein, 131 aa, Homo sapiens
MGQESSKPVWPNPTGGYQSNTGRRYGRRHAYVSFFRPPTSQRERIASQRKTNSEVPMHRSAPSQTTKRSRSPFSTTRRSWDDSESSGTNLNIDNEDYSRYPPREYRASGSRRRQNHFCCMLWVDVPVIAVP

SEQ ID NO: 885960 - protein, 183 aa, Homo sapiens
LPFWTIPGPFPGPPRVRDSGHELMQPGVFMLDGNNNLEDDSSVSEDLEVDWSLFDGFADGLGVAEAISYVDPQFLTYMALEERLAQAMETALAHLESLAVDVEVANPPASKESIDALPEILVTEDHGAVGQEMCCPICCSEYVKGEVATELPCHHYFHKPCVSIWLQKSGTCPVCRCMFPPPL

SEQ ID NO: 885961 - protein, 459 aa, Homo sapiens
SRIAQFWMLSALEVQFHRDSQQQEAETPPTSSSGCGGGAGKPREEKRTALSKVVIRRLPPGLTKEQLEEQLRPLPAHDYFEFFAADLSLYPHLYSRAYINFRNPDDILLFRDRFDGYIFLDSKGLEYPAVVEFAPFQKIAKKKLRKKDAKTGSIEDDPEYKKFLETYCVEEEKTSANPETLLGEMEAKTRELIARRTTPLLEYIKNRKLEKQRIREEKREERRRRELEKKRLREEEKRRRREEERCKKKETDKQKKIAEKEVRIKLLKKPEKGEEPTTEKPKERGEEIDTGGGKQESCAPGAVVKARPMEGSLEEPQETSHSGSDKEHRDVERSQEQESEAQRYHVDDGRRHRAHHEPERLSRRSEDEQRWGKGPGQDRGKKGSQDSGAPGEAMERLGRAQRCDDSPAPRKERLANKDRPALQLYDPGARFRARECGGNRRICKAEGSGTGPEKREEAE

SEQ ID NO: 885962 - protein, 123 aa, Homo sapiens
LSRGFVGGWRLRLGGECGMRSEKEGAGGLRAAVAARGPSGREKLSALEVQFHRDSQQQEAETPPTSSSGCGGGAGKPREEKRTALSKVVIRRLPPGLTKEQLEEQLRPLPAHDYFEFFAADLR

SEQ ID NO: 885963 - protein, 439 aa, Homo sapiens
GRGPGLPARYAVPFELLVHAPPPVGTAARSPQVVIRRLPPGLTKEQLEEQLRPLPAHDYFEFFAADLSLYPHLYSRAYINFRNPDDILLFRDRFDGYIFLDSKGLEYPAVVEFAPFQKIAKKKLRKKDAKTGSIEDDPEYKKFLETYCVEEEKTSANPETLLGEMEAKTRELIARRTTPLLEYIKNRKLEKQRIREEKREERRRRELEKKRLREEEKRRRREEERCKKKETDKQKKIAEKEVRIKLLKKPEKGEEPTTEKPKERGEEIDTGGGKQESCAPGAVVKARPMEGSLEEPQETSHSGSDKEHRDVERSQEQESEAQRYHVDDGRRHRAHHEPERLSRRSEDEQRWGKGPGQDRGKKGSQDSGAPGEAMERLGRAQRCDDSPAPRKERLANKDRPALQLYDPGARFRARECGGNRRICKAEGSGTGPEKREEAE

SEQ ID NO: 885964 - protein, 346 aa, Homo sapiens
MASGTCFLLKGLEYPAVVEFAPFQKIAKKKLRKKDAKTGSIEDDPEYKKFLETYCVEEEKTSANPETLLGEMEAKTRELIARRTTPLLEYIKNRKLEKQRIREEKREERRRRELEKKRLREEEKRRRREEERCKKKETDKQKKIAEKEVRIKLLKKPEKGEEPTTEKPKERGEEIDTGGGKQESCAPGAVVKARPMEGSLEEPQETSHSGSDKEHRDVERSQEQESEAQRYHVDDGRRHRAHHEPERLSRRSEDEQRWGKGPGQDRGKKGSQDSGAPGEAMERLGRAQRCDDSPAPRKERLANKDRPALQLYDPGARFRARECGGNRRICKAEGSGTGPEKREEAE

SEQ ID NO: 885965 - protein, 461 aa, Homo sapiens
LSRGFVGGWRLRLGGECGMRSEKEGAGGLRAAVAARGPSGREKLSALEVQFHRDSQQQEAETPPTSSSGCGGGAGKPREEKRTALSKVVIRRLPPGLTKEQLEEQLRPLPAHDYFEFFAADLSLYPHLYSRAYINFRNPDDILLFRDRFDGYIFLDSKDPEYKKFLETYCVEEEKTSANPETLLGEMEAKTRELIARRTTPLLEYIKNRKLEKQRIREEKREERRRRELEKKRLREEEKRRRREEERCKKKETDKQKKIAEKEVRIKLLKKPEKGEEPTTEKPKERGEEIDTGGGKQESCAPGAVVKARPMEGSLEEPQETSHSGSDKEHRDVERSQEQESEAQRYHVDDGRRHRAHHEPERLSRRSEDEQRWGKGPGQDRGKKGSQDSGAPGEAMERLGRAQRCDDSPAPRKERLANKDRPALQLYDPGARFRARECGGNRRICKAEGSGTGPEKREEAE

SEQ ID NO: 885966 - protein, 494 aa, Homo sapiens
LSRGFVGGWRLRLGGECGMRSEKEGAGGLRAAVAARGPSGREKLSALEVQFHRDSQQQEAETPPTSSSGCGGGAGKPREEKRTALSKVVIRRLPPGLTKEQLEEQLRPLPAHDYFEFFAADLSLYPHLYSRAYINFRNPDDILLFRDRFDGYIFLDSKGLEYPAVVEFAPFQKIAKKKLRKKDAKTGSIEDDPEYKKFLETYCVEEEKTSANPETLLGEMEAKTRELIARRTTPLLEYIKNRKLEKQRIREEKREERRRRELEKKRLREEEKRRRREEERCKKKETDKQKKIAEKEVRIKLLKKPEKGEEPTTEKPKERGEEIDTGGGKQESCAPGAVVKARPMEGSLEEPQETSHSGSDKEHRDVERSQEQESEAQRYHVDDGRRHRAHHEPERLSRRSEDEQRWGKGPGQDRGKKGSQDSGAPGEAMERLGRAQRCDDSPAPRKERLANKDRPALQLYDPGARFRARECGGNRRICKAEGSGTGPEKREEAE

SEQ ID NO: 885967 - protein, 275 aa, Homo sapiens
MEAKTRELIARRTTPLLEYIKNRKLEKQRIREEKREERRRRELEKKRLREEEKRRRREEERCKKKETDKQKKIAEKEVRIKLLKKPEKGEEPTTEKPKERGEEIDTGGGKQESCAPGAVVKARPMEGSLEEPQETSHSGSDKEHRDVERSQEQESEAQRYHVDDGRRHRAHHEPERLSRRSEDEQRWGKGPGQDRGKKGSQDSGAPGEAMERLGRAQRCDDSPAPRKERLANKDRPALQLYDPGARFRARECGGNRRICKAEGSGTGPEKREEAE

SEQ ID NO: 885968 - protein, 168 aa, Homo sapiens [sequence omitted]

SEQ ID NO: 885969 - protein, 168 aa, Homo sapiens [sequence omitted]

SEQ ID NO: 885970 - protein, 91 aa, Homo sapiens
SRIAQFWMLSALEVQFHRDSQQQEAETPPTSSSGCGGGAGKPREEKRTALSKVVIRRLPPGLTKEQLEEQLRPLPAHDYFEFFAADLRSRI

SEQ ID NO: 885971 - protein, 66 aa, Homo sapiens
GRGPGLPARYAVPFELLVHAPPRWERPRAPRRWSSAACLRASPRSSWRSSCARCQHTTTSSSSPPT

SEQ ID NO: 885972 - protein, 494 aa, Homo sapiens; identical to SEQ ID NO: 885966

SEQ ID NO: 885973 - protein, 346 aa, Homo sapiens; identical to SEQ ID NO: 885964

SEQ ID NO: 885974 - protein, 394 aa, Homo sapiens
KEAKLMDYCIFQLTIFTVISYFSLYPHLYSRAYINFRNPDDILLFRDRFDGYIFLDSKGLEYPAVVEFAPFQKIAKKKLRKKDAKTGSIEDDPEYKKFLETYCVEEEKTSANPETLLGEMEAKTRELIARRTTPLLEYIKNRKLEKQRIREEKREERRRRELEKKRLREEEKRRRREEERCKKKETDKQKKIAEKEVRIKLLKKPEKGEEPTTEKPKERGEEIDTGGGKQESCAPGAVVKARPMEGSLEEPQETSHSGSDKEHRDVERSQEQESEAQRYHVDDGRRHRAHHEPERLSRRSEDEQRWGKGPGQDRGKKGSQDSGAPGEAMERLGRAQRCDDSPAPRKERLANKDRPALQLYDPGARFRARECGGNRRICKAEGSGTGPEKREEAE

SEQ ID NO: 885975 - protein, 406 aa, Homo sapiens
GRGPGLPARYAVPFELLVHAPPPVGTAARSPQVVIRRLPPGLTKEQLEEQLRPLPAHDYFEFFAADLSLYPHLYSRAYINFRNPDDILLFRDRFDGYIFLDSKDPEYKKFLETYCVEEEKTSANPETLLGEMEAKTRELIARRTTPLLEYIKNRKLEKQRIREEKREERRRRELEKKRLREEEKRRRREEERCKKKETDKQKKIAEKEVRIKLLKKPEKGEEPTTEKPKERGEEIDTGGGKQESCAPGAVVKARPMEGSLEEPQETSHSGSDKEHRDVERSQEQESEAQRYHVDDGRRHRAHHEPERLSRRSEDEQRWGKGPGQDRGKKGSQDSGAPGEAMERLGRAQRCDDSPAPRKERLANKDRPALQLYDPGARFRARECGGNRRICKAEGSGTGPEKREEAE

SEQ ID NO: 885976 - protein, 168 aa, Homo sapiens [sequence omitted]

SEQ ID NO: 885977 - protein, 331 aa, Homo sapiens
MASGTCFLLKGLEYPAVVEFAPFQKIAKKKLRKKDAKTGSIEDDPEYKKFLETYCVEEEKTSANPETLLGEMEAKTRELIARRTTPLLEYIKNRKLEKQRIREEKREERRRRELEKKRLREEEKRRRREEERCKKKETDKQKKIAEKEVRIKLLKKPEKGEEPTTEKPKERGEEIDTGGGKQESCAPGAVVSHSGSDKEHRDVERSQEQESEAQRYHVDDGRRHRAHHEPERLSRRSEDEQRWGKGPGQDRGKKGSQDSGAPGEAMERLGRAQRCDDSPAPRKERLANKDRPALQLYDPGARFRARECGGNRRICKAEGSGTGPEKREEAE

SEQ ID NO: 885978 - protein, 400 aa, Homo sapiens
GRGPGLPARYAVPFELLVHAPPPVGTAARSPQVVIRRLPPGLTKEQLEEQLRPLPAHDYFEFFAADLSLYPHLYSRAYINFRNPDDILLFRDRFDGYIFLDSKGLEYPAVVEFAPFQKIAKKKLRKKDAKTGSIEDDPEYKKFLETYCVEEEKTSANPETLLGEMEAKTRELIARRTTPLLEYIKNRKLEKQRIREEKREERRRRELEKKRLREEEKRRRREEERCKKKETDKQKKIAEKEVRIKLLKKPEKGEEPTTEKPKERGEEIDTGGGKQESCAPGAVVKARPMEGSLEEPQETSHSGSDKEHRDVERSQEQESEAQRYHVDDGRRHRAHHEPERLSRRSEDEQRWGKGPGQDRGKKGSQDSGAPGEAMERLGRAQRCDDSPAPRKERLANKGFY

SEQ ID NO: 885979 - protein, 254 aa, Homo sapiens
LSRGFVGGWRLRLGGECGMRSEKEGAGGLRAAVAARGPSGREKLSALEVQFHRDSQQQEAETPPTSSSGCGGGAGKPREEKRTALSKVVIRRLPPGLTKEQLEEQLRPLPAHDYFEFFAADLSLYPHLYSRAYINFRNPDDILLFRDRFDGYIFLDSKGLEYPAVVEFAPFQKIAKKKLRKKDAKTGSIEDDPEYKKFLETYCVEEEKTSANPETLLGEMEAKTRELIGLFCSFLLFSLLRDLLVEDIRFFSFS

SEQ ID NO: 885980 - protein, 437 aa, Homo sapiens
MEKELRSTILFNAYKKEIFTTNNGYKSMQKKLRSNWKIQSLKDEITSEKLNGVKLWITAGPREKFTAAEFEILKKYLDTGGDVFVMLGEGGESRFDTNINFLLEEYGIMVNNDAVVRNVYHKYFHPKEALVSSGVLNREISRAAGKAVPGIIDEESSGNNAQALTFVYPFGATLSVMKPAVAVLSTGSVCFPLNRPILAFYHSKNQGGKLAVLGSCHMFSDQYLDKEENSKIMDVVFQWLTTGDIHLNQIDAEDPEISDYMMLPYTATLSKRNRECLQESDEIPRDFTTLFDLSIFQLDTTSFHSVIEAHEQLNVKHEPLQLIQPQFETPLPTLQPAVFPPSFRELPPPPLELFDLDETFSSEKARLAQITNKCTEEDLEFYVRKCGDILGVTSKLPKDQQDAKHILEHVFFQVVEFKKLNQEHDIDTSETAFQNNF

SEQ ID NO: 885981 - protein, 352 aa, Homo sapiens [sequence omitted]

SEQ ID NO: 885982 - protein, 485 aa, Homo sapiens
MEKELRSTILFNAYKKEIFTTNNGYKSMQKKLRSNWKIQSLKDEITSEKLNGVKLWITAGPREKFTAAEFEILKKYLDTGGDVFVMLGEGGESRFDTNINFLLEEYGIMVNNDAVVRNVYHKYFHPKEALVSSGVLNREISRAAGKAVPGIIDEESSGNNAQLSVFSDAIMRKMYHFGVFFFKMKRAFVSGYKNNQNLKVQEEKSRSSALALTFVYPFGATLSVMKPAVAVLSTGSVCFPLNRPILAFYHSKNQGGKLAVLGSCHMFSDQYLDKEENSKIMDVVFQWLTTGDIHLNQIDAEDPEISDYMMLPYTATLSKRNRECLQESDEIPRDFTTLFDLSIFQLDTTSFHSVIEAHEQLNVKHEPLQLIQPQFETPLPTLQPAVFPPSFRELPPPPLELFDLDETFSSEKARLAQITNKCTEEDLEFYVRKCGDILGVTSKLPKDQQDAKHILEHVFFQVVEFKKLNQEHDIDTSETAFQNNF

SEQ ID NO: 885983 - protein, 266 aa, Homo sapiens
MEKELRSTILFNAYKKEIFTTNNGYKSMQKKLRSNWKIQSLKDEITSEKLNGVKLWITAGPREKFTAAEFEILKKYLDTGGDVFVMLGEGGESRFDTNINFLLEEYGIMVNNDAVVRNVYHKYFHPKEALVSSGVLNREISRAAGKAVPGIIDEESSGNNAQALTFVYPFGATLSVMKPAVAVLSTGSVCFPLNRPILAFYHSKNQGGKLAVLGSCHMFSDQYLDKEENSKIMDVVFQWLTTGDIHLNQIDAEDPEVDTELLETFK

SEQ ID NO: 885984 - protein, 437 aa, Homo sapiens; identical to SEQ ID NO: 885980

SEQ ID NO: 885985 - protein, 474 aa, Homo sapiens
MEKELRSTILFNAYKKEIFTTNNGYKSMQKKLRSNWKIQSLKDEITSEKLNGVKLWITAGPREKFTAAEFEILKKYLDTGGDVFVMLGEGGESRFDTNINFLLEEYGIMVNNDAVVRNVYHKYFHPKEALVSSGVLNREISRAAGKAVPGIIDEESSGNNAQALTFVYPFGATLSVMKPAVAVLSTGSVCFPLNRPILAFYHSKRQVSQAGVHGAVIAHCNLELLGSSDSPAPASQVAGLQNQGGKLAVLGSCHMFSDQYLDKEENSKIMDVVFQWLTTGDIHLNQIDAEDPEISDYMMLPYTATLSKRNRECLQESDEIPRDFTTLFDLSIFQLDTTSFHSVIEAHEQLNVKHEPLQLIQPQFETPLPTLQPAVFPPSFRELPPPPLELFDLDETFSSEKARLAQITNKCTEEDLEFYVRKCGDILGVTSKLPKDQQDAKHILEHVFFQVVEFKKLNQEHDIDTSETAFQNNF

SEQ ID NO: 885986 - protein, 373 aa, Homo sapiens
MEKELRSTILFNAYKKEIFTTNNGYKSMQKKLRSNWKIQSLKDEITSEKLNGVKLWITAGPREKFTAAEFEILKKYLDTGGDVFVMLGEGGESRFDTNINFLLEEYGIMVNNDAVVRNVYHKYFHPKEALVSSGVLNREISRAAGKAVPGIIDEESSGNNAQALTFVYPFGATLSVMKPAVAVLSTGSVCFPLNRPILAFYHSKNQGGKLAVLGSCHMFSDQYLDKEENSKIMDVVFQWLTTGDIHLNQIDAEDPEISDYMMLPYTATLSKRNRECLQESDEIPRDFTTLFDLSIFQLDTTSFHSVIEAHEQLNVKHEPLQLIQPQFETPLPTLQPAVFPPSFRELPPPPLELFDLDETFSSEKARLAQITNK

SEQ ID NO: 885987 - protein, 236 aa, Homo sapiens
MEKELRSTILFNAYKKEIFTTNNGYKSMQKKLRSNWKIQSLKDEITSEKLNGVKLWITAGPREKFTAAEFEILKKYLDTGGDVFVMLGEGGESRFDTNINFLLEEYGIMVNNDAVVRNVYHKYFHPKEALVSSGVLNREISRAAGKAVPGIIDEESSGNNAQALTFVYPFGATLSVMKPAVAVLSTGSVCFPLNRPILAFYHSKVQLFLDMGIDVIFIVEIIKTTLPFPEGFYMFS

SEQ ID NO: 885988 - protein, 216 aa, Homo sapiens
MEKELRSTILFNAYKKEIFTTNNGYKSMQKKLRSNWKIQSLKDEITSEKLNGVKLWITAGPREKFTAAEFEILKKYLDTGGDVFVMLGEGGESRFDTNINFLLEEYGIMVNNDAVVRNVYHKYFHPKEALVSSGVLNREISRAAGKAVPGIIDEESSGNNAQALTFVYPFGATLSVMKPAVAVLSTGSVCFPLNRPILAFYHSKRQGFPGWCMVQS

SEQ ID NO: 885989 - protein, 235 aa, Homo sapiens
MNSYFTNPSLSCHLAGGQDVLPNVALNSTAYDPVRHFSTYGAAVAQNRIYSTPFYSPQENVVFSSSRGPYDYGSNSFYQEKDMLSNCRQNTLGHNTQTSIAQDFSSEQGRTAPQDQKASIQIYPWMQRMNSHSGVGYGADRRRGRQIYSRYQTLELEKEFHFNRYLTRRRRIEIANALCLTERQIKIWFQNRRMKWKKESNLTSTLSGGGGGATADSLGGKEEKREETEEEKQKE

SEQ ID NO: 885990 - protein, 222 aa, Homo sapiens
MSSYVANSFYKQSPNIPAYNMQTCGNYGSASEVQASRYCYGGLDLSITFPPPAPSNSLHGVDMAANPRAHPDRPACSAAAAPGHAPGRDEAAPLNPGMYSQKAARPALEERAKSSGEIKEEQAQTGQPAGLSQPPAPPQIYPWMTKLHMSHETDGKRSRTSYTRYQTLELEKEFHFNRYLTRRRRIEIANNLCLNERQIKIWFQNRRMKWKKDSKMKSKEAL

SEQ ID NO: 885991 - protein, 262 aa, Homo sapiens
MSSYLMDSNYIDPKFPPCEEYSQNSYIPEHSPEYYGRTRESGFQHHHQELYPPPPPRPSYPERQYSCTSLQGPGNSRGHGPAQAGHHHPEKSQSLCEPAPLSGASASPSPAPPACSQPAPDHPSSAASKQPIVYPWMKKIHVSTVNPNYNGGEPKRSRAAYTRQQVLELEKEFHYNRYLTRRRRIEIAHSLCLSERQIKIWFQNRRMKWKKDHRLPNTKVRSAPPAGAAPSTLSAATPGTSEDHSQSATPPEQQRAEDITRL

SEQ ID NO: 885992 - protein, 262 aa, Homo sapiens; identical to SEQ ID NO: 885991

SEQ ID NO: 885993 - protein, 153 aa, Homo sapiens
MLSNCRQNTLGHNTQTSIAQDFSSEQGRTAPQDQKASIQIYPWMQRMNSHSGVGYGADRRRGRQIYSRYQTLELEKEFHFNRYLTRRRRIEIANALCLTERQIKIWFQNRRMKWKKESNLTSTLSGGGGGATADSLGGKEEKREETEEEKQKE

SEQ ID NO: 885994 - protein, 235 aa, Homo sapiens; identical to SEQ ID NO: 885989

SEQ ID NO: 885995 - protein, 153 aa, Homo sapiens; identical to SEQ ID NO: 885993

SEQ ID NO: 885996 - protein, 126 aa, Homo sapiens
VSFPETPKSDSQTPSPNEIKTEQSLAGPKGSPSESEKERAKAADSSPDTSDNEAKETDGKRSRTSYTRYQTLELEKEFHFNRYLTRRRRIEIANNLCLNERQIKIWFQNRRMKWKKDSKMKSKEAL

SEQ ID NO: 885997 - protein, 110 aa, Homo sapiens
MCFVPGSLGVGYGADRRRGRQIYSRYQTLELEKEFHFNRYLTRRRRIEIANALCLTERQIKIWFQNRRMKWKKESNLTSTLSGGGGGATADSLGGKEEKREETEEEKQKE

SEQ ID NO: 885998 - protein, 209 aa, Homo sapiens
SGIGPNQRDRVFWVSLPEALEGEKENVVFSSSRGPYDYGSNSFYQEKDMLSNCRQNTLGHNTQTSIAQDFSSEQGRTAPQDQKASIQIYPWMQRMNSHSVCFVPGSLGVGYGADRRRGRQIYSRYQTLELEKEFHFNRYLTRRRRIEIANALCLTERQIKIWFQNRRMKWKKESNLTSTLSGGGGGATADSLGGKEEKREETEEEKQKE

SEQ ID NO: 885999 - protein, 90 aa, Homo sapiens
MSSYLMDSNYIDPKFPPCEEYSQNSYIPEHSPEYYGRTRESGFQHHHQELYPPPPPRPSYPERQYSCTSLQGPGNSRGHGPAQAGHHHPE

SEQ ID NO: 886000 - protein, 130 aa, Homo sapiens
IFLPAEPMVHIGLSPEILLDPWTHLGKGHGRSWLEFCPTLTNPSNFSKSQSRALHLFLGLAAGPPGCQSISSAIFCDHGCWLPLALCKQTHSHLLSQPPGALSTPHAWCRRDWTDLRKAVKWGQEDSAQE

SEQ ID NO: 886001 - protein, 79 aa, Homo sapiens
RRMARSMTPRMPHSMHAVGAGALGRRISRKRILSRAQDCRNSAEAGKNMGSPEDRLLSRAEAMKKCFRGRQSGNESIIH

SEQ ID NO: 886002 - protein, 130 aa, Homo sapiens; identical to SEQ ID NO: 886000

SEQ ID NO: 886003 - protein, 130 aa, Homo sapiens; identical to SEQ ID NO: 886000

SEQ ID NO: 886004 - protein, 130 aa, Homo sapiens; identical to SEQ ID NO: 886000

SEQ ID NO: 886005 - protein, 130 aa, Homo sapiens; identical to SEQ ID NO: 886000

SEQ ID NO: 886006 - protein, 130 aa, Homo sapiens; identical to SEQ ID NO: 886000

SEQ ID NO: 886007 - protein, 396 aa, Homo sapiens
SIKAARGSQESEGRTYSPRHPGCAHAVPVCSWRASGHREPPAQPAPAPQEPAKMPRRSLHAAAVLLLVILKEQPSSPAPVNGSKWTYFGPDGENSWSKKYPSCGGLLQSPIDLHSDILQYDASLTPLEFQGYNLSANKQFLLTNNGHSVKLNLPSDMHIQGLQSRYSATQLHLHWGNPNDPHGSEHTVSGQHFAAELHIVHYNSDLYPDASTASNKSEGLAVLAVLIEMGSFNPSYDKIFSHLQHVKYKGQEAFVPGFNIEELLPERTAEYYRYRGSLTTPPCNPTVLWTVFRNPVQISQEQLLALETALYCTHMDDPSPREMINNFRQVQKFDERLVYTSFSQGIILSLALAGILGICIVVVVSIWLFRRKSIKKGDNKGVIYKPATKMETEAHA

SEQ ID NO: 886008 - protein, 396 aa, Homo sapiens; identical to SEQ ID NO: 886007

SEQ ID NO: 886009 - protein, 420 aa, Homo sapiens
SIKAARGSQESEGRTYSPRHPGCAHAVPVCSWRASGHREPPAQPAPAPQEPAKMPRRSLHAAAVLLLVILKEQPSSPAPVNVQVDLFVVLMGRIAGPKKYPSQMLVRSHWHWPRVHHPPSYGTIATSLPILQYDASLTPLEFQGYNLSANKQFLLTNNGHSVKLNLPSDMHIQGLQSRYSATQLHLHWGNPNDPHGSEHTVSGQHFAAELHIVHYNSDLYPDASTASNKSEGLAVLAVLIEMGSFNPSYDKIFSHLQHVKYKGQEAFVPGFNIEELLPERTAEYYRYRGSLTTPPCNPTVLWTVFRNPVQISQEQLLALETALYCTHMDDPSPREMINNFRQVQKFDERLVYTSFSQVQVCTAAGLSLGIILSLALAGILGICIVVVVSIWLFRRKSIKKGDNKGVIYKPATKMETEAHA

SEQ ID NO: 886010 - protein, 145 aa, Homo sapiens
HHPLTGPGWHSWHLYCGGGVHLAFQKEEVSWFGSKMGMDSYVSMMISLPGKAALWHEEPQSPGPPLTLGGPSPKHPCPGLLCMRRTCDPGRSKGSGVTVLRFGSVCALLAAIAWPWTSLLTWGLCLKLSSQAVFLSRSLHMLFGL

SEQ ID NO: 886011 - protein, 407 aa, Homo sapiens
SIKAARGSQESEGRTYSPRHPGCAHAVPVCSWRASGHREPPAQPAPAPQEPAKMPRRSLHAAAVLLLVILKEQPSSPAPVNGSKWTYFGPDGENSWSKKYPSCGGLLQSPIDLHSDILQYDASLTPLEFQGYNLSANKQFLLTNNGHSVKLNLPSDMHIQGLQSRYSATQLHLHWGNPNDPHGSEHTVSGQHFAAELHIVHYNSDLYPDASTASNKSEGLAVLAVLIEMGSFNPSYDKIFSHLQHVKYKGQEAFVPGFNIEELLPERTAEYYRYRGSLTTPPCNPTVLWTVFRNPVQISQEQLLALETALYCTHMDDPSPREMINNFRQVQKFDERLVYTSFSQVQVCTAAGLSLGIILSLALAGILGICIVVVVSIWLFRRKSIKKGDNKGVIYKPATKMETEAHA

SEQ ID NO: 886012 - protein, 407 aa, Homo sapiens; identical to SEQ ID NO: 886011

SEQ ID NO: 886013 - protein, 255 aa, Homo sapiens
SIKAARGSQESEGRTYSPRHPGCAHAVPVCSWRASGHREPPAQPAPAPQEPAKMPRRSLHAAAVLLLVILKEQPSSPAPVNGSKWTYFGPDGENSWSKKYPSCGGLLQSPIDLHSDILQYDASLTPLEFQGYNLSANKQFLLTNNGHSVKLNLPSDMHIQGLQSRYSATQLHLHWGNPNDPHGSEHTVSGQHFAAELHIVHYNSDLYPDASTASNKSEGLAVLAVLIEMGSFNPSYDKIFSHLQHVKYKAQVALV

SEQ ID NO: 886014 - protein, 130 aa, Homo sapiens
MGMGWKTAMSATWCSPEGQGMGQGPGREVGGNSAASGPASPIRDPCLSEAGLKGPPSAHPLRLCLLHRLVCFSGGLTSIQLSPRTCCSHQWAQLFSPACFPQWRAPGCSLDDSRSLTRIRPVHLPGPSLD

SEQ ID NO: 886015 - protein, 130 aa, Homo sapiens; identical to SEQ ID NO: 886014

SEQ ID NO: 886016 - protein, 130 aa, Homo sapiens; identical to SEQ ID NO: 886014

SEQ ID NO: 886017 - protein, 130 aa, Homo sapiens; identical to SEQ ID NO: 886014

SEQ ID NO: 886018 - protein, 130 aa, Homo sapiens; identical to SEQ ID NO: 886014

SEQ ID NO: 886019 - protein, 114 aa, Homo sapiens
MASSVGNVADSTEPTKRMLSFQGLAELAHREYQAGDFEAAERHCMQLWRQEPDNTGVLLLLSSIHFQCRRLDRSAHFSTLAIKQNPLLAEAYSNSAPARPYSPSRAPPRPLSPP

SEQ ID NO: 886020 - protein, 1219 aa, Homo sapiens
MSNLIDWLPQSYSVAFLDKIGFEHTSSPTNLIKQIFSMGLSSRLMDLVGRLLRLGVFYVAQQFAAIAQCDAVRLRKRCLRSHYRDLNLGAILSCEVSASVLLGRRGIVRMKLKAWLYDDPTWQKDIFLLSSIVLMLVRNIVEEQHFPKCVSEYSNKMPNERRVPWSTKFREPCYTIKGLGKSSKETYFPNLFDHELLFFQPYLLTPHRTHFGNSGGRKTRPQVAPSEVALENMTRARSCLDKRTPAESLIATDFPVKSQCKGWSLVGRTEHGGLHLGSGGAGAGSSQLWQRISFGASEPMLQGHFWLVREGIMISPSSPPPPNLFFFPLQIFPFPFTSFPSHLLSLTPPKACYLKAIETQPNFAVAWSNLGCVFNAQGEIWLAIHHFEKAVTLDPNFLDAYINLGNVLKEARIFDRAVAAYLRALSLSPNHAVVHGNLACVYYEQGLIDLAIDTYRRAIELQPHFPDAYCNLANALKEKGSVAEAEDCYNTALRLCPTHADSLNNLANIKREQGNIEEAVRLYRKALEVFPEFAAAHSNLASVLQQQGKLQEALMHYKEAIRISPTFADAYSNMGNTLKEMQDVQGALQCYTRAIQINPAFADAHSNLASIHKDSGNIPEAIASYRTALKLKPDFPDAYCNLAHCLQIVCDWTDYDERMKKLVSIVADQLEKNRLPSVHPHHSMLYPLSHGFRKAIAERHGNLCLDKINVLHKPPYEHPKDLKLSDGRLRVGYVSSDFGNHPTSHLMQSIPGMHNPDKFEVFCYALSPDDGTNFRVKVMAEANHFIDLSQIPCNGKAADRIHQDGIHILVNMNGYTKGARNELFALRPAPIQAMWLGYPGTSGALFMDYIITDQETSPAEVAEQYSEKLAYMPHTFFIGDHANMFPHLKKKAVIDFKSNGHIYDNRIVLNGIDLKAFLDSLPDVKIVKMKCPDGGDNADSSNTALNMPVIPMNTIAEAVIEMINRGQIQITINGFSISNGLATTQINNKAATGEEVPRTIIVTTRSQYGLPEDAIVYCNFNQLYKIDPSTLQMWANILKRVPNSVLWLLRFPAVGEPNIQQYAQNMGLPQNRIIFSPVAPKEEHVRRGQLADVCLDTPLCNGHTTGMDVLWAGTPMVTMPGETLASRVAASQLTCLGCLELIAKNRQEYEDIAVKLGTDLEYLKKVRGKVWKQRISSPLFNTKQYTMELERLYLQMWEHYAAGNKPDHMIKPVEVTESA

SEQ ID NO: 886021 - protein, 1175 aa, Homo sapiens
MDLVGRLLRLGVFYVAQQFAAIAQCDAVRLRKRCLRSHYRDLNLGAILSCEVSASVLLGRRGIVRMKLKAWLYDDPTWQKDIFLLSSIVLMLVRNIVEEQHFPKCVSEYSNKMPNERRVPWSTKFREPCYTIKGLGKSSKETYFPNLFDHELLFFQPYLLTPHRTHFGNSGGRKTRPQVAPSEVALENMTRARSCLDKRTPAESLIATDFPVKSQCKGWSLVGRTEHGGLHLGSGGAGAGSSQLWQRISFGASEPMLQGHFWLVREGIMISPSSPPPPNLFFFPLQIFPFPFTSFPSHLLSLTPPKACYLKAIETQPNFAVAWSNLGCVFNAQGEIWLAIHHFEKAVTLDPNFLDAYINLGNVLKEARIFDRAVAAYLRALSLSPNHAVVHGNLACVYYEQGLIDLAIDTYRRAIELQPHFPDAYCNLANALKEKGSVAEAEDCYNTALRLCPTHADSLNNLANIKREQGNIEEAVRLYRKALEVFPEFAAAHSNLASVLQQQGKLQEALMHYKEAIRISPTFADAYSNMGNTLKEMQDVQGALQCYTRAIQINPAFADAHSNLASIHKDSGNIPEAIASYRTALKLKPDFPDAYCNLAHCLQIVCDWTDYDERMKKLVSIVADQLEKNRLPSVHPHHSMLYPLSHGFRKAIAERHGNLCLDKINVLHKPPYEHPKDLKLSDGRLRVGYVSSDFGNHPTSHLMQSIPGMHNPDKFEVFCYALSPDDGTNFRVKVMAEANHFIDLSQIPCNGKAADRIHQDGIHILVNMNGYTKGARNELFALRPAPIQAMWLGYPGTSGALFMDYIITDQETSPAEVAEQYSEKLAYMPHTFFIGDHANMFPHLKKKAVIDFKSNGHIYDNRIVLNGIDLKAFLDSLPDVKIVKMKCPDGGDNADSSNTALNMPVIPMNTIAEAVIEMINRGQIQITINGFSISNGLATTQINNKAATGEEVPRTIIVTTRSQYGLPEDAIVYCNFNQLYKIDPSTLQMWANILKRVPNSVLWLLRFPAVGEPNIQQYAQNMGLPQNRIIFSPVAPKEEHVRRGQLADVCLDTPLCNGHTTGMDVLWAGTPMVTMPGETLASRVAASQLTCLGCLELIAKNRQEYEDIAVKLGTDLEYLKKVRGKVWKQRISSPLFNTKQYTMELERLYLQMWEHYAAGNKPDHMIKPVEVTESA

SEQ ID NO: 886022 - protein, 1219 aa, Homo sapiens; identical to SEQ ID NO: 886020

SEQ ID NO: 886023 - protein, 1036 aa, Homo sapiens
MASSVGNVADSTGLAELAHREYQAGDFEAAERHCMQLWRQEPDNTGVLLLLSSIHFQCRRLDRSAHFSTLAIKQNPLLAEAYSNLGNVYKERGQLQEAIEHYRHALRLKPDFIDGYINLAAALVAAGDMEGAVQAYVSALQYNPDLYCVRSDLGNLLKALGRLEEAKACYLKAIETQPNFAVAWSNLGCVFNAQGEIWLAIHHFEKAVTLDPNFLDAYINLGNVLKEARIFDRAVAAYLRALSLSPNHAVVHGNLACVYYEQGLIDLAIDTYRRAIELQPHFPDAYCNLANALKEKGSVAEAEDCYNTALRLCPTHADSLNNLANIKREQGNIEEAVRLYRKALEVFPEFAAAHSNLASVLQQQGKLQEALMHYKEAIRISPTFADAYSNMGNTLKEMQDVQGALQCYTRAIQINPAFADAHSNLASIHKDSGNIPEAIASYRTALKLKPDFPDAYCNLAHCLQIVCDWTDYDERMKKLVSIVADQLEKNRLPSVHPHHSMLYPLSHGFRKAIAERHGNLCLDKINVLHKPPYEHPKDLKLSDGRLRVGYVSSDFGNHPTSHLMQSIPGMHNPDKFEVFCYALSPDDGTNFRVKVMAEANHFIDLSQIPCNGKAADRIHQDGIHILVNMNGYTKGARNELFALRPAPIQAMWLGYPGTSGALFMDYIITDQETSPAEVAEQYSEKLAYMPHTFFIGDHANMFPHLKKKAVIDFKSNGHIYDNRIVLNGIDLKAFLDSLPDVKIVKMKCPDGGDNADSSNTALNMPVIPMNTIAEAVIEMINRGQIQITINGFSISNGLATTQINNKAATGEEVPRTIIVTTRSQYGLPEDAIVYCNFNQLYKIDPSTLQMWANILKRVPNSVLWLLRFPAVGEPNIQQYAQNMGLPQNRIIFSPVAPKEEHVRRGQLADVCLDTPLCNGHTTGMDVLWAGTPMVTMPGETLASRVAASQLTCLGCLELIAKNRQEYEDIAVKLGTDLEYLKKVRGKVWKQRISSPLFNTKQYTMELERLYLQMWEHYAAGNKPDHMIKPVEVTESA

SEQ ID NO: 886024 - protein, 1154 aa, Homo sapiens
MSNLIDWLPQSYSVAFLDKIGFEHTSSPTNLIKQIFSMGLSSRLMDLVGRLLRLGVFYVAQQFAAIAQCDAVRLRKRCLRSHYRDLNLGAILSCEVSASVLLGRRGIVRMKLKAWLYDDPTWQKDIFLLSSIVLMLVRNIVEEQHFPKCVSEYSNKMPNERRVPWSTKFREPCYTIKGLGKSSKETYFPNLFDHELLFFQPYLLTPHRTHFGNSGGRKTRPQVAPSEVALENMTRARSCLDKRTPAESLIATDFPVKSQCKGWSLVGRTEHGGLHLGSGGAGAGSSQLWQRISFGASEPMLQGHFWLVREGIMISPSSPPPPNLFFFPLQIFPFPFTSFPSHLLSLTPPKACYLKAIETQPNFAVAWSNLGCVFNAQGEIWLAIHHFEKAVTLDPNFLDAYINLGNVLKEARIFDKVAEAEDCYNTALRLCPTHADSLNNLANIKREQGNIEEAVRLYRKALEVFPEFAAAHSNLASVLQQQGKLQEALMHYKEAIRISPTFADAYSNMGNTLKEMQDVQGALQCYTRAIQINPAFADAHSNLASIHKDSGNIPEAIASYRTALKLKPDFPDAYCNLAHCLQIVCDWTDYDERMKKLVSIVADQLEKNRLPSVHPHHSMLYPLSHGFRKAIAERHGNLCLDKINVLHKPPYEHPKDLKLSDGRLRVGYVSSDFGNHPTSHLMQSIPGMHNPDKFEVFCYALSPDDGTNFRVKVMAEANHFIDLSQIPCNGKAADRIHQDGIHILVNMNGYTKGARNELFALRPAPIQAMWLGYPGTSGALFMDYIITDQETSPAEVAEQYSEKLAYMPHTFFIGDHANMFPHLKKKAVIDFKSNGHIYDNRIVLNGIDLKAFLDSLPDVKIVKMKCPDGGDNADSSNTALNMPVIPMNTIAEAVIEMINRGQIQITINGFSISNGLATTQINNKAATGEEVPRTIIVTTRSQYGLPEDAIVYCNFNQLYKIDPSTLQMWANILKRVPNSVLWLLRFPAVGEPNIQQYAQNMGLPQNRIIFSPVAPKEEHVRRGQLADVCLDTPLCNGHTTGMDVLWAGTPMVTMPGETLASRVAASQLTCLGCLELIAKNRQEYEDIAVKLGTDLEYLKKVRGKVWKQRISSPLFNTKQYTMELERLYLQMWEHYAAGNKPDHMIKPVEVTESA

SEQ ID NO: 886025 - protein, 665 aa, Homo sapiens
MHYKEAIRISPTFADAYSNMGNTLKEMQDVQGALQCYTRAIQINPAFADAHSNLASIHKDSGNIPEAIASYRTALKLKPDFPDAYCNLAHCLQIVCDWTDYDERMKKLVSIVADQLEKNRLPSVHPHHSMLYPLSHGFRKAIAERHGNLCLDKINVLHKPPYEHPKDLKLSDGRLRVGYVSSDFGNHPTSHLMQSIPGMHNPDKFEVFCYALSPDDGTNFRVKVMAEANHFIDLSQIPCNGKAADRIHQDGIHILVNMNGYTKGARNELFALRPAPIQAMWLGYPGTSGALFMDYIITDQETSPAEVAEQYSEKLAYMPHTFFIGDHANMFPHLKKKAVIDFKSNGHIYDNRIVLNGIDLKAFLDSLPDVKIVKMKCPDGGDNADSSNTALNMPVIPMNTIAEAVIEMINRGQIQITINGFSISNGLATTQINNKAATGEEVPRTIIVTTRSQYGLPEDAIVYCNFNQLYKIDPSTLQMWANILKRVPNSVLWLLRFPAVGEPNIQQYAQNMGLPQNRIIFSPVAPKEEHVRRGQLADVCLDTPLCNGHTTGMDVLWAGTPMVTMPGETLASRVAASQLTCLGCLELIAKNRQEYEDIAVKLGTDLEYLKKVRGKVWKQRISSPLFNTKQYTMELERLYLQMWEHYAAGNKPDHMIKPVEVTESA

SEQ ID NO: 886026 - protein, 678 aa, Homo sapiens
RTRGSTHAIAHASGIIMEAIRISPTFADAYSNMGNTLKEMQDVQGALQCYTRAIQINPAFADAHSNLASIHKDSGNIPEAIASYRTALKLKPDFPDAYCNLAHCLQIVCDWTDYDERMKKLVSIVADQLEKNRLPSVHPHHSMLYPLSHGFRKAIAERHGNLCLDKINVLHKPPYEHPKDLKLSDGRLRVGYVSSDFGNHPTSHLMQSIPGMHNPDKFEVFCYALSPDDGTNFRVKVMAEANHFIDLSQIPCNGKAADRIHQDGIHILVNMNGYTKGARNELFALRPAPIQAMWLGYPGTSGALFMDYIITDQETSPAEVAEQYSEKLAYMPHTFFIGDHANMFPHLKKKAVIDFKSNGHIYDNRIVLNGIDLKAFLDSLPDVKIVKMKCPDGGDNADSSNTALNMPVIPMNTIAEAVIEMINRGQIQITINGFSISNGLATTQINNKAATGEEVPRTIIVTTRSQYGLPEDAIVYCNFNQLYKIDPSTLQMWANILKRVPNSVLWLLRFPAVGEPNIQQYAQNMGLPQNRIIFSPVAPKEEHVRRGQLADVCLDTPLCNGHTTGMDVLWAGTPMVTMPGETLASRVAASQLTCLGCLELIAKNRQEYEDIAVKLGTDLEYLKKVRGKVWKQRISSPLFNTKQYTMELERLYLQMWEHYAAGNKPDHMIKPVEVTESA

SEQ ID NO: 886027 - protein, 632 aa, Homo sapiens
TGLLRPDSGKAWLWMDGTPFTSELFHIIIDVTSPRSRDCVAILNGPDFPDAYCNLAHCLQIVCDWTDYDERMKKLVSIVADQLEKNRLPSVHPHHSMLYPLSHGFRKAIAERHGNLCLDKINVLHKPPYEHPKDLKLSDGRLRVGYVSSDFGNHPTSHLMQSIPGMHNPDKFEVFCYALSPDDGTNFRVKVMAEANHFIDLSQIPCNGKAADRIHQDGIHILVNMNGYTKGARNELFALRPAPIQAMWLGYPGTSGALFMDYIITDQETSPAEVAEQYSEKLAYMPHTFFIGDHANMFPHLKKKAVIDFKSNGHIYDNRIVLNGIDLKAFLDSLPDVKIVKMKCPDGGDNADSSNTALNMPVIPMNTIAEAVIEMINRGQIQITINGFSISNGLATTQINNKAATGEEVPRTIIVTTRSQYGLPEDAIVYCNFNQLYKIDPSTLQMWANILKRVPNSVLWLLRFPAVGEPNIQQYAQNMGLPQNRIIFSPVAPKEEHVRRGQLADVCLDTPLCNGHTTGMDVLWAGTPMVTMPGETLASRVAASQLTCLGCLELIAKNRQEYEDIAVKLGTDLEYLKKVRGKVWKQRISSPLFNTKQYTMELERLYLQMWEHYAAGNKPDHMIKPVEVTESA

SEQ ID NO: 886028 - protein, 1219 aa, Homo sapiens; identical to SEQ ID NO: 886020

SEQ ID NO: 886029 - protein, 1219 aa, Homo sapiens; identical to SEQ ID NO: 886020

SEQ ID NO: 886030 - protein, 1201 aa, Homo sapiens
MSNLIDWLPQSYSVAFLDKIGFEHTSSPTNLIKQIFSMGLSSRLMDLVGRLLRLGVFYVAQQFAAIAQCDAVRLRKRCLRSHYRDLNLGAILSCEVSASVLLGRRGIVRMKLKAWLYDDPTWQKDIFLLSSIVLMLVRNIVEEQHFPKCVSEYSNKMPNERRVPWSTKFREPCYTIKGLGKSSKETYFPNLFDHELLFFQPYLLTPHRTHFGNSGGRKTRPQVAPSEVALENMTRARSCLDKRTPAESLIATDFPVKSQCKGWSLVGRTEHGGLHLGSGGAGAGSSQLWQRISFGASEPMLQGHFWLVREGIMISPSSPPPPNLFFFPLQIFPFPFTSFPSHLLSLTPPKACYLKAIETQPNFAVAWSNLGCVFNAQGEIWLAIHHFEKAVTLDPNFLDAYINLGNVLKEARIFDRAVAAYLRALSLSPNHAVVHGNLACVYYEQGLIDLAIDTYRRAIELQPHFPDAYCNLANALKEKGSVAEAEDCYNTALRLCPTHADSLNNLANIKREQGNIEEAVRLYRKALEVFPEFAAAHSNLASVLQQQGKLQEALMHYKEAIRISPTFADAYSNMGNTLKEMQDVQGALQCYTRAIQINPAFADAHSNLASIHKDSGNIPEAIASYRTALKLKPDFPDAYCNLAHCLQIVCDWTDYDERMKKLVSIVADQLEKNRLPSVHPHHSMLYPLSHGFRKAIAERHGNLCLDKINVLHKPPYEHPKDLKLSDGRLRVGYVSSDFGNHPTSHLMQSIPGMHNPDKFEVFCYALSPDDGTNFRVKVMAEANHFIDLSQIPCNGKAADRIHQDGIHILVNMNGYTKGARNELFALRPAPIQAMWLGYPGTSGALFMDYIITDQETSPAEVAEQYSEKLAYMPHTFFIGDHANMFPHLKKKAVIDFKSNGHIYDNRIVLNGIDLKAFLDSLPDVKIVKMKCPDGGDNADSSNTALNMPVIPMNTIAEAVIEMINRGQIQITINGFSISNGLATTQINNKAATGEEVPRTIIVTTRSQYGLPEDAIVYCNFNQLYKIDPSTLQMWANILKRVPNSVLWLLRFPAVGEPNIQQYAQNMGLPQNRIIFSPVAPKEEHVRRGQLADVCLDTPLCNGHTTGMDVLWAGTPMVTMPGETLASRVAASQLTCLGCLELIANLKKVRGKVWKQRISSPLFNTKQYTMELERLYLQMWEHYAAGNKPDHMIKPVEVTESA

SEQ ID NO: 886031 - protein, 113 aa, Homo sapiens
PRGPQTADPLVTMPGETLASRVAASQLTCLGCLELIAKNRQEYEDIAVKLGTDLEYLKKVRGKVWKQRISSPLFNTKQYTMELERLYLQMWEHYAAGNKPDHMIKPVEVTESA

SEQ ID NO: 886032 - protein, 118 aa, Homo sapiens
SVEDLRGPLLLVTPMVTMPGETLASRVAASQLTCLGCLELIAKNRQEYEDIAVKLGTDLEYLKKVRGKVWKQRISSPLFNTKQYTMELERLYLQMWEHYAAGNKPDHMIKPVEVTESA

SEQ ID NO: 886033 - protein, 1219 aa, Homo sapiens; identical to SEQ ID NO: 886020

SEQ ID NO: 886034 - protein, 1219 aa, Homo sapiens; identical to SEQ ID NO: 886020

SEQ ID NO: 886035 - protein, 165 aa, Homo sapiens
MASSVGNVADSTEPTKRMLSFQGLAELAHREYQAGDFEAAERHCMQLWRQEPDNTGVLLLLSSIHFQCRRLDRSAHFSTLAIKQNPLLAEAYSNLGNVYKERGQLQEAIEHYRHALRLKPDFIDGYINLAAALVAAGDMEGAVQAYVSALQYNPVSKILMVTFPS

SEQ ID NO: 886036 - protein, 170 aa, Homo sapiens
MASSVGNVADSTGLAELAHREYQAGDFEAAERHCMQLWRQEPDNTGVLLLLSSIHFQCRRLDRSAHFSTLAIKQNPLLAEAYSNLGNVYKERGQLQEAIEHYRHALRLKPDFIDGYINLAAALVAAGDMEGAVQAYVSALQYNPDLYCVRSDLGNLLKALGRLEEAKVGV

SEQ ID NO: 886037 - protein, 1219 aa, Homo sapiens; identical to SEQ ID NO: 886020

SEQ ID NO: 886038 - protein, 907 aa, Homo sapiens [sequence omitted]

SEQ ID NO: 886039 - protein, 1219 aa, Homo sapiens; identical to SEQ ID NO: 886020

SEQ ID NO: 886040 - protein, 1219 aa, Homo sapiens; identical to SEQ ID NO: 886020

SEQ ID NO: 886041 - protein, 646 aa, Homo sapiens
MGNTLKEMQDVQGALQCYTRAIQINPAFADAHSNLASIHKDSGNIPEAIASYRTALKLKPDFPDAYCNLAHCLQIVCDWTDYDERMKKLVSIVADQLEKNRLPSVHPHHSMLYPLSHGFRKAIAERHGNLCLDKINVLHKPPYEHPKDLKLSDGRLRVGYVSSDFGNHPTSHLMQSIPGMHNPDKFEVFCYALSPDDGTNFRVKVMAEANHFIDLSQIPCNGKAADRIHQDGIHILVNMNGYTKGARNELFALRPAPIQAMWLGYPGTSGALFMDYIITDQETSPAEVAEQYSEKLAYMPHTFFIGDHANMFPHLKKKAVIDFKSNGHIYDNRIVLNGIDLKAFLDSLPDVKIVKMKCPDGGDNADSSNTALNMPVIPMNTIAEAVIEMINRGQIQITINGFSISNGLATTQINNKAATGEEVPRTIIVTTRSQYGLPEDAIVYCNFNQLYKIDPSTLQMWANILKRVPNSVLWLLRFPAVGEPNIQQYAQNMGLPQNRIIFSPVAPKEEHVRRGQLADVCLDTPLCNGHTTGMDVLWAGTPMVTMPGETLASRVAASQLTCLGCLELIAKNRQEYEDIAVKLGTDLEYLKKVRGKVWKQRISSPLFNTKQYTMELERLYLQMWEHYAAGNKPDHMIKPVEVTESA

SEQ ID NO: 886042 - protein, 646 aa, Homo sapiens; identical to SEQ ID NO: 886041

SEQ ID NO: 886043 - protein, 527 aa, Homo sapiens
KNIILSKHGNLCLDKINVLHKPPYEHPKDLKLSDGRLRVGYVSSDFGNHPTSHLMQSIPGMHNPDKFEVFCYALSPDDGTNFRVKVMAEANHFIDLSQIPCNGKAADRIHQDGIHILVNMNGYTKGARNELFALRPAPIQAMWLGYPGTSGALFMDYIITDQETSPAEVAEQYSEKLAYMPHTFFIGDHANMFPHLKKKAVIDFKSNGHIYDNRIVLNGIDLKAFLDSLPDVKIVKMKCPDGGDNADSSNTALNMPVIPMNTIAEAVIEMINRGQIQITINGFSISNGLATTQINNKAATGEEVPRTIIVTTRSQYGLPEDAIVYCNFNQLYKIDPSTLQMWANILKRVPNSVLWLLRFPAVGEPNIQQYAQNMGLPQNRIIFSPVAPKEEHVRRGQLADVCLDTPLCNGHTTGMDVLWAGTPMVTMPGETLASRVAASQLTCLGCLELIAKNRQEYEDIAVKLGTDLEYLKKVRGKVWKQRISSPLFNTKQYTMELERLYLQMWEHYAAGNKPDHMIKPVEVTESA

SEQ ID NO: 886044 - protein, 1219 aa, Homo sapiens; identical to SEQ ID NO: 886020

SEQ ID NO: 886045 - protein, 1154 aa, Homo sapiens; identical to SEQ ID NO: 886024

SEQ ID NO: 886046 - protein, 1219 aa, Homo sapiens; identical to SEQ ID NO: 886020

SEQ ID NO: 886047 - protein, 180 aa, Homo sapiens
MASSVGNVADSTEPTKRMLSFQGLAELAHREYQAGDFEAAERHCMQLWRQEPDNTGVLLLLSSIHFQCRRLDRSAHFSTLAIKQNPLLAEAYSNLGNVYKERGQLQEAIEHYRHALRLKPDFIDGYINLAAALVAAGDMEGAVQAYVSALQYNPDLYCVRSDLGNLLKALGRLEEAKVGV

SEQ ID NO: 886048 - protein, 1180 aa, Homo sapiens
MSNLIDWLPQSYSVAFLDKIGFEHTSSPTNLIKQIFSMGLSSRLMDLVGRLLRLGVFYVAQQFAAIAQCDAVRLRKRCLRSHYRDLNLGAILSCEVSASVLLGRRGIVRMKLKAWLYDDPTWQKDIFLLSSIVLMLVRNIVEEQHFPKCVSEYSNKMPNERRVPWSTKFREPCYTIKGLGKSSKETYFPNLFDHELLFFQPYLLTPHRTHFGNSGGRKTRPQVAPSEVALENMTRARSCLDKRTPAESLIATDFPVKSQCKGWSLVGRTEHGGLHLGSGGAGAGSSQLWQRISFGASEPMLQGHFWLVREGIMISPSSPPPPNLFFFPLQIFPFPFTSFPSHLLSLTPPKACYLKAIETQPNFAVAWSNLGCVFNAQGEIWLAIHHFEKAVTLDPNFLDAYINLGNVLKEARIFDRAVAAYLRALSLSPNHAVVHGNLACVYYEQGLIDLAIDTYRRAIELQPHFPDAYCNLANALKEKGSVAEAEDCYNTALRLCPTHADSLNNLANIKREQGNIEEAVRLYRKALEVFPEFAAAHSNLASVLQQQGKLQEALMHYKEAIRISPTFADAYSNMGNTLKEMQDVQGALQCYTRAIQINPAFADAHSNLASIHKDSGNIPEAIASYRTALKLKPDFPDAYCNLAHCLQIVCDWTDYDERMKKLVSIVADQLEKNRLPSVHPHHSMLYPLSHGFRKAIAERHGNLCLDKINVLHKPPYEHPKDLKLSDGRLRVGYVSSDFGNHPTSHLMQSIPGMHNPDKFEVFCYALSPDDGTNFRVKVMAEANHFIDLSQIPCNGKAADRIHQDGIHILVNMNGYTKGARNELFALRPAPIQAMWLGYPGTSGALFMDYIITDQETSPAEVAEQYSEKLAYMPHTFFIGDHANMFPHLKKKAVIDFKSNGHIYDNRIVLNGIDLKAFLDSLPDVKIVKMKCPDGGDNADSSNTALNMPVIPMNTIAEAVIEMINRGQIQITINGFSISNGLATTQINNKAATGEEVPRTIIVTTRSQYGLPEDAIVYCNFNQLYKIDPSTLQMWANILKRVPNSVLWLLRFPAVGEPNIQQYAQNMGLPQNRIIFSPVAPKEEHVRRGQLADVCLDTPLCNGHTTGMDVLWAGTPMVTMPGETLASRVAASQLTCLGCLELIAKNRQEYEDIAVKLGTDLEYLKKVRGKVWKQRISSPSG

SEQ ID NO: 886049 - protein, 263 aa, Homo sapiens
ESTAPAQVSTLPQSPAALSSSNRAAVWGAQGQNCTQVPVSSASELTRKTTGSAQYSLSDVTSTTSSRVDDHDSEEICLDHLCKGCPLNGSCSKVHFHLPYRWQMLIGKTWTDFEHMETIEKGYCNPGIHLCSVGSYTINFRVMSCDSFPIRRLSTPSSVTKPANSVFTTKWIWYWKNESGTWIQYGEEKDKRKNSNVDSSYLESLYQSCPRGVVPFQAGSRNYELSFQGMIQTNIASKTQKDVIRRPTFVPQWYVQQMKRGPE

SEQ ID NO: 886050 - protein, 637 aa, Homo sapiens
ASAERSCTPSPDQISHRASLEDAPVDDLTRKFTYLGSQDRARPPSGSSKATDLGGTSQAGTSQRFLENGSQEDLLHGNPGSTYLASNSTSAPNWKSLTSWTNDQGARRKTVFSPTLPAARSSLGSLQTPEAVTTRKGTGLLSSDYRIINGKSGTQDIQPGPLFNNNADGVATDITSTRSLNYKSTSSGHREISSPRIQDAGPASRDVQATGRIADDADPRVALVNDSLSDVTSTTSSRVDDHDSEEICLDHLCKGCPLNGSCSKVHFHLPYRWQMLIGKTWTDFEHMETIEKGYCNPGIHLCSVGSYTINFRVMSCDSFPIRRLSTPSSVTKPANSVFTTKWIWYWKNESGTWIQYGEEKDKRKNSNVDSSYLESLYQSCPRGVVPFQAGSRNYELSFQGMIQTNIASKTQKDVIRRPTFVPQWYVQQMKRGPDHEPAKTSSVSLTATFRPQEDFCFLSSKKYKLSEIHHLHPEYVRVSEHFKASMKNFKIEKIKKIENSELLDKFTWKKSQMKEEGKLLFYATSRAYVESICSNNFDSFLHETHENKYGKGIYFAKDAIYSHKNCPYDAKNVVMFVAQVLVGKFTEGNITYTSPPPQFDSCVDTRSNPSVFVIFQKDQVYPQYVIEYTEDKACVIS

SEQ ID NO: 886051 - protein, 637 aa, Homo sapiens; identical to SEQ ID NO: 886050

SEQ ID NO: 886052 - protein, 466 aa, Homo sapiens
ESTAPAQVSTLPQSPAALSSSNRAAVWGAQGQNCTQVPVSSASELTRKTTGSAQYSLSDVTSTTSSRVDDHDSEEICLDHLCKGCPLNGSCSKVHFHLPYRWQMLIGKTWTDFEHMETIEKGYCNPGIHLCSVGSYTINFRVMSCDSFPIRRLSTPSSVTKPANSVFTTKWIWYWKNESGTWIQYGEEKDKRKNSNVDSSYLESLYQSCPRGVVPFQAGSRNYELSFQGMIQTNIASKTQKDVIRRPTFVPQWYVQQMKRGPDHEPAKTSSVSLTATFRPQEDFCFLSSKKYKLSEIHHLHPEYVRVSEHFKASMKNFKIEKIKKIENSELLDKFTWKKSQMKEEGKLLFYATSRAYVESICSNNFDSFLHETHENKYGKGIYFAKDAIYSHKNCPYDAKNVVMFVAQVLVGKFTEGNITYTSPPPQFDSCVDTRSNPSVFVIFQKDQVYPQYVIEYTEDKACVIS

SEQ ID NO: 886053 - protein, 637 aa, Homo sapiens; identical to SEQ ID NO: 886050

SEQ ID NO: 886054 - protein, 154 aa, Homo sapiens
VCLWLSFFFCWFAAGLFLVVFVVVVCSSCVVVCRGCVLLFLRLFCVVVFLARFFCCLFRVCVCRCVCCVLCVGAAVCCESCVDPFSSAAMVGWSCVSLVCFVLSASILRGCVASVFARPEVVRVHVSARLVFVPSRFFLYACCPPVSCLARFLF

SEQ ID NO: 886055 - protein, 637 aa, Homo sapiens; identical to SEQ ID NO: 886050

SEQ ID NO: 886056 - protein, 434 aa, Homo sapiens
ASAERSCTPSPDQISHRASLEDAPVDDLTRKFTYLGSQDRARPPSGSSKATDLGGTSQAGTSQRFLENGSQEDLLHGNPGSTYLASNSTSAPNWKSLTSWTNDQGARRKTVFSPTLPAARSSLGSLQTPEAVTTRKGTGLLSSDYRIINGKSGTQDIQPGPLFNNNADGVATDITSTRSLNYKSTSSGHREISSPRIQDAGPASRDVQATGRIADDADPRVALVNDSLSDVTSTTSSRVDDHDSEEICLDHLCKGCPLNGSCSKVHFHLPYRWQMLIGKTWTDFEHMETIEKGYCNPGIHLCSVGSYTINFRVMSCDSFPIRRLSTPSSVTKPANSVFTTKWIWYWKNESGTWIQYGEEKDKRKNSNVDSSYLESLYQSCPRGVVPFQAGSRNYELSFQGMIQTNIASKTQKDVIRRPTFVPQWYVQQMKRGPE

SEQ ID NO: 886057 - protein, 656 aa, Homo sapiens
ASAERSCTPSPDQISHRASLEDAPVDDLTRKFTYLGSQDRARPPSGSSKATDLGGTSQAGTSQRFLENGSQEDLLHGNPGSTYLASNSTSAPNWKSLTSWTNDQGARRKTVFSPTLPAARSSLGSLQTPEAVTTRKGTGLLSSDYRIINGKSGTQDIQPGPLFNNNADGVATDITSTRSLNYKSTSSGHREISSPRIQDAGPASRDVQATGRIADDADPRVALVNDSLSDVTSTTSSRVDDHDSEEICLDHLCKGCPLNGSCSKVHFHLPYRWQMLIGKTWTDFEHMETIEKGYCNPGIHLCSVGSYTINFRVMSCDSFPIRRLSTPSSVTKPANSVFTTKWIWYWKNESGTWIQYGEEKDKRKNSNVDSSYLESLYQSCPRGVVPFQAGSRNYELSFQGMIQTNIASKTQKDVIRRPTFVPQWYVQQMKRGPDHEPAKTSSVSLTATFRPQEDFCFLSSKKYKLSEIHHLHPEYVRVSEHFKASMKNFKIEKIKKIENSELLDKFTCKKSQMKKKENSELLDKFTWKKSQMKEEGKLLFYATSRAYVESICSNNFDSFLHETHENKYGKGIYFAKDAIYSHKNCPYDAKNVVMFVAQVLVGKFTEGNITYTSPPPQFDSCVDTRSNPSVFVIFQKDQVYPQYVIEYTEDKACVIS

SEQ ID NO: 886058 - protein, 237 aa, Homo sapiens
MIQTNIASKTQKDVIRRPTFVPQWYVQQMKRGPDHEPAKTSSVSLTATFRPQEDFCFLSSKKYKLSEIHHLHPEYVRVSEHFKASMKNFKIEKIKKIENSELLDKFTWKKSQMKEEGKLLFYATSRAYVESICSNNFDSFLHETHENKYGKGIYFAKDAIYSHKNCPYDAKNVVMFVAQVLVGKFTEGNITYTSPPPQFDSCVDTRSNPSVFVIFQKDQVYPQYVIEYTEDKACVIS

SEQ ID NO: 886059 - protein, 147 aa, Homo sapiens
MTTLFETDRCLLFLVMSRFGFKSRLEATSCKQVQENETRRVGDTRMKTSVRDKDKTDYVHNLYMGKERAKLPYLRIIGQDKLQIVSEKTNELLSRTSCRSYLNVQQDIRQSYRVQNNSSLCGTNPHTAGHRSPWLHPLSAGSSPQLL

SEQ ID NO: 886060 - protein, 149 aa, Homo sapiens
MPALREGNQHQRDNRGTSQVTGQEQGRAPGKGMILAILAPRVLDIGVRAPHGVWTNSGNRMGDSHPRKELRSTRHFTSQDRIILGSGMSLSQQALRLWGQEKGSWAGGGREREAWLGCLWPYKIAKSLKKGISVFENERFITDEYSSTS

SEQ ID NO: 886061 - protein, 319 aa, Homo sapiens [sequence omitted]

SEQ ID NO: 886062 - protein, 93 aa, Homo sapiens
KVLSDLLGHENHEIQPYVNGALYSILSVSTRENVLGALQKFSLRRPLQTAMIQDGLIFWLVDVLKDPDCLSDYTLEYSVDHDQHGEDKAEGAG

SEQ ID NO: 886063 - protein, 665 aa, Homo sapiens
MGDILAHESELLGLVKEYLDFAEFEDTLKTFSKECKIKGKPLCKTVGGSFRDSKSLTIQKDLVAAFDNGDQKVFFDLWEEHISSSIRDGDSFAQKLEFYLHIHFAIYLLKYSVGRPDKEELDEKISYFKTYLETKGAALSQTTEFLPFYALPFVPNPMVHPSFKELFQDSWTPELKLKLEKFLALISKASNTPKLLTIYKENGQSNKEILQQLHQQLVEAERRSVTYLKRYNKIQADYHNLIGVTAELVDSLEATVSGKMITPEYLQSVCVRLFSNQMRQSLAHSVDFTRPGTASTMLRASLAPVKLKDVPLLPSLDYEKLKKDLILGSDRLKAFLLQALRWRLTTSHPGEQRETVLQAYISNDLLDCYSHNQRSVLQLLHSTSDVVRQYMARLINAFASLAEGRLYLAQNTKVLQMLEGRLKEEDKDIITRENVLGALQKFSLRRPLQTAMIQDGLIFWLVDVLKDPDCLSDYTLEYSVALLMNLCLRSTGKNMCAKVAGLVLKVLSDLLGHENHEIQPYVNGALYSILSVPSIREEARAMGMEDILRCFIKEGNAEMIRQIEFIIKQLNSEELPDGVLESDDDEDEDDEEDHDIMEADLDKDELIQPQLGELSGEKLLTTEYLGIMTNTGKTRRKGLANVQWSGDEPLQRPVTPGGHRNGYPV

SEQ ID NO: 886064 - protein, 665 aa, Homo sapiens; identical to SEQ ID NO: 886063

SEQ ID NO: 886065 - protein, 665 aa, Homo sapiens; identical to SEQ ID NO: 886063

SEQ ID NO: 886066 - protein, 966 aa, Homo sapiens
MGDILAHESELLGLVKEYLDFAEFEDTLKTFSKECKIKGKPLCKTVGGSFRDSKSLTIQKDLVAAFDNGDQKVFFDLWEEHISSSIRDGDSFAQKLEFYLHIHFAIYLLKYSVGRPDKEELDEKISYFKTYLETKGAALSQTTEFLPFYALPFVPNPMVHPSFKELFQDSWTPELKLKLEKFLALISKASNTPKLLTIYKENGQSNKEILQQLHQQLVEAERRSVTYLKRYNKIQADYHNLIGVTAELVDSLEATVSGKMITPEYLQSVCVRLFSNQMRQSLAHSVDFTRPGTASTMLRASLAPVKLKDVPLLPSLDYEKLKKDLILGSDRLKAFLLQALRWRLTTSHPGEQRETVLQAYISNDLLDCYSHNQRSVLQLLHSTSDVVRQYMARLINAFASLAEGRLYLAQNTKVLQMLEGRLKEEDKDIITRENVLGALQKFSLRRPLQTAMIQDGLIFWLVDVLKDPDCLSDYTLEYSVALLMNLCLRSTGKNMCAKVAGLVLKVLSDLLGHENHEIQPYVNGALYSILSVPSIREEARAMGMEDILRCFIKEGNAEMIRQIEFIIKQLNSEELPDGVLESDDDEDEDDEEDHDIMEADLDKDELIQPQLGELSGEKLLTTEYLGIMTNTGKTRRKGLANVQWSGDEPLQRPVTPGGHRNGYPVVEDQHTPPQTAQHARNGHPQALPAAHEAVYREGKPSTPESCVSSSSAIIAKPGEWLPRGRQEEPRPAPTGTPRQPREAPQDPGNGVTTRECASAFTCKPRAPCTPEMLELEPTQGKGVSSGPSVLFVWPPAGQPPRLHSVLHKGPAEQPVSQEVRMSPGVPITLPEDQPASRSQLAAAAGDGCEGTVVHKTLGAEGRPALQAAPEQGHRSPASRVTFSQGRATKEGWGEPGIALLERGISCSPFTHRGEGWLLPAGDLLAPETAGAGFAALALQAPTGRQCRASLEQGFSKAAEASPPHLG

SEQ ID NO: 886067 - protein, 319 aa, Homo sapiens [sequence omitted]

SEQ ID NO: 886068 - protein, 230 aa, Homo sapiens
MGDILAHESELLGLVKEYLDFAEFEDTLKTFSKECKIKGKPLCKTVGGSFRDSKSLTIQKDLVAAFDNGDQKVFFDLWEEHISSSIRDGDSFAQKLEFYLHIHFAIYLLKYSVGRPDKEELDEKISYFKTYLETKGAALSQTTEFLPFYALPFVPNPMVHPSFKELFQDSWTPELKLKLEKFLALISKASNTPKLLTIYQGECSWGPAEVQSQAPAADSDDSRRPHLLAG

SEQ ID NO: 886069 - protein, 149 aa, Homo sapiens
MGDILAHESELLGLVKEYLDFAEFEDTLKTFSKECKIKGKPLCKTVGGSFRDSKSLTIQKDLVAAFDNGDQKVFFDLWEEHISSSIRDGDSFAQKLEFYLHIHFAIYLLKYSVGRPKSYQMVFLNLMMMKMKMMKRTMTSWKPIWTKTN

SEQ ID NO: 886070 - protein, 146 aa, Homo sapiens [sequence omitted]

SEQ ID NO: 886071 - protein, 373 aa, Homo sapiens
MSSPLCVIPFVCHPLRVSSPFVVRSFCPRSTWVIMTNTGKTRRKGLANVQWSGDEPLQRPVTPGGHRNGYPVVEDQHTPPQTAQHARNGHPQALPAAHEAVYREGKPSTPESCVSSSSAIIAKPGEWLPRGRQEEPRPAPTGTPRQPREAPQDPGNGVTTRECASAFTCKPRAPCTPEMLELEPTQGKGVSSGPSVLFVWPPAGQPPRLHSVLHKGPAEQPVSQEVRMSPGVPITLPEDQPASRSQLAAAAGDGCEGTVVHKTLGAEGRPALQAAPEQGHRSPASRVTFSQGRATKEGWGEPGIALLERGISCSPFTHRGEGWLLPAGDLLAPETAGAGFAALALQAPTGRQCRASLEQGFSKAAEASPPHLG

SEQ ID NO: 886072 - protein, 84 aa, Homo sapiens
MEDILRCFIKEGNAEMIRQIEFIIKQLNSGQFDARIFDLSFELFTFARKTHGISFKRPLGSRARWLVLIIPALWEAEVGGSRGQ

SEQ ID NO: 886073 - protein, 337 aa, Homo sapiens
MGKDYYCILGIEKGASDEDIKKAYRKQALKFHPDKNKSPQAEEKFKEVAEAYEVLSDPKKREIYDQFGEEGLKGGAGGTDGQGGTFRYTFHGDPHATFAAFFGGSNPFEIFFGRRMGGGRDSEEMEIDGDPFSAFGFSMNGYPRDRNSVGPSRLKQDPPVIHELRVSLEEIYSGCTKRMKISRKRLNADGRSYRSEDKILTIEIKKGWKEGTKITFPREGDETPNSIPADIVFIIKDKDHPKFKRDGSNIIYTAKISLREALCGCSINVPTLDGRNIPMSVNDIVKPGMRRRIIGYGLPFPKNPDQRGDLLIEFEVSFPDTISSSSKEVLRKHLPAS

SEQ ID NO: 886074 - protein, 337 aa, Homo sapiens; identical to SEQ ID NO: 886073

SEQ ID NO: 886075 - protein, 337 aa, Homo sapiens; identical to SEQ ID NO: 886073

SEQ ID NO: 886076 - protein, 306 aa, Homo sapiens
RWCGLGLRKNDRNRDVARIKFKTSREQNFFWHLLSARSWGLKGGAGGTDGQGGTFRYTFHGDPHATFAAFFGGSNPFEIFFGRRMGGGRDSEEMEIDGDPFSAFGFSMNGYPRDRNSVGPSRLKQDPPVIHELRVSLEEIYSGCTKRMKISRKRLNADGRSYRSEDKILTIEIKKGWKEGTKITFPREGDETPNSIPADIVFIIKDKDHPKFKRDGSNIIYTAKISLREALCGCSINVPTLDGRNIPMSVNDIVKPGMRRRIIGYGLPFPKNPDQRGDLLIEFEVSFPDTISSSSKEVLRKHLPAS

SEQ ID NO: 886077 - protein, 337 aa, Homo sapiens; identical to SEQ ID NO: 886073

SEQ ID NO: 886078 - protein, 335 aa, Homo sapiens
MGKDYYCILGIEKGASDEDIKKAYRKQALKFHPDKNKSPQAEEKFKEVAEAYEVLSDPKKREIYDQFGEEGLKGGAGGTDGQGGTFRYTFHGDPHATFAAFFGGSNPFEIFFGRRMGGGRDSEEMEIDGDPFSAFGFSMNGYPRDRNSVGPSRLKQDPPVIHELRVSLEEIYSGCTKRMKISRKRLNADGRSYRSEDKILTIEIKKGWKEGTKITFPREGDETPNSIPADIVFIIKDKDHPKFKRDGSNIIYTAKISLREALCGCSINVPTLDGRNIPMSVNDIVKPGMRRRIIGYGLPFPKNPDQHLLHPKKYLGNIFLPHRMKNFVTHILIRH

SEQ ID NO: 886079 - protein, 564 aa, Homo sapiens
TSAGSAAAGGGRAHLSLPVSRRPRPLGRAQSRPPPLPPRAPANMTSAFKLDFLPDMMVEGRLLVPDRINGTANKMNGALDHSDQPDPDAIKMFVGQIPRSWSEKELKELFEPYGAVYQINVLRDRSQNPPQSKGCCFVTFYTRKAALEAQNALHNIKTLPGMHHPIQMKPADSEKSNAVEDRKLFIGMVSKKCNENDIRVMFSPFGQIEECRILRGPDGLSRGCAFVTFSTRAMAQNAIKAMHQSQTMEGCSSPIVVKFADTQKDKEQRRLQQQLAQQMQQLNTATWGNLTGLGGLTPQYLALLQQATSSSNLGAFSGIQQMAGMNALQLQNLATLAAAAAAAQTSATSTNANPLSTTSSALGALTSPVAASTPNSTAGAAMNSLTSLGTLQGLAGATVGLNNINALAVAQMLSGMAALNGGLGATGLTNGTAGTMDALTQAYSGIQQYAAAALPTLYSQSLLQQQSAAGSQKEGPEGANLFIYHLPQEFGDQDILQMFMPFGNVISAKVFIDKQTNLSKCFGFVSYDNPVSAQAAIQAMNGFQIGMKRLKVQLKRSKNDSKPY

SEQ ID NO: 886080 - protein, 508 aa, Homo sapiens
MRCPKSAVTMRNEELLLSNGTANKMNGALDHSDQPDPDAIKMFVGQIPRSWSEKELKELFEPYGAVYQINVLRDRSQNPPQSKGCCFVTFYTRKAALEAQNALHNIKTLPGMHHPIQMKPADSEKSNAVEDRKLFIGMVSKKCNENDIRVMFSPFGQIEECRILRGPDGLSRGCAFVTFSTRAMAQNAIKAMHQSQTMEGCSSPIVVKFADTQKDKEQRRLQQQLAQQMQQLNTATWGNLTGLGGLTPQYLALLQQATSSSNLGAFSGIQQMAGMNALQLQNLATLAAAAAAAQTSATSTNANPLSTTSSALGALTSPVAASTPNSTAGAAMNSLTSLGTLQGLAGATVGLNNINALAGMAALNGGLGATGLTNGTAGTMDALTQAYSGIQQYAAAALPTLYSQSLLQQQSAAGSQKEGPEGANLFIYHLPQEFGDQDILQMFMPFGNVISAKVFIDKQTNLSKCFGFVSYDNPVSAQAAIQAMNGFQIGMKRLKVQLKRSKNDSKPY

SEQ ID NO: 886081 - protein, 490 aa, Homo sapiens
MNGALDHSDQPDPDAIKMFVGQIPRSWSEKELKELFEPYGAVYQINVLRDRSQNPPQSKGCCFVTFYTRKAALEAQNALHNIKTLPGMHHPIQMKPADSEKSNAVEDRKLFIGMVSKKCNENDIRVMFSPFGQIEECRILRGPDGLSRGCAFVTFSTRAMAQNAIKAMHQSQTMEGCSSPIVVKFADTQKDKEQRRLQQQLAQQMQQLNTATWGNLTGLGGLTPQYLALLQQATSSSNLGAFSGIQQMAGMNALQLQNLATLAAAAAAAQTSATSTNANPLSTTSSALGALTSPVAASTPNSTAGAAMNSLTSLGTLQGLAGATVGLNNINALAVAQMLSGMAALNGGLGATGLTNGTAGTMDALTQAYSGIQQYAAAALPTLYSQSLLQQQSAAGSQKEGPEGANLFIYHLPQEFGDQDILQMFMPFGNVISAKVFIDKQTNLSKCFGFVSYDNPVSAQAAIQAMNGFQIGMKRLKVQLKRSKNDSKPY

SEQ ID NO: 886082 - protein, 138 aa, Homo sapiens
MFFVDKTSLELVYLIQKKKKEFQKKKLFALKKISCEGKEKKTYSRISFVLACEALMSFFLIVDYLDVFVFSKMDLFFSFKEKKVKIYSAKFQRYFLPESFSVFLVRSNLITWVFYYVFCINPLIFKKKNKTKKGYKVC

SEQ ID NO: 886083 - protein, 487 aa, Homo sapiens
TSAGSAAAGGGRAHLSLPVSRRPRPLGRAQSRPPPLPPRAPANMTSAFKLDFLPDMMVEGRLLVPDRINGTANKMNGALDHSDQPDPDAIKMFVGQIPRSWSEKELKELFEPYGAVYQINVLRDRSQNPPQSKGCCFVTFYTRKAALEAQNALHNIKTLPGMHHPIQMKPADSEKSNAVEDRKLFIGMVSKKCNENDIRVMFSPFGQIEECRILRGPDGLSRGCAFVTFSTRAMAQNAIKAMHQSQTMEGCSSPIVVKFADTQKDKEQRRLQQQLAQQMQQLNTATWGNLTGLGGLTPQYLALLQQATSSSNLGAFSGIQQMAGMNALQLQNLATLAAAAAAAQTSATSTNANPLSTTSSALGALTSPVAASTPNSTAGAAMNSLTSLGTLQGLDGGSEWRTWRHRLDEWHGWHHGRPHPGLLRNSTVRSRRAAHSVQPEPAAAAERCRQPEGRSRGGKPLYLPPSTGIWRPGHSADVHAFWKCYLC

SEQ ID NO: 886084 - protein, 501 aa, Homo sapiens
TSAGSAAAGGGRAHLSLPVSRRPRPLGRAQSRPPPLPPRAPANMTSAFKLDFLPDMMVEGRLLVPDRINGTANKMNGALDHSDQPDPDAIKMFVGQIPRSWSEKELKELFEPYGAVYQINVLRDRSQNPPQSKGCCFVTFYTRKAALEAQNALHNIKTLPGMHHPIQMKPADSEKSNAVEDRKLFIGMVSKKCNENDIRVMFSPFGQIEECRILRGPDGLSRGCAFVTFSTRAMAQNAIKAMHQSQTMEGCSSPIVVKFADTQKDKEQRRLQQQLAQQMQQLNTATWGNLTGLGGLTPQYLALLQQATSSSNLGAFSGIQQMAGMNALQLQNLATLAAAAAAAQTSATSTNANPLSTTSSALGALTSPVAASTPNSTAGAAMNSLTSLGTLQGLAGATVGLNNINALADGGSEWRTWRHRLDEWHGWHHGRPHPGLLRNSTVRSRRAAHSVQPEPAAAAERCRQPEGRSRGGKPLYLPPSTGIWRPGHSADVHAFWKCYLC

SEQ ID NO: 886085 - protein, 468 aa, Homo sapiens
TSAGSAAAGGGRAHLSLPVSRRPRPLGRAQSRPPPLPPRAPANMTSAFKLDFLPDMMVEGRLLVPDRINGTANKMNGALDHSDQPDPDAIKMFVGQIPRSWSEKELKELFEPYGAVYQINVLRDRSQNPPQSKGCCFVTFYTRKAALEAQNALHNIKTLPGMHHPIQMKPADSEKSNAVEDRKLFIGMVSKKCNENDIRVMFSPFGQIEECRILRGPDGLSRGCAFVTFSTRAMAQNAIKAMHQSQTMEGCSSPIVVKFADTQKDKEQRRLQQQLAQQMQQLNTATWGNLTGLGGLTPQYLALLQQATSSSNLGAFSGIQQMAGMNALQLQNLATLAAAAAAAQTSATSTNANPLSTTSSALGALTSPVAASTPNSTAGAAMNSLTSLGTLQGLAGATVGLNNINALADGGSEWRTWRHRLDEWHGWHHGRPHPGLLRNSTVRSRRAAHSVQPEPAAAAERCRQPEGR

SEQ ID NO: 886086 - protein, 501 aa, Homo sapiens; identical to SEQ ID NO: 886084

SEQ ID NO: 886087 - protein, 161 aa, Homo sapiens
MNGALDHSDQPDPDAIKMFVGQIPRSWSEKELKELFEPYGAVYQINVLRDRSQNPPQSKGCCFVTFYTRKAALEAQNALHNIKTLPGMHHPIQMKPADSEKSNAVEDRKLFIGMVSKKCNENDIRVMFSPFGQIEECRILRGPDGLSRGECAVWKASPLQC

SEQ ID NO: 886088 - protein, 71 aa, Homo sapiens
MLALQPSPELQPPFLFSAGLPLQADSLSRYFPGFVSYDNPVSAQAAIQAMNGFQIGMKRLKVQLKRSKNDS

SEQ ID NO: 886089 - protein, 110 aa, Homo sapiens
WRPGSRLRGVTVMLRRGHLAFRDVAIEFPQEEWKCLDPAQRTLYREVMVENYRNLVFLGICLPDLSVISMLEQRRDPRNLQSEVKIANNPGSCSVTQAVVEWQSSVAIVA

SEQ ID NO: 886090 - protein, 392 aa, Homo sapiens
WRPGSRLRGVTVMLRRGHLAFRDVAIEFPQEEWKCLDPAQRTLYREVMVENYRNLVFLGICLPDLSVISMLEQRRDPRNLQSEVKIANNPGGRECIKGVNAESSSKLGSNAGNKSLKINLDYTFQLHLSELQLFQAERNISGCKHVEKPINKQFLSFTTFKKFILVSEIPHFRINTEVIWMILHFSQKNKKHKSGKNRVKYEHGKAFRVSSSLANHPVIHTADNLYNVTACDEGPISNQLRNLLPPSREFIPWERKPLHSVLDCGKALQANLIPGRTESNNYWEETLHTVRFATLSSRRNRESLRTAQRGEKTVNVTGEQEVHEEASWDEEKSKRGKQQRDDEHTSGTEGNHRQQNKLEQGSKETQTRRQTGSDRTASVELASTPAYGQNRE

SEQ ID NO: 886091 - protein, 129 aa, Homo sapiens
WRPGSRLRGVTVMLRRGHLAFRDVAIEFPQEEWKCLDPAQRTLYREVMVENYRNLVFLGICLPDLSVISMLEQRRDPRNLQSEVKIANNPGGRECIKGVNAGKSLDGQSGGPIIFFFFKQGLALSPRLS

SEQ ID NO: 886092 - protein, 102 aa, Homo sapiens
WSIIDLLEKLVNGFPLVGGSTVEQVEDRTQLAPGPAPDCMVCAQQGCIPLQPPPPHFLPELVCPSHQAMWSRWLHPPLDSCPPPMKGGRGFRVSLGDPGSLR

SEQ ID NO: 886093 - protein, 2080 aa, Homo sapiens
MGSGAICWFNLRDVGSQAPEDRWYEAEKVWLAQKDGFTLATVLKPDEGTADLPAGRVRLWIDADKTITEVDEEHVHRANPPELDQVEDLASLISVNESSVLNTLLQRYKAQLLHTCTGPDLIVLQPRGPSVPSAGKVPKGRRDGLPAHIGSMAQRAYWALLNQRRDQSIVALGWSGAGKTTCCEQVLEHLVGMAGSVDGRVSVEKIRATFTVLRAFGSVSMAHSRSATRFSMVMSLDFNATGRITAAQLQTMLLEKSRVARQPEGESNFLVFSQMLAGLDLDLRTELNLHQMADSSSFGMGVWSKPEDKQKAAAAFAQLQGAMEMLGISESEQRAVWRVLAAIYHLGAAGACKVGRKQFMRFEWANYAAEALGCEYEELNTATFKHHLRQIIQQMTFGPSRWGLEDEETSSGLKMTGVDCVEGMASGLYQELFAAVVSLINRSFSSHHLSMASIMVVDSPGFQNPRHQGKDRAATFEELCHNYAHERLQLLFYQRTFVSTLQRYQEEGVPVQFDLPDPSPGTTVAVVDQNPSQVRLPAGGGAQDARGLFWVLDEEVHVEGSSDSVVLERLCAAFEKKGAGTEGSSALRTCEQPLQCEIFHQLGWDPVRYDLTGWLHRAKPNLSALDAPQVLHQSKREELRSLFQARAKLPPVCRAVAGLEGTSQQALQRSRMVRRTFASSLAAVRRKAPCSQIKLQMDALTSMIKRSRLHFIHCLVPNPVVESRSGQESPPPPQPGRDKPGAGGPLALDIPALRVQLAGFHILEALRLHRTGYADHMGLTRFRRQFQVLDAPLLKKLMSTSEGIDERKAVEELLETLDLEKKAVAVGHSQVFLKAGVISRLEKQREKLVSQSIVLFQAACKGFLSRQEFKKLKIRRLAAQCIQKNVAVFLAVKDWPWWQLLGSLQPLLSATIGTEQLRAKEEELTTLRRKLEKSEKLRNELRQNTDLLESKIADLTSDLADERFKGDVACQVLESERAERLQAFREVQELKSKHEQVQKKLGDVNKQLEEAQQKIQLNDLERNPTGGADEWQMRFDCAQMENEFLRKRLQQCEERLDSELTARKELEQKLGELQSAYDGAKKMAHQLKRKCHHLTCDLEDTCVLLENQQSRNHELEKKQKKFDLQLAQALGESVFEKGLREKVTQENTSVRWELGQLQQQLKQKEQEASQLKQQVEMLQDHKRELLGSPSLGENCVAGLKERLWKLESSALEQQKIQSQQENTIKQLEQLRQRFELEIERMKQMHQKDREDQEEELEDVRQSCQKRLHQLEMQLEQEYEEKQMVLHEKQDLEGLIGTLCDQIGHRDFDVEKRLRRDLRRTHALLSDVQLLLGTMEDGKTSVSKEELEKVHSQLEQSEAKCEEALKTQKVLTADLESMHSELENMTRNKSLVDEQLYRLQFEKADLLKRIDEDQDDLNELMQKHKDLIAQSAADIGQIQELQLQLEEAKKEKHKLQEQLQVAQMRIEYLEQSTVDRAIVSRQEAVICDLENKTEFQKVQIKRFEVLVIRLRDSLIKMGEELSQAATSESQQRESSQYYQRRLEELKADMEELVQREAEASRRCMELEKYVEELAAVRQTLQTDLETSIRRIADLQAALEEVASSDSDTESVQTAVDCGSSGRKEMDNVSILSSQPEGSLQSWLSCTLSLATDTMRTPSRQSATSSRILSPRINEEAGDTERTQSALALSRARSTNVHSKTSGDKPVSPHFVRRQKYCHFGDGEVLAVQRKSTERLEPASSPLASRSTNTSPLSREKLPSPSAALSEFVEGLRRKRAQRGQGSTLGLEDWPTLPIYQTTGASTLRRGRAGSDEGNLSLRVGAKSPLEIEGAAGGLLRSTSLKCISSDGVGGTTLLPEKSKTQFSSCESLLESRPSMGRKLSSPTTPRDMLLSPTLRPRRRCLESSVDDAGCPDLGKEPLVFQNRQFAHLMEEPLGSDPFSWKLPSLDYERKTKVDFDDFLPAIRKPQTPTSLAGSAKGGQDGSQRSSIHFETEEANRSFLSGIKTILKKSPEPKEDPAHLSDSSSSSGSIVSFKSADSIKSRPGIPRLAGDGGERTSPERREPGTGRKDDDVASIMKKYLQK

SEQ ID NO: 886094 - protein, 2651 aa, Homo sapiens
RGRDVCRCVWRGCSFAPAFPARWGPFAATRGDVLDSRGSCDLCPLCRSSVSISCAACVCKASFRAVWQEAPSHLIISRPWHCLSMAISSRLALWEQKIREEDKSPPPSSPPPLFSVIPGGFIKQLVRGTEKEAKEARQRKQLAVASPEREIPEISISQPNSKSSSGTRSGSQQISQDDQSSSPGSSDILGKESEGSRSPDPEQMTSINGEKAQELGSSATPTKKTVPFKRGVRRGDVLLMVAKLDPDSAKPEKTHPHDAPPCKTSPPATDTGKEKKGETSRTPCGSQASTEILAPKAEKTRTGGLGDPGQGTVALKKGEEGQSIVGKGLGTPKTTELKEAEPQGKDRQGTRPQAQGPGEGVRPGKAEKEGAEPTNTVEKGNVSKDVGSEGKHVRPQIPGRKWGGFLGRRSKWDGPQNKKDKEGVLLSKAEKTGEPQTQMEKTSQVQGELGDDLRMGEKAGELRSTTGKAGESWDKKEKMGQPQGKSGNAGEARSQTEKGCEAPKEVSTMVESPAAPGKGGWPGSRGQEAEEPCSRAGDGAGALETELEGPSQPALEKDAERPRIRKENQDGPAPQEEGKGGQSRDSDQAPEDRWYEAEKVWLAQKDGFTLATVLKPDEGTADLPAGRVRLWIDADKTITEVDEEHVHRANPPELDQVEDLASLISVNESSVLNTLLQRYKAQLLHTCTGPDLIVLQPRGPSVPSAGKVPKGRRDGLPAHIGSMAQRAYWALLNQRRDQSIVALGWSGAGKTTCCEQVLEHLVGMAGSVDGRVSVEKIRATFTVLRAFGSVSMAHSRSATRFSMVMSLDFNATGRITAAQLQTMLLEKSRVARQPEGESNFLVFSQMLAGLDLDLRTELNLHQMADSSSFGMGVWSKPEDKQKAAAAFAQLQGAMEMLGISESEQRAVWRVLAAIYHLGAAGACKVGRKQFMRFEWANYAAEALGCEYEELNTATFKHHLRQIIQQMTFGPSRWGLEDEETSSGLKMTGVDCVEGMASGLYQELFAAVVSLINRSFSSHHLSMASIMVVDSPGFQNPRHQGKDRAATFEELCHNYAHERLQLLFYQRTFVSTLQRYQEEGVPVQFDLPDPSPGTTVAVVDQNPSQVRLPAGGGAQDARGLFWVLDEEVHVEGSSDSVVLERLCAAFEKKGAGTEGSSALRTCEQPLQCEIFHQLGWDPVRYDLTGWLHRAKPNLSALDAPQVLHQSKREELRSLFQARAKLPPVCRAVAGLEGTSQQALQRSRMVRRTFASSLAAVRRKAPCSQIKLQMDALTSMIKRSRLHFIHCLVPNPVVESRSGQESPPPPQPGRDKPGAGGPLALDIPALRVQLAGFHILEALRLHRTGYADHMGLTRFRRQFQVLDAPLLKKLMSTSEGIDERKAVEELLETLDLEKKAVAVGHSQVFLKAGVISRLEKQREKLVSQSIVLFQAACKGFLSRQEFKKLKIRRLAAQCIQKNVAVFLAVKDWPWWQLLGSLQPLLSATIGTEQLRAKEEELTTLRRKLEKSEKLRNELRQNTDLLESKIADLTSDLADERFKGDVACQVLESERAERLQAFREVQELKSKHEQVQKKLGDVNKQLEEAQQKIQLNDLERNPTGGADEWQMRFDCAQMENEFLRKRLQQCEERLDSELTARKELEQKLGELQSAYDGAKKMAHQLKRKCHHLTCDLEDTCVLLENQQSRNHELEKKQKKFDLQLAQALGESVFEKGLREKVTQENTSVRWELGQLQQQLKQKEQEASQLKQQVEMLQDHKRELLGSPSLGENCVAGLKERLWKLESSALEQQKIQSQQENTIKQLEQLRQRFELEIERMKQMHQKDREDQEEELEDVRQSCQKRLHQLEMQLEQEYEEKQMVLHEKQDLEGLIGTLCDQIGHRDFDVEKRLRRDLRRTHALLSDVQLLLGTMEDGKTSVSKEELEKVHSQLEQSEAKCEEALKTQKVLTADLESMHSELENMTRNKSLVDEQLYRLQFEKADLLKRIDEDQDDLNELMQKHKDLIAQSAADIGQIQELQLQLEEAKKEKHKLQEQLQVAQMRIEYLEQSTVDRAIVSRQEAVICDLENKTEFQKVQIKRFEVLVIRLRDSLIKMGEELSQAATSESQQRESSQYYQRRLEELKADMEELVQREAEASRRCMELEKYVEELAAVRQTLQTDLETSIRRIADLQAALEEVASSDSDTESVQTAVDCGSSGRKEMDNVSILSSQPEGSLQSWLSCTLSLATDTMRTPSRQSATSSRILSPRINEEAGDTERTQSALALSRARSTNVHSKTSGDKPVSPHFVRRQKYCHFGDGEVLAVQRKSTERLEPASSPLASRSTNTSPLSREKLPSPSAALSEFVEGLRRKRAQRGQGSTLGLEDWPTLPIYQTTGASTLRRGRAGSDEGNLSLRVGAKSPLEIEGAAGGLLRSTSLKCISSDGVGGTTLLPEKSKTQFSSCESLLESRPSMGRKLSSPTTPRDMLLSPTLRPRRRCLESSVDDAGCPDLGKEPLVFQNRQFAHLMEEPLGSDPFSWKLPSLDYERKTKVDFDDFLPAIRKPQTPTSLAGSAKGGQDGSQRSSIHFETEEANRSFLSGIKTILKKSPEPKEDPAHLSDSSSSSGSIVSFKSADSIKSRPGIPRLAGDGGERTSPERREPGTGRKDDDVASIMKKYLQK

SEQ ID NO: 886095 - protein, 140 aa, Homo sapiens
SERLSSLPEVTQPVRGELGFETSSAGGLDQCAPRFHAISDIPPLSSLPRSFSSHHLSMASIMVVDSPGFQNPRHQGKDRAATFEELCHNYAHERLQLLFYQRTFVSTLQRYQEEGVPVQFDLSRPHPQMHLLEIIKFFLS

SEQ ID NO: 886096 - protein, 967 aa, Homo sapiens
MNSLDDFQFDLQLAQALGESVFEKGLREKVTQENTSVRWELGQLQQQLKQKEQEASQLKQQVEMLQDHKRELLGSPSLGENCVAGLKERLWKLESSALEQQKIQSQQENTIKQLEQLRQRFELEIERMKQMHQKDREDQEEELEDVRQSCQKRLHQLEMQLEQEYEEKQMVLHEKQDLEGLIGTLCDQIGHRDFDVEKRLRRDLRRTHALLSDVQLLLGTMEDGKTSVSKEELEKVHSQLEQSEAKCEEALKTQKVLTADLESMHSELENMTRNKSLVDEQLYRLQFEKADLLKRIDEDQDDLNELMQKHKDLIAQSAADIGQIQELQLQLEEAKKEKHKLQEQLQVAQMRIEYLEQSTVDRAIVSRQEAVICDLENKTEFQKVQIKRFEVLVIRLRDSLIKMGEELSQAATSESQQRESSQYYQRRLEELKADMEELVQREAEASRRCMELEKYVEELAAVRQTLQTDLETSIRRIADLQAALEEVASSDSDTESVQTAVDCGSSGRKEMDNVSILSSQPEGSLQSWLSCTLSLATDTMRTPSRQSATSSRILSPRINEEAGDTERTQSALALSRARSTNVHSKTSGDKPVSPHFVRRQKYCHFGDGEVLAVQRKSTERLEPASSPLASRSTNTSPLSREKLPSPSAALSEFVEGLRRKRAQRGQGSTLGLEDWPTLPIYQTTGASTLRRGRAGSDEGNLSLRVGAKSPLEIEGAAGGLLRSTSLKCISSDGVGGTTLLPEKSKTQFSSCESLLESRPSMGRKLSSPTTPRDMLLSPTLRPRRRCLESSVDDAGCPDLGKEPLVFQNRQFAHLMEEPLGSDPFSWKLPSLDYERKTKVDFDDFLPAIRKPQTPTSLAGSAKGGQDGSQRSSIHFETEEANRSFLSGIKTILKKSPEPKEDPAHLSDSSSSSGSIVSFKSADSIKSRPGIPRLAGDGGERTSPERREPGTGRKDDDVASIMKKYLQK

SEQ ID NO: 886097 - protein, 122 aa, Homo sapiens
QARAKLPPVCRAVAGLEGTSQQALQRSRMVRRTFASSLAAVRRKAPCSQIKLQMVSGHPVSWCPGLHCLHPHLLWAESCAYIISNLPSKARGASVTPRSTEEEMGAPSSNETWPWSHPQEVT

SEQ ID NO: 886098 - protein, 217 aa, Homo sapiens
MASQKQMEVVTKGTGFRRRPKTITYTPGTCELLRVMMKESKLTNIQQRHIMDIMKRGDALPLQCSPTSSQRVLPSKQIASPIYLPPILAARPHLRPANMCQANGAYSREQFKPQATRDLEKEKQRLQNIFATGKDMEERKRKAPPARQKAPAPELDRFEELVKEIQERKEFLADMEALGQGKQYRGIILAEISQKLREMEDIDHRRSEELRKGLATT

SEQ ID NO: 886099 - protein, 217 aa, Homo sapiens; identical to SEQ ID NO: 886098

SEQ ID NO: 886100 - protein, 217 aa, Homo sapiens; identical to SEQ ID NO: 886098

SEQ ID NO: 886101 - protein, 227 aa, Homo sapiens
MASQKQMEVVTKGTGFRRRPKTITYTPGTCELLRVMMKESKLTNIQQRHIMDIMKRGDALPLQCSPTSSQRVLPSKQIASPIYLPPILAARPHLRPANMCQANGAYSREQFKPQATRDLEKEKQRLQNIFATGKDMEERKRKAPPARQKAPAPELDRFEELVKEIQERKEFLADMEALGQGKQYRGIILAEISQVGETTRKVGRGRAQRQVRMEIQGLLWQGSGVRL

SEQ ID NO: 886102 - protein, 206 aa, Homo sapiens
MASQKQMEVVTKGTGFRRRPKTITYTPGTCELLRGGDALPLQCSPTSSQRVLPSKQIASPIYLPPILAARPHLRPANMCQANGAYSREQFKPQATRDLEKEKQRLQNIFATGKDMEERKRKAPPARQKAPAPELDRFEELVKEIQERKEFLADMEALGQGKQYRGIILAEISQVGETTRKVGRGRAQRQVRMEIQGLLWQGSGVRL

SEQ ID NO: 886103 - protein, 196 aa, Homo sapiens
MASQKQMEVVTKGTGFRRRPKTITYTPGTCELLRGGDALPLQCSPTSSQRVLPSKQIASPIYLPPILAARPHLRPANMCQANGAYSREQFKPQATRDLEKEKQRLQNIFATGKDMEERKRKAPPARQKAPAPELDRFEELVKEIQERKEFLADMEALGQGKQYRGIILAEISQKLREMEDIDHRRSEELRKGLATT

SEQ ID NO: 886104 - protein, 77 aa, Homo sapiens
WEPDSPLLCPVVKEIQERKEFLADMEALGQGKQYRGIILAEISQVGETTRKVGRGRAQRQVRMEIQGLLWQGSGVRL

SEQ ID NO: 886105 - protein, 327 aa, Homo sapiens
MTALELARRGARVVLACRSQERGEAAAFDLRQESGNNEVIFMALDLASLASVRAFATAFLSSEPRLDILIHNAGISSCGRTREAFNLLLRVNHIGPFLLTHLLLPCLKACAPSRVVVVASAAHCRGRLDFKRLDRPVVGWRQELRAYADTKLANVLFARELANQLEATGVTCYAAHPGPVNSELFLRHVPGWLRPLLRPLAWLVLRAPRGGAQTPLYCALQEGIEPLSGRYFANCHVEEVPPAARDDRAAHRLWEASKRLAGLGPGEDAEPDEDPQSEDSEAPSSLSTPHPEEPTVSQPYPSPQSSPDLSKMTHRIQAKVEPEIQLS

SEQ ID NO: 886106 - protein, 377 aa, Homo sapiens
MEALLLGAGLLLGAYVLVYYNLVKAPPCGGMGNLRGRTAVVTGANSGIGKMTALELARRGARVVLACRSQERGEAAAFDLRQESGNNEVIFMALDLASLASVRAFATAFLSSEPRLDILIHNAGISSCGRTREAFNLLLRVNHIGPFLLTHLLLPCLKACAPSRVVVVASAAHCRGRLDFKRLDRPVVGWRQELRAYADTKLANVLFARELANQLEATGVTCYAAHPGPVNSELFLRHVPGWLRPLLRPLAWLVLRAPRGGAQTPLYCALQEGIEPLSGRYFANCHVEEVPPAARDDRAAHRLWEASKRLAGLGPGEDAEPDEDPQSEDSEAPSSLSTPHPEEPTVSQPYPSPQSSPDLSKMTHRIQAKVEPEIQLS

SEQ ID NO: 886107 - protein, 383 aa, Homo sapiens
MVLPRVILLLLLGAGLLLGAYVLVYYNLVKAPPCGGMGNLRGRTAVVTGANSGIGKMTALELARRGARVVLACRSQERGEAAAFDLRQESGNNEVIFMALDLASLASVRAFATAFLSSEPRLDILIHNAGISSCGRTREAFNLLLRVNHIGPFLLTHLLLPCLKACAPSRVVVVASAAHCRGRLDFKRLDRPVVGWRQELRAYADTKLANVLFARELANQLEATGVTCYAAHPGPVNSELFLRHVPGWLRPLLRPLAWLVLRAPRGGAQTPLYCALQEGIEPLSGRYFANCHVEEVPPAARDDRAAHRLWEASKRLAGLGPGEDAEPDEDPQSEDSEAPSSLSTPHPEEPTVSQPYPSPQSSPDLSKMTHRIQAKVEPEIQLS

SEQ ID NO: 886108 - protein, 286 aa, Homo sapiens
MALDLASLASVRAFATAFLSSEPRLDILIHNAGISSCGRTREAFNLLLRVNHIGPFLLTHLLLPCLKACAPSRVVVVASAAHCRGRLDFKRLDRPVVGWRQELRAYADTKLANVLFARELANQLEATGVTCYAAHPGPVNSELFLRHVPGWLRPLLRPLAWLVLRAPRGGAQTPLYCALQEGIEPLSGRYFANCHVEEVPPAARDDRAAHRLWEASKRLAGLGPGEDAEPDEDPQSEDSEAPSSLSTPHPEEPTVSQPYPSPQSSPDLSKMTHRIQAKVEPEIQLS

SEQ ID NO: 886109 - protein, 274 aa, Homo sapiens
MPRNLLYSLLSSHLSPHFGTSVTSAKVAVNGVQLHYQQTGEGDHAVLLLPGMLGSGETDFGPQLKNLNKKLFTVVAWDPRGYGHSRPPDRDFPADFFERDAKDAVDLMKALKFKKVSLLGWSDGGITALIAAAKYPSYIHKMVIWGANAYVTDEDSMIYEGIRDVSKWSERTRKPLEALYGYDYFARTCEKWVDGIRQFKHLPDGNICRHLLPRVQCPALIVHGEKDPLVPRFHADFIHKHVKGSRLHLMPEGKHNLHLRFADEFNKLAEDFLQ

SEQ ID NO: 886110 - protein, 96 aa, Homo sapiens
GSPSFASSDRVEWLHYKQIPRAVYPSGNICRHLLPRVQCPALIVHGEKDPLVPRFHADFIHKHVKGSRLHLMPEGKHNLHLRFADEFNKLAEDFLQ

SEQ ID NO: 886111 - protein, 414 aa, Homo sapiens
ADAARALWLAASPPGKAMVAEATSEGGGSADGDTHPGSQSQHREGTVYAGAGGSRTAKPRAEFRSPMGKHPAGRGFGAGRAEGGAGWRGEVGGAEGVASGQSGPGTALGLSACALPAATRPVTMVAVLGGRGVLRLRLLLSALKPGIHVPRAGPAAAFGTSVTSAKVAVNGVQLHYQQTGEGDHAVLLLPGMLGSGETDFGPQLKNLNKKLFTVVAWDPRGYGHSRPPDRDFPADFFERDAKDAVDLMKALKFKKVSLLGWSDGGITALIAAAKYPSYIHKMVIWGANAYVTDEDSMIYEGIRDVSKWSERTRKPLEALYGYDYFARTCEKWVDGIRQFKHLPDGNICRHLLPRVQCPALIVHGEKDPLVPRFHADFIHKHVKGSRLHLMPEGKHNLHLRFADEFNKLAEDFLQ

SEQ ID NO: 886112 - protein, 273 aa, Homo sapiens
HIDSRILVAALEPAAAFGTSVTSAKVAVNGVQLHYQQTGEGDHAVLLLPGMLGSGETDFGPQLKNLNKKLFTVVAWDPRGYGHSRPPDRDFPADFFERDAKDAVDLMKALKFKKVSLLGWSDGGITALIAAAKYPSYIHKMVIWGANAYVTDEDSMIYEGIRDVSKWSERTRKPLEALYGYDYFARTCEKWVDGIRQFKHLPDGNICRHLLPRVQCPALIVHGEKDPLVPRFHADFIHKHVKGSRLHLMPEGKHNLHLRFADEFNKLAEDFLQ

SEQ ID NO: 886113 - protein, 223 aa, Homo sapiens
RPRVRPVGRGSRASALREAAAGATRPGRPAQPPWSQPDRDFPADFFERDAKDAVDLMKALKFKKVSLLGWSDGGITALIAAAKYPSYIHKMVIWGANAYVTDEDSMIYEGIRDVSKWSERTRKPLEALYGYDYFARTCEKWVDGIRQFKHLPDGNICRHLLPRVQCPALIVHGEKDPLVPRFHADFIHKHVKGSRLHLMPEGKHNLHLRFADEFNKLAEDFLQ

SEQ ID NO: 886114 - protein, 206 aa, Homo sapiens
MLWSFLVSPERFSHASYFPPDRDFPADFFERDAKDAVDLMKALKFKKVSLLGWSDGGITALIAAAKYPSYIHKMVIWGANAYVTDEDSMIYEGIRDVSKWSERTRKPLEALYGYDYFARTCEKWVDGIRQFKHLPDGNICRHLLPRVQCPALIVHGEKDPLVPRFHADFIHKHVKGSRLHLMPEGKHNLHLRFADEFNKLAEDFLQ

SEQ ID NO: 886115 - protein, 256 aa, Homo sapiens
MPRNLLYSLLSSHLSPHFGTSVTSAKVAVNGVQLHYQQTGEGDHAVLLLPGMLGSGETDFGPQLKNLNKKLFTVVAWDPRGYGHSRPPDRDFPADFFERDAKDAVDLMKALKFKKVSLLGWSDGGITALIAAVTDEDSMIYEGIRDVSKWSERTRKPLEALYGYDYFARTCEKWVDGIRQFKHLPDGNICRHLLPRVQCPALIVHGEKDPLVPRFHADFIHKHVKGSRLHLMPEGKHNLHLRFADEFNKLAEDFLQ

SEQ ID NO: 886116 - protein, 133 aa, Homo sapiens [sequence omitted]

SEQ ID NO: 886117 - protein, 592 aa, Homo sapiens
MAPGQLALFSVSDKTGLVEFARNLTALGLNLVASGGTAKALRDAGLAVRDVSELTGFPEMLGGRVKTLHPAVHAGILARNIPEDNADMARLDFNLIRVVACNLYPFVKTVASPGVTVEEAVEQIDIGGVTLLRAAAKNHARVTVVCEPEDYVVVSTEMQSSESKDTSLETRRQLALKAFTHTAQYDEAISDYFRKQYSKGVSQMPLRYGMNPHQTPAQLYTLQPKLPITVLNGAPGFINLCDALNAWQLVKELKEALGIPAAASFKHVSPAGAAVGIPLSEDEAKVCMVYDLYKTLTPISAAYARARGADRMSSFGDFVALSDVCDVPTAKIISREVSDGIIAPGYEEEALTILSKKKNGNYCVLQMDQSYKPDENEVRTLFGLHLSQKRNNGVVDKSLFSNVVTKNKDLPESALRDLIVATIAVKYTQSNSVCYAKNGQVIGIGAGQQSRIHCTRLAGDKANYWWLRHHPQVLSMKFKTGVKRAEISNAIDQYVTGTIGEDEDLIKWKALFEEVPELLTEAEKKEWVEKLTEVSISSDAFFPFRDNVDRAKRSGVAYIAAPSGSAADKVVIEACDELGIILAHTNLRLFHH

SEQ ID NO: 886118 - protein, 102 aa, Homo sapiens
MPIIPALWEAEDEDLIKWKALFEEVPELLTEAEKKEWVEKLTEVSISSDAFFPFRDNVDRAKRSGVAYIAAPSGSAADKVVIEACDELGIILAHTNLRLFHH

SEQ ID NO: 886119 - protein, 174 aa, Homo sapiens
RALGYQEDALNIPFHYNERNVYYMGPSDCPISTDQMILKYRRLLLCVFILRPEPVNNEVSLALDTPLWADVVTKNKDLPESALRDLIVATIAVKYTQSNSVCYAKNGQVIGIGAGQQSRIHCTRLAGDKANYWWLRHHPQVLSMKFKTGVKRAEISNAIDQYVTGTIGEEQEST

SEQ ID NO: 886120 - protein, 75 aa, Homo sapiens
DRNFSQFLSELKKLQSVSISSDAFFPFRDNVDRAKRSGVAYIAAPSGSAADKVVIEACDELGIILAHTNLRLFHH

SEQ ID NO: 886121 - protein, 592 aa, Homo sapiens; identical to SEQ ID NO: 886117

SEQ ID NO: 886122 - protein, 637 aa, Homo sapiens
GRGGEKTIGAKVEGWFEIRQRAPSYLRTWCRRCCLPLALNPVPAAMAPGQLALFSVSDKTGLVEFARNLTALGLNLVASGGTAKALRDAGLAVRDVSELTGFPEMLGGRVKTLHPAVHAGILARNIPEDNADMARLDFNLIRVVACNLYPFVKTVASPGVTVEEAVEQIDIGGVTLLRAAAKNHARVTVVCEPEDYVVVSTEMQSSESKDTSLETRRQLALKAFTHTAQYDEAISDYFRKQYSKGVSQMPLRYGMNPHQTPAQLYTLQPKLPITVLNGAPGFINLCDALNAWQLVKELKEALGIPAAASFKHVSPAGAAVGIPLSEDEAKVCMVYDLYKTLTPISAAYARARGADRMSSFGDFVALSDVCDVPTAKIISREVSDGIIAPGYEEEALTILSKKKNGNYCVLQMDQSYKPDENEVRTLFGLHLSQKRNNGVVDKSLFSNVVTKNKDLPESALRDLIVATIAVKYTQSNSVCYAKNGQVIGIGAGQQSRIHCTRLAGDKANYWWLRHHPQVLSMKFKTGVKRAEISNAIDQYVTGTIGEDEDLIKWKALFEEVPELLTEAEKKEWVEKLTEVSISSDAFFPFRDNVDRAKRSGVAYIAAPSGSAADKVVIEACDELGIILAHTNLRLFHH

SEQ ID NO: 886123 - protein, 592 aa, Homo sapiens; identical to SEQ ID NO: 886117

SEQ ID NO: 886124 - protein, 592 aa, Homo sapiens; identical to SEQ ID NO: 886117

SEQ ID NO: 886125 - protein, 512 aa, Homo sapiens
MAPGQLALFSVSDKTGLVEFARNLTALGLNLVASGGTAKALRDAGLAVRDVSELTGFPEMLGGRVKTLHPAVHAGILARNIPEDNADMARLDFNLIRVVACNLYPFVKTVASPGVTVEEAVEQIDIGGVTLLRAAAKNHARVTVVCEPEDYVVVSTEMQSSESKDTSLETRRQLALKAFTHTAQYDEAISDYFRKQYSKGVSQMPLRYGMNPHQTPAQLYTLQPKLPITVLNGAPGFINLCDALNAWQLVKELKEALGIPAAASFKHVSPAGAAVGIPLSEDEAKVCMVYDLYKTLTPISAAYARARGADRMSSFGDFVALSDVCDVPTAKIISREVSDGIIAPGYEEEALTILSKKKNGNYCVLQMDQSYKPDENEVRTLFGLHLSQKRNNGVVDKSLFSNVVTKNKDLPESALRDLIVATIAVKYTQSNSVCYAKNGQVIGIGAGQQSRIHCTRLAGDKANYWWLRHHPQVLSMKFKTGVKRAEISNAIDQYVTGTIGEVKDLALGSRLC

SEQ ID NO: 886126 - protein, 591 aa, Homo sapiens
MSSLSALFSVSDKTGLVEFARNLTALGLNLVASGGTAKALRDAGLAVRDVSELTGFPEMLGGRVKTLHPAVHAGILARNIPEDNADMARLDFNLIRVVACNLYPFVKTVASPGVTVEEAVEQIDIGGVTLLRAAAKNHARVTVVCEPEDYVVVSTEMQSSESKDTSLETRRQLALKAFTHTAQYDEAISDYFRKQYSKGVSQMPLRYGMNPHQTPAQLYTLQPKLPITVLNGAPGFINLCDALNAWQLVKELKEALGIPAAASFKHVSPAGAAVGIPLSEDEAKVCMVYDLYKTLTPISAAYARARGADRMSSFGDFVALSDVCDVPTAKIISREVSDGIIAPGYEEEALTILSKKKNGNYCVLQMDQSYKPDENEVRTLFGLHLSQKRNNGVVDKSLFSNVVTKNKDLPESALRDLIVATIAVKYTQSNSVCYAKNGQVIGIGAGQQSRIHCTRLAGDKANYWWLRHHPQVLSMKFKTGVKRAEISNAIDQYVTGTIGEDEDLIKWKALFEEVPELLTEAEKKEWVEKLTEVSISSDAFFPFRDNVDRAKRSGVAYIAAPSGSAADKVVIEACDELGIILAHTNLRLFHH

SEQ ID NO: 886127 - protein, 533 aa, Homo sapiens
MLGGRVKTLHPAVHAGILARNIPEDNADMARLDFNLIRVVACNLYPFVKTVASPGVTVEEAVEQIDIGGVTLLRAAAKNHARVTVVCEPEDYVVVSTEMQSSESKDTSLETRRQLALKAFTHTAQYDEAISDYFRKQYSKGVSQMPLRYGMNPHQTPAQLYTLQPKLPITVLNGAPGFINLCDALNAWQLVKELKEALGIPAAASFKHVSPAGAAVGIPLSEDEAKVCMVYDLYKTLTPISAAYARARGADRMSSFGDFVALSDVCDVPTAKIISREVSDGIIAPGYEEEALTILSKKKNGNYCVLQMDQSYKPDENEVRTLFGLHLSQKRNNGVVDKSLFSNVVTKNKDLPESALRDLIVATIAVKYTQSNSVCYAKNGQVIGIGAGQQSRIHCTRLAGDKANYWWLRHHPQVLSMKFKTGVKRAEISNAIDQYVTGTIGEDEDLIKWKALFEEVPELLTEAEKKEWVEKLTEVSISSDAFFPFRDNVDRAKRSGVAYIAAPSGSAADKVVIEACDELGIILAHTNLRLFHH

SEQ ID NO: 886128 - protein, 606 aa, Homo sapiens
LLTSTRLGLQCLQPWLPALLALFSVSDKTGLVEFARNLTALGLNLVASGGTAKALRDAGLAVRDVSELTGFPEMLGGRVKTLHPAVHAGILARNIPEDNADMARLDFNLIRVVACNLYPFVKTVASPGVTVEEAVEQIDIGGVTLLRAAAKNHARVTVVCEPEDYVVVSTEMQSSESKDTSLETRRQLALKAFTHTAQYDEAISDYFRKQYSKGVSQMPLRYGMNPHQTPAQLYTLQPKLPITVLNGAPGFINLCDALNAWQLVKELKEALGIPAAASFKHVSPAGAAVGIPLSEDEAKVCMVYDLYKTLTPISAAYARARGADRMSSFGDFVALSDVCDVPTAKIISREVSDGIIAPGYEEEALTILSKKKNGNYCVLQMDQSYKPDENEVRTLFGLHLSQKRNNGVVDKSLFSNVVTKNKDLPESALRDLIVATIAVKYTQSNSVCYAKNGQVIGIGAGQQSRIHCTRLAGDKANYWWLRHHPQVLSMKFKTGVKRAEISNAIDQYVTGTIGEDEDLIKWKALFEEVPELLTEAEKKEWVEKLTEVSISSDAFFPFRDNVDRAKRSGVAYIAAPSGSAADKVVIEACDELGIILAHTNLRLFHH

SEQ ID NO: 886129 - protein, 615 aa, Homo sapiens
MAPGQLALFSVSDKTGLVEFARNLTALGLNLVASGGTAKALRDAGLAVRDVSELTGFPEMLGGRVKTLHPAVHAGILARNIPEDNADMARLDFNLIRVVACNLYPFVKTVASPGVTVEEAVEQIDIGGVTLLRAAAKNHARVTVVCEPEDYVVVSTEMQSSESKDTSLETRRQLALKAFTHTAQYDEAISDYFRKQYSKGVSQMPLRYGMNPHQTPAQLYTLQPKLPITVLNGAPGFINLCDALNAWQLVKELKEALGIPAAASFKHVSPAGAAVGIPLSEDEAKVCMVYDLYKTLTPISAAYARARGADRMSSFGDFVALSDVCDVPTAKIISREVSDGIIAPGYEEEALTILSKKKNGNYCVLQMDQSYKPDENEVRTLFGLHLSQKRNNGVVDKSLFSNVVTKNKDLPESALRDLIVATIAVKYTQSNSVCYAKNGQVIGIGAGQQSRIHCTRLAGDKANYWWLRHHPQVLSMKFKTGVKRAEISNAIDQYVTGTIGEDEDLIKWKALFEEVPELLTEAEKKEWVEKLTEVSISSDAFFPFRDNVDRAKRIGVAYIAAPPFFLLTSFFFGPFPLCAFLPYSLFPSFSSPLFFSPLFFFWWSFLFCASVNSHA

SEQ ID NO: 886130 - protein, 531 aa, Homo sapiens
MAPGQLALFSVSDKTGLVEFARNLTALGLNLVASGGTAKALRDAGLAVRDVSELTGFPEMLGGRVKTLHPAVHAGILARNIPEDNADMARLDFNLIRVVACNLYPFVKTVASPGVTVEEAVEQIDIGGVTLLRAAAKNHARVTVVCEPEDYVVVSTEMQSSESKDTSLETRRQLALKAFTHTAQYDEAISDYFRKQYSKGVSQMPLRYGMNPHQTPAQLYTLQPKLPITVLNGAPGFINLCDALNAWQLVKELKEALGIPAAASFKHVSPAGAAVGIPLSEDEAKVCMVYDLYKTLTPISAAYARARGADRMSSFGDFVALSDVCDVPTAKIISREVSDGIIAPGYEEEALTILSKKKNGNYCVLQMDQSYKPDENEVRTLFGLHLSQKRNNGVVDKSLFSNVVTKNKDLPESALRDLIVATIAVKYTQSNSVCYAKNGQDEDLIKWKALFEEVPELLTEAEKKEWVEKLTEVSISSDAFFPFRDNVDRAKRSGVAYIAAPSGSAADKVVIEACDELGIILAHTNLRLFHH

SEQ ID NO: 886131 - protein, 473 aa, Homo sapiens
KTKDLFGEVKPVGKPLAALTARVTVVCEPEDYVVVSTEMQSSESKDTSLETRRQLALKAFTHTAQYDEAISDYFRKQYSKGVSQMPLRYGMNPHQTPAQLYTLQPKLPITVLNGAPGFINLCDALNAWQLVKELKEALGIPAAASFKHVSPAGAAVGIPLSEDEAKVCMVYDLYKTLTPISAAYARARGADRMSSFGDFVALSDVCDVPTAKIISREVSDGIIAPGYEEEALTILSKKKNGNYCVLQMDQSYKPDENEVRTLFGLHLSQKRNNGVVDKSLFSNVVTKNKDLPESALRDLIVATIAVKYTQSNSVCYAKNGQVIGIGAGQQSRIHCTRLAGDKANYWWLRHHPQVLSMKFKTGVKRAEISNAIDQYVTGTIGEDEDLIKWKALFEEVPELLTEAEKKEWVEKLTEVSISSDAFFPFRDNVDRAKRSGVAYIAAPSGSAADKVVIEACDELGIILAHTNLRLFHH

SEQ ID NO: 886132 - protein, 325 aa, Homo sapiens
AAAYYYYYCSEFKLLTMYGDMVYDLYKTLTPISAAYARARGADRMSSFGDFVALSDVCDVPTAKIISREVSDGIIAPGYEEEALTILSKKKNGNYCVLQMDQSYKPDENEVRTLFGLHLSQKRNNGVVDKSLFSNVVTKNKDLPESALRDLIVATIAVKYTQSNSVCYAKNGQVIGIGAGQQSRIHCTRLAGDKANYWWLRHHPQVLSMKFKTGVKRAEISNAIDQYVTGTIGEDEDLIKWKALFEEVPELLTEAEKKEWVEKLTEVSISSDAFFPFRDNVDRAKRSGVAYIAAPSGSAADKVVIEACDELGIILAHTNLRLFHH

SEQ ID NO: 886133 - protein, 173 aa, Homo sapiens
MVDNCPDTFQLCRYMNYSFCLVFSMGASGTFTYFPASGDRLPRITGICPRGRGVASLWGRGQIAGSHAWTSGSQAGSLPAQALRPGAPGRAPPHPAVPFSPGARILHLKLSRAGRRAGPAGHVISPETAPPPRFLSRHIPAALLPAHVVPPLLPPARPEPSACSHGSRPARLI

SEQ ID NO: 886134 - protein, 592 aa, Homo sapiens; identical to SEQ ID NO: 886117

SEQ ID NO: 886135 - protein, 461 aa, Homo sapiens
MAPGQLALFSVSDKTGLVEFARNLTALGLNLVASGGTAKALRDAGLAVRDVSELTGFPEMLGGRVKTLHPAVHAGILARNIPEDNADMARLDFNLIRVVACNLYPFVKTVASPGVTVEEAVEQIDIGGVTLLRAAAKNHARVTVVCEPEDYVVVSTEMQSSESKDTSLETRRQLALKAFTHTAQYDEAISDYFRKQYSKGVSQMPLRYGMNPHQTPAQLYTLQPKLPITVLNGAPGFINLCDALNAWQLVKELKEALGIPAAASFKHVSPAGAAVGIPLSEDEAKVCMVYDLYKTLTPISAAYARARGADRMSSFGDFVALSDVCDVPTAKIISREVSDGIIAPGYEEEALTILSKKKNGNYCVLQMDQSYKPDENEVRTLFGLHLSQKRNNGVVDKSLFSNVVTKNKDLSSTLSLTLCATPRTGRLSALEQDSSLVYTALALQEIRQTIGGLDTIHKCFR

SEQ ID NO: 886136 - protein, 568 aa, Homo sapiens
MAPGQLALFSVSDKTGLVEFARNLTALGLNLVASGGTAKALRDAGLAVRDVSELTGFPEMLGGRVKTLHPAVHAGILARNIPEDNADMARLDFNLIRVVACNLYPFVKTVASPGVTVEEAVEQIDIGGVTLLRAAAKNHARVTVVCEPEDYVVVSTEMQSSESKDTSLETRRQLALKAFTHTAQYDEAISDYFRKQYSKGVSQMPLRYGMNPHQTPAQLYTLQPKLPITVLNGAPGFINLCDALNAWQLVKELKEALGIPAAASFKHVSPAGAAVGIPLSEDEAKVCMVYDLYKTLTPISAAYARARGADRMSSFGDFVALSDVCDVPTAKIISREVSDGIIAPGYEEEALTILSKKKNGNYCVLQMDQSYKPDENEVRTLFGLHLSQKRNNGVVDKSLFSNVVTKNKDLPESALRDLIVATIAVKYTQSNSVCYAKNGQVIGIGAGQQSRIHCTRLAGDKANYWWLRHHPQVLSMKFKTGVKRAEISNAIDQYVTGTIGEDEDLIKWKALFEEVPELLTEAEKKEWVEKLTEVSISSDAFFPFRDNVDRAKRGKYGIGCICLELSIM

SEQ ID NO: 886137 - protein, 533 aa, Homo sapiens; identical to SEQ ID NO: 886127

SEQ ID NO: 886138 - protein, 567 aa, Homo sapiens
MAPGQLALFSVSDKTGLVEFARNLTALGLNLVASGGTAKALRDAGLAVRDVSELTGFPEMLGGRVKTLHPAVHAGILARNIPEDNADMARLDFNLIRVVACNLYPFVKTVASPGVTVEEAVEQIDIGGVTLLRAAAKNHARVTVVCEPEDYVVVSTEMQSSESKDTSLETRRQLALKAFTHTAQYDEAISDYFRKQYSKGVSQMPLRYGMNPHQTPAQLYTLQPKLPITVLNGAPGFINLCDALNAWQLVKELKEALGIPAAASFKHVSPAGAAVGIPLSEDEAKVCMVYDLYKTLTPISAAYARARGADRMSSFGDFVALSDVCDVPTAKIISREVSDGIIAPGYEEEALTILSKKKNGNYCVLQMDQSYKPDENEVRTLFGLHLSQKRNNGVVDKSLFSNVVTKNKDLPESALRDLIVATIAVKYTQSNSVCYAKNGQVIGIGAGQQSRIHCTRLAGDKANYWWLRHHPQVLSMKFKTGVKRAEISNAIDQYVTGTIGEDEDLIKWKALFEEVPELLTEAEKKEWVEKLTEVSISSDAFFPFRDNVDRAKRGRGGGDIAGSSGLL

SEQ ID NO: 886139 - protein, 435 aa, Homo sapiens
MQSSESKDTSLETRRQLALKAFTHTAQYDEAISDYFRKQYSKGVSQMPLRYGMNPHQTPAQLYTLQPKLPITVLNGAPGFINLCDALNAWQLVKELKEALGIPAAASFKHVSPAGAAVGIPLSEDEAKVCMVYDLYKTLTPISAAYARARGADRMSSFGDFVALSDVCDVPTAKIISREVSDGIIAPGYEEEALTILSKKKNGNYCVLQMDQSYKPDENEVRTLFGLHLSQKRNNGVVDKSLFSNVVTKNKDLPESALRDLIVATIAVKYTQSNSVCYAKNGQVIGIGAGQQSRIHCTRLAGDKANYWWLRHHPQVLSMKFKTGVKRAEISNAIDQYVTGTIGEDEDLIKWKALFEEVPELLTEAEKKEWVEKLTEVSISSDAFFPFRDNVDRAKRSGVAYIAAPSGSAADKVVIEACDELGIILAHTNLRLFHH
